United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 119

SEQ ID NO: 4223242 - RNA, 22 nt, Yersinia pestis KIM
uuccaucaaaggagaacaaugg

SEQ ID NO: 4223243 - RNA, 18 nt, Yersinia pestis KIM
uuccaucacugcauuauc

SEQ ID NO: 4223244 - RNA, 15 nt, Yersinia pestis KIM
uuccaucgucaauuc

SEQ ID NO: 4223245 - RNA, 19 nt, Yersinia pestis KIM
uuccaugacacauauuuca

SEQ ID NO: 4223246 - RNA, 17 nt, Yersinia pestis KIM
uuccaugcaaaauaugg

SEQ ID NO: 4223247 - RNA, 21 nt, Yersinia pestis KIM
uuccauuggagauccguuuuu

SEQ ID NO: 4223248 - RNA, 18 nt, Yersinia pestis KIM
uuccauuuaagccaauaa

SEQ ID NO: 4223249 - RNA, 19 nt, Yersinia pestis KIM
uucccaccauaaugugccu

SEQ ID NO: 4223250 - RNA, 18 nt, Yersinia pestis KIM
uucccagucauaaauauc

SEQ ID NO: 4223251 - RNA, 24 nt, Yersinia pestis KIM
uucccauagcuggcuucaaaauca

SEQ ID NO: 4223252 - RNA, 17 nt, Yersinia pestis KIM
uuccccuaauucuccuu

SEQ ID NO: 4223253 - RNA, 11 nt, Yersinia pestis KIM
uuccccuucaa

SEQ ID NO: 4223254 - RNA, 18 nt, Yersinia pestis KIM
uucccgacagaacugauu

SEQ ID NO: 4223255 - RNA, 14 nt, Yersinia pestis KIM
uucccgcaggcggc

SEQ ID NO: 4223256 - RNA, 23 nt, Yersinia pestis KIM
uucccgccaaccaggucaguuuu

SEQ ID NO: 4223257 - RNA, 14 nt, Yersinia pestis KIM
uucccgcucuucac

SEQ ID NO: 4223258 - RNA, 13 nt, Yersinia pestis KIM
uucccgugucaau

SEQ ID NO: 4223259 - RNA, 16 nt, Yersinia pestis KIM
uucccuaccguaucaa

SEQ ID NO: 4223260 - RNA, 18 nt, Yersinia pestis KIM
uucccuaccguaucaacg

SEQ ID NO: 4223261 - RNA, 20 nt, Yersinia pestis KIM
uucccucaauagcuaauaau

SEQ ID NO: 4223262 - RNA, 14 nt, Yersinia pestis KIM
uucccucugccuga

SEQ ID NO: 4223263 - RNA, 22 nt, Yersinia pestis KIM
uucccuguauaaaaauagccuu

SEQ ID NO: 4223264 - RNA, 17 nt, Yersinia pestis KIM
uucccuguucucuguuu

SEQ ID NO: 4223265 - RNA, 18 nt, Yersinia pestis KIM
uuccgcgccguguaguuu

SEQ ID NO: 4223266 - RNA, 17 nt, Yersinia pestis KIM
uuccggacggagaaucg

SEQ ID NO: 4223267 - RNA, 17 nt, Yersinia pestis KIM
uuccgucccaagaaaag

SEQ ID NO: 4223268 - RNA, 21 nt, Yersinia pestis KIM
uuccgucccaagaaaagcacc

SEQ ID NO: 4223269 - RNA, 14 nt, Yersinia pestis KIM
uuccucaucgaaau

SEQ ID NO: 4223270 - RNA, 16 nt, Yersinia pestis KIM
uuccucccagaauaau

SEQ ID NO: 4223271 - RNA, 21 nt, Yersinia pestis KIM
uuccucgugaaaaauaauguu

SEQ ID NO: 4223272 - RNA, 13 nt, Yersinia pestis KIM
uuccucugugacu

SEQ ID NO: 4223273 - RNA, 19 nt, Yersinia pestis KIM
uuccugauuagcagggcag

SEQ ID NO: 4223274 - RNA, 18 nt, Yersinia pestis KIM
uucuuacuaaaauaucac

SEQ ID NO: 4223275 - RNA, 15 nt, Yersinia pestis KIM
uucuuagccagugac

SEQ ID NO: 4223276 - RNA, 18 nt, Yersinia pestis KIM
uucuuagccagugacucc

SEQ ID NO: 4223277 - RNA, 18 nt, Yersinia pestis KIM
uucuuaggauaaccaauu

SEQ ID NO: 4223278 - RNA, 14 nt, Yersinia pestis KIM
uucuuagugcuaca

SEQ ID NO: 4223279 - RNA, 14 nt, Yersinia pestis KIM
uucuuauuaaucaa

SEQ ID NO: 4223280 - RNA, 21 nt, Yersinia pestis KIM
uucuucacugagcagguuaaa

SEQ ID NO: 4223281 - RNA, 21 nt, Yersinia pestis KIM
uucuucagccgcucaucaucc

SEQ ID NO: 4223282 - RNA, 22 nt, Yersinia pestis KIM
uucuucagcgguagagaucucu

SEQ ID NO: 4223283 - RNA, 13 nt, Yersinia pestis KIM
uucuucaucuaaa

SEQ ID NO: 4223284 - RNA, 15 nt, Yersinia pestis KIM
uucuucaucuaaaua

SEQ ID NO: 4223285 - RNA, 15 nt, Yersinia pestis KIM
uucuucauugcugcu

SEQ ID NO: 4223286 - RNA, 10 nt, Yersinia pestis KIM
uucuuccaac

SEQ ID NO: 4223287 - RNA, 11 nt, Yersinia pestis KIM
uucuuccaacg

SEQ ID NO: 4223288 - RNA, 21 nt, Yersinia pestis KIM
uucuucgcaaugauuacauca

SEQ ID NO: 4223289 - RNA, 22 nt, Yersinia pestis KIM
uucuugauggucaauaaugucc

SEQ ID NO: 4223290 - RNA, 23 nt, Yersinia pestis KIM
uucuuguaaaucuugagcuauuu

SEQ ID NO: 4223291 - RNA, 15 nt, Yersinia pestis KIM
uucuuguuuaguaau

SEQ ID NO: 4223292 - RNA, 18 nt, Yersinia pestis KIM
uucuuuaaucacucucau

SEQ ID NO: 4223293 - RNA, 19 nt, Yersinia pestis KIM
uucuuuaaucacucucaug

SEQ ID NO: 4223294 - RNA, 13 nt, Yersinia pestis KIM
uucuuucacuaau

SEQ ID NO: 4223295 - RNA, 16 nt, Yersinia pestis KIM
uucuuucacucggaaa

SEQ ID NO: 4223296 - RNA, 13 nt, Yersinia pestis KIM
uucuuucucgaua

SEQ ID NO: 4223297 - RNA, 17 nt, Yersinia pestis KIM
uucuuuugcuguauuuu

SEQ ID NO: 4223298 - RNA, 21 nt, Yersinia pestis KIM
uugaaaccuacaucacaccca

SEQ ID NO: 4223299 - RNA, 12 nt, Yersinia pestis KIM
uugaaauaccac

SEQ ID NO: 4223300 - RNA, 20 nt, Yersinia pestis KIM
uugaaauguccacuguacag

SEQ ID NO: 4223301 - RNA, 22 nt, Yersinia pestis KIM
uugaacaaaccccacuaacgcu

SEQ ID NO: 4223302 - RNA, 20 nt, Yersinia pestis KIM
uugaacaacgcuaugcagcc

SEQ ID NO: 4223303 - RNA, 12 nt, Yersinia pestis KIM
uugaacaguggu

SEQ ID NO: 4223304 - RNA, 17 nt, Yersinia pestis KIM
uugaacauucaucuuuu

SEQ ID NO: 4223305 - RNA, 22 nt, Yersinia pestis KIM
uugaaccgcuaucugcugacca

SEQ ID NO: 4223306 - RNA, 19 nt, Yersinia pestis KIM
uugaacgauauuuuuauua

SEQ ID NO: 4223307 - RNA, 13 nt, Yersinia pestis KIM
uugaacggugagg

SEQ ID NO: 4223308 - RNA, 20 nt, Yersinia pestis KIM
uugaacggugaggauaggca

SEQ ID NO: 4223309 - RNA, 15 nt, Yersinia pestis KIM
uugaacgugccccaa

SEQ ID NO: 4223310 - RNA, 21 nt, Yersinia pestis KIM
uugaacugagccagguuuuuu

SEQ ID NO: 4223311 - RNA, 22 nt, Yersinia pestis KIM
uugaacuguggcaugacugaug

SEQ ID NO: 4223312 - RNA, 16 nt, Yersinia pestis KIM
uugaacuucgaaagaa

SEQ ID NO: 4223313 - RNA, 23 nt, Yersinia pestis KIM
uugaacuucgaaagaaauaaaag

SEQ ID NO: 4223314 - RNA, 21 nt, Yersinia pestis KIM
uugaaguucucaucaaacuca

SEQ ID NO: 4223315 - RNA, 14 nt, Yersinia pestis KIM
uugaauaacuucuc

SEQ ID NO: 4223316 - RNA, 12 nt, Yersinia pestis KIM
uugaauaauccg

SEQ ID NO: 4223317 - RNA, 16 nt, Yersinia pestis KIM
uugaauauuuuuaauc

SEQ ID NO: 4223318 - RNA, 17 nt, Yersinia pestis KIM
uugaauauuuuuaaucu

SEQ ID NO: 4223319 - RNA, 23 nt, Yersinia pestis KIM
uugaauauuuuuaaucugcccag

SEQ ID NO: 4223320 - RNA, 14 nt, Yersinia pestis KIM
uugaauuaaauuuu

SEQ ID NO: 4223321 - RNA, 22 nt, Yersinia pestis KIM
uugaauucaccaaauugcagaa

SEQ ID NO: 4223322 - RNA, 22 nt, Yersinia pestis KIM
uugaauugagagagcuuacauu

SEQ ID NO: 4223323 - RNA, 17 nt, Yersinia pestis KIM
uugacacgagagauaau

SEQ ID NO: 4223324 - RNA, 12 nt, Yersinia pestis KIM
uugacagcaucu

SEQ ID NO: 4223325 - RNA, 16 nt, Yersinia pestis KIM
uugacauaaacacgca

SEQ ID NO: 4223326 - RNA, 14 nt, Yersinia pestis KIM
uugacauuuccuug

SEQ ID NO: 4223327 - RNA, 14 nt, Yersinia pestis KIM
uugaccaacugucg

SEQ ID NO: 4223328 - RNA, 23 nt, Yersinia pestis KIM
uugaccagauuaaucaccucacc

SEQ ID NO: 4223329 - RNA, 14 nt, Yersinia pestis KIM
uugacccucuuaau

SEQ ID NO: 4223330 - RNA, 19 nt, Yersinia pestis KIM
uugaccguguuuucacaca

SEQ ID NO: 4223331 - RNA, 16 nt, Yersinia pestis KIM
uugaccuuagauaaau

SEQ ID NO: 4223332 - RNA, 12 nt, Yersinia pestis KIM
uugacguucagg

SEQ ID NO: 4223333 - RNA, 14 nt, Yersinia pestis KIM
uugacuuaacaguu

SEQ ID NO: 4223334 - RNA, 17 nt, Yersinia pestis KIM
uugacuuaacaguuaaa

SEQ ID NO: 4223335 - RNA, 20 nt, Yersinia pestis KIM
uugacuucggucaagaugcc

SEQ ID NO: 4223336 - RNA, 14 nt, Yersinia pestis KIM
uugacuuucuaagc

SEQ ID NO: 4223337 - RNA, 18 nt, Yersinia pestis KIM
uugacuuucuaagcugcc

SEQ ID NO: 4223338 - RNA, 13 nt, Yersinia pestis KIM
uugagaaacugau

SEQ ID NO: 4223339 - RNA, 20 nt, Yersinia pestis KIM
uugagaaguuauucauugcc

SEQ ID NO: 4223340 - RNA, 20 nt, Yersinia pestis KIM
uugagaauuaaggaaacuca

SEQ ID NO: 4223341 - RNA, 18 nt, Yersinia pestis KIM
uugagacccccaaugagu

SEQ ID NO: 4223342 - RNA, 17 nt, Yersinia pestis KIM
uugagauuaauccaugu

SEQ ID NO: 4223343 - RNA, 17 nt, Yersinia pestis KIM
uugagauuuucccagug

SEQ ID NO: 4223344 - RNA, 20 nt, Yersinia pestis KIM
uugagccaauuaagaaaucu

SEQ ID NO: 4223345 - RNA, 22 nt, Yersinia pestis KIM
uugagccaccgagguuaucagc

SEQ ID NO: 4223346 - RNA, 14 nt, Yersinia pestis KIM
uugaggaaauuuca

SEQ ID NO: 4223347 - RNA, 16 nt, Yersinia pestis KIM
uugaggagcgauaaca

SEQ ID NO: 4223348 - RNA, 19 nt, Yersinia pestis KIM
uugaggagcgauaacauuu

SEQ ID NO: 4223349 - RNA, 19 nt, Yersinia pestis KIM
uugaggauauuagggcuga

SEQ ID NO: 4223350 - RNA, 16 nt, Yersinia pestis KIM
uugagguuauugacaa

SEQ ID NO: 4223351 - RNA, 19 nt, Yersinia pestis KIM
uugaguaagacaacuuauu

SEQ ID NO: 4223352 - RNA, 17 nt, Yersinia pestis KIM
uugaguaaguucgucag

SEQ ID NO: 4223353 - RNA, 23 nt, Yersinia pestis KIM
uugaguagcaggccgacaauacc

SEQ ID NO: 4223354 - RNA, 13 nt, Yersinia pestis KIM
uugagucucuggc

SEQ ID NO: 4223355 - RNA, 18 nt, Yersinia pestis KIM
uugagugaaagccugcac

SEQ ID NO: 4223356 - RNA, 19 nt, Yersinia pestis KIM
uugagugccgugucuucca

SEQ ID NO: 4223357 - RNA, 18 nt, Yersinia pestis KIM
uugauaaaaaucuuuuaa

SEQ ID NO: 4223358 - RNA, 23 nt, Yersinia pestis KIM
uugauaacgccggauaaauuaau

SEQ ID NO: 4223359 - RNA, 13 nt, Yersinia pestis KIM
uugauaauggcau

SEQ ID NO: 4223360 - RNA, 15 nt, Yersinia pestis KIM
uugauauauagaaau

SEQ ID NO: 4223361 - RNA, 19 nt, Yersinia pestis KIM
uugauaucaauauccgcau

SEQ ID NO: 4223362 - RNA, 19 nt, Yersinia pestis KIM
uugaucaucaaacuauuca

SEQ ID NO: 4223363 - RNA, 22 nt, Yersinia pestis KIM
uugauccaaauggcugcguucu

SEQ ID NO: 4223364 - RNA, 23 nt, Yersinia pestis KIM
uugauccaaauggcugcguucuu

SEQ ID NO: 4223365 - RNA, 22 nt, Yersinia pestis KIM
uugauccgauaaacuucacaau

SEQ ID NO: 4223366 - RNA, 21 nt, Yersinia pestis KIM
uugaucggauagcuuagccca

SEQ ID NO: 4223367 - RNA, 14 nt, Yersinia pestis KIM
uugaugaguaaaca

SEQ ID NO: 4223368 - RNA, 16 nt, Yersinia pestis KIM
uugaugauuugaccga

SEQ ID NO: 4223369 - RNA, 20 nt, Yersinia pestis KIM
uugaugcucuucuucacuga

SEQ ID NO: 4223370 - RNA, 18 nt, Yersinia pestis KIM
uugauggaguuguugcca

SEQ ID NO: 4223371 - RNA, 20 nt, Yersinia pestis KIM
uugauggccuugaaucaaaa

SEQ ID NO: 4223372 - RNA, 20 nt, Yersinia pestis KIM
uugauggcgcaguaacugug

SEQ ID NO: 4223373 - RNA, 21 nt, Yersinia pestis KIM
uugauggcgcaguaacugugu

SEQ ID NO: 4223374 - RNA, 15 nt, Yersinia pestis KIM
uugauggcuguuuuu

SEQ ID NO: 4223375 - RNA, 22 nt, Yersinia pestis KIM
uugauguaagcugggaaggcgu

SEQ ID NO: 4223376 - RNA, 22 nt, Yersinia pestis KIM
uugauuaacauccauuguauug

SEQ ID NO: 4223377 - RNA, 14 nt, Yersinia pestis KIM
uugauuaaccgauu

SEQ ID NO: 4223378 - RNA, 18 nt, Yersinia pestis KIM
uugauuaccaauaauuaa

SEQ ID NO: 4223379 - RNA, 19 nt, Yersinia pestis KIM
uugauuaccaauaauuaau

SEQ ID NO: 4223380 - RNA, 13 nt, Yersinia pestis KIM
uugauugcaaaac

SEQ ID NO: 4223381 - RNA, 16 nt, Yersinia pestis KIM
uugauugcaaaacaua

SEQ ID NO: 4223382 - RNA, 14 nt, Yersinia pestis KIM
uugauuggcuccua

SEQ ID NO: 4223383 - RNA, 13 nt, Yersinia pestis KIM
uugauuucaaugc

SEQ ID NO: 4223384 - RNA, 16 nt, Yersinia pestis KIM
uugauuugaacgacau

SEQ ID NO: 4223385 - RNA, 16 nt, Yersinia pestis KIM
uugauuuucauuucau

SEQ ID NO: 4223386 - RNA, 16 nt, Yersinia pestis KIM
uugcaaacggauaaug

SEQ ID NO: 4223387 - RNA, 13 nt, Yersinia pestis KIM
uugcaacauuauc

SEQ ID NO: 4223388 - RNA, 19 nt, Yersinia pestis KIM
uugcaacauuauccguuug

SEQ ID NO: 4223389 - RNA, 20 nt, Yersinia pestis KIM
uugguaaaaccgguuuuggu

SEQ ID NO: 4223390 - RNA, 13 nt, Yersinia pestis KIM
uugguaacgcaga

SEQ ID NO: 4223391 - RNA, 18 nt, Yersinia pestis KIM
uugguaauacugagaccu

SEQ ID NO: 4223392 - RNA, 23 nt, Yersinia pestis KIM
uuggucaagcgggugagauauug

SEQ ID NO: 4223393 - RNA, 15 nt, Yersinia pestis KIM
uuggucaauaaaauu

SEQ ID NO: 4223394 - RNA, 13 nt, Yersinia pestis KIM
uuggucaaucaag

SEQ ID NO: 4223395 - RNA, 11 nt, Yersinia pestis KIM
uuggucagcag

SEQ ID NO: 4223396 - RNA, 19 nt, Yersinia pestis KIM
uuggucaguugaauauucc

SEQ ID NO: 4223397 - RNA, 21 nt, Yersinia pestis KIM
uuggucguuuaaauaaaaaag

SEQ ID NO: 4223398 - RNA, 14 nt, Yersinia pestis KIM
uuggucucagaaca

SEQ ID NO: 4223399 - RNA, 17 nt, Yersinia pestis KIM
uuggugacaaacgcuug

SEQ ID NO: 4223400 - RNA, 14 nt, Yersinia pestis KIM
uugguguugcaaaa

SEQ ID NO: 4223401 - RNA, 15 nt, Yersinia pestis KIM
uugguguugcaaaac

SEQ ID NO: 4223402 - RNA, 19 nt, Yersinia pestis KIM
uugguuugacauacucuuc

SEQ ID NO: 4223403 - RNA, 15 nt, Yersinia pestis KIM
uugguuuuaauaacc

SEQ ID NO: 4223404 - RNA, 14 nt, Yersinia pestis KIM
uuguaaauuuuuuu

SEQ ID NO: 4223405 - RNA, 17 nt, Yersinia pestis KIM
uuguaaccgacuugccc

SEQ ID NO: 4223406 - RNA, 20 nt, Yersinia pestis KIM
uuguaagucagauugucaga

SEQ ID NO: 4223407 - RNA, 23 nt, Yersinia pestis KIM
uuguaauaacgauuaauuaguuu

SEQ ID NO: 4223408 - RNA, 23 nt, Yersinia pestis KIM
uuguaccagggcaccuaauucac

SEQ ID NO: 4223409 - RNA, 19 nt, Yersinia pestis KIM
uuguaccgauuuacguguu

SEQ ID NO: 4223410 - RNA, 18 nt, Yersinia pestis KIM
uuguagcccacugacacu

SEQ ID NO: 4223411 - RNA, 20 nt, Yersinia pestis KIM
uuguagcgccagguaagaaa

SEQ ID NO: 4223412 - RNA, 17 nt, Yersinia pestis KIM
uuguagguuaugacacc

SEQ ID NO: 4223413 - RNA, 20 nt, Yersinia pestis KIM
uuguauacaauugccugauu

SEQ ID NO: 4223414 - RNA, 14 nt, Yersinia pestis KIM
uuguaucacagcaa

SEQ ID NO: 4223415 - RNA, 22 nt, Yersinia pestis KIM
uugucaauaaccucagccucau

SEQ ID NO: 4223416 - RNA, 19 nt, Yersinia pestis KIM
uugucagcagucugaggcc

SEQ ID NO: 4223417 - RNA, 13 nt, Yersinia pestis KIM
uugucagccaugc

SEQ ID NO: 4223418 - RNA, 16 nt, Yersinia pestis KIM
uugucaugaaaaucuu

SEQ ID NO: 4223419 - RNA, 18 nt, Yersinia pestis KIM
uugucauggccugaugca

SEQ ID NO: 4223420 - RNA, 16 nt, Yersinia pestis KIM
uuguccaacaucuccg

SEQ ID NO: 4223421 - RNA, 19 nt, Yersinia pestis KIM
uuguccaacaucuccgcca

SEQ ID NO: 4223422 - RNA, 20 nt, Yersinia pestis KIM
uugucggcauaacaggugca

SEQ ID NO: 4223423 - RNA, 17 nt, Yersinia pestis KIM
uugucguuauuuucuau

SEQ ID NO: 4223424 - RNA, 22 nt, Yersinia pestis KIM
uugucuucuuuugggauaaaau

SEQ ID NO: 4223425 - RNA, 16 nt, Yersinia pestis KIM
uugucuuuaauaaaau

SEQ ID NO: 4223426 - RNA, 21 nt, Yersinia pestis KIM
uugucuuuaauaaaaucaaaa

SEQ ID NO: 4223427 - RNA, 23 nt, Yersinia pestis KIM
uugucuuuaucgugggcgcagaa

SEQ ID NO: 4223428 - RNA, 18 nt, Yersinia pestis KIM
uugugcccagaaaacccc

SEQ ID NO: 4223429 - RNA, 18 nt, Yersinia pestis KIM
uugugcgccggagaggcu

SEQ ID NO: 4223430 - RNA, 16 nt, Yersinia pestis KIM
uugugcguaaagaaaa

SEQ ID NO: 4223431 - RNA, 19 nt, Yersinia pestis KIM
uugugcguaaagaaaaaau

SEQ ID NO: 4223432 - RNA, 15 nt, Yersinia pestis KIM
uugugcuacggcaaa

SEQ ID NO: 4223433 - RNA, 14 nt, Yersinia pestis KIM
uugugcuccugaug

SEQ ID NO: 4223434 - RNA, 16 nt, Yersinia pestis KIM
uugugcuuuuuggcaa

SEQ ID NO: 4223435 - RNA, 17 nt, Yersinia pestis KIM
uuguggcuaccaauuau

SEQ ID NO: 4223436 - RNA, 22 nt, Yersinia pestis KIM
uugugucaucgcggaugccuuu

SEQ ID NO: 4223437 - RNA, 20 nt, Yersinia pestis KIM
uugugucguacacuauuuua

SEQ ID NO: 4223438 - RNA, 12 nt, Yersinia pestis KIM
uugugugaguug

SEQ ID NO: 4223439 - RNA, 22 nt, Yersinia pestis KIM
uuguuaauuaagauuaagccau

SEQ ID NO: 4223440 - RNA, 23 nt, Yersinia pestis KIM
uuguuaccuaaccaaacauuguc

SEQ ID NO: 4223441 - RNA, 16 nt, Yersinia pestis KIM
uuguuaucgaacaucu

SEQ ID NO: 4223442 - RNA, 13 nt, Yersinia pestis KIM
uuguuauuacuaa

SEQ ID NO: 4223443 - RNA, 15 nt, Yersinia pestis KIM
uuguucagagauaau

SEQ ID NO: 4223444 - RNA, 18 nt, Yersinia pestis KIM
uuguucaggcagauaaau

SEQ ID NO: 4223445 - RNA, 14 nt, Yersinia pestis KIM
uuguucgugaaagc

SEQ ID NO: 4223446 - RNA, 15 nt, Yersinia pestis KIM
uuguucuuacuguuu

SEQ ID NO: 4223447 - RNA, 21 nt, Yersinia pestis KIM
uuguugccuuucuguaacuca

SEQ ID NO: 4223448 - RNA, 14 nt, Yersinia pestis KIM
uuguugcucaacau

SEQ ID NO: 4223449 - RNA, 23 nt, Yersinia pestis KIM
uuguugucagauaucugcucauu

SEQ ID NO: 4223450 - RNA, 22 nt, Yersinia pestis KIM
uuguuuaaucaccgcuguggaa

SEQ ID NO: 4223451 - RNA, 21 nt, Yersinia pestis KIM
uuguuucaauaaaucccgcuu

SEQ ID NO: 4223452 - RNA, 20 nt, Yersinia pestis KIM
uuguuugaauuuuagucaaa

SEQ ID NO: 4223453 - RNA, 15 nt, Yersinia pestis KIM
uuguuuguaaauuuu

SEQ ID NO: 4223454 - RNA, 22 nt, Yersinia pestis KIM
uuguuuucguuuaaaaaauauc

SEQ ID NO: 4223455 - RNA, 18 nt, Yersinia pestis KIM
uuguuuugacuaaaauuc

SEQ ID NO: 4223456 - RNA, 19 nt, Yersinia pestis KIM
uuguuuuucaaucuauucu

SEQ ID NO: 4223457 - RNA, 18 nt, Yersinia pestis KIM
uuuaaaaacccucuucaa

SEQ ID NO: 4223458 - RNA, 18 nt, Yersinia pestis KIM
uuuaaacacucaauaagu

SEQ ID NO: 4223459 - RNA, 13 nt, Yersinia pestis KIM
uuuaaauacaaaa

SEQ ID NO: 4223460 - RNA, 17 nt, Yersinia pestis KIM
uuuaaauacaaaaauac

SEQ ID NO: 4223461 - RNA, 19 nt, Yersinia pestis KIM
uuuaaauacaaaaauacaa

SEQ ID NO: 4223462 - RNA, 19 nt, Yersinia pestis KIM
uuuaaauaugaucuugaua

SEQ ID NO: 4223463 - RNA, 20 nt, Yersinia pestis KIM
uuuaaaucuuucuccaguaa

SEQ ID NO: 4223464 - RNA, 21 nt, Yersinia pestis KIM
uuuaaauuacgguuuaccacc

SEQ ID NO: 4223465 - RNA, 22 nt, Yersinia pestis KIM
uuuaaauucaauccauugaucu

SEQ ID NO: 4223466 - RNA, 17 nt, Yersinia pestis KIM
uuuaacaauuuaucaga

SEQ ID NO: 4223467 - RNA, 21 nt, Yersinia pestis KIM
uuuaacacauuccaguaaaaa

SEQ ID NO: 4223468 - RNA, 22 nt, Yersinia pestis KIM
uuuaacacauuccaguaaaaaa

SEQ ID NO: 4223469 - RNA, 17 nt, Yersinia pestis KIM
uuuaaccgaugcaauaa

SEQ ID NO: 4223470 - RNA, 18 nt, Yersinia pestis KIM
uuuaacgccaccaaugca

SEQ ID NO: 4223471 - RNA, 15 nt, Yersinia pestis KIM
uuuaacucaaauaaa

SEQ ID NO: 4223472 - RNA, 14 nt, Yersinia pestis KIM
uuuaacuuuaucag

SEQ ID NO: 4223473 - RNA, 17 nt, Yersinia pestis KIM
uuuaacuuucaucccuu

SEQ ID NO: 4223474 - RNA, 13 nt, Yersinia pestis KIM
uuuaagaaaucua

SEQ ID NO: 4223475 - RNA, 23 nt, Yersinia pestis KIM
uuuaagaaaucuauuaauauacc

SEQ ID NO: 4223476 - RNA, 14 nt, Yersinia pestis KIM
uuuaagauccaguu

SEQ ID NO: 4223477 - RNA, 14 nt, Yersinia pestis KIM
uuuaagccaauaau

SEQ ID NO: 4223478 - RNA, 18 nt, Yersinia pestis KIM
uuuaagcgccuuaagaga

SEQ ID NO: 4223479 - RNA, 22 nt, Yersinia pestis KIM
uuuaagcgggcuuuaauagcca

SEQ ID NO: 4223480 - RNA, 14 nt, Yersinia pestis KIM
uuuaagcugaaauu

SEQ ID NO: 4223481 - RNA, 16 nt, Yersinia pestis KIM
uuuaagcugucuaaau

SEQ ID NO: 4223482 - RNA, 19 nt, Yersinia pestis KIM
uuuaagcugucuaaauugc

SEQ ID NO: 4223483 - RNA, 16 nt, Yersinia pestis KIM
uuuaauaaccauuaau

SEQ ID NO: 4223484 - RNA, 16 nt, Yersinia pestis KIM
uuuaauaugcaaaaaa

SEQ ID NO: 4223485 - RNA, 16 nt, Yersinia pestis KIM
uuuaauaugugacaau

SEQ ID NO: 4223486 - RNA, 18 nt, Yersinia pestis KIM
uuuaaucucuccaugaua

SEQ ID NO: 4223487 - RNA, 14 nt, Yersinia pestis KIM
uuuaaugaaaacua

SEQ ID NO: 4223488 - RNA, 21 nt, Yersinia pestis KIM
uuuaaugaguuggcauucuag

SEQ ID NO: 4223489 - RNA, 18 nt, Yersinia pestis KIM
uuuaaugcuguuuuguca

SEQ ID NO: 4223490 - RNA, 20 nt, Yersinia pestis KIM
uuuaauggcauacuccgcug

SEQ ID NO: 4223491 - RNA, 17 nt, Yersinia pestis KIM
uuuaauuaguuuaucag

SEQ ID NO: 4223492 - RNA, 18 nt, Yersinia pestis KIM
uuuaauuaguuuaucagu

SEQ ID NO: 4223493 - RNA, 20 nt, Yersinia pestis KIM
uuuacaagccaacauugaua

SEQ ID NO: 4223494 - RNA, 23 nt, Yersinia pestis KIM
uuuacaccacuaguuaaaaccag

SEQ ID NO: 4223495 - RNA, 13 nt, Yersinia pestis KIM
uuuacaggccaca

SEQ ID NO: 4223496 - RNA, 22 nt, Yersinia pestis KIM
uuuaccaaugcacguaaagagu

SEQ ID NO: 4223497 - RNA, 14 nt, Yersinia pestis KIM
uuuaccauccagug

SEQ ID NO: 4223498 - RNA, 11 nt, Yersinia pestis KIM
uuuaccaugcu

SEQ ID NO: 4223499 - RNA, 14 nt, Yersinia pestis KIM
uuuaccgcaaccac

SEQ ID NO: 4223500 - RNA, 19 nt, Yersinia pestis KIM
uuuaccgcagggcguucag

SEQ ID NO: 4223501 - RNA, 21 nt, Yersinia pestis KIM
uuuaccgguaccgcuaugcua

SEQ ID NO: 4223502 - RNA, 22 nt, Yersinia pestis KIM
uuuaccuguuucgauccagcua

SEQ ID NO: 4223503 - RNA, 17 nt, Yersinia pestis KIM
uuucgcuuuacauugcu

SEQ ID NO: 4223504 - RNA, 21 nt, Yersinia pestis KIM
uuucggaucagcgccugcugu

SEQ ID NO: 4223505 - RNA, 15 nt, Yersinia pestis KIM
uuucgggcaaaaaaa

SEQ ID NO: 4223506 - RNA, 13 nt, Yersinia pestis KIM
uuucguuuacuug

SEQ ID NO: 4223507 - RNA, 23 nt, Yersinia pestis KIM
uuucguuuacuugauggcuguuu

SEQ ID NO: 4223508 - RNA, 17 nt, Yersinia pestis KIM
uuucuaacaaaccuaaa

SEQ ID NO: 4223509 - RNA, 13 nt, Yersinia pestis KIM
uuucuaagcugcc

SEQ ID NO: 4223510 - RNA, 14 nt, Yersinia pestis KIM
uuucuaagcugccu

SEQ ID NO: 4223511 - RNA, 16 nt, Yersinia pestis KIM
uuucuaagcugccugu

SEQ ID NO: 4223512 - RNA, 17 nt, Yersinia pestis KIM
uuucuaccgcuucagca

SEQ ID NO: 4223513 - RNA, 13 nt, Yersinia pestis KIM
uuucuaucccuau

SEQ ID NO: 4223514 - RNA, 17 nt, Yersinia pestis KIM
uuucuauccgaaaaaua

SEQ ID NO: 4223515 - RNA, 12 nt, Yersinia pestis KIM
uuucuauuucug

SEQ ID NO: 4223516 - RNA, 13 nt, Yersinia pestis KIM
uuucuauuuucag

SEQ ID NO: 4223517 - RNA, 16 nt, Yersinia pestis KIM
uuucuauuuucagcau

SEQ ID NO: 4223518 - RNA, 15 nt, Yersinia pestis KIM
uuucuccaacuaauc

SEQ ID NO: 4223519 - RNA, 19 nt, Yersinia pestis KIM
uuucucgacauccaauuca

SEQ ID NO: 4223520 - RNA, 16 nt, Yersinia pestis KIM
uuucucuaaaauuuua

SEQ ID NO: 4223521 - RNA, 18 nt, Yersinia pestis KIM
uuucucucuacuucgucu

SEQ ID NO: 4223522 - RNA, 19 nt, Yersinia pestis KIM
uuucucugauaaucccaac

SEQ ID NO: 4223523 - RNA, 12 nt, Yersinia pestis KIM
uuucucugccgc

SEQ ID NO: 4223524 - RNA, 14 nt, Yersinia pestis KIM
uuucucuuggcuga

SEQ ID NO: 4223525 - RNA, 14 nt, Yersinia pestis KIM
uuucugauuuuuua

SEQ ID NO: 4223526 - RNA, 17 nt, Yersinia pestis KIM
uuucuggcaauuucugu

SEQ ID NO: 4223527 - RNA, 22 nt, Yersinia pestis KIM
uuucuggcguuuugcaucaacg

SEQ ID NO: 4223528 - RNA, 19 nt, Yersinia pestis KIM
uuucuggugagcaucaaca

SEQ ID NO: 4223529 - RNA, 13 nt, Yersinia pestis KIM
uuucugucgaucu

SEQ ID NO: 4223530 - RNA, 23 nt, Yersinia pestis KIM
uuucuguugaugaguaaacagag

SEQ ID NO: 4223531 - RNA, 22 nt, Yersinia pestis KIM
uuucuuaagcguacacuuucua

SEQ ID NO: 4223532 - RNA, 15 nt, Yersinia pestis KIM
uuucuuacuaaaaua

SEQ ID NO: 4223533 - RNA, 23 nt, Yersinia pestis KIM
uuucuuacuaaaauaucacuaua

SEQ ID NO: 4223534 - RNA, 22 nt, Yersinia pestis KIM
uuucuuccgccagcagaaccau

SEQ ID NO: 4223535 - RNA, 15 nt, Yersinia pestis KIM
uuucuucugagauau

SEQ ID NO: 4223536 - RNA, 22 nt, Yersinia pestis KIM
uuucuugccuuuuuauaagcgu

SEQ ID NO: 4223537 - RNA, 18 nt, Yersinia pestis KIM
uuucuuuuaaaucagaag

SEQ ID NO: 4223538 - RNA, 20 nt, Yersinia pestis KIM
uuugaaacuguuugcaacug

SEQ ID NO: 4223539 - RNA, 21 nt, Yersinia pestis KIM
uuugaaauaacgccacaauau

SEQ ID NO: 4223540 - RNA, 20 nt, Yersinia pestis KIM
uuugaacaacauugaugcua

SEQ ID NO: 4223541 - RNA, 15 nt, Yersinia pestis KIM
uuugaacgcgacuug

SEQ ID NO: 4223542 - RNA, 20 nt, Yersinia pestis KIM
uuugaacgugcucucauuua

SEQ ID NO: 4223543 - RNA, 18 nt, Yersinia pestis KIM
uuugaauaagacaguuua

SEQ ID NO: 4223544 - RNA, 21 nt, Yersinia pestis KIM
uuugaauaagacaguuuauuu

SEQ ID NO: 4223545 - RNA, 15 nt, Yersinia pestis KIM
uuugaauggcugcca

SEQ ID NO: 4223546 - RNA, 18 nt, Yersinia pestis KIM
uuugaauggcugccauca

SEQ ID NO: 4223547 - RNA, 19 nt, Yersinia pestis KIM
uuugacacgggaucaacau

SEQ ID NO: 4223548 - RNA, 16 nt, Yersinia pestis KIM
uuugacagucauaagg

SEQ ID NO: 4223549 - RNA, 15 nt, Yersinia pestis KIM
uuugacauuuccuug

SEQ ID NO: 4223550 - RNA, 15 nt, Yersinia pestis KIM
uuugacgaaguuuua

SEQ ID NO: 4223551 - RNA, 14 nt, Yersinia pestis KIM
uuugagaaacugau

SEQ ID NO: 4223552 - RNA, 10 nt, Yersinia pestis KIM
uuugagaaag

SEQ ID NO: 4223553 - RNA, 21 nt, Yersinia pestis KIM
uuugagccaccgcauuccagc

SEQ ID NO: 4223554 - RNA, 17 nt, Yersinia pestis KIM
uuugagcuugcugcuga

SEQ ID NO: 4223555 - RNA, 16 nt, Yersinia pestis KIM
uuugaggaaauuucag

SEQ ID NO: 4223556 - RNA, 20 nt, Yersinia pestis KIM
uuugaggaaauuucaguuuu

SEQ ID NO: 4223557 - RNA, 20 nt, Yersinia pestis KIM
uuugauaacgucauuccagu

SEQ ID NO: 4223558 - RNA, 13 nt, Yersinia pestis KIM
uuugauacaguga

SEQ ID NO: 4223559 - RNA, 13 nt, Yersinia pestis KIM
uuugauagaaaua

SEQ ID NO: 4223560 - RNA, 16 nt, Yersinia pestis KIM
uuugaucauggcuugu

SEQ ID NO: 4223561 - RNA, 17 nt, Yersinia pestis KIM
uuugaucgaccacgccc

SEQ ID NO: 4223562 - RNA, 21 nt, Yersinia pestis KIM
uuugauucgucugccauugcu

SEQ ID NO: 4223563 - RNA, 14 nt, Yersinia pestis KIM
uuugauuugaagau

SEQ ID NO: 4223564 - RNA, 19 nt, Yersinia pestis KIM
uuugcaacauuauccguuu

SEQ ID NO: 4223565 - RNA, 23 nt, Yersinia pestis KIM
uuugcaacgcaggcacugcagaa

SEQ ID NO: 4223566 - RNA, 19 nt, Yersinia pestis KIM
uuugcaauuaauuggccca

SEQ ID NO: 4223567 - RNA, 13 nt, Yersinia pestis KIM
uuugcagaaagua

SEQ ID NO: 4223568 - RNA, 21 nt, Yersinia pestis KIM
uuugcauaauuaugaaaguaa

SEQ ID NO: 4223569 - RNA, 15 nt, Yersinia pestis KIM
uuugcaucuggugac

SEQ ID NO: 4223570 - RNA, 18 nt, Yersinia pestis KIM
uuugcauugaccgccaaa

SEQ ID NO: 4223571 - RNA, 21 nt, Yersinia pestis KIM
uuugccaccuccgcauccggc

SEQ ID NO: 4223572 - RNA, 14 nt, Yersinia pestis KIM
uuugcccauaaacc

SEQ ID NO: 4223573 - RNA, 14 nt, Yersinia pestis KIM
uuugccuauuucag

SEQ ID NO: 4223574 - RNA, 16 nt, Yersinia pestis KIM
uuugccucacugucuu

SEQ ID NO: 4223575 - RNA, 13 nt, Yersinia pestis KIM
uuugccucugcua

SEQ ID NO: 4223576 - RNA, 21 nt, Yersinia pestis KIM
uuugccuucacugguuuucag

SEQ ID NO: 4223577 - RNA, 19 nt, Yersinia pestis KIM
uuugcgauacaccauuucc

SEQ ID NO: 4223578 - RNA, 24 nt, Yersinia pestis KIM
uuugcgauacaccauuuccaggcu

SEQ ID NO: 4223579 - RNA, 21 nt, Yersinia pestis KIM
uuugcgcaaaauuaagacauu

SEQ ID NO: 4223580 - RNA, 19 nt, Yersinia pestis KIM
uuugcgcccgcgccagaug

SEQ ID NO: 4223581 - RNA, 22 nt, Yersinia pestis KIM
uuugcgggacauuuuaaagaau

SEQ ID NO: 4223582 - RNA, 15 nt, Yersinia pestis KIM
uuugcguuaucuuuu

SEQ ID NO: 4223583 - RNA, 14 nt, Yersinia pestis KIM
uuugcuauugaaca

SEQ ID NO: 4223584 - RNA, 13 nt, Yersinia pestis KIM
uuugcucuucccu

SEQ ID NO: 4223585 - RNA, 21 nt, Yersinia pestis KIM
uuugcugacggggucagauau

SEQ ID NO: 4223586 - RNA, 13 nt, Yersinia pestis KIM
uuugcugauucag

SEQ ID NO: 4223587 - RNA, 13 nt, Yersinia pestis KIM
uuugcugcuuaua

SEQ ID NO: 4223588 - RNA, 18 nt, Yersinia pestis KIM
uuugcuuuuugcuuuuug

SEQ ID NO: 4223589 - RNA, 21 nt, Yersinia pestis KIM
uuuggaauagcuguaaaauac

SEQ ID NO: 4223590 - RNA, 15 nt, Yersinia pestis KIM
uuuggcaaauuuagc

SEQ ID NO: 4223591 - RNA, 14 nt, Yersinia pestis KIM
uuuggcauuuucag

SEQ ID NO: 4223592 - RNA, 20 nt, Yersinia pestis KIM
uuuggccaccgcgucgccgc

SEQ ID NO: 4223593 - RNA, 13 nt, Yersinia pestis KIM
uuuggccgggagu

SEQ ID NO: 4223594 - RNA, 13 nt, Yersinia pestis KIM
uuugggaacaaca

SEQ ID NO: 4223595 - RNA, 13 nt, Yersinia pestis KIM
uuugggcuaaaac

SEQ ID NO: 4223596 - RNA, 23 nt, Yersinia pestis KIM
uuuggucaguugaauauuccauu

SEQ ID NO: 4223597 - RNA, 21 nt, Yersinia pestis KIM
uuuggugaucaugauuucucg

SEQ ID NO: 4223598 - RNA, 14 nt, Yersinia pestis KIM
uuugguuaaagaag

SEQ ID NO: 4223599 - RNA, 18 nt, Yersinia pestis KIM
uuugguuggcuuuaaccc

SEQ ID NO: 4223600 - RNA, 18 nt, Yersinia pestis KIM
uuugguuuuuucaguaca

SEQ ID NO: 4223601 - RNA, 23 nt, Yersinia pestis KIM
uuuguaauaacucagccauugcu

SEQ ID NO: 4223602 - RNA, 15 nt, Yersinia pestis KIM
uuuguacaacuucuu

SEQ ID NO: 4223603 - RNA, 18 nt, Yersinia pestis KIM
uuuguagugaaugacagu

SEQ ID NO: 4223604 - RNA, 18 nt, Yersinia pestis KIM
uuuguagugacguaaaaa

SEQ ID NO: 4223605 - RNA, 22 nt, Yersinia pestis KIM
uuuguauuuacucguuuuacau

SEQ ID NO: 4223606 - RNA, 20 nt, Yersinia pestis KIM
uuugucaauaaccucagccu

SEQ ID NO: 4223607 - RNA, 22 nt, Yersinia pestis KIM
uuugucagcagucugagccuca

SEQ ID NO: 4223608 - RNA, 15 nt, Yersinia pestis KIM
uuugucaucaaccuc

SEQ ID NO: 4223609 - RNA, 20 nt, Yersinia pestis KIM
uuugucauguugaccaaaca

SEQ ID NO: 4223610 - RNA, 22 nt, Yersinia pestis KIM
uuugucauguugaccaaacaga

SEQ ID NO: 4223611 - RNA, 22 nt, Yersinia pestis KIM
uuugucgcauuuauuuguagug

SEQ ID NO: 4223612 - RNA, 17 nt, Yersinia pestis KIM
uuugucgucccaggccu

SEQ ID NO: 4223613 - RNA, 17 nt, Yersinia pestis KIM
uuugugcccagaaaacc

SEQ ID NO: 4223614 - RNA, 12 nt, Yersinia pestis KIM
uuuguuaaaaag

SEQ ID NO: 4223615 - RNA, 22 nt, Yersinia pestis KIM
uuuguugucagauaucugcuca

SEQ ID NO: 4223616 - RNA, 13 nt, Yersinia pestis KIM
uuuguuuguaaau

SEQ ID NO: 4223617 - RNA, 15 nt, Yersinia pestis KIM
uuuguuuuucugaca

SEQ ID NO: 4223618 - RNA, 23 nt, Yersinia pestis KIM
uuuuuccauucgauagaaacauc

SEQ ID NO: 4223619 - RNA, 15 nt, Yersinia pestis KIM
uuuuucccuucaacu

SEQ ID NO: 4223620 - RNA, 17 nt, Yersinia pestis KIM
uuuuucuuuuuaacuua

SEQ ID NO: 4223621 - RNA, 13 nt, Yersinia pestis KIM
uuuuugaaauucu

SEQ ID NO: 4223622 - RNA, 17 nt, Yersinia pestis KIM
uuuuugaacgauauuuu

SEQ ID NO: 4223623 - RNA, 14 nt, Yersinia pestis KIM
uuuuugaauaaucc

SEQ ID NO: 4223624 - RNA, 21 nt, Yersinia pestis KIM
uuuuugguuuucuauuuccac

SEQ ID NO: 4223625 - RNA, 22 nt, Yersinia pestis KIM
uuuuuguagugaaagcguuaau

SEQ ID NO: 4223626 - RNA, 12 nt, Yersinia pestis KIM
uuuuuuaaaaaa

SEQ ID NO: 4223627 - RNA, 18 nt, Yersinia pestis KIM
uuuuuucaccaaccaauu

SEQ ID NO: 4223628 - RNA, 21 nt, Yersinia pestis KIM
uuuuuugggaugaaaaauaca

SEQ ID NO: 4223629 - RNA, 55 nt, Bordetella pertussis
gcgccggacaaccuggucgacgcgcagaacgcgcucgaucggcuguaccaggcgc

SEQ ID NO: 4223630 - RNA, 91 nt, Bordetella pertussis
gcaugcgggcagggccgcgcgccuauuguuuugguaaauggaaaugacuaucauuugucuuuaccaaaugcaaaugccggagaccgcaugc

SEQ ID NO: 4223631 - RNA, 61 nt, Bordetella pertussis
gccgaccugcgcgucgauugggaugagggcugccccaucgccucgcucgacgcgcuguggc

SEQ ID NO: 4223632 - RNA, 124 nt, Bordetella pertussis
uagccaucgcgccgcccaacgcaucgacuuccuugaccaaaugacccuugccuauccccccgauggagggauugcaggacauuuggcccagggucucgauauuguggguaagcagcaaugucug

SEQ ID NO: 4223633 - RNA, 75 nt, Bordetella pertussis
uggccaaugcgcgccgcuucggcugcgaucugucggccaugccgacgcuggcccgcaucgaagcggcaugcgccg

SEQ ID NO: 4223634 - RNA, 73 nt, Bordetella pertussis
gcgcucucggugcugguggcggccgcgcucgcgggcugcucgcuggcgcccgacuacaagcgaccggaggcgc

SEQ ID NO: 4223635 - RNA, 85 nt, Bordetella pertussis
gccgauugcccacggcaucggcguccugcgcguuccagccggcauagaagcgguaccgcaggguuucgccggucugcgggucggc

SEQ ID NO: 4223636 - RNA, 66 nt, Bordetella pertussis
gcgcccacggcgaucucgguaucgcccagcaugauggucugggcggccgacacgaucgccugcagc

SEQ ID NO: 4223637 - RNA, 56 nt, Bordetella pertussis
ggugcccgcgucgcgggucacggcauugggauugccgugcacgcacaugggcaacc

SEQ ID NO: 4223638 - RNA, 81 nt, Bordetella pertussis
cgcugcccucggccggcaccuugcaggccaucaaggcgcaucugcgccucgaggccacgcaggggcccauggaggccggcg

SEQ ID NO: 4223639 - RNA, 130 nt, Bordetella pertussis
gcccggagugaacacauaggugucgggaaagaacaugcccucgggaugagucaccgucgagcccagccuuuccaucagggccucgucgcuggucucgcccagggucugcuugacgucgggauguucgcgc

SEQ ID NO: 4223640 - RNA, 113 nt, Bordetella pertussis
gcuggucgcggcccucgcgcaaaauggugucgaaccagucggccaccgcgcgccauugcucgcgcguguugucgaucugguucaugcgggcgcagaacgcggcugcgcccggc

SEQ ID NO: 4223641 - RNA, 62 nt, Bordetella pertussis
guucacagcuaguucuccgccuggcgcgcccaccgggccaggggcaagggcuggcugccgac

SEQ ID NO: 4223642 - RNA, 80 nt, Bordetella pertussis
cgccaugcgcuggcgugguguucguccgacgguucguggcguugccaugaacccgaucgaucacccgcacggugguggug

SEQ ID NO: 4223643 - RNA, 69 nt, Bordetella pertussis
gcgcgcggggugcuggucgucggcguaccguuccuggcggaugcgccgcuggccggcgcgaaggugcgu

SEQ ID NO: 4223644 - RNA, 79 nt, Bordetella pertussis
gcgcugcgacucggccagcagaaugccgucggucaucagcuugaucgaggcguucgggccggugcggucguugaagcgc

SEQ ID NO: 4223645 - RNA, 65 nt, Bordetella pertussis
gugguugcggcuugcgccagccaggcgcaggacaccauacgccugggguugcaggcgguccccac

SEQ ID NO: 4223646 - RNA, 71 nt, Bordetella pertussis
ggcucgucgagcagcaugacguugugccggcccaacaucaggcggccgaaggucaugcgguucuucucgcc

SEQ ID NO: 4223647 - RNA, 57 nt, Bordetella pertussis
ggcguccucgguggugagcacgcgcggcucuccuugcgucaccgccaccaggacggc

SEQ ID NO: 4223648 - RNA, 58 nt, Bordetella pertussis
ggcgugcuggguagugcaaguagcgaugcgggcaagauucuugacuacuugaguggcc

SEQ ID NO: 4223649 - RNA, 91 nt, Bordetella pertussis
ucggcgcgcacgaacgcggggucgucgagcugcgccuggguauagcccucggcguacuucaggauggcuucgcagaucgucaggcggucga

SEQ ID NO: 4223650 - RNA, 77 nt, Bordetella pertussis
agcucggacagcgcgaaaggcuuggccauguagucgucggcgccgagauccaggcccuugacgcgcuguucgaugcu

SEQ ID NO: 4223651 - RNA, 86 nt, Bordetella pertussis
gggcgugcacgccgccaugcaggucauucaucucgacaccgauuugcagcgucgcgacgaguccugggugcgcggcgucaacgccu

SEQ ID NO: 4223652 - RNA, 82 nt, Bordetella pertussis
gccaagaucgccgguucgggcggcuaccuucccgaacgcgucgucaccaacgacgaucuggccgccgagcuggcgacgcggc

SEQ ID NO: 4223653 - RNA, 61 nt, Bordetella pertussis
guagugguuguagaccgccaccgccagcaugcgcuuggggcuggucuggccaaucacguac

SEQ ID NO: 4223654 - RNA, 57 nt, Bordetella pertussis
acgugcugaccgggcuguacguccccgaagagggacagugcgaguucaacggcaugu

SEQ ID NO: 4223655 - RNA, 70 nt, Bordetella pertussis
ccaguugcuggacuucgcccgcacgcuggaggcggccggccuggcguacgcgcgcgaagccgccaaaugg

SEQ ID NO: 4223656 - RNA, 67 nt, Bordetella pertussis
cgaggccgaguugccgaccgacauggucggcacgaugccgccgucuucggugauggcagccgccucg

SEQ ID NO: 4223657 - RNA, 56 nt, Bordetella pertussis
agcgugugcauggccagcggcaugccauggaaauucugcaggcccuuguccacgcu

SEQ ID NO: 4223658 - RNA, 67 nt, Bordetella pertussis
cugguugccgucgcgcaagucggugcucauccagaugggcggcugggugaugcggcggcugggccag

SEQ ID NO: 4223659 - RNA, 63 nt, Bordetella pertussis
gaugccaagcugcgcgagcaccugcgcgucgaacuggcgcagaugcugcgcggccuggacauc

SEQ ID NO: 4223660 - RNA, 68 nt, Bordetella pertussis
gcagguguccgcgcggcucgagcgccugcucagcaaugagaaugugcuggccacgacggccacgcugc

SEQ ID NO: 4223661 - RNA, 68 nt, Bordetella pertussis
gcccgcaaucgcuggccgugcugcggcgcaucauggccaugggcgagcgcugcacggccgugcugggc

SEQ ID NO: 4223662 - RNA, 66 nt, Bordetella pertussis
ggcaagggcguggacaaggugaucauugcgcuggugguggugcaaugggccuauuucgcgcgcgcc

SEQ ID NO: 4223663 - RNA, 61 nt, Bordetella pertussis
gcgcagcagcaggagugggcgcgcgaggucuucaaucgcgacgucaugccgcugcugacgc

SEQ ID NO: 4223664 - RNA, 57 nt, Bordetella pertussis
ugacccugauggcgcugaccaucgcgaccggcuucguggucgacgacgccaucguca

SEQ ID NO: 4223665 - RNA, 78 nt, Bordetella pertussis
cgcuuucgcggguugcaugcgcugcgccgcuaucccaacggggaggagcgcugcaucgcgugcaaacugugcgaggcg

SEQ ID NO: 4223666 - RNA, 87 nt, Bordetella pertussis
cccgcauucgccuucgugaucaugaucaugaucgugaucauggccguggccauggucguggucaugauggucgugggcggcgucggg

SEQ ID NO: 4223667 - RNA, 70 nt, Bordetella pertussis
cucgggcgucagcugcucgaccagcaagggauacaaggcgcgaucccgggcgaucacgcugauguucgag

SEQ ID NO: 4223668 - RNA, 91 nt, Bordetella pertussis
gcccgguucgcgccauucgaagccggcgucgaggaacacgcgguccagccccagcucuucggcggcgcgcuugacccgcugcgagcccggc

SEQ ID NO: 4223669 - RNA, 86 nt, Bordetella pertussis
cgugcuggagcugcugaucuggucggcgccgcugcugaucaucaucgcccugggcgcgcugaccugggucagcacccaccagcucg

SEQ ID NO: 4223670 - RNA, 76 nt, Bordetella pertussis
ucgggcuccggcucgggcucgggcugcgguugcgguucagguuccggcugcgguuccggcuugggcugcggcuuga

SEQ ID NO: 4223671 - RNA, 74 nt, Bordetella pertussis
ggcagccacgccgaacugcuggccggcaagggccuguauuacgccauguggcgccagcagaucggcgaacggcc

SEQ ID NO: 4223672 - RNA, 71 nt, Bordetella pertussis
ggugauggcucagcucgcgcagcaugucggccgaggugacgucgacgcuggugacgggcucggccgugacc

SEQ ID NO: 4223673 - RNA, 57 nt, Bordetella pertussis
ggcgauggccaugccacgucgcugaccaagauccgcuucgacgacaucgccaucgcc

SEQ ID NO: 4223674 - RNA, 70 nt, Bordetella pertussis
gguauccggcucgugguccagcgcgauguagcgcucuaugcgcagcgccugcaguccaugcgcggauacc

SEQ ID NO: 4223675 - RNA, 122 nt, Bordetella pertussis
cgcggccaccgaccuggcgggccuggacaucaguuggcgcauccggcguggcaagggagcacgcucccccauugccgaugcccugugcgaacuuggcagguuuggccagaagguuggccgcg

SEQ ID NO: 4223676 - RNA, 74 nt, Bordetella pertussis
cgcgcacggcgccggucgagacauagugcaucucggucucgggcauggacucgaucucgauggccgccaacgug

SEQ ID NO: 4223677 - RNA, 93 nt, Bordetella pertussis
ugaagaugggcgagcgcgacaucaccgcgcucaaugcgcaccagcgcguggccgccgggcugucgcgcucguaccagaucaccaauaucuuca

SEQ ID NO: 4223678 - RNA, 86 nt, Bordetella pertussis
cgcccugguagggcagguuguuggguucggcguugggcgcggccugggcgccugcgcucagcgggccgagcgacagcaucagggcg

SEQ ID NO: 4223679 - RNA, 126 nt, Bordetella pertussis
guggcgucgaccaaggccuucaccacgcagcugaccgcgcuguuccugcugacgcuggcccuggcgcagacgcgcggccgccucaccgaggagcaggaggccgagcaccugaaggccuugcgccac

SEQ ID NO: 4223680 - RNA, 55 nt, Bordetella pertussis
ggcggcgcgaucuugugguucucgaucaugaccggacccggguuguugcgcagcc

SEQ ID NO: 4223681 - RNA, 64 nt, Bordetella pertussis
ugagccuggcgcuggacgggcggggcaucuacuucgauccccgccagcccagcgaucuggagca

SEQ ID NO: 4223682 - RNA, 60 nt, Bordetella pertussis
gcaccaugaucgagcgcacaucgcgcucgcccaucgccagcacccgcucgaucauggugc

SEQ ID NO: 4223683 - RNA, 85 nt, Bordetella pertussis
gcgcucgaucugagcggcguggaugucaugccauaccggcaggaucgcauggugguggugaugucccacggacacagauuggcgc

SEQ ID NO: 4223684 - RNA, 63 nt, Bordetella pertussis
ucgagcacgaguaccggcuggacuaccugauccacaccuaccccaagccggugcugugcuggg

SEQ ID NO: 4223685 - RNA, 130 nt, Bordetella pertussis
cgccgcaauugacggcgacgaauggaccgucgcgccagaugcugcggcgguacaggugcugugcguagacuuccuugccggcgccgguuucgccuugcagcagcaccgacaggccgccgucgagcgcgcg

SEQ ID NO: 4223686 - RNA, 83 nt, Bordetella pertussis
uacgacgcgcccaguucgggggucagguccaggcggccccaauuuccgccgaacugguggcuccagagcgugggaguuucgua

SEQ ID NO: 4223687 - RNA, 66 nt, Bordetella pertussis
ggucgaucgccagcggcaggucggccgcgguggucucgcgcagcggcuugccguugucgaucgacu

SEQ ID NO: 4223688 - RNA, 75 nt, Bordetella pertussis
gaugcgccgcuuggcuggcggcaggucggugacgucacggucgccgaugcggauccggccggaggugggcguauc

SEQ ID NO: 4223689 - RNA, 79 nt, Bordetella pertussis
ggcggugucgcgccugcuggagcuggaggauggcgcgcuggucagcggcgccauccgcuuccagggcagcgacacggcc

SEQ ID NO: 4223690 - RNA, 130 nt, Bordetella pertussis
ucgaaugggugcagaucgacgagccggcgcuggugcuggacuugccgcaggcuuggcgggaugccuaucaggcugucuacgccaagcuggcggccagcccggucaagcuguugcuggccaccuauuucga

SEQ ID NO: 4223691 - RNA, 71 nt, Bordetella pertussis
ccagcagacagccguuuguuuccugcuaucccucgaaaccgccaugcggucaggcgagcugcugucgcugg

SEQ ID NO: 4223692 - RNA, 57 nt, Bordetella pertussis
ucgucggcaugggcgaaucgcgccgcgaccgcgccggccuggucgcccagcugacga

SEQ ID NO: 4223693 - RNA, 79 nt, Bordetella pertussis
gaugcggauacagggcguagcuuugaaagaccaucgccaggcgccgguccuucggcggcacguccgucaugaccgcauc

SEQ ID NO: 4223694 - RNA, 83 nt, Bordetella pertussis
uacuugcagguauucggaguuugccaugguuugguaagucgccaugacccccuagccauaacagugcucuacccccugcagua

SEQ ID NO: 4223695 - RNA, 96 nt, Bordetella pertussis
uccacuggcugcgccauuaccauguagacgggcugcgcguggacgcggucgcguccaugcuguaucgcgacuacagccgcccggccggccagugga

SEQ ID NO: 4223696 - RNA, 61 nt, Bordetella pertussis
ucgucagcgcagaggaagcgaucuucaccggcgaggcgaaguucguggugcugccuggcga

SEQ ID NO: 4223697 - RNA, 109 nt, Bordetella pertussis
agcggcugccguccggacgggccgggaucaugagguucuugaugcgcacguuggcgaacgugccgcgcaucaugaucucgugguugccgcgccgcgaaccguagcuguu

SEQ ID NO: 4223698 - RNA, 82 nt, Bordetella pertussis
gggcguguccgccaccguggugcugguggcguucgacucgaccauugucacgaccacgcugccacgcguggcggcugcgcuc

SEQ ID NO: 4223699 - RNA, 86 nt, Bordetella pertussis
cuuccugcgcgagcuggugucgaacgcgucggacgcgugcgacaagcugcgcuucgaggcgaucgaccagccgggcuugcuggaag

SEQ ID NO: 4223700 - RNA, 63 nt, Bordetella pertussis
ggcucgccguuguggaaauugaaggccucguucucgcaggccgcgacauccaccgaccaggcc

SEQ ID NO: 4223701 - RNA, 78 nt, Bordetella pertussis
ggccgugauacuggaccaggugacauucggcaucgcggugcgcauggccgccaugagccuggucgcgggaguacggcc

SEQ ID NO: 4223702 - RNA, 79 nt, Bordetella pertussis
ggcgguggugcucggcaugccggugcgggcauuguuuccguuccugggcggccgcacccuggaagucgaggccaucgcc

SEQ ID NO: 4223703 - RNA, 61 nt, Bordetella pertussis
ucgcugccgguauagccgacggccugcgcgucgacgaagaucgucgggaugccggcguuga

SEQ ID NO: 4223704 - RNA, 68 nt, Bordetella pertussis
acgacggaugcgcucgaggacgucgauggccuggugcgccggcccauccucaacgagccguucguggu

SEQ ID NO: 4223705 - RNA, 58 nt, Bordetella pertussis
uugccgucggucaggucugcgccgaucagguaaucgccgucauccaggucgacggcga

SEQ ID NO: 4223706 - RNA, 84 nt, Bordetella pertussis
gcaccgaacugcagcagggccugcguuucgcuggcaucgaucuugacgaugcccagcgguugcgcggccaggcgcaggcggugc

SEQ ID NO: 4223707 - RNA, 64 nt, Bordetella pertussis
cgccguggcgucgggcaagggcggcgugggcaaaagcaccacggcggucaaccuggcgcuggcg

SEQ ID NO: 4223708 - RNA, 60 nt, Bordetella pertussis
caguacggcgccagccccgaccugggcccggggcgccagggacgggagggugccgaacug

SEQ ID NO: 4223709 - RNA, 86 nt, Bordetella pertussis
gccgcgaacucgacggccgcgugccgcugaucggcuuugcgggcagccccuggacgaucgccuguuacauggccgaagggcgcggc

SEQ ID NO: 4223710 - RNA, 130 nt, Bordetella pertussis
ggcugugcgugagcgugcccaucaucgucugggguagcacgcuggugcucaagcugaucgaccgcuucccgcuggucgucacccugggcgccggccugcugggcuggaucgccggcggcaugcucaucac

SEQ ID NO: 4223711 - RNA, 58 nt, Bordetella pertussis
gccgacgcggucggcguuggcgucacgggcgguggcgcccaccccuucaugcguuggc

SEQ ID NO: 4223712 - RNA, 90 nt, Bordetella pertussis
gggaacuuggggaaaaaccauagugaucaccgggccggcuucaugcaauauaugaguuuugcaccuguccguacuaucccuaggucuccc

SEQ ID NO: 4223713 - RNA, 67 nt, Bordetella pertussis
cgccgaaggcgcgcagaucgccauggcggccacgaccgccgauggcgcccugcgcacccagccggug

SEQ ID NO: 4223714 - RNA, 61 nt, Bordetella pertussis
uacggguugucaacagcguucuccaggcaauagcccaugccgcgcauggugacgaucugua

SEQ ID NO: 4223715 - RNA, 65 nt, Bordetella pertussis
gcgccgcacguugaggucaccguccgcauacagcgcgcuggcggucagccacagcggcgugccgc

SEQ ID NO: 4223716 - RNA, 55 nt, Bordetella pertussis
gucggccagccagccgcuguuccgggcgccccgcagcgcggcccaggcggccggc

SEQ ID NO: 4223717 - RNA, 89 nt, Bordetella pertussis
cuauucgaacggccugaccgguuuccugggcgggcugagcgccaacacgcugggccugcugggcaaccuggugacgcuggacguggugg

SEQ ID NO: 4223718 - RNA, 112 nt, Bordetella pertussis
gaccgaacugacgucauggccguccguauugacaguuacgucgccgccggaggcaaucagcgccccgccgccggcguacugauccgugaugcccuggcgcgucgccucgguc

SEQ ID NO: 4223719 - RNA, 70 nt, Bordetella pertussis
gccuucgcccaugcucgacgccaucgcccgggcgcccaucugggcgggaggcgccgaguauggccacggc

SEQ ID NO: 4223720 - RNA, 91 nt, Bordetella pertussis
cggacaacaggauggaugcgaugguaugcaugggguucgccuucaggggcaauccugcuugccgcugcauucgaccauccggaucaguucg

SEQ ID NO: 4223721 - RNA, 79 nt, Bordetella pertussis
ggcuggcucaacgugcggcugcgcaucauggaccugcuggccagcauccugaugaugaucgcgcuguacucggucaacc

SEQ ID NO: 4223722 - RNA, 57 nt, Bordetella pertussis
gcggccucgauggccuaugucgaaucauugaucgaacgguacgccaucgagugcggc

SEQ ID NO: 4223723 - RNA, 94 nt, Bordetella pertussis
ugcuccgcgcugcgcgugcugugccugcaggaggacagcgcggaucacgugcugacuaugcugcgcggcgcgaugcgcgagcugcgcgugggca

SEQ ID NO: 4223724 - RNA, 94 nt, Bordetella pertussis
cuugccgguggcgaagcggcgcgccagcgcgaucuggcuggccgagagcacguugaccacauagcgcuggcagcgcucgaaggccgccagcgag

SEQ ID NO: 4223725 - RNA, 76 nt, Bordetella pertussis
cggauccuugaacgaccgcacgacguccucgcccguuuccucccugacgcgcgcggccuccuucaaguccaugccg

SEQ ID NO: 4223726 - RNA, 55 nt, Bordetella pertussis
gucgggggcggcgccgaugacggcguucacgccgaucacggugcugccgcccggc

SEQ ID NO: 4223727 - RNA, 73 nt, Bordetella pertussis
cagccuguacgucggcgaggucgaacuguggucgccccagauccagacgcggcgcuacgccgaccagcgccug

SEQ ID NO: 4223728 - RNA, 130 nt, Bordetella pertussis
ggccgggcugcugauggccgaggcggucugggcggugcguuggcugcgccggcugggcgagcaguccacccgggccgcggucgacgccgagcccgcgggcgccucggccggcaaugggcucgacccggcc

SEQ ID NO: 4223729 - RNA, 81 nt, Bordetella pertussis
gccaugucgagcgccuggcgauccugcacgaugugccgcgucagcggcguaucgauuaucccgggcgccacggcauugagc

SEQ ID NO: 4223730 - RNA, 57 nt, Bordetella pertussis
ccacggcacugcucaccacgcaauacgacaucucgccguggcuggcgcugccggugg

SEQ ID NO: 4223731 - RNA, 59 nt, Bordetella pertussis
guucgcgcgaaaaaccgaugucgagcacgcgcacgguaucgccguacuucucgccgaac

SEQ ID NO: 4223732 - RNA, 122 nt, Bordetella pertussis
cgguugccgacacggugccgccgucguugacgaucgccauggugacuaccgaccccggcaauggccgcauuacggugucggggguuaccgaggccggcgcgcggguccaugucguguucccg

SEQ ID NO: 4223733 - RNA, 102 nt, Bordetella pertussis
ccagggaggcggcgaagcugccgaagcugcuggucaggccgguuuccauggaacggcccagcucggacagcuugggaacuuugcgaaacgcuucgauccugg

SEQ ID NO: 4223734 - RNA, 58 nt, Bordetella pertussis
ugcggaucucguacucuuugaccggauggauauucggguuguagaaguagaucgcgua

SEQ ID NO: 4223735 - RNA, 61 nt, Bordetella pertussis
augagcucguugccagcucauccaggacagcguuuuccgagcuggcuuccaugaaguucau

SEQ ID NO: 4223736 - RNA, 64 nt, Bordetella pertussis
ccguccacgugagguccaucgugcgcgaacagaucaucgccacggugggcucgauacugggcgg

SEQ ID NO: 4223737 - RNA, 99 nt, Bordetella pertussis
cugaccggcaccaaguacgguugcggcauggcgcuaugcggcgccugcaccgugcacgccgacggccagcccauccgcgccuguaucacgcccgugcag

SEQ ID NO: 4223738 - RNA, 91 nt, Bordetella pertussis
cccgccggcguccuucgcggccuuguucgccgaccggcgcggcgacgugcuggccgcgcagggcaagcgcgaugaagcgcgcgcggcgugg

SEQ ID NO: 4223739 - RNA, 121 nt, Bordetella pertussis
cgcaaguauccggggcagauuuccggcggccagcagcagcgcguggcgcuggcgcgcgcccuggcgccggcgccgucgcugcugcugcucgacgagcccaugucggcgcuggaugcgcgcg

SEQ ID NO: 4223740 - RNA, 109 nt, Bordetella pertussis
gggccuuggggucccauuggccgaacucgucgcggaaggaaaagaugcguuccuuggcgcgcgccuuuuccucgucgcgccgggcuccgccgaugcaggcauccagccc

SEQ ID NO: 4223741 - RNA, 59 nt, Bordetella pertussis
uugcagucccuguugggugaggacgagaagugaucgagaugauccgccagggacugcaa

SEQ ID NO: 4223742 - RNA, 78 nt, Bordetella pertussis
cgggcgccuguccccgcugcggcaagggugccuguccccgcggggacaggcaccuuggcccggcgggaacaggcaccg

SEQ ID NO: 4223743 - RNA, 65 nt, Bordetella pertussis
gcgccaggcgcccggcgaggucuugccgcugcaguacgcgacaagccuggcgcugugccuggcgc

SEQ ID NO: 4223744 - RNA, 69 nt, Bordetella pertussis
gguuucgucgccggccuugaccggcguggucugcaucaggaccuugccggaacggucggugacgcgguc

SEQ ID NO: 4223745 - RNA, 88 nt, Bordetella pertussis
agcgguugccgauauacaggcccagcgugucguugaggcccagcaggucguuggccgucaccgaggcguuguacuuguagcggccguu

SEQ ID NO: 4223746 - RNA, 130 nt, Bordetella pertussis
cccgcgugggagcggcaccugcgacaagagugccuguccccgcggggacggauaccgucuuaguacguacggcagugugccugucccagcggggacaggcacacgcgcagacgccggucaccaugcgcgg

SEQ ID NO: 4223747 - RNA, 89 nt, Bordetella pertussis
caguucgcgcugcugucggcgcuggccgcggugggccgcaccuaccuggccgggccgcugacgccggugcuggucgaguggcucgacug

SEQ ID NO: 4223748 - RNA, 62 nt, Bordetella pertussis
gugggcgacgaucugccguuucgucugcgccaggccgacgaggcggggcggauugcgcuggc

SEQ ID NO: 4223749 - RNA, 101 nt, Bordetella pertussis
uccugcauguucuugacgaccgacugcagcguauuggucugggcgcccagcgccugcucggccugcuugcgguuggcgucguaguugcuguucaugcugga

SEQ ID NO: 4223750 - RNA, 73 nt, Bordetella pertussis
cugguagcgcaucguauggcggggugccuguccccgcugggacaggcacaucgccguacgccgucgacgccag

SEQ ID NO: 4223751 - RNA, 81 nt, Bordetella pertussis
aacuucguacuugcgcgcuuuugcggcaagcuggacggcaacgccgugcaucuugcgccgaaaacgcgcaaaauacugguu

SEQ ID NO: 4223752 - RNA, 65 nt, Bordetella pertussis
guucucgucgguggucagcaucaaggccucaggcagcaccuuguugcgcgaaccgccgcgaaaac

SEQ ID NO: 4223753 - RNA, 84 nt, Bordetella pertussis
ugaugguggugauguccaggccgcgcagcaucugcgccaguucgacgcgcaggugcucgcgcagcuuggcauccagcgcgguca

SEQ ID NO: 4223754 - RNA, 87 nt, Bordetella pertussis
ucauggggcugcugcaaggcggcauggcgcgcgcgcagcaacggcugcucgagccccugucgccgugcaaccgcgaaaucuucauga

SEQ ID NO: 4223755 - RNA, 66 nt, Bordetella pertussis
gaucuguugcuggucgaucgcgcggucaaccuggucgaggagcgcgucgaccuggcggugcggauc

SEQ ID NO: 4223756 - RNA, 71 nt, Bordetella pertussis
caaggcccagcuggccgagcagggcguggagccgaucggcaacaccacgcccgaguucguccgguuccuug

SEQ ID NO: 4223757 - RNA, 76 nt, Bordetella pertussis
ggccggcaagcugcgcgugcugggcacggccacgcccgagcgccuggccgugcugccggacgcgcccaccauggcc

SEQ ID NO: 4223758 - RNA, 57 nt, Bordetella pertussis
guaggcgccguuacgguucacgcgcccccauuugcgcgccagcuugauggcgccuuc

SEQ ID NO: 4223759 - RNA, 64 nt, Bordetella pertussis
guggcgccauggcgggcgucaucuggcaugcgcaugaaaugcuguggggcuucaucggcgccau

SEQ ID NO: 4223760 - RNA, 57 nt, Bordetella pertussis
gucgcgcagcaauuguuccaauggguccauggcguccuggagaaaggcuugcguggc

SEQ ID NO: 4223761 - RNA, 58 nt, Bordetella pertussis
cggcaucgucaccgccgacaugcugccgcuguucggccugguggcgcuggcgaugcug

SEQ ID NO: 4223762 - RNA, 71 nt, Bordetella pertussis
gugguggcgucgaagaugggcaugccccagccuuccuggacggccuguuccaucaucgacagcguugccau

SEQ ID NO: 4223763 - RNA, 68 nt, Bordetella pertussis
ccugggcucgaacauggugggcgaguuccccgagcugcagggcaucaugggcgccuacuacgcccagg

SEQ ID NO: 4223764 - RNA, 68 nt, Bordetella pertussis
cgugcugcuggucgacgauuccaucgugcgcggcaccaccagccgcgagaucgucgacauggcgcgcg

SEQ ID NO: 4223765 - RNA, 122 nt, Bordetella pertussis
cgccggcgcgguacugcgcggucagagucgaauucgcggcggaguauaggagauaaugcgucucgcugguuuuacgcugcgcggauuccuacgccaaggugcgcgggcgccgcgcucaggcg

SEQ ID NO: 4223766 - RNA, 64 nt, Bordetella pertussis
uauccagcgcgcugagcgcgcgcaugaccaugcccaugcggcccugcagcagcgcuuccuggua

SEQ ID NO: 4223767 - RNA, 73 nt, Bordetella pertussis
gcucccagccguuggacguggccagcuggauggccuugaccaggaccagcgggccgcgguucaggcugcgggc

SEQ ID NO: 4223768 - RNA, 59 nt, Bordetella pertussis
ccgucgcgcgcggcaggcgguugagcaccaccggcagcaccaccuugccguugcggcgg

SEQ ID NO: 4223769 - RNA, 93 nt, Bordetella pertussis
gcccgacacgcccagcuacagcgccagcaaggccgcggucaaggcguauggcgaggcguugcgcgacuggcuggcgccgcagggcgugcgggu

SEQ ID NO: 4223770 - RNA, 64 nt, Bordetella pertussis
cuggugggugcugacccaggucagcgcgcccagggcgaugaugaucagcagcggcgccgaccag

SEQ ID NO: 4223771 - RNA, 68 nt, Bordetella pertussis
cggccggcgcgcugaccucgcuggccgcccugcuguacgggugccuggcgaggucggcgcgcaucccg

SEQ ID NO: 4223772 - RNA, 70 nt, Bordetella pertussis
ucuucgcgcugcugggcagcucuggcagcggcaagucgacgcugcugcgcaugcuggccggcuucgagga

SEQ ID NO: 4223773 - RNA, 84 nt, Bordetella pertussis
uguauuaccugcagcgggccuggcccgccauccgcgaaaagucgcagugagcguacgcggccgggcgcaggcccgggcaauaca

SEQ ID NO: 4223774 - RNA, 88 nt, Bordetella pertussis
gggguaucgaucagguugagguuguagaccgugccguccugcgacuuguacugcagggacgcggucugcgccuugaucgugauacccc

SEQ ID NO: 4223775 - RNA, 63 nt, Bordetella pertussis
gccgguguugaagucgcgcggcgcgccgcccagcggaucgucgcggcugaguucggccaccgc

SEQ ID NO: 4223776 - RNA, 62 nt, Bordetella pertussis
gcgugcgccaguugccgcuggccggcaucguccagcccggcggcggccaacuggcgccaggc

SEQ ID NO: 4223777 - RNA, 73 nt, Bordetella pertussis
gcuaugccgucgugcgcgccgccgacgcggccgcggcguggccgcucgaaccggugcgcguguacggcgacgc

SEQ ID NO: 4223778 - RNA, 67 nt, Bordetella pertussis
gcuugucggccugcucggccaucgcgcgcuucaucucgggcgcgcaguggcccagcguguugacggc

SEQ ID NO: 4223779 - RNA, 73 nt, Bordetella pertussis
gguugcgacauccgguggcugcgggcccagccccuggccauggggcugcgcaacggcuaucgcaaucccgacc

SEQ ID NO: 4223780 - RNA, 78 nt, Bordetella pertussis
gcgcgcugcgcgucgauggcgcgggcgugacgcugggcacgggcagcgcgggccaggcgcgcaucgacagcagcgcgu

SEQ ID NO: 4223781 - RNA, 98 nt, Bordetella pertussis
gacuuucucgggugccaguccccgccggggacaggcaccuggacacccagauucaacgugugccugucccccugcggggacaggcacccugagaaguc

SEQ ID NO: 4223782 - RNA, 125 nt, Bordetella pertussis
gucgccgcgauccggugggcgcguaguuccccagggcgccuguccccgccguucauggcgcaugacggggugccugucccggcggggacaggcacccggcuccgcgcuggccacggucaggcggc

SEQ ID NO: 4223783 - RNA, 77 nt, Bordetella pertussis
ggccugaacagggcgcaagggccagguugguuuucccgucacggggaaacggaucuggcccuuuucgcaggcaggcc

SEQ ID NO: 4223784 - RNA, 129 nt, Bordetella pertussis
gccgagaaagcccggagccucgaccgccaccgugucgcccgcggcgagguuggcgcccagcaggcgcucgauggcgucgauggcgccgugggugagaucgaccucgaaggcggccgggcagucgccggc

SEQ ID NO: 4223785 - RNA, 85 nt, Bordetella pertussis
acgaacgcgcugcugucgaugcgcgccuggcccgcgcugcccgugcccagcgucacgcccgcgccaucgacgcgcagcgcgccgu

SEQ ID NO: 4223786 - RNA, 60 nt, Bordetella pertussis
gugauauccguugccguggugccggucgagaacacucgcacgacacgcaaaggaugucgc

SEQ ID NO: 4223787 - RNA, 79 nt, Bordetella pertussis
gcccgacguaggccggcgcggccgggucuucacgccgauccgcggggagaucccgucgccgcuggacccgccgccgggc

SEQ ID NO: 4223788 - RNA, 56 nt, Bordetella pertussis
auggccgugcucgccgcaugcaucgaaaccggcgcggccuacaucgacacggccau

SEQ ID NO: 4223789 - RNA, 55 nt, Bordetella pertussis
ucggcguaggccggcucgaccgcggcggcgaacgcggcgcgaucgaccucgcuga

SEQ ID NO: 4223790 - RNA, 83 nt, Bordetella pertussis
cgucgucgggcaggcgcaccagguggugaucgggcaccgcgcaguacucagccagcccgccguggcgcgcuucgccgaugacg

SEQ ID NO: 4223791 - RNA, 65 nt, Bordetella pertussis
gcgcggccugauggcgccggugcugcacgggcuggaccaugccucgcuggacgacaucgccgcgc

SEQ ID NO: 4223792 - RNA, 61 nt, Bordetella pertussis
ggcggucgggucgucgcgguugucgccgauguucuuggcgacggugggcgacaccggcccc

SEQ ID NO: 4223793 - RNA, 76 nt, Bordetella pertussis
cggcggccugauguucggccaggcguugagcacggcguuccagagcgucauggccgauacgaucagcagcacgcug

SEQ ID NO: 4223794 - RNA, 97 nt, Bordetella pertussis
ucgaggcgccgcugcgcgcgcaguacauccgcgugauguucgacgagaucacccgcguccugaaccaccugaugucgcugggcucgcacgcccugga

SEQ ID NO: 4223795 - RNA, 56 nt, Bordetella pertussis
uccagcagcagaucgagaauccggucgccaagcugauucucgaaggcguguucgga

SEQ ID NO: 4223796 - RNA, 73 nt, Bordetella pertussis
ugcgggugcgucagggcagcguggacucgcccugguacagcgacuccagcguuucgcgcuggcgcacgaugua

SEQ ID NO: 4223797 - RNA, 91 nt, Bordetella pertussis
ggggcgacagcagcucgcgcgacgucuggcugacggcuuacaccgugggcuucaugcaggacgugcgcgaccacgaguucaaucucgcccc

SEQ ID NO: 4223798 - RNA, 62 nt, Bordetella pertussis
gccagccgcgccagcaggaugccggcgaucagguugguguccaucauggcgcggauuucggc

SEQ ID NO: 4223799 - RNA, 59 nt, Bordetella pertussis
gggccgcuguugcccugggacugcacgacgguggcagugcccaggcgcggcgguugcac

SEQ ID NO: 4223800 - RNA, 76 nt, Bordetella pertussis
cgcgcagaccucguucaucccgcugcugacccugggcaucccgggcaacgcggugauggcgcugauggucggcgcg

SEQ ID NO: 4223801 - RNA, 82 nt, Bordetella pertussis
ucuuguugugcgagccaggcacggaaggccggcguuuccggauacuggaacgccaccggcccguccggcucgccguucagga

SEQ ID NO: 4223802 - RNA, 58 nt, Bordetella pertussis
ggcgguuccggcuggcgagcucgaaucggugacgauggaguuugccucggagcuggcc

SEQ ID NO: 4223803 - RNA, 58 nt, Bordetella pertussis
guggcuggcgcgccgcaaggccaccgacgcacgcguggccgagcuggugcgccgccac

SEQ ID NO: 4223804 - RNA, 76 nt, Bordetella pertussis
cgcacacggauugcuuguugcgcgacugcgcuucccaccagaccgaagugccuucaugcagcaggcgccacuugcg

SEQ ID NO: 4223805 - RNA, 130 nt, Bordetella pertussis
cgaccagcgucaggccggcgccggugugguucaggucggucugcgcgguaucgcgaucgaucggcucgaagucgacgucguagaugcugaugucgccgaugccgccauggcccugcuugccgcgccagcg

SEQ ID NO: 4223806 - RNA, 130 nt, Bordetella pertussis
cacggcgccgaccacggccacggccaccggaaugguggcgcacucucccacgcccuugacgcccagcggguucaagggggugggagagggcuggaacaccaccucgaugggcggcacuuccggcgcggug

SEQ ID NO: 4223807 - RNA, 79 nt, Bordetella pertussis
gcugggccacgaccuguugucgcugcccuacuccgacuaucgcaucgacagcccgcgcgaucaccaggucuggcccggc

SEQ ID NO: 4223808 - RNA, 81 nt, Bordetella pertussis
gguucagcagcuugacguccuucugcggaucgaugccgugcuugcgcagcacggucuccaggaagaccagcggguuggacc

SEQ ID NO: 4223809 - RNA, 70 nt, Bordetella pertussis
ucucgauaugcucgccuuccacguaggugccguccggaaaggcgaaaugcagcggaaucggcauaucgga

SEQ ID NO: 4223810 - RNA, 61 nt, Bordetella pertussis
gauccaguuucgcgacgugggcgccaagacgcuggcgcugggcaucgccaagcuggacauc

SEQ ID NO: 4223811 - RNA, 70 nt, Bordetella pertussis
gcgccgccgggcgccaccgugcuggcgcgcucggcccaggacgcgcaccagauacugcgccuggccccgc

SEQ ID NO: 4223812 - RNA, 83 nt, Bordetella pertussis
cuuuugcacgccggacgccuucuugaugaggaccgucgcgggcggggucuucaugaugaaggugaagcucuuguccgcgaagg

SEQ ID NO: 4223813 - RNA, 67 nt, Bordetella pertussis
gccgcgucccacgaacggcauguugguggccaugauggucaugaacugcacguucguguccagcggc

SEQ ID NO: 4223814 - RNA, 56 nt, Bordetella pertussis
gcuggauguugugcgccagcagcuucuugcgcaggguguugcgcgugaugccgagc

SEQ ID NO: 4223815 - RNA, 67 nt, Bordetella pertussis
gccccaggccaccaagaauucgaugcccagcccuugcacugggcauuuucauuugugcgccaggggc

SEQ ID NO: 4223816 - RNA, 87 nt, Bordetella pertussis
gccucgacaucgugcagguugacgucguugcccagggucgcgcccaccgccuggccgcgcgcguccaccgccagcacgaucuccggc

SEQ ID NO: 4223817 - RNA, 61 nt, Bordetella pertussis
cugaugcagcacauggaucaucaggcggccgaagcggcggcugaaaucgaugugcugccgg

SEQ ID NO: 4223818 - RNA, 55 nt, Bordetella pertussis
cggccggccaaucuguucgucgccggcuuccugggacgcagcaaugugcuggccg

SEQ ID NO: 4223819 - RNA, 62 nt, Bordetella pertussis
cggccaggucaagagcguggcguauuccaccaacggccugcgccuggaucugggccuggccg

SEQ ID NO: 4223820 - RNA, 87 nt, Bordetella pertussis
cugcgccgcggcguccgguuccagcucggcauccgguuccggcucggcauccgguugcuccgcggaaucgggcggcgcggaaggcgg

SEQ ID NO: 4223821 - RNA, 71 nt, Bordetella pertussis
cgccggcgcgcagguccugauccagaccggcuaucccgagcaaccggucuaucaggcccuguugcgccacg

SEQ ID NO: 4223822 - RNA, 129 nt, Bordetella pertussis
auccuggacagcggcgcgccuuucuacgaugucuacgagugcgccgauggcgccuggaucucggucggccccaucgaggcgcgcuucuacgcgcaauugcuggagaagcuggagcugcgcgcccaggau

SEQ ID NO: 4223823 - RNA, 80 nt, Bordetella pertussis
ccgcgcggcuuauugcagaacgauguuggccugcuugaugagcuggcucaccacaggcugcucguucuucaucugcgugg

SEQ ID NO: 4223824 - RNA, 63 nt, Bordetella pertussis
gacagccugcugcauccgcgcgucacccuguacgcgggcgugcacgugggcgagcgggccauc

SEQ ID NO: 4223825 - RNA, 55 nt, Bordetella pertussis
gccguggaccaccgauccguucugccucacggaaaaggacggacgucuccauggc

SEQ ID NO: 4223826 - RNA, 129 nt, Bordetella pertussis
cgugcccgcgcgggccaggucgauaucgugcggacgcacauaggcgauggcgcgcugguugucggccucgggcagguccggcgccggcagcgccaccucgcccaggcgccacacgccgcgcguggcaug

SEQ ID NO: 4223827 - RNA, 63 nt, Bordetella pertussis
uggcggccgacaggaugguggccagcggauuggcgaugcccuggccggcgaugucgggcgccg

SEQ ID NO: 4223828 - RNA, 82 nt, Bordetella pertussis
uccgcccuggccaccgccaagaaucugcugcucgaccccuggggguugaccgaagcggaucuggcgcgcgcccugggcgaga

SEQ ID NO: 4223829 - RNA, 121 nt, Bordetella pertussis
gguucggccaucgccgcgcugguggccgccggcugaggccgcgcggccuggcgcucagugcgcgccggccgccgccucggccgcgccgccgcccgcgcucuuggcggacuugggccgggcc

SEQ ID NO: 4223830 - RNA, 77 nt, Bordetella pertussis
cggccagccgguuuccaugcugcucugucugcucguucccgaagccgccacgcagcagcaccuggacauccuggccg

SEQ ID NO: 4223831 - RNA, 64 nt, Bordetella pertussis
cuuggccgacugccaggauacccgccugcccgccaucgggacaggcgcagauccggcagccgag

SEQ ID NO: 4223832 - RNA, 71 nt, Bordetella pertussis
gccugcacgggcauccucgaagcccagcgccugcauuucggcggccagggcuuccucgaugcccugggggc

SEQ ID NO: 4223833 - RNA, 71 nt, Bordetella pertussis
ccaugucgucgucggugaucagguagcgcgccggacgcaggccguugcgguccagcguggcgccgaucugg

SEQ ID NO: 4223834 - RNA, 63 nt, Bordetella pertussis
gggccuuggcgcuguagcucaccagcaggcacuuggucugcugguaauucgacagcgccgccu

SEQ ID NO: 4223835 - RNA, 62 nt, Bordetella pertussis
cacggcgagcggcgcuccauggugggcgcggcggcgcucagcgugguggcgcugcugcugug

SEQ ID NO: 4223836 - RNA, 128 nt, Bordetella pertussis
cccgagcuccagcacccguaugccggccaguaucugccccgccaugucgucuccguauucgugacuugauauggagaagcagugugcgggcaaucgccgcgcggcagguaugggcaaaugggcaaggg

SEQ ID NO: 4223837 - RNA, 60 nt, Bordetella pertussis
gccgugcagcacgccgcguaucggaccacggucgaguucgcgcgcggcggccagcacggc

SEQ ID NO: 4223838 - RNA, 105 nt, Bordetella pertussis
uccgggccagcuguccgggggcgagcggcagcgcguggcgcuggcgcgcgcccuggugacgcggccggccugcgugcuggccgacgagcccaccggcaaccugga

SEQ ID NO: 4223839 - RNA, 63 nt, Bordetella pertussis
gcuguaccaguugcccgaccagcaguucgccaacgucuauugguuccgggucgacugguucgc

SEQ ID NO: 4223840 - RNA, 72 nt, Bordetella pertussis
ccaggaugaaaucguuguacaugaccggguagcgcuugaccgcguauccgucggccacgaauuucuccucgg

SEQ ID NO: 4223841 - RNA, 105 nt, Bordetella pertussis
gacagccagggacugcaucagcguguccggcacgcgcgccgccggcggggcagccgccgccgcgccgggguccggauacugcgccauugccucgaccagcuuuuc

SEQ ID NO: 4223842 - RNA, 72 nt, Bordetella pertussis
aggccgcuaccagcgcuucaugccggccggcaccagcuggagccggccgcagcucgaggcgcuggacggccu

SEQ ID NO: 4223843 - RNA, 55 nt, Bordetella pertussis
gcggcaugggcgccgcggccgcgcgccggcuugccgccgacggcuuucgugucgc

SEQ ID NO: 4223844 - RNA, 77 nt, Bordetella pertussis
ggccaggcugaucagcgcggcgaacauggugcugguguccagcguggucgucgccgcguugaucagguagcccagcc

SEQ ID NO: 4223845 - RNA, 66 nt, Bordetella pertussis
uggcuauggcguuccaucugccugguagucgugccgccuggcucccauggcgcggggacgccgccg

SEQ ID NO: 4223846 - RNA, 108 nt, Bordetella pertussis
gcgcgguggugcgcuggucgcgcagcggggcggugaggccgcagguggggcauagcagcacaucgaccugugccagcgccucgucgaaggcccggcgcgccacggugc

SEQ ID NO: 4223847 - RNA, 97 nt, Bordetella pertussis
cacgccugcccugcgccaggccgaagcggcgcugcuggccgacggcggcaaucucgaaggcaaggaagcccgcuucggcguggccgccacggcgcug

SEQ ID NO: 4223848 - RNA, 63 nt, Bordetella pertussis
gcggcaagugcaagccggugugcucgacccacgugccgcgcgccaaccugcuguauucgccgc

SEQ ID NO: 4223849 - RNA, 92 nt, Bordetella pertussis
cgccccgccggcgaugcggccggcguugaccaggcgauugccguugccggcgauccgcacgccgacgccgcccgcgcccgccgcgccgggcg

SEQ ID NO: 4223850 - RNA, 59 nt, Bordetella pertussis
ggagugccugcugcagcggcuggaacgccgcggcgccacgccgcuguccaggcagaucu

SEQ ID NO: 4223851 - RNA, 55 nt, Bordetella pertussis
gcccauauggugcaugccgcgucggucguccugaugaugugcaugaucauggggc

SEQ ID NO: 4223852 - RNA, 55 nt, Bordetella pertussis
auggcgucgggcgugcccuugggcgccacgaugccgaagaauacgcugacgucgu

SEQ ID NO: 4223853 - RNA, 60 nt, Bordetella pertussis
gaucagcgucaggggguucucgcgccaaagcgccgagaacaucuucuuguacgguguguc

SEQ ID NO: 4223854 - RNA, 81 nt, Bordetella pertussis
gccgguuuugccggcacgucgguggugcaggcgcacaugaccaauucgcgccugaccgaucccgaagugcuggagcugcgc

SEQ ID NO: 4223855 - RNA, 61 nt, Bordetella pertussis
gccggcgguggugcugcugacguccugccacagcgggcccgucagcgcgcgcgccgccagc

SEQ ID NO: 4223856 - RNA, 113 nt, Bordetella pertussis
cgcccuggccgcccggggccacgcgcgauucgagcucgccuugcuguaccuggaagaucgaaucgguaagcggcacgcgcuggaauuggcgcaggcgguuggcggccaccgug

SEQ ID NO: 4223857 - RNA, 87 nt, Bordetella pertussis
gcgggaacugcgcuccgguggcgcaggcaugguugggcaggaugcgcagccgcaugcccaccggaaagcgcgucgucacauccucgc

SEQ ID NO: 4223858 - RNA, 78 nt, Bordetella pertussis
gcggauaguccuugcuggcggcuuucauggccucggacucguccaggccgacgccgccgguaacgaauuggacacugc

SEQ ID NO: 4223859 - RNA, 67 nt, Bordetella pertussis
gccgcgucggcaugauguuccaggacuacgcccucuucccgcaccugagcgucagccagaacguggc

SEQ ID NO: 4223860 - RNA, 70 nt, Bordetella pertussis
gucgaacagcagcuggcuggucaccaugucguccaucaugugcgaauggaugccguaggcugcguacgac

SEQ ID NO: 4223861 - RNA, 129 nt, Bordetella pertussis
gccgcgauccugcuugccuccaagcugaugggcggcgccgggccugcuguucggcugggccaagccggugccgguggauuucgggcgccugcgccgucccaagaaggacaugcuguggguggcgcuggc

SEQ ID NO: 4223862 - RNA, 63 nt, Bordetella pertussis
uggcgauggggcccgggccgauggcguugaccgugaugccgucgccucccagcuccauggcca

SEQ ID NO: 4223863 - RNA, 61 nt, Bordetella pertussis
gucgcugaucgaucaguugcggcgcgaguucggcgucgcggugcugcugaucgagcacgac

SEQ ID NO: 4223864 - RNA, 108 nt, Bordetella pertussis
gcgcggccggcaucgagcccaaccgcgagcgcaucaccgagcuggucgagcguucgcugaugcuggugacugcgcucaacccgcacaucggcuacgacaaggccgcgc

SEQ ID NO: 4223865 - RNA, 61 nt, Bordetella pertussis
ugaucgagcacgacgaugugguuggaaaugcgcaugaccauuuucauaucguguucgacca

SEQ ID NO: 4223866 - RNA, 93 nt, Bordetella pertussis
acccgccauaucucgccugaccgcuacggggauuuccuggcguggaugcgccagggagaaauccuggcggccggguuuccgggauuccugggu

SEQ ID NO: 4223867 - RNA, 83 nt, Bordetella pertussis
cgcccccugcccccagggcaucgaggaagcccuggccgccgaaaugcaggcgcugggcuucgaggaugcccgugcaggccgcg

SEQ ID NO: 4223868 - RNA, 65 nt, Bordetella pertussis
ggccgccggccugcucaagcccucggccggcguggccgagcugcgcgggcaggccaucgacggcc

SEQ ID NO: 4223869 - RNA, 66 nt, Bordetella pertussis
gucgcgcugcuggccucgcugcugcuggggccgguggccgccggcaugggcgaggucacggcgcgc

SEQ ID NO: 4223870 - RNA, 129 nt, Bordetella pertussis
guuuuauacggcgcgauguucggaugcgcguugccggugcgcgugggcacccggccgcuguagaaguaguucggcgcgugcggaugcagcagcgacagcgcgcagucguacagcgugauguccaggaac

SEQ ID NO: 4223871 - RNA, 88 nt, Bordetella pertussis
ggcgccggccggcagcgugacggcgcgcugccaugccccguccgggcaugcauggcagaccgucacgcgcagcgaaccggcgggcgcc

SEQ ID NO: 4223872 - RNA, 58 nt, Bordetella pertussis
cuggcugcagccgcaagccagccugacgccgcaguggcuggcgcaguggcugggccag

SEQ ID NO: 4223873 - RNA, 130 nt, Bordetella pertussis
gcagaacgccaggauggugucgagccgcuggugauccucgcgcgucauguuuuccuggucgagcguggccagguagguggugauggcggucuccagcuuguccagcgcgcugucgagcuggcgugccugc

SEQ ID NO: 4223874 - RNA, 89 nt, Bordetella pertussis
gcagccgcgcgcacaggucgauggccuguugcgaacccugcacgaugaggaucuguccggguucacaggcuaucccgcgcgcgcgccgc

SEQ ID NO: 4223875 - RNA, 74 nt, Bordetella pertussis
gugggaaucagcaucgccagcgccaccaggccgaacagcggcagcaugucggcggugacgaugccggugccgac

SEQ ID NO: 4223876 - RNA, 75 nt, Bordetella pertussis
gcgaccacgacagcggcguguacguggcgcccggcauggucgcggcguaccgcgaucaucugcugucgcuggcgc

SEQ ID NO: 4223877 - RNA, 64 nt, Bordetella pertussis
ggugaugggaucgugcaccgccggcggcgcguacgugcccgccaugugcgacgaauccaucauc

SEQ ID NO: 4223878 - RNA, 92 nt, Bordetella pertussis
gagugguugacggaugagugcugugaacgucaguugcggcgggauuggguacccguacgcaccuggugcuuuauauaaaucugcgacgauuc

SEQ ID NO: 4223879 - RNA, 78 nt, Bordetella pertussis
gugauacucgccgaucacgaaaucgccauugaccagggcgucuucggcaugcgcgaggucgucgaucugcgaguacgc

SEQ ID NO: 4223880 - RNA, 85 nt, Bordetella pertussis
ugggucaggucgcugcccagcaugggguugacguuguccaggccgaucagcgacagcagggucggccccaugucgaucuggcuca

SEQ ID NO: 4223881 - RNA, 56 nt, Bordetella pertussis
gggccacgcccagcagcaggguccagccgauggcgaucagcgcguaggcguggccc

SEQ ID NO: 4223882 - RNA, 76 nt, Bordetella pertussis
acgcgcccgcgcuggugcugggcgcgcgcgacgaccagaucgugccguucgcgcugcagcagcagcuggcgcgcgu

SEQ ID NO: 4223883 - RNA, 60 nt, Bordetella pertussis
gcgcgcuggcgcacgcggcccucuucggaauugaugccguagagccgcaugucggcgcgc

SEQ ID NO: 4223884 - RNA, 79 nt, Bordetella pertussis
cggcggaaagaucuugcgcggcaaggccgccgacaugaacagguuguuggcggccaggcgcugcaggaugaggccgccg

SEQ ID NO: 4223885 - RNA, 93 nt, Bordetella pertussis
cguguuuccccucauucuuauauaaugcgucacgcgcuacuauucgcccaaguuaaguagcgcgucacgcauuacaugggcaagggcaacaug

SEQ ID NO: 4223886 - RNA, 55 nt, Bordetella pertussis
gucgccaucgcgcugcaggucggccgccagccggucgugcgugcgcgacggcgac

SEQ ID NO: 4223887 - RNA, 60 nt, Bordetella pertussis
caggggguagucaugggccagcaaguugucauuacugcggcgcauuggauguaucugcug

SEQ ID NO: 4223888 - RNA, 126 nt, Bordetella pertussis
gucgagcaguucccguacgaccugcugcccaugguggaaggcaauccggaacugaaggaggaagcgcucaguccggugggcuacuucaccauguaccgguucaacuucaaguacccgcccuucgac

SEQ ID NO: 4223889 - RNA, 105 nt, Bordetella pertussis
ggcggccagcuccaccggcgagugcgccgccagcaggcccagcaugaacucggcggccugcucggcggucaguucgccgcgguuguagcgcuccaucaggucguc

SEQ ID NO: 4223890 - RNA, 76 nt, Bordetella pertussis
cgcgcgcuuguaggccuuguuggcguccugcacgcgaaagccgauggcgcagaucgacgggccgugcaggcgcgcg

SEQ ID NO: 4223891 - RNA, 75 nt, Bordetella pertussis
cagcuugggcgccucuuccgagaaccgaguauucacagcggugaacaccggguucucgggauaggcgcuaggcug

SEQ ID NO: 4223892 - RNA, 85 nt, Bordetella pertussis
uccagccacgagccgcgguagggaaucacgcgggccgagaacagcagcuugcccgagcugugcgucuugccgcggucgugcucga

SEQ ID NO: 4223893 - RNA, 121 nt, Bordetella pertussis
gucggcgcggccgaucugcaccagguugaacaucuccugguucuucuccaccucgacgcgcugcaccuuggggaagugcuccuucagauaguugaccgacuuggugcccaccugcaccgac

SEQ ID NO: 4223894 - RNA, 59 nt, Bordetella pertussis
uacgccgccuggcuccauaugcgccugaucaagggccugcgcggcaccauggcggcgua

SEQ ID NO: 4223895 - RNA, 63 nt, Bordetella pertussis
ggcgcgccaggugcaggccgcgcuggccgcggcggauccggcgcugcuggcgccuggcgcgcu

SEQ ID NO: 4223896 - RNA, 66 nt, Bordetella pertussis
cgccacguggaugccggugaaggcgaaaccgacccguucgaccgaauacaggcgcuucauguggcg

SEQ ID NO: 4223897 - RNA, 58 nt, Bordetella pertussis
cgggcaagggcgggguguccuaccugcucgaacaggagcacggccuggucuugccgcg

SEQ ID NO: 4223898 - RNA, 55 nt, Bordetella pertussis
augcuuugaccauagaggucaugcgacgggcgcacgaccuugccggucgacgcau

SEQ ID NO: 4223899 - RNA, 86 nt, Bordetella pertussis
gcguccaucuggaccgcgcgcgacgacagcggcgagcgcggcgauacgcgccgccuggcccacaucgucgcgcuggggcaggacgc

SEQ ID NO: 4223900 - RNA, 65 nt, Bordetella pertussis
gccaggccgacgaacgcagcaugucgaaguugggccgcggcaggcggcggaagucggccuacggc

SEQ ID NO: 4223901 - RNA, 87 nt, Bordetella pertussis
uggccgagcccgggcugguaggcauuucggccggcggcgcgaugggcgcggugcuggccaucgugcugaccuccggcggcuucgcca

SEQ ID NO: 4223902 - RNA, 76 nt, Bordetella pertussis
gccacgcaaugugcgguuggccgaggcgcccagcuauggcaugccgggcgugguguaugaccgcgcgucgcgcggc

SEQ ID NO: 4223903 - RNA, 121 nt, Bordetella pertussis
gcgcgagggcggccggccguuggcgggccgccgcaucgccgucauggccgaagaaaacuauccgcuggccgucagcgccgauguggcgcuggccgugcggcaggcggccgacaccuugcgc

SEQ ID NO: 4223904 - RNA, 69 nt, Bordetella pertussis
uggccggcggcaugcacgagggcaagguguugcgcauccagggccuggccucgagcaugagccugguua

SEQ ID NO: 4223905 - RNA, 130 nt, Bordetella pertussis
caccgcggcgucgccggcgccggcguccugccccagcgcgacgaugugggccaggcggcgcguaucgccgcgcucgccgcugucgucgcgcgcgguccagauggacgcggaaucguuggccacgcucaug

SEQ ID NO: 4223906 - RNA, 88 nt, Bordetella pertussis
gugcagcggaauugucaucgcggaucgcuaggaugcggggggucauacccacgccaccacgcgauccggagggaauacuggcaugcac

SEQ ID NO: 4223907 - RNA, 55 nt, Bordetella pertussis
ggcgccaguuguccaugaaccacaugccgacggucaucgacgaucucugguugcc

SEQ ID NO: 4223908 - RNA, 59 nt, Bordetella pertussis
caacuggccggcgccgagcgcaucgucgacgccgcggugcggcgcgcgccggccgacug

SEQ ID NO: 4223909 - RNA, 96 nt, Bordetella pertussis
cguccgcgaugcgcuuggugguguccauguaggacugcgaaacguugguuucguuguucagcgugcggcagaucgugaacagcacguccucggacg

SEQ ID NO: 4223910 - RNA, 58 nt, Bordetella pertussis
ggcuggauucgcguuuuuucagcgucagcuacgagcuggcggaaggcgaguucuagcc

SEQ ID NO: 4223911 - RNA, 100 nt, Bordetella pertussis
cgccguggccgcggccgagcuggcggugcuggccggggccgaacggaucgaggggugccuguucggcaacggcgagcgcaccggcaacguggaccuggug

SEQ ID NO: 4223912 - RNA, 81 nt, Bordetella pertussis
ggcgucggugucgggaucgucauugaacagcuugagcacgucgacgugcuucaggccguugaugggaucgccgccgaugcc

SEQ ID NO: 4223913 - RNA, 55 nt, Bordetella pertussis
ucgaccugcuugccggccuggucgacgauccacacgcgggccagcugcaggucga

SEQ ID NO: 4223914 - RNA, 87 nt, Bordetella pertussis
cggcgcucauucaugcgggcgcaggccgggcgcggcauugaucgcgucgaccuuggaauggaccugcagcuugcgguagaugcgccg

SEQ ID NO: 4223915 - RNA, 66 nt, Bordetella pertussis
cuugcuggacgcgggaucuaugcugggcgugucgaugccgaucagcgugacgccgcguccggccag

SEQ ID NO: 4223916 - RNA, 84 nt, Bordetella pertussis
gcgcugagcguggacagcagcgauggcccgcuggcgacgaccucgacgccauugagcgccacgcugcugccguugcucacgcgc

SEQ ID NO: 4223917 - RNA, 61 nt, Bordetella pertussis
cgcacgcugaugcgccuugucgcgcgccagccaggcgcgacaggccucguguucggcggcg

SEQ ID NO: 4223918 - RNA, 64 nt, Bordetella pertussis
ggccuggguggccuggguggccagcugcguggcgacgcgcugccggaaacccgggcuuucgguc

SEQ ID NO: 4223919 - RNA, 71 nt, Bordetella pertussis
cgguaaggcgcgaagugggguugaucggaaucaauaaccgaauuguacgagauagccccguucgcgcaccg

SEQ ID NO: 4223920 - RNA, 59 nt, Bordetella pertussis
ucgguauuguggauguggcugccgacgaagcagaccaggcggccgucgcggaacaccgg

SEQ ID NO: 4223921 - RNA, 65 nt, Bordetella pertussis
ucgauccaggccaggucgccauggccgcccaggaugcggguggccaggucgauggccuggugcga

SEQ ID NO: 4223922 - RNA, 55 nt, Bordetella pertussis
uggccgacggcggcgaaggcacgguccaggccgugcuggccgccaccggcggcca

SEQ ID NO: 4223923 - RNA, 78 nt, Bordetella pertussis
ggcuggccaggcggccgcgcaacggauacagggucucggugcgccgggccagccguugcagcaccgccuggccgugcc

SEQ ID NO: 4223924 - RNA, 80 nt, Bordetella pertussis
ggcugcgcgccacgacgucgguaaugcugccggggggaaacggcaccaccaugcggaucgggcguucgggauaggcggcc

SEQ ID NO: 4223925 - RNA, 57 nt, Bordetella pertussis
augguggaccagcucgggcuggaagugggcuaccgccugaucccgcuggucgaccau

SEQ ID NO: 4223926 - RNA, 57 nt, Bordetella pertussis
gggcuggccguaucggcccugcauuucuacgaagccaagggguugaucgccagcacc

SEQ ID NO: 4223927 - RNA, 70 nt, Bordetella pertussis
ucaccaugaaccacggcuuccauggccgcacgcuggccaccaugucggccucgggcaagccgggcuggga

SEQ ID NO: 4223928 - RNA, 87 nt, Bordetella pertussis
gaccaccagccgcuggcccgccuggaagcgcuugcgcgcggugcggcaggccgcgcgcaggcgguccggagcgccgaaggcgaaguc

SEQ ID NO: 4223929 - RNA, 61 nt, Bordetella pertussis
ggccgaaaugcugaucgcccgccugccgucgcuggagcaggugcgccuggucagcucgggc

SEQ ID NO: 4223930 - RNA, 82 nt, Bordetella pertussis
cgccgacacgucgaugaaccgccacaccuacgaggcggcgcugcgcgccgccggcgccgggguggcggcggucgacgcggug

SEQ ID NO: 4223931 - RNA, 78 nt, Bordetella pertussis
agccccgccaccagcgcggcgucuccagcgagccggggguguauuuucuuggccugcccuggcugucgcggcguggcu

SEQ ID NO: 4223932 - RNA, 76 nt, Bordetella pertussis
gcggcggucgacuacguggggguauccaaccucuucaccuucaugaacaccauaccgcccuacuggaagccgcugc

SEQ ID NO: 4223933 - RNA, 83 nt, Bordetella pertussis
uucucgagcugggcgacgauuuccggcugauggcgguggccggccacgccauaggccuugaaguugucgcucgccucggagaa

SEQ ID NO: 4223934 - RNA, 103 nt, Bordetella pertussis
uggcuggcauugaucuuccgauugaaagccauguccugcaggccuuugugagcgaacccgucaagccuguccuggacacggucgucaccuauggagccggcca

SEQ ID NO: 4223935 - RNA, 66 nt, Bordetella pertussis
ccugcgccauccaggccgcgcgcagcagccacuggcacugcgugcaauacuggauggcgaugcggg

SEQ ID NO: 4223936 - RNA, 129 nt, Bordetella pertussis
cguccggcuuacuugcgguaggcaucgagcagcugcuggccgucggcgccggcuuucuugcuccaguccgagaccaugguggcgccgauggccugcagcuccuuggccaguugcgggggcagcggcucg

SEQ ID NO: 4223937 - RNA, 105 nt, Bordetella pertussis
gcugcuggcgaugcguuugcaggcguucaugcggcguuggcgucgagcaugccggucacggcgugcagggcuuccagcgucacgggucggucgacguccagcagc

SEQ ID NO: 4223938 - RNA, 62 nt, Bordetella pertussis
ggucaugcgggccgauggcgugcgcgucaugcugacccagcgcgccgcgcaccugcacgacc

SEQ ID NO: 4223939 - RNA, 68 nt, Bordetella pertussis
gcaucggcuaugcccugcuggcggccgggcagcccgacgccguggccgccuacgggcaauggcugggc

SEQ ID NO: 4223940 - RNA, 122 nt, Bordetella pertussis
gcaugucgggauugcgucaggccuugcggcccggaaaucgcggcagucgggguauccaugcuugcuggccuugggccggcgguucuggcaccgcaccgucugcguuucaacauccgaugugc

SEQ ID NO: 4223941 - RNA, 129 nt, Bordetella pertussis
ugcgcggcuucucgaaguacacgcgcaugacgaugagcaggucgucggccagcgugucggccgccuccuugagcuggcgcgcguacuccauggccuguucguggucguggauggagcaggggccgacca

SEQ ID NO: 4223942 - RNA, 58 nt, Bordetella pertussis
gggcgucagcgcgcuggcgcugccgcgcgaggucgagcaggugcgcgcgcugucgccc

SEQ ID NO: 4223943 - RNA, 72 nt, Bordetella pertussis
gcgccguagcgaacgccgaugucgacccgcugggcgacgaaguccacgggcuugagguugguuuccaggcgc

SEQ ID NO: 4223944 - RNA, 56 nt, Bordetella pertussis
gcgcgcggcgccggcaggcccgcccuggucgauggcguccugcugcgccagcgcgc

SEQ ID NO: 4223945 - RNA, 118 nt, Bordetella pertussis
gaucucguucauccugcugggcgcggccuaucucaccagcgcgaugagcuucaccggccugccggccaaccuggccgaguggaucucgucgcugggccugagccaguauggacugauc

SEQ ID NO: 4223946 - RNA, 78 nt, Bordetella pertussis
aucugcgacuucuucgaguacaugaucgacgauccgcugacgcgcgucaucacgauguaugucgaagguuucgucgau

SEQ ID NO: 4223947 - RNA, 57 nt, Bordetella pertussis
cccgugcaccgagauggcguagcgcucgcgcagccacgccagcugcgcgugcgcggg

SEQ ID NO: 4223948 - RNA, 79 nt, Bordetella pertussis
ggcauggacuugaaggaggccgcgcgcgucagggaggaaacgggcgaggacgucgugcggucguucaaggauccguucc

SEQ ID NO: 4223949 - RNA, 75 nt, Bordetella pertussis
gccuucgcgggcgcggccuuccugcaucugcgccagcgcuugcugggcggccugcaugcaggccgcgccccaggc

SEQ ID NO: 4223950 - RNA, 56 nt, Bordetella pertussis
cgcgguugccggcgccgcagacgcucaccgacagguugcggaucgccagcaccgcg

SEQ ID NO: 4223951 - RNA, 72 nt, Bordetella pertussis
ucagcgccaugauggucuggccggggccgccggccaggcuggcggccagggccaggccgauauagguauuga

SEQ ID NO: 4223952 - RNA, 66 nt, Bordetella pertussis
uuugcgcagcgcgucaacgcggugaccgaggcaucccggcgccccgcgauggcgcagcccagcaga

SEQ ID NO: 4223953 - RNA, 87 nt, Bordetella pertussis
cgcgccguauaccggauggcguugucgaccagguugcucagcgccucgcgcaacagccacucgacagccuguacccggaccggcgcg

SEQ ID NO: 4223954 - RNA, 56 nt, Bordetella pertussis
cugggcaccgacgugcugcggaccgccgaggccaucgucaacgugucgguguccag

SEQ ID NO: 4223955 - RNA, 89 nt, Bordetella pertussis
ucgaucgccaaggcguugaccgcguugaagggcggcacgccgccgcagcuggccgugcugcugucgaccgacauguucacgcugaucga

SEQ ID NO: 4223956 - RNA, 61 nt, Bordetella pertussis
ccggccugaggcccgauggcggggauggaguucagcagcucgcagucuugcuugaggucgg

SEQ ID NO: 4223957 - RNA, 78 nt, Bordetella pertussis
cggcgcgcgcgucgcgccccagcguggcgcgcagcucuuccuggcuuugcgccaucucggcgcgcagcgcgcgcaucg

SEQ ID NO: 4223958 - RNA, 64 nt, Bordetella pertussis
gauggcgggcaaaaaccuucaggaccgagaauucgccggucgugaucggcaccugcucgccauu

SEQ ID NO: 4223959 - RNA, 66 nt, Bordetella pertussis
gcccuugagccggcacgcgcagcugaauuccugccauugcgaguugcuggcggccggcuugugggc

SEQ ID NO: 4223960 - RNA, 83 nt, Bordetella pertussis
cgucacgccgaugucgggcaggcgcagggccauggccaugggcgugccggccuugcccgcgccgaugucgucauagugcgacg

SEQ ID NO: 4223961 - RNA, 55 nt, Bordetella pertussis
cgacaggccgcucuuggugaugauguagccguccuucaucucgagcuggccuucg

SEQ ID NO: 4223962 - RNA, 71 nt, Bordetella pertussis
ggcgcggcguccuacaacaugaagcugccgccauucacgucgaugguggcgcccgugguguagcccgcgcc

SEQ ID NO: 4223963 - RNA, 71 nt, Bordetella pertussis
gucgaggacuggauugauggccggcgccaggcucccgauggcaggcgcgcggcuuaauccaguuucuuggc

SEQ ID NO: 4223964 - RNA, 60 nt, Bordetella pertussis
augcauacaaccuauugaaucuucacagcuaggugugaacugucaauagguuguauucgu

SEQ ID NO: 4223965 - RNA, 67 nt, Bordetella pertussis
ccggagccugguacccguggggcauugugggccugcgggagauggugcccggggagccaggcaccgg

SEQ ID NO: 4223966 - RNA, 80 nt, Bordetella pertussis
cgacuugacgaugaagaucgacagcacgccguagcccagcaagggaccggccagguugccgaucuuguccaucaggcccg

SEQ ID NO: 4223967 - RNA, 69 nt, Bordetella pertussis
gcuucauggggguguggcaggggucgugauacauguagcgcacgcccugcacgccguccagcuugaugc

SEQ ID NO: 4223968 - RNA, 118 nt, Bordetella pertussis
ucgaggcgggccaggcccugggcauccugcugggcggcggccugggcgcggcugcgcucggcgucggccucgggcacgcgcccuuccaggguggccaguucggcuugcgccgccucga

SEQ ID NO: 4223969 - RNA, 58 nt, Bordetella pertussis
gggcacgcgggucgagguauugugcggacagcccgaacagaaccacggcuugcggucc

SEQ ID NO: 4223970 - RNA, 58 nt, Bordetella pertussis
caguucaucgugcgccagcaggucgaacuccaauccauccugcucgaccgacggacug

SEQ ID NO: 4223971 - RNA, 58 nt, Bordetella pertussis
gcggcggaugaucuugucgucgaugucggugauguugcgcacguagucgaccgccagc

SEQ ID NO: 4223972 - RNA, 126 nt, Bordetella pertussis
ucgccaggaaggccacguuccauaccgaugacugcaacagccccugggucugcucgaucugcaggccguagacggccgugcgcaaggcauggcccagggcggccacgguggcggucaccccggcga

SEQ ID NO: 4223973 - RNA, 57 nt, Bordetella pertussis
gccggugcucagguagcggacgcugacgucggcgauuccguacagcgugacacuggu

SEQ ID NO: 4223974 - RNA, 67 nt, Bordetella pertussis
ggccugcggcgcggcgacgcugcgguccagcgggaaguggcccagcgaauuguugcgcggcagggcc

SEQ ID NO: 4223975 - RNA, 57 nt, Bordetella pertussis
ggccauguucgucauguuggcgcugcuggccuucuuccccgaccuggcgcuauggcu

SEQ ID NO: 4223976 - RNA, 55 nt, Bordetella pertussis
gcggguaacugugccgaauuccgguccgaccaagauaccggcacgcuucaccugu

SEQ ID NO: 4223977 - RNA, 56 nt, Bordetella pertussis
gccgcugucgcuguucgcgcugcgcaacgucgccaccgccaacaucgucggcgugc

SEQ ID NO: 4223978 - RNA, 56 nt, Bordetella pertussis
ccgccgagcaguucauccaggccgacccguuccaccuggccgggcuguucgagcgg

SEQ ID NO: 4223979 - RNA, 59 nt, Bordetella pertussis
cgucggccagcgcuucgacgcggcgcguggcgcgcacccgcucgaugcgcggcccgacg

SEQ ID NO: 4223980 - RNA, 84 nt, Bordetella pertussis
ccugguuggcgaauaucucgucgaucgugguacggccgguaaaggcccggucguacgucacgaugggguauucggccagcuggg

SEQ ID NO: 4223981 - RNA, 83 nt, Bordetella pertussis
guuguagguccaguacaccaggucgucguagcgggcggcggcgcguucgccgcagccguugaucugguucaugucuuuccagc

SEQ ID NO: 4223982 - RNA, 106 nt, Bordetella pertussis
gccagcuugucgcggccgcgguugcucagggcguacagcuuccugucgucgaaggugaagaaggccgggcugacgcucacgcgguagucgguggugaugagcgggc

SEQ ID NO: 4223983 - RNA, 81 nt, Bordetella pertussis
uaugcggccguugaagucguauucgccgcgcagggugccgaacacgucgcguucguuggaguacgaccagggcugggcaua

SEQ ID NO: 4223984 - RNA, 65 nt, Bordetella pertussis
ugguuucgacgucgggcagcagguggcgguucaugccggccaucuggaacucguacucgaaaucg

SEQ ID NO: 4223985 - RNA, 63 nt, Bordetella pertussis
cgcgcguguugcgcaggucggggcaguuuuccuugaacgucaggcccaucagcagcacgcgcg

SEQ ID NO: 4223986 - RNA, 95 nt, Bordetella pertussis
cguggcgcgccucaacggcagccuguuucuguccuaccggccgccacagggcugguacggugaaaccggggugaccuucgugggugcgcgcuacg

SEQ ID NO: 4223987 - RNA, 55 nt, Bordetella pertussis
ggacgucaagccggucaacaucgacguggugucgcuggacuggaaguggcuguuc

SEQ ID NO: 4223988 - RNA, 70 nt, Bordetella pertussis
gcugaacuacaauagcgggcuguucgggccccgccuucaggcggggcugaccagcccguuuucuuuuggc

SEQ ID NO: 4223989 - RNA, 59 nt, Bordetella pertussis
ccuggccugcuucccagcgggcgaauggauccgugucgugcgccgacagcagcgccagg

SEQ ID NO: 4223990 - RNA, 60 nt, Bordetella pertussis
gguggcgaggugcuggccgugguucccaacaaugaggccggggugcugcgcuuugccgcc

SEQ ID NO: 4223991 - RNA, 56 nt, Bordetella pertussis
cgaucaauuccugcguaucacgguggguacggacgcccaaugcgaggcguugaucg

SEQ ID NO: 4223992 - RNA, 58 nt, Bordetella pertussis
ccguuggggcugcggcccacggccugcagcaccaggucguagcgcugcggcuccuugg

SEQ ID NO: 4223993 - RNA, 60 nt, Bordetella pertussis
ugggccguugcgccaccccuacgacgucgaggacguggucggguucgugcgcaaggucua

SEQ ID NO: 4223994 - RNA, 82 nt, Bordetella pertussis
cccggggugccggggugccugucccagcggggacaggcacauggauuccugcgggggcaggcaccccggagaaguuugcggg

SEQ ID NO: 4223995 - RNA, 57 nt, Bordetella pertussis
gcugggcguggcccugugcgucgagcccaucgucuuccgcaccgagggccuguccgc

SEQ ID NO: 4223996 - RNA, 82 nt, Bordetella pertussis
gauggacgugauggcgcuggagaugcuguugcugcgcguggccacgcaggcggccggcgcuccggggccggaggcguccauc

SEQ ID NO: 4223997 - RNA, 94 nt, Bordetella pertussis
cggcaagucgaccacgcugcgcaugaucgccgggcuggauacgcccaccuccggccggauccgcaucggcgaccgugacgucaccgaccugccg

SEQ ID NO: 4223998 - RNA, 70 nt, Bordetella pertussis
uggguuucgacaugcgugccuuccggacugagugaaauacagucgugcaagagcaugcauaucggacgcg

SEQ ID NO: 4223999 - RNA, 78 nt, Bordetella pertussis
cgguggucagcuuggccagguucucgaugguggcgccgcgccacgcguagauggccuggucgucgucgcccacugccg

SEQ ID NO: 4224000 - RNA, 113 nt, Bordetella pertussis
gcuggcgcagcauuucuuccaguugcgggcgcaccugguccauggcggggaauucgaccggacggguaucgucgaccuggaucacgugccagccgaacugggucugcaccggc

SEQ ID NO: 4224001 - RNA, 79 nt, Bordetella pertussis
ccgaucgucggcgccaguugcgauggcgguuaugccgagaugaugcuggcgcgcgccaccggacuggugucgaucccgg

SEQ ID NO: 4224002 - RNA, 69 nt, Bordetella pertussis
acgguugccgacgaagcacaugauggacaggccgcuggccgcggccugcgucagcaugugcucgaccgu

SEQ ID NO: 4224003 - RNA, 70 nt, Bordetella pertussis
ggccgggcugcgcaauacgcugaugguggccgcccuggccaccaucgucacgcugcugugcggccugguc

SEQ ID NO: 4224004 - RNA, 56 nt, Bordetella pertussis
ccuggccgacggcgauggcgucucgccccugcgccacgcccgccagcgcggccagg

SEQ ID NO: 4224005 - RNA, 71 nt, Bordetella pertussis
gauguucccaagugggggcugucgggaaucguggaagacuacgauccucgugcgcuccggcuuacuacguc

SEQ ID NO: 4224006 - RNA, 124 nt, Bordetella pertussis
cggcacgcuggcgcaugccuggcuggcgcgcaucggcggcgacggcccgcagcacuggucggccgaugcgcuggccguacgccugccggccaugcggcgccagcugacccgcgccggcaucccg

SEQ ID NO: 4224007 - RNA, 66 nt, Bordetella pertussis
gccggcuccagagagucagcgucaacacacuuggugguuucguaccccauggcgcugacggcccgc

SEQ ID NO: 4224008 - RNA, 60 nt, Bordetella pertussis
ggcgggguuacucuugcagcugccuaguuucuuuuucguugccgcaugucugacucugcu

SEQ ID NO: 4224009 - RNA, 91 nt, Bordetella pertussis
cgccaaggagccgaucuccauggaaacgcccaucggugacgacgacgacucgcaccugggcgauuucaucgaagacaccgccacccuggcg

SEQ ID NO: 4224010 - RNA, 85 nt, Bordetella pertussis
ggccgcgugcccuacaagggcagcgugcuggccaucaucuaccagcuggugggcggcauccgcgccucgaugggcuacugcggcu

SEQ ID NO: 4224011 - RNA, 97 nt, Bordetella pertussis
gccaugaaaucuugcgggugccagucccccaguggggacaggcaagcaauuggcgggugccagucccccuguggggacaggcacccggggguuaggu

SEQ ID NO: 4224012 - RNA, 130 nt, Bordetella pertussis
gccuucggccugcaucgccguggccaggucgcgggcguauuccaugccgcccuuggcggcgggcgugaggaucaguucggcgccauaggcggucauggcggcccgccgcucgagcgacagguugucgggc

SEQ ID NO: 4224013 - RNA, 85 nt, Bordetella pertussis
cgcgcuuuaccgucugcgagacgggcuuuggcauggggcugaauuuucucacccuguggcaagccuggcgugacgauccggcgcg

SEQ ID NO: 4224014 - RNA, 79 nt, Bordetella pertussis
gaucgagcuggucaacgcgccgucgccggccaaucccaagacuucauggcugguggcgcauagcgugcuggccacgauc

SEQ ID NO: 4224015 - RNA, 62 nt, Bordetella pertussis
ggcgguggucgccucgucggugggcacgaagcgcgcgcgcccgccgaacagcagccgccgcc

SEQ ID NO: 4224016 - RNA, 79 nt, Bordetella pertussis
cugcacgaucagcggccuggugcuguuccuguucaaggcgcgccgcgccaacgaggagcugcgccacccgcugcugcag

SEQ ID NO: 4224017 - RNA, 60 nt, Bordetella pertussis
ccugggucggccugcacgaaggccuguaccgccaguaccagcgccugcaggccgccgagg

SEQ ID NO: 4224018 - RNA, 104 nt, Bordetella pertussis
gcaucaugaugaccgccguggugguggcgaugaucgugaugaugguggccagccggccgcugauggccuucguggcucgccauccgaccguggugauccugugc

SEQ ID NO: 4224019 - RNA, 55 nt, Bordetella pertussis
cagggcgccgguguaauaggcauucagcuucucgaugaccgcaucgggcguccug

SEQ ID NO: 4224020 - RNA, 77 nt, Bordetella pertussis
guggcggaaguggcgcgugccggucaggaccauggcgaugccaugcucguccgccgccgcgaucacuucgucgucgc

SEQ ID NO: 4224021 - RNA, 61 nt, Bordetella pertussis
cggcgucaaggcgcugcugcgcgaaaccaaccagcagcucgccaagcagcgccgcacgcug

SEQ ID NO: 4224022 - RNA, 75 nt, Bordetella pertussis
gcgcggcgguuguccggguccaccaggcugaggucccacguuucacagccuugguauagauccggcacgccgggc

SEQ ID NO: 4224023 - RNA, 72 nt, Bordetella pertussis
gcaucggcaagccgcuggugaccgagggcgcgcuggucgaggcgaccucggccacccagauggcgacggugc

SEQ ID NO: 4224024 - RNA, 78 nt, Bordetella pertussis
gcggcacgaccuugaucuugcuggcgucgccgaacaccgccgcggcgacggcacggcacaggucgacguccaggccgc

SEQ ID NO: 4224025 - RNA, 68 nt, Bordetella pertussis
cuagacgcggaaucggccccucagcguuccagauacagaacgcugggggggaccguccgccguuucag

SEQ ID NO: 4224026 - RNA, 84 nt, Bordetella pertussis
gcgucuggcgccgcugcaggucgcucugggcgcgcuucaggucggccugggcgcgcgcgaucucggccugccgcacgucgaugu

SEQ ID NO: 4224027 - RNA, 82 nt, Bordetella pertussis
ucggugccgccggcaugcugguugucaccggccagcaccagcgugccugcgcccuccuugaccagcgugccggcgccagcga

SEQ ID NO: 4224028 - RNA, 77 nt, Bordetella pertussis
cggaaaaguacgcgucgacgaccaggccggugcgcuccugcagcauccggccguggccgucgugcagcaguuuuucg

SEQ ID NO: 4224029 - RNA, 74 nt, Bordetella pertussis
gccugccgauccgccaggucgucgcgcuggaaggcaagaccuacuccaccgacgccuggcaggaaugguacggc

SEQ ID NO: 4224030 - RNA, 66 nt, Bordetella pertussis
ggcgccgcugaacuacugccaccugcugauggccgucgccuucagcaccuucugguucggcaugcc

SEQ ID NO: 4224031 - RNA, 78 nt, Bordetella pertussis
ucgguauuccugggcgugcugcugcuggaccugaucaucauuaccuacgggccggugcuguacgcccgcuuuuucuga

SEQ ID NO: 4224032 - RNA, 77 nt, Bordetella pertussis
ggcgcaccguauguucgggguugaguucgggcuccugcggcagguagccgauguucagccccggcauggggauggcu

SEQ ID NO: 4224033 - RNA, 84 nt, Bordetella pertussis
ccggccggcaccgucagcgcgaacuuguagcggcuggccagcgacagcggcuggaaaucgcgcugcgcgucguagccgggcugg

SEQ ID NO: 4224034 - RNA, 128 nt, Bordetella pertussis
gcguggucaacggcacgaaguaccucgacuggcugaaguccuucgccgacaauuggcgcggcugccaggcgucgguguaggcguaggucuucagcggcgaccgguuugcgcucgcgucgguggccugu

SEQ ID NO: 4224035 - RNA, 60 nt, Bordetella pertussis
ccggccgaacgcauuaccagggcuaugcuccacggcauagcccuuuuguuuucggaccgg

SEQ ID NO: 4224036 - RNA, 58 nt, Bordetella pertussis
cgagccgaccagcggcgugggguaccaguaauagaacaccacguccugcuugcgcuug

SEQ ID NO: 4224037 - RNA, 59 nt, Bordetella pertussis
ugucacgcacaugcgcgggauucagcugcaggaggcuggcgauuucggugugugugaua

SEQ ID NO: 4224038 - RNA, 61 nt, Bordetella pertussis
cgaugccgcggccgacgagcuggccggcuggcuggccggccgcgucgcggccgccggcgcg

SEQ ID NO: 4224039 - RNA, 71 nt, Bordetella pertussis
gccaggccggcgccuugaccugcgacgugguauucgacaauugccgggugccggccgaggcgcugcugggc

SEQ ID NO: 4224040 - RNA, 130 nt, Bordetella pertussis
caccgcgccggaagugccgcccaucgaggugguguuccagcccucucccacccccuugaacccgcugggcgucaagggcgugggagagugcgccaccauuccgguggccguggccguggucggcgccgug

SEQ ID NO: 4224041 - RNA, 96 nt, Bordetella pertussis
acccgcgugacaccguauugaucgcccgcugcuuccggcaagacgcccgcuucaugcgggcguuuuuuugcggcggcgggucgggagucggcgggu

SEQ ID NO: 4224042 - RNA, 62 nt, Bordetella pertussis
gccgcugcuggugcugggcuuugccagcggccugccgcuggcgcugagcagcggcacgcugc

SEQ ID NO: 4224043 - RNA, 58 nt, Bordetella pertussis
gaccgaugagaucgccgaagucgccgcacugggcgucgaacuggccaucgucaucggc

SEQ ID NO: 4224044 - RNA, 70 nt, Bordetella pertussis
uggcggggcuggucgauggcaugcuugugcccgauguccugcgcagcgugccggcggcggucguaaacca

SEQ ID NO: 4224045 - RNA, 74 nt, Bordetella pertussis
gcggaacaugucgaagcuggcgcaggccggcgacaacagcacggcaucgccgggcugcgccagcucggcggcgc

SEQ ID NO: 4224046 - RNA, 63 nt, Bordetella pertussis
gccgcuggucggcaccggcgucgagcgcaccguugcggucgacucgggcacgaccgugcaggc

SEQ ID NO: 4224047 - RNA, 76 nt, Bordetella pertussis
cggguucuggaaguugggcacgacgacgacggcgcgaacguucgcgugcgucugcagugccagcuccagcgccucg

SEQ ID NO: 4224048 - RNA, 73 nt, Bordetella pertussis
cggugugccugucccagcggggacaggcacccgcacgggcaggcgccuguccucaugcgggacaggcacgccg

SEQ ID NO: 4224049 - RNA, 94 nt, Bordetella pertussis
uggggguggucauggcuguguauuaugccaagccggcgcggcgcccgugaggcaggcucuacaauacgcgccauggaaaaaguacgcaucucca

SEQ ID NO: 4224050 - RNA, 110 nt, Bordetella pertussis
ggccgacaucaagcugcagugacggcgcgcgcggcgcucaguacacgucgcggcgauagcgcccggcgugcugcagcgccugcagcugcgccgggccgaggaugucggcc

SEQ ID NO: 4224051 - RNA, 58 nt, Bordetella pertussis
ccacggacacgggcauggccacgcgccggugccggccgggcuggacccggguccgugg

SEQ ID NO: 4224052 - RNA, 57 nt, Bordetella pertussis
gaccaggagcugcgccagcagcggcugaucuggguggugcuggcgcuguccugcguc

SEQ ID NO: 4224053 - RNA, 65 nt, Bordetella pertussis
ggcgcgcgcggcauguucgucgaagucgcggucggcguucaaggugacgaacacguugucgcgcc

SEQ ID NO: 4224054 - RNA, 88 nt, Bordetella pertussis
augaccucggggcugcgcacccgcuugacguacuccagcgccuccuugauggcgcuggcgguuucggcgggcagugcggccgaggcgu

SEQ ID NO: 4224055 - RNA, 129 nt, Bordetella pertussis
agccuucguaagucuguccggcaccguggcggaccaugugcgagccgcucaggcccgcgguuacgccgacgccugccgcggccugcauggcguucgcgccggcguugauggucuggugcaguuggaggu

SEQ ID NO: 4224056 - RNA, 109 nt, Bordetella pertussis
gucggugggcgaagucauggccaugggccguacuuuccaggagucguuccagaaagcccugcgcggccuggaagucggcguggacggccugaaccagaagaccaccgac

SEQ ID NO: 4224057 - RNA, 96 nt, Bordetella pertussis
gcacggccgccguggcgccgccggcgguggccgcgccgccguccggcgcgcuggacgccgucgaacagucgcugcugcaggcgcugcaggccgugc

SEQ ID NO: 4224058 - RNA, 94 nt, Bordetella pertussis
gacgaacuccuggacgcugggcgugcuggccauugcgcuggccgugggcgccggccaugccgacaccggcacggugcagauguggagcuucguc

SEQ ID NO: 4224059 - RNA, 56 nt, Bordetella pertussis
ccgcgccacgcgcguggucaagccgcaagccggucacuacgccaaggcuggcgcgg

SEQ ID NO: 4224060 - RNA, 81 nt, Bordetella pertussis
ugaagcgcguagccaggagauugcuacggcugagagcgagaucggguacgggugugcugcaaucucacugguuggcauuca

SEQ ID NO: 4224061 - RNA, 71 nt, Bordetella pertussis
augacgguggcguggcgcacgaugucgucguagauguuggcgugcauguccagcgucacgcccaccgggau

SEQ ID NO: 4224062 - RNA, 70 nt, Bordetella pertussis
gcgugccgccgcugcuggcgccguccuacgccgacaccgcgcugaugggccagaugagcggcgaggccgc

SEQ ID NO: 4224063 - RNA, 73 nt, Bordetella pertussis
cgccgaacucagcgucagguccuugccgacgacgauggccugcuuguugucgauauuuuccugcaccucggcg

SEQ ID NO: 4224064 - RNA, 96 nt, Bordetella pertussis
uggucaacagcggccugacccuggcgaucgugcugggcaugagcgucgacgauaucagcgccaacgccgucgccaaccucggguggcaggagaucg

SEQ ID NO: 4224065 - RNA, 58 nt, Bordetella pertussis
ccgaccgccagggccaccgcauuuccagcuccgaggugcgcaccgcccuggcgguggg

SEQ ID NO: 4224066 - RNA, 121 nt, Bordetella pertussis
cacgcccuugaacuugaucaugucgucggagcgcccgaugaugcguccgaucuugcgcaugccgcgccgucccgacgggcagucguaggggugcgacgacagccugaccaggucaugcgug

SEQ ID NO: 4224067 - RNA, 69 nt, Bordetella pertussis
ggcucguaugucaucgaaagcaaagugccccgggucggagaggaacugcagcguuucguggcgcggacc

SEQ ID NO: 4224068 - RNA, 57 nt, Bordetella pertussis
cggcgcugaugucgcgcccgugcaggcgcaccgugccggugcgcggaaucagcgccg

SEQ ID NO: 4224069 - RNA, 72 nt, Bordetella pertussis
gccagaccguggccucgucgucguccuggcaugccugcaucauggcgauggcgaagucgugguacgacaggc

SEQ ID NO: 4224070 - RNA, 70 nt, Bordetella pertussis
ucgcgcagcgucuccaggaagccggcgagcacugucagcggcgugcgcagcucgugcgagacguuggcga

SEQ ID NO: 4224071 - RNA, 87 nt, Bordetella pertussis
ggcggcgcgggccggcuggcgccggcccggcgucaaucgcgcgccagcgcgaugcccgaagccagcgccaggcggcgccgcuccgcc

SEQ ID NO: 4224072 - RNA, 129 nt, Bordetella pertussis
ggucugcacgccgaugaucucgauguccggcuugauggccuuggcggcgguggcgaugcccgcgaucaggccgccgccgccgaugcccaccacuauggcguccaggucugggcgcgccugcagcauuuc

SEQ ID NO: 4224073 - RNA, 66 nt, Bordetella pertussis
gggcggaacaucaccgucaugggcaucuggcgcgccagguagcgcgcggugauuucgaagcagccc

SEQ ID NO: 4224074 - RNA, 57 nt, Bordetella pertussis
gacaugcuugcgagcgacgggaucaaauuucuugaucagcaucuuuucgggcauguu

SEQ ID NO: 4224075 - RNA, 64 nt, Bordetella pertussis
agcgcgaggccggcgacgcggugugcguaugcgucucgcgugccugcggcgccagccucacgcu

SEQ ID NO: 4224076 - RNA, 56 nt, Bordetella pertussis
gcgacgcguuaggcuauggcuucguucaucgugaaugaggcccaugccaugcgugc

SEQ ID NO: 4224077 - RNA, 61 nt, Bordetella pertussis
cgggccaucgaacuguuccagcccgacgcccugguguugucgcugggcuucgauguguucg

SEQ ID NO: 4224078 - RNA, 82 nt, Bordetella pertussis
gcgggggcgcaggcgcgaugaaucccgaccgacugcugggcgaacccuugcgguugcccgauucauugugggcggccaccgc

SEQ ID NO: 4224079 - RNA, 62 nt, Bordetella pertussis
cggucagcgagcugugccagucggucggacugucgauuccggugggcaaggacucgcugucg

SEQ ID NO: 4224080 - RNA, 62 nt, Bordetella pertussis
ggcgcgcccgucuggugcugauacuguuguucggcggcuuugucgugcuggccgggcgcgcc

SEQ ID NO: 4224081 - RNA, 78 nt, Bordetella pertussis
ugacgcggugucggcgcugauuccgcgcaccggcacggugcgccugcacgggcgcgacaucagcgccgugcccgcgca

SEQ ID NO: 4224082 - RNA, 63 nt, Bordetella pertussis
ccuauaugcccaugucgcgccagcucgccgccggcugcgagcuggugcaccgcaucggcaagg

SEQ ID NO: 4224083 - RNA, 62 nt, Bordetella pertussis
gugcucgggcaugggauucguguccgugccgaucggguccgccacgaagacgugcucggcgc

SEQ ID NO: 4224084 - RNA, 69 nt, Bordetella pertussis
gugcugccgugcccggugcccggcguggcggcggccgucgccgccaaggccggccugggccaggcgcgc

SEQ ID NO: 4224085 - RNA, 75 nt, Bordetella pertussis
ggucgcugaccucgcgcgcgaagcccaucucgugcgucacgcagaccauggucaugccgucgcgcgccagcgauu

SEQ ID NO: 4224086 - RNA, 114 nt, Bordetella pertussis
cgggcgaucaggucuaagaaaggaucggcacgauuuuucgcuguucggggcagggcgccugcagacgcaguggaaaucgugcuagaauccucgacucuuuuggagaugugcccg

SEQ ID NO: 4224087 - RNA, 62 nt, Bordetella pertussis
gccgugugcuugaugaauggagaaauacgcauagcccucgugcuccgugugcggcgcgcggu

SEQ ID NO: 4224088 - RNA, 94 nt, Bordetella pertussis
ucgcgggcuacgcccugagcgacuacgguuucggcgcgucgcucucgcccgaugcgccgcccgagaagucgcucagccugggcaggaccugcga

SEQ ID NO: 4224089 - RNA, 63 nt, Bordetella pertussis
gcgcguugagcgccuugaccacgucggccagguuggcgcugguggucacgcgcugcagcgcgc

SEQ ID NO: 4224090 - RNA, 66 nt, Bordetella pertussis
ccauguccagcaaggccugcucggugggcgccuggcgcccggccagcagguccugcgccagcaugg

SEQ ID NO: 4224091 - RNA, 71 nt, Bordetella pertussis
uacucgcagaucgacgaccucgcgcaugccgaagacgcccuggucaauggcgauuucgugaucggcgagua

SEQ ID NO: 4224092 - RNA, 73 nt, Bordetella pertussis
gcugaacaccagcacgcauaucgacagcagcgcggccagccagccgcugcccgauucgugcgcgcuggccagc

SEQ ID NO: 4224093 - RNA, 75 nt, Bordetella pertussis
gcccgucggguccaugauggguggcgacgccgucgaugcgcuuggcggugcgcgaccagcccgucaccggcaggc

SEQ ID NO: 4224094 - RNA, 81 nt, Bordetella pertussis
cggugcagcuggccaugcguaugcugggcucggugggcaugcucgaccagcaucgcaugcguaccggcaagcuggucgccg

SEQ ID NO: 4224095 - RNA, 60 nt, Bordetella pertussis
gcuguacucggugaugccgacgguggacucgguccagcccggcaguucuucgagcaccgc

SEQ ID NO: 4224096 - RNA, 61 nt, Bordetella pertussis
gcagcuggacgugcgcagcaugcaauggcauagcgucaacgugccgcgcgauccggacugc

SEQ ID NO: 4224097 - RNA, 69 nt, Bordetella pertussis
ccgggucagguccacaucgaagucgccgaugcgcgcgcgugugaagucgaugugguacucgaggcccgg

SEQ ID NO: 4224098 - RNA, 69 nt, Bordetella pertussis
ccggcgaucacggcgcgcaggcacaucagcugcggagcggugauguggcugacggccgccaauugccgg

SEQ ID NO: 4224099 - RNA, 69 nt, Bordetella pertussis
cucggcaucgccagcaucaaacaacugccgaaccugacgcaaggccuguucgaucgggguuaugccgag

SEQ ID NO: 4224100 - RNA, 86 nt, Bordetella pertussis
uccaccgccuucaucaggccgauguugccuuccuggaucagguccaggaacugcaggccacgguugguguacuucuuggcgaugga

SEQ ID NO: 4224101 - RNA, 96 nt, Bordetella pertussis
uugcuuggcgcgccgcuucaugauggcgaacaucaacuccugcuugcgcaggcgguuggcguucucgauuuccaggccggcggccauuuccagcaa

SEQ ID NO: 4224102 - RNA, 92 nt, Bordetella pertussis
ggccggacugugggccgacgaccuggcgggcgcgcaguacgaacgcaugcugcgcuucgaccugucgucggucgugcgcaacauggccggcc

SEQ ID NO: 4224103 - RNA, 87 nt, Bordetella pertussis
gccgcgccgcauccggugcucgacggcgccagccugcgcgucgcgcccgggcagcgcguggccaucgucggcgccagcggcgccggc

SEQ ID NO: 4224104 - RNA, 78 nt, Bordetella pertussis
ucaagcgcgugcaucgcaauaucaacaacgaacuccgugucaucgguuuguugcgcgugauguucgacccgcgcauga

SEQ ID NO: 4224105 - RNA, 62 nt, Bordetella pertussis
ggggggugccuguccccgccgggacgagcaccccuugccacgggucgggacaggcaccucuu

SEQ ID NO: 4224106 - RNA, 61 nt, Bordetella pertussis
gaugcugaucagguugccggccgagaucaugaccaucuggccgagcaaggcgaacagcguc

SEQ ID NO: 4224107 - RNA, 123 nt, Bordetella pertussis
uggucgagcaggcggugcauggcgccgggcgggcgcugcugacggugcugcccauguucggcaugcuggccgugguggcggugcugucggcggugcugcugggcggcuuugucuucucgacca

SEQ ID NO: 4224108 - RNA, 91 nt, Bordetella pertussis
gcguuccgggcggugaugcugaccggcucgaugaacggcguggcccgccugcuguucgucucgcagccggcggucagccgccugaucgcgc

SEQ ID NO: 4224109 - RNA, 114 nt, Bordetella pertussis
gcgugacgcgguaguuguuguccagcauguagcggccguugcgcucggugguguccgagcaggcgcccuggugcagcacggcacgcaaggccggcagguugccgccgcgcacgc

SEQ ID NO: 4224110 - RNA, 86 nt, Bordetella pertussis
gcaucgguacgcacccacguggcggccggcaagcugguggcccugggcaccagcgccagcggccgcgugccgcaguuucccgaugc

SEQ ID NO: 4224111 - RNA, 64 nt, Bordetella pertussis
uggucaacgccgccgccugccacguggucgaacaggacgacgugcacaacggcgcgguguucca

SEQ ID NO: 4224112 - RNA, 62 nt, Bordetella pertussis
guucccggcguucgcccugggcaugauguugaugcagguguucucggugaaccugggcuggc

SEQ ID NO: 4224113 - RNA, 77 nt, Bordetella pertussis
auacgccgccaaucguucgaucucgccacgauuaccgaccggcugauccugccggugaucaacgaaggcgcgcgugu

SEQ ID NO: 4224114 - RNA, 64 nt, Bordetella pertussis
cgaggaaaucgccuggugcaggugcgggucgaacuugucgcccugggccggcgcgauuuccuug

SEQ ID NO: 4224115 - RNA, 92 nt, Bordetella pertussis
ggccgcaucccgggcgguuucuucaagcgcgaaggcaagcccuccgaaaaggaaacgcugaccucgcgccugaucgaccguccgcugcgucc

SEQ ID NO: 4224116 - RNA, 93 nt, Bordetella pertussis
gcgccggcugcggcuaccaggcggcgguacuggcccagaucgugcgcgaggugcaugccaucgagcguauccgcggccuguacgagcuggcgc

SEQ ID NO: 4224117 - RNA, 83 nt, Bordetella pertussis
gcuggcgccgcauggccggcaggcguacggccagcgcaucggccgaccagugcugcgggccgucgccgccgaugcgcgccagc

SEQ ID NO: 4224118 - RNA, 57 nt, Bordetella pertussis
cgcccugguacgugccuugccaguccagcgaauugcgcgagguaugcguaucgggcg

SEQ ID NO: 4224119 - RNA, 57 nt, Bordetella pertussis
ucggcuucgaaccggugcgcgaaaccccgcaggcguucgccgccuuccucgagcugg

SEQ ID NO: 4224120 - RNA, 73 nt, Bordetella pertussis
gccgccaccgcgcuggucuuuuucggcucguggcugcgcuaugagcuggcgaugcgcggcgcggcggacgagu

SEQ ID NO: 4224121 - RNA, 76 nt, Bordetella pertussis
aaugaagucgaggccgucaucgcggcgcauccggguguccuggagugcgcggucaucggcgugcccgacgagcauu

SEQ ID NO: 4224122 - RNA, 56 nt, Bordetella pertussis
gcgaucauggugccggucggcgccgacaagccgcgcaugaccgcgcgcuugaucgc

SEQ ID NO: 4224123 - RNA, 61 nt, Bordetella pertussis
ccgcgugucgagcugggcauggcgcuggccggccuugcgcgcgccggcaucgacauuucgg

SEQ ID NO: 4224124 - RNA, 64 nt, Bordetella pertussis
cgggaaacggcgacaggccggccagauggugcugguccgccgucagccgcuguucgccgaccug

SEQ ID NO: 4224125 - RNA, 81 nt, Bordetella pertussis
ggcgccgacggcgugcugguacggcuggacgggccgcgacccgaggugcuggccagcgccagccugcccaugcccgccgcc

SEQ ID NO: 4224126 - RNA, 102 nt, Bordetella pertussis
auugagaaacgucgacuugccggcuccguuggagccgaugacggucacgaacuggccguucggaauguccagcgacagcccgcgcagcgcgcgcgucucgau

SEQ ID NO: 4224127 - RNA, 96 nt, Bordetella pertussis
cagcgccugggccuggcgcccaagguggcgcugcugucgcgcucgaacuucggcucgggcagcucggccucgggcgccaagaugcgccacgcgcug

SEQ ID NO: 4224128 - RNA, 57 nt, Bordetella pertussis
gcucggccaccagcuugcgggcaugggccaucuugcgcgacgaaucggugggccggc

SEQ ID NO: 4224129 - RNA, 58 nt, Bordetella pertussis
cggucugcuugugcagcgaacgcauggcgccgauggccgccucgcgcacauucagccg

SEQ ID NO: 4224130 - RNA, 57 nt, Bordetella pertussis
gcgccaguucgcgcagggcgaucagauugcccuugcggaagaagugccggcuggcgu

SEQ ID NO: 4224131 - RNA, 81 nt, Bordetella pertussis
ggcgauauccaggcgcuuggucaggaagcgcaugcgccggucgauuucgcgcaggcgcuucuugccguacagguaaucgcc

SEQ ID NO: 4224132 - RNA, 73 nt, Bordetella pertussis
cggugcugggcgagucgaucuacgccgccacgccugacgggucggucggcaaguucgaccugcucagcggccg

SEQ ID NO: 4224133 - RNA, 60 nt, Bordetella pertussis
cuggugggcuucgugcagaugccggacggcgaugccgucggcggcgcgcaggcccggcag

SEQ ID NO: 4224134 - RNA, 101 nt, Bordetella pertussis
guggcggauuucggcggcggcaugcugcuggcguucggcaugcuggccgccuugcuggcggugcguggcggggcgccgggccaggucgucgacgccgccau

SEQ ID NO: 4224135 - RNA, 55 nt, Bordetella pertussis
guguccuggaugccgcgcacgaucaggccauggucgugcgcgcgcucguaggcau

SEQ ID NO: 4224136 - RNA, 67 nt, Bordetella pertussis
caccgcaucggcggugucgguauuggucauggacugcacgaccacgcuggcauugccgcccacggug

SEQ ID NO: 4224137 - RNA, 59 nt, Bordetella pertussis
ggcgccaguucgccggccagcgccgccagcaggguggacuugccggcgccauuggcgcc

SEQ ID NO: 4224138 - RNA, 64 nt, Bordetella pertussis
cccguucgauggccaccggcgaggucgucuucgacggcgcccucgcccaugccaucggccaggg

SEQ ID NO: 4224139 - RNA, 60 nt, Bordetella pertussis
gagcgcgccgcgcggauauggcggcgaaagcgcucgcgcugccaguccagcggcucgcuc

SEQ ID NO: 4224140 - RNA, 129 nt, Bordetella pertussis
gugcgcaucggcgccgacggccgggucaccguccuggccaagcaccuggagaugggccagggagccuauaccggccuggccacgcugcuggccgaggagcucgacgccgauuggcgccaggugcgcguc

SEQ ID NO: 4224141 - RNA, 72 nt, Bordetella pertussis
cccacaaaaucgccuacuuuucuacgccagauccacgccaggauuuacgccaagggagaguagaggaugggg

SEQ ID NO: 4224142 - RNA, 88 nt, Bordetella pertussis
uugcgccggcgucuugccgcuggugcgcgguucgggcuugauuucgcgcaguucgagcgcgcagucggcgggcaggcguuuggcguag

SEQ ID NO: 4224143 - RNA, 102 nt, Bordetella pertussis
agccggccaugggcucgacgaucaccgcggcgauggucgacgcgucgugcagcgccacgaugcguuccagcucgucggccaggugcucgccccaggccggcu

SEQ ID NO: 4224144 - RNA, 67 nt, Bordetella pertussis
gucgaggucgucggagugcgccugggcggucagguccacccgcagccccgccgcuucgaugacgcgc

SEQ ID NO: 4224145 - RNA, 89 nt, Bordetella pertussis
cgacgaggugaucuccuuccgcgacgcccgcgccgcagaacugggcgagacgcugcuggugcgcagcgucgaggauucgaucgcccgcg

SEQ ID NO: 4224146 - RNA, 126 nt, Bordetella pertussis
gcgccggcggccauuucgaaggacucgggcauccgcgccaugcgcagguugcugcgcaggguguagcggcucugcgccuggucggagggguugccccauuuguccucgcccuugaagcccaggcgc

SEQ ID NO: 4224147 - RNA, 83 nt, Bordetella pertussis
gcgcguuguaguugcccguggcgccauugagcuuggccagcggcucgaccgccucgauggcggccacggcgcgcugcaggcgc

SEQ ID NO: 4224148 - RNA, 98 nt, Bordetella pertussis
gacuucucagggugccuguccccgcagggggacaggcacacguugaaucuggguguccaggugccuguccccggcggggacuggcacccgagaaaguc

SEQ ID NO: 4224149 - RNA, 76 nt, Bordetella pertussis
ggccgccaugagcgauguggaccccagcgaagcgggccuggcauccggcguggucaacacuucguucaugaugggc

SEQ ID NO: 4224150 - RNA, 76 nt, Bordetella pertussis
ggugcggcgcgccucgaugcccuugcggauccagacuucuuccugggccagcagcuugucgaagcgggccugcucc

SEQ ID NO: 4224151 - RNA, 85 nt, Bordetella pertussis
cgacgacuucaucgccaucaucaaggcggcgcccaccccgccgguggcgcgccaggaauugauggcgcguuccugggauucgucg

SEQ ID NO: 4224152 - RNA, 80 nt, Bordetella pertussis
gcggugaccgugggcuuguccuugcuguccaggcgcggcgcguggcccuggaccagcucgcgggcgcgauaggucgccgc

SEQ ID NO: 4224153 - RNA, 56 nt, Bordetella pertussis
guguugggcucgcucggcacggccuccugcaaggccccgaacgugggcaccagcgc

SEQ ID NO: 4224154 - RNA, 67 nt, Bordetella pertussis
aaggcauggagcucggucugccgauuccgguggugaucaccgccuucgcggacaagagcuucaccuu

SEQ ID NO: 4224155 - RNA, 112 nt, Bordetella pertussis
gcugacgcuggccguuucgcccagccugcugcagucgcccuauggccagcaaagccugcauagccugcggcggcugcaccgggccggaugcaaccuggugcuuaccgucagc

SEQ ID NO: 4224156 - RNA, 58 nt, Bordetella pertussis
ggcgcgcaaugcgcguuacgcaucgccaacuggcgagugggcagggugcaugcgcgcc

SEQ ID NO: 4224157 - RNA, 70 nt, Bordetella pertussis
gcagaagcugcucaagcagggcgugcgcgacaugguacgcaucucggacgcccgcaugagcggcaccagc

SEQ ID NO: 4224158 - RNA, 55 nt, Bordetella pertussis
cgcgucgaugccuucgccggccugcaccagcgugccggcgcgaaugccggcgccg

SEQ ID NO: 4224159 - RNA, 75 nt, Bordetella pertussis
gacgaaagcggagaacugcugcggcgugcuggauaccgauucgacgcccaggguagccaguuuuucgcugacauc

SEQ ID NO: 4224160 - RNA, 82 nt, Bordetella pertussis
gggcggagaauccuucggcgugcgcgccgacaacacccgccugcugcggguggucaacgccguacucgaagccauuccgccu

SEQ ID NO: 4224161 - RNA, 56 nt, Bordetella pertussis
ccggcaccaggcgguggugcagacgcuggcacaacugcaccccuacgaagugccgg

SEQ ID NO: 4224162 - RNA, 128 nt, Bordetella pertussis
cuucgacuggcuggaacugcauugcgcccacggcuaucugcugucgucguucaucucgccgcugaccaaccagcgcgacgacgaguauggcggcagccuggagaaccgccugcgcuauccgcucgaag

SEQ ID NO: 4224163 - RNA, 57 nt, Bordetella pertussis
gcugcaccggcuggacugcugcgucaucaccgacggcggcggcgcgcuggugcuggc

SEQ ID NO: 4224164 - RNA, 78 nt, Bordetella pertussis
gccgaagggcaccgugaugucgccgucggcauagcaguugacccauaccagcccggcgcgacaggcggugcgcgcggc

SEQ ID NO: 4224165 - RNA, 78 nt, Bordetella pertussis
uccggugccgauggcauggcacucguucggcggcuggaagcgcucgcuguucggcgaccaccaugccuacggcgagga

SEQ ID NO: 4224166 - RNA, 66 nt, Bordetella pertussis
gcggcgcgggcuugagcacgaccugguacugguaguagugcugcaggcgguucggguuuucgccgu

SEQ ID NO: 4224167 - RNA, 79 nt, Bordetella pertussis
gccuccuuggcgcauuccagcgcggccgggucggugggcgccaggccccggccgaacugcuggguguagcccuucaggc

SEQ ID NO: 4224168 - RNA, 67 nt, Bordetella pertussis
gcgccaucaccugcugaugucggcggucgcccagaagcgcgaccuguccgacccgcagguggugcgc

SEQ ID NO: 4224169 - RNA, 69 nt, Bordetella pertussis
cagauuggccaggcuggcgccggugcgcacgucggugcagcgcgcgccggugcgcagcuugguuuccug

SEQ ID NO: 4224170 - RNA, 65 nt, Bordetella pertussis
augagcgguaccagcgccagcagcgccagaaacagggccaggcugaaggggucgguaucgcucau

SEQ ID NO: 4224171 - RNA, 63 nt, Bordetella pertussis
gccauggcgcgcaucacgauggccugggccaccuggaacauugcccguucugccgccaugcgc

SEQ ID NO: 4224172 - RNA, 63 nt, Bordetella pertussis
ggcuuugucguccugggauuuccgugcaaccaguucgggcgccaggagccgggcgacgaggcc

SEQ ID NO: 4224173 - RNA, 62 nt, Bordetella pertussis
cgggcguggccaucagucggccaccguggccgaacucgucgcccggcugaaggccgcgcccg

SEQ ID NO: 4224174 - RNA, 62 nt, Bordetella pertussis
ggcaggcgcuggcccugaucgacgugcggcugaucgaccacgucaucguggccggcgccgcc

SEQ ID NO: 4224175 - RNA, 55 nt, Bordetella pertussis
cgccauccaguauugcacgcagugccaguggcugcugcgcgcggccuggauggcg

SEQ ID NO: 4224176 - RNA, 101 nt, Bordetella pertussis
uuucgcauuaagacgaaagcaggcuggcgcgggguucucggggcgcgccgccuggaguucagccccccggcuugccuaagucucaggagucaugugugaaa

SEQ ID NO: 4224177 - RNA, 57 nt, Bordetella pertussis
cagccgguggucggcagcgcgaugaccgccgccgacgucgcgcgcuucgccgagcug

SEQ ID NO: 4224178 - RNA, 121 nt, Bordetella pertussis
cugcauggccgagccaucguggugcucgaucagcaugcgcgauuccaucauggcgagaucgucguggaauucgacccgcaugcggucgcgcagcucggcgauggcgggaucggccaggcgg

SEQ ID NO: 4224179 - RNA, 64 nt, Bordetella pertussis
gaacgaugacgugcgauacgcccgguagcugauuccagcuaccgggcgcgcgcguugaugauuc

SEQ ID NO: 4224180 - RNA, 85 nt, Bordetella pertussis
cgcccaggccgagcaggcgguccaggucgaugcgcagcauauggggauucugcgugcccgaccagaccgucaggccaucggggcg

SEQ ID NO: 4224181 - RNA, 101 nt, Bordetella pertussis
ggucggcgcucagccggcgccacaccggcguggucagcggcgcauugguggguuccaugaugugcagcgccaccaggcuggucugcgccugcgcggcgagc

SEQ ID NO: 4224182 - RNA, 73 nt, Bordetella pertussis
ccuggcacaggcccuggccgaccgguaucgcaucaucugccccgauacgauaggccggggccugucgcaaugg

SEQ ID NO: 4224183 - RNA, 60 nt, Bordetella pertussis
gucaugccauauccguccgugucccuuguccugaggcggccuggccgcgcguggcaugac

SEQ ID NO: 4224184 - RNA, 76 nt, Bordetella pertussis
cgagauggcugcgggucaugacggcgcucauuggcguuuccuuucugucugcguuaucgaugucuguagcaauccg

SEQ ID NO: 4224185 - RNA, 58 nt, Bordetella pertussis
aucggaugagauccaugcgcaagugcgcgagcagcugucggagcaggaacucuccgau

SEQ ID NO: 4224186 - RNA, 66 nt, Bordetella pertussis
ggcguugaagccauggcucuggccauagccgguggacaggcuguagcugaagccgucggccgcgcc

SEQ ID NO: 4224187 - RNA, 86 nt, Bordetella pertussis
ggcccaggaaaugccccaccgucaugaucugcgacugcugccagugcguguaggcgggcaugaugguaucggcaugcucgacggcc

SEQ ID NO: 4224188 - RNA, 81 nt, Bordetella pertussis
gcgccaacaccgaccaggcggccagcacggcgggaauggcgaacagcguccagcccaggcuggccgccggcgcgucggcgc

SEQ ID NO: 4224189 - RNA, 91 nt, Bordetella pertussis
ucgagguugcgcugcugcgccggcgacagcggcuggucgaacaggaugaugucggccagcagcgcgccggccaucgccacgcccuccucga

SEQ ID NO: 4224190 - RNA, 130 nt, Bordetella pertussis
ggcacccggggccugggcgcggucggcggccugcugcugggaucgguggcgcgcaaggugauccaccuggccgacgugccgaucacgcuggugaaguaggucccgcgccccgcccggccgaguaccugcc

SEQ ID NO: 4224191 - RNA, 57 nt, Bordetella pertussis
cuggcggccgcaagcggcgcggccugcgcccaggccggcgccgauccggccggccag

SEQ ID NO: 4224192 - RNA, 123 nt, Bordetella pertussis
gcccguugaccgaacugacgucauggccguccguauugacaguuacgucgccgccggaggcaaucagcgccccgccgccggcguacugauccgugaugcccuggcgcgucgccucggucaggu

SEQ ID NO: 4224193 - RNA, 103 nt, Bordetella pertussis
gucggcgcgcgugcacggcgccgggcucgcgccgcuggccugcgaaaugcaggcugcgcuggccggcggcgugacccggcuggucgugccgccggauaccgac

SEQ ID NO: 4224194 - RNA, 78 nt, Bordetella pertussis
cugggucaggucggguggaaugcugagcgggucgccgcgccgcgugcuuuuguaauccaccgacucuucauugcccag

SEQ ID NO: 4224195 - RNA, 121 nt, Bordetella pertussis
gggauggacgaguaccggcugacgcgcggugcgcagggucauggcggguggcggcaugcaugugccgggccggcgcauggccuuuugcgguuugcggcgcggcagcccugagguccguccc

SEQ ID NO: 4224196 - RNA, 87 nt, Bordetella pertussis
ggccugaaaccggucaacugguguuucgacuguggcucggcguuggccgaggccgaggucgaguacgccgaccgggucgauccggcc

SEQ ID NO: 4224197 - RNA, 66 nt, Bordetella pertussis
ugccgcuggcgauggccugaugggugucgaugggguagucggccaccaggccgucggccaggggca

SEQ ID NO: 4224198 - RNA, 65 nt, Bordetella pertussis
cgaugcgcugcuccaugugcgacagcagccggcugacggccggcugcgacacgaacaggagcucg

SEQ ID NO: 4224199 - RNA, 90 nt, Bordetella pertussis
gccguuggccaccagcgggaugcgcgucgacgaggucaccggcaccagguugaccuugaucugcgccaugcccagcuuggccuugauggc

SEQ ID NO: 4224200 - RNA, 55 nt, Bordetella pertussis
caucgucaagcuggcgcuggacugguuccucgccacccaggccggccuggccaug

SEQ ID NO: 4224201 - RNA, 59 nt, Bordetella pertussis
cggcugguucauguggcguccggcccagaccgcgccggaugucgccuucaccacgcucg

SEQ ID NO: 4224202 - RNA, 84 nt, Bordetella pertussis
cugaccacucaucacguuggcgacgaucaggccggagcuaucgccgaacuuggcaugagcgucguucagcacugaguaggucag

SEQ ID NO: 4224203 - RNA, 61 nt, Bordetella pertussis
gcugggugcgcagggcgccaucggcggucguggccgccauggcgaucugcgcgccuucggc

SEQ ID NO: 4224204 - RNA, 130 nt, Bordetella pertussis
cacggccaugggcaucgccagcgcaggcgguucgcugggccaguuccugguggugccggccgggcagcagcugauuaccgggcuggacuggcccggcgcguugugggugcugucgcugcugguggccgug

SEQ ID NO: 4224205 - RNA, 65 nt, Bordetella pertussis
gcaaggccgaggucggccuguuccugcagguggccgagcggggcgugggccagauccggccgggc

SEQ ID NO: 4224206 - RNA, 73 nt, Bordetella pertussis
gccuggugcccauggcguauggggcgcccgucccugcggggaccggcaccccgcgcgucggggcaggacaggc

SEQ ID NO: 4224207 - RNA, 92 nt, Bordetella pertussis
gcuggugcaggcgcauggcaaggugcuguucuauggcccgaugcugccgcauaucggccaucuggagcgccugcucgacagccuggauccgc

SEQ ID NO: 4224208 - RNA, 81 nt, Bordetella pertussis
gggcggucuugucgaccguaucgguauaggcguagguaaccuccuggcugguaucgccguaacggucgguggcgcgcgccc

SEQ ID NO: 4224209 - RNA, 64 nt, Bordetella pertussis
cgugcgggugaucgaucggguucauggcaacgccacgaaccgucggacgaacaccacgccagcg

SEQ ID NO: 4224210 - RNA, 56 nt, Bordetella pertussis
gccggcuggcauccgcgggccggcgcauggcgccggccugacccguauccgcuggc

SEQ ID NO: 4224211 - RNA, 108 nt, Bordetella pertussis
cgucuggacgauguuccacuacgggguggcgggcugguccauguaugccuugcugggcauggcgaugggauacuucgccuaccgcuggggcaugccccuguccauccg

SEQ ID NO: 4224212 - RNA, 56 nt, Bordetella pertussis
gcuggaaucucgaugagguggcggaccaauaccgccuguucucgcgcaauuucggc

SEQ ID NO: 4224213 - RNA, 59 nt, Bordetella pertussis
gggcgcgcaggaagcgcgccucggcuucccgcugcugcauggcggcuuccugcgcggcc

SEQ ID NO: 4224214 - RNA, 82 nt, Bordetella pertussis
ucgaacugcucggcggugcgcucggagguauugaccacgcggucguagaugcccucggcgcgcgccagcucggcggcggcga

SEQ ID NO: 4224215 - RNA, 60 nt, Bordetella pertussis
gcaggggccguuguggcuggcuuccgaccugcaccuggggccggccacgccggccaccgc

SEQ ID NO: 4224216 - RNA, 87 nt, Bordetella pertussis
ccggcccgguuacuauggccguaguccugaccgggcgcgaugcgcccggucaggaaggcugugggaaccuauucaugauucugcugg

SEQ ID NO: 4224217 - RNA, 62 nt, Bordetella pertussis
ggcgcugcgcuacggcgagaacccgcaccagaccgcggcguucuacgucgacgcgcagcguc

SEQ ID NO: 4224218 - RNA, 61 nt, Bordetella pertussis
cagcgugcgcgucucgauggcgaacugaucgggcaugucggcaaacgaggcgcgcagguug

SEQ ID NO: 4224219 - RNA, 57 nt, Bordetella pertussis
ucgugguggugacggugguuuuccugcuggucaggcugaccggcgaucccgccacga

SEQ ID NO: 4224220 - RNA, 76 nt, Bordetella pertussis
cgaggaaaugaauuugaugcuggacgacgcgcuguccggacaggaaaagcugcucuagcaucaacgcgguaacucg

SEQ ID NO: 4224221 - RNA, 55 nt, Bordetella pertussis
cguguucaaggagcuggaagccggcacgcacugcuaccuggcgucuucgggcaug

SEQ ID NO: 4224222 - RNA, 77 nt, Bordetella pertussis
ccugcagccggcaagcaguaccgaagcggcuugagaagacauucucaagccgcuuuuuugcgccuguccggugcggg

SEQ ID NO: 4224223 - RNA, 81 nt, Bordetella pertussis
cgcgcggcgcccuguauccguaucucgauucauacguauacguaaaucuuauaucguauacgaauauaggcgcugcuggug

SEQ ID NO: 4224224 - RNA, 113 nt, Bordetella pertussis
ucgggcuuguccaucagcuggaggaacuggcgcgcguaugccgacaggcuuuccacguagcgacgcuggccuuccgcauacagcgugucgaacgccagcgacgacuugcccga

SEQ ID NO: 4224225 - RNA, 57 nt, Bordetella pertussis
gcgcgcuuucacucgccgcaggccgccgaggcggcgcuggccgcguucgaggcgcgc

SEQ ID NO: 4224226 - RNA, 64 nt, Bordetella pertussis
agcugcggcugcuccuuguccaccagcgccuugagcagcuuggccaccgccagcggcugcagcu

SEQ ID NO: 4224227 - RNA, 67 nt, Bordetella pertussis
ucggggucgaccaugcgcagcguggccggcuccgcgccggcgaagcgcgcuucgcggucggccucga

SEQ ID NO: 4224228 - RNA, 87 nt, Bordetella pertussis
ggccuguccuaccaggagcggcuggccggcaaccaggcgcccauccugauggggcuggcgcugcuggucguguuccuggugcuggcc

SEQ ID NO: 4224229 - RNA, 55 nt, Bordetella pertussis
gcggccgcugauggcauggggcucgaggaauguccccaugaaauccgcgagccgc

SEQ ID NO: 4224230 - RNA, 64 nt, Bordetella pertussis
gcgucaaccuggaauucaccgacaugaccgacgucaugcgcgacguggauuucaagguguucgc

SEQ ID NO: 4224231 - RNA, 66 nt, Bordetella pertussis
gcccgccugccgguguccuucacccacggccgcggggucuggcucugggacaccggcgagcggcgc

SEQ ID NO: 4224232 - RNA, 57 nt, Bordetella pertussis
acuguaaaccuuuuagaagugccuguuuucauugggaaaaucugaucgguaugcagu

SEQ ID NO: 4224233 - RNA, 59 nt, Bordetella pertussis
cgagcuguucgucgacgcgguggccaugggcgcggaagccgacgccgacccgcaguucg

SEQ ID NO: 4224234 - RNA, 119 nt, Bordetella pertussis
ggccaaccacguaggcgaagaugcccagggcgcugccgaccaugaccguaggcaugauggccaggccguccaggccaucggucagguugacggcguugcuggugccaacgaugacggcc

SEQ ID NO: 4224235 - RNA, 57 nt, Bordetella pertussis
cgcgcucaauccggagaucgccgcccgccuggcgcgcggccuggauaauugggcgcg

SEQ ID NO: 4224236 - RNA, 64 nt, Bordetella pertussis
cguggaugauggccucggcgcgggccagcaccaccaggcccagcggcgugggcgucaugccgcg

SEQ ID NO: 4224237 - RNA, 85 nt, Bordetella pertussis
gcgcaugcauacggugcuggccgacuggugcacggguugcgaccugugcguggcgccuugcccggucgacugcaucgacaugcgc

SEQ ID NO: 4224238 - RNA, 84 nt, Bordetella pertussis
ggguaguagccauaguugauggcgcccaggcugcgcaauugcaccaucugcuugcgcaguaucucggugucgaucggcuugccc

SEQ ID NO: 4224239 - RNA, 77 nt, Bordetella pertussis
gcugcggcuguugcagcgucuugucgagguuccagaaauugauggguuuggggucgacaaaggcguugucuugcagc

SEQ ID NO: 4224240 - RNA, 59 nt, Bordetella pertussis
cgugcccgagauuccgcgcguggugcgccuggugcgcagcguggugcucucggugcgcg

SEQ ID NO: 4224241 - RNA, 72 nt, Bordetella pertussis
uggcgaaaucgauuucggcgaaauuggccguggaaucgauggccggauggcggaagucgaucgagaacgcca

SEQ ID NO: 4224242 - RNA, 78 nt, Bordetella pertussis
ugccuugcgcgcggcccauuggcagcgccaggccgacgccggcguggcguucgugccggugggcgauuuugcauggua

SEQ ID NO: 4224243 - RNA, 67 nt, Bordetella pertussis
ggacggaacgugccggacgacauccgccaggcgcugcucggaggccuguucggcacgauuucgaucu

SEQ ID NO: 4224244 - RNA, 55 nt, Bordetella pertussis
ugucgacgacugggacguccaccucgccaagcuggucgacuucuggucgucgaua

SEQ ID NO: 4224245 - RNA, 83 nt, Bordetella pertussis
ccugcugcugccgcuggaccugcgcgucgacggccagcucgaauccguguucgagcaaaucggcgcgcgcuggggcagccugg

SEQ ID NO: 4224246 - RNA, 97 nt, Bordetella pertussis
ccggucgcgcugcugcuggcgcugggcgcugcccugcuggcggugggcauucucgccgccgccagcggcgcggugcauauuccgcuggccgaccugg

SEQ ID NO: 4224247 - RNA, 80 nt, Bordetella pertussis
gugaagggugcaagggugccuguccccgcggagaggcccgagugccuguccccgcggagacaggcgccccgcacagucgc

SEQ ID NO: 4224248 - RNA, 77 nt, Bordetella pertussis
gggcgcgguccaggucggcuucggaggcgugcggcaacuggccaagcaccucgagcguggccggauugacgacgucc

SEQ ID NO: 4224249 - RNA, 120 nt, Bordetella pertussis
gcgcggcggcggugggcgggcgcuacaacaguccgggcaccgccgugguguacgccucguccugcguggcgcuggcggugcuggagaccguggugcauuucgccgcgccggccaccgcgc

SEQ ID NO: 4224250 - RNA, 73 nt, Bordetella pertussis
ccacggcgacucgugcggcgugccgccgugauggccguggucgucauggugcgcgucgccaugguggccgugg

SEQ ID NO: 4224251 - RNA, 60 nt, Bordetella pertussis
ggccggcaacuacggcaugugcgggcgcgccuauucaccgcgcaugcuguucauguggcc

SEQ ID NO: 4224252 - RNA, 55 nt, Bordetella pertussis
ugcucgacaucccgauggccgaugucacgcggcaauaccugucguaugucgagca

SEQ ID NO: 4224253 - RNA, 122 nt, Bordetella pertussis
ucgggcaacucgccacggcgcaucugcgccgcgucgaucucgacccaggcgcccggcggcagcuugcggaugccggcguagaucgacugcggcgcgggaauguaguuguggcgcaugaacga

SEQ ID NO: 4224254 - RNA, 85 nt, Bordetella pertussis
cagcgugggguugaugaccaggguggcgucggcggcgaacagcagcguauagccgucgggcgcggccuuggccacggcgucgcug

SEQ ID NO: 4224255 - RNA, 56 nt, Bordetella pertussis
ccaccaggaugcuggcgaugaucaucaggccgauguucuucuccagcgucuggugg

SEQ ID NO: 4224256 - RNA, 72 nt, Bordetella pertussis
gucguccguagcauggcguagcgccguauccgcuuggcgggugggcgucgcauuccauguuucguugacgau

SEQ ID NO: 4224257 - RNA, 58 nt, Bordetella pertussis
caguccgucggucgagcaggauggauuggaguucgaccugcuggcgcacgaugaacug

SEQ ID NO: 4224258 - RNA, 80 nt, Bordetella pertussis
ccuguaccaauuguggauguucucccugguggucugguacgccuaccgcgacccgggcagcagcgccaucaugcggcagg

SEQ ID NO: 4224259 - RNA, 56 nt, Bordetella pertussis
ucgcgcacguccugcaugaagcccacgguguaagccgucagccagacgucgcgcga

SEQ ID NO: 4224260 - RNA, 73 nt, Bordetella pertussis
agcugggcgcgcgucugggcaugggugcgcagggcguuccagcgcggcuggaucaggcgcgugaacaccagcu

SEQ ID NO: 4224261 - RNA, 56 nt, Bordetella pertussis
gccggcgguggugucgcccggcguguaagcaugcgcgcccgcgccggccagccggc

SEQ ID NO: 4224262 - RNA, 86 nt, Bordetella pertussis
ucggccugucgcuggaaagcgcgcugcgccgggccgugcccgaauugacgcaggccauggugccgcguuuucucgagcgcuaccgg

SEQ ID NO: 4224263 - RNA, 56 nt, Bordetella pertussis
acuggaccagggccgugcccagcggcugcaguucgcgcggcaggccuucggccagu

SEQ ID NO: 4224264 - RNA, 129 nt, Bordetella pertussis
cucgccgcugaccaccgacagcgagacauccugcaccacggugcggccguuguaggucuugcgcagcccgguggcgcgcaggcugccggcggcggcgccggcagcgguggcgguggacagaguggcgug

SEQ ID NO: 4224265 - RNA, 66 nt, Bordetella pertussis
aucgcgcccaggucggccaccaggucgcgcuggcgcaucuggcaucccuggcugccugggcacgau

SEQ ID NO: 4224266 - RNA, 68 nt, Bordetella pertussis
ggcggaacgacugcguucaguuguccauuacgaccccgaaacgggcaaguucacgcgguugguccgcc

SEQ ID NO: 4224267 - RNA, 59 nt, Bordetella pertussis
gauuugguuuugcccgcccgggucugccuuaaugugcgccuggcgcgggcgagaucguc

SEQ ID NO: 4224268 - RNA, 64 nt, Bordetella pertussis
gaauggcugggcgacuacggcagcgccgugcgcgacuacgcgcugucguaugcccuggucaauc

SEQ ID NO: 4224269 - RNA, 65 nt, Bordetella pertussis
acgaucaaggcaugucaaucugcccgcgcgcgcgggcgcaaggagauugccaugucacugaucgu

SEQ ID NO: 4224270 - RNA, 55 nt, Bordetella pertussis
aggauguugaagauggugcgcacccccaacuccuugcgcaccgcggcaacguucu

SEQ ID NO: 4224271 - RNA, 55 nt, Bordetella pertussis
gcccugguagcaggcauggugcaggugaugccugcggcuggccgcgaaccagugc

SEQ ID NO: 4224272 - RNA, 67 nt, Bordetella pertussis
ugcgccagccaaucgagccguggcguaaugcgccacgccaaggcgggcgacgccaggcggcggcgcg

SEQ ID NO: 4224273 - RNA, 75 nt, Bordetella pertussis
gauggcgucgagcuggucggcgaagacgcccuugcugucguacagcagucggccgaucagcgucgacuugccguc

SEQ ID NO: 4224274 - RNA, 64 nt, Bordetella pertussis
ccggggcaggacgggcaaggggcagaagauccagguguccaugcucgauugccugucguccugg

SEQ ID NO: 4224275 - RNA, 68 nt, Bordetella pertussis
ggaacuggcccagcggcagguaggugaccucguccaugacgcgcgccuggauccgcuuggccacgucc

SEQ ID NO: 4224276 - RNA, 64 nt, Bordetella pertussis
auauccgagagcaugcccacgacgauggacucgacccauugguugccgcgcugcuccucggugu

SEQ ID NO: 4224277 - RNA, 91 nt, Bordetella pertussis
guuucaccaucuucgguuucaauugcguugggcgcgcucggacggcguccggacgaggccagccaauugcgggccguauugauggcgauac

SEQ ID NO: 4224278 - RNA, 67 nt, Bordetella pertussis
ggucgaggccgucuuuggcguaugggcguucguacugaucgccuguauggcgcugauggccggcacc

SEQ ID NO: 4224279 - RNA, 78 nt, Bordetella pertussis
agccggcacgcaguuccugcccuaugcccgccaggccgucgaaagccucaacaagggcaugcuggagcuguccgcgcu

SEQ ID NO: 4224280 - RNA, 88 nt, Bordetella pertussis
ggcgcgcgccaucgugcgcagcuaccucaaccugcagaacgccuucgcgcagcgcgaggugcugcagcgcgugcugagccagcgcgcc

SEQ ID NO: 4224281 - RNA, 57 nt, Bordetella pertussis
cgugcugcgcauccugcaggagguguucaccaauauccucaagcaugcgcgagcgcg

SEQ ID NO: 4224282 - RNA, 61 nt, Bordetella pertussis
caccaucgugcugaucggauugggcgcggccaucgugcccguggugaucggcgcgcuggug

SEQ ID NO: 4224283 - RNA, 67 nt, Bordetella pertussis
ggccaccuugugcugggcgcucggucccuugaagaagaaggccagcaauccagcacgaucaaaugcc

SEQ ID NO: 4224284 - RNA, 55 nt, Bordetella pertussis
ggcagcgaauccauguacgacucggaauagcgcgagccguagucgaucugcugcc

SEQ ID NO: 4224285 - RNA, 55 nt, Bordetella pertussis
uggaugccgcgcaucauggacgagcccaacgccgucgugaugcgcaccguaucca

SEQ ID NO: 4224286 - RNA, 60 nt, Bordetella pertussis
gccggcgcgcugccggaagcgcgccagcagcgccucgcgcguuucccggggcgcgcuggc

SEQ ID NO: 4224287 - RNA, 93 nt, Bordetella pertussis
uccagggcgagaagcugcccaugacgcgccccggcaucgaggucgacgucacgcgcgagccggugggcguggugggcaucaucgcgcccugga

SEQ ID NO: 4224288 - RNA, 82 nt, Bordetella pertussis
ggguagcguuggggguacucguguucaaccguggggguacuuuuccccgcaguggaauccaacgaugcccgagaaucuacuc

SEQ ID NO: 4224289 - RNA, 81 nt, Bordetella pertussis
uguacaagggccagaucgacguggcggugaccuaugaccucgaagugcagggcaccgauaucacguucgagcccuuggcca

SEQ ID NO: 4224290 - RNA, 58 nt, Bordetella pertussis
gauggccggaucggccaggaaacgcacuuccgugccgcgcuugucggucgggccgguc

SEQ ID NO: 4224291 - RNA, 82 nt, Bordetella pertussis
gggagccaguccccguggggacgagcuccuggagucugcgugugccgccagcgggagccuguccccgcggggacuggcuccc

SEQ ID NO: 4224292 - RNA, 99 nt, Bordetella pertussis
gccgcugggcguagccguggccuggcugagcggcagccugagcgccaaggcgcgccgcgaggcugccgccgccguggccgauggcagcgugcagcuggu

SEQ ID NO: 4224293 - RNA, 70 nt, Bordetella pertussis
caccauguacgaugcgccgggcgucgggcuggcggccacccaggucgacgugcacgagcgcgucguggug

SEQ ID NO: 4224294 - RNA, 62 nt, Bordetella pertussis
cgccuucgcggugucgcugggcaugcgcaaccccuugcgcgugaacgugauccgcgaccgug

SEQ ID NO: 4224295 - RNA, 78 nt, Bordetella pertussis
gccgaucacgcccuggguguucugcgcggucauggcugcgaugaccgcgcagccguaggcgcucagggcgcucauggc

SEQ ID NO: 4224296 - RNA, 129 nt, Bordetella pertussis
uccgauuuggcaucguagucaaagauaccuccguagagccuguucgcgcuccgcguagucuucgagucgggcgacgagcugguucugacguucggcuuccaugauugauccugauggcuauuuggcgaa

SEQ ID NO: 4224297 - RNA, 67 nt, Bordetella pertussis
gguguuagcauggcaggcugauuauaugauuugucuucaugucugauacagccgccaguguagaccu

SEQ ID NO: 4224298 - RNA, 56 nt, Bordetella pertussis
aucagcggccuguugcgcgugggcgcgauugcgucggugcagcaggaucugcuggu

SEQ ID NO: 4224299 - RNA, 69 nt, Bordetella pertussis
ucuacaaggccgacgaauugcagcgccagcugcucgacagcggcgccgagacgaucgucauccuggaga

SEQ ID NO: 4224300 - RNA, 56 nt, Bordetella pertussis
gugaccgacaccgugccguccuugccgauggucagcgacagcgcguugucgggcac

SEQ ID NO: 4224301 - RNA, 64 nt, Bordetella pertussis
guaaagacgggucuugggcuucaugcgaucuccagugaacgcaauguagccaagcccgcuuugc

SEQ ID NO: 4224302 - RNA, 56 nt, Bordetella pertussis
gucgggucagcucggccuauggcuaugcgcaggccaaggacgaaaccugggccgac

SEQ ID NO: 4224303 - RNA, 113 nt, Bordetella pertussis
ggugccgccggcgcgcgcggucaccagcggauggaaaaugcgcucgcggaugugcucgggcacgcccggcccguuguccagcaccgacacgaccagcgccagccggugcugcc

SEQ ID NO: 4224304 - RNA, 65 nt, Bordetella pertussis
gccggucgugaugggcuugccguguuccaugacaaggaugcggucggauauucccaugaucaggc

SEQ ID NO: 4224305 - RNA, 65 nt, Bordetella pertussis
cggcaucgggcagcagccgcagcagggccagcgcggucaugcucuugccgcugcccgacucgccg

SEQ ID NO: 4224306 - RNA, 78 nt, Bordetella pertussis
gucgcugcgcuugagcguggcgcgggcgcgggcggcggugccgcugguggccacgccacgcagcauaucguccaugac

SEQ ID NO: 4224307 - RNA, 87 nt, Bordetella pertussis
gcgcccgaggcgcuggagauggguaucgcgcaccaguuggucgacgaccggccggugcucgaugccgcccucgagcuggccgggcgc

SEQ ID NO: 4224308 - RNA, 58 nt, Bordetella pertussis
auauccucgaugucgcucagcgacagcauuucgccgucguugacgcgcuugggguugu

SEQ ID NO: 4224309 - RNA, 63 nt, Bordetella pertussis
ugguacgccgcaucaaaccccggcuggccgacaagccagcuggcggccuauugcgcgcgccca

SEQ ID NO: 4224310 - RNA, 87 nt, Bordetella pertussis
cgccaggcgcucggcguugcuggcaaagcgcgcguccugcgccaguugcggggcgcccagcgcgucggccagcgccgcgaacuggcg

SEQ ID NO: 4224311 - RNA, 91 nt, Bordetella pertussis
cgcggccggcggcacgaucguggugcaguuguggcauguggggcgcauuucgcacaccacccugcagccggggcagggcgcgccggucgcg

SEQ ID NO: 4224312 - RNA, 63 nt, Bordetella pertussis
gucgacccagggguucgggccgcagcugcgcgagcaguugcgggcguuuuuccuggcguugau

SEQ ID NO: 4224313 - RNA, 71 nt, Bordetella pertussis
ucagcagcuugggcucggccgccagcgcgauggcgaucaucaggcgcugcuucuggccgcccgagaacugg

SEQ ID NO: 4224314 - RNA, 79 nt, Bordetella pertussis
gcgcuggcggccuaccaguacauccccguggcgcuggccgucaccggcgccagggccgugcuggaaggcggccggccgc

SEQ ID NO: 4224315 - RNA, 68 nt, Bordetella pertussis
ccuguugcuguggcuguucuggacgccccugaacgaguggcugcgcuucgaggcaucgcaguggcagg

SEQ ID NO: 4224316 - RNA, 66 nt, Bordetella pertussis
guaccugaugcuggccgauggcagccgccuccuggugggcggacugcgggaccaguaucgccuuac

SEQ ID NO: 4224317 - RNA, 57 nt, Bordetella pertussis
gccggcgcuggcggcgggcugcgugguggugcucaagccggccgaacagacgccggc

SEQ ID NO: 4224318 - RNA, 56 nt, Bordetella pertussis
ggccgauauuucgcgugugcaggccaucuggcacgacacgcgcgccgaauucggcc

SEQ ID NO: 4224319 - RNA, 129 nt, Bordetella pertussis
gaugcagcgcggcggcgagcucuacgugcugacgcuguucgccuugcucggccagauggucaugaucucggccggcaaccugaucagcaucuaccucggccuggaacugaugucgcuggcgcuguacgc

SEQ ID NO: 4224320 - RNA, 80 nt, Bordetella pertussis
cgcgcgccgaaggcgcgcuggucagcagcgucgaggccgaaggcccggccgagucggccggcgugcagcccggcgacgug

SEQ ID NO: 4224321 - RNA, 78 nt, Bordetella pertussis
caggccuccacgcuggggugggcgcgucucgugcuggcgcaagccagcccggcgcuaagcaccccggugcugguacug

SEQ ID NO: 4224322 - RNA, 63 nt, Bordetella pertussis
acggcgaggacaucaccaaugugccgccguaccgccggccggugaacaugauguuccagucgu

SEQ ID NO: 4224323 - RNA, 76 nt, Bordetella pertussis
gcuggugucgaugcgcaagguguugacggcgcgcgcgcucagccgcgcgucggccgccugcgccagccgguccagc

SEQ ID NO: 4224324 - RNA, 60 nt, Bordetella pertussis
uguccggcggcgcaucgacgccgauauaggcgcccgacaacagcgugcccaggccggaua

SEQ ID NO: 4224325 - RNA, 66 nt, Bordetella pertussis
ggcgcggccgucgugcagcgugggcucgaugcguccgucggguugccgcugcaugggcggcccgcu

SEQ ID NO: 4224326 - RNA, 129 nt, Bordetella pertussis
ggcuggcucggcggcgccgaagcgcagcugcuguaccgccggguuggcgcugaggcggcgcgccugcgacaucagcucggcgcgcagcucgggcgggcagcugaccgugaugcaggccgacgccagcuc

SEQ ID NO: 4224327 - RNA, 76 nt, Bordetella pertussis
cguccuggauccgccagugcgcgaucucagccccgccgacuuggccgaccugcugcgcgucuugcgauccagggcg

SEQ ID NO: 4224328 - RNA, 80 nt, Bordetella pertussis
gggcggucucgcccagauaggcgccccagggccaggcggcgauggccacgugcaccugggcgcccuugggcgagaccccc

SEQ ID NO: 4224329 - RNA, 121 nt, Bordetella pertussis
gacgguaucgccuucguuguauugguucgacucgucaugcgccuuguacuuggccgaacgcaugaugaucuugccaaagauggggugcuugacgcggcguucgaccagaacgacgaccguc

SEQ ID NO: 4224330 - RNA, 59 nt, Bordetella pertussis
augcuguccagcgcguuccauucuucgguguacugcgccaugaacauguuaugcagcgu

SEQ ID NO: 4224331 - RNA, 94 nt, Bordetella pertussis
gcgcaacgaaaccggcgugcugaucggcaugguccauuacaugauucccuaugccgugcugcccaugcugaccaacaugcuggguaucgaccgc

SEQ ID NO: 4224332 - RNA, 62 nt, Bordetella pertussis
ggucaucaaggaagucgugugggacgagcucaagcacacguuccgccccgaguuccugaacc

SEQ ID NO: 4224333 - RNA, 63 nt, Bordetella pertussis
ccuggugccgcugccguucaucauguggaugauccacguggugcgcgaccggcugcgccacgg

SEQ ID NO: 4224334 - RNA, 90 nt, Bordetella pertussis
gcuguaugcccaguggcggaggacgcucgccgagguccgggccucagcugcccaucucgaagaagcgucccagccgcugcggcagccagu

SEQ ID NO: 4224335 - RNA, 98 nt, Bordetella pertussis
ggaugcgcuggaccacgucauugugggcgcgcggccagugccagugcuugcgcagcugccagccguccacgaugucgcccaccagguacagcgugucc

SEQ ID NO: 4224336 - RNA, 66 nt, Bordetella pertussis
cagcgcggcggccuggcgcugguuggcgaucagcucgcccagcguggcguccaggcuggcgcgcug

SEQ ID NO: 4224337 - RNA, 82 nt, Bordetella pertussis
gcgugagcaacggcagcagcguggcgcucaauggcgucgaggucgucgccagcgggccaucgcugcuguccacgcucagcgc

SEQ ID NO: 4224338 - RNA, 96 nt, Bordetella pertussis
cggcgcgccaggcgguguggcugccggucauguuucucgcgcugcuguucgccggcgcgaugaugggcauggccggcgugcgccugccugccgucg

SEQ ID NO: 4224339 - RNA, 61 nt, Bordetella pertussis
augggcgcgucgcuggcgucgaacucgcgcgaauacaggacgucgagccagucgcgcccgu

SEQ ID NO: 4224340 - RNA, 79 nt, Bordetella pertussis
ggccgugucgcugcccuggaagcggauggcgccgcugaccagcgcgccauccuccagcuccagcaggcgcgacaccgcc

SEQ ID NO: 4224341 - RNA, 62 nt, Bordetella pertussis
gcgugaggcuggcgccgcaggcacgcgagacgcauacgcacaccgcgucgccggccucgcgc

SEQ ID NO: 4224342 - RNA, 73 nt, Bordetella pertussis
ugggcgagcguguagccgucgggcagcggcgcauagcuccagacgcuggccagcgacagcagcagcacgccca

SEQ ID NO: 4224343 - RNA, 81 nt, Bordetella pertussis
cgugaaguugcacauguuggccagcaucagguaggacaggccuuccugguggauguccagcgugccggcggcggcuucgug

SEQ ID NO: 4224344 - RNA, 125 nt, Bordetella pertussis
cgucgaccggcgcgcccaguccggugguggcgccgaucugcugcgucaggccgacggucgugucgaccaccggcuugagcgucggauccagggccuugcccaccgcgcccagcgcguugucggcg

SEQ ID NO: 4224345 - RNA, 79 nt, Bordetella pertussis
gccccagccgucgcgcgcccagggcccgccgugcggguugacgaugcaggccagguuccugggcgcgcguccggccggc

SEQ ID NO: 4224346 - RNA, 103 nt, Bordetella pertussis
ucggcgcgcgccggcguguggcgcgcaugcagcgccuugaccagguccgacgugccggccaccagggcccgcagcggcgcgcccgcggcggcgauggcgccga

SEQ ID NO: 4224347 - RNA, 101 nt, Bordetella pertussis
gcucuggaacaccacgccaacuccccgcgcuuccggggcgagcgcggugacgucuucgucgccauagaggaugcgggugccggcgucgggcugcuccaggc

SEQ ID NO: 4224348 - RNA, 59 nt, Bordetella pertussis
gaugauguagcgcgugacgcgccgccgugggaggcggcgguuuuucaggcugcaucguc

SEQ ID NO: 4224349 - RNA, 55 nt, Bordetella pertussis
aaggcgcaggcgugcgauggccuguauucguacggccaugucacggccuugccuu

SEQ ID NO: 4224350 - RNA, 83 nt, Bordetella pertussis
aaaccuauuagaaaucaagugucuaaugaauuaugauaugagucugcauacauagacuuuggcgcuugauuccucauggcuuu

SEQ ID NO: 4224351 - RNA, 75 nt, Bordetella pertussis
cguccgccuucgaggcugguuucgucucggccacgcacgacgacgccgucaucgacgccacccuggaggcggccg

SEQ ID NO: 4224352 - RNA, 74 nt, Bordetella pertussis
gugccguucuucagggcgaccuugaacaugccgcggcgggccuguuccauugccuucugaaccgacaccggcac

SEQ ID NO: 4224353 - RNA, 109 nt, Bordetella pertussis
ggcccggcuggcgauagaaacgcucgaagaugcgcucgugccggucggcgggcacgccaggcccguuguccagcacgcgcaggccgaccgcgcuguucuccagcgggcc

SEQ ID NO: 4224354 - RNA, 60 nt, Bordetella pertussis
gcuggggcugucggucagcagcaugaccaggcggucgaugccgaugccgcagccgccggu

SEQ ID NO: 4224355 - RNA, 80 nt, Bordetella pertussis
gggccaccauguucugcggcgcguugaucggcaggaugaaaccguagcucaccacgaaaccgagcagcauggucaugccc

SEQ ID NO: 4224356 - RNA, 100 nt, Bordetella pertussis
ggugucgggcggcgucaacgugcagaagaaggcgcucgccgcggucggcgaaagcgccggccagcgcgccgagcgccuggccgcgcggcugcgcgacgcc

SEQ ID NO: 4224357 - RNA, 56 nt, Bordetella pertussis
uguucuggcccagcgcgaguucaccgaggucgguggacgcgccgucggccagcacg

SEQ ID NO: 4224358 - RNA, 70 nt, Bordetella pertussis
cagcggaucgcgcugguagcgguaggccaccgccaccguggucaggcgcugcggcgaccagcgcgcgcug

SEQ ID NO: 4224359 - RNA, 79 nt, Bordetella pertussis
ggccggcggcagcgcggugguguagaugaaaccggagcaggcauugaccagguagucgcacagcgcccgcgagccggcc

SEQ ID NO: 4224360 - RNA, 62 nt, Bordetella pertussis
gguacuuugccagaacgcaugcgugcggucccggcucagccaacgcaugcgcagguaaagcc

SEQ ID NO: 4224361 - RNA, 60 nt, Bordetella pertussis
gccgcucgcuggcgcagcccaggcagccggccggcgccugagcgagcccagcgugcaggc

SEQ ID NO: 4224362 - RNA, 76 nt, Bordetella pertussis
cgugcaggucggcgauguucugguccggauugcgcgccggccagcgccccgaggccaggaucucgcgcgccucgcg

SEQ ID NO: 4224363 - RNA, 104 nt, Bordetella pertussis
cgcgugcuggccgauggcgagcggacgcugcuggacguggugcgcgggaugguguccgccgcccacgccuagcgucguccgcacgccgcgccgccggcgcagcg

SEQ ID NO: 4224364 - RNA, 94 nt, Bordetella pertussis
gcuggccugcagcccgaucacguaguuggcgccgcugcggcccaggcgcauaugcgucucgccgcccggcgccagguacacguggccaggcagc

SEQ ID NO: 4224365 - RNA, 73 nt, Bordetella pertussis
gguggggcgcgcguucggcauggaggugguggccuggagucccaaccucaccgacgagcgcgccgcccaggcc

SEQ ID NO: 4224366 - RNA, 77 nt, Bordetella pertussis
ggcgcgcgccagccgcugcacaucggcgucguccagggcaucgaccacgaccaccggagcggcggcggcgaugcgcc

SEQ ID NO: 4224367 - RNA, 79 nt, Bordetella pertussis
ucagccgcuugcugggugacgacuucaagcaaaccauccggccaggagcgcgggugaggaucgcugccucaagcucuga

SEQ ID NO: 4224368 - RNA, 55 nt, Bordetella pertussis
gagcgugggaggcggggugcgggcgcgcgauggccuggcaacgccgcccgcguuc

SEQ ID NO: 4224369 - RNA, 81 nt, Bordetella pertussis
ugcuggcgaccuuuuacgugcugggucugaccauggugguguucgcgcucaccauggugauuccgcuggcggucgccuaca

SEQ ID NO: 4224370 - RNA, 97 nt, Bordetella pertussis
ggacgccggcgcgcacgucgcauugcgcggcgccagcggcgccggcaagacgaccuugcuggaguugcuggcgcgcuugcgcgacggcgccggcgcc

SEQ ID NO: 4224371 - RNA, 60 nt, Bordetella pertussis
gcacccugggcguacgcgcggauaugaccucgcaggucacgcgcaucgacgcccaucugc

SEQ ID NO: 4224372 - RNA, 82 nt, Bordetella pertussis
gccgcaagcccgcaucaagcgccugcugggcgagcuggugccgcagcuggccagcgugcaugagcagggacauaucugcggc

SEQ ID NO: 4224373 - RNA, 63 nt, Bordetella pertussis
uguacaucaucguggcccuggugaugcugcugcgcggcuucgccgacgccaucaugaugcgca

SEQ ID NO: 4224374 - RNA, 75 nt, Bordetella pertussis
gcggcgcugggcccggggcgguccgccaugcugacguucaagcugagcuacugauccgggcugcaaccccgccgu

SEQ ID NO: 4224375 - RNA, 103 nt, Bordetella pertussis
gggucggggcggugaccagcggcccguugaugguguagagcaggguguagccgucaggcuuugccugcgccaccaugcgggugccgauauugccgccggcgcc

SEQ ID NO: 4224376 - RNA, 73 nt, Bordetella pertussis
ggccagcagggacauggcagugccggguucagcgaugggcccgcuucauucggcccgcgccaugcucugcgcc

SEQ ID NO: 4224377 - RNA, 58 nt, Bordetella pertussis
guucuucuugacgaugccgaucagcaggaacacgccgaucagcgcgaucagggugaac

SEQ ID NO: 4224378 - RNA, 122 nt, Bordetella pertussis
ggcguucgcgcaggucccggcgcagcgccggcucgauggcgggaucguugaaaucgggcucggccucguccaggccauagccggucucgcgcagcaggauccacucgaagcgccgcaacgcc

SEQ ID NO: 4224379 - RNA, 129 nt, Bordetella pertussis
ccgcgcgccaacccaccggccgcuucgucgccauggaaaacguggcggcccuggucgccuuccugugcagcgaugccggacgcgacaucacgggcgccacccugcccaucgacggcggcuggaccgcgg

SEQ ID NO: 4224380 - RNA, 71 nt, Bordetella pertussis
gcugguugggcugugcuacugaugcggcaaguugucuuagcuugucgccaugggcgcauagccgcggcagc

SEQ ID NO: 4224381 - RNA, 61 nt, Bordetella pertussis
ggcgcgccuggugggagcgaccgaguccuucgugcgccgcccguuccuguaccagggcgcc

SEQ ID NO: 4224382 - RNA, 67 nt, Bordetella pertussis
acgagcguugggauucguucaucaaggccaacaacaucagccucgagaacugacggcggcgccuagu

SEQ ID NO: 4224383 - RNA, 102 nt, Bordetella pertussis
gcggcgccgagagcacgccggucuggcagcgcaucuucugguccacccugaugggcguggucgccaucgcgcugcugcuggccgacggccugcaggcgcugc

SEQ ID NO: 4224384 - RNA, 115 nt, Bordetella pertussis
uacggcaucgauggugggcuccgaucaggucuucgacgccgugcugcgcgaguucgguguguaccgcgcgcauucgaucgaagacaugcucgacgucgccuaugcacugaccgua

SEQ ID NO: 4224385 - RNA, 56 nt, Bordetella pertussis
aucgugcugaaguacggcgagcgcgugcgcuucgugcuggucaacgacaccaugau

SEQ ID NO: 4224386 - RNA, 70 nt, Bordetella pertussis
gugcgcaggugggcgugcgcuucgagcugaugcaacagaucuggcugacgcacgacccgcagcugcgcac

SEQ ID NO: 4224387 - RNA, 55 nt, Bordetella pertussis
guugcuggguucgucgagcagcagcagguuggguuuuugccagacgaucagcgac

SEQ ID NO: 4224388 - RNA, 71 nt, Bordetella pertussis
ggccgcauuucguguccacauuuggguuuucgugcacugcgaaaaucccaagaaccgcauggauauugguc

SEQ ID NO: 4224389 - RNA, 67 nt, Bordetella pertussis
aacugggccuugaagucggucucgccgcgguuguauuccucguaggccacgacuucggcgcccaguu

SEQ ID NO: 4224390 - RNA, 67 nt, Bordetella pertussis
gaugauggcgggugcguugaagcugagcgcggugcccugccccuccgucacgcucucgccgaucguc

SEQ ID NO: 4224391 - RNA, 65 nt, Bordetella pertussis
cccgcacgauccgcaggccggcgugcgcgaauucccguucacgcgugagcuguggaucgagcagg

SEQ ID NO: 4224392 - RNA, 75 nt, Bordetella pertussis
cgcccugucggugcgcauggaacugcaggccgacugcuucgccggccugugggcgcgacgcgccgaccaggcgcg

SEQ ID NO: 4224393 - RNA, 56 nt, Bordetella pertussis
gagcuguuggugcugcccacgaccagcaccaggucgcacuccggcgccagcagcuu

SEQ ID NO: 4224394 - RNA, 72 nt, Bordetella pertussis
gcgcccaacgccggcugaagcacggcggcgcgggcuggcggccgccgcgcuucaggcggcgucuucgagcgc

SEQ ID NO: 4224395 - RNA, 73 nt, Bordetella pertussis
gcgccaauacccagcuggccgagcugauccgcaagcugcagcuaccgcugaucauguuccagcugggcggugc

SEQ ID NO: 4224396 - RNA, 104 nt, Bordetella pertussis
caguucucggccacgcaguucgcgcugcugucggcgcuggccgcggugggccgcaccuaccuggccgggccgcugacgccggugcuggucgaguggcucgacug

SEQ ID NO: 4224397 - RNA, 64 nt, Bordetella pertussis
acgaccagaucaugcgcuuggguuggaagaucuucaucccgcugaccggcguguggcuggucgu

SEQ ID NO: 4224398 - RNA, 72 nt, Bordetella pertussis
gccgcugaccgauaugcuggagcaggagcccaaccugaccgacgaggaacugcucgagcgugugguggcggc

SEQ ID NO: 4224399 - RNA, 55 nt, Bordetella pertussis
gcgguugggcacggccaggaucaggcuggucuuguccuugccgcugcucaauggc

SEQ ID NO: 4224400 - RNA, 67 nt, Bordetella pertussis
cagcgacgaagugcgcagcggcgccgaggacacccaugucguggcccgcuggagcgccaucgcgcug

SEQ ID NO: 4224401 - RNA, 61 nt, Bordetella pertussis
ggcgcgcagcgcguagcccuugacggucaggcccugggccagggcaugcgccaggcgcgcc

SEQ ID NO: 4224402 - RNA, 59 nt, Bordetella pertussis
gcagcaugaagcggucgcgguacucgcccaucagggcgucgaugaucugcucauccugc

SEQ ID NO: 4224403 - RNA, 57 nt, Bordetella pertussis
gccgaugacgauggccaguucgacgcccagugcggcgacuucggcgaucucaucggu

SEQ ID NO: 4224404 - RNA, 72 nt, Bordetella pertussis
gccgaaaguggucagcgcauacucggucacgucguggccgcgcugcaccgagaugcgcuugaucgccucggc

SEQ ID NO: 4224405 - RNA, 83 nt, Bordetella pertussis
uccuguggaucaagcaguugucgcugaucgucggcguggaagugcacgccaucgcgcuggcgcucagcgccuucuuccuggga

SEQ ID NO: 4224406 - RNA, 71 nt, Bordetella pertussis
gcguggcgaucugcucgcuggcgaugaggcggucaaaacgcgccuucucgacguugagcaccuugccgcgc

SEQ ID NO: 4224407 - RNA, 60 nt, Bordetella pertussis
guccuugaguauagccggauugcuggcgcugacgcagucgaucucggacugcucgaugau

SEQ ID NO: 4224408 - RNA, 83 nt, Bordetella pertussis
cgguguagugcacgcacuccugggggacaugacgccacuucguauucugccccuuuucuuccagguagugcgucaggacgcug

SEQ ID NO: 4224409 - RNA, 89 nt, Bordetella pertussis
ggaaggccuguggcggcaauggaaucgcaugguggacaucgaauucgacauguccaccggcgcgaucauccugcgggugcgggccuucu

SEQ ID NO: 4224410 - RNA, 69 nt, Bordetella pertussis
gccgagacggucgagcacaugcugacgcaggccgcggccagcggccuguccaucaugugcuucgucggc

SEQ ID NO: 4224411 - RNA, 96 nt, Bordetella pertussis
gggcgucugugccacaaugggauguuugcccggacggccaucgcgccgcccuucgccgcgauggcggccgggcggauaccgaacacacacgacucc

SEQ ID NO: 4224412 - RNA, 64 nt, Bordetella pertussis
gccccuggccgacggccugguggccgacuaccccaucgacacccaucaggccaucgccagcggc

SEQ ID NO: 4224413 - RNA, 75 nt, Bordetella pertussis
gacagcgggguaucggucuugguggcgguggcgcugcgcguggcggcauagccgucgaccgggccgguggcgguc

SEQ ID NO: 4224414 - RNA, 78 nt, Bordetella pertussis
ggaacgagaucgacuaccgggcgcugaucgagcccacgcggaucaauagccgccuguacgucgauccggagaucuucc

SEQ ID NO: 4224415 - RNA, 64 nt, Bordetella pertussis
gcgcggcaauccgcgccaugucgucggcguccaacgccaggccgcgggccagcagauugcucgc

SEQ ID NO: 4224416 - RNA, 56 nt, Bordetella pertussis
cgcugcgcuuuggcgacggcagcaucgccgugcuuucgcuguuucccagcgcggug

SEQ ID NO: 4224417 - RNA, 55 nt, Bordetella pertussis
caaggugccgucggccucgaugccggauaugccgaucaggccgaugucgaccuug

SEQ ID NO: 4224418 - RNA, 100 nt, Bordetella pertussis
gccugcuggcuggcauggggcacgcgcggccugccgggcauggccgcggcgcgccgcaccacccuggccagacugcgcgccacccuggccgcgcccgggc

SEQ ID NO: 4224419 - RNA, 74 nt, Bordetella pertussis
cgacgucauggauguugaccagcacggggaugccguugacgcugcccuguucggucagcaguuccaugaucucg

SEQ ID NO: 4224420 - RNA, 67 nt, Bordetella pertussis
cauggcguuguugaccagcacuuuguccaugaccaccuggaagaacaagggcgucaacagggcaaug

SEQ ID NO: 4224421 - RNA, 62 nt, Bordetella pertussis
ggaacauggcccgguugguggcgauuccuuccaugaggaacggcaccagccgggcuuuuucc

SEQ ID NO: 4224422 - RNA, 76 nt, Bordetella pertussis
ccgucaugcuggcgcugucguucgccuugcugcuggucaucaaucuguugcagggcuggcagacgcgccguggcgg

SEQ ID NO: 4224423 - RNA, 61 nt, Bordetella pertussis
cgagaucugguccaucaggaugcgggcagccuggcgcaccgcuuccucgggcgagaucacg

SEQ ID NO: 4224424 - RNA, 67 nt, Bordetella pertussis
ggccguucagcucgauggcgcgguggcucaccagcugacgggcuuccgcgcgcgucgagccgaagcc

SEQ ID NO: 4224425 - RNA, 84 nt, Bordetella pertussis
gcggcgccaaugaagggcaggucaaggugcgcgcggagcuggccgacauggugcgcuucgagaccuugaaccugcuggcgccgc

SEQ ID NO: 4224426 - RNA, 83 nt, Bordetella pertussis
gcccggucgacgaccagugcgucaaccugcccgugcgcgagcccgugcgcaugcggcuggcgcgcugccaccgugugcugggc

SEQ ID NO: 4224427 - RNA, 130 nt, Bordetella pertussis
ccugcacgaucaaggcauugaggcgcgugucggccugcacgcugggcucgcucaggcgccggccggcugccugggcugcgccagcgagcggcgcguucccgucagcugccgcaucgccgaacaccggcgg

SEQ ID NO: 4224428 - RNA, 78 nt, Bordetella pertussis
ggcaucuguccgcgccgggaaaaagagccuguccccgucgggacaggcucuuuucauuuggcguagauccaggcggcc

SEQ ID NO: 4224429 - RNA, 76 nt, Bordetella pertussis
cguauagaccggaaacucgauggcgaugaaggacagcgcggcccggucgagcucgccgucggggccggucaguucg

SEQ ID NO: 4224430 - RNA, 57 nt, Bordetella pertussis
acuucgacgcgacccugaccaagguguccggcaagcuggucaaggucucgucguggu

SEQ ID NO: 4224431 - RNA, 56 nt, Bordetella pertussis
ggcgcuaggcgccggccacggucggcggcaucgauguggccaccucgcguggcgcu

SEQ ID NO: 4224432 - RNA, 75 nt, Bordetella pertussis
cgcgcccuggccaucggcguaugggccgccaucgccuccggcggggcggcccuggggccgguggucggcggcgug

SEQ ID NO: 4224433 - RNA, 124 nt, Bordetella pertussis
ccuugccggccgaaaucgugaucacggccaugucggggcagaggcggcgcaggcggcggaugaaguccacgccgucccagcuuugcgccggcaugaagaaaucgaugacggccgcgucgcaagg

SEQ ID NO: 4224434 - RNA, 76 nt, Bordetella pertussis
gucgugguucccgaugcugcugcugaucggcguauggaucuucuucaugcgccagaugcagggcggcgggcgcggc

SEQ ID NO: 4224435 - RNA, 64 nt, Bordetella pertussis
caccuuccagcauccgcuggcggccgcggccugacgggcgggugccggggggugcugcggggug

SEQ ID NO: 4224436 - RNA, 71 nt, Bordetella pertussis
cggcgaacuucucguacaccacgcgcgagccggacacccauuucgcggccgcgaaggugaacgggccgcug

SEQ ID NO: 4224437 - RNA, 85 nt, Bordetella pertussis
ugggugaugaacacgacgcccaugcgcauuuccuccugcagcuggcggaucagcugcaggauuugcgccuggaucgugacaucca

SEQ ID NO: 4224438 - RNA, 130 nt, Bordetella pertussis
ucggcccauucgagcagcuguugcgcaucgcgcaggcgggcgaauucggccuggucgacgaagcgguacucgcggccgucuugcucgccggggcgcggcgcgcgcguggugcacgaaauggacagcacga

SEQ ID NO: 4224439 - RNA, 101 nt, Bordetella pertussis
gccacccagguccagccccaugcgccggcaauggcgccggccaccgccggaccgacgagcaggccgguguuguugcccugcaugaugaugcccaugguggc

SEQ ID NO: 4224440 - RNA, 58 nt, Bordetella pertussis
cuggacgcucguggcccccggcggggaagagcugucgcugucggccaacgagcggcag

SEQ ID NO: 4224441 - RNA, 114 nt, Bordetella pertussis
gacgugguguccggcggcgcggcgcggcuggucaccauggcggccaagcagcccgagguguucuacaucguggccgccaaccaguacggcggcgaccguuacggcaucaucguc

SEQ ID NO: 4224442 - RNA, 66 nt, Bordetella pertussis
uauugcgcuuguggcgaaggggcguuggcauuaugcuggccgcccucugcccgcggcaagccagua

SEQ ID NO: 4224443 - RNA, 127 nt, Bordetella pertussis
gaugccgcuguacguggcgcugggggcgggcggcaugcccgcgcgccgccucaacgacgaggucgcauacggcgcgcuggccauggacgccuaccaguucggcgccugagccgcggccggcggcauc

SEQ ID NO: 4224444 - RNA, 130 nt, Bordetella pertussis
gggcgugggcucgcugucgcaccuggagucggcgcuguuccuggacggaucgaaggcgcaggccgagcacgucccguacaagggcagcgccgaagcccugcccggccugaugagcggcgagaccgcguuc

SEQ ID NO: 4224445 - RNA, 56 nt, Bordetella pertussis
cgcgggcuggccagccggcgcagcgcguagacguagucgucggcgaccagcucgcg

SEQ ID NO: 4224446 - RNA, 76 nt, Bordetella pertussis
uucgggcaccgucuaugucgaggccgaagccuguggccugccggucgucggcaccgacgugggcggcguguccgag

SEQ ID NO: 4224447 - RNA, 60 nt, Bordetella pertussis
ucgacaccuacgagccggcgccgcaauugcugcaaugcgcgcccggcgacgagguggagg

SEQ ID NO: 4224448 - RNA, 79 nt, Bordetella pertussis
gcccgaguaccugcgccuggucgccccgcacacgccgggcgcgcugccggugcggguggcgcgggugcaggacguuggc

SEQ ID NO: 4224449 - RNA, 55 nt, Bordetella pertussis
gccgcugcaacugcuggcugaccgcgcucugggucaggugcagcagggcggcggc

SEQ ID NO: 4224450 - RNA, 73 nt, Bordetella pertussis
ggucagguuguugaugcugaagccggccagguacaugaugccgaacgugccgaucagcgacagcggcaccacc

SEQ ID NO: 4224451 - RNA, 57 nt, Bordetella pertussis
gcccuggcggccgucgaucucgucacgcagcagccacagguugaugugguccagggc

SEQ ID NO: 4224452 - RNA, 55 nt, Bordetella pertussis
ggcgagagagcaacgcuuagugcugcgagucaguguuaagcguuggguuuuggcc

SEQ ID NO: 4224453 - RNA, 92 nt, Bordetella pertussis
ccgcgccugugcgaugaauccgcaggccgcggcgcugaugggcauucccucgucggugaugcgcggccugggcuucuuccugucgggcgcgg

SEQ ID NO: 4224454 - RNA, 110 nt, Bordetella pertussis
cgccgcccgaucccguaggcuggaagcugccgcgcggcucgcuggcgcgccaccucgugcugcgccugaugccgccgguguugcugcuggugcugcuggaucuggccgcg

SEQ ID NO: 4224455 - RNA, 58 nt, Bordetella pertussis
ucgauacguucgcccgcgaaacggcggaacuccgccucguugcgcaacggacgaucga

SEQ ID NO: 4224456 - RNA, 83 nt, Bordetella pertussis
gcucuugguggcgaugcugcgcggcagcaccgaggcgucguccugcucguaguagcgccggcacagcucgaccaccaggcggc

SEQ ID NO: 4224457 - RNA, 99 nt, Bordetella pertussis
gcgccaauugcuggcgcuggacgagccgcccaccgcggugguggccaccaacgagaucguggccgccggcgcgauggcggccgcgcaccggcagggcgu

SEQ ID NO: 4224458 - RNA, 65 nt, Bordetella pertussis
gauggguuuccugcgugacgaagccgaucuggcgccgggucggauugaagcgcaggucgcgcguc

SEQ ID NO: 4224459 - RNA, 68 nt, Bordetella pertussis
guugcggcaggauaucgauguagcgcaacucggccguggccgcgcgcacgcggguguccuguugcagc

SEQ ID NO: 4224460 - RNA, 66 nt, Bordetella pertussis
ggcuguucucgcugcugccgcucgagccgcugcuguaggcgcgcucaggccagcagcgacacggcc

SEQ ID NO: 4224461 - RNA, 70 nt, Bordetella pertussis
uuggcgcguccggcucagcggcucagcggcgcggcggcguggcgggcggccugggcuuggacagcgccga

SEQ ID NO: 4224462 - RNA, 70 nt, Bordetella pertussis
gcuggugguggccggcgugccgcgcgugccguucaagcccgccacgcccgggccgcugugccacgcccgc

SEQ ID NO: 4224463 - RNA, 57 nt, Bordetella pertussis
ugccguccuugucgaugcgguccuugaucagcuugaagacguacggauaggacggca

SEQ ID NO: 4224464 - RNA, 94 nt, Bordetella pertussis
gaugucgcggauuucgaaauccauucccuucucgaacagcacgaaacggcagcguugcgagaacgggcaggugguuccggaauagagcaccauc

SEQ ID NO: 4224465 - RNA, 77 nt, Bordetella pertussis
gcggccggcgcgguugagcaccacgucguugacggccgaggccgaguacaucugcugcucgccgcgccagacgccgc

SEQ ID NO: 4224466 - RNA, 64 nt, Bordetella pertussis
cuugugcggcagguugaaguugcucggcggcaaguucgcugccgggauccgcuugccguuguag

SEQ ID NO: 4224467 - RNA, 80 nt, Bordetella pertussis
gccggccggcacgccgggcaggccgaugcccggcagccagaugcccagcggccagaugccuggcgcugcuccgggcgggc

SEQ ID NO: 4224468 - RNA, 85 nt, Bordetella pertussis
gggccuggaugugcuggccgagaucaagacgccgaugaucgcccuggcggcgucggcggugaucgucgagcccauguccgauccc

SEQ ID NO: 4224469 - RNA, 59 nt, Bordetella pertussis
cuggaucggcaacggcggcgcgucgcgcuacuacgugguguucgccaagaccgauccgg

SEQ ID NO: 4224470 - RNA, 76 nt, Bordetella pertussis
cggcgcgccuucgguuucguacaggauggcgcuggcgccacgcgccagcgccugauccaugaauuggcgaccgucg

SEQ ID NO: 4224471 - RNA, 63 nt, Bordetella pertussis
gucgucguugcggcagucuucgacgauacugccggcguccaugaagaugacgcgaucggcgac

SEQ ID NO: 4224472 - RNA, 87 nt, Bordetella pertussis
gacaucgcccucaccuccgaugguuugugaauuauuuaauaauccgaaugaucguucgauuuauaaaugaggaggcggcggcauguc

SEQ ID NO: 4224473 - RNA, 59 nt, Bordetella pertussis
uggccgcacgcagcccgacgacggcgacaucgcccgcaguucgggccugcgcguggcca

SEQ ID NO: 4224474 - RNA, 78 nt, Bordetella pertussis
gcacauugcgccaauugcgccaguccaggcggggccggucggucuggucgcgguuguacggcgcgucguagaugaugu

SEQ ID NO: 4224475 - RNA, 56 nt, Bordetella pertussis
cggcgcccuugcaugcgcgucaacugcgcgccuuguugacgcgacgcgaggcgcug

SEQ ID NO: 4224476 - RNA, 63 nt, Bordetella pertussis
cacgauggacaggccgaccgccacccgcugguccagcgucaucuggccgaccugcccgucgug

SEQ ID NO: 4224477 - RNA, 64 nt, Bordetella pertussis
cggcuggucaugauggugcgcgaaacgccguucaaccuggcccacuugcgcaauaugaccgccg

SEQ ID NO: 4224478 - RNA, 85 nt, Bordetella pertussis
gcgguagcgccgcagcagcugguggcucaggccgcugucgaauuccagccgcagcagcggauagcgcgccagcagcggcgcgagc

SEQ ID NO: 4224479 - RNA, 94 nt, Bordetella pertussis
cgccacgcugggccgccugggcuugcgcuucggccgccgcaucgcccuggccggcggcaacaucgugcagcccuacgccaggcucggcuggacg

SEQ ID NO: 4224480 - RNA, 55 nt, Bordetella pertussis
ggucugucagcgccacggccggcuggcccagcuuggccacgcgcuugaucagauc

SEQ ID NO: 4224481 - RNA, 96 nt, Bordetella pertussis
ccgcacccgccuggccgaggacauguucagcggacugggccccugggugcgccgccugccgggccgccuggugcaugucaacgugcugggcugcgg

SEQ ID NO: 4224482 - RNA, 56 nt, Bordetella pertussis
uugcaccgcaugaacgcguuuucgagcaucgcacgaaacacguugacaucggguaa

SEQ ID NO: 4224483 - RNA, 69 nt, Bordetella pertussis
ccggggcggcgcuggaugaucuugaacguggcgguggccuuggccaccaguucaccggcgcugucgcgg

SEQ ID NO: 4224484 - RNA, 94 nt, Bordetella pertussis
cuggcgagccuggucgaccagccccugcugcuuggcguccagcuugagcgacucgaucugcgccuuggacagcgggccgacgcccggcagccag

SEQ ID NO: 4224485 - RNA, 86 nt, Bordetella pertussis
gcggcugguacgucgacacggugcuggcgggcacgcgcuacaagcagcagaccagcucgucggcccaugucggcgcgaccagccgc

SEQ ID NO: 4224486 - RNA, 70 nt, Bordetella pertussis
gcgcggcagcucgggcaggaagaaggcgucguuggacgugauggcguguuccuugcccgggaugucgggc

SEQ ID NO: 4224487 - RNA, 59 nt, Bordetella pertussis
auaaaaaagcuguugaacgcgcccgucagacacuggcuccaguucagcagcuuuuuugu

SEQ ID NO: 4224488 - RNA, 60 nt, Bordetella pertussis
gaccugugcagccggaaaaugaugcagcacgaccugcaucaugcugaauuuguacagguc

SEQ ID NO: 4224489 - RNA, 104 nt, Bordetella pertussis
cuucccauucggguucgagcggcgugacguugacgaugaugccgcaacgcgcguaggugcucuugcccaggcagaucgucagcacgcugcgcgggaugcggaag

SEQ ID NO: 4224490 - RNA, 62 nt, Bordetella pertussis
gccuggcgccaguuggccgccgccgggcuggacgaugccggccagcggcaacuggcgcacgc

SEQ ID NO: 4224491 - RNA, 98 nt, Bordetella pertussis
gcagccggacggccgcaagcgcaugaucugggaaaccccgcccgaggaguggcagcgcgucauccaggucaaucuuugcggcuacuuuuucgcgcugc

SEQ ID NO: 4224492 - RNA, 83 nt, Bordetella pertussis
gucaggcuggaggugucgcauggcgucuaccuggacuucuccuaugccgucuacccgcgcuccgaggugcgccccagccugac

SEQ ID NO: 4224493 - RNA, 129 nt, Bordetella pertussis
ugacgccggaggaaagccucaaucgccaggaaaccgagcgugccgcguugcgcgcgacguucaugagcaagcuggacgucgacgaagagguggccgacauccugaucgaugaagguuucaccgguaucg

SEQ ID NO: 4224494 - RNA, 60 nt, Bordetella pertussis
ggucagcgugcgcggccaguuccugcaccgcgcgcucgaacugguguggcgcaugcugcc

SEQ ID NO: 4224495 - RNA, 70 nt, Bordetella pertussis
cgcugcgaggcgcggcgugcgaugauuacagaauuauuucaugucauauauuggcgccgcgcccugcgcg

SEQ ID NO: 4224496 - RNA, 89 nt, Bordetella pertussis
gcacgucgauggcggcgcgagccgagucaggauuggcauuguaggugucaucgaugagcacgguuccgucacucauuugccgaugcugc

SEQ ID NO: 4224497 - RNA, 67 nt, Bordetella pertussis
ggccacgaugcuguuguacgccaccgauugcgcgcccuggcggcggaauucguacagcagcucggcc

SEQ ID NO: 4224498 - RNA, 82 nt, Bordetella pertussis
cgcgacgcugcgguggccggcauccgcaagcugcugggcaucgcgccgggccagccggugccggccgaccaagucgagugcg

SEQ ID NO: 4224499 - RNA, 83 nt, Bordetella pertussis
gugcagguuccguucgagcuggcgcgcuucaucaacgccucgaucgacgaagugcgcaauacgcagcucgaggcgguccucau

SEQ ID NO: 4224500 - RNA, 55 nt, Bordetella pertussis
ccggguuucaucgaugugcacggccacgacgaccugauguucgucgagaagccgg

SEQ ID NO: 4224501 - RNA, 62 nt, Bordetella pertussis
ccucgcgcaaggccgccgcggcgcgcaccgccacggccgugccgucggccagccuggccagg

SEQ ID NO: 4224502 - RNA, 106 nt, Bordetella pertussis
ggggguacgcgugcccggcggcuuugccacgaccgcccaggccuuccgggacuuccugcaggcuuccggucuggacaagcgcaucgcugaccgucucgccacccuc

SEQ ID NO: 4224503 - RNA, 111 nt, Bordetella pertussis
uuugccgcggcauucgcugaccgagaauuugcgcaggguuucgaugucgucgccggagacgccgaugacgguggcgcccagcgcccgauacuggucgauggccucggcgaa

SEQ ID NO: 4224504 - RNA, 74 nt, Bordetella pertussis
gugcucggccaggcccagcaguccggcgguggugugaaagaacgagcccggaccgcgcugggccggcucggcau

SEQ ID NO: 4224505 - RNA, 78 nt, Bordetella pertussis
cgcuuaccgcggugcugcggcgcgccggcgcaccggcccaggggccggcucgggcuuucgcagcgccgucggcccgcg

SEQ ID NO: 4224506 - RNA, 81 nt, Bordetella pertussis
gcggcccaguucaggcgcucgaugcgcgcgccguugcccagauggaaacgggccaccggaucgagcggcuggccggcccgc

SEQ ID NO: 4224507 - RNA, 59 nt, Bordetella pertussis
ucgccgaugcuguucggcaucuggaaggugcuguuccgcggcgccgagcuguaucgcga

SEQ ID NO: 4224508 - RNA, 96 nt, Bordetella pertussis
ccgcgcaaggcagcgcgggcagggugcgcgcgugcgcgaucaggcguucguagugguuguggcgcgucgcgcucaugccgugcgccccuugcgcgg

SEQ ID NO: 4224509 - RNA, 60 nt, Bordetella pertussis
cagcugcccaucgaacgcgugcgccgcuucuucgacggccugcgcuucgagggcgugcug

SEQ ID NO: 4224510 - RNA, 103 nt, Bordetella pertussis
gcugcgcagcaaggccgugcugcugccgggcgucaaggugucgcuggucaacgagaaaaccggcgacacgcgcaccuggcaguaccaggagggccugcgcggc

SEQ ID NO: 4224511 - RNA, 72 nt, Bordetella pertussis
ucgauccggucuauaccgugcccaugcuggcugccgugcugguggccgcauggcgcggcaugacgccggcga

SEQ ID NO: 4224512 - RNA, 58 nt, Bordetella pertussis
uguggcaggcgaugccgccguucuggugaaccuucagcaggaugacgucgccgucgca

SEQ ID NO: 4224513 - RNA, 61 nt, Bordetella pertussis
guggcgauggcgaugucgucgaagcggaucuuggucagcgacguggcauggccaucgccgc

SEQ ID NO: 4224514 - RNA, 61 nt, Bordetella pertussis
gcgagcgccucggcguaggccucgaccaucaauucuuccuggcccacgucccagcguucgc

SEQ ID NO: 4224515 - RNA, 70 nt, Bordetella pertussis
gcugguucgaaggcagcgccucgaucaccuccauggucaacgacaaggccugggaagcgcugccgccggc

SEQ ID NO: 4224516 - RNA, 63 nt, Bordetella pertussis
gccguauucgcgcaugggcgaugggcgcgcgguguugcgcucgucggugcgcgaguaucuggc

SEQ ID NO: 4224517 - RNA, 64 nt, Bordetella pertussis
ggucuggcgggugccggcggccacggccucgaucagcaugucgucggucgcccacacccgcgcc

SEQ ID NO: 4224518 - RNA, 65 nt, Bordetella pertussis
gcagugccaggggucggccaucugccguugcuggucggcgacgaaguugccgugccccugcaugc

SEQ ID NO: 4224519 - RNA, 64 nt, Bordetella pertussis
gccaucugcauggcaagggcaacuucguggccgacauggccaugcccgggcugugcgagguggc

SEQ ID NO: 4224520 - RNA, 81 nt, Bordetella pertussis
cugcuggcgcgcaugaaggaaugguucaugaacugaucaggaagggacaggucggggccuguuccucggugcgcgcggcgg

SEQ ID NO: 4224521 - RNA, 80 nt, Bordetella pertussis
gccgccccggucggggcguugcaugcugcccacccggccccugugccgcgugggcauuuugcugcgcccgccgggccggc

SEQ ID NO: 4224522 - RNA, 81 nt, Bordetella pertussis
ggcgcgccgcccagguggccgcugagccaggugcccagcacuuccugggcgcccggcacgucggccgcgugcgugggcgcc

SEQ ID NO: 4224523 - RNA, 86 nt, Bordetella pertussis
ugcaccugcggacggcuggccaucaacggacgcagcgccucgaucaguucgcgaugucccuugguggcccgcaugaucgccacgca

SEQ ID NO: 4224524 - RNA, 62 nt, Bordetella pertussis
cgaugccgagguccugcuggcgcagccgcguggcuucugugccggcguggaucgcgccaucg

SEQ ID NO: 4224525 - RNA, 68 nt, Bordetella pertussis
gcggucggccaggccgagcaggcguucgacguauuugucgaugaccaggauggucuggccggcuucgc

SEQ ID NO: 4224526 - RNA, 55 nt, Bordetella pertussis
caucgacacgcucagcgccgugaaggccguggucuccggcgacgggcugucggug

SEQ ID NO: 4224527 - RNA, 62 nt, Bordetella pertussis
caagcaccaguuccuggcccuugcgcagguagcugcgcgacccggacaggaacagguucuug

SEQ ID NO: 4224528 - RNA, 58 nt, Bordetella pertussis
uccagcgugcgcgccaacgacagcuggcccagggcgaugucgcgguacgcgugcugga

SEQ ID NO: 4224529 - RNA, 69 nt, Bordetella pertussis
ugucgcugauucccggcaagcauuucgucgacaacuacaugcaggcgcuguucgccgguucgggcggcg

SEQ ID NO: 4224530 - RNA, 106 nt, Bordetella pertussis
guuguagcggcgcgggucgaacagcuggcggugcaccggcgagcagccgcugcccgggccgccaugcaggaauaccgccggcuugcccugcggguugccgcacagc

SEQ ID NO: 4224531 - RNA, 55 nt, Bordetella pertussis
gaccacgauguacugguccagcgcgcgcucgauggccuggaccuggucgucgguc

SEQ ID NO: 4224532 - RNA, 71 nt, Bordetella pertussis
gcgaucgcgggucgaugccggggcuucgauccaauggcacgggacgccgccggcaucgaccggcgugacgc

SEQ ID NO: 4224533 - RNA, 101 nt, Bordetella pertussis
gcacaaaagcguuagccaauguccggagggguaucguuuaccuggggguaaacccggccucggguuauggcuaccccugcccagguuaugacuugccgugc

SEQ ID NO: 4224534 - RNA, 73 nt, Bordetella pertussis
cggcgugccugucccgcaugaggacaggcgccugcccgugcgggugccuguccccgcugggacaggcacaccg

SEQ ID NO: 4224535 - RNA, 56 nt, Bordetella pertussis
cgccgcgucgaccuugaccgcgcgcaagcgguugaagugguugagcgacugcggcg

SEQ ID NO: 4224536 - RNA, 91 nt, Bordetella pertussis
gcgaucagcagcgcggccgcgguggcgggcacgccggccguauacgagauggccuggcugcccacuucgcgguaggccugcucguggucgc

SEQ ID NO: 4224537 - RNA, 60 nt, Bordetella pertussis
gacuucgacgaacagggcgauaucguugagcuggacgguuugcgcuugcaugacgggguc

SEQ ID NO: 4224538 - RNA, 112 nt, Bordetella pertussis
gcuggugaccucgcgcugggccggcaagcugaccgugaucgaccuggagaccaaaaaggugagccagcaggugcgugucggcaaaucgccgcacgguguguggacgcucggc

SEQ ID NO: 4224539 - RNA, 68 nt, Bordetella pertussis
ggugugcugccgcccagggcgaucacauaggcgucggccugcagcaaucccuggucggugugcacgcc

SEQ ID NO: 4224540 - RNA, 91 nt, Bordetella pertussis
ggugcugcgcagauggacggcgcgauccugguggugucggccgcagacggcccgaugccgcagacgcgcgagcacauuuugcugucgcgcc

SEQ ID NO: 4224541 - RNA, 56 nt, Bordetella pertussis
ccuggcgcaggacccgucguucuggacgcugguggcggcgguggugcugugccagg

SEQ ID NO: 4224542 - RNA, 130 nt, Bordetella pertussis
caagaugcgcggcgugcaauccucgggcaugcugugcucggcgcgcgagcugggccugucgcaggaccaugcaggccugcucgaacugccggccgcguugcgcccgggcaccgauauccgcgccgcgcug

SEQ ID NO: 4224543 - RNA, 75 nt, Bordetella pertussis
gcacgucgaugaccugcugccagucgcugaucgacaucuugucgaucauggcgguacgggucacgccggcguugu

SEQ ID NO: 4224544 - RNA, 63 nt, Bordetella pertussis
guggccgcaaugccgaaggccgcgaaggccuguaucugaucgacggcuucggcgugcugccgc

SEQ ID NO: 4224545 - RNA, 80 nt, Bordetella pertussis
ccgucagguacggaauacgcgcgaugccugacgaaugaagcucgaucaucgcaggaauugcguguaccagggcauggcgg

SEQ ID NO: 4224546 - RNA, 86 nt, Bordetella pertussis
ggcgcugcgcuaucugccgcagagcacggucaugaugggcgugccuaccuauuacgugcggcugcuggccgaugcgcgcuucgacc

SEQ ID NO: 4224547 - RNA, 58 nt, Bordetella pertussis
ggcgcgcaugcacccugcccacucgccaguuggcgaugcguaacgcgcauugcgcgcc

SEQ ID NO: 4224548 - RNA, 55 nt, Bordetella pertussis
ggccgccucggcgucgcgcuucucuggcgccaggaugcgggcgcccaggguggcc

SEQ ID NO: 4224549 - RNA, 63 nt, Bordetella pertussis
gcggacaugaucgauugcucgucgggacaggucagccccgaccagcagccgguauauggccgc

SEQ ID NO: 4224550 - RNA, 91 nt, Bordetella pertussis
gucggccgacuacgcgcaugccaagguguauuucacgguguugggcgccgagcccgacaccgcugccgccuugcugaacgaaaaggccggc

SEQ ID NO: 4224551 - RNA, 97 nt, Bordetella pertussis
gcuggcgccgcugcugcugaagagcagaccgaguucaccguugugcugcuggaagccggcgcgaacaaggucagcgucaucaaggccgugcgcgagc

SEQ ID NO: 4224552 - RNA, 59 nt, Bordetella pertussis
gccugcucgagcagugccuugucaccgaagcggugaucgaggcggguuuccagcguggc

SEQ ID NO: 4224553 - RNA, 61 nt, Bordetella pertussis
gaugugauguuguucuccgacgccggcaaggcggugcgcuucgacgagaacgacgugcguc

SEQ ID NO: 4224554 - RNA, 72 nt, Bordetella pertussis
gagaauccgcauuuguggacgccggaguuccgcgaagaaauccgcgaacucuuccgcaaagcggucgaacuc

SEQ ID NO: 4224555 - RNA, 87 nt, Bordetella pertussis
gccuaucccccgcuaucgggcauccugcacaguccggacgugggggucgacuacuacaucuggaccuugcagaucgccggggugggc

SEQ ID NO: 4224556 - RNA, 57 nt, Bordetella pertussis
ugguguacggccugucgcgcgcccgcgucgaggaaaccgccgacuuccugugcgcca

SEQ ID NO: 4224557 - RNA, 91 nt, Bordetella pertussis
cugccgccgguguccgauaccgugcccggcuacgacgccgauaucuggcugggcgugugggccguggccgguacgccggacacgguggugg

SEQ ID NO: 4224558 - RNA, 66 nt, Bordetella pertussis
uggccuggguugcggucaugccgggcaugcgcaccgccggcagcggcaugucauagcccaggucca

SEQ ID NO: 4224559 - RNA, 114 nt, Bordetella pertussis
uggccagcgugcgcacggccgccgauugcuccaggauggcgaccgcuuucuugaauuccucggccguggcgccguccucgaguaugaccaggcgggcguugcgcgcaucggcca

SEQ ID NO: 4224560 - RNA, 57 nt, Bordetella pertussis
uggcagcagaucgacuacggcucgcgcuauuccgagucguacauggauucgcugccg

SEQ ID NO: 4224561 - RNA, 68 nt, Bordetella pertussis
uuucaccaaucgcgugccgacggcgucuuccagguucuggauauggcgcgauacgacgguaugggaaa

SEQ ID NO: 4224562 - RNA, 65 nt, Bordetella pertussis
ggccgccggcggccagggcgcgccgcuggugccgccuuuccaugccgcguuguuugccggcggcc

SEQ ID NO: 4224563 - RNA, 70 nt, Bordetella pertussis
uugcuagcguugaugaccggucgccaggcggugcuccagcgccuggcuguacuuggacaucgagaagcag

SEQ ID NO: 4224564 - RNA, 112 nt, Bordetella pertussis
ggcuuugaccguacgcgggucgagaugcugaucgaucccgaugcgacggccaacguccacgaauugcucgcgcggggcgaguucggcgauuuccacgcgcgcgucagcggcc

SEQ ID NO: 4224565 - RNA, 125 nt, Bordetella pertussis
ccaugcggugccgguugucgcgcuugaaaccggcgcgggcguacagcagcagggucugcagcaugucggccaugcgcaaugccucgcgcgcggcguugcccagcgcgacggccggcacgucaugg

SEQ ID NO: 4224566 - RNA, 86 nt, Bordetella pertussis
ucugcacggcaucccgcacuacgcggugucgaucgcgcuggucgcccacgcgggcacgcgcgugguggcgggcgccgaccugcagg

SEQ ID NO: 4224567 - RNA, 63 nt, Bordetella pertussis
ccagcacgguggugccccacagcgccgucagcuuggcggcgaugaagcgcgccaccgcgucgg

SEQ ID NO: 4224568 - RNA, 79 nt, Bordetella pertussis
augacccagggcgugccaucgucgaaacggcgcgccugcaccaggcgcgccggauagggguggaucgccaugugggcgu

SEQ ID NO: 4224569 - RNA, 88 nt, Bordetella pertussis
ggcgcccgccgguucgcugcgcgugacggucugccaugcaugcccggacggggcauggcagcgcgccgucacgcugccggccggcgcc

SEQ ID NO: 4224570 - RNA, 58 nt, Bordetella pertussis
ggucaagguggccggccgcaugaugcucaagcgcgucaugggcaaggccagcuucgcc

SEQ ID NO: 4224571 - RNA, 60 nt, Bordetella pertussis
ccgcgcucaugcugaaauccgccggcuugaauuugcagcggauuccauacaagggcgcgg

SEQ ID NO: 4224572 - RNA, 61 nt, Bordetella pertussis
guucggcgugacccgcccggggcgcaccggcccguggucgccccgggcggucugccugggc

SEQ ID NO: 4224573 - RNA, 122 nt, Bordetella pertussis
cggaccuugaagccggcguccgaggcguggcggguggugguuucgcagcacugcucggugcggaugccgcagacgaugaucucgccgacgccaugcucgagcagccagucgugcagggugug

SEQ ID NO: 4224574 - RNA, 61 nt, Bordetella pertussis
caccgccgcgcccugggacgagcuggccaaggccgacgcauucgugcucagcucggcggug

SEQ ID NO: 4224575 - RNA, 57 nt, Bordetella pertussis
ugcgucaugcccaucagccgggccgcgcgcgacaccgagcuggugaucaugaucgca

SEQ ID NO: 4224576 - RNA, 58 nt, Bordetella pertussis
gguggggccgaacuggucgaucagccacauggcgucgucgaugcggccggccuccacc

SEQ ID NO: 4224577 - RNA, 78 nt, Bordetella pertussis
gcccggcagcagcgccugcagcagcaccagcggcgccaccagguucagcgccagcgugcgcugcauggcguccggcgc

SEQ ID NO: 4224578 - RNA, 60 nt, Bordetella pertussis
gccggaaggcccaagcaaaagcgccccguccggggcgcuuuugcuugggccucaacuggc

SEQ ID NO: 4224579 - RNA, 56 nt, Bordetella pertussis
ccaguugaucggccagcgccuggagcccucgcucagccuggcgaugaucacgcugg

SEQ ID NO: 4224580 - RNA, 67 nt, Bordetella pertussis
ggccgcgcgugaucgccagcgcgccgcuuucgagcucggccaggaugcguucgauggcgcgcgugcc

SEQ ID NO: 4224581 - RNA, 58 nt, Bordetella pertussis
guacggcacuucgacauggugcaucagcucgaagcugccuaucagcagaaugccgugc

SEQ ID NO: 4224582 - RNA, 73 nt, Bordetella pertussis
ggaccgggucuauguggucaguucgcagaugggguucgaagcccugaugcuggacaagcccgugaccugcuuc

SEQ ID NO: 4224583 - RNA, 75 nt, Bordetella pertussis
gggccuugcaggaugaccgugcggccguccuuggcgaugugccagauuucggccgugauggucgugcugcggccc

SEQ ID NO: 4224584 - RNA, 59 nt, Bordetella pertussis
guuggguacagggugcggcggccgguucaggacaccgucguccagcgcccguaccuggc

SEQ ID NO: 4224585 - RNA, 70 nt, Bordetella pertussis
cagaucacggccuugcgccaauccauggacaaacgauccccuguccgcggauugcagggccaguacucug

SEQ ID NO: 4224586 - RNA, 82 nt, Bordetella pertussis
ggcgcagggcuuucagguggugcgcgacccgcgccggccgcggcgcggcaucccguacgccgccuaucuggcccuggccgcc

SEQ ID NO: 4224587 - RNA, 70 nt, Bordetella pertussis
gccggcgcugacggccaugauccagaagcuggagacccagcuuggagucguccuguucacgcguacgcgc

SEQ ID NO: 4224588 - RNA, 56 nt, Bordetella pertussis
guucgagcgagcuggcauuccagaacuuguugaggaagugcgcggcgcgcuugcgc

SEQ ID NO: 4224589 - RNA, 77 nt, Bordetella pertussis
gcucggccacgcccgucaccgugaugcgaccguugguggcaucggucgucacaucggugaucguggguacggccggc

SEQ ID NO: 4224590 - RNA, 58 nt, Bordetella pertussis
guucgccgacggcacgaucucgggcggcaugcugcccaagaucucgucgucgcuggac

SEQ ID NO: 4224591 - RNA, 60 nt, Bordetella pertussis
cugcaccagccagcgcgccagcgugcccgcaucggccugcauggcggccagguuggucag

SEQ ID NO: 4224592 - RNA, 88 nt, Bordetella pertussis
gacgaugcguucgggauguugcggcgcgccgggaaacaggcgguugauccgcgugccggcggugcccagcaggucccagugcucgauc

SEQ ID NO: 4224593 - RNA, 69 nt, Bordetella pertussis
gugcgcaucgauggugccgaucuccacgcgcgccaucucgccgucgaagaacggcgccacgacccgcac

SEQ ID NO: 4224594 - RNA, 62 nt, Bordetella pertussis
aagcggaugcccaugaguucggucuggaugauguccugggccuugagauaggcguccgacuu

SEQ ID NO: 4224595 - RNA, 93 nt, Bordetella pertussis
gucucguucauggcguaugacggggagccugucccggccgggacaggcccccucgccaugcggggacaggcgccccgucaugcgcacgcgggc

SEQ ID NO: 4224596 - RNA, 92 nt, Bordetella pertussis
cguggcgcggcugaucggcgcgccgccgggauacgugggcuacgaagaagggggcuaccugaccgaggcggugcgccgcaagccguacagcg

SEQ ID NO: 4224597 - RNA, 83 nt, Bordetella pertussis
ggccguguuguugacgggcaauuucgugacgauucucgaucuguucaucgucaacguggcguugcccaguauccagcaugguc

SEQ ID NO: 4224598 - RNA, 79 nt, Bordetella pertussis
ggcagcggcgcggcgucguucggcaugguggucauccugaccaugauggccgccaugaguuucgauccgcggcgcagcu

SEQ ID NO: 4224599 - RNA, 68 nt, Bordetella pertussis
gugguguuguucuccaggcuggcgugcggcagcgagcggccgcagccgcgcuggucgaacagcagcac

SEQ ID NO: 4224600 - RNA, 72 nt, Bordetella pertussis
cgguugagcagaugggcgucgaugcgcgugaccugcgaggucauauccgcgcguacgcccagggugcgaccg

SEQ ID NO: 4224601 - RNA, 65 nt, Bordetella pertussis
gccgcgccgcagaucugggggucgggcuggccguccagcccaucuucacgcauuuguggggcggc

SEQ ID NO: 4224602 - RNA, 68 nt, Bordetella pertussis
guccacgcgcacgaccuuguugaucgacgccggaucgaugucgauguggaucuugcgcgcaugcggac

SEQ ID NO: 4224603 - RNA, 88 nt, Bordetella pertussis
accuggccaagucggccggcaagucgcguaccgcgcuggccgccugagcggccgggcuacugcgcgaccggcugccagccggccaggu

SEQ ID NO: 4224604 - RNA, 83 nt, Bordetella pertussis
guagcgcucguucagcuuggucagggccucggcgggcgcaucagcgauccgcucguaguccuugaccauuucgucgacgcugc

SEQ ID NO: 4224605 - RNA, 60 nt, Bordetella pertussis
agguguacacgcagguggucggcaccaguuuccucagccugccaucgugggugcacgccu

SEQ ID NO: 4224606 - RNA, 89 nt, Bordetella pertussis
guggccagccugaaggugaucugcugcagguucugccgcccgcugcgcgggugcuggaacucgcgcaggccgcccucgcgcucgaccac

SEQ ID NO: 4224607 - RNA, 76 nt, Bordetella pertussis
gugucauggccgaugaugcgguggcaggggaucaggauggaaaucggauuccugcccaccgcgccggccacggcgc

SEQ ID NO: 4224608 - RNA, 93 nt, Bordetella pertussis
gcagcuccauguuggaacgcgaugucucgauagugaucacaucggcguccauggccgcgaucgacucgaugaugucguugaacucggaguagc

SEQ ID NO: 4224609 - RNA, 97 nt, Bordetella pertussis
caagcuguacuugcagguauucggaguuugccaugguuugguaagucgccaugacccccuagccauaacagugcucuacccccugcaguaauacuug

SEQ ID NO: 4224610 - RNA, 69 nt, Bordetella pertussis
gggcuuggggcgcgagauguagucgucgaacuccucgggcagcggcguccacaucucgugcaccagccc

SEQ ID NO: 4224611 - RNA, 74 nt, Bordetella pertussis
gcgucgaguacuacgccgguucggaggucgagcgccugguccgccccgauaccucggucguguacugcgagagc

SEQ ID NO: 4224612 - RNA, 98 nt, Bordetella pertussis
ggcgggcgcgcaggccucgcccgaucggccggccgggccgcgcgaugcgcggcccggccgcauugggacgcggccuuuauugcuuuuccacgcccgcc

SEQ ID NO: 4224613 - RNA, 66 nt, Bordetella pertussis
uacggaaccagcgaugaaagaagagccgcgccggccggcgccgcuccccuuucgucccucacugua

SEQ ID NO: 4224614 - RNA, 82 nt, Bordetella pertussis
ggggcguucggcgguuguugccgguggcagaaucccgaggcaggcauucgccacgcgugcaagggccuucuucaagcgcuuc

SEQ ID NO: 4224615 - RNA, 63 nt, Bordetella pertussis
gcccaggucgaacgucaggcgcacggguaucugaucgguaucgagcgucgcgucggccugugc

SEQ ID NO: 4224616 - RNA, 64 nt, Bordetella pertussis
cgagucguuggucgaggugucgccgucgaccgugaugcgguugaacgagacgucggccagcucg

SEQ ID NO: 4224617 - RNA, 118 nt, Bordetella pertussis
ggcgccgcuggucggcauugauggcggccuccaccuggcuggagccggcgcggcgcgugcgcgccagcgucagccccaccacggcauaggccagcgucgccagcaccagcgguccgcc

SEQ ID NO: 4224618 - RNA, 66 nt, Bordetella pertussis
ggcgggccacguccaugccggcgcguaucagcccgucgagccgcucgggcguggacguggcgggcc

SEQ ID NO: 4224619 - RNA, 104 nt, Bordetella pertussis
gcgucucgacccagcguaccggaugccaugccuggcgcaccagcgcgucgcggauggccgccgguucggcaggcguggcgacgucgacauuguugagcaccggc

SEQ ID NO: 4224620 - RNA, 57 nt, Bordetella pertussis
ugguggcuucgguggcggucugcgccugggcggcgccggccgccagcgaggcggcca

SEQ ID NO: 4224621 - RNA, 64 nt, Bordetella pertussis
cagccgcgucaggucgggccgcuccagaucguagggcgcgaaggcggccggcuugaugcgcuug

SEQ ID NO: 4224622 - RNA, 76 nt, Bordetella pertussis
gguaguccagcgcauggucgaggaugcguaugccggggacguagccgcguccuccgucgcugcgcucgacauagcc

SEQ ID NO: 4224623 - RNA, 91 nt, Bordetella pertussis
guccucacguuacggcaucacgacguugcgcagguccagcacgucgucggcgcgcuggaucaguuugauguuguccuugacgccccaggac

SEQ ID NO: 4224624 - RNA, 76 nt, Bordetella pertussis
ggucgacuaccuggacucggucucgcugcaggaucucgucgaucagcagcgcgugcgccaguugcaggaagcggcc

SEQ ID NO: 4224625 - RNA, 110 nt, Bordetella pertussis
gcgugcccaaucccgcgcguccggcggaauucugggccuaucugcccgggcucguacugcuggcccuggugugguucgcccaggggcgccgccagcgcgcggcggcgcgc

SEQ ID NO: 4224626 - RNA, 105 nt, Bordetella pertussis
gacagccgcaucggcgugacgguguugaccggauuccugggcagcggcaagacgacgcugcucaaucgucuggugcaggagcccgaguacgccgaggcggugguc

SEQ ID NO: 4224627 - RNA, 56 nt, Bordetella pertussis
gcgccaucucgucgcuggucaucagcuucucgaugucgaccaggaugagcaugcgu

SEQ ID NO: 4224628 - RNA, 87 nt, Bordetella pertussis
acugcacguucucggccuugauguugcucagcacguccagcagguagcugacguugaagcccacauccagcggcucgaagcuguagu

SEQ ID NO: 4224629 - RNA, 119 nt, Bordetella pertussis
gcgcagcgucucggccgguccggcguagagcucgauggcgcggccgcgccggugccgucccaccagggccggccguuccgaucggggccccaugugcuggcagccgaaccagaccgcgc

SEQ ID NO: 4224630 - RNA, 61 nt, Bordetella pertussis
acgucgccgcccaggcggaucgaggugaacgacaccugcucgaccacccggcgcgcggcgu

SEQ ID NO: 4224631 - RNA, 67 nt, Bordetella pertussis
caaggcuucgucggucagggugccgggcgugacgaugcgcacgaugcggcgcucgaccggccccuug

SEQ ID NO: 4224632 - RNA, 56 nt, Bordetella pertussis
ggccgauggcgucgcgcgcggcgcggaacucgcgcacgaugucguggccgucggcc

SEQ ID NO: 4224633 - RNA, 61 nt, Bordetella pertussis
ggcaggaaggccgcuggugcgagaaccgcauguucgaagagcagcgcgccugggaccugcc

SEQ ID NO: 4224634 - RNA, 118 nt, Bordetella pertussis
ggcggaccgcuggugcuggcgacgcuggccuaugccgugguggggcugacgcuggcgcgcacgcgccgcgccggcuccagccagguggaggccgccaucaaugccgaccagcggcgcc

SEQ ID NO: 4224635 - RNA, 85 nt, Bordetella pertussis
gcccucgcgcaggcguuugcggaaagucuggcgcgcgcuguuguccucgccgcgcucgggcucgccggaggcgccgcgcggcggc

SEQ ID NO: 4224636 - RNA, 82 nt, Bordetella pertussis
cgucgguccggugcugaugaucaauggcucgcugggcgccggcggcgccgagcgucaauucgucaacaccgccguggccaug

SEQ ID NO: 4224637 - RNA, 88 nt, Bordetella pertussis
cggcggccuguugcgccaguugccgcaagucgcgcguauagccguccagcgugugcgccgaauagcggcggugcgccugcaggugccg

SEQ ID NO: 4224638 - RNA, 90 nt, Bordetella pertussis
gcugguggagacgaaagcgcuguugcugcugccgaccuggcaggaacguccggucagauggucgagcacauugucguuguuuccccacgc

SEQ ID NO: 4224639 - RNA, 94 nt, Bordetella pertussis
ucgucggacucggccacgccaggcaguucguacgcgcggccgauggcaccgucggcgcgcgcuucgaaaugcagggugucggccaggucgauga

SEQ ID NO: 4224640 - RNA, 129 nt, Bordetella pertussis
gagcggccggcccgcgccgucgacgacgcggcccagcauggcguugcccaccggcagguggcggcccaccugcggcuuggcguugccguugaguucggccuugcgcggcagcggcacgggccgcugcac

SEQ ID NO: 4224641 - RNA, 72 nt, Bordetella pertussis
ggucagggcgcccgagaaaauguugaugauccagaucuccuugucgccgaucuucucgagcagccacaggcc

SEQ ID NO: 4224642 - RNA, 85 nt, Bordetella pertussis
gcgcaaucagcaugccuaugucaaccgccugaucgaggaaaaaggccuguucgggcgggugcgcauggagcugcucgacuaccgc

SEQ ID NO: 4224643 - RNA, 86 nt, Bordetella pertussis
auugccugacgcauucguauuucggccgcagccuguggcguuucgagcgcgccggagagcccgucgaagugccggucggcggcaau

SEQ ID NO: 4224644 - RNA, 112 nt, Bordetella pertussis
cgccggugugguucaggucggucugcgcgguaucgcgaucgaucggcucgaagucgacgucguagaugcugaugucgccgaugccgccauggcccugcuugccgcgccagcg

SEQ ID NO: 4224645 - RNA, 62 nt, Bordetella pertussis
ccgcgcgcgacuucaacggcuugguguagggaaucuuggccgggccgaucagguugcggcgg

SEQ ID NO: 4224646 - RNA, 84 nt, Bordetella pertussis
acacguacaggcgggugcgggcgggaucguccaucucgaauacauagagcgggcgaugcucguccagcgugcgcgugugggugu

SEQ ID NO: 4224647 - RNA, 59 nt, Bordetella pertussis
guguuccaggugggcuggggcauggcgcaggccgacucguuccagcccgccauggacau

SEQ ID NO: 4224648 - RNA, 105 nt, Bordetella pertussis
ggcacaaccugacccccgggugccuguccccgcagggggacugguacccgccgacuucccggugccuguccccgcggggacaggcacacugccguacgccaugcc

SEQ ID NO: 4224649 - RNA, 58 nt, Bordetella pertussis
agggcugucugcugggcgcgcgccuguuccagcgcccgcccgaguugcgcgaagcccu

SEQ ID NO: 4224650 - RNA, 70 nt, Bordetella pertussis
gccgaucgcguggcggugauguaugccgggcgcauugucgagacgggcagcgccgccgaugugaucgagc

SEQ ID NO: 4224651 - RNA, 108 nt, Bordetella pertussis
ccgaccugcgccugacccugggcggcggcauggcggugcagcgccaggucgccgagcgguggcuggagcugaccggccauccgcugauagaaggguacggccugucgg

SEQ ID NO: 4224652 - RNA, 66 nt, Bordetella pertussis
uggcgccgcaggaaggggugaccgccggcaucugggaaugccagccgggccuuuuccgccgcacca

SEQ ID NO: 4224653 - RNA, 56 nt, Bordetella pertussis
gguugcuugcucaucggcgcagggcguggccgcccugcgucaaaggggaggcggcc

SEQ ID NO: 4224654 - RNA, 93 nt, Bordetella pertussis
ggugcacgaggcguuggagaucacggugugcucggccuugagcacguucugguucacgccgaacacgaugguggcgucgacguccuugccgcc

SEQ ID NO: 4224655 - RNA, 90 nt, Bordetella pertussis
aggcggugugcuggaugcccgcguuguugaccaggauaucgaugcggcccagcucggcgacggcgccggacaccaguugccgcaccgccu

SEQ ID NO: 4224656 - RNA, 102 nt, Bordetella pertussis
gccaggcgccgaacgccaggcccacguggauggaggcgcgcgacgagaugucgguuucguugcagcugccacccagguaggccagcgugccgugcuccuggc

SEQ ID NO: 4224657 - RNA, 88 nt, Bordetella pertussis
gguagcccauuucgccgguccgggcgaugagcgccaggcgcacggcgcggcugguggcgucgcccgcggcccagcucuugcggcugcc

SEQ ID NO: 4224658 - RNA, 65 nt, Bordetella pertussis
ggucauccagggggugauccugcuguucagcuucauguacgugcuggucaaccugcuggucgauc

SEQ ID NO: 4224659 - RNA, 91 nt, Bordetella pertussis
cgcgcgauuuccuggcgccgcgcgcugaccggcaggucuucgggauaggaaaucgcggggaugggccgcucggggcgcggcucggagcgcg

SEQ ID NO: 4224660 - RNA, 74 nt, Bordetella pertussis
gcaccugaaggccggcaagcugcgggcgcuggccgucaccacgccccagcgcuccgcgcuguugccugaggugc

SEQ ID NO: 4224661 - RNA, 61 nt, Bordetella pertussis
acgccugggucgucgaagccgcggcgggcgagaauuggcacgguuucgucacggccugcgu

SEQ ID NO: 4224662 - RNA, 89 nt, Bordetella pertussis
ggcgcaacucgcccaggcgcuuggacaacgcauugcuuucggcguaccagagcgugcuggccaggcccaccccacccguguugaccgcc

SEQ ID NO: 4224663 - RNA, 78 nt, Bordetella pertussis
ugggcuggccgggaucggcgcgcacgcgggaacggugccgcaccgucgcgcccuggugcgcgucgcccgccacgccca

SEQ ID NO: 4224664 - RNA, 77 nt, Bordetella pertussis
ucgaccuucgcgggaaagaaggcggcgguccaggcauaggcuucgaaccccuuguugccgcuuuccugcaugguggg

SEQ ID NO: 4224665 - RNA, 108 nt, Bordetella pertussis
gccggcacggaacccaccgguguggaaagccugacgcuggucgagcugcccgagggcagccagacgaaguucacgcuugccaaccggggcgggguggucgacgccggc

SEQ ID NO: 4224666 - RNA, 76 nt, Bordetella pertussis
uccaguucguagaccgggucuucguuggcgaaguuggugagaaggauuucgccgaucugggccugguugcccugga

SEQ ID NO: 4224667 - RNA, 58 nt, Bordetella pertussis
gcguucaggccggugaccaccggauugggcuugaacucggugggcacgggcuuggcgc

SEQ ID NO: 4224668 - RNA, 130 nt, Bordetella pertussis
cgcaccgcgcugaacgcggcuauuggcgcgccgugcggacgucggccggcggcgcgcuuucgaaguugcugcgccacggauugauguccagcccgccgcgucgcguguagcgcgcguagacggugagcug

SEQ ID NO: 4224669 - RNA, 67 nt, Bordetella pertussis
ucgcaguacacgaccgagguaucggggcggaccaggcgcucgaccuccgaaccggcguaguacucga

SEQ ID NO: 4224670 - RNA, 77 nt, Bordetella pertussis
ggucuggccggcguaaugccaggugccgcuggcggcgaugcgccgguauucggcauuggcguugcucaggccgggcc

SEQ ID NO: 4224671 - RNA, 84 nt, Bordetella pertussis
gccgccugccucguugaauucguuggccagcgccgaggcgaucgaguugcccggcgagaacagcgagcccgaccagcggaaggc

SEQ ID NO: 4224672 - RNA, 96 nt, Bordetella pertussis
cgccggugcccggcgggguggccgugguggaccuggggcaggccgcccaggcgccggaggucacguaccgcggccgucccgucauggugcugcgcg

SEQ ID NO: 4224673 - RNA, 119 nt, Bordetella pertussis
ggugccguuccugcugggcgugguggugggcaaccuuggacaucgaauggcgcaacgugcucaagccggugcccaacaucgugaucccguucuucgccuuugcgcugggcaccggcauc

SEQ ID NO: 4224674 - RNA, 55 nt, Bordetella pertussis
ggcgcugaacuggccgccggucagcuccagcgccggcgccaagcugaucagcgcc

SEQ ID NO: 4224675 - RNA, 110 nt, Bordetella pertussis
ccauauccgcagcuucgugcaccgccgcggccacaucacgcagcgccagcgcgacgcgcuggagcagcugaugggcaaaugguccgugccguacgcgccgcgcccccugg

SEQ ID NO: 4224676 - RNA, 55 nt, Bordetella pertussis
gagcauggucgaauuccacaaugucaccaagaaguucggcgauucgacggugcuc

SEQ ID NO: 4224677 - RNA, 62 nt, Bordetella pertussis
ucgaucuccaucagccauugcgguuggcccagcgcgcuuaccaccaggcccguggagaucgg

SEQ ID NO: 4224678 - RNA, 56 nt, Bordetella pertussis
gcugagcgcgcagcugaccacgcuggcgcugucgguggcgcagcugcgcgugcagu

SEQ ID NO: 4224679 - RNA, 83 nt, Bordetella pertussis
gaggauagcgggccgccagcgcggcgaucagcuccgacuuggucacgucaaccgucguugcgcuguugguccagcuuggccuu

SEQ ID NO: 4224680 - RNA, 60 nt, Bordetella pertussis
gcuggguacguugcuggucggcaucgccuucggcggcagcaucgucagcggcgugacggc

SEQ ID NO: 4224681 - RNA, 76 nt, Bordetella pertussis
gccagcggacggucggguuggccugcgccauggcgggcaugcccaccgcggccaggccggcgccggcagcgccggc

SEQ ID NO: 4224682 - RNA, 101 nt, Bordetella pertussis
gcacgcugguggugcccaccgccacgaugcguccgccgugcgcccgugcccgggcgauggcggccaccguggcuucgggcaccguguaccacucggcgugc

SEQ ID NO: 4224683 - RNA, 55 nt, Bordetella pertussis
ggucgccucgucgaggaucaggaccggcgcguucuugaucagggcgcgggcgauc

SEQ ID NO: 4224684 - RNA, 77 nt, Bordetella pertussis
gcacuuccaccagcagcgggcgcgucccuuccugggucgccagcacgcaggaaccggccaccugcugcuggugcugc

SEQ ID NO: 4224685 - RNA, 56 nt, Bordetella pertussis
gcgccgcaucgccgcccgcguggcgcacaucgcgccgcugugcagcgaugugacgc

SEQ ID NO: 4224686 - RNA, 79 nt, Bordetella pertussis
gcgcccgcguccaggucggcggccuggccggccgccacgaucaggucgccgccacgcaggccggccugcucgccggcgc

SEQ ID NO: 4224687 - RNA, 59 nt, Bordetella pertussis
ugcguuuccaggaaaccccuacugaugggucgaguucagcaggguuuccuggagucgua

SEQ ID NO: 4224688 - RNA, 75 nt, Bordetella pertussis
ggauucgugcucgcugcgguacuggaucaggucggcgauggugccgaucuucagcuugugcucgcgcgcgaauuc

SEQ ID NO: 4224689 - RNA, 83 nt, Bordetella pertussis
aucgcgcugccggauuucgaccagagcaagccgcgccacaugaugcgcugcuccaugcugggcgagccguccggcuacgugau

SEQ ID NO: 4224690 - RNA, 86 nt, Bordetella pertussis
gcuucucccgggccgccgauguccugcaggcgcuggcggccgacgugccgucggugcuggugucggacauccgcaugccgggcggc

SEQ ID NO: 4224691 - RNA, 82 nt, Bordetella pertussis
ugcagauugccaucgccggcauggaacacguuggcgcaacgcaggccgaaaucgucuuccaucugcucgauggcgccaagca

SEQ ID NO: 4224692 - RNA, 63 nt, Bordetella pertussis
gcaugcaggugguugaagcgcaucacgccuauggugggaggcugcgcuugaccagcuugaugu

SEQ ID NO: 4224693 - RNA, 78 nt, Bordetella pertussis
cgccggcgcauacgaguacaggcuguaccgcggcggcgccacgggcgccgcgccggacagcugguaccugcgcucgcg

SEQ ID NO: 4224694 - RNA, 59 nt, Bordetella pertussis
cggcgacugaacgccgccgcgggcggccacgcgccgcccgggccggcuacagcucgccg

SEQ ID NO: 4224695 - RNA, 86 nt, Bordetella pertussis
ugacgauguggucgaggucgcgcagcgugccgcugcggcgcucgggggccacggcggcggcgcgcgcgaccagggcggcgauguca

SEQ ID NO: 4224696 - RNA, 70 nt, Bordetella pertussis
gauguaccaggaagcgcugcugcagggccgcaugggcauggucaugcgcgcgcucagcgcgcuggauauc

SEQ ID NO: 4224697 - RNA, 59 nt, Bordetella pertussis
uauggccaggcggccugcucgcccggcgccagccgcagcagcgcgggcgccucgccaua

SEQ ID NO: 4224698 - RNA, 106 nt, Bordetella pertussis
cgccgaauuucaucuugcgcggcgccagguuggccaccagcaccgucagcuugccgaccagguccugcggcugguaggccgacuugaugcccgagaacacauugcg

SEQ ID NO: 4224699 - RNA, 55 nt, Bordetella pertussis
gugcaguccaucaagaccggccauccgcucgaugccggcaccauggugggcgcac

SEQ ID NO: 4224700 - RNA, 79 nt, Bordetella pertussis
gcgcauggccacgccgauggugcgcuugagcuugucgugguugagcucguagccgccguuggcguugggcuucaugugc

SEQ ID NO: 4224701 - RNA, 107 nt, Bordetella pertussis
gcccuggcgccgcgcucgcccgaaaccgagaucguggaggucgccgacggcgacggcuggcagaccgcgcugaucuguuucgggcugaugggcguggcggugggggc

SEQ ID NO: 4224702 - RNA, 61 nt, Bordetella pertussis
caucagcacgcugcugugggcggacuggaccaaucgcuucgucugggugguguugcuggug

SEQ ID NO: 4224703 - RNA, 97 nt, Bordetella pertussis
caggccucgcucccguccggccaccgaggcucgccuugaacgcugcgcaaagugucggccauacgcugggccucgagcuggaaauggugguggccug

SEQ ID NO: 4224704 - RNA, 59 nt, Bordetella pertussis
gcgugaucgucgaggguuucaucgaguucgacuacgagaucacccugcugacggugcgc

SEQ ID NO: 4224705 - RNA, 92 nt, Bordetella pertussis
cggccaccgcgcccacgcacuuccagaauuucgugcuguucacgaacuaccaguucuauguggacgaauucugcgugugggcgcgcgggcug

SEQ ID NO: 4224706 - RNA, 79 nt, Bordetella pertussis
gcaacugguuguacuucgccaugcggucggaacgcgacagcgaaccggucuugaucugcauggcguugguagccaccgc

SEQ ID NO: 4224707 - RNA, 87 nt, Bordetella pertussis
cgcgccagccgcugcgccucgaguaugcuguauugaucgauauagucguugaacugggccgcauacuccgcguagcuggcgaacgcg

SEQ ID NO: 4224708 - RNA, 87 nt, Bordetella pertussis
ggggcgcugguggccggccugggccuguguaucguggcgguggcggugcugcgcaccgacucgggcccguucuggcgccagugcgcc

SEQ ID NO: 4224709 - RNA, 70 nt, Bordetella pertussis
ugcuugccccauggcgaugcuuguuauugugggaaugccggaucauaagcaauugccgggcggggcagcg

SEQ ID NO: 4224710 - RNA, 64 nt, Bordetella pertussis
gcacccggcgcccuugcaugcgcgucaacugcgcgccuuguugacgcgacgcgaggcgcugagc

SEQ ID NO: 4224711 - RNA, 62 nt, Bordetella pertussis
gaaugaacggugcgcggggcggacggccugcgggccgccgccccguaccgcaucagugcuuc

SEQ ID NO: 4224712 - RNA, 83 nt, Bordetella pertussis
gcccacggcgcugccgggcagcacggccgaggcgcgcgccggcgauggcggcgccgcagugcugaccggcgacgaaccggggc

SEQ ID NO: 4224713 - RNA, 68 nt, Bordetella pertussis
gugcugcuguucgaccagcgcggcugcggccgcucgcugccgcacgccagccuggagaacaacaccac

SEQ ID NO: 4224714 - RNA, 59 nt, Bordetella pertussis
gucguccaggcuuuucaggucgccgggcucgaagccggcggccgcgaagaccuggcgau

SEQ ID NO: 4224715 - RNA, 56 nt, Bordetella pertussis
aucaucaucgaccucaucguaucgaacauucuucuugccaugggaaugaugauggu

SEQ ID NO: 4224716 - RNA, 115 nt, Bordetella pertussis
ggugccuguccccgccuggggacuggcacccacggaauuccgggugucugucccugcauggggaccggcacccacggaguugcccugagugccuguccccgcggggacaggcacc

SEQ ID NO: 4224717 - RNA, 66 nt, Bordetella pertussis
gccggcgugauggagcugggcaugcucaaccgcggcgagcaugccgagaucacgucguucgucggc

SEQ ID NO: 4224718 - RNA, 106 nt, Bordetella pertussis
cgccagcgcggccggcgcgcgcaacgacggccagacgcguuacgcgggcguugccgccaugcugcgccgcuggcugucguccuacggcucgucggucaagcuggug

SEQ ID NO: 4224719 - RNA, 130 nt, Bordetella pertussis
gucaguucgcuggcgguguggcugcuagggccgguggucaagcaggcaggcuuuggcagccuguucgcgggcauggccgucaucgccgccugcaccgccaccauggugcugcugcugcccagcgagcggc

SEQ ID NO: 4224720 - RNA, 81 nt, Bordetella pertussis
uggccgacgaacgccugcgcgcggcgcaggcgcgcgcccuggcgccgcugugccgcgagcugggcgugguguuccugguca

SEQ ID NO: 4224721 - RNA, 79 nt, Bordetella pertussis
acuccuguugaugacgauuucguggccccauuaggggaaaccaguagucaggcuacaggaaucauucaacggcuggcgu

SEQ ID NO: 4224722 - RNA, 61 nt, Bordetella pertussis
ggccggaucggccggguuguggcgcagguugcccagccacagcgcuugcgcgauuucggcc

SEQ ID NO: 4224723 - RNA, 93 nt, Bordetella pertussis
cgccugcagcgugggccgcgccugguauuucucgaggaagucgauuucuucuucgggaaaguccaggguggcuuccaccagcaugcgcaggug

SEQ ID NO: 4224724 - RNA, 55 nt, Bordetella pertussis
cgcggugcagcgcggcuuucgcggcacccugcugcacggcccgcacaugaccgcg

SEQ ID NO: 4224725 - RNA, 56 nt, Bordetella pertussis
ggccgugggcgccgacgugcgucaccucaagaagggcgaccgcgucgccuauggcc

SEQ ID NO: 4224726 - RNA, 111 nt, Bordetella pertussis
cuggacaucuccaacgccucgcugcuggaugaaggcaccgccgcggccgaggccaugacgcuggcgcgccgcggcagccguucguccaguccgguguucuucgugucgcag

SEQ ID NO: 4224727 - RNA, 76 nt, Bordetella pertussis
cggauagccgccucgccgcugaacaguuucaucagcgucgacccugaaaccgucaugcggcaggccgccgacgccg

SEQ ID NO: 4224728 - RNA, 73 nt, Bordetella pertussis
cgcgucgaccgccgccaccccggcgccggcggcgcgcagcgccgccucguagguguggcgguucaucgacgug

SEQ ID NO: 4224729 - RNA, 76 nt, Bordetella pertussis
uucgagcgccauuucguagccgguggccgggggcggguuggcgcccucgggcaccacggcagcgacggcgcgcgga

SEQ ID NO: 4224730 - RNA, 65 nt, Bordetella pertussis
cggcccaguucuuggggaugagcagcguggggguuucgggcaggguguccucgacgaaggugccg

SEQ ID NO: 4224731 - RNA, 70 nt, Bordetella pertussis
gugugacuacgcuggguacggcgcugcgccggcgaaaacggcggcgcgcgucgagcauagcguauugcgc

SEQ ID NO: 4224732 - RNA, 79 nt, Bordetella pertussis
cggcaagcacaucgagcucgaagucgacaacugggccaggcugguccagcuggcgcgcaucgagccgcaaugaccgccg

SEQ ID NO: 4224733 - RNA, 64 nt, Bordetella pertussis
acucgggccaguugcgggcccuggccguggcgagccguagccgguggccgcaauugcccgaugu

SEQ ID NO: 4224734 - RNA, 78 nt, Bordetella pertussis
gagucccugaucgaguauccgagcgacuuccccaucaagguaaugggcaagcagcauccggaauucgcccagacccuc

SEQ ID NO: 4224735 - RNA, 77 nt, Bordetella pertussis
accgcgguaucgaagucggauucgcgcaucgacuacagccugcucgagcaggcggugcgcgacgaccucgacccggu

SEQ ID NO: 4224736 - RNA, 89 nt, Bordetella pertussis
gcguggcgaagaauuucagcuugggcaguuccugcagcaggcggucgaucacgcgcuugagcaggaaguugccgaagcugaucccgcgc

SEQ ID NO: 4224737 - RNA, 69 nt, Bordetella pertussis
gggccggacgccaugaaucgggucagccugaucggcaacgacaugcgccuggauucgggugucggcacc

SEQ ID NO: 4224738 - RNA, 78 nt, Bordetella pertussis
guucggccacgcccgccuuggacgcggcauacgccccgagcccggcgugcgcgcgcccgauggcguccgagccgaugc

SEQ ID NO: 4224739 - RNA, 62 nt, Bordetella pertussis
gguagccguccugguggcggugacgcaaggagagccgcgcgugcucaccaccgaggacgccc

SEQ ID NO: 4224740 - RNA, 75 nt, Bordetella pertussis
gccucgcucgagccaugccccauggcggcaugguccaucccgcccauggcgccgugguccauggccgcgcccugc

SEQ ID NO: 4224741 - RNA, 61 nt, Bordetella pertussis
ccgacggcgauaugauggaagacggucaccaguggguggccguuuucccaaucgcucucgg

SEQ ID NO: 4224742 - RNA, 84 nt, Bordetella pertussis
ggcguugaacagcaggaugucggcggccaucaggacgggauacgagaacagucccauggucacgccgucauccggcucgacgcc

SEQ ID NO: 4224743 - RNA, 61 nt, Bordetella pertussis
ugcagaucaacgucgagggcgaguugccguucggcuguaccgccaaggacguggugcugca

SEQ ID NO: 4224744 - RNA, 90 nt, Bordetella pertussis
gggucugucaggauuuccugguauccggucaucgaaguguugaacaccacuucggccacgguaugcccaggcacgccuaucgauacgccc

SEQ ID NO: 4224745 - RNA, 84 nt, Bordetella pertussis
uggcgccggugggguugcugggcgcguucaucaucagccacuuggugcguggcgugauggccgccuccagcgccugcggcguca

SEQ ID NO: 4224746 - RNA, 78 nt, Bordetella pertussis
ggccucggcggccgguucggcgcgcugcggcgcggccaccggcgggcgcggcgcgcgggucggacuggccgccgggcc

SEQ ID NO: 4224747 - RNA, 75 nt, Bordetella pertussis
ccgagaacgagacgcgcgucaagguggaucugcaguacgcccugcaggggccgcuggcgcaguucucgcgcucgg

SEQ ID NO: 4224748 - RNA, 55 nt, Bordetella pertussis
cuguacggccagcggccggcaggcgacaagcgcgcgccggccggcggccguacag

SEQ ID NO: 4224749 - RNA, 69 nt, Bordetella pertussis
cugguacugccaggugcgcgugucgccgguuuucucguugaccagcgacaccuugacgcccggcagcag

SEQ ID NO: 4224750 - RNA, 64 nt, Bordetella pertussis
ggccgugugcgcccugaucgacgcugucuucaucuucggcagcgucugggggcugcagacgcuc

SEQ ID NO: 4224751 - RNA, 57 nt, Bordetella pertussis
uggacgugcgcgagaacggcgucuauacccaggggcaccuguuccaugccgcgucca

SEQ ID NO: 4224752 - RNA, 65 nt, Bordetella pertussis
uuucgucauguucaugauauggauacggggcaggcuccgggcgccagguucaugggcguacggaa

SEQ ID NO: 4224753 - RNA, 61 nt, Bordetella pertussis
ucuucggugagcucccguuccgaaggcaaggccacgccgcuggggcgggcgccgcugagga

SEQ ID NO: 4224754 - RNA, 56 nt, Bordetella pertussis
gcugguacuacguggacggcgacauccgcugacggcgccgucaugcaggugccagc

SEQ ID NO: 4224755 - RNA, 68 nt, Bordetella pertussis
gccaucaagcuguacgaggggcugcgcgccaccaauacgccggugcaccccuacgugcugguuucggc

SEQ ID NO: 4224756 - RNA, 81 nt, Bordetella pertussis
cggcggcacgacuucgcgcgugaugcccuggucggccagcgugcggccggccauggcgcgcgcggcgaucuuggccagcug

SEQ ID NO: 4224757 - RNA, 79 nt, Bordetella pertussis
ggcgccuguccccgccgggacagauaccgucuuggccgucaaguguucaugggugccuguccccgcggggacaggcacc

SEQ ID NO: 4224758 - RNA, 82 nt, Bordetella pertussis
gcgugcgguccgccgcggccucguggacgcgcuggucguugaaaccgucccaguacucccgcaggccguugcgcccgcccgc

SEQ ID NO: 4224759 - RNA, 57 nt, Bordetella pertussis
cagggcggcggccugggcggcggaucgagcgacgccgccaccacccugaucgcccug

SEQ ID NO: 4224760 - RNA, 117 nt, Bordetella pertussis
gccgcgccggccuugccgccggccacgguagacauggggaugcaccaacuggcgcucuucccgggcgccacuuucauucccauggccaugagcagcgacgcaacggugcuggcgggc

SEQ ID NO: 4224761 - RNA, 84 nt, Bordetella pertussis
ggacccgggccucguugucgguggcgucguagagcacguagauacgcgcguccuccacaucggccaccaugacgugccagguuu

SEQ ID NO: 4224762 - RNA, 81 nt, Bordetella pertussis
cagcgcgguguagcuguccaccaccacgucgacgcggcccgccagcagaucgacgugcaugggcgcgcugccgcgauacug

SEQ ID NO: 4224763 - RNA, 79 nt, Bordetella pertussis
gaggccagcggcgucaagaacaggcugacugccgcgggcguggaaauccugacaggugucuguuuuuaccugcugacuc

SEQ ID NO: 4224764 - RNA, 67 nt, Bordetella pertussis
ucaaugccacaucgguugccggcgccgcgcagccgcaacgccugcacggccuggcggccgacaucga

SEQ ID NO: 4224765 - RNA, 56 nt, Bordetella pertussis
cggcggccgcguucucgugguugaccaugcugaccaccacguaacgcuugccgcug

SEQ ID NO: 4224766 - RNA, 55 nt, Bordetella pertussis
guaggcgccggccgcgggcggcucgccggcgauccagcucgcguccugcgccugc

SEQ ID NO: 4224767 - RNA, 68 nt, Bordetella pertussis
ggguacggcgcguucuggagcacgggccugggcacuuacgucgaggacgugcaggacgcgcugggccu

SEQ ID NO: 4224768 - RNA, 129 nt, Bordetella pertussis
ccucgcuguacgccaagcugucguacgacccggccaaguucacguauaucggcggcaucgcccgguucccgcugaugcuggcggugaacgugaacucgccguacaaaucgguggaagacgugcugcagg

SEQ ID NO: 4224769 - RNA, 63 nt, Bordetella pertussis
cuggaucggcgugaacgugccguagucaugguagcucuugaugcgcgccagcgcgccgaccag

SEQ ID NO: 4224770 - RNA, 55 nt, Bordetella pertussis
ggaugcggugaugaacgaguucgaaccauugggcugguacuucacgccggcuucc

SEQ ID NO: 4224771 - RNA, 110 nt, Bordetella pertussis
cgccauugaacgacccacggcgguugaugcaauccuucaggaucguggagccgacauggauguuggccaccggaucgagcggguugcccuugcccacgugggcaauggcg

SEQ ID NO: 4224772 - RNA, 60 nt, Bordetella pertussis
augcauacaaccuauugaaucuucacaccuagcugugaacugucaauagguuguauucgu

SEQ ID NO: 4224773 - RNA, 81 nt, Bordetella pertussis
ugcgccgcgccgccgagcuggcgcagcccggcgaugccgugcuguugucgccggccugcgccagcuucgacauguuccgca

SEQ ID NO: 4224774 - RNA, 71 nt, Bordetella pertussis
cgcagcgugaaguugaugcgcuggcggcccagcagcggauguuggcccucggccagcggcaucacgccgug

SEQ ID NO: 4224775 - RNA, 74 nt, Bordetella pertussis
ccacgaccucguccuugaccucggccaggggcuugaccgagcccggcuggaagucggugaccuugaggaugugg

SEQ ID NO: 4224776 - RNA, 114 nt, Bordetella pertussis
guccuuggcgagcaggaugccgaugauguugucgcggucgucuucguagaccggaaagcgcgagugcgcggucucgaugaugguggcgagcaacugcggcagcggcugggagau

SEQ ID NO: 4224777 - RNA, 57 nt, Bordetella pertussis
ggugcucgaugauugauuguuuacccagcuugggcugcgagaaauacucgacgcgcc

SEQ ID NO: 4224778 - RNA, 100 nt, Bordetella pertussis
ggcugcuccagcaucucgcgcaacaccgccgcgauggccggcacgucgugcaccggcacgacccagccaucccggcccgcgguaauguucucgggcagcc

SEQ ID NO: 4224779 - RNA, 56 nt, Bordetella pertussis
gccauggucaacucgcugaucgccaaggaagaccucgacuccgagaugaccguggu

SEQ ID NO: 4224780 - RNA, 64 nt, Bordetella pertussis
guccgggccgaugaagacgaugccggcgucgaugcaggccugggcgaagucuucguucucggac

SEQ ID NO: 4224781 - RNA, 70 nt, Bordetella pertussis
gcccgucaucaccgguccgcaaugggcgggagugaacuauuucugcaccacgcgcgccggcggggcgggc

SEQ ID NO: 4224782 - RNA, 79 nt, Bordetella pertussis
gcguaugcgcucuacggcgugcuguugcgcaaguggccgaugucggucgggccguggcagucgcuguucgugcaggugc

SEQ ID NO: 4224783 - RNA, 81 nt, Bordetella pertussis
ggcgcagcaggucgacgaagcguucgaugguguauuuauaggaguuuuccguguggaugcguucgucggccuggaagcgcc

SEQ ID NO: 4224784 - RNA, 83 nt, Bordetella pertussis
cgggcccuggaucaugaugucgucgcuggcgaacaggccggucgcggccuggacuccgaugacggccagcauggccagcaccg

SEQ ID NO: 4224785 - RNA, 110 nt, Bordetella pertussis
gccgccagcaccagcacccggaucaggccgcgcccgggcauguccgugcgcgacaccaaccacgccaugggcacgccaagggcaguggcgaucaccgccgugcugccggc

SEQ ID NO: 4224786 - RNA, 61 nt, Bordetella pertussis
gccgcgcgccgacgccgccgcggucgcgcugugccgcgacgcgggcgcguuggugcugggc

SEQ ID NO: 4224787 - RNA, 66 nt, Bordetella pertussis
gaugcacagcugcaugagcgcggguucgucgcguucgaccguaccugcgucauggcggcguccguc

SEQ ID NO: 4224788 - RNA, 70 nt, Bordetella pertussis
gcgccgcagucgaucuacgccggcauccgcaagcugccgccgggcgccugggucgagaucgacgcggcgc

SEQ ID NO: 4224789 - RNA, 92 nt, Bordetella pertussis
gccggcguaaucguggcgcaacagggccugauagaccgguugcucgggauagccggucuggaucaggaccugcgcgccggcggcauggcggc

SEQ ID NO: 4224790 - RNA, 71 nt, Bordetella pertussis
cgugaaccuugcgcagguccaccugcaccauggccuugagcauggucaggcggaacugcucggcguucucg

SEQ ID NO: 4224791 - RNA, 62 nt, Bordetella pertussis
gcgcugcagcagguggccgacgccuugccggccuucggcaucguggccgccgugcugggcgu

SEQ ID NO: 4224792 - RNA, 79 nt, Bordetella pertussis
cguccugcuggucggccuggccacggcgcugguuuccgugaccacacccgccacgccgccggccgcgccgcccccaacg

SEQ ID NO: 4224793 - RNA, 71 nt, Bordetella pertussis
cgaagcugcgaucaggcaaaaaacgccaagucagcgacuuggcguuuuccguuucgauaccugcggcaccg

SEQ ID NO: 4224794 - RNA, 79 nt, Bordetella pertussis
gcgcagccggucuuucucgugcgccagcgagucgggcaaggcccgcaggcgcucguccaucucgucggcgcggcugcgc

SEQ ID NO: 4224795 - RNA, 75 nt, Bordetella pertussis
ggcacgucuaccacgccaucgcgccgcucgaugugccagaacgaauugagcaugcgacuggugucguagggggcc

SEQ ID NO: 4224796 - RNA, 86 nt, Bordetella pertussis
gcugaacuucgccucgggcggcuacggcaccucgacccacauggcgggcgagauguuccgccgcgccgcgggcaucgaugucgugc

SEQ ID NO: 4224797 - RNA, 77 nt, Bordetella pertussis
ccgcugugguggccuaucuauuggcgcgcggcaucgccgccgugcuggccgauagaaaggcccggaaaacccaacgg

SEQ ID NO: 4224798 - RNA, 57 nt, Bordetella pertussis
uguugauggcgaauuccuugguguccucggggaugcgcaucgauucgugcgucagca

SEQ ID NO: 4224799 - RNA, 58 nt, Bordetella pertussis
gcgcugccagcgcuauguggucaacgugcucucggccagccagaucgcgcuggcgcgc

SEQ ID NO: 4224800 - RNA, 82 nt, Bordetella pertussis
aguuuguugaucuuggcgccuucgaucgacacgcccgccaucaggcccgcguuguugaguacgaagccuacgaucggcugcu

SEQ ID NO: 4224801 - RNA, 79 nt, Bordetella pertussis
gaccuggaucgccggcaccgcggucggcgucuaugcgggcgaagggcuggagcgccauuacccggugcugucgcagguc

SEQ ID NO: 4224802 - RNA, 78 nt, Bordetella pertussis
cuggccacgcaacucguacggcugcgacagcgcaucgagaaccucgggcgccacgucgcgcgccgagcgcggguccag

SEQ ID NO: 4224803 - RNA, 89 nt, Bordetella pertussis
cggaaccccuggacgcccggcugguggcgaccugggggcgccuguucggcgccgaggcgcgcgaccagccggcccgccaggugggccug

SEQ ID NO: 4224804 - RNA, 66 nt, Bordetella pertussis
guccucggcgauccacagccccucgaccugguggaacaugggcgaguggguggcgucgcugucgac

SEQ ID NO: 4224805 - RNA, 67 nt, Bordetella pertussis
gcccgccucggguacgccgguguggcgcguccagguggacgugcagcgcuucgaccugguggcgggc

SEQ ID NO: 4224806 - RNA, 55 nt, Bordetella pertussis
gucgggcagcggcaagagcaugaccgcgcuggcccugcugcggcugcugcccgau

SEQ ID NO: 4224807 - RNA, 56 nt, Bordetella pertussis
guucggcaacggcucggacgaacucauccaccugaucauccaggccuguugcgagc

SEQ ID NO: 4224808 - RNA, 99 nt, Bordetella pertussis
ccgaacaagggaaaaggugucgguccgggcagcgguugauggagcaucgugccgaccgaaucaaccgugcgcggauugcgcuugcaacuucaagcgcgg

SEQ ID NO: 4224809 - RNA, 114 nt, Bordetella pertussis
gcagguugcgcgcaaugaagcguucggccaggggauuggauucggucugcaucaugagccucgcggauugaagacggacuuccggcgcgcggcgucaggaaagcgggcaacggc

SEQ ID NO: 4224810 - RNA, 55 nt, Bordetella pertussis
ggauggccugcauggcgucgcgcagcgaagcggcgucggcgccgccgggccaguc

SEQ ID NO: 4224811 - RNA, 72 nt, Bordetella pertussis
ccagcuccaccgucaucugcaccggcacguccaugaucaggucgaugucggugcccuggccggucuccuugg

SEQ ID NO: 4224812 - RNA, 81 nt, Bordetella pertussis
ggcgcgccgccggccgggcgcgccaggcuggccugagccauggccagcacggccugcgccuggcucagcacggccugcgcc

SEQ ID NO: 4224813 - RNA, 59 nt, Bordetella pertussis
ggcguagccgcuuucgagcgagccgucgguuucgagcagcggcucgaagcggucgcgcc

SEQ ID NO: 4224814 - RNA, 81 nt, Bordetella pertussis
gccggggucaagagcgacuggcuggacgggcgccugagcaccaugcuggccgucuaccagcucgaacucuacaaccgccgc

SEQ ID NO: 4224815 - RNA, 57 nt, Bordetella pertussis
gcccgcgugacggccgccacgcccuggcagcuggcgcgggcggccuaucaccugggc

SEQ ID NO: 4224816 - RNA, 68 nt, Bordetella pertussis
gugcccgggcuggugcuggggcugggguacaucuucuucuucaacagccccggcaacccgcugggcgc

SEQ ID NO: 4224817 - RNA, 72 nt, Bordetella pertussis
ggggcgcgcacgagcucgaagucggcgccaagccgccggccaucgaagcguucgggcucgagcgaacgcccu

SEQ ID NO: 4224818 - RNA, 57 nt, Bordetella pertussis
ggcgaugcgcucgggcaggccgugguggucguucucccacgguugcagcgcaucguc

SEQ ID NO: 4224819 - RNA, 72 nt, Bordetella pertussis
cugcugcugcaggcccugcugcuggaauugcgaguaggucgcgguuccggaggcaggcgccuuguagcgcgg

SEQ ID NO: 4224820 - RNA, 66 nt, Bordetella pertussis
cgaguccuggccgcgcacgaucagcaccggacaauccaggcugucguacgcuugccagagaaugcg

SEQ ID NO: 4224821 - RNA, 60 nt, Bordetella pertussis
ugucgucgaccgaguagaucucgcccucggccagcggcaguucgcguucgaucgacggca

SEQ ID NO: 4224822 - RNA, 92 nt, Bordetella pertussis
gugcccaggcggaugccgcuggucacgaagggcuuuuccgggucguugggaauggcguucuuguugaccgugaugugggccuggcccagcac

SEQ ID NO: 4224823 - RNA, 69 nt, Bordetella pertussis
gcccugggcgaaguagcgcuggugaaacgccggcgugcagcaggccacguagcgcaugcugcccagggc

SEQ ID NO: 4224824 - RNA, 56 nt, Bordetella pertussis
agcgccuucaggaugucgcgcagcgucauggugcuggcggucgugaaguagguguu

SEQ ID NO: 4224825 - RNA, 69 nt, Bordetella pertussis
ugacgaacaugccgaugccgguauagggcagcagguagacaugcuccaugcugagucgguaguucugca

SEQ ID NO: 4224826 - RNA, 61 nt, Bordetella pertussis
gcccuaugugcuggucaaggcgguguccaaggauggcgccaccucggacggcuacgugggc

SEQ ID NO: 4224827 - RNA, 100 nt, Bordetella pertussis
ucgacgcacuggcggaugaugcgguugcuuucgcgcaucucggccacgcgcaccagauagcggucguagcaaucgccauugacgccgaccggcacgucga

SEQ ID NO: 4224828 - RNA, 99 nt, Bordetella pertussis
gguagugucggucaugggcgacggcagcuucggcuucaccgugggcgaaauggaaaccaucgugcgccgcaaggugccgcugcugaugaucgugcuguc

SEQ ID NO: 4224829 - RNA, 66 nt, Bordetella pertussis
gcugggcuggcagcagauggaucauccgcugcccgagggcaacuggccgcugcugucggccucggc

SEQ ID NO: 4224830 - RNA, 63 nt, Bordetella pertussis
uuugucacgcucgaagacgaaaccggccccaucaaugccguggugcgucccgagcugaucgaa

SEQ ID NO: 4224831 - RNA, 69 nt, Bordetella pertussis
gugcccgcgcauguuucaaucggucugagaaugucuucacggccugauugaaucgugcgaaucaagcac

SEQ ID NO: 4224832 - RNA, 113 nt, Bordetella pertussis
cauggcugcucgggcugcucggcgccgaggucaucaaggucgagcggccgggcgaaggagacuucgcccgcgccaucgcucccuuucacggcggugaaagccuguauuucaug

SEQ ID NO: 4224833 - RNA, 86 nt, Bordetella pertussis
cgcagcggacggucgaucaggcgcgaggucagcguuuccuuuucggagggcuugccuucgcgcuugaagaaaccgcccgggaugcg

SEQ ID NO: 4224834 - RNA, 65 nt, Bordetella pertussis
cgacuccaucaggcagcucaugcggccgccuugcgggccgcugugggccagcuugagguagaucg

SEQ ID NO: 4224835 - RNA, 79 nt, Bordetella pertussis
guggggcugcuuggcgucgcgaggacuuagcgcugauaaacgauaucggcgcggcgguucucggcgaaaucagccucgc

SEQ ID NO: 4224836 - RNA, 64 nt, Bordetella pertussis
gagcauggagaaugaaccgucagcgaaagugaaaaauacuucgucacggaucauucaccaauuc

SEQ ID NO: 4224837 - RNA, 84 nt, Bordetella pertussis
ucuccccauugugggcgcugcugauccaggccuggggguucgccugggccgcgggcguggugggcgcguccauggugcugguga

SEQ ID NO: 4224838 - RNA, 58 nt, Brucella suis 1330
gcagcgggcuguuucucgaccaugcuacagggcuuguggugggugaaacggccguugu

SEQ ID NO: 4224839 - RNA, 85 nt, Brucella suis 1330
gauaaaaaacgcacgauuccggcucgagccuucagauuguuccagcucaugaaguucgggaacugggagcgugcucauuuuuguc

SEQ ID NO: 4224840 - RNA, 63 nt, Brucella suis 1330
ggcgaugaacgcuugcaagcuggaaaucgaugacggcggcuucaccuucaggcgucaucagcc

SEQ ID NO: 4224841 - RNA, 58 nt, Brucella suis 1330
uuccacaaugcggcccuugucgaacaccagaagccggucgagcgcgcgcacuguggaa

SEQ ID NO: 4224842 - RNA, 129 nt, Brucella suis 1330
gcccugagaggcggggggacguugcgcagaagcguaggcaguuuuggaagagccgaacagcgagcuuaccugaauuggcuuuucugcugccugugcagguuuugcagccucaacguccugcgccuuggc

SEQ ID NO: 4224843 - RNA, 60 nt, Brucella suis 1330
gccacgggccggucgggccgaacgugucgcaggacuugccuuugguccacuggcccuggc

SEQ ID NO: 4224844 - RNA, 60 nt, Brucella suis 1330
gacgcgcucaauacggugauuggcaucaucgaagccaaucgcgacaagguugagggcauc

SEQ ID NO: 4224845 - RNA, 97 nt, Brucella suis 1330
guccggcccgaagucgcuggaugagguggaucccgaacuucucaaaaccuaugagaagcugggcauuccgcuucgcgaacaggaaauucuggcuggc

SEQ ID NO: 4224846 - RNA, 79 nt, Brucella suis 1330
uccucgaagcuuuucuuggcauuaucccaugcaccgccgccggaggucauggaaaucgccacgaaaagcccauugauga

SEQ ID NO: 4224847 - RNA, 84 nt, Brucella suis 1330
cggucaucgaaguggaaggucuggaccggccgggccugcuuucagagcugaccggccuuauuuccgaccuuucacuggauaucg

SEQ ID NO: 4224848 - RNA, 104 nt, Brucella suis 1330
uccccgguuaugcuugcagugaaccugcauccaaccggccgcagggcacuccaaauuucaucugccgcauugauugcggguuucuugcuauaucguuuugggga

SEQ ID NO: 4224849 - RNA, 56 nt, Brucella suis 1330
ggaugaagcgauugcccggcuuugcgaagaggcgaccccgcccgaucugcuucgcc

SEQ ID NO: 4224850 - RNA, 55 nt, Brucella suis 1330
agcggcguggugaucucgaccgcuucaacgucggcgcggggaaucaucacguccu

SEQ ID NO: 4224851 - RNA, 98 nt, Brucella suis 1330
gaacgagcuugccgcggcgaaggaugucguaaacauugaugcccugaaccggcagcacaucgauguucgggauauucgaagccgcgcgcuggaaguuc

SEQ ID NO: 4224852 - RNA, 130 nt, Brucella suis 1330
uuuuugccgucaagcgccugauuggccgucgcuaugacgauccgauggucaccaaggacaaggaucuuguuccuuacaagaucgucaagggcgacaauggcgaugccugggucgaggugcacggcaagaa

SEQ ID NO: 4224853 - RNA, 56 nt, Brucella suis 1330
gacggcucgacggugcuguuuuaggguucaccgaccacgaugcgccauugaccguc

SEQ ID NO: 4224854 - RNA, 59 nt, Brucella suis 1330
uggggcgguuucgguuaaacccgagcgucugauuggguuuggccccuaaagccgcucca

SEQ ID NO: 4224855 - RNA, 68 nt, Brucella suis 1330
uuuuaagagcaggcaguuccagcgguuuuccggaaggaucauccuccagauugaucugcugcuugaaa

SEQ ID NO: 4224856 - RNA, 125 nt, Brucella suis 1330
gcuuucgacccauuugcaaggccagcuuguugcggugcacccggccuaugaugaagcuuucgacgguuucgccgugccggaagugcgcggcaauccacaagcacgccagcaaugggcgguugagc

SEQ ID NO: 4224857 - RNA, 68 nt, Brucella suis 1330
cgcuguuucgcgaaaacaucaagaggcuggaaggaaccggccuuaccuuugaucuuugugugcagccg

SEQ ID NO: 4224858 - RNA, 55 nt, Brucella suis 1330
aacgcguuuuaaucgucuuagugaguuucgaguauggacgaguugaacaugcguu

SEQ ID NO: 4224859 - RNA, 85 nt, Brucella suis 1330
gcugcgacgccgaaggcgaugacaagcaugauggcguugcgauucggaacgaccgugacuuucaucguuucuucagcguaguggc

SEQ ID NO: 4224860 - RNA, 60 nt, Brucella suis 1330
gacgcgaauaucgagaucaaugccuucguagcgggcaugguggcucucgguuucgucuuc

SEQ ID NO: 4224861 - RNA, 95 nt, Brucella suis 1330
acgucaaugccuggcauggcgaaggcgaggauggccgcgaauggggccuuggcgaauugcuguuccgccuugcgcgcauucccggcauugcgcgu

SEQ ID NO: 4224862 - RNA, 57 nt, Brucella suis 1330
cgacaggcugaacgucguaauggccauagaaaagcacaugcggcgcaucggcugucg

SEQ ID NO: 4224863 - RNA, 63 nt, Brucella suis 1330
cucgccuucgagccugcguuucgcuuugcaccucagggugaggcguguggugcucaggguuag

SEQ ID NO: 4224864 - RNA, 90 nt, Brucella suis 1330
ugcuugauuccaguggccgcgaucuggccgugaucgaaccguccaagcgguucuucccugcgugccagaugcccacgacugaauccggua

SEQ ID NO: 4224865 - RNA, 75 nt, Brucella suis 1330
uauaaaucggcuuggcauugcugaguauacgcguuuaacuggguauguuacagacagcgaucuaaacgauuuaua

SEQ ID NO: 4224866 - RNA, 55 nt, Brucella suis 1330
gcuggugcugccggggcgcgauggcgcgauugcgggcgcccuguuuggcaccggc

SEQ ID NO: 4224867 - RNA, 84 nt, Brucella suis 1330
uggucaagggcuuccagaccgucgagccgcucaagaucggcgagcuuugggcgcugccuucggcgguccgcuauuuccugaucg

SEQ ID NO: 4224868 - RNA, 84 nt, Brucella suis 1330
uggccaguaaaaugugguucauugauggucacguucuugauaccagucgccgauacgucaccaucgauauccacaaugcgguca

SEQ ID NO: 4224869 - RNA, 69 nt, Brucella suis 1330
cugucagccggguucccggacggauugaccguauugucgaucuuuaccggaacaccggaugaaagacgg

SEQ ID NO: 4224870 - RNA, 92 nt, Brucella suis 1330
gucggugcgccguuacgguggauugaucagggaauaucugccggaaaaggcagccauaccggggacaauucauucgauuuauggggcucgac

SEQ ID NO: 4224871 - RNA, 70 nt, Brucella suis 1330
ggcgcaaggcgcguuaucgaugguccggcguucuggaaugcugucaucgggguaauucgucacuacagcc

SEQ ID NO: 4224872 - RNA, 81 nt, Brucella suis 1330
agcugaaaauggcugaagugaugcguuuugaaaugacgccgcacccggucgaguucgauauguauuacucgguauaaagcu

SEQ ID NO: 4224873 - RNA, 57 nt, Brucella suis 1330
aucuggcuuucgggcugggcuccgcacgaaucgcagcaaaagccccugaagccaggu

SEQ ID NO: 4224874 - RNA, 81 nt, Brucella suis 1330
gucgcccuuuugaagcggcagcuugcgcauuacaaggucgauggccugaaugccguuggugccuucauagaucggggugau

SEQ ID NO: 4224875 - RNA, 58 nt, Brucella suis 1330
ucccguagcugaaggacuggauguugaugugcucgucauccgucuugcaguuauagga

SEQ ID NO: 4224876 - RNA, 117 nt, Brucella suis 1330
acuucucggcguuaucaucaaugggcuuuucguggcgauuuccaugaccuccggcggcggugcaugggauaaugccaagaaaagcuucgaggaugguuuuaccgaugccgauggagu

SEQ ID NO: 4224877 - RNA, 71 nt, Brucella suis 1330
ucgcauugcgguguccgcuucggccagcacgaugucuaucugaauguggcgggcggcuaucgcaucagcga

SEQ ID NO: 4224878 - RNA, 65 nt, Brucella suis 1330
gcagcgccggggucaacaugcccgagugagcguucccccagucgggcagcccggccccgcguggc

SEQ ID NO: 4224879 - RNA, 59 nt, Brucella suis 1330
ggagguucuggaugccgugcuugagcguagccgucgaagacgggcaaccggaacaggcc

SEQ ID NO: 4224880 - RNA, 80 nt, Brucella suis 1330
gcauggugaucgcggcggcguucccauugagccauaucuuaccgaccaaugguaugugaaugccggugagcucgccaagc

SEQ ID NO: 4224881 - RNA, 68 nt, Brucella suis 1330
cgggcgcguggaacaaagcgcugcuggauaauuccgcccguccuuccggugcgcuggucuaugccccg

SEQ ID NO: 4224882 - RNA, 60 nt, Brucella suis 1330
ucugccauugggcgaaagugccgcaguuucgauaaucaaagcugcgcuuuucuccccaga

SEQ ID NO: 4224883 - RNA, 66 nt, Brucella suis 1330
ugcguggcgagcugccuuccgguuucgaugcugcaaucgucgaauacaagaagaagcuuuccgccg

SEQ ID NO: 4224884 - RNA, 97 nt, Brucella suis 1330
ccauuuugccaaaggauauuuuggccaaaagcaguggaagccgaauccuucggcuuaucccaauauuuagcguaguauuuuuuuccgggcaauaugg

SEQ ID NO: 4224885 - RNA, 55 nt, Brucella suis 1330
cuuagagcauuuucgagccaaaacugcuucgcacuuuugcuggaaaugcuuuagg

SEQ ID NO: 4224886 - RNA, 80 nt, Brucella suis 1330
agcauuuccggcaaaucuagagcauuuccagcaaaaccgcuucgcacuuuugcuggaaaugcucuaaaucgccccaugcu

SEQ ID NO: 4224887 - RNA, 63 nt, Brucella suis 1330
ggcguucuggccguggccuggaugcaaggcuaugacgcacuugccgucggcuauggccuuucc

SEQ ID NO: 4224888 - RNA, 85 nt, Brucella suis 1330
acgagcuaguggucugauuccaacauuugcaucccucgguucaagcguugaucaaauguuggaaucacaaagaccacuaguaagu

SEQ ID NO: 4224889 - RNA, 91 nt, Brucella suis 1330
guccggccaugcgucuuuccucgcugaugggcauucgcgucgucuaugugaugacgcaugauuccaucggucuuggcgaagacggcccgac

SEQ ID NO: 4224890 - RNA, 114 nt, Brucella suis 1330
ggccguuucugggcuggcaaugcggcgccuguugguguuuucgaugccaaggccgaugcgcuggccgcauuggaagcugccggugcgccgguugaccguauccagaucgaggcc

SEQ ID NO: 4224891 - RNA, 64 nt, Brucella suis 1330
gccuugucggcaaggauaucgagcucaagaucgaucaugggcgcgaucuuuggccggugaaggc

SEQ ID NO: 4224892 - RNA, 60 nt, Brucella suis 1330
gaaaucugcgccugugucggcuccaccgacaggcggggcugcacgaagcgcgggucuuuc

SEQ ID NO: 4224893 - RNA, 57 nt, Brucella suis 1330
guuuuucggugguaacaggauagaugagcggcagcagcaccuguuccggcgaaagau

SEQ ID NO: 4224894 - RNA, 58 nt, Brucella suis 1330
auguggugggcuuucaucuggucggguaucugcgcuuccaccagaggggucagcacau

SEQ ID NO: 4224895 - RNA, 112 nt, Brucella suis 1330
ggucuccgggcgaggcauucaucucgcugaaaauccgguccaugaugugaucgacaaucgcgucggcgggcaucauuuuuucccggaugacaccgcguucgccauggaugcc

SEQ ID NO: 4224896 - RNA, 57 nt, Brucella suis 1330
aguucaggucgauuuggggagcuugaucggacauucuuugccucggagaucugaauu

SEQ ID NO: 4224897 - RNA, 91 nt, Brucella suis 1330
gucgugggagagcuugcgcguuucggcaucgaugcggaugauuccggcgggcggcaucugcgcgauguggaaacggccacgcuuuugcggc

SEQ ID NO: 4224898 - RNA, 91 nt, Brucella suis 1330
ccgaaggcguugcuauugaucugaacgcgccugcgcccgucgucaucaugauggugggcuugcaggguucgggcaagacgaccaccaccgg

SEQ ID NO: 4224899 - RNA, 81 nt, Brucella suis 1330
cuguucaaaagcacagguuuuucgcuugccggcgaagcaaaugaucuugguggccacagaagagccaugcuuuucgggcag

SEQ ID NO: 4224900 - RNA, 81 nt, Brucella suis 1330
ggauuccacagauguuucacgugaaacauugcaacggcuauuggugcucauaaagcugcauguuucacgugaaucacuucc

SEQ ID NO: 4224901 - RNA, 75 nt, Brucella suis 1330
cgcauuuuggguacaguuggcggcgaccggcugaaaaucagcaagaaugucgaugucagcguggccgaucugacg

SEQ ID NO: 4224902 - RNA, 63 nt, Brucella suis 1330
gugugacaaugaccgaucucgaacagcuucgcauaggcccgccggaucggcucguugauccau

SEQ ID NO: 4224903 - RNA, 55 nt, Brucella suis 1330
ugcguggacuuucgauauggugcuaucaaugaggacauauucaaaguccggcgua

SEQ ID NO: 4224904 - RNA, 87 nt, Brucella suis 1330
gccgaccgucacaugguugacggauguggagaaggcaucccccucaccgccauucuggcguucgaugaucgugcccuugacguuggc

SEQ ID NO: 4224905 - RNA, 62 nt, Brucella suis 1330
gcgccgacguggcgcugaacccgaaacugauggaacaauauccguucauccgccugucgggc

SEQ ID NO: 4224906 - RNA, 60 nt, Brucella suis 1330
ugacgccgaaaaagguugaccaguccaccuauauggacgggccgauccguuauggcguca

SEQ ID NO: 4224907 - RNA, 61 nt, Brucella suis 1330
gucgaguguuggcgcgguauugugcggacggaaacugccgagccgcuuuucaaccucgcgc

SEQ ID NO: 4224908 - RNA, 78 nt, Brucella suis 1330
ggcucgacaagcgggcgcaucgccgaugcauucaaccucccuccggcgaaggguucggcuguugcccgcaucgaugcc

SEQ ID NO: 4224909 - RNA, 62 nt, Brucella suis 1330
ucggcgaugaucggcggcgcaaucuuccaguacccgcuuggacgcgcuuccgauuucgucga

SEQ ID NO: 4224910 - RNA, 88 nt, Brucella suis 1330
cauuguuuuugcaaugcgacuuuaucgcaaugcagccaugcauuuuacgcaugacugcauugaggauaaaaguaauuuaaaaacaaug

SEQ ID NO: 4224911 - RNA, 104 nt, Brucella suis 1330
cauccucuauucgauggagcgucugcgcugguugccgcaugauuucggcaaacgcuaugucauggucaaccagccugccuaccaugccggauauuaugaggaug

SEQ ID NO: 4224912 - RNA, 88 nt, Brucella suis 1330
ccguggccggcagccaccaaugcugcacgucacccucgcggaacuggcgcgaggcggcguucaguaucugcucgcgcgccagcgacgg

SEQ ID NO: 4224913 - RNA, 60 nt, Brucella suis 1330
caagccauaucagucuuugagaagauaugccgaaaggguccuucucaagacggucgcuug

SEQ ID NO: 4224914 - RNA, 130 nt, Brucella suis 1330
cugaucgcaggaaggcgcuggaagcugaauaucgcgcgcuugaauauucgccagcggggaaaucgguuuuguggagcggagccggaucaaacgcuggcgacgugacggcggcgcaacccuaucaggucgg

SEQ ID NO: 4224915 - RNA, 69 nt, Brucella suis 1330
aucgcucgugauagggcauggcguaauagaagcguuccuugccguugaacagccugcuuucgcggcgau

SEQ ID NO: 4224916 - RNA, 68 nt, Brucella suis 1330
guaguuuucggggucgcugcuuuugccaucgauccuuaccuuccguuagcacgaucccgaaaaguugc

SEQ ID NO: 4224917 - RNA, 116 nt, Brucella suis 1330
cgagccgcuuggcaaugaaacacuggucuuugcggaauuugccgggcgcgaauggguggcgcguaugcugaacccgcgcccggugcagccgggugagagcauugccaugcaguucg

SEQ ID NO: 4224918 - RNA, 64 nt, Brucella suis 1330
gcauuuuaagagcauaauccagccggagugcaacaaaacgauccggauuaugcucuaagaaugc

SEQ ID NO: 4224919 - RNA, 67 nt, Brucella suis 1330
acaggagcgaucaucaugacaguacugcuuggaaugggccagcaaaucauugaugauacggucaugu

SEQ ID NO: 4224920 - RNA, 96 nt, Brucella suis 1330
ggcgucgccgcccagucaugguccugaucgccgaugggcggcacaaagcgccccucgcucugaucggggcgcagaaugcucucaaagggcgauguc

SEQ ID NO: 4224921 - RNA, 79 nt, Brucella suis 1330
ggcucaggaccuguugcggcaucagacgccuucugcauuacagucaguggugcgaacguugaagucguuaaugcaagcc

SEQ ID NO: 4224922 - RNA, 74 nt, Brucella suis 1330
aaaucaucaacaucagccucaucaggccggcaaaauggcgccuugcaaugucaugagcugauguaggaagauuu

SEQ ID NO: 4224923 - RNA, 64 nt, Brucella suis 1330
cucgcgcgguguggugcuggucgcgaccucgaacgucgcgccggacaaucucuaccgcgacggg

SEQ ID NO: 4224924 - RNA, 63 nt, Brucella suis 1330
gacggcgaucuuggcgcgggaacccggaucgcgagcgaccgacuugaucucgaugaugccguc

SEQ ID NO: 4224925 - RNA, 63 nt, Brucella suis 1330
gugcgcgauuucugcggucauggcgucggccggcuuuuccaugaugcgccgaauauccugcac

SEQ ID NO: 4224926 - RNA, 58 nt, Brucella suis 1330
gcgaaacaguuucaauuuccguauccgcauccuugaacggcagguugagcauguucgc

SEQ ID NO: 4224927 - RNA, 80 nt, Brucella suis 1330
ucgcucaccugcacgccaagcgucgccgcacagucacggucaaucgugaucguggucugcggcgcguugaaggagagcga

SEQ ID NO: 4224928 - RNA, 81 nt, Brucella suis 1330
gcuuggcggcucggcggacgaaaacucggccauuggugaaaucaccgggcgcgguuucucgucggaagagguggucgaugc

SEQ ID NO: 4224929 - RNA, 59 nt, Brucella suis 1330
gcggcgguaucgaucuugucuuuccgcaccacgaaaacgagauugcccaguccugcugc

SEQ ID NO: 4224930 - RNA, 55 nt, Brucella suis 1330
gauguuguggaacuauaugcgcuucgauuucggccgcagcuauuuccgcgacauc

SEQ ID NO: 4224931 - RNA, 73 nt, Brucella suis 1330
cauuauggugacuguccgcaagcuucaagccuucuauccggcuugaaggguguggggcaugucauugcugaug

SEQ ID NO: 4224932 - RNA, 62 nt, Brucella suis 1330
ucgugaugauauucaagcguuucgcgcgacaugaaaggcgcaagcgcaucauagucauacgg

SEQ ID NO: 4224933 - RNA, 93 nt, Brucella suis 1330
gugccugcuucaaagcgguguggcggaugauuguaggugacguuuuccuccgucacuuccucgaucauuucgcccccgcccuggaacgggcgc

SEQ ID NO: 4224934 - RNA, 55 nt, Brucella suis 1330
uauauugcgaagacuugccgcgugucaccuuauagagcggcggcugcgcgauaua

SEQ ID NO: 4224935 - RNA, 58 nt, Brucella suis 1330
aguggcuguucuugcgcaggcgaaagaccaggguaugcgauugagugagauggucgcu

SEQ ID NO: 4224936 - RNA, 93 nt, Brucella suis 1330
uucaaaagcggcaugugcaugcgcaaauggugauuuucgagcgccggaacgcagaucaauuuccauuugcagccgcacagcgcgacuuuugga

SEQ ID NO: 4224937 - RNA, 66 nt, Brucella suis 1330
gacacgcuugacggugccguugacgauuucgccaacgcgauccuuguauucgucauacuggcgguc

SEQ ID NO: 4224938 - RNA, 66 nt, Brucella suis 1330
cgguacggauagcauccgugccugcucgcaggauuuccaugaacaggccggugcugugcgaggccg

SEQ ID NO: 4224939 - RNA, 69 nt, Brucella suis 1330
gccgggugucgaacugcaugaugccgaaagcauuuugccugaaacggcauucaagcggcuugauccggc

SEQ ID NO: 4224940 - RNA, 107 nt, Brucella suis 1330
ucccgccaagccgcuuggcugcuacggugacgguggcgccauguucaccaaugaugcagaauuggcagauacacugcgcuccgugcuguuccacggcaagggcgaga

SEQ ID NO: 4224941 - RNA, 65 nt, Brucella suis 1330
gagcggcggucgucacgaucaucaaaaaugccgcaaauccggaugucguuauccggcugcuguuc

SEQ ID NO: 4224942 - RNA, 60 nt, Brucella suis 1330
gcggugucgaaaguuuuggcaugaugugcuccgagcgcgagcuggaacuuuccgacgagc

SEQ ID NO: 4224943 - RNA, 55 nt, Brucella suis 1330
uugcccucaugucucgcgcuacccugauaaguggggcgguacugcaugagggcga

SEQ ID NO: 4224944 - RNA, 93 nt, Brucella suis 1330
ucgaccgcacgcaguuugcaaucucgacggaagaaacccguuauuaccugaacgguaucuucuuccaugcgauugaaagcgauggcgcguuga

SEQ ID NO: 4224945 - RNA, 85 nt, Brucella suis 1330
ggcacuuaucggccucuccuucaugucgucgcugcgcuauaaccgccugaacccgaacuggcagaacgagaccgaggaagugacc

SEQ ID NO: 4224946 - RNA, 72 nt, Brucella suis 1330
aucugagaaaaccuugcaagcugcuguacuugaucccgucaaaaaguacgcagcuuuaaaguuuuuuaggau

SEQ ID NO: 4224947 - RNA, 72 nt, Brucella suis 1330
guccgcguucacgcuucccugaaauaaugacgauaauccucgcaucauauuucacgggacagcggaucggac

SEQ ID NO: 4224948 - RNA, 76 nt, Brucella suis 1330
ggcgcuguuuuccauggugccggaaggggcgauccuugauuggggcgccuaucauaugcgccaggaucucggcgcu

SEQ ID NO: 4224949 - RNA, 72 nt, Brucella suis 1330
cggcccgcagcggggucaaaaacgcgcugcaacagauugaugagcgucgucuugcccgcgccgguggggccg

SEQ ID NO: 4224950 - RNA, 114 nt, Brucella suis 1330
gcggcuuucggcggguggcaagcgcauugccuucgugggcgacggcaucaaugaugcgcccgcgcucgccgcugccgaugugggccuugcgauuggcaccggcacggauaucgc

SEQ ID NO: 4224951 - RNA, 84 nt, Brucella suis 1330
ggguucaagcaggaugccagccguuuccggcgugauggcggcgcgaagggccgccucgucgccgaacggcaccugaucgaagcc

SEQ ID NO: 4224952 - RNA, 104 nt, Brucella suis 1330
uaguuuugaagccuugcgcgagcagcgccgacagaauggcaagcaagcccugcaaacggcgcuugcgcuuuaucugccgcgaaaacuggcgcaggcuauagcug

SEQ ID NO: 4224953 - RNA, 63 nt, Brucella suis 1330
aucguggugacgagccuucagaaggcgagccuguucgaggaagugaaggaccgucuucacgau

SEQ ID NO: 4224954 - RNA, 74 nt, Brucella suis 1330
ugcggucagccggaaugaaaccagcguucgggacgcguacgccagauguuguaccguuccagguaaagaccaca

SEQ ID NO: 4224955 - RNA, 57 nt, Brucella suis 1330
gucguuggguggucgcgacauuugccuuuauacgacauauucgcggcgccggacgac

SEQ ID NO: 4224956 - RNA, 60 nt, Brucella suis 1330
ggcgaagacguaauggaacugcugcgcucgaugcaccagcaggggcauaccgucaucguc

SEQ ID NO: 4224957 - RNA, 78 nt, Brucella suis 1330
gaggcgcuugaagucuuuaugcaugucguugaccggaaaacgggccuccgcuuuuccgcgauaugcuuaaguugccuc

SEQ ID NO: 4224958 - RNA, 104 nt, Brucella suis 1330
gcaucggucaucauuugcgcggccuggaucgcacgcguuuccuggcgauccgcacccaguacgauugccagcaccgugcggccguugcggguggccgaaccugc

SEQ ID NO: 4224959 - RNA, 60 nt, Brucella suis 1330
uucgccggucgccuggaaggaagcggugcgaaccgugauaaccuucuuggcgucggugga

SEQ ID NO: 4224960 - RNA, 104 nt, Brucella suis 1330
aagggcauauugucguugacgauggugaugacgcucaccggccggcuauggggcuugccauggcgugcgauaccgucgucaauauugaugaugcucuugcccuu

SEQ ID NO: 4224961 - RNA, 64 nt, Brucella suis 1330
uugcuucaacuucggaggcgaucgaauuugauggcaaugauaauacucuggagcuuuggggcgg

SEQ ID NO: 4224962 - RNA, 57 nt, Brucella suis 1330
cuuuucaugcggauaguucagcgucgccuugggcgcgaagaacuggcgcauggaaag

SEQ ID NO: 4224963 - RNA, 67 nt, Brucella suis 1330
ugugcagaucacggaaggccagagcgaagccgacagggcuuuugaggauaucuuccgugaaagcgca

SEQ ID NO: 4224964 - RNA, 59 nt, Brucella suis 1330
guuaagcuuuaaagcgaaagggcaccgcuggcgcccuuucuguuucgugggguucaaac

SEQ ID NO: 4224965 - RNA, 130 nt, Brucella suis 1330
ggggccuugucggaaggugcagccggcguggccgauggagcaggcgcuuccggcuuugccucaucuggcuuuuucccggcaggcuuuguugcaucggcagccgacuggcccggaauauccggcaggcccu

SEQ ID NO: 4224966 - RNA, 63 nt, Brucella suis 1330
ccgccuauggcuuuacccugaaacccgaucagcucaucacgcuuucaggcggcgauacggcgg

SEQ ID NO: 4224967 - RNA, 59 nt, Brucella suis 1330
ugcguuugcccuugaugucgcuuuucuugaaauccuugagcgcaucgaugccgagcgca

SEQ ID NO: 4224968 - RNA, 67 nt, Brucella suis 1330
ucgggguucagagcauuuucccgcgcaggcgguucccgcuuuuggaagacaugcucuggcacccuga

SEQ ID NO: 4224969 - RNA, 73 nt, Brucella suis 1330
augcggucacgaagccggcgaaaaucgguauucuggcacgacgcauacugccugcgcgcuggcuuuaccggau

SEQ ID NO: 4224970 - RNA, 70 nt, Brucella suis 1330
ccgaucuugcggccaucgagaaccgccugcacggcauuggcaaggccggugauaucgaugcccagaucgg

SEQ ID NO: 4224971 - RNA, 77 nt, Brucella suis 1330
ggccgcuaaugccgcgauaggcagccgaaacacucucaagcgccgccuuuucggcagcgguugccgcaugugcgccc

SEQ ID NO: 4224972 - RNA, 101 nt, Brucella suis 1330
ucacuaguaaguauauguaucuauuggauuuuuagaauuuaacguuugaaacagcauauguaacggccgggauucaaacgucaaauucaauccacuaguga

SEQ ID NO: 4224973 - RNA, 68 nt, Brucella suis 1330
gcggucaugacacccaaacuuagccauggugcaccaucgacuauaagaaguuucuugucgugaaucgc

SEQ ID NO: 4224974 - RNA, 74 nt, Brucella suis 1330
gccgaaaaggcugccauggccgcaacggcugauggcgggcagggccguuccggccgugugcuggcguuuguugc

SEQ ID NO: 4224975 - RNA, 55 nt, Brucella suis 1330
gacgauuuugaugucagccgccugcgcugcaaaggcggcugcaagcaaggcuguc

SEQ ID NO: 4224976 - RNA, 56 nt, Brucella suis 1330
cgaggcuggucuccgccaugcgcgcuggcaagacgcucaaagugcaggccacuucg

SEQ ID NO: 4224977 - RNA, 67 nt, Brucella suis 1330
ggugcuggcggcaugcguuuuggcgcgucggaaaaggccgauucgcuuuuccaugccgcgcagcgcc

SEQ ID NO: 4224978 - RNA, 91 nt, Brucella suis 1330
guccgcccguaucacgaacaaccuuuuccacuucaucgaccgucaggucgcuggaggcaucgaagguugcggugcugaucgggaaaucgac

SEQ ID NO: 4224979 - RNA, 64 nt, Brucella suis 1330
gcagaggacaaaguggaagaaacgcucgauguguuucaucguggggcauuccaccuuguccagc

SEQ ID NO: 4224980 - RNA, 78 nt, Brucella suis 1330
uucauucaggcgcgcgaaguugaaugcggcguucuugaagacgaaggaggcgcgcuguucgucucgcgcgcuggcgag

SEQ ID NO: 4224981 - RNA, 69 nt, Brucella suis 1330
gcggcauccgugcugcggguguucccucgcgcgggcuauaggggaagacaugcagauggguaaggccgc

SEQ ID NO: 4224982 - RNA, 72 nt, Brucella suis 1330
ccuggcagcggaagcccaguuccgcauauucuuccgcgcgggagaugccggauuuggcuucgcgcagcgagg

SEQ ID NO: 4224983 - RNA, 62 nt, Brucella suis 1330
cgcaccggcggaugggcaggccgcuucgcaaccugcgacgccggucgaaccgucugcgggcg

SEQ ID NO: 4224984 - RNA, 74 nt, Brucella suis 1330
ugcaggcugauaaaaagauacguaaaaaggccgcgcgaugcggccuuuuuauugcucuauuggaucagucgaca

SEQ ID NO: 4224985 - RNA, 60 nt, Brucella suis 1330
gcgacggcaugggacaggugagcgccacaccggcggcgcucgaucuuauccgcgcguugc

SEQ ID NO: 4224986 - RNA, 81 nt, Brucella suis 1330
ccguuucacacuuuucgggaugcgcucuaaaaucccggcuuuguccgggauuuuuuguaucuugaggaauggaugauccgg

SEQ ID NO: 4224987 - RNA, 75 nt, Brucella suis 1330
cgaacucgcuggaugcgcucugcaagcguuaugguaucgacaauucgcaccgcacccugcacggcgcauugcucg

SEQ ID NO: 4224988 - RNA, 127 nt, Brucella suis 1330
ggagguaaguacagucagauuccggucuuugauauuccauauagagcauaaucuugaguguccucguuccacucuggucggauuauguucuauaugguugagaacaccgcauacugaugccucuucc

SEQ ID NO: 4224989 - RNA, 65 nt, Brucella suis 1330
ucuggaagacgaucuucuaaagacgcugcgcaacggcaaggcggcgaccuucaucgucuuccaga

SEQ ID NO: 4224990 - RNA, 64 nt, Brucella suis 1330
aucauacuuucuuugagaugcucggcaauuuuucguucggcgacuauuucaaggaagaugcgau

SEQ ID NO: 4224991 - RNA, 74 nt, Brucella suis 1330
uccgguggccacuuaauucgccguccccaacgcaaaaccgcuuugcacuuuugcuggaacugcauggccccgga

SEQ ID NO: 4224992 - RNA, 65 nt, Brucella suis 1330
ggaaaugcagauuggccgcuauuaccuugagcgcaaggaauaucuggcggcgaucaagcguuucc

SEQ ID NO: 4224993 - RNA, 77 nt, Brucella suis 1330
cggcuugcggucagcgaugugaagccgggugaggcgcuucuggccuucggcccgcaucgcguugcugagagcaaccg

SEQ ID NO: 4224994 - RNA, 70 nt, Brucella suis 1330
gguacagcaauagaggaaaccaaggcgccacgggccuuccagugugccguucccgucugugcuguuugcc

SEQ ID NO: 4224995 - RNA, 73 nt, Brucella suis 1330
gaccguucuggaagccgcugagcuguccaagcuucucgaagagaaguggggcguuucggcugcugcuccgguc

SEQ ID NO: 4224996 - RNA, 108 nt, Brucella suis 1330
agcauuuccagcaaaagugcgaagcgguuuugcguuggauaaugcgaccaggaaagguuugcauuuccagccaaaagugcaaagcaguuuugcauuuggaacaaugcu

SEQ ID NO: 4224997 - RNA, 83 nt, Brucella suis 1330
ggcaagcuuguggcgcuguucccuguugagggaagcgaucagauucugcuuguuucggauggcggacagcuuauucgugugcc

SEQ ID NO: 4224998 - RNA, 102 nt, Brucella suis 1330
ggcaguauguuaggggaguaagggaguagggggcguauguuuugguugcgcaugaccgcaaaaccauauccuucacugcccuacugcccuauucacgccgcc

SEQ ID NO: 4224999 - RNA, 73 nt, Brucella suis 1330
acgcugaagaaacgaugaaagucacggucguuccgaaucgcaacgccaucaugcuugucaucgccuucggcgu

SEQ ID NO: 4225000 - RNA, 71 nt, Brucella suis 1330
cgugaucgcgcgcagccaugcaagugaaauggagcgcgagauccgcagcuugcgcagccgcgccgauugcg

SEQ ID NO: 4225001 - RNA, 56 nt, Brucella suis 1330
uccgcuuucgcccccuuggcgaaggcgaccagccugucaggggugcgaugggcgga

SEQ ID NO: 4225002 - RNA, 72 nt, Brucella suis 1330
cugcggaucggcuucaauccgaaaucaagaugcuugaggaucgucugacggaguugaacgcuguuauugcag

SEQ ID NO: 4225003 - RNA, 64 nt, Brucella suis 1330
ccccuuuggauggcauagaagccuuccagggccucccggguggcaaacaugccauccaucgggg

SEQ ID NO: 4225004 - RNA, 101 nt, Brucella suis 1330
gcgcgaccagcggagcgauaccgaaggcagcgaaguucuugaggauguuuuucaucguuacguccuucauaucucucgcugcaucagcccuugguuuccgc

SEQ ID NO: 4225005 - RNA, 94 nt, Brucella suis 1330
gcaucuuauaaacuuuauagauucgauuuuuugaaauuuagcauaugcaaauauaagcgguaaauguaaaagugagugauaauuuauaagcugc

SEQ ID NO: 4225006 - RNA, 63 nt, Brucella suis 1330
gacgggcaggcggaagaacgucugaccacgaaacgggacggugaauucuuccgccgggcgcgc

SEQ ID NO: 4225007 - RNA, 61 nt, Brucella suis 1330
gcgcaugguaaucaucgugccuuugucguuuuucagccauggcgcgguaauggccgugcgc

SEQ ID NO: 4225008 - RNA, 83 nt, Brucella suis 1330
ccugaccgaaacgccggauuuugaacggaugaucgucaccgauggcauucaccuguucaaguucuggcucgauaucgggcagg

SEQ ID NO: 4225009 - RNA, 79 nt, Brucella suis 1330
cggcacggggggcgcaacacuccauauugccgacaauuaugucggacauaauggcauuguugcgaucaauaccgugcug

SEQ ID NO: 4225010 - RNA, 70 nt, Brucella suis 1330
cgggcggaucggacggucgaucaggcgcgaaacgaggguuucguuuucgcucggacggccuucacgcuug

SEQ ID NO: 4225011 - RNA, 83 nt, Brucella suis 1330
gcugacauugcugagaacccugucgcuggaacaggugcggggcgagaugcccgaccucaccacgcggcaggcagccauucugc

SEQ ID NO: 4225012 - RNA, 55 nt, Brucella suis 1330
ugcgacgugccuccuuguagaucauaucaacgauuucaucggaaaugcggucgca

SEQ ID NO: 4225013 - RNA, 72 nt, Brucella suis 1330
ucgccgugaaggacaagcucggcaucgcaaucgacaucucgcugugggaccgccgcuuguuuuuugccgcga

SEQ ID NO: 4225014 - RNA, 86 nt, Brucella suis 1330
gguuacugauuuggcuuugaaaccggaauucguucaugucuccuuucaggaggcauacggguuucgguuucaucaaauccguggcc

SEQ ID NO: 4225015 - RNA, 82 nt, Brucella suis 1330
cgccgccaaacaggccggggcagaugucgucgugcuugaccaccaucaggucggcggcgaucugccggaagaugcgguggcg

SEQ ID NO: 4225016 - RNA, 92 nt, Brucella suis 1330
cauucccagcgcggaucgucgguggugcugucgggaugcgccagcgcgcagaccucgacaaugcccaccacuucaagccccucguuggaaug

SEQ ID NO: 4225017 - RNA, 55 nt, Brucella suis 1330
cugccuuugcacaagguauggacggcgcacgcauuuccaugccguucggaggcag

SEQ ID NO: 4225018 - RNA, 66 nt, Brucella suis 1330
ggcugaaaagcccgcaucuuccgcuguuuguucuggacaggcguagcuggaucgggcugagaagcu

SEQ ID NO: 4225019 - RNA, 64 nt, Brucella suis 1330
gaagacgauuuuugugcgcgccgucacaccugcgaggauggcguccacaucgaugcguucguuc

SEQ ID NO: 4225020 - RNA, 55 nt, Brucella suis 1330
gcugaccgacuaccgcaauaucaaugacaaguucgaccggcuggugucggucggc

SEQ ID NO: 4225021 - RNA, 66 nt, Brucella suis 1330
acuuuaccggcgaagauuauccggucgaugcguucugcgcgcgccugaaaucuuucucggaaaagu

SEQ ID NO: 4225022 - RNA, 84 nt, Brucella suis 1330
cuggcucugggcacaagccguuuuugugcugcucggguuucugcgccuguuuccggcaaaagcggcaaucagcuuuucggccag

SEQ ID NO: 4225023 - RNA, 65 nt, Brucella suis 1330
gcagaaaccgauaaaggugggcguugugcuuugguaucgauuuguuuaccuugucggcucacagc

SEQ ID NO: 4225024 - RNA, 80 nt, Brucella suis 1330
gccguaggaaaucuggucgcuuucgauggugacggaauccgccucgccgacaacgaugcggccacggaauuucuugcggc

SEQ ID NO: 4225025 - RNA, 130 nt, Brucella suis 1330
uuggucgagguuuccucgcccuucugauacuggcgauaguggcggguuacggugccgugggcggcuuccgcuuccaccgucuugccauccggcgucaucagaaccgaggucaucaggccgagcgagccga

SEQ ID NO: 4225026 - RNA, 56 nt, Brucella suis 1330
gcgauggaucaucgccgcgcgggcaucauagccaagaauggcacugaucucaucgc

SEQ ID NO: 4225027 - RNA, 79 nt, Brucella suis 1330
cggccuucguguuggcggagcgguggaguucgguaggcuggaucugccgcccaauuuugcacgcuccgaagcgaugcug

SEQ ID NO: 4225028 - RNA, 63 nt, Brucella suis 1330
ggcugaugacgccugaaggugaagccgccgucaucgauuuccagcuugcaagcguucaucgcc

SEQ ID NO: 4225029 - RNA, 77 nt, Brucella suis 1330
ucugggccugaaaaucaugguaggcugcauggugggcacgucgcucggcauggccccugccguccuucuggcgcaga

SEQ ID NO: 4225030 - RNA, 60 nt, Brucella suis 1330
ggugcggugacacugcuuucaccgccggaugcgcuggcggucaacgcugcucaccucacc

SEQ ID NO: 4225031 - RNA, 59 nt, Brucella suis 1330
guccuaaagcauuuccagcaaaagugcgaagcaguuuuggcucgaaaaugcucuaaggc

SEQ ID NO: 4225032 - RNA, 60 nt, Brucella suis 1330
gcuggcgccacuuucguuucaacagcauuuuuugauuguugaauggaaaauggcgcgagu

SEQ ID NO: 4225033 - RNA, 65 nt, Brucella suis 1330
ucuggaagacgaugaaggucgccgccuugccguugcgcagcgucuuuagaagaucgucuuccaga

SEQ ID NO: 4225034 - RNA, 96 nt, Brucella suis 1330
uccgcuugccaucaucgguaucguggcuucggucgugggcgcguucuacuaucugcgcaugaucaagaucaugugguucgaugaaccggcagcggg

SEQ ID NO: 4225035 - RNA, 56 nt, Brucella suis 1330
gcgcuuguggccgcgggcggggaaugcacacucguuccuuccgccgccgcacaggc

SEQ ID NO: 4225036 - RNA, 55 nt, Brucella suis 1330
gcaagcguuuuccguuuuuugcagagggcaaccgugcauggacagaaaaugucgc

SEQ ID NO: 4225037 - RNA, 63 nt, Brucella suis 1330
cuggcgcuccgauggggacucaccuucacgcagcgcauugguagagucgcagaucagcgccag

SEQ ID NO: 4225038 - RNA, 61 nt, Brucella suis 1330
ggaaauuaccggucuucagggcuaugaucucaagcagaucaugcgcaccggaacgguugcc

SEQ ID NO: 4225039 - RNA, 59 nt, Brucella suis 1330
gccguucgugaagcuugccgaugugcugggcgcuuuugucggucaggucacggaugagc

SEQ ID NO: 4225040 - RNA, 108 nt, Brucella suis 1330
aucauccagcagaugggcccgcgcccgcagaucagccuugaggcugccgcaagccaggcgggccuuaucugaauuugcuagcggaaccgauuauucuggccggaugau

SEQ ID NO: 4225041 - RNA, 66 nt, Brucella suis 1330
ucgaucuggauugagaagaucagucgcgguuugcaagccgcggcgcgaccugcucgaucuggccga

SEQ ID NO: 4225042 - RNA, 61 nt, Brucella suis 1330
gagcggcguuuaucaucgcggcauaaucgguugcgagugcuggauagagaaacgcacccuc

SEQ ID NO: 4225043 - RNA, 85 nt, Brucella suis 1330
gcggaugaccgcgauggcgggcgccccggcgauuuugauuucuauguucugucauuaucguggucgcccagcuauugcgccucgc

SEQ ID NO: 4225044 - RNA, 104 nt, Brucella suis 1330
gggaaaggcuguuaaggcagaugcccgaauugucuucuucgcuguccaauucguccaccgaacacaagacuucggagcagauuccgcccgaacagcccucuccc

SEQ ID NO: 4225045 - RNA, 59 nt, Brucella suis 1330
uugcaauguguuuuuggcagaugcgaaaaccccucuuuuuucugcggaaaaacuugcaa

SEQ ID NO: 4225046 - RNA, 77 nt, Brucella suis 1330
gcgcacgucgauccagcgcuccggcugaucgucauaggccgucagugcgggcgacuggaugggauagaucgugaugc

SEQ ID NO: 4225047 - RNA, 55 nt, Brucella suis 1330
gaagcuuggaaugucgcgcggauugggaaugaggauauugcgcgcgccaagcuuc

SEQ ID NO: 4225048 - RNA, 56 nt, Brucella suis 1330
gcccgguuggcgaugcccaugacaccaaggucacgcugacgguucgcgaaccgggc

SEQ ID NO: 4225049 - RNA, 89 nt, Brucella suis 1330
uacaaauucuaguggucugauuccaacauuugccucccucgguucaagcguugagcaaauguuggaaucacaaagaccacuaguaagua

SEQ ID NO: 4225050 - RNA, 60 nt, Brucella suis 1330
gauggcggcucgcugcgggcggagccugcaaaugccccguaucgcagggagcccgcuauc

SEQ ID NO: 4225051 - RNA, 71 nt, Brucella suis 1330
gagauuguucgugcggucagaagccuugcgcgcgaugucgccgccgggcuucuugauccauccucgaucuc

SEQ ID NO: 4225052 - RNA, 66 nt, Brucella suis 1330
gugauucacgugaaacaugcagcuuuaugagcaccaauagccguugcaauguuucacgugaaacau

SEQ ID NO: 4225053 - RNA, 74 nt, Brucella suis 1330
gagaaugcacaugaaaccugugugaaaauuuguccgagaggauggguuccacaggguucauuuugauugaucuu

SEQ ID NO: 4225054 - RNA, 57 nt, Brucella suis 1330
ugguuggugcgggccgaacggagcuuauggaaggaaucgucgguuugcgcccagcca

SEQ ID NO: 4225055 - RNA, 79 nt, Brucella suis 1330
caucggcaucauauugguaucgagaugauacaugauccagauggaaccgaucagcacgauagccagaauaaugccggug

SEQ ID NO: 4225056 - RNA, 79 nt, Brucella suis 1330
agguggcgcucggccauaucgaggaacuggaagcaaaaaugcgccagcuucaggaaauggccgauacgcugcgcuaucu

SEQ ID NO: 4225057 - RNA, 80 nt, Brucella suis 1330
gcaggacuucacccgccagauagagcgauccgccaaucagaaugcguggcggagccucaucggcgggccagguaucgugc

SEQ ID NO: 4225058 - RNA, 86 nt, Brucella suis 1330
augagcuuuuccgcgauuaccugauggggcguaucgcagccgaagcgcggcgcuacgccgauagcgggcaauugcgugaagcugau

SEQ ID NO: 4225059 - RNA, 80 nt, Brucella suis 1330
agcauggggcgauuuagagcauuuccagcaaaagugcgaagcgguuuugcuggaaaugcucuagauuugccggaaaugcu

SEQ ID NO: 4225060 - RNA, 124 nt, Brucella suis 1330
cgccgcgccauugagcagggugcgcuuucgggccaugggcuggagauugccuucguggcugaccgcguugaugcauuuuucgcccaugugcagggggcggcacgccugaaacugaccgacggug

SEQ ID NO: 4225061 - RNA, 75 nt, Brucella suis 1330
ggaaaaucuguuucguggcuggugcugguggcggugcuuaucagcgccauuaaugcggucacgcgcaaauuguuc

SEQ ID NO: 4225062 - RNA, 64 nt, Brucella suis 1330
ggaaaaccgguugaaauccccgaucccuauuauggcgaaaucggagauuucgagcugguuuacc

SEQ ID NO: 4225063 - RNA, 61 nt, Brucella suis 1330
gaauaucauugacgauggugagaagcacggacgacgaggugcugauauggucgagauauuc

SEQ ID NO: 4225064 - RNA, 112 nt, Brucella suis 1330
gucggaaacacgauuuaaaaaaaugcugucugccuuuugagcagacagcuuuuauccaauugaaaggacgaagcggucugcuggaaggcgaucgcugcauaacgugucagac

SEQ ID NO: 4225065 - RNA, 77 nt, Brucella suis 1330
uugagcgcauucgccgugcagaucguaagcguaucggucggcuggcaaaucuacgaucucacacgcgaugccuucaa

SEQ ID NO: 4225066 - RNA, 55 nt, Brucella suis 1330
aggugaaggucauuuccacgcccggccauacggcgggugggauuuccuauuaccu

SEQ ID NO: 4225067 - RNA, 57 nt, Brucella suis 1330
cauguguccgcagucgccaaagguguuauuugcggcuuuggcgcggaaggauaccug

SEQ ID NO: 4225068 - RNA, 57 nt, Brucella suis 1330
gcgcagguuuuugccauuuucaaguagaaucugcacgaaaaagacaaaugccugagc

SEQ ID NO: 4225069 - RNA, 106 nt, Brucella suis 1330
ucacgaucguccaucgccgugacgguuuccgugcggaaaagaucaugcaggaucgccugcuuucgcgcgagaacgucucggugguguggaacagugugaucgauga

SEQ ID NO: 4225070 - RNA, 63 nt, Brucella suis 1330
cuugagaagcgguucaaaguucaucgcaggguuccuguugaauuucguaucgcuuucaacaag

SEQ ID NO: 4225071 - RNA, 67 nt, Brucella suis 1330
cggcuucggcacgauggggccggaugagcaugccccgcuugucgauccggccaucaugcugaugccg

SEQ ID NO: 4225072 - RNA, 57 nt, Brucella suis 1330
cucggcguuggagacgcgccagaaauggcgguuguccuauucguuuucacgcacggg

SEQ ID NO: 4225073 - RNA, 55 nt, Brucella suis 1330
ggcacucuucugcuugcggccuggcugauuucggcugcaaccagcgaagagugcu

SEQ ID NO: 4225074 - RNA, 62 nt, Brucella suis 1330
uaccguucauggacggaaggaacgccgcugcaucuggcucggcccuccgauccgaaauggua

SEQ ID NO: 4225075 - RNA, 117 nt, Brucella suis 1330
gccgccuauuucgagcguuucgacaauaucuggugccauggcgauuuugccgaauggaccgaacauggcggcaucgucauccauggccgcucggacgcgacgcugaaccccggcggc

SEQ ID NO: 4225076 - RNA, 96 nt, Brucella suis 1330
ugcgccgaugggcgaugucgagcacaagcaggcuuuugacggcuaugugcgccguggcgacgagcaggcuuugcgcggcauugagcagaaggcgca

SEQ ID NO: 4225077 - RNA, 62 nt, Brucella suis 1330
gugggcgucgagcgugucgagauccgugugaaccuuggaauaaagcaugcucguauguccau

SEQ ID NO: 4225078 - RNA, 74 nt, Brucella suis 1330
gguguuucggcagcgcgugguuuugcgcuggcgcugggugugcccgccaucgggaucaccgcuuucgaggcgcu

SEQ ID NO: 4225079 - RNA, 94 nt, Brucella suis 1330
gucggccuugucggcguggugguaaccgguuggucggugcucgauccauugcucgccauucugguggccaucaauauucucuggcagggcuggc

SEQ ID NO: 4225080 - RNA, 61 nt, Brucella suis 1330
cacggucuuguuugggucgagugcaucgcggcucugauccacauaggaaagaugaaccgug

SEQ ID NO: 4225081 - RNA, 72 nt, Brucella suis 1330
aacaguaugaaaauuucuuaaucgcgugaugcaaaauuguauuuacgcugugggagauauuagaugucuguu

SEQ ID NO: 4225082 - RNA, 73 nt, Brucella suis 1330
aggaaacgaaggucaucgauuucgaugucgacgguaucaaguccggcaaugucaccuauggccaccguuuccu

SEQ ID NO: 4225083 - RNA, 55 nt, Brucella suis 1330
cgcccggcacuucugguuuuugccauugcgcuggcggcagcuuuccugccgggcg

SEQ ID NO: 4225084 - RNA, 82 nt, Brucella suis 1330
uggaugaugauuaucgguacggucgccaucacgggccucggcauuccgggcaccguuaucggcacggccgguuucuucucca

SEQ ID NO: 4225085 - RNA, 97 nt, Brucella suis 1330
cuggcaugauucuuguuugucucuguuugaaccggccucuucagcgcaaccgcguuugaagccgcccuucgacggagauauucgaugcucauaacag

SEQ ID NO: 4225086 - RNA, 61 nt, Brucella suis 1330
ggcggguuuucucccuuuugcgaacaugccaaaacaggcgcgcaaaacgaggagacuuguc

SEQ ID NO: 4225087 - RNA, 130 nt, Brucella suis 1330
cagaucggugccggugcuuacgccgccaucagcgacaucacgaucaucgcugaaaucgccguauuggccaucaugacgugaauuguugcugguguaguugaagcgcagcugaguauaggugccgagugug

SEQ ID NO: 4225088 - RNA, 89 nt, Brucella suis 1330
caaaagucgcgcugugcggcugcaaauggaaauugaucugcguuccggcgcucgaaaaucaccauuugcgcaugcacaugccgcuuuug

SEQ ID NO: 4225089 - RNA, 90 nt, Brucella suis 1330
gcgcuugaugcgcuggugaucgauacgggugcggcacuugauugucugccgcaagugccgcucuccgacgaucaggcccagcgggugcgc

SEQ ID NO: 4225090 - RNA, 70 nt, Brucella suis 1330
aauucucgggcgcaauaucgacaagcugaacgagauggaaaagauggccaucgauaugcgcauggggguu

SEQ ID NO: 4225091 - RNA, 83 nt, Brucella suis 1330
ggccccuuucaucgugcuggaagaugccgaucucgaucaggccguggaugcggcagcuuucggcgccuucaugaaucaaggcc

SEQ ID NO: 4225092 - RNA, 85 nt, Brucella suis 1330
uggggccuguucaugcaggcgaacuggguggucaagcuggugaugcuuggccuguuguucgcuucgaucuggacuugggccauca

SEQ ID NO: 4225093 - RNA, 84 nt, Brucella suis 1330
aagugcugcggcaagcaggaacaggaaaauccacagcgaccaguaaccgcgccggugggccuugaaauucugccagcggcgcuu

SEQ ID NO: 4225094 - RNA, 69 nt, Brucella suis 1330
cagauugcggagaugcgcacggaauugaaacgcaugucgcguucacuugccucgcauuccgaugaucug

SEQ ID NO: 4225095 - RNA, 87 nt, Brucella suis 1330
ugguggcccauguggccgaggugaugaagggcgaccgcaacaagcaccgcgugaccuucuauuaucucguggccaaacagcucggca

SEQ ID NO: 4225096 - RNA, 63 nt, Brucella suis 1330
cguggcucggucgcacuccuguuccagcccgccgaagaaggcggugcaggcggccuugccaug

SEQ ID NO: 4225097 - RNA, 129 nt, Brucella suis 1330
aucggucagugcggcugcgaucaguccgccggugcaggauuccgccguugcgaucaugaugccugccuugcggcaggcaucaagcacggcgauggcuuucuguccggcgaugauguggcucauuccggu

SEQ ID NO: 4225098 - RNA, 87 nt, Brucella suis 1330
ugauggccucgaagaucugcuucacgaucagcggcgcaagacccagugacggcucaucgagaagcaggagcuucggacgcgccauca

SEQ ID NO: 4225099 - RNA, 81 nt, Brucella suis 1330
cggccaucgacgcauugcaucaggccgauaaacuugcugauuccuaugccauuaucggcuaugcgagcguggaaaucgccg

SEQ ID NO: 4225100 - RNA, 73 nt, Brucella suis 1330
ggcaggaaggugguucucuuugcggugccgggugcauuuacgccgaccuguagccugaaccaccugccgggcu

SEQ ID NO: 4225101 - RNA, 61 nt, Brucella suis 1330
cgcgccggcguuguacggaggaagcgauauucaucgcuucccgauauuucgccacggugcg

SEQ ID NO: 4225102 - RNA, 84 nt, Brucella suis 1330
cgugcgucgcaacugguucuggaagcgcagcgguuuaaugccgacaaacagacauugcuauugcugccgggaucacggcgcacg

SEQ ID NO: 4225103 - RNA, 78 nt, Brucella suis 1330
gacgguuucacccgcagcgacgaucaucucacgcuuggaggcgcccuccgugacgacgauaguuugcggcccacuguc

SEQ ID NO: 4225104 - RNA, 80 nt, Brucella suis 1330
gcgaucgccaucauagaagauuagagcgguuccgguuaaaacggaaucguuggaaccgcucugauuauuuguuuuaucgc

SEQ ID NO: 4225105 - RNA, 64 nt, Brucella suis 1330
gcaccuggaagggugagccgguuacgcugacuguuaccgaauuucucauccuucacucacuugc

SEQ ID NO: 4225106 - RNA, 71 nt, Brucella suis 1330
caucaagaugcgcgaaauucccgacauguaucuuuauacggugcguucgguuccgccgcaaauucuugaug

SEQ ID NO: 4225107 - RNA, 66 nt, Brucella suis 1330
ugccggucuggccggucagguucgcgcaggcauagccuugcgcagccccgacgggcgcacaccgca

SEQ ID NO: 4225108 - RNA, 72 nt, Brucella suis 1330
gaauucgucaucccggaucuucuggguggaucacagacgcugaugaucggcaagacgaucuggagcgaguuc

SEQ ID NO: 4225109 - RNA, 64 nt, Brucella suis 1330
uuguuuuuaugcauguuuucaucccaaaaccgguucccgcuuuugggagacaugcauuagauaa

SEQ ID NO: 4225110 - RNA, 77 nt, Brucella suis 1330
uugaaggcaucgcgugugagaucguagauuugccagccgaccgauacgcuuacgaucugcacggcgaaugcgcucaa

SEQ ID NO: 4225111 - RNA, 57 nt, Brucella suis 1330
ggucgaucggcauugguuuugcuauuccggcggaaauggccgccggugucaucgauc

SEQ ID NO: 4225112 - RNA, 76 nt, Brucella suis 1330
ggcaccuccacggcugcuucuacagccggaccggggaauccgccguccgcucaggagcagcccguugcggugggcc

SEQ ID NO: 4225113 - RNA, 93 nt, Brucella suis 1330
gcgagaccuugccgguaucgaagcuuuuuucggucgaggcgaacaccccguaacgccuggucucgaaccgguccgaaccuucgauccccuugc

SEQ ID NO: 4225114 - RNA, 60 nt, Brucella suis 1330
ucguggaagcguaauccuggucguccucguuucaccccggucggauuaugcuuucgacga

SEQ ID NO: 4225115 - RNA, 130 nt, Brucella suis 1330
gcgcuugcgcacgagaaggaaacggcccgcuucaucgcggauaauggcugcugaaauacgaaucgucuucaugauuucggagcaucaucacgcaggcggaugccgucaagaauaauggcgcugacagcgc

SEQ ID NO: 4225116 - RNA, 74 nt, Brucella suis 1330
gggcgaagccagaaugacaucggugaucuuggcauuaacgcgccugucacggaucgccaucuggcgcagcgccu

SEQ ID NO: 4225117 - RNA, 59 nt, Brucella suis 1330
gcugcucgacugggaccgcauggugaacagcauugauucauggguuccgcguaagcagc

SEQ ID NO: 4225118 - RNA, 59 nt, Brucella suis 1330
aaaauuguuugaucuuguuuucagacggcgaauccugucugaaaggaucaugcaguuuu

SEQ ID NO: 4225119 - RNA, 74 nt, Brucella suis 1330
gcgaagauacugauaggcggcaucuucgaucacugggauauccaguucgucggcaugugccagcagcuuuucgc

SEQ ID NO: 4225120 - RNA, 88 nt, Brucella suis 1330
cgaugcaguugccgcaccggcgccauaggcggcacgcgcuggaccuucaagccgugcugaaaggcugccgaucagcagcaccgugucg

SEQ ID NO: 4225121 - RNA, 99 nt, Brucella suis 1330
ggccgcgcucagccaucgccgggcgcuuguuccggcuuccgguuucuacgaauggcggcgcgaaggccgcaacaagucgcaggcuuauugggugcggcc

SEQ ID NO: 4225122 - RNA, 62 nt, Brucella suis 1330
cgcgucuucguucacaagaauauccgcgaacguuucaucgagcgccuugucgagcgcacgcg

SEQ ID NO: 4225123 - RNA, 103 nt, Brucella suis 1330
ugauccgcauggaagaaaugcgccagucggcgcguaucaugcgccagugcguugaucugcuucugggcaaggagcgugucggccccguuuccaauacggauca

SEQ ID NO: 4225124 - RNA, 93 nt, Brucella suis 1330
cgcgccaccgcccgucaccgugcggucgauggcuuucaggaggcucccaucgcgauugcccgacauggugcgggccaauuccaggcuggcgcg

SEQ ID NO: 4225125 - RNA, 129 nt, Brucella suis 1330
ggcaguagggcaguagggcaguagggcaguagggcagugaagaauauggucgcugcggccaugcgcaaccaaaaacauacuccccuacucccuuauuccccuauucccuuaacauacugccuuauugcc

SEQ ID NO: 4225126 - RNA, 76 nt, Brucella suis 1330
ggcguccauagagcaggaacuggcgcgcaaucuggcccgcacggcuugccgcgcuuuccugcgacaugaggaggcu

SEQ ID NO: 4225127 - RNA, 100 nt, Brucella suis 1330
ccgucgcuauugucggccccaccggcgcgggcaagacgacgcucaucaaucuguugcagcgcguuuuugaccccgcugcgggccguaucaugauugacgg

SEQ ID NO: 4225128 - RNA, 67 nt, Brucella suis 1330
gcguggcgacuggcagcuucugccguggcuuuucacuacgggccgcggcgucagcgccaucacccgc

SEQ ID NO: 4225129 - RNA, 66 nt, Brucella suis 1330
gcaucucuucugaaaaccggaaagcgcgccuuuuggcgcgcuuuuuguuauuucaggggauugagc

SEQ ID NO: 4225130 - RNA, 117 nt, Brucella suis 1330
uuguugaaggucguuucgagacgauugacgaggcuugucgcuuuguuauucgcgaggaugaagguucgcgggucgcgguaacggcgggcgaugucuauuucgggacggcugcaacaa

SEQ ID NO: 4225131 - RNA, 74 nt, Brucella suis 1330
ggcgccucaauauugcggccuguucgcuuggcggugcgcaagcugcaacggcgaaagcgcuggaauauugcgcc

SEQ ID NO: 4225132 - RNA, 70 nt, Brucella suis 1330
cggcgagcuuuggcgauugccccggcugggaucgggacgaucaggcuuuggcauuugccgcuuuucgccg

SEQ ID NO: 4225133 - RNA, 61 nt, Brucella suis 1330
uguuuuagagcgcaucccgaaaagugugaaacgguuuucggaaaagaugcgcgucaaaaca

SEQ ID NO: 4225134 - RNA, 93 nt, Brucella suis 1330
auggacgcgcgcgccauucacccggccauucacuucaaaauguccguuggcggauuuugcaaguguaacggucagugugccaucggcguucau

SEQ ID NO: 4225135 - RNA, 55 nt, Brucella suis 1330
ucaagcggaaucacauuuugcagguucucauccuuggcagaaaagaaccgcuuga

SEQ ID NO: 4225136 - RNA, 63 nt, Brucella suis 1330
gcaguuccuuuuccuucaucacaccgccauaaagccuggugccgauaacaaaggagggagugc

SEQ ID NO: 4225137 - RNA, 64 nt, Brucella suis 1330
gugguucaaucccuaucgcguuucgauggauaccagccgugaaacgcaggaggcguugaaaaac

SEQ ID NO: 4225138 - RNA, 83 nt, Brucella suis 1330
gcucaaggcgcaguucugcaagcaguuuauugcggucucacgcaagcuucauaaucagcuugccgaaauugucgccuuugagc

SEQ ID NO: 4225139 - RNA, 72 nt, Brucella suis 1330
ugguagcagguucgguuagagcauuuccuguuucauguaagugauuggaaaggcucuaucuguuuguuuuca

SEQ ID NO: 4225140 - RNA, 76 nt, Brucella suis 1330
uggugguuuucuggauuccaaaauuugcucaaugccugaaccgagggacgcaaauguuggaaucagacacccauca

SEQ ID NO: 4225141 - RNA, 106 nt, Brucella suis 1330
gaggcgaugaccaccaucacggugaagaucgucaaccagcuuaccggcgaucuugaguucaauucgccgcagacgcugguggccuucgcgcuuggcaucacgcuuu

SEQ ID NO: 4225142 - RNA, 86 nt, Brucella suis 1330
gguauuccuugucggugagcgucagcgccggugcgacggugaucgaaucgccggugugaacgcccaucggaucgagguuuucgauc

SEQ ID NO: 4225143 - RNA, 88 nt, Brucella suis 1330
ggaccgugcgcgaaauggaagaccgcuaucgcaagaugucgaaggucggcgugcgcaauauagacggcuucaaccagcgugucggucu

SEQ ID NO: 4225144 - RNA, 63 nt, Brucella suis 1330
cggcggcacggcuucugggucuuuuugccaauggaacggagggcucgauugccgucguugcug

SEQ ID NO: 4225145 - RNA, 63 nt, Brucella suis 1330
gcggcuuugcgggcuguuugcacgucaauaucgccaagcgugugaagcugcaccgcaagcggc

SEQ ID NO: 4225146 - RNA, 69 nt, Brucella suis 1330
uauuuguuuugucgcauuuuccaacgcaaaaccguuucacacuugugcuggaaaugcucuaaaaagaua

SEQ ID NO: 4225147 - RNA, 129 nt, Brucella suis 1330
aaggucacgcugucgucauugaccgcaucgagacgaccauuggcaagaucaaggcgauauucuuccgccgugggauaagccuugaucgugcugucggugaaggucugcucggcauaguucgcguggguu

SEQ ID NO: 4225148 - RNA, 82 nt, Brucella suis 1330
guuuugucgcagagcauuuccggcaaaaccguuucacggccuuuaccggagaugcucucgccccuuauuccccgaucagaac

SEQ ID NO: 4225149 - RNA, 77 nt, Brucella suis 1330
caucguugugcuugcaaguggagauccgauguuuuucggcgucggcgcgucgcuugcgaagcauuuuucgcccgaug

SEQ ID NO: 4225150 - RNA, 71 nt, Brucella suis 1330
ugcccgcacgcuucauucccugauuuaucgcccgcgcggugaagaggcgauugaggacgagacgacaggca

SEQ ID NO: 4225151 - RNA, 57 nt, Brucella suis 1330
auugcaugaaauacaagaaagcccggcuucggccgggcuuucuuguacauucacaau

SEQ ID NO: 4225152 - RNA, 69 nt, Brucella suis 1330
gucuucaugguucucggacuuuucgacacaucacgcggugcgccgaucucgaaaauuccgggugcugac

SEQ ID NO: 4225153 - RNA, 66 nt, Brucella suis 1330
cgcuugaugcgaucgaguucgccgagcgccgccuuugccugggcaagaacguugauugcacaggcg

SEQ ID NO: 4225154 - RNA, 74 nt, Brucella suis 1330
gucgaacgcggauugcggcuugucgucuucugcucgauggaaauggcgggcgacaggccgucaaucuggucgac

SEQ ID NO: 4225155 - RNA, 68 nt, Brucella suis 1330
caaucggauuugauuguagcggcaucuuuucgcaaggaaugaugcaucguugaucaagauaucgauug

SEQ ID NO: 4225156 - RNA, 83 nt, Brucella suis 1330
gcaaggcgccaugguaucgaucccgugacauuccugccgaccauucauggcgugcgcgccguugaaaccgugcgccgccuugc

SEQ ID NO: 4225157 - RNA, 80 nt, Brucella suis 1330
cugccgccgauagaggaugagacgccugcccuuugggaacguaucggcagcuggcugucgcgccuuuucuauggcggugg

SEQ ID NO: 4225158 - RNA, 62 nt, Brucella suis 1330
ggcuugccaucgggccgcaggaacauggucagcggccagccgccuugcugucccauggcgcc

SEQ ID NO: 4225159 - RNA, 73 nt, Brucella suis 1330
uccauaucgucgcguucaauggcgucgagaaccucauagguuucuucgagcguauagggcgcgauggugcgga

SEQ ID NO: 4225160 - RNA, 57 nt, Brucella suis 1330
uugggcgcaaccaccagcaauaugccguuauuuuccuguuucuggcccagcgcccag

SEQ ID NO: 4225161 - RNA, 71 nt, Brucella suis 1330
caaugcgcuugaccuguucaucgacuuccucaucggaaaugucgacgacuucacgggucacggcgaucuug

SEQ ID NO: 4225162 - RNA, 84 nt, Brucella suis 1330
ggccagcgcaucugcgagaugccgguugaggauggcgcugcggccugauccuuuuccgcauccucgauuaccuuguugcuggcc

SEQ ID NO: 4225163 - RNA, 63 nt, Brucella suis 1330
cugguuucgcagcgucgucgucuccuugacuaugucaagggcguggaccaugcgcguuaccag

SEQ ID NO: 4225164 - RNA, 63 nt, Brucella suis 1330
acgcaagcagguucagggagugcuugcagcaauugcaggucuuucgggaaccuuguccugugu

SEQ ID NO: 4225165 - RNA, 84 nt, Brucella suis 1330
guugaggccgacguugcgcgcgggaugaucgaucugcaaagugcugaacaggcgcgcaucgaaaucucccgccgcauccucaau

SEQ ID NO: 4225166 - RNA, 65 nt, Brucella suis 1330
gucgucaucaguggcgaaugaccggcgagagccgucagauagccuucgcuacccggaaugacgac

SEQ ID NO: 4225167 - RNA, 64 nt, Brucella suis 1330
caugcccagugcgaaagccgugucuuccagcucuuuugcaagaucgucaucgacgcuggccaug

SEQ ID NO: 4225168 - RNA, 109 nt, Brucella suis 1330
gauggugcgcucggagaccuccaggcguucagccaguugccgcgcggugacaagccggccaccgcgcaagugcugaacgaucuggaaaaggcgguccgcgcgacgcauc

SEQ ID NO: 4225169 - RNA, 126 nt, Brucella suis 1330
auccauggcaucuuccgcacgcgcuuucagaucaucggaaugcgaggcaagugaacgcgacaugcguuucaauuccgugcgcaucuccgcaaucugcuuuuccaaagccuguuggaugucauugau

SEQ ID NO: 4225170 - RNA, 73 nt, Brucella suis 1330
uuuagagcauuuccggcaaaucuagagcauuuccagcaaaaccgcuucgcacuuuugcuggaaaugcucuaaa

SEQ ID NO: 4225171 - RNA, 61 nt, Brucella suis 1330
gcgggcauggcgcacugacgaucgcacugaagaaccccgaucguuucaaauccgucuccgc

SEQ ID NO: 4225172 - RNA, 60 nt, Brucella suis 1330
cgaugcgcuuuggcuggcggcgcacacgcucguaaaugccgcgcagcgucgaggcgaucg

SEQ ID NO: 4225173 - RNA, 86 nt, Brucella suis 1330
gagaauaucgacggcgaggcgcugaucugggcgcaucagcggcugcugggccguccugaacagcgcaagauccugaugaugauuuc

SEQ ID NO: 4225174 - RNA, 86 nt, Brucella suis 1330
gcggcaguggaagccccgaagggcgaguuuggcgucuaucugguuucggauggcuccaacaagccuuaucgcugcaagcugcgcgc

SEQ ID NO: 4225175 - RNA, 57 nt, Brucella suis 1330
gccgguauauuccuugucgagaccggccaugaucuugagaacgguggauuuaccggc

SEQ ID NO: 4225176 - RNA, 65 nt, Brucella suis 1330
cgaaaugcuggagcuuuugaccgggcgcgaccccaauuucagccuggagcagaaauucuacaccg

SEQ ID NO: 4225177 - RNA, 68 nt, Brucella suis 1330
ggauugaauuugacguuugaaucccggccguuacauaugcuguuucaaacguuaaauucuaaaaaucc

SEQ ID NO: 4225178 - RNA, 57 nt, Brucella suis 1330
cugcgcugcacgauacggacggguauuuucuucgcaauuccguuuucgaugcgccag

SEQ ID NO: 4225179 - RNA, 94 nt, Brucella suis 1330
ggagcggcuuuccaaugucaccaugcgggugaaggaaugggacaaugacgucaucuuccugcaugagguggcaaaaggagcagccgaccguucc

SEQ ID NO: 4225180 - RNA, 69 nt, Brucella suis 1330
ccguguuuccagagcgcgaugcgugccagaaugucgauauccugcccgcgugugccuuugggaaaacgg

SEQ ID NO: 4225181 - RNA, 126 nt, Brucella suis 1330
ggucugcgaaaagcuugugaaugacgccggaaagcagcaugucguccggcuccgcgauuuccaccacgguugcagccuugagacgugaugcgaggucaggcaguuucacguuccaguuugcaggcc

SEQ ID NO: 4225182 - RNA, 129 nt, Brucella suis 1330
ucuuuaccggcgcuccauucucaccguagaucagacgcuugccgaucuuguuguccugacgaagcagaacccgcagcaggaugcgcgggugaagcagauucgugcgcugguggagcgucagcaggaaga

SEQ ID NO: 4225183 - RNA, 97 nt, Brucella suis 1330
gccguugguuuuugugguuacgaaugggucgaagaggugcggcagcauguccugcggcacgcccggcccguuaucaugcacgcagaacuccagcggc

SEQ ID NO: 4225184 - RNA, 74 nt, Brucella suis 1330
auggcggggcuugccucggcccugaugucggccggcgucaucguccaaccgggacugauggcgggccuugccau

SEQ ID NO: 4225185 - RNA, 66 nt, Brucella suis 1330
gcucaauccccugaaauaacaaaaagcgcgccaaaaggcgcgcuuuccgguuuucagaagagaugc

SEQ ID NO: 4225186 - RNA, 93 nt, Brucella suis 1330
cgcaggcgcgggccguggcgcucgacauggaaucggccacgauugcggccaaugguuuccguuuccguguucccuacggcaccuugcucugcg

SEQ ID NO: 4225187 - RNA, 69 nt, Brucella suis 1330
gucauaggugucgucuucauggccaccaucgcggugauggccagcguggagacggcuuucauuaaugac

SEQ ID NO: 4225188 - RNA, 64 nt, Brucella suis 1330
gugcgcaggccaugcucggcaauaugcuguuucaggccggcaagaccgugcguggccuugccau

SEQ ID NO: 4225189 - RNA, 71 nt, Brucella suis 1330
gcuuggcggaauguucgcgcugcaauggggcaaugugauucccucgcccggugcgcgcgugaccgccgggc

SEQ ID NO: 4225190 - RNA, 69 nt, Brucella suis 1330
ggccugucgcugcuucugcucuucguggcgaugaauuucgaccgcgguuucuggacagugacacuugcc

SEQ ID NO: 4225191 - RNA, 65 nt, Brucella suis 1330
accuugauaucggucguguagcccagaccuuugagaauuucgguugcgaccgccguugucgaggu

SEQ ID NO: 4225192 - RNA, 68 nt, Brucella suis 1330
gcgaauucgucaccuucgaccgcuccugguauaaccgggcgggcgucgagcgggugaugggcuucugc

SEQ ID NO: 4225193 - RNA, 63 nt, Brucella suis 1330
cgguuguuuagcgaagccgugagaaaagcuuauaaaaauuucgauacggugcuggacagcgcg

SEQ ID NO: 4225194 - RNA, 117 nt, Brucella suis 1330
gcccggcgcagaagcgugugaagcgccuugccaucauggaccaggacggcgccaaugugcguuuuauuucugauggccgcgcccuuucgcugacgccgcgcuucucgccgaaccggc

SEQ ID NO: 4225195 - RNA, 70 nt, Brucella suis 1330
ggugaagcugccgcugaucuggccggagccgcccgugaucggcucgcggaugaccggcgcgcucagcacc

SEQ ID NO: 4225196 - RNA, 84 nt, Brucella suis 1330
gugcaucagcgccccggcggccagcaggcacagcguccgcgcccggcggaucguuccggcauggugcugaacacgcugucgcgc

SEQ ID NO: 4225197 - RNA, 72 nt, Brucella suis 1330
ugcaacuauugauguucugugggauuaagugacuugccgcuguugguucaucacggaauauuaaucuuugua

SEQ ID NO: 4225198 - RNA, 79 nt, Brucella suis 1330
gaugcccggacguuuuucggcauugaacgggaaggggcgcaccacguccauugccgcaauuccgauacgugccgucauc

SEQ ID NO: 4225199 - RNA, 65 nt, Brucella suis 1330
gcgcgggucagcggcggcgucagguggucgaugauaacggcgcuugcgcgccgcuuggccugcgu

SEQ ID NO: 4225200 - RNA, 119 nt, Brucella suis 1330
gccugauaaucuugauugaugucgaggaauguugcccggaucguguuugccguugucaucacgucacggccaaccggcggguaguuuuccaaagaccggaccucauugauagucauggc

SEQ ID NO: 4225201 - RNA, 68 nt, Brucella suis 1330
ugccgaaggcgaggugcugcggguugauguccuucaauucaucgacaagcugcgguucgucuuccgca

SEQ ID NO: 4225202 - RNA, 55 nt, Brucella suis 1330
ucgacuguuuucggcgacaagcucggcuccauuccgguuucguccaacaagucga

SEQ ID NO: 4225203 - RNA, 56 nt, Brucella suis 1330
ggccguguuguccgcauuugcaugagggaggcaagcagcaugugcgcaucgcggcc

SEQ ID NO: 4225204 - RNA, 58 nt, Brucella suis 1330
ucagugccguugaaggccagcuuuauuuccacgcgcgucuggccgucaaaaacacuga

SEQ ID NO: 4225205 - RNA, 95 nt, Brucella suis 1330
gcagggcgucgagaugcagcgcgucuuccggugugugcgugaccaucagcaccgucaugccgguuucgcgccgcaauuuauugacgagaucgagc

SEQ ID NO: 4225206 - RNA, 57 nt, Brucella suis 1330
uaucagaugacaccuuuaugguccgcucauacaccaucaaaggauuucugucugaua

SEQ ID NO: 4225207 - RNA, 75 nt, Brucella suis 1330
auggauaucaacaugccgcuucugaacggcauugacgccaucgagcuuuucaagcggcaguugcccaauguccgu

SEQ ID NO: 4225208 - RNA, 59 nt, Brucella suis 1330
ccuugcggcgauccucgcguacacgcucauagaucagaauaugcgcaucgaccgcaagg

SEQ ID NO: 4225209 - RNA, 84 nt, Brucella suis 1330
uaaggaggcuuggaaggaugcgaauuuugcgauugcucgcugucaauaugauggacgcaauauugcgcauuuccgccuuucuug

SEQ ID NO: 4225210 - RNA, 56 nt, Brucella suis 1330
gcugcugccgcagaagaaaagaccgaauucgacgucguucucgcugacggcggcgc

SEQ ID NO: 4225211 - RNA, 77 nt, Brucella suis 1330
cggggugguuggaggcgaagcuggaaugguuggccggaugccaauccugcgugaccacgacauuuucgcuuuccccg

SEQ ID NO: 4225212 - RNA, 95 nt, Brucella suis 1330
guaagacugccacauccagucaaauggaaauaugaccgggccgaauugugggccgauggcgucauccaugugcugggugucgggcuggcgcuugc

SEQ ID NO: 4225213 - RNA, 92 nt, Brucella suis 1330
gaaugaagcaggugcgcaggacauguggccaugcgugcguugccggugcaggcgcaugacugcgccgcgucaggcuggcgagccugcucuuc

SEQ ID NO: 4225214 - RNA, 62 nt, Brucella suis 1330
uuuggcggauaaugccgauaucauucaggagcuuggccagaaugccggcaauauucgccaga

SEQ ID NO: 4225215 - RNA, 76 nt, Brucella suis 1330
ucgaagcgacgccaggccugauagcgcucaagggcugcaaaggaaccgauaucgaggccgaggcgguccguuucga

SEQ ID NO: 4225216 - RNA, 73 nt, Brucella suis 1330
gcggauggaacgcaccgccggauugucguuggaaaaaagcuuggucagaaugucgguggugacgcccaucugc

SEQ ID NO: 4225217 - RNA, 66 nt, Brucella suis 1330
gaagcggcuuugcuuuggauaaugcguaaaacaacgaaauagagcgguuccaaggaugccgucuuc

SEQ ID NO: 4225218 - RNA, 81 nt, Brucella suis 1330
ugcgccugacacggcaggccauugaagauuucgccaugguaaagccgggugaucgcuggauggucugccugucgggcggca

SEQ ID NO: 4225219 - RNA, 61 nt, Brucella suis 1330
gcgauuauccgaacagaaagaagaccguucccgauugcguuuuccucaccccggaaaucgu

SEQ ID NO: 4225220 - RNA, 57 nt, Brucella suis 1330
cgcgccgaggugaucgauguuuccaaguugacgggcgacaggaucaaauucggugcg

SEQ ID NO: 4225221 - RNA, 77 nt, Brucella suis 1330
cggcuucauccgcgcccagaccaucgccuaugaagacuaugucaaauauaauggcgaacugggugccaaggaggccg

SEQ ID NO: 4225222 - RNA, 69 nt, Brucella suis 1330
gguguugacgguuuccagauucugcgcguggcgcaugacgugauauucaaucuggauaccguugccgcc

SEQ ID NO: 4225223 - RNA, 67 nt, Brucella suis 1330
cggcaucagcaugauggccggaucgacaagcggggcaugcucauccggccccaucgugccgaagccg

SEQ ID NO: 4225224 - RNA, 62 nt, Brucella suis 1330
uuugcugaugauagucgcguucaggccguucaggcuucgauaaucgacuaucguccagcaga

SEQ ID NO: 4225225 - RNA, 63 nt, Brucella suis 1330
ggaaugcugaucaaauuguugcuguaucauaugcaacuucaucagcaauuucuucgguauucc

SEQ ID NO: 4225226 - RNA, 56 nt, Brucella suis 1330
uugaauuugacgcuugcucggccccccuauccgagggaugcaaaugucggaaucaa

SEQ ID NO: 4225227 - RNA, 102 nt, Brucella suis 1330
gaccagcguaccccgcuugagggugguugacguucccuugaccuugagguccuugauaagcgugacggaaucaccgucauugaguuggguaccguugcuguc

SEQ ID NO: 4225228 - RNA, 78 nt, Brucella suis 1330
cgccucgaugagcuuggacaggauggccuucuugcccuccggcgugaaggcaaccuucuuguccgggccuucgaugcg

SEQ ID NO: 4225229 - RNA, 81 nt, Brucella suis 1330
cgccggggggaauggcgcgcgcggcuucuguuucguuugcaauaucgauccaguugucgccgggcugcuucucccaaagcg

SEQ ID NO: 4225230 - RNA, 59 nt, Brucella suis 1330
gcucgaaaaggcucuaaggaaaacgcaauugaugaaagcgguuuauagucuguucgagc

SEQ ID NO: 4225231 - RNA, 56 nt, Brucella suis 1330
cgucgauguggcuccgcugauccgucuuaucgacgauccgcgccauacguugaacg

SEQ ID NO: 4225232 - RNA, 73 nt, Brucella suis 1330
gccaguuguuuugacgaaugcaucgcagccaugacggcccagccugcgauccgcauucgugagggagacaggc

SEQ ID NO: 4225233 - RNA, 73 nt, Brucella suis 1330
uccggccgggugcaggugcucuccgucacccaugcgccgcagguggcggcgcgcgcuuccacccauuuccuga

SEQ ID NO: 4225234 - RNA, 85 nt, Brucella suis 1330
cguucuuggugucuuuuuaugguggggcaaauggcgaaagaccggcguuuugcugauugcccuugccguuauuucauauggagcg

SEQ ID NO: 4225235 - RNA, 76 nt, Brucella suis 1330
ggcuccggccgugugcgugccgcgcaggguuucuucucgguggaacguaccugcccaggcuguaacggucgcggcc

SEQ ID NO: 4225236 - RNA, 84 nt, Brucella suis 1330
gcuuuaucugggucucgaacugcaaucgcuggcgcucuauguucuggcggcguucaaccgugauagcguucguuccacagaagc

SEQ ID NO: 4225237 - RNA, 83 nt, Brucella suis 1330
ccgguugcguucaugggcggucugguuggcgaaauguacaagcaguucgccgucaccaucgccauuucugugacgcucuccgg

SEQ ID NO: 4225238 - RNA, 94 nt, Brucella suis 1330
agccuccucgcauaaauggauagccuuuagcugaagcggcuccaaucauggagccugccagaaaagguaggcauuuaugcccgguuuucaagcu

SEQ ID NO: 4225239 - RNA, 78 nt, Brucella suis 1330
ccgccugccuuggcuuugcggucgaucucaucgagccugccgguuucgauauuuccgaccgcgcgcuaaagcgugcgg

SEQ ID NO: 4225240 - RNA, 76 nt, Brucella suis 1330
gagcaauucguggugcuggccucgcgcggugaacagccguuuggcgacgaggccgaguuucgcaauuuugccgcuc

SEQ ID NO: 4225241 - RNA, 103 nt, Brucella suis 1330
gccacacggcaaaugaagccaaggcgcgccgcauugccgcccagaucaauaugcucuggucgcaaucaggcagcgccacggucgaucuucugaugcaaugggc

SEQ ID NO: 4225242 - RNA, 76 nt, Brucella suis 1330
gcgcuuguugcugcggcuugcauuuuccaccacugcaaccgccguauccucaugcaggccggcggcaaucagacgc

SEQ ID NO: 4225243 - RNA, 63 nt, Brucella suis 1330
gaccagcgcagcgaugaaggcggugccgaagcucguuucaagcgccuucagcgugcgcucguc

SEQ ID NO: 4225244 - RNA, 81 nt, Brucella suis 1330
cgcaauuucgauuuucucucgccgugggaaggaacggauuacguucugcccggugaugagaaagcaaagacgaacugagcg

SEQ ID NO: 4225245 - RNA, 64 nt, Brucella suis 1330
ggcuggcggcucaggcauuggcacggcugcgauccagcuugcaaagaagaugggcugcacaguc

SEQ ID NO: 4225246 - RNA, 55 nt, Brucella suis 1330
ucgggcguaugcugauggauggggugcugcgccaucuuuaucaggaacgugccga

SEQ ID NO: 4225247 - RNA, 75 nt, Brucella suis 1330
gaugcggucggccauggcugccuguuugacggcuuccucaugauugucgagcguugccaugccguucaccgcauc

SEQ ID NO: 4225248 - RNA, 58 nt, Brucella suis 1330
gcggucgagaugcuuggcgaucucggccugugucagcccgccauccacacucgccagc

SEQ ID NO: 4225249 - RNA, 64 nt, Brucella suis 1330
ggacuucguugaaauguucgucggugucggcgcaagccgcguccgcgauauguuugaacaggcc

SEQ ID NO: 4225250 - RNA, 121 nt, Brucella suis 1330
gacggucauugaugccgugaaugccuccggccugccggucguggcugucgaucugccaagcggcauaucgggagcaaccggcauggcgcugggggcggcgaugagggcaaaggcaaccguc

SEQ ID NO: 4225251 - RNA, 65 nt, Brucella suis 1330
ucugguaaagcuugaauucuucaauccgcuggcaagcgugaaggaucguaucgggcuugccauga

SEQ ID NO: 4225252 - RNA, 67 nt, Brucella suis 1330
ucgccgccgagcgucagcagaaaugcaucggauuucaggauuuuugcugcuucacgcucgauggugg

SEQ ID NO: 4225253 - RNA, 66 nt, Brucella suis 1330
gccucguaauucucauauucggcuuccacuaugaucuauuguggaacgaacgagccguuacguugc

SEQ ID NO: 4225254 - RNA, 58 nt, Brucella suis 1330
gguucaggaagugcgccuggccgcgagcgaugcgccggugcgugucuucauugaugcc

SEQ ID NO: 4225255 - RNA, 56 nt, Brucella suis 1330
gcggggcgcgugaacauggaugugccgauugcgcucgccauuucacucgccuucgc

SEQ ID NO: 4225256 - RNA, 58 nt, Brucella suis 1330
ugauauugcggcgcggaauggcccguuuucgggcgccccauuuuucgacgcaauauca

SEQ ID NO: 4225257 - RNA, 56 nt, Brucella suis 1330
ccgucuucacagcuuuggcguccggccccucggccuggacgucggcagugaaacgg

SEQ ID NO: 4225258 - RNA, 68 nt, Brucella suis 1330
ggaagcccuuugucuugccgauggucucgaaagacuugaauucaucgggcuugacgaagcggauaacc

SEQ ID NO: 4225259 - RNA, 90 nt, Brucella suis 1330
gcggcaaaacaaagaguuagggcuguuccguuaaagcaagaaacgcucgcugcaaauaugccuucagcuuuuucauuacccauuugccgc

SEQ ID NO: 4225260 - RNA, 103 nt, Brucella suis 1330
guguugccagaugcgcguagcgcauugucaucugcaaggucuggugaccaagccacaucugaacccggcggaugucgaugcccccacgcaccagucgcgacgc

SEQ ID NO: 4225261 - RNA, 62 nt, Brucella suis 1330
guuuucgauggaugcggagcugaugccguuccugcguggccagcuucugauuuucgauaugc

SEQ ID NO: 4225262 - RNA, 92 nt, Brucella suis 1330
auggcaacgaagguuaaggaaaacgaagaagccgaagucgagcgcgaaggugcugccgacgguccgcuucucgaccuuucugacgaugcugu

SEQ ID NO: 4225263 - RNA, 57 nt, Brucella suis 1330
gccgaaaucucugccgaagccgcugaccgcagacgaugcccggcgggugguuucggc

SEQ ID NO: 4225264 - RNA, 73 nt, Brucella suis 1330
uucuggccuugaaggacgaagcgccgcaauauguguugauccaugauggcgugcguccuuucaucggucagga

SEQ ID NO: 4225265 - RNA, 86 nt, Brucella suis 1330
gccuugucgcgaagggcggcaucuaugcccgccuugccaagcugcaauucgaggcgggugcgggagccuuugcugcccagugaggc

SEQ ID NO: 4225266 - RNA, 57 nt, Brucella suis 1330
cacugguuauugccugcgaggguuucgcggcacugcaaauccagcacgaaaccggug

SEQ ID NO: 4225267 - RNA, 69 nt, Brucella suis 1330
ucaguaaaaaguugaguaucggcgcgcggccuuaauugagccguguucgccgguucacuucauugcuga

SEQ ID NO: 4225268 - RNA, 93 nt, Brucella suis 1330
augaacgccuaugcggcuguggaagucaucaaggccggcaucgaacgcgccgguucgacugacgauuccgcugccguugccaaggcgcugcau

SEQ ID NO: 4225269 - RNA, 89 nt, Brucella suis 1330
auguaucuaguggauuuuuagaauuugacguuugaaacagcauauguaacagccgggauucaaacgucaaauucaauccacuagagcau

SEQ ID NO: 4225270 - RNA, 93 nt, Brucella suis 1330
gucgaucugcgugaagucaagcagcuugcuuuugugcaugccgaccagaucggccacaagaucaucaagcuguuugaagaaggcgcuuucgac

SEQ ID NO: 4225271 - RNA, 61 nt, Brucella suis 1330
gggaauaugucagugaaggcgaugcgggaaacaucaucgaugcagacauggacauauuccc

SEQ ID NO: 4225272 - RNA, 74 nt, Brucella suis 1330
gauagcgggaucagccaugccaccgcgcucggugucgagccggaacuguggcuuggcgauuuugauucugcuuc

SEQ ID NO: 4225273 - RNA, 76 nt, Brucella suis 1330
gcgaggaugacggaggacgaugauuucuugucggguggauugcuuggcgucccuuucgcucucccugucguacagc

SEQ ID NO: 4225274 - RNA, 63 nt, Brucella suis 1330
cggcacaaggcuuugcccaugucuugaucgaagugcggcaagaccugaucgcagaaccuuccg

SEQ ID NO: 4225275 - RNA, 59 nt, Brucella suis 1330
uggaaagcugaugagucgcccgaagcgaaaaauuucgggcgauuucuuuguguuuucca

SEQ ID NO: 4225276 - RNA, 56 nt, Brucella suis 1330
gaugcgucggauaaugcgacaaaacaaaugcuuggagucgcuuuaaccggcguauu

SEQ ID NO: 4225277 - RNA, 97 nt, Brucella suis 1330
cugucgacguugaucccgcgcaauaucucgguccagauuuuccgugcucuuuuggaaaaugucgcgggcgagaugggugcgaagaugagcgcgaugg

SEQ ID NO: 4225278 - RNA, 111 nt, Brucella suis 1330
gucaugcuggugcuggccuauaaugcggcgaaaaucgugcaggcuggccucaaccagcuucgugacgcacuuuuugccaguguuggccaauaugcggugcgccagcuugcc

SEQ ID NO: 4225279 - RNA, 57 nt, Brucella suis 1330
ugaucgggcuuggcuuccguucgauuuccaugucggcggcggcgaucggcccgguca

SEQ ID NO: 4225280 - RNA, 103 nt, Brucella suis 1330
gagcgagcgccugcgcgaccauaauaucggccuugaugucgauauugccgacgauguggacguguucaaggccgaugccaaccgcgugcggcaggugcuguuc

SEQ ID NO: 4225281 - RNA, 102 nt, Brucella suis 1330
gaugcggucggacuucgacauggucaaagccugcgcgucgguguuggccacaacgaaauccacgccgcgcaggccggcauugaucauguuguugaccgcauu

SEQ ID NO: 4225282 - RNA, 55 nt, Brucella suis 1330
ccgggcuuuuccuguucuuccgccaucagggccuugaagucgggaagggccucgg

SEQ ID NO: 4225283 - RNA, 106 nt, Brucella suis 1330
gcgcgccaauccgcaucagcucgacugggaaaacuacgagccggugaagccggccuucaccggaacgaagguuuuugaaaccuaugaucuggcggaaaucgcgcgc

SEQ ID NO: 4225284 - RNA, 97 nt, Brucella suis 1330
gacgguuaucauaucuuagccccgaaagagcagcggcauuugcagcuccggcacgugccucuuuccgggcgcuguugaucugaccuugcaacccguc

SEQ ID NO: 4225285 - RNA, 91 nt, Brucella suis 1330
ggaauugguuucccacgcaggcauccgguuccgucaacuuuaugccgccuugcguaacauugcgugagaucgggccugaaucaccaguucc

SEQ ID NO: 4225286 - RNA, 106 nt, Brucella suis 1330
caggcucuuguccgcauggguggcccuuugcagcgccuccucauuaguggauggaugcacaccgcugauaaggaggcgcuugccgcgcuuuuccuucaagagguug

SEQ ID NO: 4225287 - RNA, 60 nt, Brucella suis 1330
guggagcagcucguccgcgucugaauaucagcggauauucggcguuaugagcugcaucgc

SEQ ID NO: 4225288 - RNA, 61 nt, Brucella suis 1330
gaacaugacguucgauagaucauacucaacuucaagguagugauccaugaaggucgcguuc

SEQ ID NO: 4225289 - RNA, 106 nt, Brucella suis 1330
gcuaucauguaaacucguggucugauuccaacauuugcaucccucgguucaagcgucgagcaaauguuggaaucacaaagaccacuaguaaguauauguaucuagc

SEQ ID NO: 4225290 - RNA, 60 nt, Brucella suis 1330
ccgguuugucgcgcgaagugcgugagcaugauccgcuugcagcacuugauggcgggccgg

SEQ ID NO: 4225291 - RNA, 83 nt, Brucella suis 1330
gaucaauggcguucaguucaauaugggcaagugcaugcaucagcgcgaugcggccauguucuguguugagcgaacgcuucuuc

SEQ ID NO: 4225292 - RNA, 104 nt, Brucella suis 1330
cugaaaauaccgagcaggaagccaaaaucgccaacgcgguugacaacgaaagcuuucauugcggcggcauuggccgaaggcuucuugaaccagaaaccgaucag

SEQ ID NO: 4225293 - RNA, 87 nt, Brucella suis 1330
uguucuaguggauuggauuugacguuugaaucccggcuguuacauaugcuguuucaaacgucaaauucuaaaaauccauuagauaca

SEQ ID NO: 4225294 - RNA, 70 nt, Brucella suis 1330
ucuccccgauggauggcauguuugccacccgggaggcccuggaaggcuucuaugccauccaaaggggcga

SEQ ID NO: 4225295 - RNA, 61 nt, Brucella suis 1330
ggcgagccagaugccggucaacgaauaucgugucgauauuucuucuccgcgucugggcgcc

SEQ ID NO: 4225296 - RNA, 56 nt, Brucella suis 1330
gcuucuugauuucggugcgcaucugcguacgcaguuuggcaucgagguucgagagc

SEQ ID NO: 4225297 - RNA, 78 nt, Brucella suis 1330
acggauuugaugaaaccgaaacccguaugccuccugaaaggagacaugaacgaauuccgguuucaaagccaaaucagu

SEQ ID NO: 4225298 - RNA, 77 nt, Brucella suis 1330
auaaagcgcggugccguuuugcagcgacuggaacgcuucaagcgccgccacguuggcaaaacgcaccguugcggugu

SEQ ID NO: 4225299 - RNA, 55 nt, Brucella suis 1330
auggcgggccauuccuucucgaucucggcugaccacgggaaggucgcauugucau

SEQ ID NO: 4225300 - RNA, 74 nt, Brucella suis 1330
cggcauuggcuucggcguccuugaccaucuuuucgaugucggcaucggucaggccgcccgaagccugaaugcgg

SEQ ID NO: 4225301 - RNA, 77 nt, Brucella suis 1330
ggcacgaucagggaacggucgcuauuuuucucgucggcauagauugaaaagcgcagcagaucguccuugaucuugcc

SEQ ID NO: 4225302 - RNA, 66 nt, Brucella suis 1330
guuuccaccauggcaauucgcgcgccgcccagcauuugcggcgcaagccugccaauggugcgcagc

SEQ ID NO: 4225303 - RNA, 79 nt, Brucella suis 1330
uuuguucaaaaacugcacauuccaaauugacaagcaagguucauaccaguuuccauuggauugcugcggcaagaacaag

SEQ ID NO: 4225304 - RNA, 65 nt, Brucella suis 1330
cgucagcggcgauggugucaacaagccgcgugguuuccugagcuaugagaccguugccgaugaug

SEQ ID NO: 4225305 - RNA, 64 nt, Brucella suis 1330
gaugaaggaaucgauuucggccgcggcauccuauguccgcucgcgcgcgaucgauuucggcauc

SEQ ID NO: 4225306 - RNA, 80 nt, Brucella suis 1330
ucaguccggcgguugcugcgaugguucaucgcccaugugcuauccgcagggcgaauucauugucggcgacacggauguga

SEQ ID NO: 4225307 - RNA, 89 nt, Brucella suis 1330
gauuuuccuuuucagccuuugucgaguucggcgcggaucgcagcgccguguucauuuaguuucggcgagcggcugucgaguuuuaaauc

SEQ ID NO: 4225308 - RNA, 80 nt, Brucella suis 1330
cacgcgccagcaaacacuuagagcgguuccaacgauuccgcuuuaaccggaaccgcucuaggauuuuugcuguuccugug

SEQ ID NO: 4225309 - RNA, 66 nt, Brucella suis 1330
gugcagccgaaaugcccgccgggccagcgccgacaacggcaaugugccugcccguuucggcugcgc

SEQ ID NO: 4225310 - RNA, 129 nt, Brucella suis 1330
gcagcuugcgccugccaaggguguggagcgcgucagccuggugcagauucaccugcccgcacucagcaaacaggccaaggccgaucuuaccgccgggcugaaacguguucugggucaggugcgcucugc

SEQ ID NO: 4225311 - RNA, 82 nt, Brucella suis 1330
cgguaaagaugaaaauauggaggaguuggcacggcuucgcuggaagacgaacuacucagcucgcuugauauuucaccuaccg

SEQ ID NO: 4225312 - RNA, 86 nt, Brucella suis 1330
gcgaucgacuccgucgaggacaugaaaauccuuuucgauggcauuccgcuggaaaagauuuccguuuccaugaccaugaacggugc

SEQ ID NO: 4225313 - RNA, 55 nt, Brucella suis 1330
cagugacgaugcgaacuucaucaacggcgccauccaugaagucgaaaucgcgcug

SEQ ID NO: 4225314 - RNA, 80 nt, Brucella suis 1330
auguuccuuccgugcugauugagauuggcuaucuuuccaacccggaggaugaaaaacucaucagcaacccggaauggcgu

SEQ ID NO: 4225315 - RNA, 59 nt, Brucella suis 1330
cgagcguugcgcccgguuggaaaggggccugcgacuuccagccgaggccggaaagcucg

SEQ ID NO: 4225316 - RNA, 79 nt, Brucella suis 1330
acguugaguuugaagaucucgucgauggucugucgguuucggaaacggccgacgagucgacugguaucaccaagcgcgu

SEQ ID NO: 4225317 - RNA, 129 nt, Brucella suis 1330
caaggccauccgcuccgccaaagccgccgcugcgaaccgggccgcucaguuuugcaggagcagcggugcgucccgcaagcgaggugauggccgcgaccggcagggcggugaaggcgcuggcaaggcuug

SEQ ID NO: 4225318 - RNA, 60 nt, Brucella suis 1330
cuggugcgcggcaucgugccggauggcaagcugaccucuggccccaugcugcgcggccgg

SEQ ID NO: 4225319 - RNA, 61 nt, Brucella suis 1330
gccauuugccgauaaucgcaucggcgcgaucgaaggaaauaucgagcgcaucggcaagugc

SEQ ID NO: 4225320 - RNA, 64 nt, Brucella suis 1330
gggcuacguucugguucgugcaaagcuuaccgauucgguauuuucgcuuaucaagaauacgccc

SEQ ID NO: 4225321 - RNA, 67 nt, Brucella suis 1330
cgugccgguuuuuccagccugaugaaaccauccucccaggugacaugggcgagccgaaaucggcgcg

SEQ ID NO: 4225322 - RNA, 69 nt, Brucella suis 1330
gcggcuguuccguccggcgcaucgacuggcgcgcaugaagccguugaacugcgugauggcggcagccgu

SEQ ID NO: 4225323 - RNA, 80 nt, Brucella suis 1330
ccgugaauaugccgaacccgaaugguaugucgacaucuggcucaccaucgucuggguugccuaucuggucguguucaugg

SEQ ID NO: 4225324 - RNA, 83 nt, Brucella suis 1330
ucgccggugguggagcauaucaagcucaucaaggaaguaaugccgaacaucaagaagcucggcuaucucuacaauuccggcga

SEQ ID NO: 4225325 - RNA, 63 nt, Brucella suis 1330
gcgaccgucaagggcgaugugcacgauaucggcaagaauaucgugggcgugguucuggccugc

SEQ ID NO: 4225326 - RNA, 87 nt, Brucella suis 1330
ggcuccaugucggucauuucgggcaagucuucuuuccgccugcaaugccugccgcaauccgauuucccggaacugaccgcuggcgcc

SEQ ID NO: 4225327 - RNA, 128 nt, Brucella suis 1330
ucugggcaaaggucguccacggauugucgagggucugcuugaggccgagcgagauacggcgcuugaccggaucaacuucgagcacaacgacuucgacuuccugcgugguggacagaaucuugcccgga

SEQ ID NO: 4225328 - RNA, 57 nt, Brucella suis 1330
gagcguccaguagcgcgggcgaaaggcaaugcggcuuuucucugccgccggaugcuc

SEQ ID NO: 4225329 - RNA, 84 nt, Brucella suis 1330
cuguuccagaugaucuugcgcgccuugaucugccacagaacgggcuugucuggauucuuggcgcaggguucgcaggcgguauag

SEQ ID NO: 4225330 - RNA, 76 nt, Brucella suis 1330
ccuguggccgguauugcccuaucgaugacggcugcggaggcgcggcccgacaucauagaggcgaugggaaagcggg

SEQ ID NO: 4225331 - RNA, 60 nt, Brucella suis 1330
ggcaaaauaaccuguccaggcgguauuggugcaauagcugucgaacugguuggaauagcc

SEQ ID NO: 4225332 - RNA, 115 nt, Brucella suis 1330
ccacucaugcacgucccgcaaccguuugaaauccucaagauggacaagcgccgcggcaacaucguugucucgcgccguaccguucuugaagaaagccgugcggaacagcguucgg

SEQ ID NO: 4225333 - RNA, 55 nt, Brucella suis 1330
ucguucgcaaguucgauuaugcgccggauuggcugcguaucggccuugcgcauga

SEQ ID NO: 4225334 - RNA, 80 nt, Brucella suis 1330
gcauugagccguuuggaugauggcacuuaugguuucugcgaggaaaccggcgaccccaucagccugaagcgucuugaugc

SEQ ID NO: 4225335 - RNA, 100 nt, Brucella suis 1330
gaucacguugagaaugauccagccgaugggcagaaggccauaggcugcaccguaaacggcuguggcucccgccaugucggcgggcauuccaaaaccgauc

SEQ ID NO: 4225336 - RNA, 109 nt, Brucella suis 1330
cgcuuuuggcgaggaugaagucaugcgcagccgcagccuuggcggcggcguggaccuccucaugcgucgcauuggcgcggccaacgcggauauuguccucgaccgagcg

SEQ ID NO: 4225337 - RNA, 130 nt, Brucella suis 1330
aagagcguuucggcggccuuuaccgugccuuccaauauggugcgccuccgcauggcggcauggcggccggcaucgaccgugucaucauguugcuugucggcgcgaagaaccugcgugaaaucucgcucuu

SEQ ID NO: 4225338 - RNA, 65 nt, Brucella suis 1330
gcgcgcggcauuggugaagagcugaacgauguuuccggaauugcggcccuucccaugcugcucgu

SEQ ID NO: 4225339 - RNA, 60 nt, Brucella suis 1330
gcauucauggccuuggccugcgugucgggcagaucgaugggcacgccaacggucagaagc

SEQ ID NO: 4225340 - RNA, 82 nt, Brucella suis 1330
ggccgacaaugauauagcccuuuucggcgcgcagaauaugcaucgucucggugccguaaggugugaugucauauugcuggcc

SEQ ID NO: 4225341 - RNA, 77 nt, Brucella suis 1330
ugccgggcguucugguugauuauaucguggucgauccagaccagaagcagacgacgcagacgcuuuacgacccggca

SEQ ID NO: 4225342 - RNA, 58 nt, Brucella suis 1330
uugggucgucccggcgcaggaucgaaaguuccgcaucccugcuccagagcgacaucga

SEQ ID NO: 4225343 - RNA, 57 nt, Brucella suis 1330
gauguggcugucgauggugcgaucauccacauagaccuguucaucauaggccgcauc

SEQ ID NO: 4225344 - RNA, 60 nt, Brucella suis 1330
gaaugcuuggcgaggcgcuuccacaccuugucgaagguccacggcgccuugucgaguuuc

SEQ ID NO: 4225345 - RNA, 98 nt, Brucella suis 1330
gauauccuugcccuccaucaccaccuuugcggucgggucggcaaggggcggcucgcccuucggcucggcugcaagcagaugcuuuguguaaggguguu

SEQ ID NO: 4225346 - RNA, 114 nt, Brucella suis 1330
gccgcgugaaugcuccgacaucuuugcgccgcggcgaugguucauugugcggcaggaauagccgcccgcauuauagaucguguugacgccggaaagauaacgcaggcgcgcggc

SEQ ID NO: 4225347 - RNA, 69 nt, Brucella suis 1330
gcccgucgggccgacgagcagaauguucgacuucgccaguucgauaucgcuguucuuggacugaugcgc

SEQ ID NO: 4225348 - RNA, 60 nt, Brucella suis 1330
guuuugacgcgcaucuuuuccgaaaaccgguuaucgcuuuugggagauaugcguuagaac

SEQ ID NO: 4225349 - RNA, 92 nt, Brucella suis 1330
gauggccuuucagagcgggcuggacaagguggaaugccccacgaugaaacacaucgagcguuucuuccacuuuguccucugcuggagccguc

SEQ ID NO: 4225350 - RNA, 61 nt, Brucella suis 1330
ggaugccgauuuugccgguuuggcgcuggaaccacccucaaauuuggcaagacgugcuucc

SEQ ID NO: 4225351 - RNA, 60 nt, Brucella suis 1330
cuugcgaagaagcgcggcuacgucaccauggacgaguugaaugccgugcuuccuuccgag

SEQ ID NO: 4225352 - RNA, 61 nt, Brucella suis 1330
gugccggggcugaucgcauuggcgugaauuccccauuuugccaaugccacggccauggcgc

SEQ ID NO: 4225353 - RNA, 74 nt, Brucella suis 1330
ggccagaacacggauacgguucuugcgcaugcggccugccguaugggcaaugauuucauguucguuuucgagcu

SEQ ID NO: 4225354 - RNA, 66 nt, Brucella suis 1330
gcccgaacggguccggcugcaaggugucggugucgccgauuacuuccagcuugauccaguucgugc

SEQ ID NO: 4225355 - RNA, 98 nt, Brucella suis 1330
uacuucucugccgggccgaacgaaaucaaaaaggggaagggucaaccuuccccuuuugcuauguucgguccgcguuguagacuugaucucuugaagug

SEQ ID NO: 4225356 - RNA, 68 nt, Brucella suis 1330
gucuuuccacagugcgcgcgcucgaccggcuucugguguucgacaagggccgcauuguggaagaaggc

SEQ ID NO: 4225357 - RNA, 61 nt, Brucella suis 1330
ucgaggaugcgggaaaggccgaaagccgugaagaacugguggccacacugcgcguccuuga

SEQ ID NO: 4225358 - RNA, 65 nt, Brucella suis 1330
ucucaucaauggcgaggcaagaggcagugcugaagcgcauccaguugccgcggccuugaucgaga

SEQ ID NO: 4225359 - RNA, 81 nt, Brucella suis 1330
gcaacuggauugcaaggcauucacgcagaucgcgcgcaaaaagcccugguggaucaaagccuugcagcacacccagaaugc

SEQ ID NO: 4225360 - RNA, 67 nt, Brucella suis 1330
cuucggaaagcgccagaacaucguccucucccaccaugcgggcgguuucggcaggcucuuuccgggg

SEQ ID NO: 4225361 - RNA, 56 nt, Brucella suis 1330
gccgguuuccacguugauggugaaggauuaugcgcuauugcagggcgugaaccggc

SEQ ID NO: 4225362 - RNA, 87 nt, Brucella suis 1330
uacuuacuaguggucuuugugauuccaacauuugaucaacgcuugaaccgagggaugcaaauguuggaaucagaccacuagcucgug

SEQ ID NO: 4225363 - RNA, 128 nt, Brucella suis 1330
augugauccaggccgauggcggcacgcgcacggcggcuaucaccggcggcuggguggcgcugcacgaaugccugcgcuggauggaagcgcgccagauggugcgugucgaaaagguccugaaagaccau

SEQ ID NO: 4225364 - RNA, 96 nt, Brucella suis 1330
cggggcgcgaucuugcgcaggccugccgggacgcuuauccgcguuuccucgcauggccgcucuggcuucuggcagagcuugccaucugcgccaccg

SEQ ID NO: 4225365 - RNA, 78 nt, Brucella suis 1330
gguuguccauucggagcggaucgaggagacuggaguuaccauaccucaguuuuccaggauugcuccgaaugaacaucc

SEQ ID NO: 4225366 - RNA, 64 nt, Brucella suis 1330
augcgcgauuugccgcaagccagcuugaauauuccugcaugguucggucggcgauugccugcau

SEQ ID NO: 4225367 - RNA, 78 nt, Brucella suis 1330
ggcuaccgcguuuucggaucgaagccuggcgcuuauggugcggguuugcaggcgcugaucgacgagaauggcugggcu

SEQ ID NO: 4225368 - RNA, 124 nt, Brucella suis 1330
ggaauugggcgcgcuuuagccacagcuuguaacucuuuggcuggaaugucucgcccccauacguugcggguggagcgaucucacgcuaaacaggcagugcauaaggccuaauucguucaguucc

SEQ ID NO: 4225369 - RNA, 69 nt, Brucella suis 1330
gcugaugcagcgagagauaugaaggacguaacgaugaaaaacauccucaagaacuucgcugccuucggu

SEQ ID NO: 4225370 - RNA, 55 nt, Brucella suis 1330
caugcucgccuauauccucuggggcaaccgccucgaaggguucaagcgcggcgug

SEQ ID NO: 4225371 - RNA, 72 nt, Brucella suis 1330
uaaaucguucuugguguuuuaucgcauuuaaugaagccaaguugaagcggcgaaacgccaaagaaauuuuug

SEQ ID NO: 4225372 - RNA, 60 nt, Brucella suis 1330
gaggauuucaacggcgcgaugcuggcgcuugccaagcugcguggcccgguugauaucuuc

SEQ ID NO: 4225373 - RNA, 64 nt, Brucella suis 1330
gaugcccggcucgauuucgacgaacgcaccguaaucggugauguucgugacggugccggugauc

SEQ ID NO: 4225374 - RNA, 101 nt, Brucella suis 1330
gauugagcgaaucggcgcggccugccugcggaaugcgggcaagcuugucgcaggcgccggcaagacugucgggcaggcccugcuguucauugcccauuauc

SEQ ID NO: 4225375 - RNA, 72 nt, Brucella suis 1330
uuccugcuucggcucgucuuccucacggaugaugcggaucaccucauccagauugagauaggcgaucaggaa

SEQ ID NO: 4225376 - RNA, 58 nt, Brucella suis 1330
gaaaggcuggagcuuccagaagcaagcuuugaucuugucuacaguucccuggccuuuc

SEQ ID NO: 4225377 - RNA, 78 nt, Brucella suis 1330
aagccucgaccgcgaugcgccccugccgggaaacaguaacgaagcuguuugcuggcacggccauccaguuggcggcuu

SEQ ID NO: 4225378 - RNA, 80 nt, Brucella suis 1330
ggaccagucauggggcaggauugcaggcaguucguuuugauuuuccacgagcuucccguugucuugcccguggccugucc

SEQ ID NO: 4225379 - RNA, 80 nt, Brucella suis 1330
cgauaaggcguuccgauccaccggugcgccucggcaagaacccguucggcaaucaucauggaacgagaacgcccccaucg

SEQ ID NO: 4225380 - RNA, 56 nt, Brucella suis 1330
acccgcaucuuccugcgugccgacaagaaugucgcuuauggcgaacugaugcgggu

SEQ ID NO: 4225381 - RNA, 66 nt, Brucella suis 1330
ccaguguggcggauauuuucggcuaugacgaagcgggcuucgaucauaucgcuauccgccauaugg

SEQ ID NO: 4225382 - RNA, 61 nt, Brucella suis 1330
cuugccauugcacagcaucauggcauuuccgaucugguugcgcgugugcuugcggggcggg

SEQ ID NO: 4225383 - RNA, 75 nt, Brucella suis 1330
agccggaucggcaaggcaaugcgcgagcguuuucauuucgaugaagcaacgcucgaccugcuuggccuucuggcu

SEQ ID NO: 4225384 - RNA, 89 nt, Brucella suis 1330
auaagcugaucccgacaugcugucgcaccugucgauccgcgauauuguucugauugaaaggcucgacaucguguucaggagcggcuugu

SEQ ID NO: 4225385 - RNA, 130 nt, Brucella suis 1330
gagcgaugucuaugccgauaugggccggggugacgccgaagggcuuuacagguuucuugugcaucgcggcgugguucgcgaugaaaaugugaagcucgauggugaguauaagggccucgugacgccgcuu

SEQ ID NO: 4225386 - RNA, 84 nt, Brucella suis 1330
gccugcgccggaaagacggucgagcgcaucgccgcccuggccggaaagcugcgcgauuacgcgcucgaccgggccgccgggggc

SEQ ID NO: 4225387 - RNA, 84 nt, Brucella suis 1330
ucgacgccaugccacugguccgccguucgcugagauugcgauacagcucuuccagugauuggccggaccagaagcucugcucga

SEQ ID NO: 4225388 - RNA, 56 nt, Brucella suis 1330
gugaaauggaucgugcgggaauaggggccguucugguguucgcgacguccguucac

SEQ ID NO: 4225389 - RNA, 68 nt, Brucella suis 1330
cggcggauggauggcgaggccgauauccugaaggaccggguugauaucgccgccuuccaugggagccg

SEQ ID NO: 4225390 - RNA, 72 nt, Brucella suis 1330
uuugaagccauggugccgcaggcccugccgaaauccaugcuggugauggggucuggcgcuaucgguaucgaa

SEQ ID NO: 4225391 - RNA, 67 nt, Brucella suis 1330
gacgcugacgaccgcagggcgaaccuuuuccaccagaucggcaaagccagccugcggcggcggcguc

SEQ ID NO: 4225392 - RNA, 80 nt, Brucella suis 1330
ccacaaggcggcgaaggaccggucuaugugaacauguaauguucacauuuuaagaccguguccgucucgaccgccgcugg

SEQ ID NO: 4225393 - RNA, 56 nt, Brucella suis 1330
aucaucgccacgcacgaucuuucccucauggaccaggucaaugcgcggcgcaugau

SEQ ID NO: 4225394 - RNA, 70 nt, Brucella suis 1330
gggccguuuuuggcuuggugaugaggcggcucgccuguuccggcucuuccaccagagccagaaccggucc

SEQ ID NO: 4225395 - RNA, 60 nt, Brucella suis 1330
gucgaucgcauggaucgguauuggcagcaaagucuggccgaaaucagccagcgcaucggc

SEQ ID NO: 4225396 - RNA, 56 nt, Brucella suis 1330
uuuggcggcaauugccgccaugauaucagccuugcuuggcggcgauagccgccaaa

SEQ ID NO: 4225397 - RNA, 66 nt, Brucella suis 1330
ucgcuucugcuaucuggugcucgauaaugggcaggcgcugcguuauggcgucgguaucggucgcga

SEQ ID NO: 4225398 - RNA, 76 nt, Brucella suis 1330
ggcugggugugcuugccggauggcgcacacaggccaaaaucgccuuugaugugccgccgcaggcuuucacuccgcc

SEQ ID NO: 4225399 - RNA, 75 nt, Brucella suis 1330
gcacgguauugaucgcaacaaugccauuauguccgacauaauugucggcaauauggaguguugcgccccccgugc

SEQ ID NO: 4225400 - RNA, 55 nt, Brucella suis 1330
augucauguucucgcagcgcggcguaaugaugcuggcgcauacggugcaugacgu

SEQ ID NO: 4225401 - RNA, 127 nt, Brucella suis 1330
cgaaacccgcuauuggucagauauugugagagaaggcugcggaugcgcguaucgucguccacgacgagaaggugcggugcgucguccgauagcgucuuuucuucuucugcagccauggcgucuuucg

SEQ ID NO: 4225402 - RNA, 57 nt, Brucella suis 1330
ucgccgaucggccauuugcaggugcguucgcuaagcugcaacagggucagauggcgg

SEQ ID NO: 4225403 - RNA, 57 nt, Brucella suis 1330
ggugccgcacgaaacucaucgucaaaacgcagaggaagaugacuucaugauggcauc

SEQ ID NO: 4225404 - RNA, 90 nt, Brucella suis 1330
ggguuggccgggcaguuuucaaguauuuccugaugcaaaaccguuucacgcuuuugcuggaaaugccuuguuuggccucucagccauccc

SEQ ID NO: 4225405 - RNA, 100 nt, Brucella suis 1330
gauaacgguccgguaacgauauccggcuagaaaggagcacgagacggguugcaccgcucucggcuccggaucugguacugcguaccggagcuaaaguauc

SEQ ID NO: 4225406 - RNA, 59 nt, Brucella suis 1330
gaaccugcugcuccaagcgucgcggcccccaagggcgugaaguucccgacggcgguuuc

SEQ ID NO: 4225407 - RNA, 70 nt, Brucella suis 1330
gauuccauauccaucccgaaggggccagcgugaaacagccgcccuuuggggcaucuggauuggcauaguc

SEQ ID NO: 4225408 - RNA, 86 nt, Brucella suis 1330
acuuauucaagaccgacgaucuugccgucaucccacuugaagauaucaaagcuuggcgagcuaaggucgccgguuucgcuauaggu

SEQ ID NO: 4225409 - RNA, 85 nt, Brucella suis 1330
ggccgucaucuggaacgugaaggugagaaggccgaucugccagaaggacaggcuauaauucuccuucagcaucggauagauggcc

SEQ ID NO: 4225410 - RNA, 79 nt, Brucella suis 1330
cccgauacaucuucuuuccauacugguguugcugggaugcgcgcgcgccgucgcggcggccagaaugggacagaucggg

SEQ ID NO: 4225411 - RNA, 70 nt, Brucella suis 1330
gggauagaugaaaagccauuuccagucgagcgcaacgacuucgacauugaucggcuuuacauucgauucc

SEQ ID NO: 4225412 - RNA, 59 nt, Brucella suis 1330
ggucaaugucgaauauguaucggccaacccuacgggcccgaugcaugucggccauugcc

SEQ ID NO: 4225413 - RNA, 86 nt, Brucella suis 1330
gccguccauucuuugugcgggccaaauucuggcgauagaucagcuagacgauugccgauuucgcuugcauaugguuuauggacggc

SEQ ID NO: 4225414 - RNA, 77 nt, Brucella suis 1330
gaucccaaacugauugacgucagguggaauauaaaucucacaauauuuuaggcauugaucgcagucaaacaaggauc

SEQ ID NO: 4225415 - RNA, 69 nt, Brucella suis 1330
cuugaaaagcucgauggcgucaaugccguucagaagcggcauguugauauccaucagcaccacgucggg

SEQ ID NO: 4225416 - RNA, 97 nt, Brucella suis 1330
ggagccggaaugacgcgacaaacgaugucguuguacuggcaggaccuuguauccagggccuuguacaaugaaucgaugucgggccuuuucccguuuc

SEQ ID NO: 4225417 - RNA, 79 nt, Brucella suis 1330
ugcgccaguuuucgcggcagauaaagcgcaagcgccguuugcagggcuugcuugccauucugucggcgcugcucgcgca

SEQ ID NO: 4225418 - RNA, 65 nt, Brucella suis 1330
gcgcggcuggcgcguucagauuuucgagaaagcgcaggaacuuucggaagucggugccggccugc

SEQ ID NO: 4225419 - RNA, 58 nt, Brucella suis 1330
aaggcggucgccgaauauaccgccaaauaugccauuggcgauauuccccgcccgccuu

SEQ ID NO: 4225420 - RNA, 70 nt, Brucella suis 1330
gcauucaggcuucgggcggccugaccgaugccgacaucgaaaagauggucaaggacgccgaagccaaugc

SEQ ID NO: 4225421 - RNA, 97 nt, Brucella suis 1330
guucggcccaagaaugccgaucuuggcaucgggauagaaggagagauggauauucuccagaaucuucuuguugccauaggccuuguugaggccggac

SEQ ID NO: 4225422 - RNA, 90 nt, Brucella suis 1330
uuucggugauggcgauggggaagccgucguccucgaacgccuguucgagaauauuguaggugcgcucggcuuccgccuugucugccgaaa

SEQ ID NO: 4225423 - RNA, 72 nt, Brucella suis 1330
gccguggucucgauaugggcuugccgguugaccguauugucgaacugauuggcccauauugcgccauucggc

SEQ ID NO: 4225424 - RNA, 104 nt, Brucella suis 1330
gggagagggcuguucgggcggaaucugcuccgaagucuuguguucgguggacgaauuggacagcgaagaagacaauucgggcaucugccuuaacagccuuuccc

SEQ ID NO: 4225425 - RNA, 119 nt, Brucella suis 1330
uggcuuuaaaaucgaucaucggcagccucuuuucacuugugcgggaaucgcauggccaagcauaggccauggccuugucugcgcaaguugcgggcuugccuguuaugagcgaagcgccg

SEQ ID NO: 4225426 - RNA, 58 nt, Brucella suis 1330
gaccgccauugccgcgcugcugaccauuaucgguuauucggugaacgacaaggugguc

SEQ ID NO: 4225427 - RNA, 87 nt, Brucella suis 1330
gguguauugugaacuggccgaugaaaaccaugcuggcgcugcauguugccaugucgcuguuuuucuucggcuguguucuuauccgcc

SEQ ID NO: 4225428 - RNA, 66 nt, Brucella suis 1330
ccauauggcggauagcgauaugaucgaagcccgcuucgucauagccgaaaauauccgccacacugg

SEQ ID NO: 4225429 - RNA, 96 nt, Brucella suis 1330
ucugcgacgaaugcgucgaacucugcauggacaucauccgugaggaaaacaaauccuccauggugaagucgcgugagggagugccgacgccgcagg

SEQ ID NO: 4225430 - RNA, 72 nt, Brucella suis 1330
ugccgaucuuguggcuuuccucagcaauuggcgcauagacgcgcucguugauaaggaaggcagaaaucggca

SEQ ID NO: 4225431 - RNA, 61 nt, Brucella suis 1330
gauggcugcgggccugccgcuugaaaucugguuugcaagccgcaagcccggcagcaccauc

SEQ ID NO: 4225432 - RNA, 82 nt, Brucella suis 1330
ggcgugcuggcggggaucaacugggauucgacgcuggcgcuugccgaagccguuuccauuccggugauugccuccggcggcc

SEQ ID NO: 4225433 - RNA, 57 nt, Brucella suis 1330
gcaggcggccugggaugcuugcgccucgcugaagcgcaauaacuucggcugcuaugc

SEQ ID NO: 4225434 - RNA, 80 nt, Brucella suis 1330
gaggcggcaaccgcugcgggcgcgguggaaaaguaugguuuuaucucugcuuccaccgccgcaucgagccuuuccgccuc

SEQ ID NO: 4225435 - RNA, 67 nt, Brucella suis 1330
gcgguugagauauaggugaagucgucgaccacgcccgcaugguugagggcugccaccguaucgccgc

SEQ ID NO: 4225436 - RNA, 73 nt, Brucella suis 1330
cgcugggccugaucgucggagagcggcacuugcggcagacaaucaagugccgcacccguaucgaucaccagcg

SEQ ID NO: 4225437 - RNA, 73 nt, Brucella suis 1330
auugcgcugaucgaauauugccuugccgugcccgccaaucgcaucggccaucaggucuauucggcagcacaau

SEQ ID NO: 4225438 - RNA, 63 nt, Brucella suis 1330
ggcgaacuugucguaaacgccgcgcuguacauaaaugcgguuggcgcaaacgcaggucuggcc

SEQ ID NO: 4225439 - RNA, 59 nt, Brucella suis 1330
uccggcaucgggaucguaacacccuugucauugaagacaaauugcgucgccgugucggg

SEQ ID NO: 4225440 - RNA, 62 nt, Brucella suis 1330
uuuuggcggcaauggcggcaauggccgcccacugguuggccuguguuuccuugccaccgaaa

SEQ ID NO: 4225441 - RNA, 58 nt, Brucella suis 1330
uggaacgaguggucguacauggauuccgccgcaaggcuguaauggccguagcguucca

SEQ ID NO: 4225442 - RNA, 78 nt, Brucella suis 1330
gcccgacgauaucggcggaauucggcccgacuacugcggcaagaucgggcgaaauuucgcugaaugugccgucugggc

SEQ ID NO: 4225443 - RNA, 68 nt, Brucella suis 1330
ugguucuuuugucgggcuggcgcucgccaucggcguggcgcuggugcaguucuggcccgacuggauca

SEQ ID NO: 4225444 - RNA, 74 nt, Brucella suis 1330
gaccgcgugaaaucgauccgugccguccucuuugacaaggacggcacacugaucgacuucgaucgcacaugguu

SEQ ID NO: 4225445 - RNA, 79 nt, Brucella suis 1330
uccgcgcagcaagaaggcgcacaaugccggaacgguggcgcaccuccgccaaugucgccuucaacucgcucaagccgga

SEQ ID NO: 4225446 - RNA, 79 nt, Brucella suis 1330
ggcguuccgauccgcuggaggucuuccggcucgaugccaaugccgguauccgaaacgcugaauuccagcaucgggcacc

SEQ ID NO: 4225447 - RNA, 93 nt, Brucella suis 1330
cauauacuuacuaguggucuuugugauuccaacauuugcucgacgcuugaaccgagggaugcaaauguuggaaucagaccacgaguuuacaug

SEQ ID NO: 4225448 - RNA, 70 nt, Brucella suis 1330
cauccuguuccagcgcacugaccuggcgcgaaauagcugauugcgacaggugcagugucugggcggcaug

SEQ ID NO: 4225449 - RNA, 67 nt, Brucella suis 1330
gucucgaucaaggccgcggcaacuggaugcgcuucagcacugccucuugccucgccauugaugagau

SEQ ID NO: 4225450 - RNA, 70 nt, Brucella suis 1330
cugaaggcggcagcucaagcgggccuuugcguccgcaggcagcgagggugaggcugagcgcggcaaucag

SEQ ID NO: 4225451 - RNA, 92 nt, Chlamydia trachomatis
uugguaaagaaggucauuucaaauacugcuugagcuagagagaaaucuaagguuugggcguguuugaaaagaggggagcacuucugggcuaa

SEQ ID NO: 4225452 - RNA, 62 nt, Chlamydia trachomatis
gugggauuggaaagaguaauccaaacgcuauuagagcaaggaaacucuuuaucgaccucuac

SEQ ID NO: 4225453 - RNA, 74 nt, Chlamydia trachomatis
aacuuuaugagggagccuauguuuuuagcgugacguuaagugaagacgcuagacguaaggcuuuagaaaaaguu

SEQ ID NO: 4225454 - RNA, 107 nt, Chlamydia trachomatis
ucccgucccuacuaaauccuuuacucuacucuuggauuggacuccgaauccuaaucacauuccccucuaugcagguguagaaaaaggauuuuuuguagaugaaggga

SEQ ID NO: 4225455 - RNA, 61 nt, Chlamydia trachomatis
aguucuuacuuuugauuugaagcuuugauuacgcaauugcuuuuucuuagaagugauaacu

SEQ ID NO: 4225456 - RNA, 74 nt, Chlamydia trachomatis
gcuacagccccaacugauccagagccuucaccagcauuuuccgugguaggcucuucggaugggaaaacuguagu

SEQ ID NO: 4225457 - RNA, 55 nt, Chlamydia trachomatis
uuuuggguuguguacgaagcuugggauuuguuccaggaguugucauggcucaaag

SEQ ID NO: 4225458 - RNA, 103 nt, Chlamydia trachomatis
auguugcgaguucagcaacuggcaucuguagcauauccagucccuguugaagauguaaagcaggacaaagagcuacagaugcuguuugaugcugaugcaacau

SEQ ID NO: 4225459 - RNA, 82 nt, Chlamydia trachomatis
cucaacgauacugucuguaggagaauuaucacacacgauuaagaaucgauuggugauuucuccuugcauauuuuguguuggg

SEQ ID NO: 4225460 - RNA, 102 nt, Chlamydia trachomatis
cugcuagagagcaaaagcuuucuuuugcucuccauuuucucuuucaaaaagcccuuaaggaagggaaaguauuucgagcgaaaggaggcgcgccuuaugcag

SEQ ID NO: 4225461 - RNA, 82 nt, Chlamydia trachomatis
gccuacuuccgagaagcucuuuacuuacuagaaauccgcaguaaaguguauccaaaaguagaggcuaccuauggagaguggc

SEQ ID NO: 4225462 - RNA, 86 nt, Chlamydia trachomatis
cucaagaagaucucaaguccauuuuagguaaggauagcgauacgguucuagcucgcuuacauaaguuaggauuagaggucaaugag

SEQ ID NO: 4225463 - RNA, 60 nt, Chlamydia trachomatis
gaaucgugcuuuguuguauuucuccgaucguaauggagaaagagaaacauuagccgauuu

SEQ ID NO: 4225464 - RNA, 69 nt, Chlamydia trachomatis
gaguguaccucuaaauaacaaaaagagggagaaagaccucccucuuuuuguucuuaaggaccaaaacuc

SEQ ID NO: 4225465 - RNA, 87 nt, Chlamydia trachomatis
cuucuguaugccucuuggggaacucgguggacucguuauuugggaggacacgaaaauccaagauuccccacuaggcaaaaacagaag

SEQ ID NO: 4225466 - RNA, 78 nt, Chlamydia trachomatis
uaggaguagacguagaagcucuuuuugagagaacggaaagcguguauuucuuagauaaggcauuuguguaacuuucua

SEQ ID NO: 4225467 - RNA, 66 nt, Chlamydia trachomatis
gagaauagggauagugauuucugcauaaggcgcgccuccuuucgcucgaaauacuuucccuuccuu

SEQ ID NO: 4225468 - RNA, 56 nt, Chlamydia trachomatis
ggaggaagucuaguuuauauguauggguuuucuuuaaaaccgacgagacucccuuc

SEQ ID NO: 4225469 - RNA, 60 nt, Chlamydia trachomatis
cuguuaucauaggugccagagcaucuaauuugaagaugucugucaccauggugaugaggg

SEQ ID NO: 4225470 - RNA, 58 nt, Chlamydia trachomatis
agaguuugcgucaagauuucuuaaaaacaggcuccgagaugucuuugaugcaagcucu

SEQ ID NO: 4225471 - RNA, 76 nt, Chlamydia trachomatis
gagcugccuucuucuguuacggaagcuuucuccauuggagauggcgaguuuucuuccguagcgcuauuagguucuc

SEQ ID NO: 4225472 - RNA, 66 nt, Chlamydia trachomatis
aggaguuauuuagcucucucaaaaaggacaaucugucuccuaucauggaagaaauagauagcuucu

SEQ ID NO: 4225473 - RNA, 78 nt, Chlamydia trachomatis
guucuaucuacguucaugucguucagaaugcaacgggcccuucuguugauuaucccgaagauauaaccaaaguggagc

SEQ ID NO: 4225474 - RNA, 89 nt, Chlamydia trachomatis
auagucuagagaaugcugcuauugagguaagcuauuucuuugcuaagacagaaauaguuaacucuguagcguaguguuuuugagauugu

SEQ ID NO: 4225475 - RNA, 62 nt, Chlamydia trachomatis
ucugcauacugugugaugucuccauaaguaagagaaucauuccacaucacaucguagacgga

SEQ ID NO: 4225476 - RNA, 130 nt, Chlamydia trachomatis
gagcugcugugagacacuccguauaccaauuagacucugcuguugagaauguauucagguuggcauggacuuugagauucucagagcggaagauguuguuguuaucucgccagagugguuccgguggcuc

SEQ ID NO: 4225477 - RNA, 66 nt, Chlamydia trachomatis
gagggcuaguuucuuuuauuguuaaaagaauugcuuuuaucgauaaaagaaacuucaagagcccuu

SEQ ID NO: 4225478 - RNA, 75 nt, Chlamydia trachomatis
uagaagcgcaggaacgaggaauaagcgcucuauaucaagaauuagagcuuuuggauccuguuuaugcagccacua

SEQ ID NO: 4225479 - RNA, 71 nt, Chlamydia trachomatis
auuuccuaagaacgggggaccucguaaacguguuauguuauggaugcggguuauucccuucuuuagcaaau

SEQ ID NO: 4225480 - RNA, 117 nt, Chlamydia trachomatis
uagcuauaguuugcugaagucccaucacgauuguauucaccauucucuucauugugcuuaucguuauaggcaacaguaucguagagugugaagccaucaugagagcagauauaguua

SEQ ID NO: 4225481 - RNA, 107 nt, Chlamydia trachomatis
ucucugcucuguguuuaggaggaugcucgcagccugcauuaucuucguuuuuagaguuuauagauaaugacuauacagcugcagcucaucuagguauagaucgggga

SEQ ID NO: 4225482 - RNA, 58 nt, Chlamydia trachomatis
agagaaugucaaaagauacuuuuccuucuguuuuuugacaaguuguuugacauuuucu

SEQ ID NO: 4225483 - RNA, 103 nt, Chlamydia trachomatis
gauguuguagaagaguugcauucuuuacuucguggagaagaagggacaguuaucuauauuccugaagguagagaacugcaaacaccuuuauuuguacagcauc

SEQ ID NO: 4225484 - RNA, 57 nt, Chlamydia trachomatis
aggauauucagacguaccuaugguaagcacauuccauagucuuagcguuuauauccu

SEQ ID NO: 4225485 - RNA, 107 nt, Chlamydia trachomatis
uugaacgagaaaagaaucgugaauuggcugcagcuaugaaacguucuuaucgguaauauaugcgcaaagauguuucuuauuugcccagucaagagcuucuuguuuag

SEQ ID NO: 4225486 - RNA, 93 nt, Chlamydia trachomatis
aaugauggcagcacucagcggaauguuagacucucuuccugucgaaaccuugacaaaagggguguuugacaauccuaaagaggaagcccaguu

SEQ ID NO: 4225487 - RNA, 66 nt, Chlamydia trachomatis
uggagauuugcuucuccucgauaguucgcuaacaacugaaucguaucaauagggagcaaaccucua

SEQ ID NO: 4225488 - RNA, 76 nt, Chlamydia trachomatis
ucccuuuaaagacagaucuaauccgcgagaaacaacuauuuucauaucucgggauuauagaaguuuuuauaaggga

SEQ ID NO: 4225489 - RNA, 67 nt, Chlamydia trachomatis
guucauaauuguagacauuucgagcuugcuucauagauugcagcucuuuaaugucuuugauuuuuac

SEQ ID NO: 4225490 - RNA, 58 nt, Chlamydia trachomatis
gagaagucuuguaucauagaggauaguguuccgcuauuuuccauuuugcagaucuuuc

SEQ ID NO: 4225491 - RNA, 70 nt, Chlamydia trachomatis
guacuuacuuuaguauugaccuuguguuucuugcuagaaagagaaggaaagcuuaaagcugaagaaguau

SEQ ID NO: 4225492 - RNA, 105 nt, Chlamydia trachomatis
guagguuugauagcaaauuugaaacuuuugguacaaaggcucugguaaaagcugaucuucaaaagccugauauaaacaguuugaaaaaugcaucaacacaccuau

SEQ ID NO: 4225493 - RNA, 80 nt, Chlamydia trachomatis
guauuuuucaaucgcuuguucuaauugccuauaguccgaccggucgcggaugagaaggaagaggaagucgugagagauau

SEQ ID NO: 4225494 - RNA, 72 nt, Chlamydia trachomatis
ucggcggaucgggcuaguaaaguguguguaguagucuaagcacagaccguaauggccuuuguuuuccguaga

SEQ ID NO: 4225495 - RNA, 91 nt, Chlamydia trachomatis
uucuaucgaagaauuuauucaugcuuugacggaguuuuuuacuucuauagaaggagaucuccuagcgaagcauaauguuucuggauuagaa

SEQ ID NO: 4225496 - RNA, 57 nt, Chlamydia trachomatis
uaguagggaauucuggaaguggcugcgacgcauccacaacccagagaauuccuucug

SEQ ID NO: 4225497 - RNA, 71 nt, Chlamydia trachomatis
uucugauguguucuucuguuagcuacgcucuguucaaaacaagcuuagcucacuggaaaucacuuaaagag

SEQ ID NO: 4225498 - RNA, 59 nt, Chlamydia trachomatis
uggcacccuguguacaguuaggaugaguagacuaguucugcgccuuuuacaggguguua

SEQ ID NO: 4225499 - RNA, 55 nt, Chlamydia trachomatis
uguugcuaagauuagguggauuccuacagcucuagccaucugagcuaagcguaca

SEQ ID NO: 4225500 - RNA, 56 nt, Chlamydia trachomatis
cgguuuuuagccucuggagagcuauauaauagcucgucugcuaggccuaaagacug

SEQ ID NO: 4225501 - RNA, 56 nt, Chlamydia trachomatis
agcggggagaacaagaguuaugcucggagcuuguaaaaccucuguuuucuuuagcu

SEQ ID NO: 4225502 - RNA, 59 nt, Chlamydia trachomatis
aguuggggaaagguuaucuugaaaaauuaaguuuuuucaugguaacuucuucucuaucu

SEQ ID NO: 4225503 - RNA, 85 nt, Chlamydia trachomatis
caucaugggaguugguuuuaccuuaagucguugacucaacccgcaagggagagaggcgcccaaggugaggcugaugacuaggaug

SEQ ID NO: 4225504 - RNA, 122 nt, Chlamydia trachomatis
uaacgacuuguagauaucuuuuauauucuggagcaggaaacaguuucauuuugggagaaucgaugccuucucuugaggauguucuguuuuuaugccaggaagagaugguugauggguuuuua

SEQ ID NO: 4225505 - RNA, 59 nt, Chlamydia trachomatis
ccuacuugagcaaauuguucuaacugagacucuccccaacgcaacauuugcucaauagg

SEQ ID NO: 4225506 - RNA, 98 nt, Chlamydia trachomatis
uuugaaugauuuucuaaacguucuguucuuuggggauauauacuguaacucguggaguuggcaccacuauccucauacagaguuuggacuucaucaaa

SEQ ID NO: 4225507 - RNA, 64 nt, Chlamydia trachomatis
gaauggcuugccgcccuucucacuugcgauuaugacgauauugagaaaguugggaagcuaauuc

SEQ ID NO: 4225508 - RNA, 70 nt, Chlamydia trachomatis
gaucuuuucguucaagacaugaugcguacucuaguaguuggugggcaauuaacucuugcaacagacgauu

SEQ ID NO: 4225509 - RNA, 74 nt, Chlamydia trachomatis
guguaagcucguaagguuaucucauagcaagauuuagagucaucuugauacauagaagcuuuaggagcuagcau

SEQ ID NO: 4225510 - RNA, 80 nt, Chlamydia trachomatis
ccuauagagacgguuuugcacuggugucucaggguuuucuaaugcauuggaacuggugaaggacuguuugcuuuuauagg

SEQ ID NO: 4225511 - RNA, 91 nt, Chlamydia trachomatis
agguuaucuguuuggcagaauauaucuauuugcccucuaucuugcaacuucaggaaagaagggcaauauaaauauaccaaaucucuagccu

SEQ ID NO: 4225512 - RNA, 76 nt, Chlamydia trachomatis
uuauagggaagagauuguccuauuuccauagcagggaaaauagccgcauggaaagaaguauuaucuuuaccuauaa

SEQ ID NO: 4225513 - RNA, 130 nt, Chlamydia trachomatis
ccguugacgacugaggaguuugcguuuucuccgcaagcuauagauucagcgcaguugaauaccuuuuauuugcagcauggauuuaaggcucugguaaagcaugcggaaacugcuacgaguuccauugcgg

SEQ ID NO: 4225514 - RNA, 59 nt, Chlamydia trachomatis
ggcuucucguuaaggcuuuacgauauaggaucguguaauuaaaguuuugggaagaagcu

SEQ ID NO: 4225515 - RNA, 130 nt, Chlamydia trachomatis
aagccgauugaaaaggcaucuuauucacaauacuaucauccacaggaugcaacuccucagcagucguuaaugccugaggaccuaguaccuuggacucuaguuguugcuggagcucuuuucucucucucuu

SEQ ID NO: 4225516 - RNA, 97 nt, Chlamydia trachomatis
gguaaaggugcucuugauacucuuauagcuuaucgauugaauccaucuuuauucgacagagcugucaagagucugugcaagcuauuuagcuuuuacc

SEQ ID NO: 4225517 - RNA, 88 nt, Chlamydia trachomatis
gcuaaaguugcuaacgaaaaugcugacgccuugauucaagaagugaauacuauugcagaucaacucguugcauuugaaacaacuuugc

SEQ ID NO: 4225518 - RNA, 57 nt, Chlamydia trachomatis
gcuuguuuaggaagagagggaauggaugcucaggcguauuccuuucuuucugcaagu

SEQ ID NO: 4225519 - RNA, 66 nt, Chlamydia trachomatis
uuucagaagggaccagcccuuguuuagcgaauagaucaagaaggcugguuccuuucauucuuggaa

SEQ ID NO: 4225520 - RNA, 59 nt, Chlamydia trachomatis
guaggcaugagcuugcuuuaaagcaugaaauacuucuucuucugaaaagguucugccac

SEQ ID NO: 4225521 - RNA, 59 nt, Chlamydia trachomatis
gauaggauguaucggauugacgaucuucucauugagauuuuucauccagugguucuauc

SEQ ID NO: 4225522 - RNA, 56 nt, Chlamydia trachomatis
ucgauagaacgcauaauccagaguuuaccaugauagaggcuuaugcggcuuauugg

SEQ ID NO: 4225523 - RNA, 82 nt, Chlamydia trachomatis
gaucaggucacuggacuuguuuaucauauucagggccgcaucucccccgaauguucuacugacaaaguugaguagcuuguuc

SEQ ID NO: 4225524 - RNA, 55 nt, Chlamydia trachomatis
ugcugccauaaagauuucuuaucagccugauggcuuagauguuuuugugccagca

SEQ ID NO: 4225525 - RNA, 56 nt, Chlamydia trachomatis
gcuguagcugcagcggcaaaguuucuuguacgagaugugugugcagcagcuacugc

SEQ ID NO: 4225526 - RNA, 74 nt, Chlamydia trachomatis
agguguuuagaaacguugaauauaggggagauuucggcgaucuguucuacuuguucagccuuaucuccgcaucu

SEQ ID NO: 4225527 - RNA, 66 nt, Chlamydia trachomatis
caggagaauuaacgguucucguugaaacgguaacguuguuauguaaauccuuaauuucuuugccug

SEQ ID NO: 4225528 - RNA, 60 nt, Chlamydia trachomatis
uagguucuuuuuggcaaaaaggaugagcuaacuguauccaaucuuggaaaaaaggaucua

SEQ ID NO: 4225529 - RNA, 76 nt, Chlamydia trachomatis
gcagguucuacuuuggguuuggaagaagugugugcuugcuugugcuuauguuuuuuacucaugguuuagucccugc

SEQ ID NO: 4225530 - RNA, 78 nt, Chlamydia trachomatis
ggugacggaguuuuugaaguucucucaaccaacggggauacucacuugggaggagacgacuucgauggagucaucauc

SEQ ID NO: 4225531 - RNA, 79 nt, Chlamydia trachomatis
uguaaagaguuuguuugcuugugaauaagaaauauuaauauuaaaagaaagauuucuauucucaacagacgauacugca

SEQ ID NO: 4225532 - RNA, 58 nt, Chlamydia trachomatis
ucaggaauauuuggcauagguagggcaaacauccuggccaugccugagguauucaugg

SEQ ID NO: 4225533 - RNA, 58 nt, Chlamydia trachomatis
uuucggaucucuugcacagcugccucgauuuucaaggcuaaagcugggcgaucugaag

SEQ ID NO: 4225534 - RNA, 63 nt, Chlamydia trachomatis
agggcuuucuguuuguuuagcugcaauuuuacuugcuuguugccagaacaaugugaaagcuuu

SEQ ID NO: 4225535 - RNA, 107 nt, Chlamydia trachomatis
auuucccugcuagcacggacgauucuccauggaaaggaauucguuucacacuuucuggaaaugaauucuuauucgguaucccaagauuaguccguacggaaggaaau

SEQ ID NO: 4225536 - RNA, 58 nt, Chlamydia trachomatis
gugcgcuauuugaugcucuaccccaucuaacagcgaggaagagccuaaaauagcgcgc

SEQ ID NO: 4225537 - RNA, 58 nt, Chlamydia trachomatis
guauauuuauauugcccuucuuuccugaaguugcaagauagagggcaaauagauauau

SEQ ID NO: 4225538 - RNA, 77 nt, Chlamydia trachomatis
agccaucuucauacuuucaucgaaaacgguuucaauguagugccgaaaaagcuuuuuauguaagaugaaccuuggcu

SEQ ID NO: 4225539 - RNA, 130 nt, Chlamydia trachomatis
gagauugcguaacuauagguagcauggugggugugcaccaguuuguucguauaggcucuuacucaauggucggagcuaugagcgguauucgucgugauaucccgccuuucacuauagggacaggcaaucc

SEQ ID NO: 4225540 - RNA, 55 nt, Chlamydia trachomatis
uuucuauccauuaaugcaggagcaggggggaccgaaucuugugacuggguagaga

SEQ ID NO: 4225541 - RNA, 102 nt, Chlamydia trachomatis
ggaucuauguugagcaggauagcaagaauucuuugguaaagguucgaguugaagugaauguggacuacggaguuucuaucccugaaaaaacagaagaaaucc

SEQ ID NO: 4225542 - RNA, 93 nt, Chlamydia trachomatis
aguaguugcagagggaucacuaaucaagagaggaagagguuuuuggaagaaaacuuuucggaauucuuugguaggagaauccccugugacgcu

SEQ ID NO: 4225543 - RNA, 62 nt, Chlamydia trachomatis
ucuuucaaaauccuuuuaugaugugaguuauuuuuuaauuacucgagaaggauuaugggaga

SEQ ID NO: 4225544 - RNA, 75 nt, Chlamydia trachomatis
auaccgccuaccucaacuuauagaaaggcaagaacacuuuuaugcagaccuuccuauccuuguaguuggcggugu

SEQ ID NO: 4225545 - RNA, 84 nt, Chlamydia trachomatis
cuggggaaauuucccauuguaaugauccaugaguuuucucagucagagacaacucuuuauucauaacaaaacggaagucuccgg

SEQ ID NO: 4225546 - RNA, 55 nt, Chlamydia trachomatis
uuagacucggggaccguuaccucaauuguugauggggaaaggugggcugagcuga

SEQ ID NO: 4225547 - RNA, 115 nt, Chlamydia trachomatis
uuugcuacuucggacuuaaaugaucuguaucguagaguuauuaaccggaauaaucgcuuaaaagcuauuuugcggcuaaaaacuccagaggucauuguccguaacgagaagcgga

SEQ ID NO: 4225548 - RNA, 77 nt, Chlamydia trachomatis
acuuaggaugggaucuuguucaaagcuccguuucugcacagcagaagcuucguacacaagaaaauccaucaacaagu

SEQ ID NO: 4225549 - RNA, 68 nt, Chlamydia trachomatis
aaaaaaagcaagcccuuucucuacagagcgcucgaccuccuuuguagagaaagggauuuguaguuuuu

SEQ ID NO: 4225550 - RNA, 64 nt, Chlamydia trachomatis
gagugguugaaaggaguuccuuugggaagaguugguaugccugaagaaauugcuaaggccgcuu

SEQ ID NO: 4225551 - RNA, 105 nt, Chlamydia trachomatis
gcaagagcuaauaacaguucgugaauuguauccgcaguccgauggucuaaauuuccagaagguucgucugcuaauacaaucuccggaucguucauuagagcucgc

SEQ ID NO: 4225552 - RNA, 104 nt, Chlamydia trachomatis
uaagagcaacgucuuagcguaugccggcgauguauuaacuucugcucaagcugaagcuauugaugacgcugguauugaaagugugaagauucguuccacucuua

SEQ ID NO: 4225553 - RNA, 99 nt, Chlamydia trachomatis
cuguagagacucugaauaagcuagaggcuguuuuagauaucuaucauaaauuuacaggugaagauccuaaaaaagucccuaugcgcauuuuuccugcgg

SEQ ID NO: 4225554 - RNA, 73 nt, Chlamydia trachomatis
ugcgagaacgcuuugccaguauuccgaaauuaugcggaauuguccaaugucgaggcuuuaaacguuuucagua

SEQ ID NO: 4225555 - RNA, 65 nt, Chlamydia trachomatis
gcuaaaaaccagcagguagacugcuucaucacugguaauuuugaugagccggcauggucuuuagc

SEQ ID NO: 4225556 - RNA, 130 nt, Chlamydia trachomatis
guccuguauucauaaggacuucuccccauuucccuaccagaauguucaguaccccagcaguagaaggaucggcuauuuuugcuaguugauacugaaauagggaaccaaaaggaagcagugaaagcaggac

SEQ ID NO: 4225557 - RNA, 88 nt, Chlamydia trachomatis
gggauauuucuuccugugacuugguaaaguaguugaauauaccccgaacaaucuacaccauuacgaggaagcuguuuaugaaugcacc

SEQ ID NO: 4225558 - RNA, 84 nt, Chlamydia trachomatis
cuccugauucuuugucuuuaauacggacauaggugagcucaggaugcacagcuagcgccauauuugaaacaagaguccaaggag

SEQ ID NO: 4225559 - RNA, 106 nt, Chlamydia trachomatis
aguuuuuuucauuaaaaaagggaugcguuuacgggaaucgccuuucuuuugaagauaugaagaaagucgauuccguaaauuuuucgccuuaccuacguaaagaacu

SEQ ID NO: 4225560 - RNA, 62 nt, Chlamydia trachomatis
aaugcuacgguuugaaucucgcuaauggucguuugauuggauuaggagaagcuguugguauu

SEQ ID NO: 4225561 - RNA, 89 nt, Chlamydia trachomatis
cuaucagugcuaaaugcuucaaaagaaccucguauucucuacauugccuuacuuaucaaguuuuugacggagcauaauagcccuuuuag

SEQ ID NO: 4225562 - RNA, 67 nt, Chlamydia trachomatis
gaagcccucgagacucaaaugacaauuccacuucuuccauauggaauuuaucuuugaguuucugcuc

SEQ ID NO: 4225563 - RNA, 56 nt, Chlamydia trachomatis
aaggguugucuaaacuugaguaucgugguuaugacucugcagggauagcaacucuu

SEQ ID NO: 4225564 - RNA, 63 nt, Chlamydia trachomatis
cggugucggugauaaagaauacgguaacguuuuuugaauuuguuugucuuuaucaugauacug

SEQ ID NO: 4225565 - RNA, 55 nt, Chlamydia trachomatis
uacuucuauggggauagaaacccugauguugggaccuaucccuaccccaggagug

SEQ ID NO: 4225566 - RNA, 90 nt, Chlamydia trachomatis
agauacuagagaagauauccuuuuugaacuuucggagcuagcugccagagcuggguuacuggaagauagggaggcuuucuuucgugcucu

SEQ ID NO: 4225567 - RNA, 91 nt, Chlamydia trachomatis
guucuucuaauccuauuuuuguuugaaggacguacgcuugagguaguuuagccgcaggaaugaaaccuucaugacaaaauucugggaggac

SEQ ID NO: 4225568 - RNA, 77 nt, Chlamydia trachomatis
cugggcuaugaccguauuagccaaaggcucuguaauuucuugcccaaucaugacuaugcggucuuucaguagccgag

SEQ ID NO: 4225569 - RNA, 81 nt, Chlamydia trachomatis
agaacguaaagcaaagguuuuuaagguauuagauguaauaaguugcuguuugagguguauugaagagcugugcuuuuaacu

SEQ ID NO: 4225570 - RNA, 60 nt, Chlamydia trachomatis
gauaucggguucuugcucucuuccaucguaagaaucauggaaggucaugagauccguauu

SEQ ID NO: 4225571 - RNA, 72 nt, Chlamydia trachomatis
gaagagagauucuuuugcaaugaggaagaaugggaagaagauugcucuuuugaagcagaggaaucuuucuuc

SEQ ID NO: 4225572 - RNA, 65 nt, Chlamydia trachomatis
gcuaguucuuggggaagagauuucgaguuuucaaccguuuuguaaaucguuucuucgaaaacugu

SEQ ID NO: 4225573 - RNA, 89 nt, Chlamydia trachomatis
agaucaagaacuuagaugauuacguaggcaagguuugugaguucaaaauucucaaaaucaacguagaucgucggaacguuguuguaucu

SEQ ID NO: 4225574 - RNA, 68 nt, Chlamydia trachomatis
gcguuaucucauccggauauuguuguuguuguguacuuacggcuaggagaguuuggaagggaugcugc

SEQ ID NO: 4225575 - RNA, 70 nt, Chlamydia trachomatis
gugguucggcaaugauuucuugaacagucaucaugggauugagacugcuauagacaucuugccaaaucau

SEQ ID NO: 4225576 - RNA, 62 nt, Chlamydia trachomatis
gauccuuuuggaggaggcucuuuuuucccaaaaggaagacuucgagacuucccagaaagauu

SEQ ID NO: 4225577 - RNA, 103 nt, Chlamydia trachomatis
gguuucuucuucuguuuuugccuaguggggaaucuuggauuuucguguccucccaaauaacgaguccaccgaguuccccaagaggcauacagaaggaggggcc

SEQ ID NO: 4225578 - RNA, 61 nt, Chlamydia trachomatis
uuuggucuuggagucuucacaguguugcuaccugcgauuucucguugcguucaagaucaag

SEQ ID NO: 4225579 - RNA, 57 nt, Chlamydia trachomatis
gauguggugcuuguuucuuauucuaaaaguguggaucaggaacucggcaguuauauc

SEQ ID NO: 4225580 - RNA, 55 nt, Chlamydia trachomatis
gaucucucuugaaaugaagguggaguagcuccaccuucguuugcuagagagccuc

SEQ ID NO: 4225581 - RNA, 67 nt, Chlamydia trachomatis
ugacagaguaagggaagcgacuccguccaagauaucuugggcuugugucgcuucccuugaacaguca

SEQ ID NO: 4225582 - RNA, 61 nt, Chlamydia trachomatis
cagccucagccuauucuguuucauguguguacaguaaaaggaaaugguuuagcugaagcug

SEQ ID NO: 4225583 - RNA, 89 nt, Chlamydia trachomatis
aaguaucuuuaacaaaguuuucugggaagagaagagccacagcuuucucuuguuuuucuagacaagcuuuauguucagaagggguaguu

SEQ ID NO: 4225584 - RNA, 84 nt, Chlamydia trachomatis
uucagucaaaaaguuucgaauauagucaaagauacuuuggauagucaucguuggguauugacuauauuuguaccgcacauugaa

SEQ ID NO: 4225585 - RNA, 61 nt, Chlamydia trachomatis
ccgaggucguuguucgcauauuggaagacggagguauuucuauuucggauaacggucgagg

SEQ ID NO: 4225586 - RNA, 86 nt, Chlamydia trachomatis
uuuacagccguugcuaaaacuguuuuggaauggauggcuaaagggugguuaaagacacaaagcaguuauuaugauaacgauguaaa

SEQ ID NO: 4225587 - RNA, 60 nt, Chlamydia trachomatis
auaauagggaaucauaagaauuuccuucaaucuagaaggaguaauggacaucccuguuau

SEQ ID NO: 4225588 - RNA, 88 nt, Chlamydia trachomatis
cuuacaguuccagguauucagaucauuggcccuaaacagggagcugcacgagguucucuguguaguaucaguauuccuggugugcaag

SEQ ID NO: 4225589 - RNA, 56 nt, Chlamydia trachomatis
gacgaaaagcaaguaucugcuuaugaaaauccucauaagugaacguugcuuuuguu

SEQ ID NO: 4225590 - RNA, 78 nt, Chlamydia trachomatis
acgaaucuugcuauguugaugccuaagcugccaggguggaagguggaguguauuggggaugacauugcuuggauucgu

SEQ ID NO: 4225591 - RNA, 74 nt, Chlamydia trachomatis
gcguaggucuuacuaccuaugugaaugacuacguucuuccuuacuuagcguuuucuauagggaguguuucucgc

SEQ ID NO: 4225592 - RNA, 117 nt, Chlamydia trachomatis
ggagcucucauuguauuagaaaaugagcgucuuuugaaugaucugcuuaaucucucugccgugaaaauuaaugcagauuuuucagaagaacuucucgaagcuauuuuugagcccucc

SEQ ID NO: 4225593 - RNA, 62 nt, Chlamydia trachomatis
uauuuucuagagauauuggcgcacccgguuuuuuauccggugcacaccucuuuacgagaaua

SEQ ID NO: 4225594 - RNA, 66 nt, Chlamydia trachomatis
aggcuugguaugcgauuguucugcuucuaacucuuccuuuguuagaacaucucgcucauuaagcuu

SEQ ID NO: 4225595 - RNA, 64 nt, Chlamydia trachomatis
gcgcuuauauggagguguuagccuaucauugcggaagcucucaaugauccuagcacuccaacgc

SEQ ID NO: 4225596 - RNA, 70 nt, Chlamydia trachomatis
auggcuuuguauaagaugaauaaaguuaauccgauaacggguugucuuccuuugcuuauacaaauuccau

SEQ ID NO: 4225597 - RNA, 85 nt, Chlamydia trachomatis
guuuggagccgcuagagauguugugcaaaaauguguuuuguggauggaaauaaauacauuuuaugcuagccuggcugcagaagac

SEQ ID NO: 4225598 - RNA, 79 nt, Chlamydia trachomatis
cauuugucaggaggccaaauucaacguguucuccuagcuagagcuuuggcugcgcguccugaauuccuuuuguuagaug

SEQ ID NO: 4225599 - RNA, 80 nt, Chlamydia trachomatis
gagcuucuuuuaaggauuuuguauuggaacaauacaaagcuaaagagagcguacgcccagcacaaaaauccuggaagguc

SEQ ID NO: 4225600 - RNA, 80 nt, Chlamydia trachomatis
ggacucggauuccguguauauucauacagaggagugccaucaaaaccacucauugcaaaugaaucuauagggaagugucc

SEQ ID NO: 4225601 - RNA, 92 nt, Chlamydia trachomatis
gaucguuuauaucagcagcuauuggauguagacuuugaaaagccuaaacaggcuuuagagggucuuauucacgaguuggaaagagaucgauc

SEQ ID NO: 4225602 - RNA, 72 nt, Chlamydia trachomatis
cagagaacaccaugcgaucaucuuuugaaaauuguaauaaaaauucagcgacuugaucggcaggaaucucug

SEQ ID NO: 4225603 - RNA, 93 nt, Chlamydia trachomatis
gaaucuuucaaagaucuuccugugaacuuuucuaugacagaagaucucgcugaaauacagaaacagauucguggagaaguagacuuugaguuc

SEQ ID NO: 4225604 - RNA, 82 nt, Chlamydia trachomatis
aucccagauguuguuguguuccuaggcaaagagauucaaaagaaagaauaucuauuucuuggaauagagcaauggaagggau

SEQ ID NO: 4225605 - RNA, 98 nt, Chlamydia trachomatis
gaaguuauugauuugcgaacgauuguuccuugugauuuugcuacuguaugugagucaguuaaaaaaacagggaaguuauuaguuguucaugaagcuuc

SEQ ID NO: 4225606 - RNA, 67 nt, Chlamydia trachomatis
auucuaguaacuuuaguaccgcaagaagcaucuuugaaagauguauagguaguugaaggucuagaau

SEQ ID NO: 4225607 - RNA, 71 nt, Chlamydia trachomatis
aguaagcguaucagugaauugauucugcagugcuauaagaaaguuggguuagaagccacuguacgcuuccu

SEQ ID NO: 4225608 - RNA, 77 nt, Chlamydia trachomatis
ucuggagcuucaggagugcuuucuacuauugcuuuaacaguguuaucugcaaaagugaagguagacuugagguuaga

SEQ ID NO: 4225609 - RNA, 98 nt, Chlamydia trachomatis
gcaagaagucuuuggaaucaaagcuuuaguuugccuuggaucccuuauucuaaaaaucuuccgggcuguuaaagcuuuuuuccauagaacuuuuucgc

SEQ ID NO: 4225610 - RNA, 58 nt, Chlamydia trachomatis
ugucuccuuuuuacccagaaaaaccgagcugcuuacgguuuuuuguaacaaaggagca

SEQ ID NO: 4225611 - RNA, 92 nt, Chlamydia trachomatis
gcuucuuggcguucuuguaaagcgaguaagaaggauuugucuuuagaagaagcaacuccuuugaguuugucugcaacaaggacauggggggc

SEQ ID NO: 4225612 - RNA, 81 nt, Chlamydia trachomatis
gauuuucaacgcguggucucugugguaagagagauggaagaacauacucuacucauagaugacuacccgggauugaaaauc

SEQ ID NO: 4225613 - RNA, 83 nt, Chlamydia trachomatis
gaaggaucuucuaagacaaacuggucauucuuuugggauagcuuuaucaaucauucuaaugagcugaccaaguuucauucuuc

SEQ ID NO: 4225614 - RNA, 88 nt, Chlamydia trachomatis
gcggugccgauuacgaagcuagagaucugaaagagccucguucuaaauuaacgggggcagcuuuaucuuuacgugauacggaacaugc

SEQ ID NO: 4225615 - RNA, 93 nt, Chlamydia trachomatis
acacauuuuucugcacgcuacaauacgacagaagaauuuguccaagaggcuggagaaauuuuucccaauguauuugcugcagaggaauucugu

SEQ ID NO: 4225616 - RNA, 76 nt, Chlamydia trachomatis
ccuauuuucucauacggauaucuugcuggcugguacucgguuguucgucaucagaaucuguaucuuguugaguagg

SEQ ID NO: 4225617 - RNA, 80 nt, Chlamydia trachomatis
gcguaauagcagcugucaacguagucuuaccauggucaacguggccaauggucccuauguugauaugaggcuuauuacgu

SEQ ID NO: 4225618 - RNA, 79 nt, Chlamydia trachomatis
aagcauggagcgcacgguaucguaaagcuuauguuuaaugaauagauauucuaaaguuuugugguacagcucgcggcuu

SEQ ID NO: 4225619 - RNA, 84 nt, Chlamydia trachomatis
cagaaauagaagaauucgaugugguugcgaacaaagcucaagauugggaugucgauguagcuaugucaaauucuuuugguuuug

SEQ ID NO: 4225620 - RNA, 72 nt, Chlamydia trachomatis
gcgugagguguuuuuucuguuucuugugguuugaaagauugacuagaggagagacuucaauacauaacucgc

SEQ ID NO: 4225621 - RNA, 75 nt, Chlamydia trachomatis
gcuuuccgucaggcuguguuaucuacaacuaaagcacaaauuugugagguuguacguaaucgucuugaaggaugc

SEQ ID NO: 4225622 - RNA, 95 nt, Chlamydia trachomatis
ggguuuagaacacgcaagggacgaagggaaacucaccuuaguaguauuguuagauacuucuggguauuccuucgagacucuugcugaugcagccc

SEQ ID NO: 4225623 - RNA, 75 nt, Chlamydia trachomatis
cuauuugcgccauacuguucgcugguugaagcagguagcugcuccauuccagauggagguaugucgcgugaaugg

SEQ ID NO: 4225624 - RNA, 57 nt, Chlamydia trachomatis
uagaagaagcuggaggccucguuacagauauaucggggaauccucucccuuuuucua

SEQ ID NO: 4225625 - RNA, 83 nt, Chlamydia trachomatis
augcgagaaauucgagagggaauuuuaaaugaccguauauaaaacggcgcgauuaugagauucuuuuuguguuuuucucgggu

SEQ ID NO: 4225626 - RNA, 59 nt, Chlamydia trachomatis
uuaucgguaguaacguugucuugcuguuaugcagaaaagagagcggucucuauugguaa

SEQ ID NO: 4225627 - RNA, 57 nt, Chlamydia trachomatis
cagaaauauaagguagcuuggcuucauguaacuuagccaaagcugcagauguuuuug

SEQ ID NO: 4225628 - RNA, 70 nt, Chlamydia trachomatis
auucauagaaugauuucugcuuggauucgucaucguauggacguuauccaaagaagaacucguuaugagu

SEQ ID NO: 4225629 - RNA, 88 nt, Chlamydia trachomatis
gugccugauuuuacgcaagcucugauuaaugaccguccuaucgcagagacgauagcggaucgugauugguuagagaauauuauggugc

SEQ ID NO: 4225630 - RNA, 66 nt, Chlamydia trachomatis
gcuuauguuugcagucgcucugccuaucguaggaugugauaacggaggcgguucgcaaacaucggc

SEQ ID NO: 4225631 - RNA, 99 nt, Chlamydia trachomatis
gugguuaagauggauagaaucggacguauugauuuguagcuuagcuuucaauugcuuagccaagcgaaugaguucgacaucguccugcucuuguuucau

SEQ ID NO: 4225632 - RNA, 78 nt, Chlamydia trachomatis
cgaagacagcgaggaagagagaaucacaaaucgauuaggcuuuguagcaggaauuuguguuucuucuaccagucuuug

SEQ ID NO: 4225633 - RNA, 112 nt, Chlamydia trachomatis
agcguucuaaugagguagugaguaggguauuacuuuguucgaagagaggggaguagagauuaccaugcugaucggacaaggugauauguucuuuaguuaacccagggacgcu

SEQ ID NO: 4225634 - RNA, 61 nt, Chlamydia trachomatis
uucaaaguuuuguguuuccaaagcuuuaauaauaagagcuacaggaaccgggauugcugaa

SEQ ID NO: 4225635 - RNA, 74 nt, Chlamydia trachomatis
gcaaaguuuuucagaauuuucuaaagagcgaacuguccgugaagcucgagaaaaggagaguuuugaagcuuugc

SEQ ID NO: 4225636 - RNA, 101 nt, Chlamydia trachomatis
uacaaucuugagcaugagugaauuuggguuaguagaaaugacucgccagagaaaucgugagucacuaaugcagaccuuauuuaccaccuguccauauugua

SEQ ID NO: 4225637 - RNA, 101 nt, Chlamydia trachomatis
uuuuguugacagugaaagagcugcaguuuuauccagaauuugaggaguuguucuucgaguuucugcaaaagacugugcaaucuuucgaagcuguugcgaaa

SEQ ID NO: 4225638 - RNA, 75 nt, Chlamydia trachomatis
acagccuguacauuuucuauuggcguuugagguaagauaccaugcccuaaauugaaaauauaaugcgauugcugu

SEQ ID NO: 4225639 - RNA, 75 nt, Chlamydia trachomatis
gguaacugcuguucagaaacauaaggcgcuucauguacgaacuggcucgcuaaauauuucuguaaaguagcuacu

SEQ ID NO: 4225640 - RNA, 69 nt, Chlamydia trachomatis
ggcuaguaaugugucuaaagaucggcuuacaucgaguguguaguuaucuuuagcgcacuuaauaaagcc

SEQ ID NO: 4225641 - RNA, 76 nt, Chlamydia trachomatis
guaucaacagcuaacaacgcacuuucagcccaaacuucugcuaagguuggaugugcguggauaguuucguaaauac

SEQ ID NO: 4225642 - RNA, 87 nt, Chlamydia trachomatis
gaauuugaaagguucguugcuuaaaaaguauccucuacaagauugugaagguggaagaugcucucaaaaguuacgagcuacgauuuc

SEQ ID NO: 4225643 - RNA, 110 nt, Chlamydia trachomatis
gcuaagguuuuagcgcgagacucaguaucuguguauguuuaagggaagacucgaagagcuucccuuaaauauucauauguuacaggugauucaagguuuuaagaccuagu

SEQ ID NO: 4225644 - RNA, 61 nt, Chlamydia trachomatis
gaaaucggcuaauguuucucuuucuccauuacgaucggagaaauacaacaaagcacgauuc

SEQ ID NO: 4225645 - RNA, 59 nt, Chlamydia trachomatis
uuuauugagagaaugguggauuacuaccaagacugggcuccacuaccuucuccaaugga

SEQ ID NO: 4225646 - RNA, 68 nt, Chlamydia trachomatis
uggcgcagaaguaucuuuggaagcuuuaaaagaaagaaaaguuauccauagagagacuucucguguua

SEQ ID NO: 4225647 - RNA, 61 nt, Chlamydia trachomatis
ggcuucuugagaucggaugggcguaucuagaggagagaguucagagagaauucgagaaguu

SEQ ID NO: 4225648 - RNA, 69 nt, Chlamydia trachomatis
cagcagcgauuguagcauguugagcaucgucuacacgaucuuuuuucucuuucaucucaaucucuguug

SEQ ID NO: 4225649 - RNA, 103 nt, Chlamydia trachomatis
auguugcaucagcaucaaacagcaucuguagcucuuuguccugcuuuacaucuucaacagggacuggauaugcuacagaugccaguugcugaacucgcaacau

SEQ ID NO: 4225650 - RNA, 104 nt, Chlamydia trachomatis
cgaaaaaggaggcccuaugccuuacggaacucguuauccuacauuggcuuuucacacaggaggcguuggcgaguccgaugauggcaugccgccucaaccuuucg

SEQ ID NO: 4225651 - RNA, 57 nt, Chlamydia trachomatis
guucuuuucuaugaaucggguauugguugauaugacauuaccugauuggaaaaaagc

SEQ ID NO: 4225652 - RNA, 74 nt, Chlamydia trachomatis
gaugccaguagaucuguauauuggaggugcagaacaugcuguacugcacuuacuuuaugcgcguuucuggcauc

SEQ ID NO: 4225653 - RNA, 107 nt, Chlamydia trachomatis
ccaacguucucauuuugucuucuuggcucaugagaggaaaaguggugcauucuuuccagaacuguauagcuuuuccugucgagugaguagguaaaaauaugcgaugg

SEQ ID NO: 4225654 - RNA, 69 nt, Chlamydia trachomatis
ucuagaaaacgcagagucggcaucggagauugcuuacacaacucguaugccucccuuuguuuuucaaga

SEQ ID NO: 4225655 - RNA, 69 nt, Chlamydia trachomatis
aaaucuuaucuaugaauggcgagacgguguguauuagcgcacaaauucgugguucguacgauaacguuu

SEQ ID NO: 4225656 - RNA, 94 nt, Chlamydia trachomatis
ucuucauucuaaccgcaaacguauuagauuccaucccagacccucuacuggaccgaauggaaguauugcguuuaucugguuacauucuggaaga

SEQ ID NO: 4225657 - RNA, 72 nt, Chlamydia trachomatis
cuaugauugugguuuuuauauuaugccaaguguucgguaugaucauggcugugaauaaaaaccauuggauag

SEQ ID NO: 4225658 - RNA, 63 nt, Chlamydia trachomatis
agaggaauugcuugauuuuguaagagcucauacagguggaucgcgcggaucaaguaggauucu

SEQ ID NO: 4225659 - RNA, 69 nt, Chlamydia trachomatis
uauuugaaagaaaugggaaccguuccucuacuuacuagagaggaagagguggaaauuucuaagagaaua

SEQ ID NO: 4225660 - RNA, 58 nt, Chlamydia trachomatis
ucuugggaggcggagcggcucuucuuuacgcuacucagagccucucuuccucuccaga

SEQ ID NO: 4225661 - RNA, 64 nt, Chlamydia trachomatis
uguagucgaggauuaggcggaggauccgaggcaugggugucugacggcuaauuccuuguuuuca

SEQ ID NO: 4225662 - RNA, 59 nt, Chlamydia trachomatis
aucguaaagaugguucuacacuaagauucgauacgaauaguuguguaaucaucgaugau

SEQ ID NO: 4225663 - RNA, 70 nt, Chlamydia trachomatis
uguggagcuaucauuuccaaaaucuucaaugcuguuucaggcauaauaggauaggaaaugagagcuagca

SEQ ID NO: 4225664 - RNA, 63 nt, Chlamydia trachomatis
acaccauccucuccuaaaggagacccaugugcuuuauugguuccuucuuuaggggagccgugu

SEQ ID NO: 4225665 - RNA, 84 nt, Chlamydia trachomatis
guuuauuagcuaauuuguaagcagcuucggguaagguuucuuugauaauuagagaagcauauucauaagcucgagcugauaaau

SEQ ID NO: 4225666 - RNA, 110 nt, Chlamydia trachomatis
cauuauuauagguaccugcuacgggaaucaauugcaugaagaauuugcaaaucuucaagaaucauuagcgaauuccccugauguaaggauucuuuugacuuauagugaug

SEQ ID NO: 4225667 - RNA, 63 nt, Chlamydia trachomatis
gugauuguguuuucuuaugcaugauaaaaaaugauaauuuuuacuuauaagagggcauaucau

SEQ ID NO: 4225668 - RNA, 123 nt, Chlamydia trachomatis
ucuuggaucgcuagaaaagcgcuuucuguuuauaguucccguucaaaacaaugucuuaagauguuuauaacaaaggaacuuaugaaucgaguuauagaaauccaugcucacuacgaucaaaga

SEQ ID NO: 4225669 - RNA, 69 nt, Chlamydia trachomatis
gaucggggaguguaugucgauccucacuuagcagguguugugcaagggacguuacacuaugaccccauc

SEQ ID NO: 4225670 - RNA, 82 nt, Chlamydia trachomatis
gagcggagagugauuuuaguugaaggucaggcagauuguuugcaaaugauugauuuuggcuucaacuguacuuuggcugcuc

SEQ ID NO: 4225671 - RNA, 67 nt, Chlamydia trachomatis
ggaagaguaggggcuuugucaugacucggaauaagaggauuauuccgagagaagcuccucuucuucu

SEQ ID NO: 4225672 - RNA, 75 nt, Chlamydia trachomatis
cgcuggauucucugguauuaacugguuuuuuacgcaaaaucuagcaaaacuuuuaauagcagauagucgacggcg

SEQ ID NO: 4225673 - RNA, 106 nt, Chlamydia trachomatis
gaggaacgcgguuccucaggguuuggauaugauccuuuguuuguaaaacaugacuacaagcaaacuuaugccgaauuaccagaggcaauuaaaaaccaaguuucuc

SEQ ID NO: 4225674 - RNA, 56 nt, Chlamydia trachomatis
uuccuaaagcguaugacccuaaaagcucugaaacugggguguauucguuuugggaa

SEQ ID NO: 4225675 - RNA, 57 nt, Chlamydia trachomatis
cagcuaaaucaucagcuccuugguuaggauagccaguaaggggaagagaguuagcug

SEQ ID NO: 4225676 - RNA, 96 nt, Chlamydia trachomatis
cuuccgauacgguaauggcgacgauuucuucugaagauuauggguuauuuggucguccgcaaucuccugaagagauugcugccagagcugcggaag

SEQ ID NO: 4225677 - RNA, 70 nt, Chlamydia trachomatis
gauguccaaagcucuuugauaugcagcauccaauagaguuuuaaguucauuaucaauagcuuuggccguc

SEQ ID NO: 4225678 - RNA, 55 nt, Chlamydia trachomatis
uucuucauuaggagguucaugugugcggaauggcaugguuauucccugaugggaa

SEQ ID NO: 4225679 - RNA, 61 nt, Chlamydia trachomatis
ggaaagcgagaaaguugcuagcaaggcagacaaaaaggcggcagcgaucacauugcuuucc

SEQ ID NO: 4225680 - RNA, 63 nt, Chlamydia trachomatis
gaauuuuuuaaaaaugguguaugcggagcaagaagcaaccgcagcauuuccauugaaagauuu

SEQ ID NO: 4225681 - RNA, 63 nt, Chlamydia trachomatis
ucuguaaucccuugggauagucugcgaauugcuucgggcugaucuccacaagggaggaaagga

SEQ ID NO: 4225682 - RNA, 58 nt, Chlamydia trachomatis
ggagauuacgaaaaggugcuuuugaucgugauauuucaugccuuuucgugcaaucucu

SEQ ID NO: 4225683 - RNA, 61 nt, Chlamydia trachomatis
ucugcuucuuuagauacacaguauucaaugauugcuauugaaaaagagucuagagagcagg

SEQ ID NO: 4225684 - RNA, 65 nt, Chlamydia trachomatis
ggauauugauaccgcuauacauuacugcaaagcagaucuuguaucuucgguugucaaugaauucc

SEQ ID NO: 4225685 - RNA, 75 nt, Chlamydia trachomatis
auuauuucugguaguacuauugcagauauuaagcaaaguaccgcuaaaguauuagugacuaccauuacagauagu

SEQ ID NO: 4225686 - RNA, 105 nt, Chlamydia trachomatis
gaaaauuaaacgacgggcacuuaaagcucucucuacaaauggauuuuauuagcagagaauaaaaauauagcgaguagagccgcaagagccacgaucgucauuuuc

SEQ ID NO: 4225687 - RNA, 67 nt, Chlamydia trachomatis
cccaagcaacuuggaauucauuucucgagcaaaacaagccgcugguaaugauuucccaguauuuggg

SEQ ID NO: 4225688 - RNA, 82 nt, Chlamydia trachomatis
uucgagcccauaucgcggccuucaaauacacaauucccuacugucgcguauugcuuuuguaagguuugcauguaggcucgaa

SEQ ID NO: 4225689 - RNA, 104 nt, Chlamydia trachomatis
gaagaaaacucugcaucgcaaagagaaagcucuucuuuuaguugcugagcuauaagcuuacugaaaaggaaagggguuuguucgagacgauucagaaguucuuc

SEQ ID NO: 4225690 - RNA, 58 nt, Chlamydia trachomatis
uggagauuugugggaugagugaccaauaucauugguuacuucuuugauaagcucuuca

SEQ ID NO: 4225691 - RNA, 60 nt, Chlamydia trachomatis
uuuagggccuuuuuccaagaggcuuguuuguuagaacaagccuuuauuaaagacccugaa

SEQ ID NO: 4225692 - RNA, 103 nt, Chlamydia trachomatis
cugaucaauacgaagaauauucucguuccauacuucagcuguuuugucuuuggaaagacucugauauuguggaaugggagaauacuuuucagauguuguuugg

SEQ ID NO: 4225693 - RNA, 67 nt, Chlamydia trachomatis
ccgcuuguuccuccacauuuuguauggguuugugcauaccgauacuccauuuguaggaauuuggugg

SEQ ID NO: 4225694 - RNA, 77 nt, Chlamydia trachomatis
agaaucuguguuugcuccuuuguuacaaaaaaccguaagcagcucgguuuuucuggguaaaaaggagacauuauuuu

SEQ ID NO: 4225695 - RNA, 107 nt, Chlamydia trachomatis
gcgagguugugagcgagaaaccuuaucuugugggacagggauguuggcaagugcuuugguugcagcggauaucuuuucucuaggacaagauuucucuauagcggugu

SEQ ID NO: 4225696 - RNA, 126 nt, Chlamydia trachomatis
caaaggaugggauaaagauuucagagcgauaucuacuuugugcgauaaagucuucuuuuuguguagaaaacuuggaagauucuguauccaagagugaauuuuuugagauaguuuacuuauuuuuug

SEQ ID NO: 4225697 - RNA, 66 nt, Chlamydia trachomatis
caaaauauugaucaauaagguagcuaaaagcuuacgcuuaguugcucgcuguugaucgcuauccug

SEQ ID NO: 4225698 - RNA, 76 nt, Chlamydia trachomatis
ucuugacccguaacgcucauuacaacucuccgaauccagaauuaaaaaccucggagaguuucugcauuacucgaga

SEQ ID NO: 4225699 - RNA, 80 nt, Chlamydia trachomatis
agaguacuuuuugauuuccuucaaaugggaaaguuugaauagcagaaaagaucuggucaggaaggagauaaaaugucucu

SEQ ID NO: 4225700 - RNA, 61 nt, Chlamydia trachomatis
ggaagcagcaucauuuugucgaggcuguuguugaguagucucuucaguugaugccgcuuuc

SEQ ID NO: 4225701 - RNA, 124 nt, Chlamydia trachomatis
uuugcagaggagagcgauguucguugggauaauaacugucugguuggagagauuggagugggauuaccgauugugauuacuccaucuaagcucuauuugaaugaguugcguccuuucgugcaag

SEQ ID NO: 4225702 - RNA, 71 nt, Chlamydia trachomatis
gcaacagagauugagaugaaagagaaaaaagaucguguagacgaugcucaacaugcuacaaucgcugcugu

SEQ ID NO: 4225703 - RNA, 82 nt, Chlamydia trachomatis
gcauuucaccgcgaauauugcgaaucguauaaacuagccuuucugcuaugccaaaugauucucguaauccuuguggaaaagc

SEQ ID NO: 4225704 - RNA, 76 nt, Chlamydia trachomatis
gaagcauauaaggagaucuuaacagauaagagaagcuuucgcccaugcucaucuuagguuuagauuucuuagcuuu

SEQ ID NO: 4225705 - RNA, 102 nt, Chlamydia trachomatis
cguauuacagcucaguuaacagcucaaggugcuucuaaucaggucauagagaagucuuuggcugauuaugagaaguauuauguuaaugaguacuuugauacg

SEQ ID NO: 4225706 - RNA, 72 nt, Chlamydia trachomatis
guagagucgggaggauugaaaagagagucuguucgcauaaaaacuauuuucucuuuuuaauuuuuauucugc

SEQ ID NO: 4225707 - RNA, 68 nt, Chlamydia trachomatis
caaggucucgauuacaacuagcuccccauuaccaacauuaaugcgcuacuucaaaucgauuggccuug

SEQ ID NO: 4225708 - RNA, 130 nt, Chlamydia trachomatis
gagccccaaaaauuuuucgcccuuuaucaaguaaaucucccaauagauugauauuaucaagaaguucuaaagaagaugaugacaaaacuacuggcagagagugcagggggagcggaagagaggcuguuau

SEQ ID NO: 4225709 - RNA, 64 nt, Chlamydia trachomatis
cguuuucauugugaugugauuaucgaccucuguuguuaucgaaaauacggucacaaugaaagug

SEQ ID NO: 4225710 - RNA, 62 nt, Chlamydia trachomatis
uaaagagguuuuucacacucuuucuauucaaguggauaaaaaagggaagaagauccuguuug

SEQ ID NO: 4225711 - RNA, 130 nt, Chlamydia trachomatis
agagagagagaaaagagcuccagcaacaacuagaguccaagguacuagguccucaggcauuaacgacugcugaggaguugcauccuguggaugauaguauugugaauaagaugccuuuucaaucggcuuu

SEQ ID NO: 4225712 - RNA, 80 nt, Chlamydia trachomatis
gauuggaaugguaguuguaugaaaauccgugaugaagugcuaagcucgucggauuucaucucagcuguugcugaccaauu

SEQ ID NO: 4225713 - RNA, 90 nt, Chlamydia trachomatis
cagcgauucccuaaagaauuccuuaaagaugguguagcgaaaaguguuguugcgauucaagcuggggaaucuuuggauacaggagaguug

SEQ ID NO: 4225714 - RNA, 80 nt, Chlamydia trachomatis
uugcugaaggauuucugaaggacagaggcguuuugucauuagcaaggaaaaacggcaucugucuuaucgauccuaugcag

SEQ ID NO: 4225715 - RNA, 74 nt, Chlamydia trachomatis
cguauuucucugcuaucucucuuugagugagcuccccuucuaaaagagcucgaaugauaugauagcgagaagcg

SEQ ID NO: 4225716 - RNA, 59 nt, Chlamydia trachomatis
gaaguuucugugaucgaagcaagcucucaaauccuugcuuugaauaauccagauauuuc

SEQ ID NO: 4225717 - RNA, 59 nt, Chlamydia trachomatis
aauaaacucgccacacuagucaccgcgaagaucgucacugcucgucugaugaguuuguu

SEQ ID NO: 4225718 - RNA, 57 nt, Chlamydia trachomatis
ugauuugguaaacaagugugcuagcaaugaaagcuaacauagcgggauaccaaguca

SEQ ID NO: 4225719 - RNA, 64 nt, Chlamydia trachomatis
aagaacuuugcuagcuaaacgaguuacuuugcugagaagugauaguggagauaggagcguucuu

SEQ ID NO: 4225720 - RNA, 63 nt, Chlamydia trachomatis
guaacaagaggcuuuuugggaguuaccuugcaaccgauagauucugaauuggcuacuuguuac

SEQ ID NO: 4225721 - RNA, 70 nt, Chlamydia trachomatis
uaucaaaauagcggcuuauuauggcugugguuuuuguauaaccaucgguuaucuggacugcugugcgaug

SEQ ID NO: 4225722 - RNA, 66 nt, Chlamydia trachomatis
uuuugauugauagcgacauucaaaauguucucaaucgacacgucuauaucgcuauuaguaucagaa

SEQ ID NO: 4225723 - RNA, 77 nt, Chlamydia trachomatis
gcuguuuuucggcuucuauucuuucgagauaauaacgucucucuuguucaucucggaacuuggaugcaagagcucgc

SEQ ID NO: 4225724 - RNA, 72 nt, Chlamydia trachomatis
acaagcuuuucagagcuuuguaaaugaauguaacagcaucgaguucucauuugggagcuuuggagagcaugu

SEQ ID NO: 4225725 - RNA, 59 nt, Chlamydia trachomatis
cuagaaauuauggaagagcgguaaacguauacguuuacagcuuuuugagucauuguuag

SEQ ID NO: 4225726 - RNA, 114 nt, Chlamydia trachomatis
gaucuucuccucaaauuuuuauuucuaacgaacaacaagauguuagcauagauuuacaaucugcucagcgucuuguuguucuguuuuuggaacuacaaaaaguuucuacagauc

SEQ ID NO: 4225727 - RNA, 81 nt, Chlamydia trachomatis
gugcagaugauuuggcaagaugucuauagcagucucaaucccaugaugacuguucaagaaaucauugccgaaccacuacac

SEQ ID NO: 4225728 - RNA, 73 nt, Chlamydia trachomatis
cuaugagucugguucccacuaaauucccuucuuuuuaaaaagaagauaaugauuagggggacuaagacugugg

SEQ ID NO: 4225729 - RNA, 85 nt, Chlamydia trachomatis
uuguauuaaaauaacucuuuuuuauaagaagggagcgugcuacgguggaacuacuuccucaugaaaaacagguugucgaauacga

SEQ ID NO: 4225730 - RNA, 56 nt, Chlamydia trachomatis
agggcuuugugagaguuugcuuccagaucaggauccucaagucauagcagagucuu

SEQ ID NO: 4225731 - RNA, 58 nt, Chlamydia trachomatis
uucugcauuuacuagagcugcucgcguuguugauaagagccccucauuaagugcaggg

SEQ ID NO: 4225732 - RNA, 87 nt, Chlamydia trachomatis
ucuaugcauccuaaagauguagagguaugggcugaagugguuucacauuuccacaauucuucuacaaaaauuuuauggguuccuaga

SEQ ID NO: 4225733 - RNA, 58 nt, Chlamydia trachomatis
aacgguuuuaugaaguauuggaucuagcaaagcagcaguccaauguuucugaaaaguu

SEQ ID NO: 4225734 - RNA, 58 nt, Chlamydia trachomatis
ugaugaaauucuugacggaagaagucucuaccuuuuaucuuccaauaaggguuucuca

SEQ ID NO: 4225735 - RNA, 106 nt, Chlamydia trachomatis
gaaugugugguuguagaggagaagagugcauccgguugcaugguuugcaauguuuugucgaccaacggaauagguguauaguuuuuucuucugauugcccguuuuc

SEQ ID NO: 4225736 - RNA, 114 nt, Chlamydia trachomatis
uauggguaccaucccugcucugaguucuaagaacccucuaccagagucgccaccucuuccuacuagcgauauggggaugguuucuuagaaaugagggggauauggaucccuaua

SEQ ID NO: 4225737 - RNA, 129 nt, Chlamydia trachomatis
agagauuucucaggcuauucaauuuuucaaucaaaacaguauggggguccacgcucuuaucaucgcaaggggcgguggaaguaucgaggaucucugggcuuuuaaugaagaagagcuaguuaaaucuau

SEQ ID NO: 4225738 - RNA, 63 nt, Chlamydia trachomatis
uuaugcuggcugugaguucccuggauaaacaaguuuauucccaaaaauugacagccauuguaa

SEQ ID NO: 4225739 - RNA, 56 nt, Chlamydia trachomatis
gguauccagguuuuucaaaggaacaagugcuguuccuuagagaagagcuugguauu

SEQ ID NO: 4225740 - RNA, 66 nt, Chlamydia trachomatis
gcuauuauacuuucucuauacagcauuccgcuugguaaggaaugcucgucgaagaaacuaaguagu

SEQ ID NO: 4225741 - RNA, 71 nt, Chlamydia trachomatis
gcaacgacaaacgggagcccaauuaaaacaauagugacuagguguuguaagguucgcguuuccgcggcugc

SEQ ID NO: 4225742 - RNA, 57 nt, Chlamydia trachomatis
uauuucguuggugggagcguucgagacaugcucuuaggacgccccaucgaagaggua

SEQ ID NO: 4225743 - RNA, 71 nt, Chlamydia trachomatis
ugaaggaaucuuggagaugacguugucacuauuccaacauaaagacaacgaauaaucuugcaauccaauca

SEQ ID NO: 4225744 - RNA, 58 nt, Chlamydia trachomatis
uguggccgcaggauugugaugagccccaccuauggguucuuugaucacugcguccaca

SEQ ID NO: 4225745 - RNA, 80 nt, Chlamydia trachomatis
agcuaguuucugagcuuucugaaguaucuggagaagugauuuuuccagcaacggcuugggaaguuuuauucgaaguggcu

SEQ ID NO: 4225746 - RNA, 64 nt, Chlamydia trachomatis
cuaaaagaccugagaacgcucuuuuccuaugauuuagagggguggcaauucucagguauuuaag

SEQ ID NO: 4225747 - RNA, 71 nt, Chlamydia trachomatis
ugggaaauuuaaaauggaaauguguucuggaguuuuggucguacuucaagauccuaaacaauuucuuccua

SEQ ID NO: 4225748 - RNA, 59 nt, Chlamydia trachomatis
ucaaucgaguugcuauggauugagcugcuccaccugcuccuauaauagcaacucguugg

SEQ ID NO: 4225749 - RNA, 67 nt, Chlamydophila pneumoniae AR39
aagauuucggagagauauucugaucuacaagcugauauuguagagauaugaauguuucccagguuuu

SEQ ID NO: 4225750 - RNA, 68 nt, Chlamydophila pneumoniae AR39
ugauuuuuccucgauacccauguuuucucagcuuuuuaauuaagagaaggugaaaaucggggaaauca

SEQ ID NO: 4225751 - RNA, 92 nt, Chlamydophila pneumoniae AR39
ucuuuaucucagguagagaggcaagaauacgauggcugcuaguauuuuaucucaggagcuuuuggauauccuuccuuauacuuuuuuaaaga

SEQ ID NO: 4225752 - RNA, 59 nt, Chlamydophila pneumoniae AR39
ucugaaguccuagcauugaaagauccggaaggaaucccuguuauugauacgauuuuaga

SEQ ID NO: 4225753 - RNA, 61 nt, Chlamydophila pneumoniae AR39
aggguucaauacuauggauuuacuugcagcguuuuucuucugcuccauaguuuugaucucu

SEQ ID NO: 4225754 - RNA, 83 nt, Chlamydophila pneumoniae AR39
ucuggagacaucuuuugaagcucugcaucaguaagaaagagagcgggcagauguuccaagagaagaaagaguuugucucuaga

SEQ ID NO: 4225755 - RNA, 70 nt, Chlamydophila pneumoniae AR39
auuggggauuguuacgauagacaucggaaacaaagaauccugagagaucauagguguaggaaucuccgau

SEQ ID NO: 4225756 - RNA, 65 nt, Chlamydophila pneumoniae AR39
uaaagaagaagaauccguggaugaugaagucucagauggcucgucuacaggguucuucgcuuuua

SEQ ID NO: 4225757 - RNA, 67 nt, Chlamydophila pneumoniae AR39
ggggacucuucacugucugaaguuccauguucgucuuuguaggauaguauagugaggagaucuuccc

SEQ ID NO: 4225758 - RNA, 78 nt, Chlamydophila pneumoniae AR39
gauaagcagaauucccuuuggauccagaagcuaaagggaaaaaaccuugcaugcuaaccuuccagaggauucuguauc

SEQ ID NO: 4225759 - RNA, 83 nt, Chlamydophila pneumoniae AR39
gaucauagguucguuauugucauaggugaguucuuuagggaucacguuccaggcaaggcgcaugccaguaaagccuaaugauu

SEQ ID NO: 4225760 - RNA, 129 nt, Chlamydophila pneumoniae AR39
ucuacaguucaaguucacuugcagauuacgaaauaugaguacccuuuauugcauuuuguagucucuuguagcaaaggaacuuauauucgcagcauugcucaugagcuuggcacgauguuaggcugugga

SEQ ID NO: 4225761 - RNA, 81 nt, Chlamydophila pneumoniae AR39
gcgugucccgagauugaaaauaugagcaacuucuaugccuugauaaaugcgguaaggauggccaggauuuucaggacaugu

SEQ ID NO: 4225762 - RNA, 57 nt, Chlamydophila pneumoniae AR39
ucucggguucuuuuccuauaaugcucucaguuacgauuguucuaguaggacucgaga

SEQ ID NO: 4225763 - RNA, 100 nt, Chlamydophila pneumoniae AR39
uccgagaaaugauagucuuuggcaaucucugaacuuuugcuguugucaauaugauaacagcauguuucggagguucuucgaagacuuuuaaaaaugcgga

SEQ ID NO: 4225764 - RNA, 97 nt, Chlamydophila pneumoniae AR39
gauccccguguuagcaggaggaaauaaccguauauuaagauucucugcucgugugauucccuucauagcaggauuuuacuguauuucuugcgggauc

SEQ ID NO: 4225765 - RNA, 84 nt, Chlamydophila pneumoniae AR39
ucccaugucuuuuuuacagaaagauuuauuccaauccuuacacaucaccaaaggaaauaucugccuuguaaauaaguauggcga

SEQ ID NO: 4225766 - RNA, 107 nt, Chlamydophila pneumoniae AR39
guagcuuaaaccauucugccauuuucucuguagucacuggggugaggguggaagcauucccacaaccaaaacgugcgcagggauggcccugaggagcaacaagcugc

SEQ ID NO: 4225767 - RNA, 91 nt, Chlamydophila pneumoniae AR39
gcgaaccauccaguaaauccgcuagcaguaccagcagcuuuuuuaugagagaguucugcugcugcuagaccgaucaucauuugagggccgu

SEQ ID NO: 4225768 - RNA, 68 nt, Chlamydophila pneumoniae AR39
uagaaguauuaagccaagauuuuauuugugcugcuaaagcucgaggauugcguugguuugauauucua

SEQ ID NO: 4225769 - RNA, 63 nt, Chlamydophila pneumoniae AR39
cgaagauucuuuuaguggauuggucguguuuucaacaacuucagucucuagaggagcucuuug

SEQ ID NO: 4225770 - RNA, 57 nt, Chlamydophila pneumoniae AR39
auaggaauccuuagcuucuugauaggucauuuuagccaaaggcaaaggaaucucuau

SEQ ID NO: 4225771 - RNA, 84 nt, Chlamydophila pneumoniae AR39
gauucuaugucuucuugcuacgcuuucuuguuucccgggaucauaaaaaaacuaggacgauaaaguguguguaggauuagaauu

SEQ ID NO: 4225772 - RNA, 62 nt, Chlamydophila pneumoniae AR39
aagacgaugaagcauuugcucuuugggaagcauaucuuccuacagaucguauuuuccgucuu

SEQ ID NO: 4225773 - RNA, 126 nt, Chlamydophila pneumoniae AR39
cugggcuuuauuuucguagcucuaagaaguucuacaauuccuauagcucaagauguggcuuauguuuuagcugcucuuguaggggcuuguaucggauucuuaugguauaaugguuucccggcccag

SEQ ID NO: 4225774 - RNA, 91 nt, Chlamydophila pneumoniae AR39
gucuuacaaccauuuuuaaauacgauggucguuccgucuugaaagccauaacgccacuccucuaucguauuggggaugccaccuuguagau

SEQ ID NO: 4225775 - RNA, 55 nt, Chlamydophila pneumoniae AR39
gaagcucaggaucugucaguucugaacagagggaauugaucucaucacuaguuuc

SEQ ID NO: 4225776 - RNA, 67 nt, Chlamydophila pneumoniae AR39
gauacauauuggagaguuuuuuaccaucuggcucagcaagauacagauuuagagaaacucccauauc

SEQ ID NO: 4225777 - RNA, 55 nt, Chlamydophila pneumoniae AR39
uugagacaaagaauccccccuucuaauacuuuaggaggggggauucuguuuacag

SEQ ID NO: 4225778 - RNA, 71 nt, Chlamydophila pneumoniae AR39
aucgcuuguuauuaggagcuauuugugucauugcaguaaaugcagguggugcauggacuccucuaggugau

SEQ ID NO: 4225779 - RNA, 61 nt, Chlamydophila pneumoniae AR39
ggcaaaucuuugacucuaccgccuuggaucaacacaaugcugugcucuugaagauuguguc

SEQ ID NO: 4225780 - RNA, 55 nt, Chlamydophila pneumoniae AR39
gaaagaugacgaccgcccuuuaaucuuccuaauuggaggagcagguucaucuuuu

SEQ ID NO: 4225781 - RNA, 107 nt, Chlamydophila pneumoniae AR39
acuguaaauaccuuuuuaucgccaggucucaugucuccuaaguuaaaagagagaacucuuugaccagaugcaugagaauagccaucgggaacaggauuaucuacagu

SEQ ID NO: 4225782 - RNA, 63 nt, Chlamydophila pneumoniae AR39
ugagugagguucugauugaaucgugucucuugguauuggguuuguucuuucaggagcuccuca

SEQ ID NO: 4225783 - RNA, 59 nt, Chlamydophila pneumoniae AR39
cagguucauccaagauaucggaaugaagguuuacugaagccuuaucuaggaagagcuug

SEQ ID NO: 4225784 - RNA, 60 nt, Chlamydophila pneumoniae AR39
uuagagaggggaagaaaaauagccauggguaguaaucuauagcauugauucccucuuuaa

SEQ ID NO: 4225785 - RNA, 66 nt, Chlamydophila pneumoniae AR39
gaugguuuaggagguucuguuuuuauaacuuuuggaauggguuuuuguagagccuucuggacguuc

SEQ ID NO: 4225786 - RNA, 66 nt, Chlamydophila pneumoniae AR39
uuuccagagcccgagguacuacaaggcgagcuuaccucucuuguaggaauugacgggcaagggaaa

SEQ ID NO: 4225787 - RNA, 56 nt, Chlamydophila pneumoniae AR39
uagcaaguaugcgauacgcaauaguguuuccaucuauaguaaguucaugcuuguua

SEQ ID NO: 4225788 - RNA, 87 nt, Chlamydophila pneumoniae AR39
acauucaugagcacuucuccccauuucccuacgaggaugucgaggacaccagcuguagagggauuggggauguucgcuaguugaugu

SEQ ID NO: 4225789 - RNA, 101 nt, Chlamydophila pneumoniae CWL029
gucagaguauauggaaaagcauuccauuuccaagcuuauaggaucuucuccaggguauguggguuaugaggaaggugggagucuuucugaggcucuucgac

SEQ ID NO: 4225790 - RNA, 58 nt, Chlamydophila pneumoniae CWL029
aguccgcuuuaguaaaaauaagaccggaaauuauuccgcuccuauuaccaaagcggcu

SEQ ID NO: 4225791 - RNA, 60 nt, Chlamydophila pneumoniae CWL029
gucuuuuucaugagaaaagggaugcguucucgagaguccccuuucucaugaaaauaggau

SEQ ID NO: 4225792 - RNA, 85 nt, Chlamydophila pneumoniae CWL029
aaugguagguuucgcucguaugggacuugccuaucgucagugucuuggcgauucuaagauuccuacgaucggauugcuuaauauu

SEQ ID NO: 4225793 - RNA, 57 nt, Chlamydophila pneumoniae CWL029
guucuuuauuauacuccugacauguuaugcaggucuggguugguaugaugauagaau

SEQ ID NO: 4225794 - RNA, 76 nt, Chlamydophila pneumoniae CWL029
uuguaggugcuggaggugcugcuaaagcaaucgcugcaacacuggcgaugcaaggugcuaaucuccacaucuucaa

SEQ ID NO: 4225795 - RNA, 76 nt, Chlamydophila pneumoniae CWL029
aaggaguuuuuagaugcucgugcucaggguuuagaucgggaacuuacugagugucaggagcuuuugaaagcggcuu

SEQ ID NO: 4225796 - RNA, 65 nt, Chlamydophila pneumoniae CWL029
augaucaauaaguccagcgacuuaauccuugcucuuuggaugaugggcguugucuuaaugaucau

SEQ ID NO: 4225797 - RNA, 67 nt, Chlamydophila pneumoniae CWL029
ggugcucugguggucccuuauguugggugauucucaacauccuagcauuuauuauuacuucaguacu

SEQ ID NO: 4225798 - RNA, 82 nt, Chlamydophila pneumoniae CWL029
ucaauauucuuuccggcaacauuaauuuauuuagaaaauccccaaugggauuucuaauuauuguuuuggaaggggaaguuga

SEQ ID NO: 4225799 - RNA, 94 nt, Chlamydophila pneumoniae CWL029
uuccuauagacguucagcuuugggauguagauuucuauguguuuucgucacauaagauuuauggacccacgggcauaggagucuuauaugggaa

SEQ ID NO: 4225800 - RNA, 58 nt, Chlamydophila pneumoniae CWL029
cguucuccucccagcaauuucucguuguguacagcgagaagaucaugagaggggauug

SEQ ID NO: 4225801 - RNA, 82 nt, Chlamydophila pneumoniae CWL029
gcgugcaauuauuuuuuauugaagugguagccuucgguuucccuuaggcuagcaauuucaaugagaaguacuuaagcuaggc

SEQ ID NO: 4225802 - RNA, 70 nt, Chlamydophila pneumoniae CWL029
cccuucaguaagaacuucguuucagcaccguguaauggcggcacuagauaauugguuuuuucuaggaggg

SEQ ID NO: 4225803 - RNA, 64 nt, Chlamydophila pneumoniae CWL029
gggacaucuugcguaaucaagcacaguaucuuauaggagucuguuacuucacgcaggaucaccc

SEQ ID NO: 4225804 - RNA, 82 nt, Chlamydophila pneumoniae CWL029
uacuauaggggauaacaauaccuugaguuacaaacucucuuugauguuugcucuuaagauguauugcaaugucaucauggua

SEQ ID NO: 4225805 - RNA, 101 nt, Chlamydophila pneumoniae CWL029
gugauugcuagagacauugauaugaggaggaagaaucggaaugcccauacucugagcuucucgaaucaguuuuccuaucuucucaauaucgucagaaucac

SEQ ID NO: 4225806 - RNA, 70 nt, Chlamydophila pneumoniae CWL029
uucgugagggagaugcagauuuagaucauggugucauucgccaaguuaaagucuacguugccucuaagag

SEQ ID NO: 4225807 - RNA, 110 nt, Chlamydophila pneumoniae CWL029
gaaaagacaagugacggguaggaucuuagaauguuguaggucucgggucuuuuuuucaccuggauucuuuaauuuucugaaagauuauaggaacucuucuuuuguauuuc

SEQ ID NO: 4225808 - RNA, 70 nt, Chlamydophila pneumoniae CWL029
aggaguucugcaagagucuaagcaagguucuaccaaagauccugauggaacuuuuguuuccuuuacuccu

SEQ ID NO: 4225809 - RNA, 90 nt, Chlamydophila pneumoniae CWL029
uuucuucuucuacauuagacuugugcuuuuuuagcguuggcugaacaacuucagcaaggcuuuguaaaacguucaaaucagaagaagaaa

SEQ ID NO: 4225810 - RNA, 58 nt, Chlamydophila pneumoniae CWL029
uccuuuggaguaacggagacccucugacagcucaagacuuugucuccucuuggaagga

SEQ ID NO: 4225811 - RNA, 67 nt, Chlamydophila pneumoniae CWL029
gaguuggggaaggauaguuucucuaugauaguagugcccuuuaucuuggacuaucuuauuguaacuu

SEQ ID NO: 4225812 - RNA, 73 nt, Chlamydophila pneumoniae CWL029
cgaggcauuccgaagaauucccuccuuccccucucucugaagaaggagagggcgaagaauuccuuccuccuug

SEQ ID NO: 4225813 - RNA, 61 nt, Chlamydophila pneumoniae CWL029
augcaaggugaacaagaucuucugguuucuaucaaccacagaacacuguuuaccgaagcau

SEQ ID NO: 4225814 - RNA, 62 nt, Chlamydophila pneumoniae CWL029
uuugugauuccucgagcgagacguacugcagucauuguugcuuccguucccgaggauacaaa

SEQ ID NO: 4225815 - RNA, 94 nt, Chlamydophila pneumoniae CWL029
gucuucuagagggcguuuuccuguaguuuuaccuuuaagugugauuucuccuaggucgcaccccggaaggguagaaaggcgggauuuagaagau

SEQ ID NO: 4225816 - RNA, 61 nt, Chlamydophila pneumoniae CWL029; identical to SEQ ID NO: 4225753

SEQ ID NO: 4225817 - RNA, 130 nt, Chlamydophila pneumoniae CWL029
agaacguccaggcauauaguuagauucuaaucucccaccucuuucuucaugcaucaaucuagaggcaauacuuagagccucuggguucugcuggggauugagaacuagagcuaccucaugucccccuucu

SEQ ID NO: 4225818 - RNA, 72 nt, Chlamydophila pneumoniae CWL029
caucucuugaaugacgcguaggucugccuuauugucuaauagauguguagcaaaggcgugucguaaggagug

SEQ ID NO: 4225819 - RNA, 68 nt, Chlamydophila pneumoniae CWL029; identical to SEQ ID NO: 4225750

SEQ ID NO: 4225820 - RNA, 56 nt, Chlamydophila pneumoniae CWL029
gucugcgucuuuaauuaaaaguucagcaaagaaguuauaauuuagacgacguagau

SEQ ID NO: 4225821 - RNA, 118 nt, Chlamydophila pneumoniae CWL029
gcggagggaaucaagugagucuauaucaaaaaugguggaacagucaguuaaagaagagccucugcuauucgacuguugcugcucuaauauuuaugauuccuucucaagaauccuuugc

SEQ ID NO: 4225822 - RNA, 65 nt, Chlamydophila pneumoniae CWL029
ggggacucuucacugucugaaguuccauguucgucuuuguaggauaguauagugaggagaucuuc

SEQ ID NO: 4225823 - RNA, 67 nt, Chlamydophila pneumoniae CWL029
gacauuaggaucgcgagacaucucuucgucaauugcuucucggagagcuucucgaauuucuaauguu

SEQ ID NO: 4225824 - RNA, 57 nt, Chlamydophila pneumoniae CWL029
ccuguaucuucgacaacaugguuauuagucacaauauagccaucuggagauacuagg

SEQ ID NO: 4225825 - RNA, 62 nt, Chlamydophila pneumoniae CWL029
aguuucauuuaaagaguccgaagccuucauuccaugagggucggauuuagauuaaagagacu

SEQ ID NO: 4225826 - RNA, 56 nt, Chlamydophila pneumoniae CWL029
cgacuuagaucuuuucuacuucaggaaauaauuuguuuagaaaaagaucuaagucg

SEQ ID NO: 4225827 - RNA, 88 nt, Chlamydophila pneumoniae CWL029
cucccugcaauuuuaaagaggcaaugagcuuguguguggagauucccuuuucuaaagcugcauagcuuuccuguaaaauugcauggag

SEQ ID NO: 4225828 - RNA, 63 nt, Chlamydophila pneumoniae CWL029
agguuuuucuauaaugacacgggaccaggguuucccuuggucuugauuuuuauagaaaagcuu

SEQ ID NO: 4225829 - RNA, 84 nt, Chlamydophila pneumoniae CWL029
gcgguuuuucuuagaggcucuuccagcaaaacagauggcuuuagauucugaucuuguuucuggaagagcuucuuauaaggcugu

SEQ ID NO: 4225830 - RNA, 73 nt, Chlamydophila pneumoniae CWL029
ugugauuaucuguggagaccagcugaccaaucacauuccgauuuguauuucuaaagacuccacaaugauuaca

SEQ ID NO: 4225831 - RNA, 80 nt, Chlamydophila pneumoniae CWL029
acguauucaauauuugcuuuagaacaugcccacaaacuucuaacgguguugcgcauguucuagagcauaugguccuuugu

SEQ ID NO: 4225832 - RNA, 60 nt, Chlamydophila pneumoniae CWL029
agaguuacaggcuguaguagcuucgaaguaagauuuuuagaaucugcggccucugucucu

SEQ ID NO: 4225833 - RNA, 79 nt, Chlamydophila pneumoniae CWL029
guguuuucuuaggaaguuuacucuugauuuuggggcugauuuucuuugucucuuaucaccggaaacuuucagaagccac

SEQ ID NO: 4225834 - RNA, 62 nt, Chlamydophila pneumoniae CWL029
cugagaaaagaggucuuuacagagaucuuuuaucugaacuuugguuucuauuuuuuucucag

SEQ ID NO: 4225835 - RNA, 64 nt, Chlamydophila pneumoniae CWL029
gucuugugcaggucaugagcuugccggcguucuugcugguaaaagucucauuccugguaaagac

SEQ ID NO: 4225836 - RNA, 102 nt, Chlamydophila pneumoniae CWL029
auguuacgaaauuauuuuguuauaauucaaugauuugauugugcggauuaacaaucauucuacuucaacucguugauugugaaucuuauguguuuuuaauau

SEQ ID NO: 4225837 - RNA, 69 nt, Chlamydophila pneumoniae CWL029
ccaucaacauggaugccgaacugcuccgcaugcuuaaugugagauacaacauuggcuccagcaaugagg

SEQ ID NO: 4225838 - RNA, 59 nt, Chlamydophila pneumoniae CWL029
ugcuagaggaagagguugaccugcaaguuuacuugcagcacguaccuuuucugcuacca

SEQ ID NO: 4225839 - RNA, 63 nt, Chlamydophila pneumoniae CWL029
cugccauuuucauucuuuuuucuaaaagagucuuaauuuuaggauggggaugaaaauugucag

SEQ ID NO: 4225840 - RNA, 84 nt, Chlamydophila pneumoniae CWL029
gucugcugcuugauguaugcgagcaaugaccucauccuuauuuucaaguguagggguuuugcugguaacaagaccuaagcagac

SEQ ID NO: 4225841 - RNA, 58 nt, Chlamydophila pneumoniae CWL029
aaugguuucuagaaccacggagaaccugucgagaggcaccucuuggucugugaccauu

SEQ ID NO: 4225842 - RNA, 84 nt, Chlamydophila pneumoniae CWL029
auaauaauagccaauaaggagaucgucauuaagauugcaguaaccacuagaacuccuguacgagcuccuuuugugcuuuguugu

SEQ ID NO: 4225843 - RNA, 70 nt, Chlamydophila pneumoniae CWL029
ucuaaaagucucugaugguugauguacagagaguuauaguuuucuguugcagaaauuauaggaucauaga

SEQ ID NO: 4225844 - RNA, 70 nt, Chlamydophila pneumoniae CWL029
gcucccuuuaaugguaccuauugugcaucuccaaauauggagauucucuaugauauacuauggagugagu

SEQ ID NO: 4225845 - RNA, 55 nt, Chlamydophila pneumoniae CWL029; identical to SEQ ID NO: 4225775

SEQ ID NO: 4225846 - RNA, 88 nt, Chlamydophila pneumoniae CWL029
cagcagaacuauccgaguaucuugagaagcaggcacaaccauuuuuuucugccgcuacccaucaagauucucaaggagagcuucccug

SEQ ID NO: 4225847 - RNA, 76 nt, Chlamydophila pneumoniae CWL029
acagagaguuguugccuuuagaauauaaggcgccgccugucuuugcuguauuugugcugaaggucacgguuccugu

SEQ ID NO: 4225848 - RNA, 59 nt, Chlamydophila pneumoniae CWL029
gauuaaagaauaguucugaauucgaaacgauuaucucgaguuuaggaucuuuuuaaauc

SEQ ID NO: 4225849 - RNA, 80 nt, Chlamydophila pneumoniae CWL029
auguuccugauuaugcuauggaagugauucaagaugaaauugaaaaacuucagacuuuagaaacuucuucggcggaauau

SEQ ID NO: 4225850 - RNA, 61 nt, Chlamydophila pneumoniae CWL029
ucauucacuacagacaugaaagaagcgauccacaaugcuuucaugauuguagaaggaguga

SEQ ID NO: 4225851 - RNA, 60 nt, Chlamydophila pneumoniae CWL029
aacauuuuccacugagaaguugguaguaaaaauucucuagcuuaucaauaaggagauguu

SEQ ID NO: 4225852 - RNA, 57 nt, Chlamydophila pneumoniae CWL029; identical to SEQ ID NO: 4225770

SEQ ID NO: 4225853 - RNA, 61 nt, Chlamydophila pneumoniae CWL029
ggauauuccaaaggacugauggucuggaagauauugcagagcgcacgccuauugguuaucu

SEQ ID NO: 4225854 - RNA, 65 nt, Chlamydophila pneumoniae CWL029
guugccuccauauagccgcauuggaauucuguaauuuggaucagcuguuguaugguaacuguggc

SEQ ID NO: 4225855 - RNA, 61 nt, Chlamydophila pneumoniae CWL029
ggcuguuuuuguaaguagauugcuuuagagaauaccaaugcgguucccuauaaagacggcu

SEQ ID NO: 4225856 - RNA, 77 nt, Chlamydophila pneumoniae CWL029
cuauagugccauuagggaaaaaagguguaacaguugcuguaaguaaaugcaugauucucccuacguggcgacuauag

SEQ ID NO: 4225857 - RNA, 84 nt, Chlamydophila pneumoniae CWL029
uagaauguucuaagugccauaaaggaaaacuaguaaaaaucuggucuaaaaacaguuauuucuauggcugcucagaauauccug

SEQ ID NO: 4225858 - RNA, 63 nt, Chlamydophila pneumoniae CWL029; identical to SEQ ID NO: 4225782

SEQ ID NO: 4225859 - RNA, 67 nt, Chlamydophila pneumoniae CWL029
gaucgcucgaaucaugaaagccgagagcgcuuuuggugcucaguuugauucucuuucugaugcgguc

SEQ ID NO: 4225860 - RNA, 63 nt, Chlamydophila pneumoniae CWL029
gacuuggguaacuacgggcuacaacccuaauccugagcguagagcuuccguaguucccgauuc

SEQ ID NO: 4225861 - RNA, 118 nt, Chlamydophila pneumoniae CWL029
augagggaaucaguuacuuggucgucucuggaauuuuauauuuucuuuccuauaagcguuauuugcauuuagguaagggauaugugacuucuauagccuguauuucugucgcuuucau

SEQ ID NO: 4225862 - RNA, 66 nt, Chlamydophila pneumoniae CWL029
uggaugggaaucuugaagaguuguuguggaaucacguccacaagcuuuucgcagauacuucuucca

SEQ ID NO: 4225863 - RNA, 68 nt, Chlamydophila pneumoniae CWL029
ucuuacgguauccguauaauuugaugucacguaguauguaucaaacuauagaggaugcugcuaauaga

SEQ ID NO: 4225864 - RNA, 62 nt, Chlamydophila pneumoniae CWL029
ccuagaauuuaauccuaaugauaggccugacauuuuuggauugcuuugggauugaaguuagg

SEQ ID NO: 4225865 - RNA, 59 nt, Chlamydophila pneumoniae CWL029
ucagcuaucaauaaagcuaaagaaaucauugaagguuuaguuggagaaguugaaguugg

SEQ ID NO: 4225866 - RNA, 109 nt, Chlamydophila pneumoniae CWL029
aacuguaaauaccuuuuuaucgccaggucucaugucuccuaaguuaaaagagagaacucuuugaccagaugcaugagaauagccaucgggaacaggauuaucuacaguu

SEQ ID NO: 4225867 - RNA, 59 nt, Chlamydophila pneumoniae CWL029
ugaagagaucgaagcgauacuuaaggaauauccugauaucuaugcagcagauuucuuca

SEQ ID NO: 4225868 - RNA, 85 nt, Chlamydophila pneumoniae CWL029
gcuagaaucaugaauucugaaacgacuuguuuccaugcgagagagaagcuuucuaugccaggauguuucagacccuaaugcuagu

SEQ ID NO: 4225869 - RNA, 59 nt, Chlamydophila pneumoniae CWL029
cauuuaaaccaaucggaagagagaggguggugaacgcuaacuuuuccaugguguaaaug

SEQ ID NO: 4225870 - RNA, 60 nt, Chlamydophila pneumoniae CWL029; identical to SEQ ID NO: 4225784

SEQ ID NO: 4225871 - RNA, 62 nt, Chlamydophila pneumoniae CWL029
gcuucgaguaguuauaggagagcagcuccucaaguuuagguugucccggggcuacuugaggc

SEQ ID NO: 4225872 - RNA, 81 nt, Chlamydophila pneumoniae CWL029
gcucuugguuggcauuuuggaaagaguuuaccuuaacagaagaggugagauacccuucaaaauaguugucauuccaagugc

SEQ ID NO: 4225873 - RNA, 68 nt, Chlamydophila pneumoniae CWL029
aauuaagauuugccgaugaaccaguacgacauaaaauacuggaucugauuggagaucuuuccuuaguu

SEQ ID NO: 4225874 - RNA, 69 nt, Chlamydophila pneumoniae CWL029
ugacugcugccgauagaacuugauuuguacccgccccaucucgacucauuguucuauuggcugcguuua

SEQ ID NO: 4225875 - RNA, 70 nt, Chlamydophila pneumoniae CWL029
ugcagacuuuauugcugaaggguuggaucagacgcgaggaugguuuuauacucucacagugauuucugca

SEQ ID NO: 4225876 - RNA, 97 nt, Chlamydophila pneumoniae CWL029
uauuguaagccaugggaaccauauacugagcuuccucagggaacuccugaacaaucucauuauagguuucauucgcccucuccauagcuucucgaua

SEQ ID NO: 4225877 - RNA, 72 nt, Chlamydophila pneumoniae CWL029
uguuuccgaacauacaguucugcaauggcuuaaagaaggagccauuccaagcuauaguaugaauaaugaaua

SEQ ID NO: 4225878 - RNA, 63 nt, Chlamydophila pneumoniae CWL029
cuguagcuacgucuuuucauaauaaugugaauuacgguccguuagaguugacuguaguuacag

SEQ ID NO: 4225879 - RNA, 65 nt, Chlamydophila pneumoniae CWL029
ggauagggaaaucgcugcaaaggcuucguuuacuaaugcaaagcuggaaguuagauucccuguuu

SEQ ID NO: 4225880 - RNA, 68 nt, Chlamydophila pneumoniae CWL029
aggaaaagucgcgaagcguuauauugccgcacacccucaagcaucaguaacucucgucgacuuuuccu

SEQ ID NO: 4225881 - RNA, 112 nt, Chlamydophila pneumoniae CWL029
uccuucuagcgcuguacaagagacuaagacuucaccuguugcagucuuuaauauuccagaggcuguggaaacuguugagcugucuucuuuuagaguuauauuugcagaggga

SEQ ID NO: 4225882 - RNA, 55 nt, Chlamydophila pneumoniae CWL029
agugucuuuuguaucgcguaacaccguauaguuaaauguaauacagaagaacauu

SEQ ID NO: 4225883 - RNA, 64 nt, Chlamydophila pneumoniae CWL029
uuguuauugaaucagaacugcacaagggucucggaccuguugcgacuguuuugauucaaaaugg

SEQ ID NO: 4225884 - RNA, 87 nt, Chlamydophila pneumoniae CWL029
agaccagggagaccuacuuauuguucuuggugaaucuguauuuaaaaauacuauacaccaagaacaauaaguaggucucccuggucu

SEQ ID NO: 4225885 - RNA, 62 nt, Chlamydophila pneumoniae CWL029; identical to SEQ ID NO: 4225772

SEQ ID NO: 4225886 - RNA, 62 nt, Chlamydophila pneumoniae CWL029
cccaaccaggaugcgucucuguccaaagagaaaauugugagugaaugacaucuugaguaggg

SEQ ID NO: 4225887 - RNA, 61 nt, Chlamydophila pneumoniae CWL029
uccguggcucuaguuaucggguuuuucuucgaaugguuaaucacgguuccuggaguaugga

SEQ ID NO: 4225888 - RNA, 78 nt, Chlamydophila pneumoniae CWL029
acucuugcuccuaucgaucaagggggaggacagccuccaaaacaugagcuccuuucucuuauugaaagauuuuggggu

SEQ ID NO: 4225889 - RNA, 73 nt, Chlamydophila pneumoniae CWL029
ucuccaggauuuuucguccuuacagauccaucaaagggaucuauaaggcauaaggaaaagucuguauuggaga

SEQ ID NO: 4225890 - RNA, 116 nt, Chlamydophila pneumoniae CWL029
ucuggcaaugauggugaccguaauacgauaucagauccuuuagaagaaagugccgcagaagagggggauucagauuuagaggaucggguaucggaaagugcuacccaagugauaga

SEQ ID NO: 4225891 - RNA, 72 nt, Chlamydophila pneumoniae CWL029
gaaaaguaaauguguauggaauugugagguuuuuagugaggaaaaaauuuuaucuauagcacuuugcuguuc

SEQ ID NO: 4225892 - RNA, 78 nt, Chlamydophila pneumoniae CWL029
aggccaaaaguuguaaaauuauucaguagggucagugaaaacauggugcgcugcucaugcuuuuccaauaccacgccu

SEQ ID NO: 4225893 - RNA, 63 nt, Chlamydophila pneumoniae CWL029
ggcaguccaccuuugccacguauagcuauaauuuuuagcauaacgcaaaugaggucgacuucc

SEQ ID NO: 4225894 - RNA, 61 nt, Chlamydophila pneumoniae CWL029
agaagcucuuccagaaacaagaucagaaucuaaagccaucuguuuugcuggaagagccucu

SEQ ID NO: 4225895 - RNA, 64 nt, Chlamydophila pneumoniae CWL029
gacaauugugaaugcuauuuuguaaaacuuaucguaguuuugucguagcguuccauaagaaguu

SEQ ID NO: 4225896 - RNA, 68 nt, Chlamydophila pneumoniae CWL029; identical to SEQ ID NO: 4225768

SEQ ID NO: 4225897 - RNA, 85 nt, Chlamydophila pneumoniae CWL029
ccuagauaagcagaauucccuuuggauccagaagcuaaagggaaaaaaccuugcaugcuaaccuuccagaggauucuguaucagg

SEQ ID NO: 4225898 - RNA, 61 nt, Chlamydophila pneumoniae CWL029
ucaaaggaggcgaagucaaaagugagcauuagcgaauguccuuuugagguucguucuuugg

SEQ ID NO: 4225899 - RNA, 65 nt, Chlamydophila pneumoniae CWL029
auacgaaguuuccucauggauuguggaugucccucguccaagagauacguaggaagagaacguau

SEQ ID NO: 4225900 - RNA, 95 nt, Chlamydophila pneumoniae CWL029
gagacugucugcacugugagagcgaucucuggaacaagaagaauuguacuuuucccuuguuuaagagccucgcuuguugcucgaagauagaucuc

SEQ ID NO: 4225901 - RNA, 56 nt, Chlamydophila pneumoniae CWL029
caaggcagguaucuccuugauaaaacgcuauuguuuguccuggaguuaccgccuug

SEQ ID NO: 4225902 - RNA, 55 nt, Chlamydophila pneumoniae CWL029
aauuggauaggguuucuugaggaaugcguucuccccaaggagguccuugccaauu

SEQ ID NO: 4225903 - RNA, 55 nt, Chlamydophila pneumoniae CWL029; identical to SEQ ID NO: 4225780

SEQ ID NO: 4225904 - RNA, 107 nt, Chlamydophila pneumoniae CWL029
gucucugcuucuuuacgucuauauaguucuucagcaaagauauauacgcuguuuugugaaauaucuuggggggagcuaauggcacuuaugguaaggaaggaagagau

SEQ ID NO: 4225905 - RNA, 59 nt, Chlamydophila pneumoniae CWL029
uuuuccaaaagcauauaacuuucaggauacagaacccgaguuguauguguuuugggaaa

SEQ ID NO: 4225906 - RNA, 60 nt, Chlamydophila pneumoniae CWL029
aaggcuaucgauuugauagaugaagcggcaaguuuaauucgcaugcaaauugguagucuu

SEQ ID NO: 4225907 - RNA, 76 nt, Chlamydophila pneumoniae CWL029
ucuguuguucuucuggaguggcuuuaacgauagccgagaagauggcuucuuuagagcacucggggagaggagcaga

SEQ ID NO: 4225908 - RNA, 128 nt, Chlamydophila pneumoniae CWL029
uccuugucacacucugcagcaucuuuaacagcguuuuguaccucagccugcaauaaagcuuucuuaaguuuuaaugucggaagguacguuuguaaucgugcuaguuuuuguuuuucuagucgaaagga

SEQ ID NO: 4225909 - RNA, 69 nt, Chlamydophila pneumoniae CWL029
ugauaaugagggggaguguuuuggagaaccuauagagauugcuacuccaacauuuaacccugucugucg

SEQ ID NO: 4225910 - RNA, 69 nt, Chlamydophila pneumoniae CWL029
gagcuugagaguauagggguguuucggagagaggaaaaucucuucaacgguuccuguuucuaugaguuu

SEQ ID NO: 4225911 - RNA, 57 nt, Chlamydophila pneumoniae CWL029
cauucuuuaaccaagggaaucuuuauaucauggauucuccuguauuuauaaagaaug

SEQ ID NO: 4225912 - RNA, 60 nt, Chlamydophila pneumoniae CWL029
gcagggcuugauagagcgucucuucagaauggugaagagugcccuuaagaagcuuucugc

SEQ ID NO: 4225913 - RNA, 90 nt, Chlamydophila pneumoniae CWL029
auuagcgauauguucuaaagauucccugugucuuugugcaaaagaaugcauugaagacacuagagagaguuuuuuauaaaauguugaaau

SEQ ID NO: 4225914 - RNA, 78 nt, Chlamydophila pneumoniae CWL029
cgauuuucuaagugcaucaucuuauauaauggaguggcucccccuugccauucaguauaagauugagcaagauuauug

SEQ ID NO: 4225915 - RNA, 61 nt, Chlamydophila pneumoniae CWL029; identical to SEQ ID NO: 4225779

SEQ ID NO: 4225916 - RNA, 116 nt, Chlamydophila pneumoniae CWL029
ucgagcuuuuucuaggcgauuugcguagguaucgguaucuauaaauuccaagggaucuugggauuucagauccguauaaagaggacgccaagaaucuuugucugcaagcagcuuga

SEQ ID NO: 4225917 - RNA, 107 nt, Chlamydophila pneumoniae CWL029
cagguuaugaaacgcuuucuugcuuacuucaaaugcuugcuuaggaucguuguuacacuuagcagcuucgggaccaagcaguugugcuaagaagugugcuuugccug

SEQ ID NO: 4225918 - RNA, 82 nt, Chlamydophila pneumoniae CWL029
ggacguguagcucuacccaaaaucuuagauagccuucuuaucuaugauuuuaguggguagagcuuucccucccgacucgucu

SEQ ID NO: 4225919 - RNA, 59 nt, Chlamydophila pneumoniae CWL029
ggacuuuuauuuagaucguguugaaggguuuauucucuacauagauuuagauaaagacc

SEQ ID NO: 4225920 - RNA, 72 nt, Chlamydophila pneumoniae CWL029
gguuuaugaucauuuaucucggaguucuugcgcaacuuugcgcaugaggaauaagauaguaaucauaaaacc

SEQ ID NO: 4225921 - RNA, 65 nt, Chlamydophila pneumoniae CWL029
uuauaauaauagcagcuacuaagagaaguggggauuccuuuuuucuuaguagcugcuacguauag

SEQ ID NO: 4225922 - RNA, 60 nt, Chlamydophila pneumoniae CWL029
uagaaggagagaguaaggaagaugguuaucuaaaccacggauccuuauuuguucuuucug

SEQ ID NO: 4225923 - RNA, 80 nt, Chlamydophila pneumoniae CWL029
cuucuacggacuugccuuucucaacuagauuacgaagagcuauuuucuucguggacuuguuggggaagaucuacgagagg

SEQ ID NO: 4225924 - RNA, 57 nt, Chlamydophila pneumoniae CWL029
aucccacucauaggaauucccugucguuguguuaaaguaaguuccaaauguugggau

SEQ ID NO: 4225925 - RNA, 63 nt, Chlamydophila pneumoniae CWL029
agugauggucaguuuucugaagaaaguaaaacaagcuaucuuagagcgaugcugaccgacauu

SEQ ID NO: 4225926 - RNA, 71 nt, Chlamydophila pneumoniae CWL029
guucaagagagaguugcgcaagucgccgguguuguugaggaagauccggauuuugugcgauuuucuugaac

SEQ ID NO: 4225927 - RNA, 56 nt, Chlamydophila pneumoniae CWL029
guuucuucggauuuguuuacagagcacuuagucucugcuauccguucaggagaaau

SEQ ID NO: 4225928 - RNA, 63 nt, Chlamydophila pneumoniae CWL029
aggagauccuacaauugccauuacugccuuuagauaaggugcuuuuaauuguggaaucugccu

SEQ ID NO: 4225929 - RNA, 70 nt, Chlamydophila pneumoniae CWL029
ucuguuuuuuucucuuccuaaccaauauccggauauuggguuauuaucuuaugaagaagaagagaacgga

SEQ ID NO: 4225930 - RNA, 88 nt, Chlamydophila pneumoniae CWL029
uuuugacauuuuauugccgucuucugcaagaauaaucccauucacaauggcauuacgaaaugcaggacgaucaaauaaaauugcagaa

SEQ ID NO: 4225931 - RNA, 56 nt, Chlamydophila pneumoniae CWL029
guaguuucugcagggcacucucaugaacuuuguggaggcacgcaugcggaagcuac

SEQ ID NO: 4225932 - RNA, 66 nt, Chlamydophila pneumoniae CWL029
uugguuagaccuauuucuuguuuugggacuauguaaaucuaaaggggaaauucgaaggcuaauuga

SEQ ID NO: 4225933 - RNA, 96 nt, Chlamydophila pneumoniae CWL029
agugucuuugagaugaaguuugaugcgacagaaaaacuagggaauaaaguacuuucugauguaacgaaccgucuugagauuuuaugugaagaugcu

SEQ ID NO: 4225934 - RNA, 72 nt, Chlamydophila pneumoniae CWL029
gugggcacgauaggguagaugucaaaagacaagggauauccucagcuuuuaaagcaucugcuacugccauac

SEQ ID NO: 4225935 - RNA, 80 nt, Chlamydophila pneumoniae CWL029
gcucuugauaacgaagaguuuuuuaugacucaugcgaaacaguguuuagcccaagucggagaaagcuuauuucaggaugc

SEQ ID NO: 4225936 - RNA, 128 nt, Chlamydophila pneumoniae CWL029
gcaggaucuuucauucuuacccuguuuguuggaggauuggcuauucucuuugguauaggaacagcuucucuuuuccauaccaaagaagugguuccuuuagaaaauauugauuaucaagaagaucuugc

SEQ ID NO: 4225937 - RNA, 97 nt, Chlamydophila pneumoniae CWL029
gagcaacaaaauuuaguccauaauacuucauauauuuuagcuucaaccucggugagguuaggauauuucggagauucauauagagauuaugaugcuc

SEQ ID NO: 4225938 - RNA, 67 nt, Chlamydophila pneumoniae CWL029
agagucuucacuucccgcaguuuuagaguuuacaaucuugaaugaggacugugggcaggaggaauuu

SEQ ID NO: 4225939 - RNA, 64 nt, Chlamydophila pneumoniae CWL029
aucgagaggaauuuuugcguaauguuccagagucuuuagggggauuagugaaaguuccugcggu

SEQ ID NO: 4225940 - RNA, 120 nt, Chlamydophila pneumoniae CWL029
uuuuauauugcuuagacucgacuuuggcucaacuuucuuuuaaagaacaucacgauaguuucgucgcggugauacaaaagagaguguggaauaaagaagauuuuuugauccaacguaaaa

SEQ ID NO: 4225941 - RNA, 70 nt, Chlamydophila pneumoniae CWL029
ggguauaacauucgcgacuuucuugaccuguauuuuuaguauagccauaagucucuggauaguaauaccc

SEQ ID NO: 4225942 - RNA, 58 nt, Chlamydophila pneumoniae CWL029
uuguaggguuauuguccucugugaaaggagcacuagauuguagaggacggauccacaa

SEQ ID NO: 4225943 - RNA, 56 nt, Chlamydophila pneumoniae CWL029
ugaugcuacgaucacuuaagaaaaccgcaaucuucuugaguaucuucguaguuuca

SEQ ID NO: 4225944 - RNA, 63 nt, Chlamydophila pneumoniae CWL029
agagaaaugagggagucuucugaucaagggaaacguaggauugguagacucacacguuuguuu

SEQ ID NO: 4225945 - RNA, 109 nt, Chlamydophila pneumoniae CWL029
ucuccuuauuuugaaaagguuucuuucccuguuguaggaacgguagcuaucaacacucuaguuucugugcgucuugauaggguagaggaagaagggcugauuggggaga

SEQ ID NO: 4225946 - RNA, 105 nt, Chlamydophila pneumoniae CWL029
agcgcaguugguguaggaugauagggagaagaguuaaaauaaugacgccuguuaaagcuaaggcugucgcuauuacgauuuuuggucuugugugccagcggcgcu

SEQ ID NO: 4225947 - RNA, 55 nt, Chlamydophila pneumoniae CWL029
ugcuuuuagguaggacgucacucaguagauuguguuggcgugcuuccuaugagua

SEQ ID NO: 4225948 - RNA, 64 nt, Chlamydophila pneumoniae CWL029
aaaucaagaauacaucgcagaucuaugggccuuaucuuucugaucugcaauguguucuuuauuu

SEQ ID NO: 4225949 - RNA, 97 nt, Chlamydophila pneumoniae CWL029; identical to SEQ ID NO: 4225764

SEQ ID NO: 4225950 - RNA, 64 nt, Chlamydophila pneumoniae CWL029
agaagguuugaugacaacaguucaugcugcuacugcuacucaacuaguuguugacggaccuucu

SEQ ID NO: 4225951 - RNA, 69 nt, Chlamydophila pneumoniae CWL029
agcacaaaaggagcucguacaggaguucuagugguuacugcaaucuuaaugacgaucuccuuauuggcu

SEQ ID NO: 4225952 - RNA, 58 nt, Chlamydophila pneumoniae CWL029
cuucacaaggucuaugaguaucuugcucaaaaaaagauacuacagguucuuguagaag

SEQ ID NO: 4225953 - RNA, 61 nt, Chlamydophila pneumoniae CWL029
uaaugauuucugaaaagcuugcgaugacuuuccaaguuagcgaaguuauucagaauuguua

SEQ ID NO: 4225954 - RNA, 60 nt, Chlamydophila pneumoniae CWL029
gagaaaauuguaugacagcuuguuucaucucuuggcggaacaguucauucgauuucucuc

SEQ ID NO: 4225955 - RNA, 60 nt, Chlamydophila pneumoniae CWL029
uuaaaaaugcucaagauuugcgagaucugguuguagaacuuccucuugagcaucuuuuaa

SEQ ID NO: 4225956 - RNA, 74 nt, Chlamydophila pneumoniae CWL029
uguaauggaugaugauaucauuucucaagaagcucaagagcaccuuguagauguuuuaucgcuaucuaguguca

SEQ ID NO: 4225957 - RNA, 55 nt, Chlamydophila pneumoniae CWL029
gcuuuuggcucaccuauuccaacaauauuugauugagaaucggcggagccggagc

SEQ ID NO: 4225958 - RNA, 73 nt, Chlamydophila pneumoniae CWL029
guggaaaagaaauauuguugggacuuugguuauacuuugcuucacagaaccuaaguccucaguaguucuccau

SEQ ID NO: 4225959 - RNA, 75 nt, Chlamydophila pneumoniae CWL029
gaguuucuggagaugguaaaauuguuauaggaaugaaaguuccggaugauccuuuugcuauaacuguaggauuuc

SEQ ID NO: 4225960 - RNA, 81 nt, Chlamydophila pneumoniae CWL029
cuaaugguccgcuacauuuuggacauauugcaggagucuaucuuccugcagauguguaugcaagauuccguagauuguuag

SEQ ID NO: 4225961 - RNA, 68 nt, Chlamydophila pneumoniae CWL029
guugucuuuccaacuccagaacuuccuaaaauaaucguaauugucccuggagacgcuuggaaagaagc

SEQ ID NO: 4225962 - RNA, 98 nt, Chlamydophila pneumoniae CWL029
ucuguaggacguaaccguugauuuucuuuagucguauauucacgacuuugaauuuuguucauuaucguggcauacguugaaggacggccgaucccaga

SEQ ID NO: 4225963 - RNA, 63 nt, Chlamydophila pneumoniae CWL029; identical to SEQ ID NO: 4225769

SEQ ID NO: 4225964 - RNA, 65 nt, Chlamydophila pneumoniae CWL029
gccgugagauuuuaaggcuuguucugcauagugcgaacaggaaggaaaaaaucuacagcacgagc

SEQ ID NO: 4225965 - RNA, 64 nt, Chlamydophila pneumoniae CWL029
uauauuaaaagaacgcucguauccauuuauccaaauaggauguggacgauacguuuuuaaugua

SEQ ID NO: 4225966 - RNA, 62 nt, Chlamydophila pneumoniae CWL029
guucuuuuucuaugaugaugaguuucuuaggguaguucagcuuaugcauuaggaaggagagc

SEQ ID NO: 4225967 - RNA, 56 nt, Chlamydophila pneumoniae CWL029
aguucccuagggaagacugaggagcagguugcugcuccugaguuuccuaaggaacu

SEQ ID NO: 4225968 - RNA, 71 nt, Chlamydophila pneumoniae CWL029
aaaugucucucagguuuauuccuuccuuaucuaucucuaauuuggaugacucaggagaaccaagaacauuu

SEQ ID NO: 4225969 - RNA, 60 nt, Chlamydophila pneumoniae CWL029
uuguccguauguuagagcaagaguuuucuucugcuuuugcugagacuauaucgguaacaa

SEQ ID NO: 4225970 - RNA, 125 nt, Chlamydophila pneumoniae CWL029
ggaaguagaaggaaauuaugaguuuauuaaaagauacgguuuuuacuugccuagauugugaaaugacaggucuagauguaaaaaaagaucguauuauugaaauugccgcuguucgcuuuacuuuc

SEQ ID NO: 4225971 - RNA, 61 nt, Chlamydophila pneumoniae CWL029
gggaggaugucguccugucggucucuuagaggggggagguguagagggaugacauucaacc

SEQ ID NO: 4225972 - RNA, 72 nt, Chlamydophila pneumoniae CWL029
ggauuuuuugagcaaucaacuagggguaauggaugcaucagcaauuucccuauguauggauucucauauucc

SEQ ID NO: 4225973 - RNA, 62 nt, Chlamydophila pneumoniae CWL029
uuguggagcuguuuggcuguuuuuauauacaaagcgauugaaauagucucuagguucuauag

SEQ ID NO: 4225974 - RNA, 107 nt, Chlamydophila pneumoniae CWL029
ucuucagauguagauacaccuuggauauuucagcuuaugucaaagguagauucuuaucuuuucuuaggcgggaauagaaucaagguuguaucuauaguuaugcaaga

SEQ ID NO: 4225975 - RNA, 93 nt, Chlamydophila pneumoniae CWL029
ucguaaagguggugaagcugcaaaaaagaauuuaaugaagauagaagcuuuagaagaugguucuauuccucaugaaguucuuguccaucacga

SEQ ID NO: 4225976 - RNA, 60 nt, Chlamydophila pneumoniae CWL029
uuuugaagauguuuccucaguugauguucguggaauuucaaaaggaaaagguuuucaagg

SEQ ID NO: 4225977 - RNA, 73 nt, Chlamydophila pneumoniae CWL029
uucuagcacuauuggagaaucuggaggugcuaucuuugcagcagacucuauacaaauccaacagugcacggga

SEQ ID NO: 4225978 - RNA, 102 nt, Chlamydophila pneumoniae CWL029
ucaggccgacauucaugagcacuucuccccauuucccuacgaggaugucgaggacaccagcuguagagggauuggggauguucgcuaguugauguuggaaga

SEQ ID NO: 4225979 - RNA, 63 nt, Chlamydophila pneumoniae CWL029
caaacuaaagagcuugaguuugcaauugcuaaaaguaaguuagaacggggcuguuuaguuaug

SEQ ID NO: 4225980 - RNA, 85 nt, Chlamydophila pneumoniae CWL029
ucgaugaugaaauuuuugugaucggaaguuauaauuuuggaaagaaaagugaugccuuugauuacgaaaguauuguaguuaucga

SEQ ID NO: 4225981 - RNA, 65 nt, Chlamydophila pneumoniae CWL029
gcauccuauuuucaugagaaaggggacucucgagaacgcaucccuuuucucaugaaaaagaccgc

SEQ ID NO: 4225982 - RNA, 74 nt, Chlamydophila pneumoniae CWL029
cgauaaggaagauauucuuaaaguuucggaugagcucugugcucgauuaaauaaacuuggaguaucugaaaucg

SEQ ID NO: 4225983 - RNA, 91 nt, Chlamydophila pneumoniae CWL029
ccagagaaaacgcgggacuucuugaaagaauacccuaaccaccgagagcuuguaggguuugaaucuuuagaagauuuugugaauucauugg

SEQ ID NO: 4225984 - RNA, 81 nt, Chlamydophila pneumoniae CWL029
auuaaugucuauuuucuuuguagcuaccaauggaggaagcacuccgauuuggaucaccaaagaaaaucugauggcguuagu

SEQ ID NO: 4225985 - RNA, 103 nt, Chlamydophila pneumoniae CWL029
gcaguauccguacagagaugccuauguguaacucuauagcuaugaaaaagcaaaagcguggcuuugugcuuauggaauuacucaugucguucacucuaauugc

SEQ ID NO: 4225986 - RNA, 58 nt, Chlamydophila pneumoniae CWL029
augcaggaagaaagauuucuucuguaauuccacaaggacggaucuuuuuacuuagcau

SEQ ID NO: 4225987 - RNA, 83 nt, Chlamydophila pneumoniae CWL029
guauugcgguauuugacuucuauagaauucaguaguaaauaugcugucugcucuaucucagaaaucaauuccgaagaaugugc

SEQ ID NO: 4225988 - RNA, 104 nt, Chlamydophila pneumoniae CWL029
cguauugguauaaggcuucuugguuauuuagguagguuugagcugaagaguuugcuuggaguucuugggcaaugauggagagguuaucuugagcaacuaauacg

SEQ ID NO: 4225989 - RNA, 77 nt, Chlamydophila pneumoniae CWL029
uaugauuggaaauaaugugagagcauaguucucuguaauuuucagacgagagugaagcucauaauauccauagcaug

SEQ ID NO: 4225990 - RNA, 57 nt, Chlamydophila pneumoniae CWL029
ggcauuaaagauuuggcugaagaucucucuuuucaugagucaacaaucuuccgugcc

SEQ ID NO: 4225991 - RNA, 81 nt, Chlamydophila pneumoniae CWL029; identical to SEQ ID NO: 4225761

SEQ ID NO: 4225992 - RNA, 81 nt, Chlamydophila pneumoniae CWL029
ugauagucuuuggcaaucucugaacuuuugcuguugucaauaugauaacagcauguuucggagguucuucgaagacuuuua

SEQ ID NO: 4225993 - RNA, 96 nt, Chlamydophila pneumoniae CWL029
uuuuucauaagauauuucuguagaauccucucgaaguaugucgagcuaucauuuggcauaauaggauagcgauuuuggaguugucaauaugaaaaa

SEQ ID NO: 4225994 - RNA, 73 nt, Chlamydophila pneumoniae CWL029
ucgauacgaauuuucuguucuuuaccgcuggcaacaucuuuagcugagacauggaaaauuccguuugcaucga

SEQ ID NO: 4225995 - RNA, 70 nt, Chlamydophila pneumoniae CWL029
uuuuagaaguuguauauaugcgcuaauugcaucuauuuuguaguauagcgaaauaugcaaucuuuuaaaa

SEQ ID NO: 4225996 - RNA, 107 nt, Chlamydophila pneumoniae CWL029; identical to SEQ ID NO: 4225766

SEQ ID NO: 4225997 - RNA, 73 nt, Chlamydophila pneumoniae CWL029
gacgagagagucucuuaacaagagaagguguuucacgguuuuccuucaguauaacagacucuugauuuaaguc

SEQ ID NO: 4225998 - RNA, 85 nt, Chlamydophila pneumoniae CWL029
gcuaugauauuguuagaauuauuggaaagggaggcaugggugaagucuaucuugccuacgauccuguauguucucguaaaguagc

SEQ ID NO: 4225999 - RNA, 75 nt, Chlamydophila pneumoniae CWL029
uucccuugccuuuaagagaggaacaugaaagaaaucuugucaaguucguaauuauuuaaagguauuugaagggag

SEQ ID NO: 4226000 - RNA, 66 nt, Chlamydophila pneumoniae CWL029; identical to SEQ ID NO: 4225786

SEQ ID NO: 4226001 - RNA, 55 nt, Chlamydophila pneumoniae CWL029
ggcuuuguuuuucagaaauagaauuguuccucgauugucucugaaaaagagagcc

SEQ ID NO: 4226002 - RNA, 77 nt, Chlamydophila pneumoniae CWL029
ucuucgccaaacgaguauuuuuucauguccgcaggagaaaaccauuuugcuuuggguagauacuacguaagcgaagg

SEQ ID NO: 4226003 - RNA, 61 nt, Chlamydophila pneumoniae CWL029
aaacuucaggaacuuucugaguuggguguaguccuuuauccuuacgaguuuccuggaguuu

SEQ ID NO: 4226004 - RNA, 84 nt, Chlamydophila pneumoniae CWL029
uuuaagcaccgauagcucaauuggauagaguaccuggcuucggaccaggugguuggagguucgagcccucuucggugcguuaaa

SEQ ID NO: 4226005 - RNA, 83 nt, Chlamydophila pneumoniae CWL029
gccaagugauauaaggaaaucgaacuccaagcaucguuaguuucuaacaauacuuggaguucgaugauuauucaacguaaggc

SEQ ID NO: 4226006 - RNA, 130 nt, Chlamydophila pneumoniae CWL029
gaggcaaagaaaauaucucuccagaacccuggauuuucaagucuuuugaagaaggugaaguugaggauucaucaagagaaagaagaagaucagggauuaggauacgcguauuauuuaggucgggauaguc

SEQ ID NO: 4226007 - RNA, 87 nt, Chlamydophila pneumoniae CWL029
guacggucucucagaaauuuggaggagaaucuauagaugcuaaaacaacuacaggucagcuuuuccauauagcugguaagaccgaac

SEQ ID NO: 4226008 - RNA, 76 nt, Chlamydophila pneumoniae CWL029
gaucccgaagcuuuuuucuuagaauuuccuuauuuuaacucuuugauagugaaucauucgaugaaggaagcggauc

SEQ ID NO: 4226009 - RNA, 60 nt, Chlamydophila pneumoniae CWL029
gccuuuuuugaugcucuuguccgucgugaaaacaucauguccacaggaaucggaaugggc

SEQ ID NO: 4226010 - RNA, 68 nt, Chlamydophila pneumoniae CWL029
ugugauuggcguugagauuauuccugaugcuguagcuucggcucaggagaacaucaaagcgaauaaca

SEQ ID NO: 4226011 - RNA, 59 nt, Chlamydophila pneumoniae CWL029
aagcuucgugaucagaaaaugacuauaucuaaagauuucaauuucugaucacgaaguuu

SEQ ID NO: 4226012 - RNA, 99 nt, Chlamydophila pneumoniae CWL029
ugcucuccaaaugauccgaagucgagacuaugaccuugucaucucagacaugaguaugccugacggcucuggucuugauuuaaucaaaauuauaaagca

SEQ ID NO: 4226013 - RNA, 114 nt, Chlamydophila pneumoniae CWL029
gagcaccuccauucgaccgauaguacuuauaguccaagaugaaaucauugugauucccgacaauugcgagaucuugauuuugguuaugaguaaacccuacuugaggggcugcuu

SEQ ID NO: 4226014 - RNA, 120 nt, Chlamydophila pneumoniae CWL029
uccauagcauggggauaugaugugaaguuuuccauucagaacggaagccuaugggagaggaaagaucuguaaggggauguuuuggauggaauuuucuuauauggucuccaguuucuugga

SEQ ID NO: 4226015 - RNA, 56 nt, Chlamydophila pneumoniae CWL029
agcucuacccacuaaaaucauagauaagaaggcuaucuaagauuuuggguagagcu

SEQ ID NO: 4226016 - RNA, 55 nt, Chlamydophila pneumoniae CWL029
ucuugcagucauuuagguagguaaguaaagauccuggaucuaagugacucacaga

SEQ ID NO: 4226017 - RNA, 72 nt, Chlamydophila pneumoniae CWL029
cuuguauagaacgugcguucucuuauguugagggggccugcccuaaggaacaagaaucacaguucuaucaag

SEQ ID NO: 4226018 - RNA, 76 nt, Chlamydophila pneumoniae CWL029
uugauauaccuguuuuuucauaguauccuuaguaucaauauuaaguguagaaacagaagaccaagcaggcuaucaa

SEQ ID NO: 4226019 - RNA, 56 nt, Chlamydophila pneumoniae CWL029
cucuucaggaucggcauuauuuccuguuuucacaaggagugcugcucccgaaguag

SEQ ID NO: 4226020 - RNA, 80 nt, Chlamydophila pneumoniae CWL029
uacaaguuuuugaacgucacgucucuccagaacaggcguuggcauuguucccagaauaucgugauggcaagucuuuugua

SEQ ID NO: 4226021 - RNA, 96 nt, Chlamydophila pneumoniae CWL029
ucaguacauggaugucccuuuuguuucugauaauuuuggaagaauagcugcucacgcagcacgacaaauuaucggucaaaagcuaagacaugcuga

SEQ ID NO: 4226022 - RNA, 63 nt, Chlamydophila pneumoniae CWL029
agauuuuuagggacuauaauuucaucuuuauugaacauagggauuguggacuccuaaauaucu

SEQ ID NO: 4226023 - RNA, 77 nt, Chlamydophila pneumoniae CWL029
agcaaggggcucuaguuuugaauaaucucuggagucauuauacagaucuuagagcucuuaagcaggagaucuuugcu

SEQ ID NO: 4226024 - RNA, 58 nt, Chlamydophila pneumoniae CWL029
gauauguauguaaaggcucuucuauaaacucuuugaagaaaucugcugcauagauauc

SEQ ID NO: 4226025 - RNA, 71 nt, Chlamydophila pneumoniae CWL029
gcuucuguauugucccagacaaccaaacaugucauugcuaugggugagugucgacagacaauagcagaugc

SEQ ID NO: 4226026 - RNA, 129 nt, Chlamydophila pneumoniae CWL029; identical to SEQ ID NO: 4225760

SEQ ID NO: 4226027 - RNA, 71 nt, Chlamydophila pneumoniae CWL029
cuugcuuuauaggaaggaauggaagcucugcuauacguagcaugauuucuauuucuucgacucgaggcagg

SEQ ID NO: 4226028 - RNA, 63 nt, Chlamydophila pneumoniae CWL029
guucagacuauuuuccuuugauuugugugaucucacgcauuguugaggaaaaggguccugaau

SEQ ID NO: 4226029 - RNA, 102 nt, Chlamydophila pneumoniae CWL029
aauccauuuacucagagaaauauagauagaauuuuacaggagaggucaggcggugcuuccgcuucuccuguagagccuauuuaugaugagaucccauggauu

SEQ ID NO: 4226030 - RNA, 61 nt, Chlamydophila pneumoniae CWL029
gucuaguuuugacguaggaagagguuuagcuguacagcuccucccuacguuaaagcuuugc

SEQ ID NO: 4226031 - RNA, 81 nt, Chlamydophila pneumoniae CWL029
guuuaguuuuaauaguugaaacagauggaagagugacuccgaaagaagcucuggcuuuuucaacucaaauuuugacuaaac

SEQ ID NO: 4226032 - RNA, 92 nt, Chlamydophila pneumoniae CWL029; identical to SEQ ID NO: 4225751

SEQ ID NO: 4226033 - RNA, 62 nt, Chlamydophila pneumoniae CWL029
gcuuacgucuuugauguauaucguaagggaccugucucuuugauuacacucaaggaugcugc

SEQ ID NO: 4226034 - RNA, 77 nt, Chlamydophila pneumoniae CWL029
gagcgaccaacaaauucguggagccguuuuuuuaccuaaugguacaggaaaaacuuuaagaauuuugguuuuugcuu

SEQ ID NO: 4226035 - RNA, 83 nt, Chlamydophila pneumoniae CWL029
gguuguaagcaagcucuauaauagggugcguauagguaacauuccuauauuuaaucauaucauagauacagcggcuauaaauc

SEQ ID NO: 4226036 - RNA, 69 nt, Chlamydophila pneumoniae CWL029
gccucuggaauucuuuaugcuguaaagugggaagggaacacuauuacacaucuaggaacuuuaggaggc

SEQ ID NO: 4226037 - RNA, 74 nt, Chlamydophila pneumoniae CWL029
acuccugguugucccauguggucuaguauaggcaagccgauauugcccauagcuauagcagggaucccuaaagu

SEQ ID NO: 4226038 - RNA, 91 nt, Chlamydophila pneumoniae CWL029
ggagccaggggucuaaagaagguguuucuuuaggaaaaauagauuuugguuuuuguucguccuuuugaacacuuuucgagcacuguguucc

SEQ ID NO: 4226039 - RNA, 83 nt, Chlamydophila pneumoniae CWL029; identical to SEQ ID NO: 4225754

SEQ ID NO: 4226040 - RNA, 59 nt, Chlamydophila pneumoniae CWL029
agggagugcguuccuugggggacaucccuugugaucuucucaaagcaacgcgacucccu

SEQ ID NO: 4226041 - RNA, 76 nt, Chlamydophila pneumoniae CWL029
cuuuaagaaggauuauucgugcauuugguggcgcagaagaagagccgccgcuucauugcugaguaauuuuuuagag

SEQ ID NO: 4226042 - RNA, 76 nt, Chlamydophila pneumoniae CWL029
agcucuccuugagaaucuugauggguagcggcagaaaaaaaugguugugccugcuucucaagauacucggauaguu

SEQ ID NO: 4226043 - RNA, 59 nt, Chlamydophila pneumoniae CWL029
caagagcaauugcugauuccgggacauugcaaaugccuaggagauaagcaauguuucug

SEQ ID NO: 4226044 - RNA, 79 nt, Chlamydophila pneumoniae CWL029
uuccucuuaucuauguaguugccuggauugaugcgaaccuugucagcaaaaucagcaacuaacauagcugcuugaggga

SEQ ID NO: 4226045 - RNA, 116 nt, Chlamydophila pneumoniae CWL029
gggaauuacucucuaugaauaucgauccugaagauauucaggcaauuuuuguuacgcacgaacauucugaucauaucuccgggauuaaaaguuuuguuaaggcguauaacacuccc

SEQ ID NO: 4226046 - RNA, 86 nt, Chlamydophila pneumoniae CWL029
agagaaggaguuaugacaauuagaguccgaaaccuugccuacucuguaaauaagaaaaagauucuagaugguguaacuuuuucuuu

SEQ ID NO: 4226047 - RNA, 91 nt, Chlamydophila pneumoniae CWL029; identical to SEQ ID NO: 4225774

SEQ ID NO: 4226048 - RNA, 75 nt, Chlamydophila pneumoniae CWL029
ccuguauuugcuauugagauuuuccccauauccaauguugcggauuggaugcggaauucuucaaaagaauacggg

SEQ ID NO: 4226049 - RNA, 67 nt, Chlamydophila pneumoniae CWL029
ucgccucucuuuuugcuauuaaggaguauuucucaagagagugcuucgauguagcgagaaaguuuga

SEQ ID NO: 4226050 - RNA, 93 nt, Chlamydophila pneumoniae CWL029
ucccacauaaaaugaagcuuaucaauaauuugugggaaugagggaagaccgaguuuucccucguuccccaaauaguuuacagagaaaaaagga

SEQ ID NO: 4226051 - RNA, 61 nt, Chlamydophila pneumoniae CWL029
cauugucuuaguauuauuuuuuguagcuccuggagcugcucccguaauuacugcggcaaug

SEQ ID NO: 4226052 - RNA, 79 nt, Chlamydophila pneumoniae CWL029
ccaugucuuuuuuacagaaagauuuauuccaauccuuacacaucaccaaaggaaauaucugccuuguaaauaaguaugg

SEQ ID NO: 4226053 - RNA, 64 nt, Chlamydophila pneumoniae CWL029
aggagauuuucucacuuacagcauuacuuguaucagguucuugaguggguugggaaaaauuccu

SEQ ID NO: 4226054 - RNA, 65 nt, Chlamydophila pneumoniae CWL029
gggugaagguaugaaggauuucugguucuaagaaaaauucuaugaauuccucacuuccuuuaccu

SEQ ID NO: 4226055 - RNA, 58 nt, Chlamydophila pneumoniae CWL029
auaaaguuuugcugcgggcuccccguacggacggugagugugcauaacgagccuuugu

SEQ ID NO: 4226056 - RNA, 56 nt, Chlamydophila pneumoniae CWL029
aguuccuuaggaaacucaggagcagcaaccugcuccucagucuucccuagggaacu

SEQ ID NO: 4226057 - RNA, 64 nt, Chlamydophila pneumoniae CWL029
gaaaaauuaggaucggcagaauuaccaaaaauuuauuuagguucuucucugauccuuugcguuc

SEQ ID NO: 4226058 - RNA, 72 nt, Chlamydophila pneumoniae CWL029
cuugauagaacugugauucuuguuccuuagggcaggcccccucaacauaagagaacgcacguucuauacaag

SEQ ID NO: 4226059 - RNA, 65 nt, Chlamydophila pneumoniae CWL029; identical to SEQ ID NO: 4225756

SEQ ID NO: 4226060 - RNA, 74 nt, Chlamydophila pneumoniae CWL029
ugaaaaugaucuuccuuuucguguuuuacaggaauuuacuaagaguccugaugaaaacggaggaguuacuuuua

SEQ ID NO: 4226061 - RNA, 69 nt, Chlamydophila pneumoniae CWL029
acuuuugguuuugagacucuccuacaagcgguacgaacucccuugaagguuuuagcucagaacuguggu

SEQ ID NO: 4226062 - RNA, 70 nt, Chlamydophila pneumoniae CWL029
cccuguaaacuuagagcaaguagcauaguucuauuuuauuaucuuuaugcugcuuuuucuaaaaauaggg

SEQ ID NO: 4226063 - RNA, 86 nt, Chlamydophila pneumoniae CWL029
cugcaauugcagaguauuuucgugaucaagggaaaacugucguacuuaugauggauuccgugacacgauuugcucgugcauugcgg

SEQ ID NO: 4226064 - RNA, 103 nt, Chlamydophila pneumoniae CWL029
uucugcuuuagguggugaugguauugauuuaagaguuucaggguacacaacaacagucccugcauuguuaaacucaauuuuaaccucauuaccuaauuuagag

SEQ ID NO: 4226065 - RNA, 80 nt, Chlamydophila pneumoniae CWL029
uaagaaguucuacaauuccuauagcucaagauguggcuuauguuuuagcugcucuuguaggggcuuguaucggauucuua

SEQ ID NO: 4226066 - RNA, 84 nt, Chlamydophila pneumoniae CWL029; identical to SEQ ID NO: 4225771

SEQ ID NO: 4226067 - RNA, 64 nt, Chlamydophila pneumoniae CWL029
ugauuuugcuucgcagcuugaaguacauggugaaucaugcggaucacugcugggggcaaaguua

SEQ ID NO: 4226068 - RNA, 56 nt, Chlamydophila pneumoniae CWL029
ggaggaacaauagcuuugacaacaggauugaugacuaacuccucuauuguuccucc

SEQ ID NO: 4226069 - RNA, 90 nt, Chlamydophila pneumoniae CWL029
ucuugagaaucucauggaugaagaagcuggaaauccuaaucacauagauuuauggagacaguuugcuuuaucucuuggaguuucugaaga

SEQ ID NO: 4226070 - RNA, 78 nt, Chlamydophila pneumoniae CWL029
ugugguucuaagagaguuuuaccgggugagggauugcuacgggauaagcuuuuagaugguggauuuucaagagcggca

SEQ ID NO: 4226071 - RNA, 102 nt, Chlamydophila pneumoniae CWL029
auucuggaaccgaaaauauaugcagaguuaugguugaaggucauaaaaaacaucaaguagacugccuugccaaggcucuugcggauguuauugaugcagaau

SEQ ID NO: 4226072 - RNA, 105 nt, Chlamydophila pneumoniae CWL029
gaaguaaucucggguaagaaaaggaaacgacgagcagccugagggacuuuuguauaaauaucacucgaaauuguuguuucuguuucuaccuuagcagauugcuuc

SEQ ID NO: 4226073 - RNA, 79 nt, Chlamydophila pneumoniae CWL029
acugaucuaaacuaaggagugucaaugaagaaagaaaugcuucgcuuucuuuaugaauuaggccuuguguguagagagu

SEQ ID NO: 4226074 - RNA, 84 nt, Chlamydophila pneumoniae CWL029
uugcugauagguguuauuugauuauugaugggaagaucuucuuugaagggucuucaagccaaaugaucaguaacccuaugguaa

SEQ ID NO: 4226075 - RNA, 71 nt, Chlamydophila pneumoniae CWL029
gcaaaguguuacggccucaauuuagcuaaugguagacucauuggcaugggugaagcuguugguauuauugc

SEQ ID NO: 4226076 - RNA, 68 nt, Chlamydophila pneumoniae CWL029
agggggaaagccaagaagauguagagucggccguauaacuuuauguuuucuuggcuuuuuuguucccu

SEQ ID NO: 4226077 - RNA, 64 nt, Chlamydophila pneumoniae CWL029
cugaugauauucgugauauugaagacaucauuaccaaugagucuguuauuaucacgauauccgg

SEQ ID NO: 4226078 - RNA, 67 nt, Chlamydophila pneumoniae CWL029
ggauguucuccagcaggagcccagaaauuagaagcuuugauuuucgcuucucuugaagaaaucaucc

SEQ ID NO: 4226079 - RNA, 74 nt, Chlamydophila pneumoniae CWL029
gaucuuuaaguccuugauuugugaagaaauugguccuuaggaguugccgcuuucuucagacaguucaagagauc

SEQ ID NO: 4226080 - RNA, 76 nt, Chlamydophila pneumoniae CWL029
cgucucuauuaaaagaugcucaagaggaaguucuacaaccagaucucgcaaaucuugagcauuuuuaaaagucacg

SEQ ID NO: 4226081 - RNA, 58 nt, Chlamydophila pneumoniae CWL029
uuuauauguuaggaaauaguguuggaucauaucuaauacugugccuggacagucugaa

SEQ ID NO: 4226082 - RNA, 74 nt, Chlamydophila pneumoniae CWL029
ugggaacuuacgagaaaaguuagaauuuauuccucuucaggaauaaauuccucucgcuucuuccuguguuucca

SEQ ID NO: 4226083 - RNA, 77 nt, Chlamydophila pneumoniae CWL029
ucaccuucccucaccuccagggaugauucguaggaguuuaucuccagauacgauguugaugggggugguaaauguga

SEQ ID NO: 4226084 - RNA, 70 nt, Chlamydophila pneumoniae CWL029
ccaggcuaaaacaucuucuucggaaucuucgcuguagcgaaucgaaagaccgugucuuuugccuuguugg

SEQ ID NO: 4226085 - RNA, 66 nt, Chlamydophila pneumoniae CWL029
gcggacaccagcuucccaagcugaaagaaugccauucuuaucugcugggggagcuagaaaguccgc

SEQ ID NO: 4226086 - RNA, 55 nt, Chlamydophila pneumoniae CWL029
aaagucuucaauuucugcgauaggguuauccaaauuaaucguaggaugaagcuuu

SEQ ID NO: 4226087 - RNA, 72 nt, Chlamydophila pneumoniae CWL029
gaaauaaacucgggcagacguacugcauagguuuuaugucuaagcgguagauguuaugaguuuuuaauuuuc

SEQ ID NO: 4226088 - RNA, 63 nt, Chlamydophila pneumoniae CWL029
cgucguaucgguguggauaaguuucucuugaugcaugggggagcugaguacgcggauaaggcg

SEQ ID NO: 4226089 - RNA, 80 nt, Chlamydophila pneumoniae CWL029
guauuggauuuuaacugcacugagcgugcagauguaucuugcgauguacaucugucuguuucuugcaggaccgaucuuac

SEQ ID NO: 4226090 - RNA, 84 nt, Chlamydophila pneumoniae CWL029
ugucgggguuaggaguguagccuaaagaguauuccuugaggaaacgagcgaacacucuuucucuauauucuuuagcaaaagaua

SEQ ID NO: 4226091 - RNA, 57 nt, Chlamydophila pneumoniae CWL029
ggaaggaucuuuaucggaauaugcuggaguaucauaaaucuguacaagauccucucc

SEQ ID NO: 4226092 - RNA, 100 nt, Chlamydophila pneumoniae CWL029
ucaucgaagaauucuucacaauaggagaaaguucucuuagaagugagaaagacuuugcucuucuuguuggaaggauuuuagcagacaauauuauugauga

SEQ ID NO: 4226093 - RNA, 77 nt, Chlamydophila pneumoniae CWL029
cuucauuccaagaucaugucuccucugugcgaaggguuugcuuacaguaugacgaggucuuuauugacggauuggag

SEQ ID NO: 4226094 - RNA, 67 nt, Chlamydophila pneumoniae CWL029; identical to SEQ ID NO: 4225749

SEQ ID NO: 4226095 - RNA, 85 nt, Chlamydophila pneumoniae CWL029
aaaucauaccucugauaggaauuuuucaaucugagcaaaaguaccaagacuuguaaucgguuuagaaaucccuauagagcgauuu

SEQ ID NO: 4226096 - RNA, 72 nt, Chlamydophila pneumoniae CWL029
uguucuggaagcuguuuucuaugaaaguaaucccaaggucgggauugaauuucuugaaaauuucccgaugca

SEQ ID NO: 4226097 - RNA, 121 nt, Chlamydophila pneumoniae CWL029
gauagccauaagauagcucuuaaugacaacuuaguuucuuuuggcggacguuuucgugauguccaaacucaagaaggacaacuacguuaucauuaucuagagcuuauugaucagggccauc

SEQ ID NO: 4226098 - RNA, 89 nt, Chlamydophila pneumoniae CWL029
agagcgccuuucucuuaagaugcgugguauccugcaaucuuagcaaucagauaccaaaaugugauuuugagggaucagagagcguaucu

SEQ ID NO: 4226099 - RNA, 67 nt, Chlamydophila pneumoniae CWL029
guagugauucuguggaguaugcauccaucguaccucaagauggaucgcaagccccagcagagacugc

SEQ ID NO: 4226100 - RNA, 85 nt, Chlamydophila pneumoniae CWL029
gacgcuuuuauauccacagggaauacaggggccuuaguuacauuagcacgugcuaagauuccucuauuuccugccguaucucguc

SEQ ID NO: 4226101 - RNA, 67 nt, Chlamydophila pneumoniae CWL029; identical to SEQ ID NO: 4225776

SEQ ID NO: 4226102 - RNA, 57 nt, Chlamydophila pneumoniae CWL029
cucagcuuguugcaguagcaacaacaagcacgcuuuuugcuaugcaaaauaagcgag

SEQ ID NO: 4226103 - RNA, 84 nt, Chlamydophila pneumoniae CWL029
cugugguucuugaaucugugauugaugaguuuuugaugguggcagaugccaaggcaaagagaaucgcuacagaucccaccgcag

SEQ ID NO: 4226104 - RNA, 85 nt, Chlamydophila pneumoniae CWL029
gaccagggagaccuacuuauuguucuugguguauaguauuuuuaaauacagauucaccaagaacaauaaguaggucucccugguc

SEQ ID NO: 4226105 - RNA, 61 nt, Chlamydophila pneumoniae CWL029
agcuauggcgagcuacuuaugaagggauguauacauuucuugugggugcguugcuaaaguu

SEQ ID NO: 4226106 - RNA, 71 nt, Chlamydophila pneumoniae CWL029; identical to SEQ ID NO: 4225778

SEQ ID NO: 4226107 - RNA, 100 nt, Chlamydophila pneumoniae CWL029
ggugaggugccuugaaguaugacccacauuaucuaggucguuguguuucccuccagcucgaauacauuucugcgauguuguggcucgagaguagcucacc

SEQ ID NO: 4226108 - RNA, 69 nt, Chlamydophila pneumoniae J138
uugcuguuagaauuauacgugccugucaugauuuaggauugucgacaguggcuguauauucuuuagcag

SEQ ID NO: 4226109 - RNA, 72 nt, Chlamydophila pneumoniae J138; identical to SEQ ID NO: 4225891

SEQ ID NO: 4226110 - RNA, 84 nt, Chlamydophila pneumoniae J138
gacgguuugaggauaacgauacgcaaugucuaagcuuugaaucaggauacucugcuuuacaggcgugucuuugugccuaugguc

SEQ ID NO: 4226111 - RNA, 88 nt, Chlamydophila pneumoniae J138
guagugguacaaucgaggcucuucuaaaagacauaguaaaaagauuauuauuguguuuauagaaggccagagauuuguuauuuauugc

SEQ ID NO: 4226112 - RNA, 55 nt, Chlamydophila pneumoniae J138
aaggagcucguacaggaguucuagugguuacugcaaucuuaaugacgaucuccuu

SEQ ID NO: 4226113 - RNA, 90 nt, Chlamydophila pneumoniae J138; identical to SEQ ID NO: 4226069

SEQ ID NO: 4226114 - RNA, 56 nt, Chlamydophila pneumoniae J138
uuuuggaauuaggcaugggccuuuccgaauuaggaggagggcuguuaauuucggga

SEQ ID NO: 4226115 - RNA, 61 nt, Chlamydophila pneumoniae J138; identical to SEQ ID NO: 4225779

SEQ ID NO: 4226116 - RNA, 71 nt, Chlamydophila pneumoniae J138
cgcgggacuucuugaaagaauacccuaaccaccgagagcuuguaggguuugaaucuuuagaagauuuugug

SEQ ID NO: 4226117 - RNA, 67 nt, Chlamydophila pneumoniae J138; identical to SEQ ID NO: 4226099

SEQ ID NO: 4226118 - RNA, 76 nt, Chlamydophila pneumoniae J138; identical to SEQ ID NO: 4226041

SEQ ID NO: 4226119 - RNA, 57 nt, Chlamydophila pneumoniae J138
cuuucccagaaguacguggagcuacggcugcuguuguccaugccgacucugggaagg

SEQ ID NO: 4226120 - RNA, 62 nt, Chlamydophila pneumoniae J138; identical to SEQ ID NO: 4225864

SEQ ID NO: 4226121 - RNA, 85 nt, Chlamydophila pneumoniae J138; identical to SEQ ID NO: 4225792

SEQ ID NO: 4226122 - RNA, 104 nt, Chlamydophila pneumoniae J138
uggucuuggguuuuaaaugagcaauguuuguaguguugaauaagauuuugaaaauugcauuuaaacuaagaauaccuauagguucaccagaagcauugaggaca

SEQ ID NO: 4226123 - RNA, 59 nt, Chlamydophila pneumoniae J138
gcugccgauagaacuugauuuguacccgccccaucucgacucauuguucuauuggcugc

SEQ ID NO: 4226124 - RNA, 56 nt, Chlamydophila pneumoniae J138
gucugcgucuuuaauuaaaaguucagcaaggaaguuauaauuuagacgacguagau

SEQ ID NO: 4226125 - RNA, 70 nt, Chlamydophila pneumoniae J138; identical to SEQ ID NO: 4225941

SEQ ID NO: 4226126 - RNA, 63 nt, Chlamydophila pneumoniae J138; identical to SEQ ID NO: 4225893

SEQ ID NO: 4226127 - RNA, 97 nt, Chlamydophila pneumoniae J138
gguuacuggguauugugaguaggcucccccugcuaagaggggauuaaacucuuguaggaaagccuuauuuacaucuucauuuauacuaaggugcgcu

SEQ ID NO: 4226128 - RNA, 76 nt, Chlamydophila pneumoniae J138; identical to SEQ ID NO: 4226008

SEQ ID NO: 4226129 - RNA, 63 nt, Chlamydophila pneumoniae J138
uauaauaauagcagcuacuaagagaaguggggauuccuuuuuucuuaguagcugcuacguaua

SEQ ID NO: 4226130 - RNA, 81 nt, Chlamydophila pneumoniae J138; identical to SEQ ID NO: 4225872

SEQ ID NO: 4226131 - RNA, 92 nt, Chlamydophila pneumoniae J138
guguggguucuugauaaagaggauauuuucuugguaaguugauaaauuuuauaugcagaguagcacaaaaugccuaguguaggcccgaacac

SEQ ID NO: 4226132 - RNA, 107 nt, Chlamydophila pneumoniae J138; identical to SEQ ID NO: 4225974

SEQ ID NO: 4226133 - RNA, 69 nt, Chlamydophila pneumoniae J138; identical to SEQ ID NO: 4225909

SEQ ID NO: 4226134 - RNA, 63 nt, Chlamydophila pneumoniae J138; identical to SEQ ID NO: 4226022

SEQ ID NO: 4226135 - RNA, 55 nt, Chlamydophila pneumoniae J138
aguuccuguagaugaagaagcagucgcucagguaguuucucuacaaacaggaauu

SEQ ID NO: 4226136 - RNA, 68 nt, Chlamydophila pneumoniae J138
aaaagagucgugucuucucuuuaguaggaagaugauauuccucuccugaagcagagacgaucuuuuuu

SEQ ID NO: 4226137 - RNA, 100 nt, Chlamydophila pneumoniae J138; identical to SEQ ID NO: 4225763

SEQ ID NO: 4226138 - RNA, 93 nt, Chlamydophila pneumoniae J138
aagauuuauggaaaguuuugaaagauacccggaugauucauuauuugacuguaucgauuuuuuugggaucuuucuucuuauugauaggugcuu

SEQ ID NO: 4226139 - RNA, 64 nt, Chlamydophila pneumoniae J138; identical to SEQ ID NO: 4226053

SEQ ID NO: 4226140 - RNA, 77 nt, Chlamydophila pneumoniae J138; identical to SEQ ID NO: 4226083

SEQ ID NO: 4226141 - RNA, 64 nt, Chlamydophila pneumoniae J138
gaguucuagugaucuaaguacgaagaggaagaaagacuuuuguauuuuuugcauccuagaauuu

SEQ ID NO: 4226142 - RNA, 83 nt, Chlamydophila pneumoniae J138
gccuuacguugaauaaucaucgaacuccaaguauuguuagaaacuaacgaugcuuggaguucgauuuccuuauaucacuuggc

SEQ ID NO: 4226143 - RNA, 61 nt, Chlamydophila pneumoniae J138; identical to SEQ ID NO: 4226105

SEQ ID NO: 4226144 - RNA, 61 nt, Chlamydophila pneumoniae J138
uccuaaagcaucuugaaaugcgugcaauuccguaggacacacguaaguaaaaucuuuagga

SEQ ID NO: 4226145 - RNA, 67 nt, Chlamydophila pneumoniae J138
gaaaauaaagaacucuccuauaauggcaaggaaucugcaaaaccgcugccguugagaguucuuuuuc

SEQ ID NO: 4226146 - RNA, 95 nt, Chlamydophila pneumoniae J138; identical to SEQ ID NO: 4225900

SEQ ID NO: 4226147 - RNA, 67 nt, Chlamydophila pneumoniae J138
augacuuggguaacuacgggcuacaacccuaauccugagcguagagcuuccguaguucccgauucau

SEQ ID NO: 4226148 - RNA, 69 nt, Chlamydophila pneumoniae J138
uacuuauaguccaagaugaaaucauugugauucccgacaauugcgagaucuugauuuugguuaugagua

SEQ ID NO: 4226149 - RNA, 92 nt, Chlamydophila pneumoniae J138
aggaucuuaaugaauucgacuuagaucuuuuucuaaacaaauuauuuccugaaguagaaaagaucuaagucguuguuuagucucgguuuccu

SEQ ID NO: 4226150 - RNA, 55 nt, Chlamydophila pneumoniae J138; identical to SEQ ID NO: 4225780

SEQ ID NO: 4226151 - RNA, 60 nt, Chlamydophila pneumoniae J138
uccacaguugcagcgagcuucuuaggaacgccuccuaaaagcuuuucugcauacacaaga

SEQ ID NO: 4226152 - RNA, 80 nt, Chlamydophila pneumoniae J138
uuuuuuuggaauuaggcaugggccuuuccgaauuaggaggagggcuguuaauuucgggacuacuauguuuuuuagaaaaa

SEQ ID NO: 4226153 - RNA, 78 nt, Chlamydophila pneumoniae J138; identical to SEQ ID NO: 4225914

SEQ ID NO: 4226154 - RNA, 60 nt, Chlamydophila pneumoniae J138; identical to SEQ ID NO: 4225851

SEQ ID NO: 4226155 - RNA, 107 nt, Chlamydophila pneumoniae J138; identical to SEQ ID NO: 4225917

SEQ ID NO: 4226156 - RNA, 63 nt, Chlamydophila pneumoniae J138
uuuuccugagcauugacuugggauucuugccaauagagaauucgagagcaauguucgcaaaaa

SEQ ID NO: 4226157 - RNA, 104 nt, Chlamydophila pneumoniae J138
gaaauagugaaugagacuaaauauugaccuuuagcugcaggagguuuggccuuaauuaaagcagaacuuagagcuucaauauuuucuuugauuugacugcuuuc

SEQ ID NO: 4226158 - RNA, 89 nt, Chlamydophila pneumoniae J138
uagaccagggagaccuacuuauuguucuugguguauaguauuuuuaaauacagauucaccaagaacaauaaguaggucucccuggucug

SEQ ID NO: 4226159 - RNA, 60 nt, Chlamydophila pneumoniae J138; identical to SEQ ID NO: 4225912

SEQ ID NO: 4226160 - RNA, 64 nt, Chlamydophila pneumoniae J138
uauggccauugcguagguuauguaaagagucucgagagagcuuucaucaacugcguaguucaug

SEQ ID NO: 4226161 - RNA, 81 nt, Chlamydophila pneumoniae J138; identical to SEQ ID NO: 4225761

SEQ ID NO: 4226162 - RNA, 64 nt, Chlamydophila pneumoniae J138; identical to SEQ ID NO: 4225950

SEQ ID NO: 4226163 - RNA, 62 nt, Chlamydophila pneumoniae J138; identical to SEQ ID NO: 4225886

SEQ ID NO: 4226164 - RNA, 58 nt, Chlamydophila pneumoniae J138
acaagaaaaguuuaaggcucagcaaguuccucuaguauugcgugagcuacuuucuugu

SEQ ID NO: 4226165 - RNA, 67 nt, Chlamydophila pneumoniae J138; identical to SEQ ID NO: 4226078

SEQ ID NO: 4226166 - RNA, 97 nt, Chlamydophila pneumoniae J138; identical to SEQ ID NO: 4225876

SEQ ID NO: 4226167 - RNA, 72 nt, Chlamydophila pneumoniae J138; identical to SEQ ID NO: 4225818

SEQ ID NO: 4226168 - RNA, 105 nt, Chlamydophila pneumoniae J138; identical to SEQ ID NO: 4226072

SEQ ID NO: 4226169 - RNA, 80 nt, Chlamydophila pneumoniae J138
augucccuuuuguuucugauaauuuuggaagaauagcugcucacgcagcacgacaaauuaucggucaaaagcuaagacau

SEQ ID NO: 4226170 - RNA, 62 nt, Chlamydophila pneumoniae J138; identical to SEQ ID NO: 4225966

SEQ ID NO: 4226171 - RNA, 64 nt, Chlamydophila pneumoniae J138; identical to SEQ ID NO: 4225835

SEQ ID NO: 4226172 - RNA, 55 nt, Chlamydophila pneumoniae J138; identical to SEQ ID NO: 4226001

SEQ ID NO: 4226173 - RNA, 61 nt, Chlamydophila pneumoniae J138
gccucuugguaacgaucgcaacgggcuauucggguccugugagugaucucuaccaagaugu

SEQ ID NO: 4226174 - RNA, 83 nt, Chlamydophila pneumoniae J138
uccagaacccuggauuuucaagucuuuugaagaaggugaaguugaggauucaucaagagaaagaagaagaucagggauuagga

SEQ ID NO: 4226175 - RNA, 73 nt, Chlamydophila pneumoniae J138; identical to SEQ ID NO: 4225830

SEQ ID NO: 4226176 - RNA, 67 nt, Chlamydophila pneumoniae J138
gacacuuacaacucagggauuuguucuuaauaaaucuuuaaggaaggauuaugagcugugguuuguc

SEQ ID NO: 4226177 - RNA, 114 nt, Chlamydophila pneumoniae J138
ggaggugagguucgucacuuuacuagcggagaucuuuucaauuuagcaguuccuauuggcgugaaguuugagagauuuucagacuguaaaaggggaucuuaugaacuuaccuuu

SEQ ID NO: 4226178 - RNA, 129 nt, Chlamydophila pneumoniae J138; identical to SEQ ID NO: 4225760

SEQ ID NO: 4226179 - RNA, 107 nt, Chlamydophila pneumoniae J138; identical to SEQ ID NO: 4225904

SEQ ID NO: 4226180 - RNA, 102 nt, Chlamydophila pneumoniae J138
aagagaagcagggccuuauuuuauuuuguggccaccaggcaaacugggaacuuccuuauuuuauuuuguggccaccaggcaaacugggaacuuccuuuucuu

SEQ ID NO: 4226181 - RNA, 58 nt, Chlamydophila pneumoniae J138
auguauggcacuaaagaguuuagucuguaagauagagaggcuccuacuugccauucau

SEQ ID NO: 4226182 - RNA, 60 nt, Chlamydophila pneumoniae J138
gcucuaaacgcgagaacgaugccgucaugcgacucacaugguugauuuucguuuggaugc

SEQ ID NO: 4226183 - RNA, 80 nt, Chlamydophila pneumoniae J138; identical to SEQ ID NO: 4226065

SEQ ID NO: 4226184 - RNA, 55 nt, Chlamydophila pneumoniae J138
guaaauaccgauuuuaauagggaacugagaguuccuuauuguagagaguauuuac

SEQ ID NO: 4226185 - RNA, 67 nt, Chlamydophila pneumoniae J138; identical to SEQ ID NO: 4225757

SEQ ID NO: 4226186 - RNA, 68 nt, Chlamydophila pneumoniae J138; identical to SEQ ID NO: 4225768

SEQ ID NO: 4226187 - RNA, 92 nt, Chlamydophila pneumoniae J138
uuuucuucuucuacauuagacuugugcuuuuuuagcguuggcugaacaacuucagcaaggcuuuguaaaacguucaaaucagaagaagaaaa

SEQ ID NO: 4226188 - RNA, 69 nt, Chlamydophila pneumoniae J138; identical to SEQ ID NO: 4226036

SEQ ID NO: 4226189 - RNA, 58 nt, Chlamydophila pneumoniae J138; identical to SEQ ID NO: 4225942

SEQ ID NO: 4226190 - RNA, 72 nt, Chlamydophila pneumoniae J138
ggacguguagcucuacccaaaaucuuagauagccuucuuaucuaugauuuuaguggguagagcuuucccucc

SEQ ID NO: 4226191 - RNA, 89 nt, Chlamydophila pneumoniae J138
agacagcauugaggagcuugagaguauagggguguuucggagagaggaaaaucucuucaacgguuccuguuucuaugaguuugccgucu

SEQ ID NO: 4226192 - RNA, 100 nt, Chlamydophila pneumoniae J138
caaacguauucuuguugucugugaugaaaugacagguauggaagaagaacaucugauuccauuaaccaaacauuugauuguacaacguggagauagugug

SEQ ID NO: 4226193 - RNA, 99 nt, Chlamydophila pneumoniae J138
ggggauaugaugugaaguuuuccauucagaacggaagccuaugggagaggaaagaucuguaaggggauguuuuggauggaauuuucuuauauggucucc

SEQ ID NO: 4226194 - RNA, 58 nt, Chlamydophila pneumoniae J138
gcguucuugauauuuuguuaaucuuucuuuaaugauuuccgggguaucgucagaacgc

SEQ ID NO: 4226195 - RNA, 85 nt, Chlamydophila pneumoniae J138; identical to SEQ ID NO: 4225868

SEQ ID NO: 4226196 - RNA, 67 nt, Chlamydophila pneumoniae J138
ugagcugcgagaauaaauuuugucuuccucaugaaggcaaaaccauauucugguuacgagaaguuca

SEQ ID NO: 4226197 - RNA, 81 nt, Chlamydophila pneumoniae J138
uccauaaccgcgaaagcuuuaggagccuaugucgaacacacaccaagacaaggacaugagggcuuuucaggucgcuaugga

SEQ ID NO: 4226198 - RNA, 63 nt, Chlamydophila pneumoniae J138
ggaauuuuauauuuucuuuccuauaagcguuauuugcauuuagguaagggauaugugacuucu

SEQ ID NO: 4226199 - RNA, 77 nt, Chlamydophila pneumoniae J138; identical to SEQ ID NO: 4226023

SEQ ID NO: 4226200 - RNA, 78 nt, Chlamydophila pneumoniae J138
ggaaaggauguuguuauugaaccguacguuguuauaaaagcuacgguaacccuuugugacaacguuguuguuaagucc

SEQ ID NO: 4226201 - RNA, 71 nt, Chlamydophila pneumoniae J138; identical to SEQ ID NO: 4226025

SEQ ID NO: 4226202 - RNA, 65 nt, Chlamydophila pneumoniae J138
cucuuuugaagaaggcugcuugcuauauugaguguagcaagcuuccgcagcuuuuugcacaggag

SEQ ID NO: 4226203 - RNA, 91 nt, Chlamydophila pneumoniae J138; identical to SEQ ID NO: 4226038

SEQ ID NO: 4226204 - RNA, 65 nt, Chlamydophila pneumoniae J138; identical to SEQ ID NO: 4225756

SEQ ID NO: 4226205 - RNA, 63 nt, Chlamydophila pneumoniae J138
guagguuugaggaucggauuagagauguagcuccacuacugcuacuuccuccuuuagagcuau

SEQ ID NO: 4226206 - RNA, 87 nt, Chlamydophila pneumoniae J138
gaauuuaaauacacuucuugcuugggcccacgcuacuguuaucaacaacuuagcacccaaaccugcaggagaugucuuugcuauuuc

SEQ ID NO: 4226207 - RNA, 61 nt, Chlamydophila pneumoniae J138; identical to SEQ ID NO: 4225753

SEQ ID NO: 4226208 - RNA, 69 nt, Chlamydophila pneumoniae J138; identical to SEQ ID NO: 4226061

SEQ ID NO: 4226209 - RNA, 82 nt, Chlamydophila pneumoniae J138
gaauacagacauuaggaucgcgagacaucucuucgucaauugcuucucggagagcuucucgaauuucuaauguuuuauguuu

SEQ ID NO: 4226210 - RNA, 82 nt, Chlamydophila pneumoniae J138
uaauaauagccaauaaggagaucgucauuaagauugcaguaaccacuagaacuccuguacgagcuccuuuugugcuuuguug

SEQ ID NO: 4226211 - RNA, 76 nt, Chlamydophila pneumoniae J138
cggcgaucccuuuacaagauucaagcaagauccaguacgcaugcugagacuguuaaagauuuuaucacggucgccg

SEQ ID NO: 4226212 - RNA, 70 nt, Chlamydophila pneumoniae J138
uagaucgaugcuauguuuagagaagacgauaggagaaucucuuuccauucaucuauacaggcuucguuua

SEQ ID NO: 4226213 - RNA, 62 nt, Chlamydophila pneumoniae J138; identical to SEQ ID NO: 4225834

SEQ ID NO: 4226214 - RNA, 64 nt, Chlamydophila pneumoniae J138; identical to SEQ ID NO: 4226057

SEQ ID NO: 4226215 - RNA, 63 nt, Chlamydophila pneumoniae J138; identical to SEQ ID NO: 4225928

SEQ ID NO: 4226216 - RNA, 59 nt, Chlamydophila pneumoniae J138; identical to SEQ ID NO: 4226040

SEQ ID NO: 4226217 - RNA, 91 nt, Chlamydophila pneumoniae J138
caagagagagcuggacuucugguuuuucgauuuggaagauugaaggcaccaacacuuuuaaagauaaggaccagguguagguuccugcuug

SEQ ID NO: 4226218 - RNA, 105 nt, Chlamydophila pneumoniae J138; identical to SEQ ID NO: 4225946

SEQ ID NO: 4226219 - RNA, 70 nt, Chlamydophila pneumoniae J138; identical to SEQ ID NO: 4225929

SEQ ID NO: 4226220 - RNA, 71 nt, Chlamydophila pneumoniae J138
ggaaggguggucugaagcucaugcaauuucuggaaauggcaguagaauuguaggagcuucgggagcuggcc

SEQ ID NO: 4226221 - RNA, 94 nt, Chlamydophila pneumoniae J138; identical to SEQ ID NO: 4225799

SEQ ID NO: 4226222 - RNA, 62 nt, Chlamydophila pneumoniae J138; identical to SEQ ID NO: 4225772

SEQ ID NO: 4226223 - RNA, 77 nt, Chlamydophila pneumoniae J138
uaaugucuauuuucuuuguagcuaccaauggaggaagcacuccgauuuggaucaccaaagaaaaucugauggcguua

SEQ ID NO: 4226224 - RNA, 55 nt, Chlamydophila pneumoniae J138
cgguauccguauaauuugaugucacguaguauguaucaaacuauagaggaugcug

SEQ ID NO: 4226225 - RNA, 92 nt, Chlamydophila pneumoniae J138
uacuagagaccuuaguaaagagaaaagaaaguccacaggcaaacaaaguguggccuguaacuacauuuucuuuagcuagaaaucucucugua

SEQ ID NO: 4226226 - RNA, 89 nt, Chlamydophila pneumoniae J138
gaaaaggcucuuaauucuacugauacagacugcgagcagcgucauguucuguuuggagaauguucagaaggaaauuguccauacuuuuc

SEQ ID NO: 4226227 - RNA, 59 nt, Chlamydophila pneumoniae J138; identical to SEQ ID NO: 4225869

SEQ ID NO: 4226228 - RNA, 81 nt, Chlamydophila pneumoniae J138
cggucucucagaaauuuggaggagaaucuauagaugcuaaaacaacuacaggucagcuuuuccauauagcugguaagaccg

SEQ ID NO: 4226229 - RNA, 58 nt, Chlamydophila pneumoniae J138
acaagaaaguagcucacgcaauacuagaggaacuugcugagccuuaaacuuuucuugu

SEQ ID NO: 4226230 - RNA, 55 nt, Chlamydophila pneumoniae J138; identical to SEQ ID NO: 4225882

SEQ ID NO: 4226231 - RNA, 69 nt, Chlamydophila pneumoniae J138
gacuaucauuuuagaugggucuauuucucccuuaccucaggaagagauccccgguucuaagaaagaguc

SEQ ID NO: 4226232 - RNA, 74 nt, Chlamydophila pneumoniae J138; identical to SEQ ID NO: 4226082

SEQ ID NO: 4226233 - RNA, 57 nt, Chlamydophila pneumoniae J138
cccaaagggaaguucuaaaucaaaucaaaauugaugaugagggacccucccuagggg

SEQ ID NO: 4226234 - RNA, 81 nt, Chlamydophila pneumoniae J138
uuccacgauaaggaaugauucugaaggagaauaaaauauuaccuuuggaauguuuuucuuguucaaaguuaauuccuggag

SEQ ID NO: 4226235 - RNA, 60 nt, Chlamydophila pneumoniae J138
cccgacgcucucgacggaucauacuucuuggggaggauaugucugggcuggagagcuggg

SEQ ID NO: 4226236 - RNA, 125 nt, Chlamydophila pneumoniae J138; identical to SEQ ID NO: 4225970

SEQ ID NO: 4226237 - RNA, 65 nt, Chlamydophila pneumoniae J138
auugugaucuuuuaaaaagcaugauuuucgugcaaagaaauucgugcguuuaaaagaggaacaau

SEQ ID NO: 4226238 - RNA, 60 nt, Chlamydophila pneumoniae J138
agaauuauuggaaagggaggcaugggugaagucuaucuugccuacgauccuguauguucu

SEQ ID NO: 4226239 - RNA, 128 nt, Chlamydophila pneumoniae J138; identical to SEQ ID NO: 4225936

SEQ ID NO: 4226240 - RNA, 61 nt, Chlamydophila pneumoniae J138; identical to SEQ ID NO: 4226003

SEQ ID NO: 4226241 - RNA, 67 nt, Chlamydophila pneumoniae J138; identical to SEQ ID NO: 4225749

SEQ ID NO: 4226242 - RNA, 115 nt, Chlamydophila pneumoniae J138
gaaccuaaggugagugaaggcaggaguuggggaaggauaguuucucuaugauaguagugcccuuuaucuuggacuaucuuauuguaacuugaggcuauacaaucccaagagguuu

SEQ ID NO: 4226243 - RNA, 121 nt, Chlamydophila pneumoniae J138
agguuaucuugaacugugaguucuuuaaaaauuguggguucuugagcaagauaaccgauucccagucgugcacgaugguccauaguuuuuuuggugacaucgacauuuuuaaagauaaucu

SEQ ID NO: 4226244 - RNA, 59 nt, Chlamydophila pneumoniae J138; identical to SEQ ID NO: 4225752

SEQ ID NO: 4226245 - RNA, 61 nt, Chlamydophila pneumoniae J138
uauuuuuuauugaagugguagccuucgguuucccuuaggcuagcaauuucaaugagaagua

SEQ ID NO: 4226246 - RNA, 72 nt, Chlamydophila pneumoniae J138; identical to SEQ ID NO: 4225972

SEQ ID NO: 4226247 - RNA, 57 nt, Chlamydophila pneumoniae J138
cuccagaucaagcuucacguccuugggauagagaucgugauggcuuugucuuaggag

SEQ ID NO: 4226248 - RNA, 129 nt, Chlamydophila pneumoniae J138
uaauccaguuuuuuaaauaccuagagcucugaaauaaacucgggcagacguacugcauagguuuuaugucuaagcgguagauguuaugaguuuuuaauuuucuguuaaugguauucccuaacaggaaag

SEQ ID NO: 4226249 - RNA, 117 nt, Chlamydophila pneumoniae J138
uguagucuucucauaauuagcgauauguucuaaagauucccugugucuuugugcaaaagaaugcauugaagacacuagagagaguuuuuuauaaaauguugaaauagaagugcuaua

SEQ ID NO: 4226250 - RNA, 74 nt, Chlamydophila pneumoniae J138; identical to SEQ ID NO: 4225982

SEQ ID NO: 4226251 - RNA, 106 nt, Chlamydophila pneumoniae J138
gaaggugaggugccuugaaguaugacccacauuaucuaggucguuguguuucccuccagcucgaauacauuucugcgauguuguggcucgagaguagcucaccuuc

SEQ ID NO: 4226252 - RNA, 129 nt, Chlamydophila pneumoniae J138
cuucagaugcagauaucaucgaagaauucuucacaauaggagaaaguucucuuagaagugagaaagacuuugcucuucuuguuggaaggauuuuagcagacaauauuauugaugaagccugcucucuag

SEQ ID NO: 4226253 - RNA, 84 nt, Chlamydophila pneumoniae J138; identical to SEQ ID NO: 4226074

SEQ ID NO: 4226254 - RNA, 60 nt, Chlamydophila pneumoniae J138
gcaguuggcauccgaaagaauuuuuguuucucgugaaaaagaagcugcugaugccuaugc

SEQ ID NO: 4226255 - RNA, 61 nt, Chlamydophila pneumoniae J138; identical to SEQ ID NO: 4225971

SEQ ID NO: 4226256 - RNA, 78 nt, Chlamydophila pneumoniae J138
uauuaguacagcacauuccuuauuugauuggaggguccgcagaucuuucaagcucagauggaacuuggauugcgaaug

SEQ ID NO: 4226257 - RNA, 67 nt, Chlamydophila pneumoniae J138
uugucguuguuucaggacguuuguauuuacggucucuguauacgauacgaucgaaacucuuagacaa

SEQ ID NO: 4226258 - RNA, 64 nt, Chlamydophila pneumoniae J138; identical to SEQ ID NO: 4225948

SEQ ID NO: 4226259 - RNA, 79 nt, Chlamydophila pneumoniae J138; identical to SEQ ID NO: 4226073

SEQ ID NO: 4226260 - RNA, 87 nt, Chlamydophila pneumoniae J138
gaaucauuuucagcaauuacgacaaacuucaagcaaucugagaauuuucuuugcuuccaaucgaaguuugguccuggaaaauggcuc

SEQ ID NO: 4226261 - RNA, 62 nt, Chlamydophila pneumoniae J138
gcacuauuggagaaucuggaggugcuaucuuugcagcagacucuauacaaauccaacagugc

SEQ ID NO: 4226262 - RNA, 70 nt, Chlamydophila pneumoniae J138; identical to SEQ ID NO: 4225802

SEQ ID NO: 4226263 - RNA, 109 nt, Chlamydophila pneumoniae J138; identical to SEQ ID NO: 4225866

SEQ ID NO: 4226264 - RNA, 84 nt, Chlamydophila pneumoniae J138; identical to SEQ ID NO: 4226090

SEQ ID NO: 4226265 - RNA, 66 nt, Chlamydophila pneumoniae J138; identical to SEQ ID NO: 4225786

SEQ ID NO: 4226266 - RNA, 72 nt, Chlamydophila pneumoniae J138
gaauuuuagaaggagagaguaaggaagaugguuaucuaaaccacggauccuuauuuguucuuucuguguuuc

SEQ ID NO: 4226267 - RNA, 63 nt, Chlamydophila pneumoniae J138; identical to SEQ ID NO: 4225828

SEQ ID NO: 4226268 - RNA, 68 nt, Chlamydophila pneumoniae J138; identical to SEQ ID NO: 4225880

SEQ ID NO: 4226269 - RNA, 84 nt, Chlamydophila pneumoniae J138; identical to SEQ ID NO: 4225765

SEQ ID NO: 4226270 - RNA, 80 nt, Chlamydophila pneumoniae J138
ggacucucaauaucuaaaggugaugguaagcacgaagugaguuuguguacguuaucauuuuuaggaaugcuaaaggguuc

SEQ ID NO: 4226271 - RNA, 65 nt, Chlamydophila pneumoniae J138; identical to SEQ ID NO: 4225981

SEQ ID NO: 4226272 - RNA, 56 nt, Chlamydophila pneumoniae J138; identical to SEQ ID NO: 4225787

SEQ ID NO: 4226273 - RNA, 80 nt, Chlamydophila pneumoniae J138; identical to SEQ ID NO: 4226089

SEQ ID NO: 4226274 - RNA, 65 nt, Chlamydophila pneumoniae J138
ggugaaguguguuuuuuugaagcucaaggaaauggucugaguuuaggaauuaagagcacgccacu

SEQ ID NO: 4226275 - RNA, 78 nt, Chlamydophila pneumoniae J138
uucgcagagauggaaugauuuuccuucuaaaauagaauuugugaauucuucuuuagaaggaaaaugaaucucuuugaa

SEQ ID NO: 4226276 - RNA, 86 nt, Chlamydophila pneumoniae J138; identical to SEQ ID NO: 4226063

SEQ ID NO: 4226277 - RNA, 91 nt, Chlamydophila pneumoniae J138
gaaguugagcauauucgugagggagaugcagauuuagaucauggugucauucgccaaguuaaagucuacguugccucuaagagaaaacuuc

SEQ ID NO: 4226278 - RNA, 78 nt, Chlamydophila pneumoniae J138
ucauaauagcggacaccagcuucccaagcugaaagaaugccauucuuaucugcugggggagcuagaaaguccgcauga

SEQ ID NO: 4226279 - RNA, 57 nt, Chlamydophila pneumoniae J138
cguugcuugaaggagauguuuuuaaucugugguuagguuacaguccuauaaguaaug

SEQ ID NO: 4226280 - RNA, 60 nt, Chlamydophila pneumoniae J138
uuucuauccauuuuaacuccgaggaaaucguucuacucacaggaguuucgggaucaggaa

SEQ ID NO: 4226281 - RNA, 61 nt, Chlamydophila pneumoniae J138; identical to SEQ ID NO: 4225887

SEQ ID NO: 4226282 - RNA, 81 nt, Chlamydophila pneumoniae J138
ucuuuauaugcaaggugaacaagaucuucugguuucuaucaaccacagaacacuguuuaccgaagcauuugcaaaucaaga

SEQ ID NO: 4226283 - RNA, 70 nt, Chlamydophila pneumoniae J138; identical to SEQ ID NO: 4226062

SEQ ID NO: 4226284 - RNA, 58 nt, Chlamydophila pneumoniae J138; identical to SEQ ID NO: 4226024

SEQ ID NO: 4226285 - RNA, 72 nt, Chlamydophila pneumoniae J138
cagaagauuuuccaaaagcauauaacuuucaggauacagaacccgaguuguauguguuuugggaaaagaaug

SEQ ID NO: 4226286 - RNA, 59 nt, Chlamydophila pneumoniae J138
uccgagggaacuaaaggagcgaauaacugaugaaggaguucuuccuuuuucuuuaagga

SEQ ID NO: 4226287 - RNA, 123 nt, Chlamydophila pneumoniae J138
uuuauuuuuuaauguuacgaaauuauuuuguuauaauucaaugauuugauugugcggauuaacaaucauucuacuucaacucguugauugugaaucuuauguguuuuuaauauagaaaauaag

SEQ ID NO: 4226288 - RNA, 55 nt, Chlamydophila pneumoniae J138
ccgauuguuucuuuacuucuugggaccaacggcucaggaaaaacgacaacagcgg

SEQ ID NO: 4226289 - RNA, 59 nt, Chlamydophila pneumoniae J138
aagcuucgugaucagaaauugaaaucuuuagauauagucauuuucugaucacgaaguuu

SEQ ID NO: 4226290 - RNA, 66 nt, Chlamydophila pneumoniae J138
ucuuuucaugcaagcaaggcagauucaaggccauaaggcuuuggaauuuuggauuguuugcgaaga

SEQ ID NO: 4226291 - RNA, 57 nt, Chlamydophila pneumoniae J138; identical to SEQ ID NO: 4225824

SEQ ID NO: 4226292 - RNA, 65 nt, Chlamydophila pneumoniae J138
gaaguuuugugaucaggagaguauugucacauucaaccgcaaucuuaucuugauccaagaagauc

SEQ ID NO: 4226293 - RNA, 60 nt, Chlamydophila pneumoniae J138
cuugaaggcaaacuccccgcuuuugugggcacuucugcaaagcuggggauuucuuucuag

SEQ ID NO: 4226294 - RNA, 78 nt, Chlamydophila pneumoniae J138
gcuguuuuucaaagaaagauucuugguagaaauggcuccgccauuuuccucacaguaaucuuguuuaaauaaaauagu

SEQ ID NO: 4226295 - RNA, 79 nt, Chlamydophila pneumoniae J138
gcucucguggauuuuuagauauucaugguauuuuagccgcucguaaggguaagcaaguagugaaaucuacugcgggcgc

SEQ ID NO: 4226296 - RNA, 56 nt, Chlamydophila pneumoniae J138
gaguauaggugccuguguuaguacuuccgucaaagcuaucagaggggccuauauuu

SEQ ID NO: 4226297 - RNA, 95 nt, Chlamydophila pneumoniae J138
augucuuacaaccauuuuuaaauacgauggucguuccgucuugaaagccauaacgccacuccucuaucguauuggggaugccaccuuguagauau

SEQ ID NO: 4226298 - RNA, 56 nt, Chlamydophila pneumoniae J138
ucccuauacaaugagagaugugccuuagaaaaccaacaaucucaguugagugggga

SEQ ID NO: 4226299 - RNA, 64 nt, Chlamydophila pneumoniae J138; identical to SEQ ID NO: 4225895

SEQ ID NO: 4226300 - RNA, 72 nt, Chlamydophila pneumoniae J138
uguagagucuucacuucccgcaguuuuagaguuuacaaucuugaaugaggacugugggcaggaggaauuuca

SEQ ID NO: 4226301 - RNA, 69 nt, Chlamydophila pneumoniae J138
uucuuugauaaugauagauuucgcaugaauggcuccaccguugcucuggcuuugguuauuguuaaagag

SEQ ID NO: 4226302 - RNA, 92 nt, Chlamydophila pneumoniae J138
augaaagggucuccaggauuuuucguccuuacagauccaucaaagggaucuauaaggcauaaggaaaagucuguauuggagagugccaucau

SEQ ID NO: 4226303 - RNA, 59 nt, Chlamydophila pneumoniae J138
gaggaaaucauugcuaugggugcuuuauaccgcccaggcccuauggauaugauuccuuc

SEQ ID NO: 4226304 - RNA, 79 nt, Chlamydophila pneumoniae J138
acuuguuuauucguuucuugaguaggguuuugaucuccaagcacggcuucccaaucuucugaagagacggcaaauaggu

SEQ ID NO: 4226305 - RNA, 63 nt, Chlamydophila pneumoniae J138
gggguuaccuuagguuuaguuuuagaagauaaagccaucuuuuuuaaaccuauaggagacauc

SEQ ID NO: 4226306 - RNA, 92 nt, Chlamydophila pneumoniae J138; identical to SEQ ID NO: 4225751

SEQ ID NO: 4226307 - RNA, 86 nt, Chlamydophila pneumoniae J138
gcuuuguccugauuuugucuuguguuggauaagcuuagagagaucuuuuccaaguucuagaauuacgggaagaguuagagaauagu

SEQ ID NO: 4226308 - RNA, 86 nt, Chlamydophila pneumoniae J138
caaucggucuggucugggaacuuugugaagcuugagaaggaagaccuucuagagacucgcgaaguaaaacuguaaucagaucuuug

SEQ ID NO: 4226309 - RNA, 61 nt, Chlamydophila pneumoniae J138
cacguuauauugcucguauccgucaauuaacucguuuaguugcggauagcuauguagagug

SEQ ID NO: 4226310 - RNA, 68 nt, Chlamydophila pneumoniae J138; identical to SEQ ID NO: 4226076

SEQ ID NO: 4226311 - RNA, 83 nt, Chlamydophila pneumoniae J138; identical to SEQ ID NO: 4225754

SEQ ID NO: 4226312 - RNA, 84 nt, Chlamydophila pneumoniae J138; identical to SEQ ID NO: 4226004

SEQ ID NO: 4226313 - RNA, 56 nt, Chlamydophila pneumoniae J138
uuugcgagauguuguugaucagcuuuucacuauaggcugucacgaaucuuugcaag

SEQ ID NO: 4226314 - RNA, 60 nt, Chlamydophila pneumoniae J138
auagauuugcugauuuucccagaaguagucgugccuuuugguaagcauaggcaagucuau

SEQ ID NO: 4226315 - RNA, 98 nt, Chlamydophila pneumoniae J138
gaguauuuuuuaucaaaugcacaggucuuugagaaaucccgaguacccaagaucguuucaaagauaagccugugaguacauuccuuaaguucgcgcuc

SEQ ID NO: 4226316 - RNA, 60 nt, Chlamydophila pneumoniae J138
uucggaagaucuugagauagcugauuuaccaguacccuccagucaucaagauuuucugga

SEQ ID NO: 4226317 - RNA, 71 nt, Chlamydophila pneumoniae J138
guuguaagcaagcucuauaauagggugcguauagguaacauuccuauauuuaaucauaucauagauacagc

SEQ ID NO: 4226318 - RNA, 117 nt, Chlamydophila pneumoniae J138
uuuuggaaguaucaucuuuagcuuuuucuggcaugggugccagcaucauuuuuauagagacuguaaagaggagaaagccgccuaugaucugaaaagcguagagagaaauauccaaga

SEQ ID NO: 4226319 - RNA, 64 nt, Chlamydophila pneumoniae J138; identical to SEQ ID NO: 4225939

SEQ ID NO: 4226320 - RNA, 89 nt, Chlamydophila pneumoniae J138
uuagguaaugagguuaaaauugaguuuaacaaugcagggacuguuguuguguacccugaaacucuuaaaucaauaccaucaccaccuaa

SEQ ID NO: 4226321 - RNA, 75 nt, Chlamydophila pneumoniae J138
ccucuuaucuauguaguugccuggauugaugcgaaccuugucagcaaaaucagcaacuaacauagcugcuugagg

SEQ ID NO: 4226322 - RNA, 58 nt, Chlamydophila pneumoniae J138; identical to SEQ ID NO: 4225810

SEQ ID NO: 4226323 - RNA, 64 nt, Chlamydophila pneumoniae J138
cucuuucuucaugcaucaaucuagaggcaauacuuagagccucuggguucugcuggggauugag

SEQ ID NO: 4226324 - RNA, 80 nt, Chlamydophila pneumoniae J138; identical to SEQ ID NO: 4225935

SEQ ID NO: 4226325 - RNA, 87 nt, Chlamydophila pneumoniae J138; identical to SEQ ID NO: 4225884

SEQ ID NO: 4226326 - RNA, 85 nt, Chlamydophila pneumoniae J138; identical to SEQ ID NO: 4225980

SEQ ID NO: 4226327 - RNA, 62 nt, Chlamydophila pneumoniae J138; identical to SEQ ID NO: 4225973

SEQ ID NO: 4226328 - RNA, 118 nt, Chlamydophila pneumoniae J138; identical to SEQ ID NO: 4225821

SEQ ID NO: 4226329 - RNA, 69 nt, Chlamydophila pneumoniae J138
gcuuuccauuguuccuuuaagauuucugcuaugcguuggcaucuuagaauaucugagggauagguaagc

SEQ ID NO: 4226330 - RNA, 62 nt, Chlamydophila pneumoniae J138; identical to SEQ ID NO: 4226033

SEQ ID NO: 4226331 - RNA, 58 nt, Chlamydophila pneumoniae J138; identical to SEQ ID NO: 4225800

SEQ ID NO: 4226332 - RNA, 88 nt, Chlamydophila pneumoniae J138
ccuugguauggauacaacuuugaggaugcgaucauuaucucugaaaaauugaucagagaagaugccuauaccucuauuuauauugagg

SEQ ID NO: 4226333 - RNA, 77 nt, Chlamydophila pneumoniae J138; identical to SEQ ID NO: 4226034

SEQ ID NO: 4226334 - RNA, 78 nt, Chlamydophila pneumoniae J138
ucguuagaggaagaaggauuugcuucaaaacacccucgauuccuuuaucagaaaagcgaagaucuucagccuuuacga

SEQ ID NO: 4226335 - RNA, 56 nt, Chlamydophila pneumoniae J138; identical to SEQ ID NO: 4225826

SEQ ID NO: 4226336 - RNA, 88 nt, Chlamydophila pneumoniae J138; identical to SEQ ID NO: 4225846

SEQ ID NO: 4226337 - RNA, 63 nt, Chlamydophila pneumoniae J138; identical to SEQ ID NO: 4225878

SEQ ID NO: 4226338 - RNA, 73 nt, Chlamydophila pneumoniae J138
gggagggaaagcucuacccacuaaaaucauagauaagaaggcuaucuaagauuuuggguagagcuacacgucc

SEQ ID NO: 4226339 - RNA, 124 nt, Chlamydophila pneumoniae J138
cagucaucaaaacuuucaauuuuaaacacacuuuugucguauuuguuauuacuaguugucugaagagucauuuugagacccgcgaguaaagauucuaauacaguaaguugguuuaaagugacug

SEQ ID NO: 4226340 - RNA, 89 nt, Chlamydophila pneumoniae J138
uaucgaagcggcuaggguauuuaccuucuggggauguucgaggggagggguuaaagaaaucugcgaaggagauagucgcucguuugaug

SEQ ID NO: 4226341 - RNA, 71 nt, Chlamydophila pneumoniae J138; identical to SEQ ID NO: 4225968

SEQ ID NO: 4226342 - RNA, 84 nt, Chlamydophila pneumoniae J138; identical to SEQ ID NO: 4226103

SEQ ID NO: 4226343 - RNA, 63 nt, Chlamydophila pneumoniae J138; identical to SEQ ID NO: 4225979

SEQ ID NO: 4226344 - RNA, 85 nt, Chlamydophila pneumoniae J138; identical to SEQ ID NO: 4226095

SEQ ID NO: 4226345 - RNA, 67 nt, Chlamydophila pneumoniae J138
uagagcuuaaauuuacgaaaugccgugcuuccuauaucuacgagguauuuuuuaauuuuagguugua

SEQ ID NO: 4226346 - RNA, 83 nt, Chlamydophila pneumoniae J138
uaaaccuugugcaagggggggacauugccuuugcuguagcauauacaggaaaccaucuucucucuuugaagcuugaagguuua

SEQ ID NO: 4226347 - RNA, 60 nt, Chlamydophila pneumoniae J138
ggugcuaugagaucuuuugggcuuaagugaguuucggccaacaaaucucuuauagcugcu

SEQ ID NO: 4226348 - RNA, 75 nt, Chlamydophila pneumoniae J138; identical to SEQ ID NO: 4225959

SEQ ID NO: 4226349 - RNA, 78 nt, Chlamydophila pneumoniae J138; identical to SEQ ID NO: 4225758

SEQ ID NO: 4226350 - RNA, 63 nt, Chlamydophila pneumoniae J138; identical to SEQ ID NO: 4225769

SEQ ID NO: 4226351 - RNA, 81 nt, Chlamydophila pneumoniae J138
uggagaacaccaaucccguauacgauuaaucacagauguaggaaugaagcccucuguaguugcuaugcgcggugauauuca

SEQ ID NO: 4226352 - RNA, 82 nt, Chlamydophila pneumoniae J138; identical to SEQ ID NO: 4225804

SEQ ID NO: 4226353 - RNA, 109 nt, Chlamydophila pneumoniae J138
agaguuuugcuacuuuaggucagguacauccugaguuagcaaaaaaagcacagauaaaacacccuguguucuuugcagaacucaacuuagaccuucuaugcaagaugcu

SEQ ID NO: 4226354 - RNA, 84 nt, Chlamydophila pneumoniae J138; identical to SEQ ID NO: 4225829

SEQ ID NO: 4226355 - RNA, 67 nt, Chlamydophila pneumoniae J138
uaguucaaggaggagcuccugguggagguucucgaccaucucagcauuauggaggcuccucugauua

SEQ ID NO: 4226356 - RNA, 82 nt, Chlamydophila pneumoniae J138
caggcucguuacuuaauaaucucuuagauagugcuagaaugcaacgucuaggacauuauuguuauagaaccgggacucccug

SEQ ID NO: 4226357 - RNA, 124 nt, Chlamydophila pneumoniae J138
gguccgcuucgauaugucagaguauauggaaaagcauuccauuuccaagcuuauaggaucuucuccaggguauguggguuaugaggaaggugggagucuuucugaggcucuucgacgacguccc

SEQ ID NO: 4226358 - RNA, 103 nt, Chlamydophila pneumoniae J138
acacucugcagcaucuuuaacagcguuuuguaccucagccugcaauaaagcuuucuuaaguuuuaaugucggaagguacguuuguaaucgugcuaguuuuugu

SEQ ID NO: 4226359 - RNA, 65 nt, Chlamydophila pneumoniae J138; identical to SEQ ID NO: 4225854

SEQ ID NO: 4226360 - RNA, 65 nt, Chlamydophila pneumoniae J138; identical to SEQ ID NO: 4226054

SEQ ID NO: 4226361 - RNA, 63 nt, Chlamydophila pneumoniae J138
uuuuuaaaucaucuucagcaaguuccauggugagggguaauguugcugccgaugauuuugaga

SEQ ID NO: 4226362 - RNA, 57 nt, Chlamydophila pneumoniae J138
caggauugcucaagauauguuagaacguuauucuggcucuagcguaaagcaauuuug

SEQ ID NO: 4226363 - RNA, 78 nt, Chlamydophila pneumoniae J138; identical to SEQ ID NO: 4225888

SEQ ID NO: 4226364 - RNA, 97 nt, Chlamydophila pneumoniae J138; identical to SEQ ID NO: 4225764

SEQ ID NO: 4226365 - RNA, 67 nt, Chlamydophila pneumoniae J138
gagcacuucuccccauuucccuacgaggaugucgaggacaccagcuguagagggauuggggauguuc

SEQ ID NO: 4226366 - RNA, 55 nt, Chlamydophila pneumoniae J138; identical to SEQ ID NO: 4225775

SEQ ID NO: 4226367 - RNA, 60 nt, Chlamydophila pneumoniae J138; identical to SEQ ID NO: 4225969

SEQ ID NO: 4226368 - RNA, 76 nt, Chlamydophila pneumoniae J138; identical to SEQ ID NO: 4226042

SEQ ID NO: 4226369 - RNA, 92 nt, Chlamydophila pneumoniae J138
gcaaaaucuauagugccauuagggaaaaaagguguaacaguugcuguaaguaaaugcaugauucucccuacguggcgacuauagcuuuuugu

SEQ ID NO: 4226370 - RNA, 73 nt, Chlamydophila pneumoniae J138; identical to SEQ ID NO: 4225994

SEQ ID NO: 4226371 - RNA, 75 nt, Chlamydophila pneumoniae J138
uccgcuucauuccaagaucaugucuccucugugcgaaggguuugcuuacaguaugacgaggucuuuauugacgga

SEQ ID NO: 4226372 - RNA, 57 nt, Chlamydophila pneumoniae J138; identical to SEQ ID NO: 4225793

SEQ ID NO: 4226373 - RNA, 69 nt, Chlamydophila pneumoniae J138
uucuuuccggcaacauuaauuuauuuagaaaauccccaaugggauuucuaauuauuguuuuggaagggg

SEQ ID NO: 4226374 - RNA, 62 nt, Chlamydophila pneumoniae J138
ucugcuguuuauaggggucuagggaaaguaaauuaggauaacuaggaucuccaaagaguaga

SEQ ID NO: 4226375 - RNA, 55 nt, Chlamydophila pneumoniae J138; identical to SEQ ID NO: 4225947

SEQ ID NO: 4226376 - RNA, 59 nt, Chlamydophila pneumoniae J138; identical to SEQ ID NO: 4225783

SEQ ID NO: 4226377 - RNA, 60 nt, Chlamydophila pneumoniae J138; identical to SEQ ID NO: 4225784

SEQ ID NO: 4226378 - RNA, 89 nt, Chlamydophila pneumoniae J138
guuuuuugacagccuuauaagaagcucuuccagaaacaagaucagaaucuaaagccaucuguuuugcuggaagagccucuaagaaaaac

SEQ ID NO: 4226379 - RNA, 81 nt, Chlamydophila pneumoniae J138; identical to SEQ ID NO: 4226031

SEQ ID NO: 4226380 - RNA, 58 nt, Chlamydophila pneumoniae J138; identical to SEQ ID NO: 4225986

SEQ ID NO: 4226381 - RNA, 56 nt, Chlamydophila pneumoniae J138; identical to SEQ ID NO: 4226019

SEQ ID NO: 4226382 - RNA, 57 nt, Chlamydophila pneumoniae J138; identical to SEQ ID NO: 4225770

SEQ ID NO: 4226383 - RNA, 83 nt, Chlamydophila pneumoniae J138; identical to SEQ ID NO: 4226005

SEQ ID NO: 4226384 - RNA, 58 nt, Chlamydophila pneumoniae J138
auccgcuagcaguaccagcagcuuuuuuaugagagaguucugcugcugcuagaccgau

SEQ ID NO: 4226385 - RNA, 65 nt, Chlamydophila pneumoniae J138
aguucagacuauuuuccuuugauuugugugaucucacgcauuguugaggaaaaggguccugaauu

SEQ ID NO: 4226386 - RNA, 103 nt, Chlamydophila pneumoniae J138; identical to SEQ ID NO: 4226064

SEQ ID NO: 4226387 - RNA, 85 nt, Chlamydophila pneumoniae J138; identical to SEQ ID NO: 4226100

SEQ ID NO: 4226388 - RNA, 94 nt, Chlamydophila pneumoniae J138; identical to SEQ ID NO: 4225815

SEQ ID NO: 4226389 - RNA, 60 nt, Chlamydophila pneumoniae J138; identical to SEQ ID NO: 4225906

SEQ ID NO: 4226390 - RNA, 116 nt, Chlamydophila pneumoniae J138; identical to SEQ ID NO: 4226045

SEQ ID NO: 4226391 - RNA, 82 nt, Chlamydophila pneumoniae J138
cuugcgccuaguucuuauucaugucuuacgucgcuauuucccuguggguaaggaaaaucagaaaaagagaccuauucgcaag

SEQ ID NO: 4226392 - RNA, 56 nt, Chlamydophila pneumoniae J138; identical to SEQ ID NO: 4225967

SEQ ID NO: 4226393 - RNA, 100 nt, Chlamydophila pneumoniae J138
auccauuuacucagagaaauauagauagaauuuuacaggagaggucaggcggugcuuccgcuucuccuguagagccuauuuaugaugagaucccauggau

SEQ ID NO: 4226394 - RNA, 56 nt, Chlamydophila pneumoniae J138; identical to SEQ ID NO: 4226056

SEQ ID NO: 4226395 - RNA, 73 nt, Chlamydophila pneumoniae J138
gaucacuuguucugguuuaauuaugaucuggcuauauaggcggauucaucauuugacuauugauacuucgauc

SEQ ID NO: 4226396 - RNA, 67 nt, Chlamydophila pneumoniae J138; identical to SEQ ID NO: 4225776

SEQ ID NO: 4226397 - RNA, 60 nt, Chlamydophila pneumoniae J138; identical to SEQ ID NO: 4226009

SEQ ID NO: 4226398 - RNA, 76 nt, Chlamydophila pneumoniae J138; identical to SEQ ID NO: 4225907

SEQ ID NO: 4226399 - RNA, 89 nt, Chlamydophila pneumoniae J138; identical to SEQ ID NO: 4226098

SEQ ID NO: 4226400 - RNA, 82 nt, Chlamydophila pneumoniae J138
gauauacuugauagaacugugauucuuguuccuuagggcaggcccccucaacauaagagaacgcacguucuauacaagaauc

SEQ ID NO: 4226401 - RNA, 70 nt, Chlamydophila pneumoniae J138; identical to SEQ ID NO: 4225844

SEQ ID NO: 4226402 - RNA, 63 nt, Chlamydophila pneumoniae J138; identical to SEQ ID NO: 4226088

SEQ ID NO: 4226403 - RNA, 76 nt, Chlamydophila pneumoniae J138
gcagcuuuggagauaucguuaaaagaucgcaaccagcuaaugcuaguaccugcucuuuuguacgaaaagaugcugc

SEQ ID NO: 4226404 - RNA, 76 nt, Chlamydophila pneumoniae J138; identical to SEQ ID NO: 4226018

SEQ ID NO: 4226405 - RNA, 76 nt, Chlamydophila pneumoniae J138
uagggggcuuuuagaaaauuuuaguggucagcucagagcuuaaaagcgaugcauugaaauuuucuugugucuuuug

SEQ ID NO: 4226406 - RNA, 59 nt, Chlamydophila pneumoniae J138
gaggaauuacaaauucaugagaccuauaaauuaggaauucgagauauuguagugaccuc

SEQ ID NO: 4226407 - RNA, 66 nt, Chlamydophila pneumoniae J138; identical to SEQ ID NO: 4225862

SEQ ID NO: 4226408 - RNA, 71 nt, Chlamydophila pneumoniae J138
agaggauucaauuucagaagaacgcuugcuuugccuaggugaaugguguucaucagagaugugaggacucu

SEQ ID NO: 4226409 - RNA, 60 nt, Chlamydophila pneumoniae J138; identical to SEQ ID NO: 4225955

SEQ ID NO: 4226410 - RNA, 64 nt, Chlamydophila pneumoniae J138; identical to SEQ ID NO: 4226067

SEQ ID NO: 4226411 - RNA, 56 nt, Chlamydophila pneumoniae J138
gaucgcgugaauuugaugacccuucauaauggaaaaggguuggaguuccguguauc

SEQ ID NO: 4226412 - RNA, 121 nt, Chlamydophila pneumoniae J138; identical to SEQ ID NO: 4226097

SEQ ID NO: 4226413 - RNA, 97 nt, Chlamydophila pneumoniae J138; identical to SEQ ID NO: 4225937

SEQ ID NO: 4226414 - RNA, 64 nt, Chlamydophila pneumoniae J138
guccuugauuugugaagaaauugguccuuaggaguugccgcuuucuucagacaguucaagagau

SEQ ID NO: 4226415 - RNA, 83 nt, Chlamydophila pneumoniae J138
agaauguuucugucuguuucuggagaaucccgugaucuugcagugcggauuuaaauugggauucccaguagacaaaacagccu

SEQ ID NO: 4226416 - RNA, 62 nt, Chlamydophila pneumoniae J138
cauuuagaaaacgcgaacaccuuugaucaaagucuucagaggaacgcccuguuuucuucaug

SEQ ID NO: 4226417 - RNA, 104 nt, Chlamydophila pneumoniae J138; identical to SEQ ID NO: 4225988

SEQ ID NO: 4226418 - RNA, 56 nt, Chlamydophila pneumoniae J138
uaaaguuuugcugcgggcuccccguacggacggugagugugcauaacgagccuuug

SEQ ID NO: 4226419 - RNA, 57 nt, Chlamydophila pneumoniae J138; identical to SEQ ID NO: 4225762

SEQ ID NO: 4226420 - RNA, 84 nt, Chlamydophila pneumoniae J138; identical to SEQ ID NO: 4225771

SEQ ID NO: 4226421 - RNA, 73 nt, Chlamydophila pneumoniae J138; identical to SEQ ID NO: 4225958

SEQ ID NO: 4226422 - RNA, 58 nt, Chlamydophila pneumoniae J138; identical to SEQ ID NO: 4225790

SEQ ID NO: 4226423 - RNA, 67 nt, Chlamydophila pneumoniae J138
uuuaugaucauuuaucucggaguucuugcgcaacuuugcgcaugaggaauaagauaguaaucauaaa

SEQ ID NO: 4226424 - RNA, 70 nt, Chlamydophila pneumoniae J138; identical to SEQ ID NO: 4225995

SEQ ID NO: 4226425 - RNA, 95 nt, Chlamydophila pneumoniae TW-183; identical to SEQ ID NO: 4226297

SEQ ID NO: 4226426 - RNA, 63 nt, Chlamydophila pneumoniae TW-183
uucuaaggaauuauccuaaagcagagcgauauuccgcucugcuuuaggauagcuuucaaagaa

SEQ ID NO: 4226427 - RNA, 67 nt, Chlamydophila pneumoniae TW-183; identical to SEQ ID NO: 4226365

SEQ ID NO: 4226428 - RNA, 73 nt, Chlamydophila pneumoniae TW-183
cgcuaauauccuaauuuacaacuauccugggguuaagucgagcacaggaaaauugaacuuagagaaccuagcg

SEQ ID NO: 4226429 - RNA, 68 nt, Chlamydophila pneumoniae TW-183; identical to SEQ ID NO: 4225961

SEQ ID NO: 4226430 - RNA, 77 nt, Chlamydophila pneumoniae TW-183; identical to SEQ ID NO: 4226034

SEQ ID NO: 4226431 - RNA, 69 nt, Chlamydophila pneumoniae TW-183; identical to SEQ ID NO: 4225951

SEQ ID NO: 4226432 - RNA, 67 nt, Chlamydophila pneumoniae TW-183; identical to SEQ ID NO: 4226145

SEQ ID NO: 4226433 - RNA, 56 nt, Chlamydophila pneumoniae TW-183; identical to SEQ ID NO: 4225943

SEQ ID NO: 4226434 - RNA, 64 nt, Chlamydophila pneumoniae TW-183; identical to SEQ ID NO: 4225895

SEQ ID NO: 4226435 - RNA, 80 nt, Chlamydophila pneumoniae TW-183; identical to SEQ ID NO: 4226065

SEQ ID NO: 4226436 - RNA, 85 nt, Chlamydophila pneumoniae TW-183; identical to SEQ ID NO: 4225980

SEQ ID NO: 4226437 - RNA, 63 nt, Chlamydophila pneumoniae TW-183
ucagcuagaucgguuugcaccucuguuaacuucucaauagaacaaaccucagagcuaguuuga

SEQ ID NO: 4226438 - RNA, 86 nt, Chlamydophila pneumoniae TW-183; identical to SEQ ID NO: 4226046

SEQ ID NO: 4226439 - RNA, 63 nt, Chlamydophila pneumoniae TW-183; identical to SEQ ID NO: 4226028

SEQ ID NO: 4226440 - RNA, 58 nt, Chlamydophila pneumoniae TW-183
uccugcaaaaacuccuuuggaaggcuucaaagagaucaauccgguaguuuuugcugga

SEQ ID NO: 4226441 - RNA, 107 nt, Chlamydophila pneumoniae TW-183; identical to SEQ ID NO: 4225974

SEQ ID NO: 4226442 - RNA, 58 nt, Chlamydophila pneumoniae TW-183; identical to SEQ ID NO: 4225841

SEQ ID NO: 4226443 - RNA, 59 nt, Chlamydophila pneumoniae TW-183
ggaaguuuacucuugauuuuggggcugauuuucuuugucucuuaucaccggaaacuuuc

SEQ ID NO: 4226444 - RNA, 79 nt, Chlamydophila pneumoniae TW-183; identical to SEQ ID NO: 4226044

SEQ ID NO: 4226445 - RNA, 81 nt, Chlamydophila pneumoniae TW-183; identical to SEQ ID NO: 4226031

SEQ ID NO: 4226446 - RNA, 93 nt, Chlamydophila pneumoniae TW-183; identical to SEQ ID NO: 4226138

SEQ ID NO: 4226447 - RNA, 72 nt, Chlamydophila pneumoniae TW-183
ggcuugaacguggguacuuggaggacauaaagauuauaaauuucuuuaaacucucgagacuccguaauugcu

SEQ ID NO: 4226448 - RNA, 56 nt, Chlamydophila pneumoniae TW-183; identical to SEQ ID NO: 4225931

SEQ ID NO: 4226449 - RNA, 57 nt, Chlamydophila pneumoniae TW-183; identical to SEQ ID NO: 4226091

SEQ ID NO: 4226450 - RNA, 99 nt, Chlamydophila pneumoniae TW-183; identical to SEQ ID NO: 4226193

SEQ ID NO: 4226451 - RNA, 86 nt, Chlamydophila pneumoniae TW-183; identical to SEQ ID NO: 4226063

SEQ ID NO: 4226452 - RNA, 58 nt, Chlamydophila pneumoniae TW-183; identical to SEQ ID NO: 4225810

SEQ ID NO: 4226453 - RNA, 116 nt, Chlamydophila pneumoniae TW-183
guguuuuuccuugcuuuuucauaagauauuucuguagaauccucucgaaguaugucgagcuaucauuuggcauaauaggauagcgauuuuggaguugucaauaugaaaaaaaauac

SEQ ID NO: 4226454 - RNA, 96 nt, Chlamydophila pneumoniae TW-183; identical to SEQ ID NO: 4226021

SEQ ID NO: 4226455 - RNA, 61 nt, Chlamydophila pneumoniae TW-183; identical to SEQ ID NO: 4226003

SEQ ID NO: 4226456 - RNA, 70 nt, Chlamydophila pneumoniae TW-183; identical to SEQ ID NO: 4225941

SEQ ID NO: 4226457 - RNA, 76 nt, Chlamydophila pneumoniae TW-183; identical to SEQ ID NO: 4226042

SEQ ID NO: 4226458 - RNA, 61 nt, Chlamydophila pneumoniae TW-183; identical to SEQ ID NO: 4226030

SEQ ID NO: 4226459 - RNA, 64 nt, Chlamydophila pneumoniae TW-183; identical to SEQ ID NO: 4225939

SEQ ID NO: 4226460 - RNA, 64 nt, Chlamydophila pneumoniae TW-183; identical to SEQ ID NO: 4225948

SEQ ID NO: 4226461 - RNA, 62 nt, Chlamydophila pneumoniae TW-183; identical to SEQ ID NO: 4225772

SEQ ID NO: 4226462 - RNA, 64 nt, Chlamydophila pneumoniae TW-183; identical to SEQ ID NO: 4226057

SEQ ID NO: 4226463 - RNA, 64 nt, Chlamydophila pneumoniae TW-183
aaauaaagaacacauugcagaucagaaagauaaggcccauagaucugcgauguauucuugauuu

SEQ ID NO: 4226464 - RNA, 72 nt, Chlamydophila pneumoniae TW-183; identical to SEQ ID NO: 4225891

SEQ ID NO: 4226465 - RNA, 65 nt, Chlamydophila pneumoniae TW-183; identical to SEQ ID NO: 4225756

SEQ ID NO: 4226466 - RNA, 59 nt, Chlamydophila pneumoniae TW-183
gcauuuagaagcaggaaauauagugcaguuucuuuuaucuuuccagucuucugagaugc

SEQ ID NO: 4226467 - RNA, 64 nt, Chlamydophila pneumoniae TW-183; identical to SEQ ID NO: 4225965

SEQ ID NO: 4226468 - RNA, 77 nt, Chlamydophila pneumoniae TW-183; identical to SEQ ID NO: 4226083

SEQ ID NO: 4226469 - RNA, 57 nt, Chlamydophila pneumoniae TW-183
uuauggucggcugauuuucccucaaaccuccauguauggacaauucuuugaccauaa

SEQ ID NO: 4226470 - RNA, 65 nt, Chlamydophila pneumoniae TW-183
ggaugucuagcaagaguugucaaaaugauaacccacgguugauuuugauuuucugcuucugaucc

SEQ ID NO: 4226471 - RNA, 77 nt, Chlamydophila pneumoniae TW-183
ccuucgccaaacgaguauuuuuucauguccgcaggagaaaaccauuuugcuuuggguagauacuacguaagcgaagg

SEQ ID NO: 4226472 - RNA, 64 nt, Chlamydophila pneumoniae TW-183; identical to SEQ ID NO: 4226141

SEQ ID NO: 4226473 - RNA, 61 nt, Chlamydophila pneumoniae TW-183
gugauggucaguuuucugaagaaaguaaaacaagcuaucuuagagcgaugcugaccgacau

SEQ ID NO: 4226474 - RNA, 73 nt, Chlamydophila pneumoniae TW-183
aaagaauggugcuaugagaucuuuugggcuuaagugaguuucggccaacaaaucucuuauagcugcugucuuu

SEQ ID NO: 4226475 - RNA, 71 nt, Chlamydophila pneumoniae TW-183
cugaacuugcucuucgcuacuuuuacagacgaucucugcggcugcagaaggagugggagcacgcacaucag

SEQ ID NO: 4226476 - RNA, 55 nt, Chlamydophila pneumoniae TW-183; identical to SEQ ID NO: 4225902

SEQ ID NO: 4226477 - RNA, 94 nt, Chlamydophila pneumoniae TW-183
guacagagaugccuauguguaacucuauagcuaugaaaaagcaaaagcguggcuuugugcuuauggaauuacucaugucguucacucuaauugc

SEQ ID NO: 4226478 - RNA, 90 nt, Chlamydophila pneumoniae TW-183
gaagagcgugcgcagauuaccaagaagauggucggcgcauuaaguuauccuuguguguuguuaguauuuucuuuugccgugaugcuuuuc

SEQ ID NO: 4226479 - RNA, 65 nt, Chlamydophila pneumoniae TW-183
ucuguauugucccagacaaccaaacaugucauugcuaugggugagugucgacagacaauagcaga

SEQ ID NO: 4226480 - RNA, 77 nt, Chlamydophila pneumoniae TW-183
ggucuggucugggaacuuugugaagcuugagaaggaagaccuucuagagacucgcgaaguaaaacuguaaucagauc

SEQ ID NO: 4226481 - RNA, 83 nt, Chlamydophila pneumoniae TW-183; identical to SEQ ID NO: 4225754

SEQ ID NO: 4226482 - RNA, 75 nt, Chlamydophila pneumoniae TW-183
uguuucugucuguuucuggagaaucccgugaucuugcagugcggauuuaaauugggauucccaguagacaaaaca

SEQ ID NO: 4226483 - RNA, 94 nt, Chlamydophila pneumoniae TW-183; identical to SEQ ID NO: 4225815

SEQ ID NO: 4226484 - RNA, 128 nt, Chlamydophila pneumoniae TW-183; identical to SEQ ID NO: 4225936

SEQ ID NO: 4226485 - RNA, 56 nt, Chlamydophila pneumoniae TW-183; identical to SEQ ID NO: 4225967

SEQ ID NO: 4226486 - RNA, 80 nt, Chlamydophila pneumoniae TW-183; identical to SEQ ID NO: 4225849

SEQ ID NO: 4226487 - RNA, 63 nt, Chlamydophila pneumoniae TW-183; identical to SEQ ID NO: 4225878

SEQ ID NO: 4226488 - RNA, 97 nt, Chlamydophila pneumoniae TW-183
uccgaccuacuucagguuuagugaaagaagcguuuuucaguaucuguagggaagauauagaaggggcugcuuuuuuagaucuuuuugccgggauggg

SEQ ID NO: 4226489 - RNA, 61 nt, Chlamydophila pneumoniae TW-183; identical to SEQ ID NO: 4225971

SEQ ID NO: 4226490 - RNA, 56 nt, Chlamydophila pneumoniae TW-183; identical to SEQ ID NO: 4226056

SEQ ID NO: 4226491 - RNA, 77 nt, Chlamydophila pneumoniae TW-183; identical to SEQ ID NO: 4226023

SEQ ID NO: 4226492 - RNA, 57 nt, Chlamydophila pneumoniae TW-183; identical to SEQ ID NO: 4225911

SEQ ID NO: 4226493 - RNA, 102 nt, Chlamydophila pneumoniae TW-183; identical to SEQ ID NO: 4225836

SEQ ID NO: 4226494 - RNA, 73 nt, Chlamydophila pneumoniae TW-183; identical to SEQ ID NO: 4225994

SEQ ID NO: 4226495 - RNA, 68 nt, Chlamydophila pneumoniae TW-183
cgauaucagauccuuuagaagaaagugccgcagaagagggggauucagauuuagaggaucggguaucg

SEQ ID NO: 4226496 - RNA, 55 nt, Chlamydophila pneumoniae TW-183; identical to SEQ ID NO: 4225780

SEQ ID NO: 4226497 - RNA, 90 nt, Chlamydophila pneumoniae TW-183; identical to SEQ ID NO: 4226069

SEQ ID NO: 4226498 - RNA, 100 nt, Chlamydophila pneumoniae TW-183
auccauuuacucagagaaauauagauagaauuuuacaggagaggucaggcggugcuuccgcuucuccuguagagccuauuuaugaugagaucccguggau

SEQ ID NO: 4226499 - RNA, 77 nt, Chlamydophila pneumoniae TW-183; identical to SEQ ID NO: 4226093

SEQ ID NO: 4226500 - RNA, 58 nt, Chlamydophila pneumoniae TW-183
gugaguaggcucccccugcuaagaggggauuaaacucuuguaggaaagccuuauuuac

SEQ ID NO: 4226501 - RNA, 63 nt, Chlamydophila pneumoniae TW-183; identical to SEQ ID NO: 4225893

SEQ ID NO: 4226502 - RNA, 74 nt, Chlamydophila pneumoniae TW-183; identical to SEQ ID NO: 4226082

SEQ ID NO: 4226503 - RNA, 72 nt, Chlamydophila pneumoniae TW-183; identical to SEQ ID NO: 4226058

SEQ ID NO: 4226504 - RNA, 66 nt, Chlamydophila pneumoniae TW-183; identical to SEQ ID NO: 4225786

SEQ ID NO: 4226505 - RNA, 62 nt, Chlamydophila pneumoniae TW-183; identical to SEQ ID NO: 4225834

SEQ ID NO: 4226506 - RNA, 109 nt, Chlamydophila pneumoniae TW-183; identical to SEQ ID NO: 4225866

SEQ ID NO: 4226507 - RNA, 78 nt, Chlamydophila pneumoniae TW-183; identical to SEQ ID NO: 4225758

SEQ ID NO: 4226508 - RNA, 63 nt, Chlamydophila pneumoniae TW-183; identical to SEQ ID NO: 4225769

SEQ ID NO: 4226509 - RNA, 83 nt, Chlamydophila pneumoniae TW-183
gccuccccuuauuuaaugaaaucgaagauaccgcgaaacgggcagaucauuggcguuguuauaucgaguugacuaaggaaggc

SEQ ID NO: 4226510 - RNA, 73 nt, Chlamydophila pneumoniae TW-183; identical to SEQ ID NO: 4225977

SEQ ID NO: 4226511 - RNA, 75 nt, Chlamydophila pneumoniae TW-183; identical to SEQ ID NO: 4225959

SEQ ID NO: 4226512 - RNA, 117 nt, Chlamydophila pneumoniae TW-183; identical to SEQ ID NO: 4226318

SEQ ID NO: 4226513 - RNA, 62 nt, Chlamydophila pneumoniae TW-183; identical to SEQ ID NO: 4225966

SEQ ID NO: 4226514 - RNA, 57 nt, Chlamydophila pneumoniae TW-183; identical to SEQ ID NO: 4225793

SEQ ID NO: 4226515 - RNA, 76 nt, Chlamydophila pneumoniae TW-183; identical to SEQ ID NO: 4226403

SEQ ID NO: 4226516 - RNA, 85 nt, Chlamydophila pneumoniae TW-183; identical to SEQ ID NO: 4225792

SEQ ID NO: 4226517 - RNA, 85 nt, Chlamydophila pneumoniae TW-183
gaauccacauccauuguucaggcugacuggcgaucccuuuuucuaaaaaucccaucaucugauccauaaggauagccacggauuc

SEQ ID NO: 4226518 - RNA, 65 nt, Chlamydophila pneumoniae TW-183; identical to SEQ ID NO: 4225899

SEQ ID NO: 4226519 - RNA, 68 nt, Chlamydophila pneumoniae TW-183; identical to SEQ ID NO: 4225880

SEQ ID NO: 4226520 - RNA, 59 nt, Chlamydophila pneumoniae TW-183
ucuucacuucccgcaguuuuagaguuuacaaucuugaaugaggacugugggcaggagga

SEQ ID NO: 4226521 - RNA, 76 nt, Chlamydophila pneumoniae TW-183
gagucccuuacuuguaaagacuacagauccugaagcgccauuagcguugauuguaaugucuuuauuagacggacuu

SEQ ID NO: 4226522 - RNA, 96 nt, Chlamydophila pneumoniae TW-183; identical to SEQ ID NO: 4225933

SEQ ID NO: 4226523 - RNA, 89 nt, Chlamydophila pneumoniae TW-183; identical to SEQ ID NO: 4226158

SEQ ID NO: 4226524 - RNA, 58 nt, Chlamydophila pneumoniae TW-183; identical to SEQ ID NO: 4225942

SEQ ID NO: 4226525 - RNA, 77 nt, Chlamydophila pneumoniae TW-183
ggaauugaacucuaaggacuacuccuaccucaauauauuuucuugucacggagauaguaguccucagcuuuuauucc

SEQ ID NO: 4226526 - RNA, 55 nt, Chlamydophila pneumoniae TW-183; identical to SEQ ID NO: 4226288

SEQ ID NO: 4226527 - RNA, 56 nt, Chlamydophila pneumoniae TW-183; identical to SEQ ID NO: 4226019

SEQ ID NO: 4226528 - RNA, 60 nt, Chlamydophila pneumoniae TW-183; identical to SEQ ID NO: 4225906

SEQ ID NO: 4226529 - RNA, 69 nt, Chlamydophila pneumoniae TW-183
cugagugguucuuccuaaagaacuauccugcaugggguacuuuuuuaauagggcaccuuuuaaauucag

SEQ ID NO: 4226530 - RNA, 76 nt, Chlamydophila pneumoniae TW-183
auguucuaagugccauaaaggaaaacuaguaaaaaucuggucuaaaaacaguuauuucuauggcugcucagaauau

SEQ ID NO: 4226531 - RNA, 66 nt, Chlamydophila pneumoniae TW-183
guuuuuuagggcuaaagcgagcgaggaggucuuugucuccaacuugucuugccaguucuaaaacgc

SEQ ID NO: 4226532 - RNA, 70 nt, Chlamydophila pneumoniae TW-183
aucuuuaggacuugaugaaggcgaaguauucaaugccuauaaugaaagagccucaauuagggcuaaagau

SEQ ID NO: 4226533 - RNA, 63 nt, Chlamydophila pneumoniae TW-183; identical to SEQ ID NO: 4225782

SEQ ID NO: 4226534 - RNA, 60 nt, Chlamydophila pneumoniae TW-183; identical to SEQ ID NO: 4225851

SEQ ID NO: 4226535 - RNA, 71 nt, Chlamydophila pneumoniae TW-183; identical to SEQ ID NO: 4225778

SEQ ID NO: 4226536 - RNA, 60 nt, Chlamydophila pneumoniae TW-183
gauugguggaucgcggcuuauggugaugaagguuacucuauagaugcagauccagguguc

SEQ ID NO: 4226537 - RNA, 63 nt, Chlamydophila pneumoniae TW-183; identical to SEQ ID NO: 4225828

SEQ ID NO: 4226538 - RNA, 110 nt, Chlamydophila pneumoniae TW-183; identical to SEQ ID NO: 4225807

SEQ ID NO: 4226539 - RNA, 76 nt, Chlamydophila pneumoniae TW-183
agaggagagcagggcuugauagagcgucucuucagaauggugaagagugcccuuaagaagcuuucugcaauacuuu

SEQ ID NO: 4226540 - RNA, 62 nt, Chlamydophila pneumoniae TW-183
uagaaggaccucgaucagugcuuggauaucaugaguaugaaggccugucguagguucaucua

SEQ ID NO: 4226541 - RNA, 73 nt, Chlamydophila pneumoniae TW-183
uugacgacagcccaugguacagggcaggcucuugaagauuuagauaguuugcuuuguuauuaugaucaguuaa

SEQ ID NO: 4226542 - RNA, 89 nt, Chlamydophila pneumoniae TW-183
guuuuuugacagccuuauaagaagcucuuccagaaacaagaucagaauccaaagccaucuguuuugcuggaagagccucuaagaaaaac

SEQ ID NO: 4226543 - RNA, 59 nt, Chlamydophila pneumoniae TW-183; identical to SEQ ID NO: 4225869

SEQ ID NO: 4226544 - RNA, 65 nt, Chlamydophila pneumoniae TW-183
cuuuuuguaaguugccaucuucuaagacaagccaacccguaguaggagcgagcugcuucaaagag

SEQ ID NO: 4226545 - RNA, 81 nt, Chlamydophila pneumoniae TW-183
ucgcuuagcauccuauuuucaugagaaaggggacucucgagaacgcaucccuuuucucaugaaaaagaccgcgucuauuga

SEQ ID NO: 4226546 - RNA, 88 nt, Chlamydophila pneumoniae TW-183; identical to SEQ ID NO: 4225827

SEQ ID NO: 4226547 - RNA, 58 nt, Chlamydophila pneumoniae TW-183; identical to SEQ ID NO: 4226384

SEQ ID NO: 4226548 - RNA, 59 nt, Chlamydophila pneumoniae TW-183; identical to SEQ ID NO: 4226123

SEQ ID NO: 4226549 - RNA, 61 nt, Chlamydophila pneumoniae TW-183
uugaagaauuuguaaacucguauuuucaguuuuuagagaucucugaguccgaauuuuucaa

SEQ ID NO: 4226550 - RNA, 62 nt, Chlamydophila pneumoniae TW-183; identical to SEQ ID NO: 4225871

SEQ ID NO: 4226551 - RNA, 60 nt, Chlamydophila pneumoniae TW-183; identical to SEQ ID NO: 4225784

SEQ ID NO: 4226552 - RNA, 69 nt, Chlamydophila pneumoniae TW-183; identical to SEQ ID NO: 4226329

SEQ ID NO: 4226553 - RNA, 85 nt, Chlamydophila pneumoniae TW-183; identical to SEQ ID NO: 4226100

SEQ ID NO: 4226554 - RNA, 59 nt, Chlamydophila pneumoniae TW-183; identical to SEQ ID NO: 4225838

SEQ ID NO: 4226555 - RNA, 81 nt, Chlamydophila pneumoniae TW-183; identical to SEQ ID NO: 4225960

SEQ ID NO: 4226556 - RNA, 130 nt, Chlamydophila pneumoniae TW-183
gaggcaaagaaaauaucucuccagaaccuuggauuuucaagucuuuugaagaaggugaaguugaggauucaucaagagaaagaagaagaucagggauuaggauacgcguauuauuuaggucgggauaguc

SEQ ID NO: 4226557 - RNA, 102 nt, Chlamydophila pneumoniae TW-183; identical to SEQ ID NO: 4226071

SEQ ID NO: 4226558 - RNA, 68 nt, Chlamydophila pneumoniae TW-183; identical to SEQ ID NO: 4225750

SEQ ID NO: 4226559 - RNA, 55 nt, Chlamydophila pneumoniae TW-183
gagagauuuuuucauacuuauccuuuucaaggauauaggcgugugaaaucugcuc

SEQ ID NO: 4226560 - RNA, 64 nt, Chlamydophila pneumoniae TW-183; identical to SEQ ID NO: 4225835

SEQ ID NO: 4226561 - RNA, 107 nt, Chlamydophila pneumoniae TW-183; identical to SEQ ID NO: 4225766

SEQ ID NO: 4226562 - RNA, 69 nt, Chlamydophila pneumoniae TW-183; identical to SEQ ID NO: 4225910

SEQ ID NO: 4226563 - RNA, 82 nt, Chlamydophila pneumoniae TW-183
ugcugauagguguuauuugauuauugaugggaagaucuucuuugaagggucuucaagccaaaugaucaguaacccuauggua

SEQ ID NO: 4226564 - RNA, 74 nt, Chlamydophila pneumoniae TW-183
ucuugaccuucucggguucuuuuccuauaaugcucucaguuacgauuguucuaguaggacucgagauggcuaga

SEQ ID NO: 4226565 - RNA, 69 nt, Chlamydophila pneumoniae TW-183; identical to SEQ ID NO: 4226036

SEQ ID NO: 4226566 - RNA, 59 nt, Chlamydophila pneumoniae TW-183; identical to SEQ ID NO: 4226289

SEQ ID NO: 4226567 - RNA, 61 nt, Chlamydophila pneumoniae TW-183; identical to SEQ ID NO: 4226051

SEQ ID NO: 4226568 - RNA, 71 nt, Chlamydophila pneumoniae TW-183; identical to SEQ ID NO: 4225926

SEQ ID NO: 4226569 - RNA, 64 nt, Chlamydophila pneumoniae TW-183; identical to SEQ ID NO: 4226067

SEQ ID NO: 4226570 - RNA, 56 nt, Chlamydophila pneumoniae TW-183; identical to SEQ ID NO: 4225826

SEQ ID NO: 4226571 - RNA, 55 nt, Chlamydophila pneumoniae TW-183; identical to SEQ ID NO: 4225775

SEQ ID NO: 4226572 - RNA, 118 nt, Chlamydophila pneumoniae TW-183; identical to SEQ ID NO: 4225821

SEQ ID NO: 4226573 - RNA, 67 nt, Chlamydophila pneumoniae TW-183; identical to SEQ ID NO: 4226099

SEQ ID NO: 4226574 - RNA, 100 nt, Chlamydophila pneumoniae TW-183; identical to SEQ ID NO: 4226092

SEQ ID NO: 4226575 - RNA, 115 nt, Chlamydophila pneumoniae TW-183; identical to SEQ ID NO: 4226242

SEQ ID NO: 4226576 - RNA, 59 nt, Chlamydophila pneumoniae TW-183; identical to SEQ ID NO: 4225752

SEQ ID NO: 4226577 - RNA, 67 nt, Chlamydophila pneumoniae TW-183; identical to SEQ ID NO: 4225797

SEQ ID NO: 4226578 - RNA, 59 nt, Chlamydophila pneumoniae TW-183
uucugaguaaaagacguagucuuuguucccuggagcuagaaaccagucauugcuuagga

SEQ ID NO: 4226579 - RNA, 62 nt, Chlamydophila pneumoniae TW-183; identical to SEQ ID NO: 4225814

SEQ ID NO: 4226580 - RNA, 60 nt, Chlamydophila pneumoniae TW-183; identical to SEQ ID NO: 4225955

SEQ ID NO: 4226581 - RNA, 61 nt, Chlamydophila pneumoniae TW-183; identical to SEQ ID NO: 4225953

SEQ ID NO: 4226582 - RNA, 90 nt, Chlamydophila pneumoniae TW-183
ucuacaggggacucuucacugucugaaguuccauguucgucuuuguaggauaguauagugaggagaucuucccgauucaacauguguagg

SEQ ID NO: 4226583 - RNA, 57 nt, Chlamydophila pneumoniae TW-183
caagggggggacauugccuuugcuguagcauauacaggaaaccaucuucucucuuug

SEQ ID NO: 4226584 - RNA, 67 nt, Chlamydophila pneumoniae TW-183; identical to SEQ ID NO: 4225823

SEQ ID NO: 4226585 - RNA, 55 nt, Chlamydophila pneumoniae TW-183; identical to SEQ ID NO: 4225947

SEQ ID NO: 4226586 - RNA, 87 nt, Chlamydophila pneumoniae TW-183; identical to SEQ ID NO: 4225884

SEQ ID NO: 4226587 - RNA, 83 nt, Chlamydophila pneumoniae TW-183
gauugggagucgcuuuauauguuaggaaauaguguuggaucauaucuaauacugugccuggacagucugaaauaucuucgauc

SEQ ID NO: 4226588 - RNA, 76 nt, Chlamydophila pneumoniae TW-183
uuuaguguucugcucaaugguuuuaggaaucgcuuccauuagcgauaugaaaaaauugggacgcauuggcauuaaa

SEQ ID NO: 4226589 - RNA, 92 nt, Chlamydophila pneumoniae TW-183; identical to SEQ ID NO: 4226369

SEQ ID NO: 4226590 - RNA, 100 nt, Chlamydophila pneumoniae TW-183; identical to SEQ ID NO: 4226192

SEQ ID NO: 4226591 - RNA, 105 nt, Chlamydophila pneumoniae TW-183; identical to SEQ ID NO: 4225946

SEQ ID NO: 4226592 - RNA, 103 nt, Chlamydophila pneumoniae TW-183; identical to SEQ ID NO: 4226064

SEQ ID NO: 4226593 - RNA, 71 nt, Chlamydophila pneumoniae TW-183
uuguaaaaaaaucucagaaccaagcuuugcuaaaaacuagcaaagcuuaggguccugugguuaguuaacaa

SEQ ID NO: 4226594 - RNA, 100 nt, Chlamydophila pneumoniae TW-183; identical to SEQ ID NO: 4225763

SEQ ID NO: 4226595 - RNA, 124 nt, Chlamydophila pneumoniae TW-183; identical to SEQ ID NO: 4226357

SEQ ID NO: 4226596 - RNA, 116 nt, Chlamydophila pneumoniae TW-183; identical to SEQ ID NO: 4226045

SEQ ID NO: 4226597 - RNA, 65 nt, Chlamydophila pneumoniae TW-183; identical to SEQ ID NO: 4226054

SEQ ID NO: 4226598 - RNA, 71 nt, Chlamydophila pneumoniae TW-183; identical to SEQ ID NO: 4225968

SEQ ID NO: 4226599 - RNA, 70 nt, Chlamydophila pneumoniae TW-183; identical to SEQ ID NO: 4225755

SEQ ID NO: 4226600 - RNA, 81 nt, Chlamydophila pneumoniae TW-183; identical to SEQ ID NO: 4226351

SEQ ID NO: 4226601 - RNA, 82 nt, Chlamydophila pneumoniae TW-183; identical to SEQ ID NO: 4225918

SEQ ID NO: 4226602 - RNA, 67 nt, Chlamydophila pneumoniae TW-183; identical to SEQ ID NO: 4226049

SEQ ID NO: 4226603 - RNA, 68 nt, Chlamydophila pneumoniae TW-183
guuuaccguucuccucccagcaauuucucguuguguacagcgagaagaucaugagaggggauugaaac

SEQ ID NO: 4226604 - RNA, 64 nt, Chlamydophila pneumoniae TW-183; identical to SEQ ID NO: 4226053

SEQ ID NO: 4226605 - RNA, 68 nt, Chlamydophila pneumoniae TW-183
uguauagaacgugcguucucuuauguugagggggccugcccuaaggaacaagaaucacaguucuauca

SEQ ID NO: 4226606 - RNA, 81 nt, Chlamydophila pneumoniae TW-183; identical to SEQ ID NO: 4225984

SEQ ID NO: 4226607 - RNA, 92 nt, Chlamydophila pneumoniae TW-183; identical to SEQ ID NO: 4226149

SEQ ID NO: 4226608 - RNA, 100 nt, Chlamydophila pneumoniae TW-183
aauaccuagagcucugaaauaaacucgggcagacguacugcauagguuuuaugucuaagcgguagauguuaugaguuuuuaauuuucuguuaaugguauu

SEQ ID NO: 4226609 - RNA, 61 nt, Chlamydophila pneumoniae TW-183; identical to SEQ ID NO: 4225779

SEQ ID NO: 4226610 - RNA, 65 nt, Coxiella burnetii RSA 493
cauuacaaauggacgaugcagaaaaaguaggucaacucgcauucgcgcgucaucgcauuuuaaug

SEQ ID NO: 4226611 - RNA, 84 nt, Coxiella burnetii RSA 493
aguagcccguaugagcgaacgaauacgggaaaacaaugaugucgucucucguucccguauuucgcuucgcucauacgggcuacu

SEQ ID NO: 4226612 - RNA, 89 nt, Coxiella burnetii RSA 493
gucacuaauugugauaugaauucaauaaggccgauuuuaucugcggugcugaugagcgcacgcuuaaucggccuuucaguaucaccgac

SEQ ID NO: 4226613 - RNA, 86 nt, Coxiella burnetii RSA 493
aguagcccgucugagcggagcgaaauacggggacgauagacgacaucauuguuuucccguauuucgcuucgcucauacgggcuacu

SEQ ID NO: 4226614 - RNA, 88 nt, Coxiella burnetii RSA 493
aaguagcccguaugagcgaagcgaaauacggggacgaugaugacaucauuguuuuccccguauuucgcuucgcucauacgggcuacuu

SEQ ID NO: 4226615 - RNA, 55 nt, Coxiella burnetii RSA 493
ucucaauaccugaaagggacaagguuaaagaacaaggucugcuacaguauugagg

SEQ ID NO: 4226616 - RNA, 87 nt, Coxiella burnetii RSA 493
aaguaaccccuaucagcgaagcgaaacacggggacgauagaugacaucauuguuucccguauuucgcuucgcucauacggacuacuu

SEQ ID NO: 4226617 - RNA, 82 nt, Coxiella burnetii RSA 493
guugggcuucgcaagcucagcccaaccuacgugcuaaaauugccaauuuaagcgagguugggcugagcuugugaagcacaau

SEQ ID NO: 4226618 - RNA, 83 nt, Coxiella burnetii RSA 493
guagcccguauggagaagcagaauacgggauuuugauugaaaucuuuaauuccccguauuccgcuucgcuccauacgggcuac

SEQ ID NO: 4226619 - RNA, 102 nt, Coxiella burnetii RSA 493
aggcagaggacagaggacaguguucguguggcuucgccacaauuaauuuauaaaauuuaguugucgcguagcgacacaaccacugucuucugucuucugucu

SEQ ID NO: 4226620 - RNA, 80 nt, Coxiella burnetii RSA 493
uagcccguaugagcgaagcgaaauacggggacaauagaugacaucauuguuuucccguauucguucgcucauacgggcua

SEQ ID NO: 4226621 - RNA, 73 nt, Coxiella burnetii RSA 493
acauuaacccaguggauugaucggauuguauuaaaccguuucuuaggcauuccgauuuuuuucgcuguuaugu

SEQ ID NO: 4226622 - RNA, 74 nt, Coxiella burnetii RSA 493
cguaugcagcgaagcgaaauacggggacaauagaugacaucauuguuuucccguauuucgcuucgcuucauacg

SEQ ID NO: 4226623 - RNA, 59 nt, Coxiella burnetii RSA 493
cguaccgauauuguguggcagcgccuuuaaaaauaaggguguacaagcauuauuggaug

SEQ ID NO: 4226624 - RNA, 86 nt, Coxiella burnetii RSA 493
uugauguugaagauauguuauuggaagaagcaaaaaagcgaaugaaugaaauugcuucccaauuaaauauuuccuccgaucaucaa

SEQ ID NO: 4226625 - RNA, 70 nt, Coxiella burnetii RSA 493
uuggucagcuuucaugccagcccgucgugugcgaacgacgacucgaucagccacaaugaaagccgaauaa

SEQ ID NO: 4226626 - RNA, 66 nt, Coxiella burnetii RSA 493
gcuuaaaugaaugaaaccgaucacgaauuuuuauccuuaucuugacugguuuuaaacauugcgagc

SEQ ID NO: 4226627 - RNA, 70 nt, Coxiella burnetii RSA 493
ggugauugacgauugucuaaaacggauaauuacugcccuucaauccguuggcggggaagcguuaaucacc

SEQ ID NO: 4226628 - RNA, 64 nt, Coxiella burnetii RSA 493
ucgcgaucggcacagccaugauuguuuauccgccggcggauuuagacgcugugcccgaucaaga

SEQ ID NO: 4226629 - RNA, 98 nt, Coxiella burnetii RSA 493
gagcuaaguagcccguaugagcgaagcgaaauacggggacgauagaugacaucauuguuuucccguauuucgcuucgcucauacgggcuacuuuacuu

SEQ ID NO: 4226630 - RNA, 63 nt, Coxiella burnetii RSA 493
ggugggguuugagucggcuuguaaucgaaaugggauaaugcagguaaauucggaacccacacc

SEQ ID NO: 4226631 - RNA, 60 nt, Coxiella burnetii RSA 493
ggaaaugugaguaauuaaaacuuuauugauuucaaugaguuaugcuguacuuauguuucu

SEQ ID NO: 4226632 - RNA, 60 nt, Coxiella burnetii RSA 493
ccaagaucguuuggcaggcaucuucgacgauaugaagauugugcuuuuuagcgaucuugg

SEQ ID NO: 4226633 - RNA, 81 nt, Coxiella burnetii RSA 493
aagucgcccguaugcagcgaagcgaaauacggggaaauaaugacaauucccguauuucgcuucgcugcauacggacgacuu

SEQ ID NO: 4226634 - RNA, 59 nt, Coxiella burnetii RSA 493
uuugaacuuuggugaaaucgcccuggugguaacacagggcgauuucaccaaaguucaaa

SEQ ID NO: 4226635 - RNA, 92 nt, Coxiella burnetii RSA 493
uaaguaacccguaugagcgaagcgaaauacggggacgauaacgacgacaucauuguuuucccguauuucgcuucgcucauacgggcuacuug

SEQ ID NO: 4226636 - RNA, 83 nt, Coxiella burnetii RSA 493
cccugaucuuauugaagcagcaccagcuuaucagcaaaaauuauaccaacuguugcgaugguuuaauguuuuagugggcgggg

SEQ ID NO: 4226637 - RNA, 88 nt, Coxiella burnetii RSA 493
gaagaccgcuaauuuuaguugcuaaugaaacggcuuguuuaagugacagcucugaaagcaauaggguuaguaacuguugguguucuuc

SEQ ID NO: 4226638 - RNA, 98 nt, Coxiella burnetii RSA 493
ucagcuaaguagcccguaugagcgaacgaaauacggggacgauugacgacaucguuguuuucccguauuucgcuucgcucauacgggcuacugguuga

SEQ ID NO: 4226639 - RNA, 90 nt, Coxiella burnetii RSA 493
uaaguagcccguaugagcgaagcgaaauacggggacgauugacgacaucguuguuuucccguauuucgcuucgcucauacgggcuacuug

SEQ ID NO: 4226640 - RNA, 90 nt, Coxiella burnetii RSA 493
uaaguagcccguaugagcgaagcgaaauacggggacgauugacgacaucauuguuuucccguauuucgcuucgcucauacgggcuacuua

SEQ ID NO: 4226641 - RNA, 89 nt, Coxiella burnetii RSA 493
uugguuggguucugcauuucuuagagaagcgcuugaagcguauucaaacgcuucuuuggaagagcuaaugagaaaauuacuugauccag

SEQ ID NO: 4226642 - RNA, 109 nt, Coxiella burnetii RSA 493
ggguuuguuuacaauucuacucugcuggccauaauuaauugauuuccugugguucgcugcucgaaaaucaaugaauucuggcucagccuagcgaauuguaaacagaccc

SEQ ID NO: 4226643 - RNA, 55 nt, Coxiella burnetii RSA 493
uauuucagccguuucucguuugacguugaccucacgucaaaaaaaugcugagaug

SEQ ID NO: 4226644 - RNA, 105 nt, Coxiella burnetii RSA 493
ugguuuaacagaaggagaaggguguuuuucgauaucauuuaacuucagaaaaaaguuaaaaauugguauugaaacaagaccaucuuuuuccaucacguuaaauca

SEQ ID NO: 4226645 - RNA, 88 nt, Coxiella burnetii RSA 493
aguagcccguaugagcgaagcgaaauacgggaaaacaaugaugucgucguuaucguccccguauuucgcuucgcucauacggguuacu

SEQ ID NO: 4226646 - RNA, 85 nt, Coxiella burnetii RSA 493
ucccuaaagcuagcaguagcccguaugaaacaaagcggaaugacgcaauucccguaucucgcuuugcuucauacgggcuauggga

SEQ ID NO: 4226647 - RNA, 65 nt, Coxiella burnetii RSA 493
guagccuuguuuuuguuugaacaucaauaaaaggaaugagauguuuaaacauauccaaugguaac

SEQ ID NO: 4226648 - RNA, 73 nt, Coxiella burnetii RSA 493
cguaugagcgaagcgaaauacggggacaauagaugacaucauuguuuucccguauuucgcuucgcuucauacg

SEQ ID NO: 4226649 - RNA, 79 nt, Coxiella burnetii RSA 493
auaguccuugaucggccuugcuaagaugaauauucuuaaauucaagauauuccucgaagucaagcggauuaauuucuau

SEQ ID NO: 4226650 - RNA, 55 nt, Coxiella burnetii RSA 493
uauuuuugauggagguugaucaccgcgauaacggcgauuacguucguuuaaaaua

SEQ ID NO: 4226651 - RNA, 130 nt, Coxiella burnetii RSA 493
ccuucauagauagagugauaaggucgaccgguauaauaauaaggcaaaauauacgucgguucguaaaaagaaauuccugcgcguguuuuuguaacuugucguugccgugccaaucgcuucucgaggaggg

SEQ ID NO: 4226652 - RNA, 90 nt, Coxiella burnetii RSA 493
aaguagcccguaugaagcgaagcgaaauacggggacgauagacgacaucauuguuuuccccuauuccgcuucgcugcauacgggcuacuu

SEQ ID NO: 4226653 - RNA, 77 nt, Coxiella burnetii RSA 493
agcuguugggcaggauuucguuuguaagaauuaaauuuuaucaaaguuuccgcaaugaggugcugcucaauuugguu

SEQ ID NO: 4226654 - RNA, 129 nt, Coxiella burnetii RSA 493
aagaauacaaaaccucacggccgagucgggaggacccagauuaaggggcuaagaaaaacaccgauggcgcuuuucuuagccuuuuagccuagauucccgugacuucggccgugaaagcccucgauucuu

SEQ ID NO: 4226655 - RNA, 103 nt, Coxiella burnetii RSA 493
gauuaauugcagcgcgaucaggauaagggaguaaggcauuacguuuuuuuaauugagcgacaaugcuucuacccgcuaauucuggucgaaaaaggccuaaauc

SEQ ID NO: 4226656 - RNA, 56 nt, Coxiella burnetii RSA 493
uggggauuuggcggcagcauuaaauaaaaauaaucugucuaucacccaaagcccua

SEQ ID NO: 4226657 - RNA, 67 nt, Coxiella burnetii RSA 493
agccuugaaguuguuuaagucgaguagaaaaacgcugauuuucuuuucggcauaaacagcggaggcu

SEQ ID NO: 4226658 - RNA, 78 nt, Coxiella burnetii RSA 493
aguagcccguaugcagcgaagcggaauacgggagaacuauaagauuuccccguauuacuucgcugcauacgggcuacu

SEQ ID NO: 4226659 - RNA, 117 nt, Coxiella burnetii RSA 493
ugaaguuaagguaucgggccagccuuugaguaagcuaccagaagaccuuuacauuccgccggaugcguugcgugucuuuuuggaagcuuuugaagggccgcuggaucuucugcuuua

SEQ ID NO: 4226660 - RNA, 57 nt, Coxiella burnetii RSA 493
ugcuucugcaauuguagaaggcggcaauuuauacgccuuuuauuugcuuuggaagca

SEQ ID NO: 4226661 - RNA, 129 nt, Coxiella burnetii RSA 493
cauuucacccagacuuuugcagcuaaguagcccguaugagcgaacgaauacggggacgauagaugacaucauuguuuucccguauuucgcuucgcucauacgggcuacuuuacuaaaguguuacccaug

SEQ ID NO: 4226662 - RNA, 74 nt, Coxiella burnetii RSA 493
aguaccuguaugagcgaagcguaauacgggcgagaucauuauuucccguauuccgcuucgcucauacgggcucu

SEQ ID NO: 4226663 - RNA, 73 nt, Coxiella burnetii RSA 493
agcccguaugaagcgaagcgaaauacgggauuuuauuaaaauuuaaucucccguauuucgcuucauacgggcu

SEQ ID NO: 4226664 - RNA, 78 nt, Coxiella burnetii RSA 493
aguagcccguaugcagcgaaguaauacggggaaaucuuauaguucucccguauuccgcuucgcugcauacgggcuacu

SEQ ID NO: 4226665 - RNA, 55 nt, Coxiella burnetii RSA 493
ggauguggguggggcggauaaagguuuuauauuauugauccagcucucuacgucu

SEQ ID NO: 4226666 - RNA, 91 nt, Coxiella burnetii RSA 493
ccaacaacuucuagccugauguauuauuuuaugggcgagccuuuucuuaauaagcauucuuaugaaaugauucgauacgcuagagaaaggg

SEQ ID NO: 4226667 - RNA, 116 nt, Coxiella burnetii RSA 493
aggggguuuuuguauggggggauaaugcgcuuggucagcuugggcuuaauuauaaaaaucauaaaauuagcauagagcgacccaccuaucguccucuugauaaaagaauaccuccu

SEQ ID NO: 4226668 - RNA, 101 nt, Coxiella burnetii RSA 493
uuuagcuaaguagcccguaugagcgaagcgaaauacggggacaauagaugacaucuuguuuucccguauuccgcuucgcugcauacgggcuacuuguugaa

SEQ ID NO: 4226669 - RNA, 101 nt, Coxiella burnetii RSA 493
ucucugaagugcgucuaaccguagcuguaugagcgaagugaaauacaggguucccguuuuccgcuucgcuucauacgggcuacggaaucgcauugaggaga

SEQ ID NO: 4226670 - RNA, 97 nt, Coxiella burnetii RSA 493
uagcuuaguagcccguaugagcaaagcgaaauacgggaacaaagaugucuucuaucguccccguauuccgcugcgcuucauacgggcuacuuagcug

SEQ ID NO: 4226671 - RNA, 67 nt, Coxiella burnetii RSA 493
cgaugcccgcaaaacccacuaauuucccguuuuccauaaugggaaaauaggugucuuugauccaucg

SEQ ID NO: 4226672 - RNA, 56 nt, Coxiella burnetii RSA 493
ucaagguuggcgaugguucaugcggcgagugcugcgugaaaucuuacaaccuguga

SEQ ID NO: 4226673 - RNA, 86 nt, Coxiella burnetii RSA 493
aguagcccguaugagcgaagcgaaauacgggaaaacaaugaugucgucuaucguucccguauuucgcuucgcucauacgggcuacu

SEQ ID NO: 4226674 - RNA, 61 nt, Coxiella burnetii RSA 493
uucaacauuagcggcugcuuuaugugcuaagaaacugcauuuugcagucacucauguggaa

SEQ ID NO: 4226675 - RNA, 62 nt, Coxiella burnetii RSA 493
uucaauggcucgugcgcauuuaggggaucggcacgucacccaaguagcuaucgaccguugga

SEQ ID NO: 4226676 - RNA, 117 nt, Coxiella burnetii RSA 493
cgcucaauucugcaauugauagugcuugguuccaagaugauuuuuuugggccuaucgaagggaugaugaucaaggaaaaauuaucuacgacuuuaaguuuauuugcagcuucacgcg

SEQ ID NO: 4226677 - RNA, 84 nt, Coxiella burnetii RSA 493
guagcccguaugagcgaagcgaaauacggggacgauagacgacaucauuguuuucccguauuucgcuucgcucauacgggcuac

SEQ ID NO: 4226678 - RNA, 90 nt, Coxiella burnetii RSA 493
aaguagccccgucugagcgaagcgaaauacggggacgauagaugacaucauuguuuucccguauuucgcuucgcugcauacgggcuacuu

SEQ ID NO: 4226679 - RNA, 66 nt, Coxiella burnetii RSA 493
uguggcggguaugugguauugcucaaggguguuuaaaauuuucaugaagcgauuaugcucgcgacg

SEQ ID NO: 4226680 - RNA, 79 nt, Coxiella burnetii RSA 493
gaaguaacucguaugaagcgcagaauacgggaacgucauuauuuccccguauuucgcugcgcuucauacgaguuacuuc

SEQ ID NO: 4226681 - RNA, 129 nt, Coxiella burnetii RSA 493
gaagcauacaaaaccuucacggucgagucgggaggacccagauuagggggcuaagaaaaacaccgauggcgcuuuucuuagacuuuuagccuggauucccgugacuucggccgugaaagcccucgauuc

SEQ ID NO: 4226682 - RNA, 118 nt, Coxiella burnetii RSA 493
gcguacaugccaucgcccaacuaacgcgcgucguuauuauugccuucguuuuguuaauguuauugcaaacgaucgguauuaagauaucggcguuauuagcuuuugguggcgugggcgu

SEQ ID NO: 4226683 - RNA, 72 nt, Coxiella burnetii RSA 493
gcuucacaagcucagcccaaccucgcuuaaauuggcaauuuuagcacguagguugggcugagcuugcgaagc

SEQ ID NO: 4226684 - RNA, 62 nt, Coxiella burnetii RSA 493
uccccuuuuuaucgcgugaguccaucgaaaguuaucgagucuuacgcggaauagaaaaagga

SEQ ID NO: 4226685 - RNA, 62 nt, Coxiella burnetii RSA 493
gagaaagguucuugucaaguuucgaauuguuucgcguuuuauuaacuuuaagaaucuuuuuu

SEQ ID NO: 4226686 - RNA, 106 nt, Coxiella burnetii RSA 493
uuuuuauuucgccugcaaguucgcuaucauuuaacaccauggaauaucaagauuauuauaaaauucuaggugucucgcgugaugcgacggcagaugaaauuaaaaa

SEQ ID NO: 4226687 - RNA, 59 nt, Coxiella burnetii RSA 493
auuccaaucuggaugaauuccauugggcucgguaccgacacguugauccaaauuggcgu

SEQ ID NO: 4226688 - RNA, 86 nt, Coxiella burnetii RSA 493
uuuuguacugccauucucuucuccgagguuuacgggauaucgauuauuuaacccucugaaaacugaggaggaaugguauagcggaa

SEQ ID NO: 4226689 - RNA, 58 nt, Coxiella burnetii RSA 493
accuagcgaaugcccaauuaacgacuuugucgaauuaauccacgguaauucguuaggu

SEQ ID NO: 4226690 - RNA, 57 nt, Coxiella burnetii RSA 493
gucuaugguggccucaugggugguauuguuuuugguaucuugauggcugccaugggc

SEQ ID NO: 4226691 - RNA, 79 nt, Coxiella burnetii RSA 493
gaaauuguaacgguauuguuuggcgucacuuauuugauauuugguuuucacaugaguaagccaaagauacgucauuuuc

SEQ ID NO: 4226692 - RNA, 111 nt, Coxiella burnetii RSA 493
uugcgauuggguugcuugauauuguuauaagucagccauuuuugggagaaguagugauaauauuccggaaagucauugauaauagcgcggguuagaacggccauaucguaa

SEQ ID NO: 4226693 - RNA, 66 nt, Coxiella burnetii RSA 493
ggcgaauucgguguuuauaucguuucagacggagcgaauaaaccuuaucgaguuaaaguccgugcc

SEQ ID NO: 4226694 - RNA, 58 nt, Coxiella burnetii RSA 493
uaguggaauuaucuaucgcgccaucgcgugggcaauggcgcauuacaaaguuccacug

SEQ ID NO: 4226695 - RNA, 55 nt, Coxiella burnetii RSA 493
ggucaggccuuuauuaucaggguuguuaaaaaaacuaauaauaaaaggccugauc

SEQ ID NO: 4226696 - RNA, 56 nt, Coxiella burnetii RSA 493
guccgaaagaagaacuucgcauugccuuugauggcgaugccguuuuauuuucagac

SEQ ID NO: 4226697 - RNA, 73 nt, Coxiella burnetii RSA 493
cguaugagcgaagcgaaauacggggacgauagacgacaucauuguuuucccguauuccgcuucgcuucauacg

SEQ ID NO: 4226698 - RNA, 85 nt, Coxiella burnetii RSA 493
aguaguccguaugagcgaagcgaaauacgggaaacaaugaugucaucuaucguccccguguuucgcuucgcugauagggguuacu

SEQ ID NO: 4226699 - RNA, 88 nt, Coxiella burnetii RSA 493
uuagaagguagcccauaugaagcgaagcggaauacggggaaauaaacaaaucccguauuucgcuucgcuucauacgggcuacggcuaa

SEQ ID NO: 4226700 - RNA, 73 nt, Coxiella burnetii RSA 493
cguaugaagcgaagcgaaauacgggaaaacaaugaugucaucuauuguccccguauuucgcuucgcucauacg

SEQ ID NO: 4226701 - RNA, 60 nt, Coxiella burnetii RSA 493
ugcgcgucauauuuuagcauuucucgaucacgcguaacuuuugccaaaauggacgcugca

SEQ ID NO: 4226702 - RNA, 77 nt, Coxiella burnetii RSA 493
gcugcaaaaguuuuaaaauuuucccacgagguauuacacgcaaugagucguggcguggaaguuuuggccaacgcggu

SEQ ID NO: 4226703 - RNA, 58 nt, Coxiella burnetii RSA 493
ucggcgguaugauuuuggaagaaagauuuacgauaaucuugcuuucaucguucgcugg

SEQ ID NO: 4226704 - RNA, 95 nt, Coxiella burnetii RSA 493
gguggguccauauacguaugagcgaagcgaaauacgggaauugcgcaacguauuucccgguauuuuguuucguuccauacggacuacuuucuacu

SEQ ID NO: 4226705 - RNA, 78 nt, Coxiella burnetii RSA 493
guagcccguaugaagcgaagcgaaauacgggaaauuaugaugucguucccguauuucgcuucgcuucauacgggcuac

SEQ ID NO: 4226706 - RNA, 130 nt, Coxiella burnetii RSA 493
uugacaacaaggguggguccauauacguaugagcgaagcgaaauacgggaaaacaaugaugucaucuauuguccccguauuucgcuucgcucauacgggcuacugguugaaaaccuacacuuuacauaaa

SEQ ID NO: 4226707 - RNA, 71 nt, Coxiella burnetii RSA 493
ccgggaagcucagcuugguuugauuguaguuuugucacuuauagcaacauuucaaaaguagagcuuuuagg

SEQ ID NO: 4226708 - RNA, 58 nt, Coxiella burnetii RSA 493
gaggcgauuggaguaaagucaguugcgguaauuguucagcguggugcuccaguuucuc

SEQ ID NO: 4226709 - RNA, 111 nt, Coxiella burnetii RSA 493
ugggauucagcggagcagccccugguuucaggcaucgccuuugaucgccgucaggccaaguuaacgauccagggcauuccugagagaccaggacuagcaagcuauauucua

SEQ ID NO: 4226710 - RNA, 73 nt, Coxiella burnetii RSA 493
caaauugaaauggacaguccuaaccacuuuccuguuugggagagcaggcuacggauugauuuaauuuaaauug

SEQ ID NO: 4226711 - RNA, 80 nt, Coxiella burnetii RSA 493
gauuuaaccguaaugucauaaaacuauuuucgauaaugagcaauuguaaucgcaaaucauuuuuguugaaacgguggauc

SEQ ID NO: 4226712 - RNA, 63 nt, Coxiella burnetii RSA 493
ugauuuuaugagaaauauugcugauucgauaacccaucucagcauuuuuuugacgugagguca

SEQ ID NO: 4226713 - RNA, 82 nt, Coxiella burnetii RSA 493
cauuuuuugguauuaauuggggguauucguuauaguagugggaaaguuggacuauaauauccucccgaucaucuaaaaaaug

SEQ ID NO: 4226714 - RNA, 56 nt, Coxiella burnetii RSA 493
caguaccgaagaucagcuuaaagcgcaggaugugauucaggcugucguugguacug

SEQ ID NO: 4226715 - RNA, 90 nt, Coxiella burnetii RSA 493
aaguagcccguaugcagcgaagcgaaauacgggaaaacaaugaugucaucuaucguccccguauuucgcuucgcucagacggggcuacuu

SEQ ID NO: 4226716 - RNA, 129 nt, Coxiella burnetii RSA 493
cgauugaaaguguagguuuccuaagccgccucggggggccgaguagcuaaguagcccguauuucgcuucgcugcauacgggcuacuuagcuacucggcccgcggcuuaggaaaccuacacuuucaaucg

SEQ ID NO: 4226717 - RNA, 83 nt, Coxiella burnetii RSA 493
gaugaaaucacuuacguucacaauuuucaaauucagcuuaaaaauaucuaugacaaaggaaaugugaagugcguuguuucauc

SEQ ID NO: 4226718 - RNA, 59 nt, Coxiella burnetii RSA 493
uuagcgagaugagcuuggugauuuccaucugucuaaauugccaaacgaucauccguuaa

SEQ ID NO: 4226719 - RNA, 88 nt, Coxiella burnetii RSA 493
aguagcccguaugcagcgaagcgaaauacgggaaaacaauaaugucgucuaucguccccguauuucgcuucgcugcauacgggcuacu

SEQ ID NO: 4226720 - RNA, 76 nt, Coxiella burnetii RSA 493
aauauuauuuuuagcgauaggguuaucgacaaguacucaaaucaucggauauccagcgguugcugaaaguaguguu

SEQ ID NO: 4226721 - RNA, 61 nt, Coxiella burnetii RSA 493
guugcggguggaaaauaauagagggcgcccccccgaugccgucuuauuucuaacuugcgau

SEQ ID NO: 4226722 - RNA, 61 nt, Coxiella burnetii RSA 493
guaugaagcgcggcgaaauacaggauuauauuaguuucccguauuucgcuucgcuacauac

SEQ ID NO: 4226723 - RNA, 124 nt, Coxiella burnetii RSA 493
ucagaagacagaggacugaugaaagaagacagaugguugugucgcuucgcgacaauuuaaaaaauauauugcggcgaagccgcacagcuucacugucuucugccauccguccucugucuucuga

SEQ ID NO: 4226724 - RNA, 57 nt, Coxiella burnetii RSA 493
uuacgguuaaggucucgccgauccggcaaauaccgagauugguagauaaaaccguaa

SEQ ID NO: 4226725 - RNA, 69 nt, Coxiella burnetii RSA 493
aaaaccaguuuucuucaaacacguuuagauacgcgauucuuauuuacggcgugggagcgaacucguuuu

SEQ ID NO: 4226726 - RNA, 88 nt, Coxiella burnetii RSA 493
aaguagcccguaugagcgaagcgaaauacggggacgauagaugacaucauuguuuucccguauuucgcuucgcucauacgggcuacuu

SEQ ID NO: 4226727 - RNA, 78 nt, Coxiella burnetii RSA 493
guagcccguaugaaacgaagcgaauacgggaacaauacgugcaccuccccguauuucgcuucgcuucauacgggcuac

SEQ ID NO: 4226728 - RNA, 109 nt, Coxiella burnetii RSA 493
gggucuguuuacaauucgcuaggcugagccagaauucauugauuuucgagcagcgaaccacaggaaaucaauuaauuauggccagcagaguagaauuguaaacaaaccc

SEQ ID NO: 4226729 - RNA, 80 nt, Coxiella burnetii RSA 493
uuuuuaauaaaauugauuuauugccuccugaugucgcgcaagcgcgcugucaggaaauuauaaaucgacuuaauuggaaa

SEQ ID NO: 4226730 - RNA, 97 nt, Coxiella burnetii RSA 493
cuccuuagaaagaagcccguauggagcgaagcgaaauacgggaagcaauaacaaacccguauuucgcuucgcuccauacgggcuacggcuuugguag

SEQ ID NO: 4226731 - RNA, 95 nt, Coxiella burnetii RSA 493
aacaaguagcccguaugagcgaagcgaaauacgggaaaacaacgaugucgucaaucguccccguauuucgcuucgcucauacgggcuacuuaguu

SEQ ID NO: 4226732 - RNA, 63 nt, Coxiella burnetii RSA 493
uauuaguggcucaagccaucagcuuaguucgugcuggcgcugaugugauugcgccaaguggua

SEQ ID NO: 4226733 - RNA, 77 nt, Coxiella burnetii RSA 493
ucauugauugaucaaaccauuacgcucugcgguuggguccaccgacggcgggaccauggugguuuaauuuucauuga

SEQ ID NO: 4226734 - RNA, 63 nt, Coxiella burnetii RSA 493
gccucacgauuuaguauuuaaaggcgaugauuccaagccuuuaaaaaugcaauucguagaggc

SEQ ID NO: 4226735 - RNA, 106 nt, Coxiella burnetii RSA 493
gccggcuaugauauuggaaacgauggaaaaaaugaauuacguuucgcucugauuucccucgcaagcguggagcaaguuuucuauauuuucuuucuuuucuucuggc

SEQ ID NO: 4226736 - RNA, 62 nt, Coxiella burnetii RSA 493
uaauauucgugugcgauuagccgaggucaaauuaaugggcuggcuuuaugcgcacgguguug

SEQ ID NO: 4226737 - RNA, 88 nt, Coxiella burnetii RSA 493
gccguagguugggcugagcuugcgaagcccaacaguuucgcuuucuuccuuuuuguugggcuucgcaaacucagcccaaccuacaggc

SEQ ID NO: 4226738 - RNA, 63 nt, Coxiella burnetii RSA 493
ccggcggcgucguuuccgccacguauucuucauuaggauauugguauucaucgucgccgaugg

SEQ ID NO: 4226739 - RNA, 75 nt, Coxiella burnetii RSA 493
guggggaacaacgguugagcaauuuuauguuauggcaauuugccuauacugaaauuuacuucacgcccgcccuau

SEQ ID NO: 4226740 - RNA, 60 nt, Coxiella burnetii RSA 493
ccuauuuucaauaaccguuccauggauucuaaguccucgcaacggcuugcuugaauuagg

SEQ ID NO: 4226741 - RNA, 61 nt, Coxiella burnetii RSA 493
gugcgaaggucucccaaguccagcgucaauaauuaaaauguuuuuaggaaaccguucgcgc

SEQ ID NO: 4226742 - RNA, 78 nt, Coxiella burnetii RSA 493
cugucuaugcugaauuauuaaugaaacguauugaagcaacgggcugucaaguuuaccucguuaauacuggcuggacag

SEQ ID NO: 4226743 - RNA, 69 nt, Coxiella burnetii RSA 493
ggcuuuggucagucuggggcccaaucaaaauaauggaugguuuugauugggacuuggacggcgagagcc

SEQ ID NO: 4226744 - RNA, 56 nt, Coxiella burnetii RSA 493
cgguuccuuuguuugaugccuuuaugagacggaucaugcaaugaacgaagggauug

SEQ ID NO: 4226745 - RNA, 123 nt, Coxiella burnetii RSA 493
guuauccgccgugcgccgcugggugauccugugcaaauucgcgugcgugauuuuuauuugaguuuacggcagaaagaguuugcgcuguugaaaauugagcgaggcaaggaauaaauggauaac

SEQ ID NO: 4226746 - RNA, 83 nt, Coxiella burnetii RSA 493
uagcccguaugcagcgaagcggaauacggggacgauagacgacaucuuguuuucccguauuucgcuucgcugcauacgggcua

SEQ ID NO: 4226747 - RNA, 61 nt, Coxiella burnetii RSA 493
guauuuuuaauguugcuucuuauugauuuugcucaaucuagagaguugcauuacugaaugc

SEQ ID NO: 4226748 - RNA, 56 nt, Coxiella burnetii RSA 493
cggggaugaaauuaaaccuuaccuuguagaaggcaucgguuaugauuuuauucccg

SEQ ID NO: 4226749 - RNA, 60 nt, Coxiella burnetii RSA 493
auugaagucgauaugauugugcaaaaugugccuacgauugaugcuaauauugacuuuagu

SEQ ID NO: 4226750 - RNA, 55 nt, Coxiella burnetii RSA 493
ggcuucuuuugacucuguuucuggaauugcguuagcggcagagggauagaaggcc

SEQ ID NO: 4226751 - RNA, 82 nt, Coxiella burnetii RSA 493
aagaggugagugauccaauaagcguguuugccuuugguugaauccgguuguucaaacguguauugauggacaaucgcgucuu

SEQ ID NO: 4226752 - RNA, 129 nt, Coxiella burnetii RSA 493
gucguccccgcacgguuuuguuguuaaucgucauucccgcguaggcgggaaucuagcgcgcuuuuagcgcgcagcgcacguagugcgcuggguccccgccugcgcgggaacgaaaccgaaaccggaugc

SEQ ID NO: 4226753 - RNA, 83 nt, Coxiella burnetii RSA 493
uggcgggguguucgaugaggcuuucaacaccgccgaggcuuuccgcuaaggugaacaguuggcagcguucgaguacuuuuuua

SEQ ID NO: 4226754 - RNA, 68 nt, Coxiella burnetii RSA 493
agcugacuuucacgucuuucuacggcggggaaaucuuccgaaggcagaguggaaagcaugaaacggcu

SEQ ID NO: 4226755 - RNA, 105 nt, Coxiella burnetii RSA 493
ccgcacuaaaccuuggagcaacaguacaguggcgcaaugaaaaugaucuuaucaaggguuauuuggaacuugcgcaacaaagcuauucucucaagggggggacgg

SEQ ID NO: 4226756 - RNA, 81 nt, Coxiella burnetii RSA 493
cguagcccguauggagcgaagcgaaauacggggaauuaaaacgcaauucccguauuccgcuaacgccccauacgggcuacg

SEQ ID NO: 4226757 - RNA, 71 nt, Coxiella burnetii RSA 493
gcccguaugcagcccagcgaaauacgggaacauaacgaaaauucccguauuucgcugcgcugcauacgggc

SEQ ID NO: 4226758 - RNA, 59 nt, Coxiella burnetii RSA 493
guuucaugccaaugcuuuuuuagcuguucauugcgguuaaaaaugugauuggcagcagc

SEQ ID NO: 4226759 - RNA, 69 nt, Coxiella burnetii RSA 493
auacguaugagcgaagcgaaauacgggaaauaauaaugcaaucccguauucgcugcgcuucauauauau

SEQ ID NO: 4226760 - RNA, 81 nt, Coxiella burnetii RSA 493
gcgcauuaaaacgagcguuuacuaauuuauuaaauaaugcuauucguuaugcgaagaaugucaacguucguauucaauggc

SEQ ID NO: 4226761 - RNA, 82 nt, Coxiella burnetii RSA 493
agcguagcccguauggagcgaagcggaauacggggauuguucuaauuuccccguaucucguucgcuccauacgggcuacgcu

SEQ ID NO: 4226762 - RNA, 79 nt, Coxiella burnetii RSA 493
gaauauaacuucguuuuacacccugaaacucuguuuucaguuuuucuucagaagggucuacaacaacggaguugccuuc

SEQ ID NO: 4226763 - RNA, 69 nt, Coxiella burnetii RSA 493
uccuccgaaacaagcauuauuuuauuuaauuugucauaaccuugauuuaaaguuuguucuucggaagga

SEQ ID NO: 4226764 - RNA, 68 nt, Coxiella burnetii RSA 493
uuuuagucguucuuauucgccacgauucuuucaaccgauggcuuauuggcgacguaguaaugaugaag

SEQ ID NO: 4226765 - RNA, 91 nt, Coxiella burnetii RSA 493
ggucuguuaaggagcuauuagaauauucauuuaauuuaguuaaucuuaauuggcgugauuuuguuguaauagauccaaaauauuacagacc

SEQ ID NO: 4226766 - RNA, 61 nt, Coxiella burnetii RSA 493
ggcgggaagacagggaaaaauucuagucgauaucgcgcucguuuuauuagguuuucccgcu

SEQ ID NO: 4226767 - RNA, 68 nt, Coxiella burnetii RSA 493
uaugagcgaagcgaaauacgggaaaacaaugaugucaucuauuguccccguauuucgcuucgcucaua

SEQ ID NO: 4226768 - RNA, 60 nt, Coxiella burnetii RSA 493
gcuaaggcagcuuuagaagcggucucucguucgauugcuguugaauuugcugccuauggu

SEQ ID NO: 4226769 - RNA, 77 nt, Coxiella burnetii RSA 493
gcgcuguacccaucaaucauuuaucgcuuucagaaaaaaauucagucguugucgcaggaaugaugauggguaugcgu

SEQ ID NO: 4226770 - RNA, 62 nt, Coxiella burnetii RSA 493
agucgccguuaaaacggaugauaauuuacaaucuuauauugucacgacgguuaaaggcgacu

SEQ ID NO: 4226771 - RNA, 57 nt, Coxiella burnetii RSA 493
acgucauuuuccuuuauguugugcauuccccaauggacccacucaagggaaagacgu

SEQ ID NO: 4226772 - RNA, 125 nt, Coxiella burnetii RSA 493
ugaaaguuucgaaaacuaaaucucaagugaaaucugcuauuccugauguuuuuucaauaauuaguaagcauuuugguaaaaguauuuugggaaucggcgccgcuggauuuuuacucgguuuuuca

SEQ ID NO: 4226773 - RNA, 77 nt, Coxiella burnetii RSA 493
ggcgggccuggcaaaaauggucaauuauugaaaaugaguaaaucauuaaauaaugcuauuuuuuuaagcgauccgcc

SEQ ID NO: 4226774 - RNA, 98 nt, Coxiella burnetii RSA 493
gcagaggacagaggacagugguugugucgcuacgcgacaacuaaauuuuauaaauuaauuguggcgaagccacacaaccacugucuucugucuucugu

SEQ ID NO: 4226775 - RNA, 60 nt, Coxiella burnetii RSA 493
guaugagcgaagcggaauacgggaaauaaugaucucgcccguauuacgcuucgcucauac

SEQ ID NO: 4226776 - RNA, 86 nt, Coxiella burnetii RSA 493
gccgguguguuuuugauugaugaucguaucgaucgcaauagcgguuuuuccgguuuggcgaucgccgauaauuaauucacgcuggc

SEQ ID NO: 4226777 - RNA, 94 nt, Coxiella burnetii RSA 493
gcgauggggguugauuugcauauugcgccgacaguugggccagucauucgaaaccccgugcguucugcgcaggacguaaaucggcuccaaaugc

SEQ ID NO: 4226778 - RNA, 65 nt, Coxiella burnetii RSA 493
cguaugcagcgaagcggaauacgaggaugaaaucauuuucuccguauuccgcuucgcugcauacg

SEQ ID NO: 4226779 - RNA, 66 nt, Coxiella burnetii RSA 493
uaagaugagcccaucggugaagucaaaaucauuaaagauuuucccucgccggaugaguugguuuua

SEQ ID NO: 4226780 - RNA, 71 nt, Coxiella burnetii RSA 493
auaauaaauuucggcugcuagcauucgcaugauaucgcgucgguuuaauugagcaagccggauuuuguuau

SEQ ID NO: 4226781 - RNA, 63 nt, Coxiella burnetii RSA 493
gucgggguaaauccgcuaaguaacuuuuuguaauuuucguucccuuagcgaguuuauucgggc

SEQ ID NO: 4226782 - RNA, 63 nt, Coxiella burnetii RSA 493
gcggguuucucauuuuuacgaauuaccacagucggaaagcucaugaauuagaugaaaauccgc

SEQ ID NO: 4226783 - RNA, 72 nt, Coxiella burnetii RSA 493
guaugaagcgaagcgaaauacgggaaaacaaugaugucaucuauuguccccguauuucgcuucgcugcauac

SEQ ID NO: 4226784 - RNA, 93 nt, Coxiella burnetii RSA 493
ggugcgauugaaaguguagguuuucaacaaguagcccguauuccgcuucgcuucauacgggcuacuuguugaaaacuaacuuucaaucgcacc

SEQ ID NO: 4226785 - RNA, 57 nt, Coxiella burnetii RSA 493
uuuuucuacaggacaaaaaacgagcgaggcuaguugcauuuuuguuagguagaaaga

SEQ ID NO: 4226786 - RNA, 86 nt, Coxiella burnetii RSA 493
aguagcccguaugagcgaagcgaaauacgggaaaacaaugaugucgucuaucguccccguauuucgcuccgcucagacgggcuacu

SEQ ID NO: 4226787 - RNA, 60 nt, Coxiella burnetii RSA 493
gcccccgcaauaggggcuuuuuucgcuaacguuagcggaauaucgccuguuccgggcggc

SEQ ID NO: 4226788 - RNA, 73 nt, Coxiella burnetii RSA 493
uguuuaaucucuucgccuuuguggaucgagauaccgauccacgcgaugcugaggagcuugcucaaauuaaaca

SEQ ID NO: 4226789 - RNA, 61 nt, Coxiella burnetii RSA 493
uaauuuucccaggugccauucugagcgacgcgcuugcuuaggacaaccucugaggaaauua

SEQ ID NO: 4226790 - RNA, 78 nt, Coxiella burnetii RSA 493
guagcccguaugcagcgaagcgaaauacggggggaauaauggcacaacucccguauucguucgcugcauacgggcuac

SEQ ID NO: 4226791 - RNA, 58 nt, Coxiella burnetii RSA 493
ucuugauaagguugccuuuuagaaggcgauagcauuugaaaacgcaccuuaucccaga

SEQ ID NO: 4226792 - RNA, 62 nt, Coxiella burnetii RSA 493
cguauaaagcgaagcggaauacgggaauuauuauuuccccguauugcgcuucgcuucauacg

SEQ ID NO: 4226793 - RNA, 75 nt, Coxiella burnetii RSA 493
cggaaugaaacggcuucaccgcaauuagcgauuacggaauugugucguguugcgcaugagguacguauuuuuccg

SEQ ID NO: 4226794 - RNA, 103 nt, Coxiella burnetii RSA 493
uggcuaggcgugagauucaucugaugaaaauuaaauaacaaacucccuauuuucuccgcuuguugugguaauauuucaucgacggacauuaccuuuccuucca

SEQ ID NO: 4226795 - RNA, 59 nt, Coxiella burnetii RSA 493
gcgguauucgugaaggaaagcuauuuucugaucugaaaacuuaaccacacugaugccgc

SEQ ID NO: 4226796 - RNA, 68 nt, Coxiella burnetii RSA 493
auacucaucucacuggacaaauuuguccagugaucacuagacaaauuuguccagugaugauaggguau

SEQ ID NO: 4226797 - RNA, 90 nt, Coxiella burnetii RSA 493
aaguagcccguaugcagcgaagcggaauaggggaaaacaaugaugucgucuaucguccccguauuucgcuucgcuucauacgggcuacuu

SEQ ID NO: 4226798 - RNA, 70 nt, Coxiella burnetii RSA 493
ucuauuagucuuaauuucaaaaaaccucggguucccgcccgggaauggugaagucuaaaauugaacuaga

SEQ ID NO: 4226799 - RNA, 78 nt, Coxiella burnetii RSA 493
guagcccguaugaagcaaagcggaauacggggggaaacgaugccaaucccguauuccgcugcgcuucauacgggcuac

SEQ ID NO: 4226800 - RNA, 70 nt, Coxiella burnetii RSA 493
guaugagcgaagcgaaauacggggacaauagaugacaucauuguuuucccguauuucgcuucgcucauac

SEQ ID NO: 4226801 - RNA, 79 nt, Coxiella burnetii RSA 493
gaaguaacucguaugaagcgcagcgaaauacggggaaauaaugacguucccguauucugcgcuucauacgaguuacuuc

SEQ ID NO: 4226802 - RNA, 124 nt, Coxiella burnetii RSA 493
aaaacgguagaaacuugugcaaccauauugggcacguuuuuauuaguaauggcgauucgacagccuucggugcgcgcuaacuugcuggugggaaaauuaaccgaguugcgaauauaaccguuuu

SEQ ID NO: 4226803 - RNA, 79 nt, Coxiella burnetii RSA 493
guagcccuuaugcagcgcagcggaauacgggggaguggagcaccaauucccguauuccgcugcgcugcauacgggcuac

SEQ ID NO: 4226804 - RNA, 63 nt, Coxiella burnetii RSA 493
uugaaaucgaugacgaagcggcugcuaauuuaauuauggcagcacgagcgcauugguuugcag

SEQ ID NO: 4226805 - RNA, 83 nt, Coxiella burnetii RSA 493
aaaguagcccguauggagcgaagcggaauacggggaaauaauaacaaaucacguauuucguuuggcuccauaccuaauacuuu

SEQ ID NO: 4226806 - RNA, 60 nt, Coxiella burnetii RSA 493
uugaaauugauuaguggauacuucuagcgauaauucgcgcaucguauuagucgaugccaa

SEQ ID NO: 4226807 - RNA, 95 nt, Coxiella burnetii RSA 493
uagcuaaguagcccguaugagcgaagcgaaauacgggaacgagagacgacaucauuguuuucccguauucguucgcucauacgggcuacugguug

SEQ ID NO: 4226808 - RNA, 79 nt, Coxiella burnetii RSA 493
guagcccguaugcagcgcagcggaauacgggaauuggugcuccacucccccguauuccgcugcgcugcauaagggcuac

SEQ ID NO: 4226809 - RNA, 73 nt, Coxiella burnetii RSA 493
agcccguaugaagcgaaauacgggagauuaaauuuuaauaaaaucccguauuucgcuucgcuucauacgggcu

SEQ ID NO: 4226810 - RNA, 56 nt, Coxiella burnetii RSA 493
uuagcugcuauugucuuugguaaaacuguccuggccaaagcauuacgcgcugcuaa

SEQ ID NO: 4226811 - RNA, 77 nt, Coxiella burnetii RSA 493
cguacccguaugcagcgaacgaauacgggaauugugguuuuauuucccguauuccgcuucgcugcauacgggcuacg

SEQ ID NO: 4226812 - RNA, 72 nt, Coxiella burnetii RSA 493
guaugaagcgaagcgaaauacgggaaaacaaugaugucaucuauuguccccguauuucgcuucgcuucauac

SEQ ID NO: 4226813 - RNA, 110 nt, Coxiella burnetii RSA 493
guuacugccagauaguauauacguaugagcgaagcgaaauacggggacgauagaugagaucauuguuuucccguauuucgcuucgcucauacgggcuacugguugaaaac

SEQ ID NO: 4226814 - RNA, 58 nt, Coxiella burnetii RSA 493
ggcaguuaucgcaauagcgggucauuuguuuaacgggacuuuaaugccuauagcugcu

SEQ ID NO: 4226815 - RNA, 78 nt, Coxiella burnetii RSA 493
guagcccguaugcagcgaacgaauacgggaguugugccauuauuccccccguauuucgcuucgcugcauacgggcuac

SEQ ID NO: 4226816 - RNA, 87 nt, Coxiella burnetii RSA 493
aaguagcccguaugagcgaagcgaauacggggacgguagacgacauuauuguuuucccguauuucgcuucgcucauacgggcuacuu

SEQ ID NO: 4226817 - RNA, 75 nt, Coxiella burnetii RSA 493
cgcuaucgaauccaaacaaaaugguuuacuacugcucgcaccaaaccgauuuguuuuggauuggaucaaugagcg

SEQ ID NO: 4226818 - RNA, 128 nt, Coxiella burnetii RSA 493
ugaaacgauauaaacaccgaauucgccuuuugguuguuccacggcggcauaagcuucuccuuccggaacaauauagccuuccgugaauaauuuaaaaugaugaauuaaggcuuccauaucgcgcuuca

SEQ ID NO: 4226819 - RNA, 56 nt, Coxiella burnetii RSA 493
ggagucuguuuacaauucgcuagucuggacagacuaguagaaucguaaacagaccc

SEQ ID NO: 4226820 - RNA, 86 nt, Coxiella burnetii RSA 493
gacgcgccagaaaaagacccuucagguaauggaagaucuacucagguaaagggauuuuaccugaggggucuuuuuuuaacuucguc

SEQ ID NO: 4226821 - RNA, 86 nt, Coxiella burnetii RSA 493
aaguagcccguaugagcgaagcgaaauacgggaaaacaaugaugucaucuaucguccccguauucguucgcucauacgggcuacuu

SEQ ID NO: 4226822 - RNA, 116 nt, Coxiella burnetii RSA 493
gacaacaaggguggguccauauacguaugagcgaagcgaaauacgggaaaacaaugaugucaucuauuguccccguauuucgcuucgcucauacgggcuaccuagcuuugucuguc

SEQ ID NO: 4226823 - RNA, 99 nt, Coxiella burnetii RSA 493
gcaaggcagccaauuaaucccaauuccucgcccgucacagcgaaaauaaagucggucgcaugggccgguaggaauugcagaugagacuguguuccaugc

SEQ ID NO: 4226824 - RNA, 69 nt, Coxiella burnetii RSA 493
uaaaaucuucgcuaaugcgauaaaagaacuuuggugccagggccacaguaucgauuggagaaaauuuua

SEQ ID NO: 4226825 - RNA, 86 nt, Coxiella burnetii RSA 493
aguagcccguaugagcgaagcgaaauacgggaaaacaaugaugucgucaaucguccccguauuucgcuucgcucauacgggcuacu

SEQ ID NO: 4226826 - RNA, 76 nt, Coxiella burnetii RSA 493
gggugcauugaaaguauagguuuucaagcuacucggcccccgaggcggcuuagguaaccuauacuuucaaucgccc

SEQ ID NO: 4226827 - RNA, 82 nt, Coxiella burnetii RSA 493
aguagcccguaugagcgaagcgaaauacgggaaaugaugccaucuaucguccccguauuucgcuucgcucauacgggcuacu

SEQ ID NO: 4226828 - RNA, 56 nt, Coxiella burnetii RSA 493
gaucguaacgaugcgcaggcgauagcugaagcggcuucccgcgccucgaugcgguu

SEQ ID NO: 4226829 - RNA, 71 nt, Coxiella burnetii RSA 493
aaguccagaagaacgggcuaaauuagauggauuauacgaauguauuuuaugcgccuguuguucuucuucuu

SEQ ID NO: 4226830 - RNA, 63 nt, Coxiella burnetii RSA 493
gcaaugccaugcaauuucgcuggcucguuccauugaugacucaaggugaaauugauggggugc

SEQ ID NO: 4226831 - RNA, 56 nt, Coxiella burnetii RSA 493
cgcgcccuguuaucggcgaagugaucccucacucgaucgccgcacaagcgggcgug

SEQ ID NO: 4226832 - RNA, 83 nt, Coxiella burnetii RSA 493
guagcccguaugagcgaagcgaaauacggggacaauaaacgacauuuuguuuucccguauuucgcuucgcucauacgggcuac

SEQ ID NO: 4226833 - RNA, 55 nt, Coxiella burnetii RSA 493
uaacauugcuguuggcagcacguugcauuaugaaacgcugcuuauagcaggguua

SEQ ID NO: 4226834 - RNA, 106 nt, Coxiella burnetii RSA 493
cuauuuaugcugugaauuaugauggacugggguuagugcaggaucucacucgcaaucacaauaucacacugacucaaaaauccauuuuaauugucggcgcaggcgg

SEQ ID NO: 4226835 - RNA, 72 nt, Coxiella burnetii RSA 493
guaacaagaaugaucguaacgaugcgcaggcgauagcugaagcggcuucccgcgccucgaugcgguuugugc

SEQ ID NO: 4226836 - RNA, 76 nt, Coxiella burnetii RSA 493
guaucgcgugcuuuuccuuaaccccgcuugggagcaagaacuccauagcuggguuggaaauaguacccuaguguac

SEQ ID NO: 4226837 - RNA, 81 nt, Coxiella burnetii RSA 493
aagucguccguaugcagcgaagcgaaauacgggaauugucauuauuuccccguauuucgcuucgcugcauacgggcgacuu

SEQ ID NO: 4226838 - RNA, 64 nt, Coxiella burnetii RSA 493
uuauuucaaccugcucagaaacuucguaaaauugcugcuaaaguuggugaucauguuggaguga

SEQ ID NO: 4226839 - RNA, 69 nt, Coxiella burnetii RSA 493
ccgauguggucgaagucgaaaugcaauauuuauacaaugauggugaauuuuggcauuucaugacaucgg

SEQ ID NO: 4226840 - RNA, 93 nt, Coxiella burnetii RSA 493
ggugcgauugaaaguuaguuuucaacaaguagcccguaugaagcgaagcggaauacgggcuacuuguugaaaaccuacacuuucaaucgcacc

SEQ ID NO: 4226841 - RNA, 99 nt, Coxiella burnetii RSA 493
ccucucccccucgaggagaggguuaaggagaggguuuuuaaagaaccuaacugcugcgguuuuuuacccucuccuagccucucccgcaggcgggagggg

SEQ ID NO: 4226842 - RNA, 108 nt, Coxiella burnetii RSA 493
acgccugcgucgaauaaucguucgcuuaaaucaaucagcguuuugcuaucaucguuaacguuuuuuaguaagacggauugauucaacaagcuaacuuucgaccggcgu

SEQ ID NO: 4226843 - RNA, 67 nt, Coxiella burnetii RSA 493
ugguaaauguucacaguuaaaagggggagaauggagaucugcacucccgcuuuagcuguauuuauug

SEQ ID NO: 4226844 - RNA, 68 nt, Coxiella burnetii RSA 493
uaugagcgaagcgaaauacggggacaauagaugacaucauuguuuucccguauuucgcuucgcucaua

SEQ ID NO: 4226845 - RNA, 55 nt, Coxiella burnetii RSA 493
ggcuugcuugagcagaauggccugcauuucgcuuccauccuucgccaagcuggcc

SEQ ID NO: 4226846 - RNA, 58 nt, Coxiella burnetii RSA 493
augagcgaagcgaaauacggggaauaauaacaauaccccguauuccgcuucgcuucau

SEQ ID NO: 4226847 - RNA, 81 nt, Coxiella burnetii RSA 493
guagcccguauggagcgaagcggaauacaggaaauaauacuguacaauuccccguauuccgcuucgcuccauacgggcuac

SEQ ID NO: 4226848 - RNA, 72 nt, Coxiella burnetii RSA 493
gagggggaaugaacacaagagagacacuugcccuggaaaggagcggguucuuuuguguggccaugcccccuc

SEQ ID NO: 4226849 - RNA, 129 nt, Coxiella burnetii RSA 493
aauagagggugcguagguuuucaacaaguagcccguaugcagcgaagcggaauacgggaaaacaagaugucaucuauuguccccguauuucgcuucgcucauacgggcuacuuagcuaaauucuuuauu

SEQ ID NO: 4226850 - RNA, 83 nt, Coxiella burnetii RSA 493
guagcccguaugagcgaagcgaaauacgggaaacaaugaugucaucuaucguccccguauuucgcuucgcucauacgggcuac

SEQ ID NO: 4226851 - RNA, 114 nt, Coxiella burnetii RSA 493
gggcuuucacagccgaagucacgggaauccaggcuaagaggggcuugaagaacgcuaacggcguuuuucuuaguauuguuagucuggauccucccgacucggccgugaagguuu

SEQ ID NO: 4226852 - RNA, 83 nt, Coxiella burnetii RSA 493
guagcccguaugagcgaagcgaaauacgggaaaacaaaaugucguuuauuguccccguauuucgcuucgcucauacgggcuac

SEQ ID NO: 4226853 - RNA, 55 nt, Coxiella burnetii RSA 493
uaucacgaaugauaaucauauuucugcuaugcugaaguucuguauuaucgugaug

SEQ ID NO: 4226854 - RNA, 76 nt, Coxiella burnetii RSA 493
guagcccguauggagugaagcgaaauacgggaauuauuauuauuccgccguauuccacuucgcuucauacgcuuac

SEQ ID NO: 4226855 - RNA, 83 nt, Coxiella burnetii RSA 493
guagcccguaugagcgaagcgaaauacgggaaaacaacgaugucgucaaucguccccguauuucguucgcucauacgggcuac

SEQ ID NO: 4226856 - RNA, 111 nt, Coxiella burnetii RSA 493
ggauuuuugacagcgccaaaguagcuguuuucguuggaagaacccauggcgaauucguccauauugguuuuaccgauuaaaauggcuccugcuuuguuuagcugcucuacc

SEQ ID NO: 4226857 - RNA, 73 nt, Coxiella burnetii RSA 493
cguaugaagcgaagcgaaauacggggacgauagacgacaucauuguuuucccguauuucgcuucgcucauacg

SEQ ID NO: 4226858 - RNA, 68 nt, Coxiella burnetii RSA 493
gccaucaauucaggauuugucgcuccgauggcacucgaguaaacggcacaauccgccugagugauggc

SEQ ID NO: 4226859 - RNA, 66 nt, Coxiella burnetii RSA 493
uggccgaucaaaaauaaucuuuugcuuucugaaaaggaugcggcggggguauuuuugcaacgggca

SEQ ID NO: 4226860 - RNA, 97 nt, Coxiella burnetii RSA 493
aguaaaguagcccguaugagcgaagcgaaauacggggaaacaaugguguugucaaucguccccguauuucgcuucgcuccauacggacuacuuagcu

SEQ ID NO: 4226861 - RNA, 77 nt, Coxiella burnetii RSA 493
ccguagcccguaugaagcgaagcgaaauacgggaacgauaacaaucccguauucguuucgcuucauacgggcuacgg

SEQ ID NO: 4226862 - RNA, 67 nt, Coxiella burnetii RSA 493
gacgacguugucuuuugcgauuccuuauucccucggaggaauaggcauuuaugagacagcuaucguu

SEQ ID NO: 4226863 - RNA, 88 nt, Coxiella burnetii RSA 493
aaguagcccguaugagcgaagcgaaauacgggaaaacaaugaugucgucuaucguucccguauuucgcuucgcucauacgggcuacuu

SEQ ID NO: 4226864 - RNA, 73 nt, Coxiella burnetii RSA 493
gaucgcuguuauugcgcuucugauuuauuauuauuuuuuggauauuaaguuagcucugcugaugacggugauu

SEQ ID NO: 4226865 - RNA, 130 nt, Coxiella burnetii RSA 493
gucaagcuuacccuaaugauuuuaagcgcgauaguuuagcggcugauuuacaugcuguuuacgaucaauucgacaguggugcauuaaccgcaaaggcuauccgcguuaaaauggcgggccggaugaugac

SEQ ID NO: 4226866 - RNA, 60 nt, Coxiella burnetii RSA 493
auuaggcgaaaaguagcaauuauacaagagaugagagguuaauugcuacuuuuuacugau

SEQ ID NO: 4226867 - RNA, 102 nt, Coxiella burnetii RSA 493
uugcaagucuuugaugcauuuaaagugcuuguuauuacugguggcuaauacccaauuauucucaacggcuguagcggcaauaauugcaucaccggcacgcaa

SEQ ID NO: 4226868 - RNA, 75 nt, Coxiella burnetii RSA 493
guagcccguaugagcgaagcgaaauacgagauuucggcauuaucccccguauuucgcuucgcucauacgggcuac

SEQ ID NO: 4226869 - RNA, 83 nt, Coxiella burnetii RSA 493
guagcccguaugagcgaagcgaaauacggggacgauagaugacaucauuguuucccguauuucgcuucgcucauacgggcuac

SEQ ID NO: 4226870 - RNA, 75 nt, Coxiella burnetii RSA 493
auuuuuuugucauuuccagauugugguuaucaguuuuaggcucaucccuacgcuuucugcgaggugaaaaaaaau

SEQ ID NO: 4226871 - RNA, 60 nt, Coxiella burnetii RSA 493
caguaacugagaaaaagcguuuaauuuguaauucgguaaacguuuuauucucguugucug

SEQ ID NO: 4226872 - RNA, 81 nt, Coxiella burnetii RSA 493
ggcagucgcacaaauuauuacuuauggcacgauggcagcgcgcgccguguugcgcgaugucggccguguguugggauugcc

SEQ ID NO: 4226873 - RNA, 83 nt, Coxiella burnetii RSA 493
aguagcccguauggagcgaagcggaauacggggaauuguacaguauuauuuccuguauuccgcuucgcuccauacgggcuacu

SEQ ID NO: 4226874 - RNA, 65 nt, Coxiella burnetii RSA 493
gucaccuauguuaggggacuaagaaaaacaccgauggugcuuuucucagcauuuuagcccgugac

SEQ ID NO: 4226875 - RNA, 73 nt, Coxiella burnetii RSA 493
agaaguugaggaauaaacaacucucgauaaaggacgguaaauuuugcuagagucuguuuauuguucgauuucu

SEQ ID NO: 4226876 - RNA, 130 nt, Coxiella burnetii RSA 493
gcuguuuuuucaacaguaaaguaaaguagcccguaugaagcgcagcgaaaugccgggaaauaaaggcaauuccccguauuucgcugcgcuucauacgggcuacuucuaauuuucuagaggacaaaaaugc

SEQ ID NO: 4226877 - RNA, 78 nt, Coxiella burnetii RSA 493
ggccacauccaauugacgcucgaaauucaacgaaaagauuaucaacgucuuuuugaauaucgugcucgaccuguggcu

SEQ ID NO: 4226878 - RNA, 71 nt, Coxiella burnetii RSA 493
acgcgcuaauggaugaucacagaauaauucgccacgcaaacgaguaaaauucucuuuauccaugagucugu

SEQ ID NO: 4226879 - RNA, 75 nt, Coxiella burnetii RSA 493
guagcccguaugaagcgaagcgaaauacgggauuuguuuauuuccccguauuccgcuucgcuucauaugggcuac

SEQ ID NO: 4226880 - RNA, 73 nt, Coxiella burnetii RSA 493
guagcccguaugaagcgaagcgcaauacggggaaauaauaauucccguauuccgcuucgcuuuauacguauau

SEQ ID NO: 4226881 - RNA, 83 nt, Coxiella burnetii RSA 493
aagccguccauuaaugaguuugccacgcgagaaugacgaauaucgccaauaaucgugacgcacaauuuauuccaaugggguuu

SEQ ID NO: 4226882 - RNA, 73 nt, Coxiella burnetii RSA 493
cguaugaagcgaagcgaaauacggggacaauagaugacaucauuguuuucccguauuucgcuucgcucauacg

SEQ ID NO: 4226883 - RNA, 83 nt, Coxiella burnetii RSA 493
ggcuuuaaucauuggcauuguuauugggacuuauucauccauuuacguugcgggguccuuggcggugaccuuuggccuaagcc

SEQ ID NO: 4226884 - RNA, 75 nt, Coxiella burnetii RSA 493
gauuuuuuggagagugauccgcuaaauugauagcaucaagcugcucuuucaguuucugauauuuuccuauuaauc

SEQ ID NO: 4226885 - RNA, 78 nt, Coxiella burnetii RSA 493
guagccuguauggagcgccagcggaauacgggaaccgaugcgcagcacccguauuucgcuucgcuccauacaggcuac

SEQ ID NO: 4226886 - RNA, 71 nt, Coxiella burnetii RSA 493
gcccguaugcagcgcagcgaaauacgggaauuuucguuauguucccguauuucgcugggcugcauacgggc

SEQ ID NO: 4226887 - RNA, 84 nt, Coxiella burnetii RSA 493
gagcguagcccguauggagcgaacgagauacggggaaauuagaacaauccccguauuccgcuucgcuccauacgggcuacgcuu

SEQ ID NO: 4226888 - RNA, 87 nt, Coxiella burnetii RSA 493
ggaaguagcccguauggagcgaagcgaaauacggggaauuaaaacacaauucccguauuccgcuaacgccccauacgggcuacuuuc

SEQ ID NO: 4226889 - RNA, 94 nt, Coxiella burnetii RSA 493
ugagcgagcgcggcgggcguuucgguuugaugauugcuaauaucaauuuuaaccguaauuguucgauuaaaauguucgcucaaugcuucgcuua

SEQ ID NO: 4226890 - RNA, 125 nt, Coxiella burnetii RSA 493
uuccccgacuuugacgaaaaaucuuguaacugauugauuuuauugagacuuaguuuggauuuuagcauuacaaaaagaucuugaaauuaccaguaaccacccggguuuuuaguuaaagucaggaa

SEQ ID NO: 4226891 - RNA, 80 nt, Coxiella burnetii RSA 493
uuauuaauugaggguuaucgucguuuuggucaucucaacgcuaaaauuaauccguugggcgauaaccguccgguugauag

SEQ ID NO: 4226892 - RNA, 125 nt, Coxiella burnetii RSA 493
caaaucucaccccagagugaauaagggcgagcuucuuuaauuuuaaucgugaccaucugcccaaucaaugggguaucgccauuaaaauuaacgacccgauuauuuucugugcggccacucaauug

SEQ ID NO: 4226893 - RNA, 77 nt, Coxiella burnetii RSA 493
guagcccguaugagcgaagcgaaauacggggagacaacauggaauucccguauuucgcuucgcuccagacgggcuac

SEQ ID NO: 4226894 - RNA, 64 nt, Coxiella burnetii RSA 493
auuaaucguugcaacgcaaaucgcuccguuaaauuauccuuagcuauuugcaaugcagauugau

SEQ ID NO: 4226895 - RNA, 89 nt, Coxiella burnetii RSA 493
aaguaguccguauggagcgaagcgaaauacggggacgauugacaacaccauuguuuccccguauuucgcuucgcucauacgggcuacuu

SEQ ID NO: 4226896 - RNA, 77 nt, Coxiella burnetii RSA 493
aucgccuugcgauuguauuuagaaaaaggcuuuaaagaucagggaccuuuuucuuuagcggcguuaaaaaaggcgau

SEQ ID NO: 4226897 - RNA, 86 nt, Coxiella burnetii RSA 493
aguagcccguaugagcgaagcgaaaugcggggacgauagacgacaucauuguuuucucguauuucgcuucgcucauacgggcuacu

SEQ ID NO: 4226898 - RNA, 102 nt, Coxiella burnetii RSA 493
uucacggccgagucgggaggacccggauuagggggcuaagaaaaacaccgauggcgcuuuucuuaggcuuuuagccgggauucccgugacuucggccgugaa

SEQ ID NO: 4226899 - RNA, 80 nt, Coxiella burnetii RSA 493
ggcuuaauugaggaauuacuuuauagcuuugucccaucaucgcaaaacgauuaauguaauuaccuccgagugaauaagcc

SEQ ID NO: 4226900 - RNA, 127 nt, Coxiella burnetii RSA 493
aguuuuagcacagcaccauauuucaauuuucucaacgccguuauccgauagaguacgagccaguucauuaaugguauggccuguugugaugacaucaucgagaauggcgacguguuuggcugaaauu

SEQ ID NO: 4226901 - RNA, 63 nt, Coxiella burnetii RSA 493
gggaugcuuauuguauacuaguugcuauuuucaaccaauaacaaggauuguaaugagcagccc

SEQ ID NO: 4226902 - RNA, 69 nt, Coxiella burnetii RSA 493
ggaaaaagaagacgagugaucgcuaucguuuuuauaaacucaaaaggaucaaucgcuuuuguauuuucc

SEQ ID NO: 4226903 - RNA, 80 nt, Coxiella burnetii RSA 493
cuauccugaaaaacgaaaaaugauuaucgaagcuuuucuucaacucauugaaaagaaucauuuaucguuugacaucguag

SEQ ID NO: 4226904 - RNA, 58 nt, Coxiella burnetii RSA 493
guugugucgcuaugcgacaacuaaauuuuauaaauuaauguuggcgaagccacacaac

SEQ ID NO: 4226905 - RNA, 105 nt, Coxiella burnetii RSA 493
cagcgcuucggggggaagcccuuguuuuugugcggugaucauaauggccgugccaugcgcaucuucaccgcaaaugaaaaggcaaucguuucccuucagucgcug

SEQ ID NO: 4226906 - RNA, 73 nt, Coxiella burnetii RSA 493
cguaugagcgaagcgaaauacgggaaaacaaugaugucgucuaucguccccguauuucgcuucgcuucauacg

SEQ ID NO: 4226907 - RNA, 60 nt, Coxiella burnetii RSA 493
uuuauucaaacacucggcgcgacugccuuuaugggguugguguugcuggguuugaauaaa

SEQ ID NO: 4226908 - RNA, 93 nt, Coxiella burnetii RSA 493
aaagugaugggccagugacaguuuuuuuagaaaguaaauggaucuuuuacugucuaaaaaaaucguuaccuuaaaguaaugguuuaucauuuu

SEQ ID NO: 4226909 - RNA, 102 nt, Coxiella burnetii RSA 493
guuggaaggguugaaaauuccaaaaauuguccccguuuucuagagcuuaaacuacucaaaaacggagggcaauuguuggguuaaugacauccuuucuuuaac

SEQ ID NO: 4226910 - RNA, 59 nt, Coxiella burnetii RSA 493
uggcgauggaagaaaagacaucuggaaugaucuucccgaugcuuuugcuuccauugcca

SEQ ID NO: 4226911 - RNA, 102 nt, Coxiella burnetii RSA 493
cugugguuaauucuucuucauuuauuucugcagauuguaaaucauugguuuuugauugccaaaguucauuaaguauauuugcaguuugcagguugaccacag

SEQ ID NO: 4226912 - RNA, 86 nt, Coxiella burnetii RSA 493
ggaaaaaacgcugcaagaaauagcaagcggccaguuaucagugauuauuggcacucaugcgcuuuuucaagcagccgugacuuuuc

SEQ ID NO: 4226913 - RNA, 61 nt, Coxiella burnetii RSA 493
ccguuaaguacauucauaggcccuaauucaucaggauagaaccacaugaauagugcuucgg

SEQ ID NO: 4226914 - RNA, 86 nt, Coxiella burnetii RSA 493
guuugcuugcaauugaccggcaauaucgcgauugaccgucauauuauauuguugacuaucaaaccgcauguugcuuugaaucacac

SEQ ID NO: 4226915 - RNA, 76 nt, Coxiella burnetii RSA 493
gucgaaauucuacuuccauugacaaugggauaaaaucaagauaugauuccauuaucaaugggguuaauauggcgac

SEQ ID NO: 4226916 - RNA, 58 nt, Coxiella burnetii RSA 493
ucaguaccaacgacagccugaaucacauccugcgcuuuaagcugaucuucgguacugg

SEQ ID NO: 4226917 - RNA, 130 nt, Coxiella burnetii RSA 493
aagcauauaaaaccuucaaggccgagucggggggacccagauuaaggggcuaagaaaaacaccgauggcgcuuuucuuagccuuuuaguuuggauucccgugacuucggccgugaaagcccucgauucuu

SEQ ID NO: 4226918 - RNA, 78 nt, Coxiella burnetii RSA 493
guagcccguaugaagcgcagcggaauacgggauuggcaucguuuccccccguauuccgcuuugcuucauacgggcuac

SEQ ID NO: 4226919 - RNA, 97 nt, Coxiella burnetii RSA 493
uaagaaaaagaguagcccguauguagcgaagcgaaauacgggaaacuaauauaauccuguauuucgccgcgcuucauacagacuaucgguuuuuuua

SEQ ID NO: 4226920 - RNA, 57 nt, Coxiella burnetii RSA 493
uccgcuuuauucaaccguuucauuaacucaucgugaauuugguaaaauagaagcggg

SEQ ID NO: 4226921 - RNA, 63 nt, Coxiella burnetii RSA 493
cggcuauugaacguuuaaugggaaugauuuuaacgacgaucgccguccaaauguuuuuagcug

SEQ ID NO: 4226922 - RNA, 129 nt, Coxiella burnetii RSA 493
aagaauacaaaaccuucacggccgagucgggaggauccagauuaaggggcuaagaaaaacaccaacggcgcuuuucuuagccuuuuagccuggauucccgugacuucggccgugaaagcccucgauucu

SEQ ID NO: 4226923 - RNA, 73 nt, Coxiella burnetii RSA 493
cguaugagcgaagcgaaauacgggaaaacaaugaugucaucuauuguccccguauuucgcuucgcuucauacg

SEQ ID NO: 4226924 - RNA, 61 nt, Coxiella burnetii RSA 493
gaggaauuucgaugagcuugguuucuguuaaugccacgaccguugccgaucgagguucguc

SEQ ID NO: 4226925 - RNA, 79 nt, Coxiella burnetii RSA 493
uauccgccauaaaaauaauuauucacgaagcuaaauccuauuugguuaacggaggaugguuauuacuggaacacgggua

SEQ ID NO: 4226926 - RNA, 55 nt, Coxiella burnetii RSA 493
uuauagaaaugagcuaaagcggcgacagcuuggccgcuuucguucaugaaugugg

SEQ ID NO: 4226927 - RNA, 78 nt, Coxiella burnetii RSA 493
ggccgcuuuaauuaaaaugggguaaccaauuugcucggcaauaagcagauuagcauccccaucuuucccuaaagcgcc

SEQ ID NO: 4226928 - RNA, 91 nt, Coxiella burnetii RSA 493
cuuugaugcgcugaucaucggagccgguauuagcggccuuucggcagccagucaacuuuuugaugccggucuugauguuaucguauuagag

SEQ ID NO: 4226929 - RNA, 87 nt, Coxiella burnetii RSA 493
aguagcccguaugagcgaagcgaaauacgggaaaacaaugaucucaucuaucguccccguauuucgcuucgcucauacguauauacu

SEQ ID NO: 4226930 - RNA, 56 nt, Coxiella burnetii RSA 493
ggagaauccaugacguuuaaagccaaaccugcuagaaacgucguuaaaauucgucc

SEQ ID NO: 4226931 - RNA, 63 nt, Coxiella burnetii RSA 493
guaugcagcgaagcggaauacggagaaaaugauuucauccucguauuccgcuucgcugcauac

SEQ ID NO: 4226932 - RNA, 77 nt, Coxiella burnetii RSA 493
ggugugaaguaguggaguuauuuugugagguggacggccauuuuccuaaucaucauccugacccuacuauucccgcc

SEQ ID NO: 4226933 - RNA, 57 nt, Coxiella burnetii RSA 493
aauagucgcgcugcaugauguuggacuuuccguucugcaagacaugcgucgauuauu

SEQ ID NO: 4226934 - RNA, 95 nt, Coxiella burnetii RSA 493
agcuaaguagcccguaugaagcgcagcggaauacggggacgauagaagacaucuuuguucccguauuucgcuuugcucauacgggcuacuaagcu

SEQ ID NO: 4226935 - RNA, 67 nt, Coxiella burnetii RSA 493
uaucggcuucaagagacguugaguaauuaucaagucccguuuaauucaugguuuuuugauaccgaug

SEQ ID NO: 4226936 - RNA, 57 nt, Coxiella burnetii RSA 493
gagacggcgcaauuucaaaaacucaaaagaauuauuucuguugaaauagugccucuc

SEQ ID NO: 4226937 - RNA, 89 nt, Coxiella burnetii RSA 493
aaguagcccguaugcagcgaagcgaaauacgggaaaacaagaugucgucuaucguccccguauuccgcuucgcugcauacgggcuauuu

SEQ ID NO: 4226938 - RNA, 57 nt, Coxiella burnetii RSA 493
ugaauuuugcaaucgccaucgccuuggacgguagcgccgauggcgguugcuaauuca

SEQ ID NO: 4226939 - RNA, 80 nt, Coxiella burnetii RSA 493
auucaagauaaaaugaucacucgugucaguuugcuagcuaacguacuagcaauugaucaagagagauuguuugcuugggu

SEQ ID NO: 4226940 - RNA, 74 nt, Coxiella burnetii RSA 493
aaucuaauuugaacuuuggugaaaucgcccuguguuaccaccagggcgauuucaccaaaguucaaaagccgauu

SEQ ID NO: 4226941 - RNA, 67 nt, Coxiella burnetii RSA 493
gaaaagcauuuaauccuucugucaauauuaauugaagccuacuuugacuaaggguccgcugcuuuuu

SEQ ID NO: 4226942 - RNA, 75 nt, Coxiella burnetii RSA 493
uccauacuauuuuuaacgcugcugcuuuuaaugaaaauacgauuuggcccugugggcagcguuaugguagaugga

SEQ ID NO: 4226943 - RNA, 77 nt, Coxiella burnetii RSA 493
ggauuuaccagaacccggucgcgcguaaaauaaaucgauccacgugguuuguugaugagaaccggguugauaaggcc

SEQ ID NO: 4226944 - RNA, 56 nt, Coxiella burnetii RSA 493
cggguucugauggauguugaaugccaugacaaugacauuuauugguuagaacgucg

SEQ ID NO: 4226945 - RNA, 90 nt, Coxiella burnetii RSA 493
aucuugcuuacaacucgaacgacgcaauuuuccacuggauguuuucggcaaggugugcggaggcacuaauaaaauuucgucaggcgggau

SEQ ID NO: 4226946 - RNA, 69 nt, Coxiella burnetii RSA 493
uggacggcuuagucacgaugggcguuccggaaauucgauugguaggcccaucgucauuauugccggaca

SEQ ID NO: 4226947 - RNA, 57 nt, Coxiella burnetii RSA 493
guuaccuaaacgagcgcgugaugcccauaaaggcagcuaugggcacguuuuggugau

SEQ ID NO: 4226948 - RNA, 83 nt, Coxiella burnetii RSA 493
gguaaugauauauaugaagcgcagcgaauacgggauugcauuauuauuucccguauuucgcuucgcucauacguauauggacc

SEQ ID NO: 4226949 - RNA, 55 nt, Coxiella burnetii RSA 493
cugugcuuucaggcguucgggcgggacaacccgccuuugacgaugaaguauucgg

SEQ ID NO: 4226950 - RNA, 129 nt, Coxiella burnetii RSA 493
cgauugaaaguguagguuuccuaagccgcgggccgaguagcuaaguagcccguaugcagcgaagcgaaauacgggcuacuuagcuacucggccccccgaggcggcuuaggaaaccuacacuuucaaucg

SEQ ID NO: 4226951 - RNA, 128 nt, Coxiella burnetii RSA 493
aagaauagagggcuuucacggccgaagucacgggaaucccggcuaaaaggcuaagaaaagcgcaucguguuuuucuuagccccuuaaccugggucccuccgacucggccgugaaaguuuuguaugcuu

SEQ ID NO: 4226952 - RNA, 63 nt, Coxiella burnetii RSA 493
auugguuauuagugcuauuaaugggaccgcucgugguuauuuuggaauggccuaauuuucgau

SEQ ID NO: 4226953 - RNA, 78 nt, Coxiella burnetii RSA 493
ggcgcuuuagggaaagauggggaugcuaaucugcuuauugccgagcaaauugguuaccccauuuuaauuaaagcggcc

SEQ ID NO: 4226954 - RNA, 85 nt, Coxiella burnetii RSA 493
aguagcccguaugagcgaagcgaaauacgggaaaacaacgaugucgccuaucguccccguaucucguucgcucauacgggcuacu

SEQ ID NO: 4226955 - RNA, 94 nt, Coxiella burnetii RSA 493
ggguuagaagacguaccuauuuuugaagacuuaagugauuucguuaaucaucucacccgaaaaucgcuauaaucuucgacgacgauuucuuccc

SEQ ID NO: 4226956 - RNA, 93 nt, Coxiella burnetii RSA 493
gcaaucucuaagugaugguaguuaucgcucaguguuaagcuaugcacguuugugcuuaauguugggugaucauuauuauucaucccagggugc

SEQ ID NO: 4226957 - RNA, 63 nt, Coxiella burnetii RSA 493
auugaucgcuuuuugaaguugcuuuuuaucuuucguauugaguaacaaugcaaaagcaucgau

SEQ ID NO: 4226958 - RNA, 74 nt, Coxiella burnetii RSA 493
aucaguuuuugcuugcugauaaugaucaagaucagaaugcugaugcuucuaauaaucagccagcggaucaagau

SEQ ID NO: 4226959 - RNA, 71 nt, Coxiella burnetii RSA 493
guaugaagcgaagcgaaauacggggacaauagaugacaucauuguuuucccguauuucgcuucgcucauac

SEQ ID NO: 4226960 - RNA, 84 nt, Coxiella burnetii RSA 493
cggacggguuguuuucgcagucacuuuucaucggcaaguucucucuuuaaugcugagaaauacugucgaaaguggcuucaaacg

SEQ ID NO: 4226961 - RNA, 86 nt, Coxiella burnetii RSA 493
uaacaguagcccguaugaagcgaaacgaaauacgggaauugcauuauuuccccguauuccgcuucgcuucauacgggcuacuuuua

SEQ ID NO: 4226962 - RNA, 75 nt, Coxiella burnetii RSA 493
gggcgauugaaaguauagguuaccuaagccgccucgggggccgaguagcuugaaaaccuauacuuucaaugcacc

SEQ ID NO: 4226963 - RNA, 72 nt, Coxiella burnetii RSA 493
guaugaagcgaagcgaaauacggggacaauagaugacaucauuguuuucccguauuucgcuucgcuucauac

SEQ ID NO: 4226964 - RNA, 98 nt, Coxiella burnetii RSA 493
agcuaaguagcccguaugcagcgaagcggaauacggggacgauagaugacaucauuguuuucccguauuucgcuucgcugcauacgggcuacuuuacu

SEQ ID NO: 4226965 - RNA, 73 nt, Coxiella burnetii RSA 493
gaugggugaauuucauuaauccuccauagccuaaguuauaggccaugucgaggaugauggcuuuucguucguu

SEQ ID NO: 4226966 - RNA, 77 nt, Coxiella burnetii RSA 493
uagaaccguucaaccuucaaugacuuuucaagcccgucuuugcgcgggaagaaaauugaacguugauaacagcucua

SEQ ID NO: 4226967 - RNA, 90 nt, Coxiella burnetii RSA 493
cgacauaaaaaguauuuuaauaaucggcgcaggcccgaucauuauuggucaagccugugaauuugauuauucaggcacucaagcgugucg

SEQ ID NO: 4226968 - RNA, 62 nt, Coxiella burnetii RSA 493
ggaccaaaugcgacaaucauuuuuguacugcuguauaaacaauucuuggggcguuuuguacc

SEQ ID NO: 4226969 - RNA, 61 nt, Coxiella burnetii RSA 493
acuucaaaguugacgacguauuuaaaagguuccccacgaaguauuuuguccauuuugaugu

SEQ ID NO: 4226970 - RNA, 82 nt, Coxiella burnetii RSA 493
gcuucgucauucccgcgcaggcgcggcuucggcgcgcugcacacgugugcguuggauccccgccugcgcggggaugacgggc

SEQ ID NO: 4226971 - RNA, 61 nt, Coxiella burnetii RSA 493
gcguuauuggaagucguuuuggcaucacuuaccuugaugccauuggcgcuuuuauuaucgc

SEQ ID NO: 4226972 - RNA, 96 nt, Coxiella burnetii RSA 493
cagaagacagaagacagugguugugucgcuacgcgacaacuaaauuuuauaaauuaauuguggcgaagccacacgaacacuguccucuguccucug

SEQ ID NO: 4226973 - RNA, 78 nt, Coxiella burnetii RSA 493
guagcccguaugaagcgaagcgaaauacggggaggugcacguauuguucccguauucgcuucguuucauacgggcuac

SEQ ID NO: 4226974 - RNA, 83 nt, Coxiella burnetii RSA 493
guagcccguaugagcgaagcgaaauacgggaaacaaugaugucgucuauuguccccguauuucgcuucgcucauacgcgcuac

SEQ ID NO: 4226975 - RNA, 56 nt, Coxiella burnetii RSA 493
gugcaggcgcuagcauuggccguggaagccaaaucggaucggacugcugcuugcac

SEQ ID NO: 4226976 - RNA, 129 nt, Coxiella burnetii RSA 493
cgacaaaaauaaaaaugcacauuuccgucgucccgcggcuugaccgcgggacccagaaaauucuuuuaauacaaggaguucuggaucccgcggucaaaccgcgggacgacgauguucuauugugucacg

SEQ ID NO: 4226977 - RNA, 95 nt, Coxiella burnetii RSA 493
uuuucagaaggugguuaacgcaugugguuucauccauucgauagguuuuauuuaacgauggucggaucgcauuuugcgcuaucgcuuuuucaaaa

SEQ ID NO: 4226978 - RNA, 88 nt, Coxiella burnetii RSA 493
ucgucauucccgcgcaggcgggaauccagcgcgcuuuagcgcgcagcgcacguagugcgcuggguccucgccuucgcgggaagggcga

SEQ ID NO: 4226979 - RNA, 65 nt, Coxiella burnetii RSA 493
gguugcggaaaucacagacaucgccaaucaagcaguuucggcgguggcugcugauuaucgcggcu

SEQ ID NO: 4226980 - RNA, 55 nt, Coxiella burnetii RSA 493
uuuaguagaaauauguucaaagacaaugcgaaguugaggaaauguuucuacuaaa

SEQ ID NO: 4226981 - RNA, 83 nt, Coxiella burnetii RSA 493
uggugguuugauuggaaugauugccuuuaguggcagcuuaaucgcuuuugcaaaauuacaaggcauuauucgcaaaaccauca

SEQ ID NO: 4226982 - RNA, 105 nt, Coxiella burnetii RSA 493
gccgcugagacuagggcgggucgucaauuaacccugucgucgucccgcgccuuguccgcgggacgacgacagguuaauuggcgacacgccuaguaaaacaccggc

SEQ ID NO: 4226983 - RNA, 88 nt, Coxiella burnetii RSA 493
uccgcccguagcccguaugaagcgaaacgaauacgggauuguuaucguucccguauuucgcuucgcuucauacgggcuacggguugga

SEQ ID NO: 4226984 - RNA, 70 nt, Coxiella burnetii RSA 493
gcccguaugcagcgaagcggaauacgggaaauaaaaccacaauucccguauucguucgcugcauacgggu

SEQ ID NO: 4226985 - RNA, 56 nt, Coxiella burnetii RSA 493
gguuggcugaugauuugcaauuacuggauugguugcaaaaccacaucuggccagcc

SEQ ID NO: 4226986 - RNA, 91 nt, Coxiella burnetii RSA 493
cucgucuuucccgcgcaggggggaauccagcgcgcuuuuagcgcgcagcgcacccagugcgcuggguccccgccuucgcggggacgacggg

SEQ ID NO: 4226987 - RNA, 67 nt, Coxiella burnetii RSA 493
uugcacaugugggggaguguuuugaugaguacuagagauuucuucgaaauucuucuucucauugcga

SEQ ID NO: 4226988 - RNA, 55 nt, Coxiella burnetii RSA 493
ggcugccacaggauuuuuaaaggcaucgcccaauugacuuaaauuuuguggcacc

SEQ ID NO: 4226989 - RNA, 130 nt, Coxiella burnetii RSA 493
aagaauacaaaaccuucacggccgagucgggaggauccagauuagggggcuaagaaaaacaccgauggcgcuuuucuuagccuuuuagucuggauucccgugacuucggccgugaaagcccucgauucuu

SEQ ID NO: 4226990 - RNA, 96 nt, Coxiella burnetii RSA 493
aguaaaguagcccguaugagcgaagcgaaauacggggacgauagaugacaucauuguuuucccguauuucgcuucgcucauacgggcuacuuagcu

SEQ ID NO: 4226991 - RNA, 73 nt, Coxiella burnetii RSA 493
uggcggaauaaucucguuccaagaguuguugaaaacgacuuucaauggcuuuggcaacgguggacuuuggcca

SEQ ID NO: 4226992 - RNA, 59 nt, Coxiella burnetii RSA 493
auggcguugaaauuaccgauccugcgauuauugcagcagccacguuaucucaacgcuau

SEQ ID NO: 4226993 - RNA, 115 nt, Coxiella burnetii RSA 493
gggaauauuggugcggcuuuuaucuucgucgcgcuggugcccguagaccugggcagugccgguuuuggccgcuaccgugaaaccaggaugucugccaaagaaaucagcuguuccc

SEQ ID NO: 4226994 - RNA, 92 nt, Coxiella burnetii RSA 493
gaaagcuuaaaagcugaaaugaauuuaggaaagccagcacuagcaucucgcuauuacgccuggguaguuuuaaguuuaugcgcuuuguuuuu

SEQ ID NO: 4226995 - RNA, 89 nt, Coxiella burnetii RSA 493
aaguagcccguaugagcgaagcgaaauacggggacgauagaugacaucauuguuuucccguacuucgcuucgcucauacggggcuacuu

SEQ ID NO: 4226996 - RNA, 87 nt, Coxiella burnetii RSA 493
gaaauuucuaaugagucgccuuuaaccgucgugacaauauaagauuguaaauuaucauccguuuuaacggcgacuugcugagguuuc

SEQ ID NO: 4226997 - RNA, 87 nt, Coxiella burnetii RSA 493
uacgaugccugccaucaacacaagggcuaacucuaaaagaggauuguuaggaguuggcuuagauaauugaucggcccaagguucgua

SEQ ID NO: 4226998 - RNA, 65 nt, Coxiella burnetii RSA 493
gguugauuuuggucggauccccuuucaugcgcgccaucgcaucgcgcaucgcggcuaaaucgacc

SEQ ID NO: 4226999 - RNA, 80 nt, Coxiella burnetii RSA 493
ggcguauggauuagcugcaacaaccuuguggguguuaggaauuccgcaugguuucgcagugaugcauggaaaaacucguc

SEQ ID NO: 4227000 - RNA, 65 nt, Coxiella burnetii RSA 493
uuguuaauaucgguuugguaauaucucgguagagaggucaaucaugccaucgauaaauuugacga

SEQ ID NO: 4227001 - RNA, 85 nt, Coxiella burnetii RSA 493
aguagcucguaugagcgaagcgaaauacgggacgauagacgacaucauuguuuccccguauuucgcuucgcucauacgagcuacu

SEQ ID NO: 4227002 - RNA, 82 nt, Coxiella burnetii RSA 493
ucugaggaccaaauugaaaaaauagcugcacuuucgggcucgggcccugcuuauauuuuuuuaauuauggaggcacuucagg

SEQ ID NO: 4227003 - RNA, 89 nt, Coxiella burnetii RSA 493
ggaaacucaugcgugaugaugggugaaaugucuaacccgcuuaguaauaaauuagucauuuuauaccacgucucaaacaugcggcgucc

SEQ ID NO: 4227004 - RNA, 72 nt, Coxiella burnetii RSA 493
cguaugagcgaagcgaaauacggggacaauagaugacaucauuguuuucccguauuucgcuucgcucauacg

SEQ ID NO: 4227005 - RNA, 98 nt, Coxiella burnetii RSA 493
aguaaaguagcccguaugcagcgaagcgaaauacgggaaaacaaugaugucaucuaucguccccguauuccgcuucgcugcauacgggcuacuuagcu

SEQ ID NO: 4227006 - RNA, 67 nt, Coxiella burnetii RSA 493
acguaaagacgucguuucccaauuuuguugaauuagcaaacgagguaggaaugaaugucaaaggcgu

SEQ ID NO: 4227007 - RNA, 91 nt, Coxiella burnetii RSA 493
uaaguagcccguaugagcgaagcgaaauacgggacgauagaugacauucauuuguuuuuccguauuucgcuucgcucauacgggcuacuug

SEQ ID NO: 4227008 - RNA, 71 nt, Coxiella burnetii RSA 493
uuucuaacacuucgaguaaagcuacucgaguaccgcguaauugagcuggcuuugcuugcuugucauagaga

SEQ ID NO: 4227009 - RNA, 68 nt, Coxiella burnetii RSA 493
auuugccauuuacgcugcuauccgauaaagacaauacuguuugcgaacaauacggugugaugguugau

SEQ ID NO: 4227010 - RNA, 57 nt, Coxiella burnetii RSA 493
ccagcgauuaucaauuagcauuggcgauuaugccaauugcuuuuguguuagcgcugg

SEQ ID NO: 4227011 - RNA, 64 nt, Coxiella burnetii RSA 493
cugguucaugcgacggaaugcgggggugaauuugaauugcgucauauuccgaaugcggaaccag

SEQ ID NO: 4227012 - RNA, 107 nt, Coxiella burnetii RSA 493
gacagaagacagaagacagugguuguguggcuucgccacaauuaauuuauaaaauuuaguugucgcguagcgacacaaccacuguccucuguccucugccuucuguc

SEQ ID NO: 4227013 - RNA, 101 nt, Coxiella burnetii RSA 493
cuuaaaacccgucguccucccgcgaggucgucugcuauauuauugaaguauacaaaaaaccuucacggccgagucgggaggacccagauuaaggggcuaag

SEQ ID NO: 4227014 - RNA, 91 nt, Coxiella burnetii RSA 493
ccaggaaaaccauuaauuauaucggcuacguugaaggcaauacuauuuuuaauaauauugccgauguggucguuugugauggguuuguugg

SEQ ID NO: 4227015 - RNA, 68 nt, Coxiella burnetii RSA 493
gggugaauuuauuuggucuggcggagauugucauauuuauaauacccaucaagaccaaguaagcaccc

SEQ ID NO: 4227016 - RNA, 80 nt, Coxiella burnetii RSA 493
uagcccguaugagcgaacgaauacgggaaaacaaugaugucaucuauuguccccguauuucgcuucgcucauacgggcua

SEQ ID NO: 4227017 - RNA, 99 nt, Coxiella burnetii RSA 493
uagcuaaguagcccguaugaagcacagcgaaauacggggacgauagacgacaucauuguuuucccguauuccgcuucgcggcauacgggcuacuuguug

SEQ ID NO: 4227018 - RNA, 84 nt, Coxiella burnetii RSA 493
guagcccguaugagcgaagcgaaauacgggaacgauagacgacaucauuguuuucccguauuucgcuucgcucauacgggcuac

SEQ ID NO: 4227019 - RNA, 68 nt, Coxiella burnetii RSA 493
auacccuaucaucacuggacaaauuugucuagugaucacuggacaaauuuguccagugagaugaguau

SEQ ID NO: 4227020 - RNA, 96 nt, Coxiella burnetii RSA 493
aguaaaguagcccguaugagcgaagcgaaauacgggaacgauagacgacaucauuguuuucccguauuucgcuucgcucauacgggcuacuuagcu

SEQ ID NO: 4227021 - RNA, 108 nt, Coxiella burnetii RSA 493
agguuuucaaccaguagcgcguaugagcgaagcgaaauacggggacaauagacgacaucauuguuucccguauuucgcuucgcucauacgggcuacuuagcuagacuu

SEQ ID NO: 4227022 - RNA, 59 nt, Coxiella burnetii RSA 493
uagcgagagcgacguccugcggugugaccauccccaugucgccauggcuugccucgcua

SEQ ID NO: 4227023 - RNA, 90 nt, Coxiella burnetii RSA 493
gaguagcccguaugcagcgaagcgaaauacggggacgauagacgacauuauuguuuucccguauuucgcuucgcugcauacgggcuacuu

SEQ ID NO: 4227024 - RNA, 87 nt, Coxiella burnetii RSA 493
cugcgcaccggcaucaguaaaucauuaaaaaucauugccuugcauaagacugguugauuaaaaauauuucacugacucggcguguag

SEQ ID NO: 4227025 - RNA, 79 nt, Coxiella burnetii RSA 493
uuuccuuuguagagauagaggauggcguaguagcgugaagcacguauucauuugcguccucaauuuuuauauacugaag

SEQ ID NO: 4227026 - RNA, 58 nt, Coxiella burnetii RSA 493
aauguuaaaagggcuucgaucacgccgagauuugugcucaauaagcucuuuuaauguu

SEQ ID NO: 4227027 - RNA, 88 nt, Coxiella burnetii RSA 493
cuugauagucccucuuuaccucgcucuuuuaguugacgccuaugcgccugcgcgggcacgacggggagcagggauggcggguuuuaag

SEQ ID NO: 4227028 - RNA, 77 nt, Coxiella burnetii RSA 493
agcaaucaguuuuucaugagucaaaaucccuguccaagcaucuugaaccaaaauugauucugaacgagcuaauuguu

SEQ ID NO: 4227029 - RNA, 76 nt, Coxiella burnetii RSA 493
uaaacuaaaauagcacgaucgccuggcgcugccguuuggcucaauaauugcgcuaagcaucgugcuuuuucauuua

SEQ ID NO: 4227030 - RNA, 59 nt, Coxiella burnetii RSA 493
gaugccuugguaauugguuuguuggcuccgcaugcggaugaaaaaagaaucaaggcguu

SEQ ID NO: 4227031 - RNA, 104 nt, Coxiella burnetii RSA 493
uauuggagaaacgcaaggucgcgacauccguuguuuugugaucggcaacaaaguugucgccaccaugcagcgagaagcgcggcccggcgauuuccgcuccaaug

SEQ ID NO: 4227032 - RNA, 58 nt, Coxiella burnetii RSA 493
gucgugagcagauugugguuguccugucucagguucaaccgggauuuauucgagcggc

SEQ ID NO: 4227033 - RNA, 78 nt, Coxiella burnetii RSA 493
gacgggcagccguguaaguuuuggauuaauucguuuugcuaauauugauccguugauugacguggcuaaacaucuguu

SEQ ID NO: 4227034 - RNA, 90 nt, Coxiella burnetii RSA 493
gguuucuuguugauagcgguguguaauauuuaauaaacgggcuucuucaaaauaauucccuauuaauugcgcuccgaucggcaacugauc

SEQ ID NO: 4227035 - RNA, 71 nt, Coxiella burnetii RSA 493
ugguuuggauugcgugauucuaauuacguuuguaucgaugcgcaaugucaugagaauaaugcaccggauca

SEQ ID NO: 4227036 - RNA, 55 nt, Coxiella burnetii RSA 493
uugauccccaugguagcuaaugcccagaggguauuggcgauaucuugaggauuaa

SEQ ID NO: 4227037 - RNA, 72 nt, Coxiella burnetii RSA 493
cguaugagcgaagcgaaauacgggaaaacaaugaugucaucuauuguccccguauuucgcuucgcucauacg

SEQ ID NO: 4227038 - RNA, 83 nt, Coxiella burnetii RSA 493
aaccauuacaagcgcauccgacgauuauugaagaugacugcuuuauuggcgcacgcucggaaauugucgaaggcguuaugguu

SEQ ID NO: 4227039 - RNA, 84 nt, Coxiella burnetii RSA 493
gcacuggagcgaaaugaggaaauugaaauccucuaucaugguaaagugaaagggacaauucuuccuuaucgaaagcccagcagc

SEQ ID NO: 4227040 - RNA, 56 nt, Coxiella burnetii RSA 493
gggucuguuuacgauucuacuagucuguccagacuagcgaauuguaaacagacucc

SEQ ID NO: 4227041 - RNA, 84 nt, Coxiella burnetii RSA 493
cgucguccgcggcuugaccgcgguaucuagagacauccgcgugugacgguuuacugggucccgcggucaagccgcgggacgacg

SEQ ID NO: 4227042 - RNA, 96 nt, Coxiella burnetii RSA 493
ggguggguccauauacguaugagcgaagcgaaauacgggaaaacaaugaugucaucuauuguccccguauuucgcuucgcuucauacgggcuaccu

SEQ ID NO: 4227043 - RNA, 71 nt, Coxiella burnetii RSA 493
gauuaauaagucgaacuggauagugccguuaguuguuuuuacgguauuuuuauucauucgacuuaaaaauu

SEQ ID NO: 4227044 - RNA, 79 nt, Coxiella burnetii RSA 493
gcgaucgcucuuuuuucugaugaagauauaaaaccgaucuuuaaaagggguucuauuuuuauuauagauauggaauugc

SEQ ID NO: 4227045 - RNA, 88 nt, Coxiella burnetii RSA 493
ggcuguuucggcuauuuuagauggauuaauaacacgagcagccgucuaucgguuauuucuggauucagguucgucuccgacaauagcu

SEQ ID NO: 4227046 - RNA, 85 nt, Coxiella burnetii RSA 493
aguaggcuguuuaauaaaugucugguaugcugguguagccgugauucaauaucagccauuauuacgacuuuuauguucagcuucu

SEQ ID NO: 4227047 - RNA, 112 nt, Coxiella burnetii RSA 493
aggauagccuggacagaggacagugguugugucgcuaugcgacaacuaaauuuuauaaauuaauguuggccaagccacacaacucuguuuucaguccucuguccccugucuu

SEQ ID NO: 4227048 - RNA, 80 nt, Coxiella burnetii RSA 493
guggacaauguggcugaugcuaugcuuuuaggagguuuauuaagugcgcuuuuuaaguaugguauuuguuuuauugccac

SEQ ID NO: 4227049 - RNA, 69 nt, Coxiella burnetii RSA 493
augggcaaagcgaccuuaccuaucgauaacuucuaugcuuuuaucgagggugguguugcuuaugugcau

SEQ ID NO: 4227050 - RNA, 74 nt, Coxiella burnetii RSA 493
uaugauuaaagcgcacgagauccaaggcgugaucgcuuuggaaaaugccuucaaucgcguggguuuagaucaug

SEQ ID NO: 4227051 - RNA, 77 nt, Coxiella burnetii RSA 493
uagcauuugguuuugcauggcagaaacgauaccauacaauucaucugcaguuucggguuuguuaugcaaaagcgcua

SEQ ID NO: 4227052 - RNA, 65 nt, Coxiella burnetii RSA 493
guucgacgagccuuggcauaaaaaacuucugccgauugaaggaauugcgcuuuuugcucgucaac

SEQ ID NO: 4227053 - RNA, 60 nt, Coxiella burnetii RSA 493
aauagucgcaaaauaauuccacugacugggguucccaaucggcuuccguuuuuggcuguu

SEQ ID NO: 4227054 - RNA, 76 nt, Coxiella burnetii RSA 493
guagcccguaugaagcgaagcgcgucuugcaggacuguguuaauccccguauugcgcuucgcuucauacgggcuac

SEQ ID NO: 4227055 - RNA, 64 nt, Coxiella burnetii RSA 493
gccaaagagaguuuauuacaucaucaaucaaaaagugguuuggcguacuuaaauuuauuuuggu

SEQ ID NO: 4227056 - RNA, 81 nt, Coxiella burnetii RSA 493
gcgauuccguagcccguaugaagcgaagcggaaaacgggaacccuguauuucacuucgcucauacagcuacgguuagacgc

SEQ ID NO: 4227057 - RNA, 79 nt, Coxiella burnetii RSA 493
aagcucucggcuuuuucaucauucauccucgauuuguaaucuccaagauucuagcauaaugacgaggaaaugggagcuu

SEQ ID NO: 4227058 - RNA, 99 nt, Coxiella burnetii RSA 493
guuuuuuagaaaguaagcguaugaagcgaaguggaauacggcggaauaauaauaauucccguauuucgcuucacuccauacgggcuacggcuaagggac

SEQ ID NO: 4227059 - RNA, 92 nt, Coxiella burnetii RSA 493
aguguaguagcccguaugagcgaagcgaaauacggggacgauagauggcaucauuucccguauuucgcuucgcucauacgggcuacuuuacu

SEQ ID NO: 4227060 - RNA, 70 nt, Coxiella burnetii RSA 493
guaugagcgaagcgaaauacgggaaaacaaugaugucaucuauuguccccguauuucgcuucgcucauac

SEQ ID NO: 4227061 - RNA, 88 nt, Coxiella burnetii RSA 493
gcaaauccaucucgccgcaacaguuuucguccuuuugacuguauuucccaaauauaaucguccguaggaagcgcggggggauguuugu

SEQ ID NO: 4227062 - RNA, 78 nt, Coxiella burnetii RSA 493
gcggccuugagggaaauuguagguacgaaugcguuccgagcgaucaccgcuuccuaccaacgauuuucguuuagccgc

SEQ ID NO: 4227063 - RNA, 65 nt, Coxiella burnetii RSA 493
ggacgacggguuuuaaguuuuucgcucuucaccacggguggguaaugguaggaacccguuguauc

SEQ ID NO: 4227064 - RNA, 96 nt, Coxiella burnetii RSA 493
cuccgcauaaaggcuugucugaauuaauggcucuacguuuuguuacuuuuguaauaguguggagcgguuauuuuuuauuauugcugcaugcguggg

SEQ ID NO: 4227065 - RNA, 69 nt, Coxiella burnetii RSA 493
cgccuaucgauguuuucaauaauuauuuugggaccaagauuaaugaugaagauuuugauacaauuggcg

SEQ ID NO: 4227066 - RNA, 73 nt, Coxiella burnetii RSA 493
cguaugaagcgaagcggaauacgggaaaacaaugaugucgucuaucguccccguauuucgcuucgcucauacg

SEQ ID NO: 4227067 - RNA, 88 nt, Coxiella burnetii RSA 493
guugagcccugaaaauagugcgaaaaagauaguaauuccagauaacacuaaauggaccaaugcuuuuuuugcauuaucugcagucaac

SEQ ID NO: 4227068 - RNA, 63 nt, Coxiella burnetii RSA 493
acuaaucugcuuagagccaccaaagaagguacgucuuuuuuuacuuggagcaaagcggauagu

SEQ ID NO: 4227069 - RNA, 60 nt, Coxiella burnetii RSA 493
aagccagugcguuuuuaauccaugacucgauuuuuuugucguguaaaaauucauuggcuu

SEQ ID NO: 4227070 - RNA, 96 nt, Coxiella burnetii RSA 493
uacuugggcagauucgugagaaaauuaauuauuuauuguacuugauuagucugcauuacaaugaaggauugaauuuuuuuaggggucucuaucgua

SEQ ID NO: 4227071 - RNA, 89 nt, Coxiella burnetii RSA 493
uaaucaaggcagacaaaugggaauggacguguugaauagguuccaucccuuuaaugauuccuuucucauuucguccauaaagcugauug

SEQ ID NO: 4227072 - RNA, 92 nt, Coxiella burnetii RSA 493
gcuaaguagcccguaugagcgaagcgaaauacgaggacgauagacaucauuguuuuccccguauuucgcuucgcucauacgggcuacuuuac

SEQ ID NO: 4227073 - RNA, 60 nt, Coxiella burnetii RSA 493
uaaugguuggcguuggcauuguaggguguaaaucacuuuugcaaacgaucccggcuguua

SEQ ID NO: 4227074 - RNA, 82 nt, Coxiella burnetii RSA 493
accguuuuucgacgguagcuaaaggcuucuuucacaacaugacucaauugauccaaguuuuuggcgaccggcguaaaauugu

SEQ ID NO: 4227075 - RNA, 66 nt, Coxiella burnetii RSA 493
uuuuagcacuuucagcagggaaaaauuuaggccggccgagguaccccugcguggaagaagcuggag

SEQ ID NO: 4227076 - RNA, 70 nt, Coxiella burnetii RSA 493
gcucucaugucguuaccuauuuaugaccauuuauucaugaaaaucggucugauuaccguagcgauaucgc

SEQ ID NO: 4227077 - RNA, 67 nt, Coxiella burnetii RSA 493
gguugggaguugucgugauuacgcuaccuuauuuugugcuauuuuaaggcaucauggcaucccagcc

SEQ ID NO: 4227078 - RNA, 87 nt, Coxiella burnetii RSA 493
ucguaacuuuaggcgcauuuaugguauuuuuuaucgucgcgcauacgggcgauagagcggaugcuuauuugaguuuggaaggcgcga

SEQ ID NO: 4227079 - RNA, 130 nt, Coxiella burnetii RSA 493
uaaaacacguccuuuccgugaagcagacgucccauagcccguaugaagcaaagcgagauacgggaauugcgucauuccgcuuuguuucauacgggcuacugcuagcuuuagggaugaguuugagcgcuug

SEQ ID NO: 4227080 - RNA, 64 nt, Escherichia coli CFT073
gagcugcaccaaggucgacaaccgucauucccgguuuaaagaguuugucacuuugcuguauuuc

SEQ ID NO: 4227081 - RNA, 102 nt, Escherichia coli CFT073
uugccugaugcgcuacgcuuaucaggccuacaucguuccugcaauuuauugauuuugcaagauuuuguaggucggguaaagcguucacgccgcauccggcaa

SEQ ID NO: 4227082 - RNA, 69 nt, Escherichia coli CFT073
ggcgaugcaacgcuguguaaagguucucagcaguuacagcuuaaaccgggugaaucagcguuuauugcc

SEQ ID NO: 4227083 - RNA, 72 nt, Escherichia coli CFT073
cucuucgaucucguaaccgucgcagguuggguuauuaccacagacaugcaacuuacguuucggaucgaugag

SEQ ID NO: 4227084 - RNA, 83 nt, Escherichia coli CFT073
gaagaauggcgcagcggcaaugaaagcguucgucgugacccgugugggugacgucuuccucgcuuucgcgcuguucauucuuu

SEQ ID NO: 4227085 - RNA, 74 nt, Escherichia coli CFT073
aauaagcucaccacugcacgaaaaugauucauugcuuuaaucagcucccgcuuuucgucaguggucagcucauu

SEQ ID NO: 4227086 - RNA, 77 nt, Escherichia coli CFT073
ugcucaggccugcguugguguaguuguucacaacgaugugguucauguuggcaaucugcugcgccgucaggucagua

SEQ ID NO: 4227087 - RNA, 67 nt, Escherichia coli CFT073
uuggugaugauuuaccggaucaaccugcacaacccuucgaagguuuaggcuccggugucaucaucaa

SEQ ID NO: 4227088 - RNA, 72 nt, Escherichia coli CFT073
cugacggcaacgguuaaggaucaauacggcaaccuucuuccuggcgcuguggucgucuuuaaucugccucgg

SEQ ID NO: 4227089 - RNA, 122 nt, Escherichia coli CFT073
ccacgucguaugccauccguuuuccugaugauccggagauuuuuucgcagacagaggcgcagcaacuggucgcggaagagcuuguggagaagugggaaaaaggaaagaugcgucugcugugg

SEQ ID NO: 4227090 - RNA, 62 nt, Escherichia coli CFT073
aucgcuaaggaaacaguaugaaccuguuuaaucccgacagguuaaucacuuuuccugccgau

SEQ ID NO: 4227091 - RNA, 70 nt, Escherichia coli CFT073
acgcagguuagcgugcuugugcuuaaaaccaccuuuaccgguuuuuuugaagcgcuuagcagcaccgcgu

SEQ ID NO: 4227092 - RNA, 82 nt, Escherichia coli CFT073
uuccgggaaauuuuccgaacaucagugauaaugaggguuuuguuguuuuuguuucugcaauguuugagggcuguuccuggag

SEQ ID NO: 4227093 - RNA, 64 nt, Escherichia coli CFT073
cugggcacgaccguucagcugcuccugauuaaagguguuuccuucacugaaggucaugccauag

SEQ ID NO: 4227094 - RNA, 62 nt, Escherichia coli CFT073
ggccuuaacgauaagcaguuagcagaaauuucuucucuggguuugccgguuaucguuaagcc

SEQ ID NO: 4227095 - RNA, 55 nt, Escherichia coli CFT073
ugggcaaugcccuguacgacaucaaaggcuugacguaucaagggcauuugcacca

SEQ ID NO: 4227096 - RNA, 61 nt, Escherichia coli CFT073
uauugaugagcguggagcacugacggguguacacgucacaggcuuccauugcaucacaaua

SEQ ID NO: 4227097 - RNA, 64 nt, Escherichia coli CFT073
ggaaaacgugcugcugcauaagcugccggugaaacgccugcaacuggcugauggcagcaccgcc

SEQ ID NO: 4227098 - RNA, 58 nt, Escherichia coli CFT073
cugcugguaaaccuggcuaucuggcaccaacagccgcacuggccaacguuuauuacag

SEQ ID NO: 4227099 - RNA, 130 nt, Escherichia coli CFT073
uaaaauagccgcaauuuuucguuuucaacaagcgcggcgcgaugccgcuuacucaagaagaaagaauuaugacguugucuccuuauuugcaagagguggcgaagcgccgcacuuuugccauuauuucuca

SEQ ID NO: 4227100 - RNA, 88 nt, Escherichia coli CFT073
agaauaucgcugaccagcggcucgccuuuugccgugggcuuaucuguugccaccagcaacuggggggccgcuuugucgguuguugucu

SEQ ID NO: 4227101 - RNA, 61 nt, Escherichia coli CFT073
gguucacuggugguuuuacuggcgcucuacccguggguggaagugaaauccaacaguagcc

SEQ ID NO: 4227102 - RNA, 60 nt, Escherichia coli CFT073
cggacucagccaugauggaguuaauggucguucauccacauauuuucuggcucagucucg

SEQ ID NO: 4227103 - RNA, 85 nt, Escherichia coli CFT073
uuaaucauuuucagagugguggauuuaccggagccugauguaccaaucagcaccgaaaaacuccccuccugaaaauugagauuga

SEQ ID NO: 4227104 - RNA, 90 nt, Escherichia coli CFT073
gcgccagcaguuugcggcgauuagcgucgaauuuguccaugauaaucaagucuacaggucaauguuaucguuuauaugcacuucuggcgc

SEQ ID NO: 4227105 - RNA, 55 nt, Escherichia coli CFT073
cauugauaucgauaagcugcgauaauaguggaaucgcagcuuaucugagacaaug

SEQ ID NO: 4227106 - RNA, 104 nt, Escherichia coli CFT073
cauugcccgaugcgcuacgccuaucaggccuacacguucgcugcaaucuccuggauuugaacgguuuguaggccggauaaggcguucacgccgcauccggcaug

SEQ ID NO: 4227107 - RNA, 60 nt, Escherichia coli CFT073
gcugcuuaauaugggaucgucucauggccuugccaugguguucucuauguugcuggcggc

SEQ ID NO: 4227108 - RNA, 59 nt, Escherichia coli CFT073
uguaauggaguauggcgucaguuuuucagaacgggaacuaaugacauacugcuguuuca

SEQ ID NO: 4227109 - RNA, 70 nt, Escherichia coli CFT073
guugccaguuuggcgacaguugacgcgaccaucaccugccccggcgucaccugacgagcaaacugucgac

SEQ ID NO: 4227110 - RNA, 96 nt, Escherichia coli CFT073
ugaagcugaaggucaugcguuauugcugggcaaucaggcgcuguuaaaugaccaacaggucgauaccaaagcaauugaagcagauauuucagcuca

SEQ ID NO: 4227111 - RNA, 91 nt, Escherichia coli CFT073
aggcauccauacccguugcagcggucagugacuucggcauaccgaucaucagagaggagucauugacagaaagcagcggaguuacauguuu

SEQ ID NO: 4227112 - RNA, 73 nt, Escherichia coli CFT073
ucuuuuucgcguaaacgccaggcguguaauaacgguucgguauagccguuuggcuguuucacgccgaggaaga

SEQ ID NO: 4227113 - RNA, 59 nt, Escherichia coli CFT073
ugggcgugggaugugggccugaacggucguccgcaugauuuagguaauaucucggcuua

SEQ ID NO: 4227114 - RNA, 81 nt, Escherichia coli CFT073
gccccggucaucaaauucaagauggggaauaagcuguacggagcggauaccccguuguuugaaauugugauaaaaaucggc

SEQ ID NO: 4227115 - RNA, 70 nt, Escherichia coli CFT073
cagggaaaacaacaaaaucaguccggcggaaguguaaaacaccaccggauugauuuuguccuuuucccug

SEQ ID NO: 4227116 - RNA, 67 nt, Escherichia coli CFT073
guugaucgugguugcggaaauuguguuguggaacgcacaaacgcaguucuggcaacugguggucggc

SEQ ID NO: 4227117 - RNA, 59 nt, Escherichia coli CFT073
guugguccucgucgaccacgggcaccgcacagggugccuguccgacaugagagagcaac

SEQ ID NO: 4227118 - RNA, 59 nt, Escherichia coli CFT073
aauccgguguuugcauuuuugacccgcguggcagucaugaucaugcaagcauuaggauu

SEQ ID NO: 4227119 - RNA, 67 nt, Escherichia coli CFT073
aucgguguuggagcgguaggccggauaaggcguuuacgccgcauccggcaucuuuccuaacgccgau

SEQ ID NO: 4227120 - RNA, 92 nt, Escherichia coli CFT073
ggauuguauuguucaggccagguucagagcugaugccccuguuuaugcaggggcguguccugcuggagccugagccggaacguuauucaucu

SEQ ID NO: 4227121 - RNA, 99 nt, Escherichia coli CFT073
ggcaaacauauugaugaacuacuggcgacagaaggcacugagaaccucggguccucuucgguccucccugucaccggugcacugcaucuugaugagguc

SEQ ID NO: 4227122 - RNA, 59 nt, Escherichia coli CFT073
agaaaaucauaucgccaucuugcgcgccaguacgcuccaggauggcuucgaugauuucu

SEQ ID NO: 4227123 - RNA, 59 nt, Escherichia coli CFT073
gcaucguuguaggccugauaagacgcugcaagcgucgcaucaggcauuacaagggcugc

SEQ ID NO: 4227124 - RNA, 78 nt, Escherichia coli CFT073
uucucucccuaaaaaucugucuggcaggguagcgauuugugcguauugucacgauugagauuuuuuaaggugagagga

SEQ ID NO: 4227125 - RNA, 60 nt, Escherichia coli CFT073
cugguuacagaaagagauugauaauucgcgucgcgaaaaauagucuguuccuguagucag

SEQ ID NO: 4227126 - RNA, 89 nt, Escherichia coli CFT073
ggaaaaccugaauauggaucugcuguacauggcugccgcugugaugaugggucuggcggcaaucggugcugcgaucgguaucggcaucc

SEQ ID NO: 4227127 - RNA, 79 nt, Escherichia coli CFT073
gggcagaguuuuuagugauuaacgucucuuucagaccggaaguguucuggaguaguguagucaauggggugcucuggcc

SEQ ID NO: 4227128 - RNA, 70 nt, Escherichia coli CFT073
ccgcuuuguaggugguguuaccgguguucagauccgggaagaugaacacgguagcgcgaccugcaaccgg

SEQ ID NO: 4227129 - RNA, 67 nt, Escherichia coli CFT073
auuuguaacuuuuuuaucauugucuuuuccucuuuugaugaaauggcaacgauagaggcgagcaaau

SEQ ID NO: 4227130 - RNA, 58 nt, Escherichia coli CFT073
guguaaguaaggugguaaggucacuccccagggggcgugaccuuauccauauuuacgc

SEQ ID NO: 4227131 - RNA, 124 nt, Escherichia coli CFT073
auuuugcaaagaagucuguuucgccaggauaaugagaccauccaaaaaugguuacucaaccauuuuuaucgauggcuaauuagugacuuuccaauggugcaacaaauuaacucgcuugcagaau

SEQ ID NO: 4227132 - RNA, 76 nt, Escherichia coli CFT073
gguaacggcgacguagacaacgguacugaacuggauaacaguucuguagacaacguuguugcggcaaccgguaacu

SEQ ID NO: 4227133 - RNA, 90 nt, Escherichia coli CFT073
augaauccgcgcugaauggcggaguguugcucaaaauguaaacgcauauugacuauacuuacgccauugagguaaaaaacagcguuucau

SEQ ID NO: 4227134 - RNA, 75 nt, Escherichia coli CFT073
uuacguacuggcgguggaacuggcuucuaugcugcugcucgcgggucugguuguggccuuccacgucggucguga

SEQ ID NO: 4227135 - RNA, 74 nt, Escherichia coli CFT073
gcgcaagaaagauauuauuguccgcggcggcgaaaauauuagcagccgugaaguagaagauauuuuauugcagc

SEQ ID NO: 4227136 - RNA, 95 nt, Escherichia coli CFT073
ugcggauuuaaccccgaaacgcaucgguaugauugcgccagaagcuguggcuuugcguaucaucaacccgaugcgcuucugccuguacguuugca

SEQ ID NO: 4227137 - RNA, 64 nt, Escherichia coli CFT073
gcuuccucauauucuuccugugccaguccuaaagauaguccagccaggcggaaaaugaggcagc

SEQ ID NO: 4227138 - RNA, 80 nt, Escherichia coli CFT073
gcaacaguuccuuaaagguucgcugaaauaauuuccucuccggugguuaacgcugccggaguauuucauggggaauuugc

SEQ ID NO: 4227139 - RNA, 119 nt, Escherichia coli CFT073
gcaggaaguuugcaugugcauccagcauuugagcgaagucagaacggauaucguacuuguccagaucgaaguaaacgauguuguucugcugcagcuguugcauuugcagacgagccugc

SEQ ID NO: 4227140 - RNA, 64 nt, Escherichia coli CFT073
uuaacgguaaccugauccccacaucacaaauguguaaucagcagacgggauucagggcuguuga

SEQ ID NO: 4227141 - RNA, 107 nt, Escherichia coli CFT073
guucuggcgcgacgaccagcaguucgcgaauacgcugcucacggguuucaccuuuauggccuuccggcagcgcguuggugaagugcggguugauuugcagcgggaac

SEQ ID NO: 4227142 - RNA, 58 nt, Escherichia coli CFT073
gcaaccaaccugacucgcgguguugcucccggaaugcgcccgcgcgcaggcugguugc

SEQ ID NO: 4227143 - RNA, 60 nt, Escherichia coli CFT073
uugugcgucgcgaacugcggguagauuagauuuggcaccgccagcaguuuuuucgcacag

SEQ ID NO: 4227144 - RNA, 64 nt, Escherichia coli CFT073
ccgcgugguugugcucguuacccgcguaaacuuucaguuuacggaacauagcacgacccagcgg

SEQ ID NO: 4227145 - RNA, 65 nt, Escherichia coli CFT073
ggcgcagugccaggguuuugaucgauguucaguuuugcaacggucaguuugcccugauauucguc

SEQ ID NO: 4227146 - RNA, 71 nt, Escherichia coli CFT073
cggcgucucgcugcugauugcuaacgucgcgauugcuauuucggcgguugguuacggcaccgaacugcucg

SEQ ID NO: 4227147 - RNA, 62 nt, Escherichia coli CFT073
uugccgacgcugcggcgaaauccgccgugauugacccgguggguuaugccagcccgucgcaa

SEQ ID NO: 4227148 - RNA, 61 nt, Escherichia coli CFT073
ucgccguguucugcgaaggacgacugacgcaaauccugaccaaucgcgaugacaugagcga

SEQ ID NO: 4227149 - RNA, 75 nt, Escherichia coli CFT073
aacaaauauaaaguuccgcguauugcguucguuaacaaaauggaccgcaugggugcgaacuuccugaaaguuguu

SEQ ID NO: 4227150 - RNA, 62 nt, Escherichia coli CFT073
cugcgagaauggcguaucggagcggugauguaucgcugguuucugcgccauuucccacgcgg

SEQ ID NO: 4227151 - RNA, 58 nt, Escherichia coli CFT073
ggauauugguucccgucugguagaaggauuugcuguagacggauuuaaccgauugucc

SEQ ID NO: 4227152 - RNA, 85 nt, Escherichia coli CFT073
ggguagcagguugacuuccugauagacggugccgaugccgaguuguugugcgugggcgguguuuuucggugagauagccuggccu

SEQ ID NO: 4227153 - RNA, 130 nt, Escherichia coli CFT073
uuuugcacccggucaucucguucauccagugguuugagauugaucuguaaacgcgcacuguucagcgacggguuagugccaucaacgccaacaaaugaggucaaacuuugcacugccggauccugcaaaa

SEQ ID NO: 4227154 - RNA, 89 nt, Escherichia coli CFT073
ugccccuugcguuacggcuuguccgguuaaugcucugacuuuccaguccgauagcguacaacuggacgagcaaaaauguauugguugua

SEQ ID NO: 4227155 - RNA, 84 nt, Escherichia coli CFT073
uccguucugccauaagcuuuguuacuucugcgguugcaauaagauuguuacucgccagcagcacaaggccgaucaguaucugga

SEQ ID NO: 4227156 - RNA, 58 nt, Escherichia coli CFT073
acggcugagagcaccaccagagaacauguuaaacaucucaaugauggugccucgcugu

SEQ ID NO: 4227157 - RNA, 67 nt, Escherichia coli CFT073
gagcaacagcgaggcaccaucauugagauguuuaacauguucucugguggugcucucagccgugcuu

SEQ ID NO: 4227158 - RNA, 75 nt, Escherichia coli CFT073
uuucauaagguuauuggcaauauaacguucaauucuuacuugcauuuuauauuagccaggaacuuugcccugagg

SEQ ID NO: 4227159 - RNA, 67 nt, Escherichia coli CFT073
ugaaaaacggcugcggaauuagaccaguuaucucccgaagaaggaaauuuccgcagcgcguguuuua

SEQ ID NO: 4227160 - RNA, 58 nt, Escherichia coli CFT073
gugucgaaauggaagcguuaaccgcggccuccguggcggcgcugaccauuuaugacau

SEQ ID NO: 4227161 - RNA, 66 nt, Escherichia coli CFT073
cauuucauguguugucagugcaguggggugccgugggugucccacaaugccaauacacuugaaaug

SEQ ID NO: 4227162 - RNA, 94 nt, Escherichia coli CFT073
agaggcacgucagccguuaacagccaaagacuggaaacugguguuccaucguaaacugaucggugucuaucuugggcaauuugcgguggcuucu

SEQ ID NO: 4227163 - RNA, 65 nt, Escherichia coli CFT073
gcagcgacaacuuacugaugaucaaugcgcacauugcgcacgauuguacgguagguaaccgcugc

SEQ ID NO: 4227164 - RNA, 65 nt, Escherichia coli CFT073
accgacgaucaugaugucggcaucuuugcccugaauggugcugccaucaucggucaccgucaggu

SEQ ID NO: 4227165 - RNA, 56 nt, Escherichia coli CFT073
cuccuuuguaacguugcaggaugucgguggccguauucaacuguacguugcaagag

SEQ ID NO: 4227166 - RNA, 57 nt, Escherichia coli CFT073
gguaugcguggcgcgcguguucaggcgguuucuacugaacugggcggcgagcguauc

SEQ ID NO: 4227167 - RNA, 57 nt, Escherichia coli CFT073
aggcaacaaucaacgaggccaccagcgccccggcgaaggccaucgccaguuguuccu

SEQ ID NO: 4227168 - RNA, 106 nt, Escherichia coli CFT073
cgguugauuuauuuuguugcacaggggcgaucgccaggcagguaccggaggcgggcucugaaguacugaguagggugaucgcgucaggccgcgaaguacugacucg

SEQ ID NO: 4227169 - RNA, 59 nt, Escherichia coli CFT073
gcgggaucaacaucgacaaccgcaugauccguaaagguucugucgaugccauucgccgc

SEQ ID NO: 4227170 - RNA, 96 nt, Escherichia coli CFT073
gaaaucaucccccgcgaccacguuuuuauugaucacuacggcguaaccgugauggauaguaaagcgucggccuauggucgcggcggccuggauuuc

SEQ ID NO: 4227171 - RNA, 83 nt, Escherichia coli CFT073
uccggggaagaagccaugcuauacgguuccaucgugaccuuccucgguuggacacuguauggucuggucucaccacgcuuuga

SEQ ID NO: 4227172 - RNA, 67 nt, Escherichia coli CFT073
aagaaaagguuuuagccugguacccuucaaguaaugaaggcgaaaacaaggcugauaaccuuauuuu

SEQ ID NO: 4227173 - RNA, 57 nt, Escherichia coli CFT073
agaaaggaaacgacaggugcugaaaacgggcuuuuuggccucugucguuuccuuucu

SEQ ID NO: 4227174 - RNA, 55 nt, Escherichia coli CFT073
cacugacugaaacguuuuugcccuaugagcuccgguuacaggcguuucagucaug

SEQ ID NO: 4227175 - RNA, 86 nt, Escherichia coli CFT073
gaaucgagauguucugcucuuuagccgcagccaggucugccggagucaggcucaguacgcagcugaagacgaagaacauuacgguc

SEQ ID NO: 4227176 - RNA, 78 nt, Escherichia coli CFT073
cguauccgggcgcggaauuaaggucgcuggcgaaacaaauaacggcaacgaccagaauucucgcaccccgguuaaaug

SEQ ID NO: 4227177 - RNA, 62 nt, Escherichia coli CFT073
ugguuuguugauuggcgcagagguugccaguaugcgcgacuaugugacccaucaacacgcca

SEQ ID NO: 4227178 - RNA, 78 nt, Escherichia coli CFT073
cagacgggugucaucaacguugguaacaaacagcggaugcuucgcacguugaccgauguugaggauugccgcaaucug

SEQ ID NO: 4227179 - RNA, 85 nt, Escherichia coli CFT073
guuacgucaaaaacaaagugauggaguucguaggucccgguguugcagcgcucucuaccgauuuccguaacagcguugacgugau

SEQ ID NO: 4227180 - RNA, 73 nt, Escherichia coli CFT073
agaugagcguguauaucaauaaaguccggcucccguugagcaaggcgucggaguuuguugauguaacucgucu

SEQ ID NO: 4227181 - RNA, 130 nt, Escherichia coli CFT073
uggauauucugauugcguggcugcaggacaauauugacugcgaaucagggauuaucuucgacaacgaugaggauaaaacggauucggcagcacuguugcccuguauugaacaggcuagggaggauauccg

SEQ ID NO: 4227182 - RNA, 81 nt, Escherichia coli CFT073
gcugcgcgaacgaucagguuaucuucauguuccacgccuucaacgggcguuaacagacgaauauccccaucgucacgaagc

SEQ ID NO: 4227183 - RNA, 69 nt, Escherichia coli CFT073
gccagcgacagcgccaauaagcgcgccgaaggcuugugcguuccguuuauuuugggcguugucuacggc

SEQ ID NO: 4227184 - RNA, 77 nt, Escherichia coli CFT073
ggcucgcgugaugauauugcuccagauguugaccgauaaaccagguuucaucuguacugguaaugucuugugcugcc

SEQ ID NO: 4227185 - RNA, 68 nt, Escherichia coli CFT073
cggguaaacgucaauuacgucgcccauguucagguuagagacgucgacuucgauuggcagugcacccg

SEQ ID NO: 4227186 - RNA, 78 nt, Escherichia coli CFT073
gucaacuccggggaaauugucggucugcuggggccaaacggugccgguaagaccaccacuuucuacaugguuguuggc

SEQ ID NO: 4227187 - RNA, 107 nt, Escherichia coli CFT073
ggugccaaacacguaggccggauaaggcguuuacgccgcauccggcagucgguacacaaugccugaugcgacgcugacgcgucuuaucaggccuacaggucggugcc

SEQ ID NO: 4227188 - RNA, 73 nt, Escherichia coli CFT073
ggcaugauaaacgaguaaaaaugacucgccugcugcggguagcgagucauuuuuacucauugaaacuuaagcc

SEQ ID NO: 4227189 - RNA, 111 nt, Escherichia coli CFT073
gcggcucauacugcuuagccauaccagaccagaaugcaguagucgcagcggaagugaugguaauaccacguuccugcuccugcuccauccaguccaugguugcagcgccgu

SEQ ID NO: 4227190 - RNA, 73 nt, Escherichia coli CFT073
gcagaugucaucgaucgucaggagcgucuggugcuaauucaguaucggcccaaaugaucugguuaacauuagu

SEQ ID NO: 4227191 - RNA, 83 nt, Escherichia coli CFT073
ccgcaaugcggcugaugaggaucgcgaugcacugcgugcggcgcuggaaggugcagacauggucuuuauugcugcggguaugg

SEQ ID NO: 4227192 - RNA, 82 nt, Escherichia coli CFT073
gcgcugcgcuuaucaggccuacugggugaguugcaauauauugaauuugcacgaucuuguaggccggauaaggcguuuacgc

SEQ ID NO: 4227193 - RNA, 61 nt, Escherichia coli CFT073
ugcuacgcgcuguuguugcaguaccggaugguccgcaccaaacagcagcggcgcaauggca

SEQ ID NO: 4227194 - RNA, 97 nt, Escherichia coli CFT073
caucaccaagcaaauugauggcauguugcugcuggguucaaggcugccguuugaugccagcauugaggaacagcguaaucugccgccgauggugaug

SEQ ID NO: 4227195 - RNA, 124 nt, Escherichia coli CFT073
gcgcaucugcucaguaagcuugaggccugugacgccagugagaaaaugcuugaugagugggaucugcgucaucaggcguuucauacugcaauuguggcgggcugugguucuuacuauuugcugc

SEQ ID NO: 4227196 - RNA, 72 nt, Escherichia coli CFT073
cugauccgaugguugugccguuucgcuccgcuccgggcggcgcggaauaaacgauacaacccaggaaaccag

SEQ ID NO: 4227197 - RNA, 65 nt, Escherichia coli CFT073
ggcgaaccgcaagauuacaacgaacauuuguucuggaacauguuagcaacgguuuuugguuugcc

SEQ ID NO: 4227198 - RNA, 68 nt, Escherichia coli CFT073
cacuggguaaaaaccucggcgacgguaugcucaacgagccgcuguugcuggcagguuuuggccugaug

SEQ ID NO: 4227199 - RNA, 77 nt, Escherichia coli CFT073
uugcggaaccgguuaugucuacgaugugauugccgauuucgacggcaagccuuccauuacgcugaccgaauuugcag

SEQ ID NO: 4227200 - RNA, 74 nt, Escherichia coli CFT073
uguuuguaccaccgaaaagugauauuacggucucgucgccagugacguuggcuggugaaauuacuuaucaaaca

SEQ ID NO: 4227201 - RNA, 65 nt, Escherichia coli CFT073
aucacuucuucucggauuucacccagcaguuagauaaagcugaaaaagauccggaagaggguggu

SEQ ID NO: 4227202 - RNA, 56 nt, Escherichia coli CFT073
gcuggguuggggagaaauaagccacucugaaauggagcgauuucugcucauccagc

SEQ ID NO: 4227203 - RNA, 110 nt, Escherichia coli CFT073
ggcucaucacccacaguuguuuucaguuccuuauaguauucaaugaauugccuuuguuucucuucacugaauuuaugggggacgccugacgguuuuuuguaggugacacc

SEQ ID NO: 4227204 - RNA, 61 nt, Escherichia coli CFT073
ucaccagcaacagacggcgaaucagauaagcgcccaucuacucucccuguugucuggcuga

SEQ ID NO: 4227205 - RNA, 77 nt, Escherichia coli CFT073
cagaucacaaucgcuguuaucaacagacgaagccagacagcaugcucauccugugcugauaucagcgguguggucug

SEQ ID NO: 4227206 - RNA, 64 nt, Escherichia coli CFT073
gcugaccggcuggauuggugaaauugccgcguauuacgccgcagcaccgguccgucugggaggc

SEQ ID NO: 4227207 - RNA, 63 nt, Escherichia coli CFT073
uugcccguuggagacggcuucaaugguuuuguugauugccugaagcugguaauaacguggcga

SEQ ID NO: 4227208 - RNA, 130 nt, Escherichia coli CFT073
ggaguugaugucuuccagucucaagcagcguuuaacugcugagccggugcguuuuguuuaucagcgcgauaugcccaaugcgcugguugaaguguuacgcgaaaaacugacuauuucccgcuacgacucc

SEQ ID NO: 4227209 - RNA, 94 nt, Escherichia coli CFT073
ggcugaucaaaugccgcucagugccgggaaugcggucagaauucagccccuuacugacguauggugugcugcucccgcugauggcggaaaagcc

SEQ ID NO: 4227210 - RNA, 59 nt, Escherichia coli CFT073
ggugaaaaaacuugaugcacgucaaaagaugacgcauauuugcgcgcguuuuauucauc

SEQ ID NO: 4227211 - RNA, 76 nt, Escherichia coli CFT073
cgccgauugcugccgaugcucauucaucgugaugaagcgauggcugaaugucuggcagcuaagcaaccagucggug

SEQ ID NO: 4227212 - RNA, 69 nt, Escherichia coli CFT073
acauuacguucauuaccggcgcauacaccacaccuaaaaucgguuuaccguggucgaugagcgcaaugu

SEQ ID NO: 4227213 - RNA, 84 nt, Escherichia coli CFT073
aggguggcggcaaacagcgugagcagcgcggcagacggugugacgccuugcugcugccagcgcuguuucacggccugccauucu

SEQ ID NO: 4227214 - RNA, 60 nt, Escherichia coli CFT073
uucaucgaugguuugcgucgugagcggugcggcacgccacugacguugguuuuuggugaa

SEQ ID NO: 4227215 - RNA, 55 nt, Escherichia coli CFT073
gaagguuaacccgcugggcggcugcuucccgcugcugauccagaugccaaucuuc

SEQ ID NO: 4227216 - RNA, 72 nt, Escherichia coli CFT073
gacgacggcauuagguaugggauuugauaaaccugauuuagguuucgucauucauuaucagaugccgggguc

SEQ ID NO: 4227217 - RNA, 76 nt, Escherichia coli CFT073
ggcagcagacaaucaggcuuuuuuacuggcaaaucauggcccagugguuugcggugaaagccugcaagaagccgcc

SEQ ID NO: 4227218 - RNA, 78 nt, Escherichia coli CFT073
cugcuggaaaacugucugaaguggauuuuaaagggguuaagcaggcauuagccaaaaugcauuauacgguucuggcgg

SEQ ID NO: 4227219 - RNA, 72 nt, Escherichia coli CFT073
ggcgugaacgccuuaucuggccuacgauuucgugaaaauuugaaccguaggccaaucaggggguuuaacgcu

SEQ ID NO: 4227220 - RNA, 60 nt, Escherichia coli CFT073
cauaccaacguacuggcucugcaaaguucugcugcggguagcgcaacaaacguuggugug

SEQ ID NO: 4227221 - RNA, 128 nt, Escherichia coli CFT073
cagacuugaacaaaggugugauuauccaguccgguaaugacgccuguauugcgcuggcugauuacguugccgggagccaggagucauuuauugguuugaugaaugguuaugccaaaaaacugggucug

SEQ ID NO: 4227222 - RNA, 72 nt, Escherichia coli CFT073
ccuuucaauacuuaucgauuccuuugcaaggaucgccaguuccgccacaaagaguugauaaaaaucgacagg

SEQ ID NO: 4227223 - RNA, 78 nt, Escherichia coli CFT073
ccggaagcgaagcagggcgauuaccugguggguacagaugaaaacgugcugguacuuaaucgcaccuaugccaaccgg

SEQ ID NO: 4227224 - RNA, 75 nt, Escherichia coli CFT073
ccacguuaccuugcucuucauucaggccuuuaaccgcacccgcgauaaucccgauugaagagaaguuagcgaagg

SEQ ID NO: 4227225 - RNA, 55 nt, Escherichia coli CFT073
gcgcaauucuggggucgauggaacguuucaucgguauccugaccgaagaauuugc

SEQ ID NO: 4227226 - RNA, 83 nt, Escherichia coli CFT073
cggcggguugcuguggucgagcguuugcguaaagggcgucugccagucaauacgccgggccugcucggcccagaacuucuccg

SEQ ID NO: 4227227 - RNA, 125 nt, Escherichia coli CFT073
uaacuuuuuguuuuuuuuaauauugcauccguaaagguccgacaugaaaguguccgaaaaugccuuuuucuggcguuuucaugucgggccuuguauuugauaauggguuguuuucaugaagguua

SEQ ID NO: 4227228 - RNA, 85 nt, Escherichia coli CFT073
ggcgcaacacgcgcgauuccgguaggcggucguuauaccuuccgggauauggggauguuaagcuggaguugcguuguugccagcc

SEQ ID NO: 4227229 - RNA, 67 nt, Escherichia coli CFT073
gcagagcggcggucugaucacccguuaagcggugagcaccgccgggugcaguaauaucgcccugagc

SEQ ID NO: 4227230 - RNA, 73 nt, Escherichia coli CFT073
ggugaggaguuuugugugauucugccaggcgcgaaucugacgcaggcugcggaggucgcagaacguauucgcc

SEQ ID NO: 4227231 - RNA, 63 nt, Escherichia coli CFT073
aggugauuggcagugggauuuugcgugguuauaaagauacgcguuccauuuucuauaucaccu

SEQ ID NO: 4227232 - RNA, 57 nt, Escherichia coli CFT073
gauugauagacaugccgaucaugugacggcuacaugguuuggcaucgcuuaucaguc

SEQ ID NO: 4227233 - RNA, 66 nt, Escherichia coli CFT073
gggcgggcagcauguuaacaggcgguacuuucugguuugucaccggacuguuuauucuguuugccc

SEQ ID NO: 4227234 - RNA, 60 nt, Escherichia coli CFT073
gggucaggugguuucccgugagcauuuaagccaggaagugcugggcaagcgccugacgcc

SEQ ID NO: 4227235 - RNA, 105 nt, Escherichia coli CFT073
ugccggaugcgaugcuggcgcgucuuaucuggccuacgaauugcacaauuuguugauguuguuggguuuuguaggccggauaaggcguuuacgccgcauccggca

SEQ ID NO: 4227236 - RNA, 57 nt, Escherichia coli CFT073
gggucaucguuacgcgugucagcaccgaucaggauguuggcgagcagauggugaauc

SEQ ID NO: 4227237 - RNA, 67 nt, Escherichia coli CFT073
ucgcgcuggcggaaaaaggcauuccuuuauuguuccgugaaguggaugacuuugccgccagcgucga

SEQ ID NO: 4227238 - RNA, 102 nt, Escherichia coli CFT073
uuauuaaaaugguuggauuaggaagggaaacauauguuguaucauuuuuuaguuuuauuucuuugauguuuucuuuguuaauuuuaucaaucguuucaauag

SEQ ID NO: 4227239 - RNA, 77 nt, Escherichia coli CFT073
cgaagcaggauccgucguauccgggagccggacugcucacgcagcgcacgcucaaggauaccgaugauuuuguucug

SEQ ID NO: 4227240 - RNA, 77 nt, Escherichia coli CFT073
gaccaacuacacugccuacaacauggaugcaccgcagaacucugugggugaguucucugucggcagugaagacgguc

SEQ ID NO: 4227241 - RNA, 55 nt, Escherichia coli CFT073
cggcauagcuucaccuuuggcguuuuccauaugcucaaggguaaaguuaauguug

SEQ ID NO: 4227242 - RNA, 58 nt, Escherichia coli CFT073
gcugauggucugucguagagccgcuucauucaggcuggcuaugggacuaucguuaagc

SEQ ID NO: 4227243 - RNA, 59 nt, Escherichia coli CFT073
cgaaggcaagacggguuuuaucuuuggaagaaccuugagauucagcacgguugccuuug

SEQ ID NO: 4227244 - RNA, 63 nt, Escherichia coli CFT073
cgacccacuauucgguagcguugcaguaugacgaaaacaaaaugagcgcaccgaaaguggucg

SEQ ID NO: 4227245 - RNA, 58 nt, Escherichia coli CFT073
gcgucaugcagucacgguugaacauacaguuaacaauggaaccgacuugcgcugacgc

SEQ ID NO: 4227246 - RNA, 130 nt, Escherichia coli CFT073
gcagacgcuuggcggcguggguugccaccuguaucaggaguuugaaggccauugucugacggcgucgcagcuggagcaggccaucacgaccuugcugcaacgccacccaaugcugcauaucgccuuucgc

SEQ ID NO: 4227247 - RNA, 117 nt, Escherichia coli CFT073
gacugcgggaugucggcguugauacuauguaugggguggcauucggcgaaaaaggcauuaauccgcugaccagaaccucguuuauuauuaccgaagaucugacaccaaccaucaguc

SEQ ID NO: 4227248 - RNA, 57 nt, Escherichia coli CFT073
acggugacagaacgcuaagauuauucuuuuauauucuggcuuguuucugcucaccgu

SEQ ID NO: 4227249 - RNA, 58 nt, Escherichia coli CFT073
gugcugauacucuucuucgcaggguuaucaauaccccggagacgaaacagucaggcgc

SEQ ID NO: 4227250 - RNA, 73 nt, Escherichia coli CFT073
gcggcgcuuucccuggcaauauccgcuucauccagcguuuugcgcuugaugcgauugcucauggaaaauccgc

SEQ ID NO: 4227251 - RNA, 80 nt, Escherichia coli CFT073
ggcuuugacggagcgucuuuccggcgagguggcgcagcauacauugcgucugccgccgcaggaagggcgccugagaaguc

SEQ ID NO: 4227252 - RNA, 85 nt, Escherichia coli CFT073
ugaacaaugcgguaauugcgcuccaguucgccaugacgacugguauacaaaacagcgucuggcugauggcggcguagcauuguca

SEQ ID NO: 4227253 - RNA, 60 nt, Escherichia coli CFT073
gaaaucagcgguaucguuuccuucgguaaagaaaccaaagguaaacgucgucugguuauc

SEQ ID NO: 4227254 - RNA, 59 nt, Escherichia coli CFT073
aguggagaugcgguaaauauuggcuuugguauuucugccaacguaccacgcauucuacu

SEQ ID NO: 4227255 - RNA, 91 nt, Escherichia coli CFT073
cuguugcauguucacguuguuuuuaugacaaaauaccgccguccaguuuuuggugaauugcaucaugcaaacaugcgucaguauguagcgg

SEQ ID NO: 4227256 - RNA, 83 nt, Escherichia coli CFT073
cgucgcccggcauaugcucgccuguuggaucgugcgguacgcauucuggcggugcgcgaucacagugagcaagaacugcgacg

SEQ ID NO: 4227257 - RNA, 62 nt, Escherichia coli CFT073
aucgcucugcaacuggaguuaauuucguuaccgcugauguuagucuggugcgcggcggcgau

SEQ ID NO: 4227258 - RNA, 64 nt, Escherichia coli CFT073
ggaucacggagugcuccugcagguugugaccuucaccaccgauguaggaagucacuucgaaacc

SEQ ID NO: 4227259 - RNA, 56 nt, Escherichia coli CFT073
ccgcgauagugucgacauucagcccgguuucggcagagaucggcacgauaucgagg

SEQ ID NO: 4227260 - RNA, 84 nt, Escherichia coli CFT073
gccgggcagccgugggaaaaggccaaagcguuugauaacucuuguccgcuuuccggguuuauucccgcggcggaguuuaccggc

SEQ ID NO: 4227261 - RNA, 62 nt, Escherichia coli CFT073
uggcaaugugccggagcuggcggguuggcucuuuuuacucaccagcgaaccggcaauugcca

SEQ ID NO: 4227262 - RNA, 80 nt, Escherichia coli CFT073
uuguugccaugcuggggccggggcugguuaacggcgcacuggcgcuggcauuaaccaccuggccugcuuaugcgcgucag

SEQ ID NO: 4227263 - RNA, 79 nt, Escherichia coli CFT073
ccgguacgcuucagggugcggaccugcuggugaauuaccacacauucagcaacagcgguacccugcugggaaccuccgg

SEQ ID NO: 4227264 - RNA, 69 nt, Escherichia coli CFT073
gccgugguucgcgacuggacagcggucggcuguuuaaaggcgcgaagaaaccagucgcgggucgccggu

SEQ ID NO: 4227265 - RNA, 79 nt, Escherichia coli CFT073
cugaauuccagaaagucgagucgcuguggcgugguacaugguucgucguacagcgcacugauuuucgcaaaaaugucag

SEQ ID NO: 4227266 - RNA, 58 nt, Escherichia coli CFT073
ucacuuuuucucugauucaucaaaugguuaauucguucaugaucaggagaaaaacuga

SEQ ID NO: 4227267 - RNA, 101 nt, Escherichia coli CFT073
gcaaaugaauuacggcggcugcguggcggccuguggucuggcgggugguuuuacucugccaaccacggucaugccauuuauucugcguaauguccguuugc

SEQ ID NO: 4227268 - RNA, 86 nt, Escherichia coli CFT073
auuuuucgcacuguccaagaccgauauucaaauagagcgggcuaugcuuaaagccgucuucaauaucgcguuuuucugcgaaaggu

SEQ ID NO: 4227269 - RNA, 65 nt, Escherichia coli CFT073
agaacuggaacacaaaacucgucgccgcgauauucugguggaugacgaaacgcuguuugaguucu

SEQ ID NO: 4227270 - RNA, 68 nt, Escherichia coli CFT073
accccauacagaaagcuuauaaugcgaucugcuucacuaaaguggcauuauuucuuuuuguugguggu

SEQ ID NO: 4227271 - RNA, 66 nt, Escherichia coli CFT073
uuccggcauccgcgauaauaauggacggcaccaugccggugccaucacgucgauuaucgccugggg

SEQ ID NO: 4227272 - RNA, 77 nt, Escherichia coli CFT073
gcugaucgguaucgucaaacagcgaaaaguuagccuucauccccagcgccgcauacucgcguuugaugauauccagc

SEQ ID NO: 4227273 - RNA, 97 nt, Escherichia coli CFT073
gauuccucccgaauaaacuuuggcgaugcaaucucgaagcuccuccugagacgguugcuucggcauugcaucccacagcuuaugugguugggugauc

SEQ ID NO: 4227274 - RNA, 92 nt, Escherichia coli CFT073
ggcugacagcuacagcaagaaugucaucacccgcguuaucggcgaacagcagaugaaagagcuggggaugcauuccuaucuggcggucgguc

SEQ ID NO: 4227275 - RNA, 78 nt, Escherichia coli CFT073
cugggauuacgcaaaacgcuccauggagaugucucugcguugggcgaagcguagccgugagcguuuugacagucucgg

SEQ ID NO: 4227276 - RNA, 87 nt, Escherichia coli CFT073
cgauugccgcgucgaaaaaucugccaaaagaggaugcccaugcgcugggcauuuuccugcgcgauuuaacgacgauggauccgcucg

SEQ ID NO: 4227277 - RNA, 87 nt, Escherichia coli CFT073
gggcagaacauuggaucauaguuucuggaacugcaagggugacuauagguucugaaacuaagauucuuagcgaaaaugaaucuguuu

SEQ ID NO: 4227278 - RNA, 65 nt, Escherichia coli CFT073
guuuguauuuguguauugucuugccgguuaacaugaucggagauuaguaauaugcgaauaaccac

SEQ ID NO: 4227279 - RNA, 57 nt, Escherichia coli CFT073
guucgugauggucagguggugaaaggcguacaguuucgcaaccaugaaaucauuggc

SEQ ID NO: 4227280 - RNA, 78 nt, Escherichia coli CFT073
ugcagcgauccagcagauacagaagguucagguugauacaaauaauaaccugaacagcaugugggcugugaagcugca

SEQ ID NO: 4227281 - RNA, 81 nt, Escherichia coli CFT073
ucaucguguagucuggggguaacaauucguaaauuaucaauaucguauacgcugccgccauauucaauugcaacacgauga

SEQ ID NO: 4227282 - RNA, 81 nt, Escherichia coli CFT073
cagcuugagcggcgugagguuuuugacguugauauaaccgaacaggugaucaacguaagcgucacgcagauugauuugcug

SEQ ID NO: 4227283 - RNA, 56 nt, Escherichia coli CFT073
ucagaauauccggugaagugauuaauauuucguugaauauuucuccggauuuuuga

SEQ ID NO: 4227284 - RNA, 66 nt, Escherichia coli CFT073
ggcuuccugcauucguucagccugaaacaggccauagacgcuguuguugaacagaacgcggaagcc

SEQ ID NO: 4227285 - RNA, 77 nt, Escherichia coli CFT073
guugaugauugucagggauaguaaagcgcguuacucuuuccagagcaguuuuucaucccugaauauuugccaucagc

SEQ ID NO: 4227286 - RNA, 64 nt, Escherichia coli CFT073
gccaggcgaaaagugggugaugccagacguuacgaugguaauucacucccuguucgccguuggu

SEQ ID NO: 4227287 - RNA, 83 nt, Escherichia coli CFT073
gggcaucugaccaaagcgugauagcggguuuacucauuauguccucggcaauaaagggggcuugcuaucaaacuauagagccu

SEQ ID NO: 4227288 - RNA, 94 nt, Escherichia coli CFT073
ggguuaccuguaagucaccuccacucccggccggauaaauaucguuuaucucgaacgggccuggagguagcguacucugguaaauuucauaccc

SEQ ID NO: 4227289 - RNA, 69 nt, Escherichia coli CFT073
ggcauagcgacuguucucccgacguuccucgcgaaucgccgccagacguuccgggucgauagucaggcc

SEQ ID NO: 4227290 - RNA, 91 nt, Escherichia coli CFT073
cgguuaaucugcugguucgcggcauguguucgcugauccccaaucuggaaggcauuagcgacaacauucgugccaucaguauuguugaccg

SEQ ID NO: 4227291 - RNA, 64 nt, Escherichia coli CFT073
gcccauaaagugaucuucuaagcccgcacggauaaucuggcggucguuguagagauacuccggc

SEQ ID NO: 4227292 - RNA, 71 nt, Escherichia coli CFT073
cgaagguaccgagaucgauccgcccgugcaugaccgaccacccgccguagcacagcaggacgauuugcccg

SEQ ID NO: 4227293 - RNA, 87 nt, Escherichia coli CFT073
gggaucagcgcauaguuacuggugucugcuucuucuuccagcggacgaguauggaacagaucgccagcaaauuucggcagcugaccc

SEQ ID NO: 4227294 - RNA, 63 nt, Escherichia coli CFT073
acgugccugaaaugcgcgagaaaggugccgaugucguugucguucuggcgcauuccgggcugu

SEQ ID NO: 4227295 - RNA, 79 nt, Escherichia coli CFT073
guugacagcguaaucaccacguuucaggacaaacguuuugguaaacguguugccugccgcgucgguauacgucaucggc

SEQ ID NO: 4227296 - RNA, 57 nt, Escherichia coli CFT073
ggcguuggguaauaucgccgcuuuuaacgugaguuuacgcgguauuacgccagugcc

SEQ ID NO: 4227297 - RNA, 130 nt, Escherichia coli CFT073
uccaggaacucaauuuugaauacugcccuauagauguugaacugacggagagcugccugauugagaaugaugaacuggcacugucuguuauucaacaauuuagccgauuaggugcgcaaguucaucugga

SEQ ID NO: 4227298 - RNA, 80 nt, Escherichia coli CFT073
gaguuuaucaacgcaauuugugcagucggugcagcgacaagcauugcaucgguaaacagguugccaaguugcgaugacuc

SEQ ID NO: 4227299 - RNA, 55 nt, Escherichia coli CFT073
uggguaucgucgaagauaaagugaucaaaaaccacuuugcuucugaauauaucua

SEQ ID NO: 4227300 - RNA, 62 nt, Escherichia coli CFT073
guuuccauauugucuuccagaucagcggcaaacgacgccgaacugaauaccaaugaggagac

SEQ ID NO: 4227301 - RNA, 69 nt, Escherichia coli CFT073
gugagcugacccugugggaaucucgcaucauuauggaauaucuggaugagcguuucccgcauccgccac

SEQ ID NO: 4227302 - RNA, 90 nt, Escherichia coli CFT073
gccugugcguuggcuguaagcccccagauggguaaggaagaauuuugcucacggaguuugcgagucaacucaaaaccauccauauucggc

SEQ ID NO: 4227303 - RNA, 70 nt, Escherichia coli CFT073
ugcauuucagucugaauucagccuugccgcuuuauggcgcaacgaaaaucaugcugggguaaaagaugca

SEQ ID NO: 4227304 - RNA, 78 nt, Escherichia coli CFT073
uguggcuaaaagcaggcacauaacagcuaaguauuuucaaccagagagaauccuuagcguuguggugaaugcggcuca

SEQ ID NO: 4227305 - RNA, 67 nt, Escherichia coli CFT073
gcuacauauucagcucugauauacucgcaggucuuuucagaccugcgguccaggaguagaaaguggc

SEQ ID NO: 4227306 - RNA, 72 nt, Escherichia coli CFT073
ugcugcagcgguaacgucugacuauacccagaaagccuguuuguaaaguccagccuuccguauguuuuagca

SEQ ID NO: 4227307 - RNA, 62 nt, Escherichia coli CFT073
gggcuaaccaauaugcuuuauuaacccgggauaauuacccuguugcauauuguaguugggcu

SEQ ID NO: 4227308 - RNA, 108 nt, Escherichia coli CFT073
gcaggcacugacaaacgauuuugcugccacgucaucgagcgucaaguuucugagaauauuuuucucaauauggaauuucgcucguucgauaaaaucgauauugccugu

SEQ ID NO: 4227309 - RNA, 78 nt, Escherichia coli CFT073
gaugcgccgcugacgcgacuuaucaggccuacgaggugaacugaacuguaggucggauaagacgcauagcgucgcauc

SEQ ID NO: 4227310 - RNA, 59 nt, Escherichia coli CFT073
gcgagagaugauuugugaacauuuacgcucggugaagucgcgaccaaaaucuuucucgu

SEQ ID NO: 4227311 - RNA, 95 nt, Escherichia coli CFT073
gccuucccguucuguuaucggcugaauuugauugcgugugagauauuuaugccagcccgccagacgcagacgcgccgagacagaacuuaaugggc

SEQ ID NO: 4227312 - RNA, 68 nt, Escherichia coli CFT073
cguaugauugaguuugaguggcuggaagacacgaguuuucaucgccugcucaaaacucaaaccagacg

SEQ ID NO: 4227313 - RNA, 68 nt, Escherichia coli CFT073
cuacccggaagacgaacuugccagcgaaccgugguacagcgucucgccgggcgauguuuucccggaag

SEQ ID NO: 4227314 - RNA, 77 nt, Escherichia coli CFT073
gcuaucucaauuugggccaggaaagcauaacuuagacuuucaagguuaauuauuuuccugguuuauauuugugaagc

SEQ ID NO: 4227315 - RNA, 61 nt, Escherichia coli CFT073
ucgugguguaacucaggcagcgaaacagggcuucaaauuguugccaguuacugacccacgg

SEQ ID NO: 4227316 - RNA, 85 nt, Escherichia coli CFT073
acggcgcguuaaucacggcguugcuggaagaaaaaccauugccagaggcgauucguuuugcccaugcagccgcugcgauugccgu

SEQ ID NO: 4227317 - RNA, 64 nt, Escherichia coli CFT073
cgaucguggcggaaaauugcugccacacgaguaucgauauguggcauauguucgcgcauggucg

SEQ ID NO: 4227318 - RNA, 56 nt, Escherichia coli CFT073
cgaccaguugcaggagaucguuaucaagaauggugauggugcgcuguagcugauug

SEQ ID NO: 4227319 - RNA, 59 nt, Escherichia coli CFT073
caacugagaggcucuuugcuaaguguacggaaaugcuuaaaucgagagccuccuaauug

SEQ ID NO: 4227320 - RNA, 71 nt, Escherichia coli CFT073
ucugugguguucuguugcguguugacggcaaaauuuugcuggcguaacaugcgcgcacgaucacucuaaga

SEQ ID NO: 4227321 - RNA, 123 nt, Escherichia coli CFT073
gcuguuaagucaguacgccgguucuaccugcgaacuggauagccaggcaggguuguauaacccagguaugcaauggcuggcauccggcgugcuggaaugggugagaaaacuguucuggacggc

SEQ ID NO: 4227322 - RNA, 61 nt, Escherichia coli CFT073
agagaaaggaaacgacagaggccaaaaagcccguuuucagcaccugucguuuccuuucuuu

SEQ ID NO: 4227323 - RNA, 111 nt, Escherichia coli CFT073
ggacuucgacagcacccaggcgcacuccgcguuguacgacaccgaacgcacugcugugcuguuuugugaaaucgucaaccgcuggaaacgucugggaggcuggccgcuacc

SEQ ID NO: 4227324 - RNA, 70 nt, Escherichia coli CFT073
aguacacguauuaacagauuaugucagaaggccccggugaugccuucugacgauagauuaaugugguauu

SEQ ID NO: 4227325 - RNA, 103 nt, Escherichia coli CFT073
gcgaaggccgcugcgaauaauguuuucaauuucauauucauguuaagcgagauuuugugccuggcaggccauuggguugagaauauuagaguauuggaagcgc

SEQ ID NO: 4227326 - RNA, 72 nt, Escherichia coli CFT073
uggccuuccguuugucgcagcauaucuucgauuaacuuuuucucgaaagcaucaaugcaggcgguaaggcca

SEQ ID NO: 4227327 - RNA, 89 nt, Escherichia coli CFT073
caguccaggucccgucgccauuauccguccagccugaugccguagaaccagcagcagcugcgcccgauaaugacggugcauccggauug

SEQ ID NO: 4227328 - RNA, 75 nt, Escherichia coli CFT073
caguuucuccaccaaugucagacgcagacuaagcggcgcauuuaacaugccgccguucguccaugucugaagcug

SEQ ID NO: 4227329 - RNA, 84 nt, Escherichia coli CFT073
augggcugacacuuaccagaaagaaaccgguaauaaaguuaacuaccaggguaucgguucuucuggugguguaaaacagaucau

SEQ ID NO: 4227330 - RNA, 85 nt, Escherichia coli CFT073
gaaauuaugccaaagcgguuguacacgugccgguguugaugcucccauugauaucggucguuuacagcguuuuguuacugauuuu

SEQ ID NO: 4227331 - RNA, 83 nt, Escherichia coli CFT073
cagcgagcgacgagaacagaucauucaacgccugcgccagcaaggaagugugcaaguuaaugaucuaucggcguuguauggug

SEQ ID NO: 4227332 - RNA, 98 nt, Escherichia coli CFT073
gaaugcuccucaauugauacuggcggcgauuauagccauauguuggcgcgguaucgacgaauuugcuauauuugcgccccugacaacaggagcgauuc

SEQ ID NO: 4227333 - RNA, 103 nt, Escherichia coli CFT073
ccggauaucgccgcggcgaucgauguuauccacacccagguaagcggcggcggccgucugauuuaucucggugcgggaacauccggucgucuggggauucugg

SEQ ID NO: 4227334 - RNA, 58 nt, Escherichia coli CFT073
gcugagcgccagauuuuuguccuucggauucggcgcagacggcaguuugacguucggc

SEQ ID NO: 4227335 - RNA, 61 nt, Escherichia coli CFT073
gcguuuugaggaucgccaccaagucguagcgacugcgacaguaaugauucaucgccaccgc

SEQ ID NO: 4227336 - RNA, 106 nt, Escherichia coli CFT073
gauuuuucgcguauuaccagaccacuucaccuuguagcguuuggcgaugucuuucagacgcgcacgcucagcaggugaccauuggcccugauacuguuuugaaauc

SEQ ID NO: 4227337 - RNA, 57 nt, Escherichia coli CFT073
cgguuuaaaggcgcuaugagcgagcuuugugaauucacugauggcgcuuauaaaccg

SEQ ID NO: 4227338 - RNA, 57 nt, Escherichia coli CFT073
acaagcgggugucccaggucaggcugcuauccaguuucucgucaacauacugcuugu

SEQ ID NO: 4227339 - RNA, 72 nt, Escherichia coli CFT073
cacacuggcaauugccagccacgguauaaaccagccacagauuugauacagccguggugggaucgccaguug

SEQ ID NO: 4227340 - RNA, 89 nt, Escherichia coli CFT073
aacagcagggcgauuuuguuggucgaugcugguuuaaacgcuuuuacguuaaccaacugcguuggcagcauuuucgcgcccggguuguu

SEQ ID NO: 4227341 - RNA, 56 nt, Escherichia coli CFT073
guggcggcgcuggcgacauuaaucgcgcugguguuagggacgcuggccgcugccgc

SEQ ID NO: 4227342 - RNA, 62 nt, Escherichia coli CFT073
aagguuuucccugagcaaauuugccagacagaguaauccagcaaaucguucggggaaaccuu

SEQ ID NO: 4227343 - RNA, 70 nt, Escherichia coli CFT073
acgggaugcuggagcuuggcaccagcgaacggggcgggcuuuccauucgcgccuggcugccagugccggu

SEQ ID NO: 4227344 - RNA, 73 nt, Escherichia coli CFT073
guaguugguggugguguauuuggcguucgggaucaagaaaccagagcgacguuugucacccaccggcaacugc

SEQ ID NO: 4227345 - RNA, 71 nt, Escherichia coli CFT073
ucacgauaaacagcccugcguuauaugaguuaucggcaugauuauccguuucugcaggguuuuuaaucgga

SEQ ID NO: 4227346 - RNA, 102 nt, Escherichia coli CFT073
gaacgucuucaucugaaaccgcugccgcuucgucgcagugcugacuaugaugagcugacugugaggguuagccgcagcaguaccaucaaugugaagcacguc

SEQ ID NO: 4227347 - RNA, 59 nt, Escherichia coli CFT073
ggcgauguugcuaaaagccauugaagagaaaaccuuuuacccguuuggcagcgaucgcc

SEQ ID NO: 4227348 - RNA, 80 nt, Escherichia coli CFT073
aauaaacaaguaacauggccgccugcaucacaaagcuacuaacccacagugacacauuggccgccuguuuacuguucguu

SEQ ID NO: 4227349 - RNA, 60 nt, Escherichia coli CFT073
uggcgaaucagcgauuuuugcugacuuaaugaacgugcaguaucaauagugauaucgcca

SEQ ID NO: 4227350 - RNA, 59 nt, Escherichia coli CFT073
cgaaucugcuccgccagauuuuuaccgguggcaauccccaguuuggccgagaggauuug

SEQ ID NO: 4227351 - RNA, 61 nt, Escherichia coli CFT073
acggcugccaccggagcgugaaauugcagaaaugcuugaugucacgcggacggugguacgu

SEQ ID NO: 4227352 - RNA, 104 nt, Escherichia coli CFT073
gguuucugauugcguccaugacauuuugcuguuuucgccuucgcacaaagcacgcuuggugacgaaguugagaauaccgccgguguuguuaucgccagggaacc

SEQ ID NO: 4227353 - RNA, 56 nt, Escherichia coli CFT073
uuacuguacgauuucagucaaaucuaauuacauagauugagugaagguacgaguaa

SEQ ID NO: 4227354 - RNA, 57 nt, Escherichia coli CFT073
uuucaacauagucuucuccuuugcaauggcagcaggauacgaaggcuaugugggaag

SEQ ID NO: 4227355 - RNA, 75 nt, Escherichia coli CFT073
gcauauugcuuuugguuauuaucugcacaguaaacggugguauacugugcaggucuugucuaaaagcgaggaugc

SEQ ID NO: 4227356 - RNA, 87 nt, Escherichia coli CFT073
ggucgcuacuggaaccugccguacuucuacauuccgggucacuucaacgugaacucgguacuguucgagacggcggucuguaugacc

SEQ ID NO: 4227357 - RNA, 98 nt, Escherichia coli CFT073
gcaguuacggucaaucagaauggugcugccugccggagcagaguacauaccaacaauuuuguucgcaguggaaguaccguuggucaccauguagcugc

SEQ ID NO: 4227358 - RNA, 68 nt, Escherichia coli CFT073
gccuccugauuaucuggugugcccguaaaugucagcuucacugcacugacagcacugccgcaggaggu

SEQ ID NO: 4227359 - RNA, 60 nt, Escherichia coli CFT073
ucuuacgcagcaguuccaggugcgggcugcucuucgcugccgcguaacugucugcgguga

SEQ ID NO: 4227360 - RNA, 96 nt, Escherichia coli CFT073
acaucaacagcguaucgaagaaaauuuugcuauuugggauuucucacugacagagaaagaaauggcgcaaauuaguucgcuugauuuggguuaugu

SEQ ID NO: 4227361 - RNA, 65 nt, Escherichia coli CFT073
auuuuauggcggaacggcguugcugccaguaauuccacaccaauguugucggucgccauauaagu

SEQ ID NO: 4227362 - RNA, 82 nt, Escherichia coli CFT073
ugcauagugaucagccucucucugagggugaaauaaucccguucagcggugucugccagucggggggaggcugcauuaucca

SEQ ID NO: 4227363 - RNA, 56 nt, Escherichia coli CFT073
ucaggaugccgaaguggaugaugcgaaauacggcuucgucgccuccggcauguuga

SEQ ID NO: 4227364 - RNA, 65 nt, Escherichia coli CFT073
uguugggcagggcgaucagauauucaugaacgaaguguuccugaaauaucugacggcucccacca

SEQ ID NO: 4227365 - RNA, 75 nt, Escherichia coli CFT073
uuuuccuccugcccuccuuuauucugaucuccgcggcuuuaaucgccgguuguaacgauaagggagaagagaaag

SEQ ID NO: 4227366 - RNA, 77 nt, Escherichia coli CFT073
gaaaacgccagaauguacuggcuguacgcaauaauugcaacugcgauuguugugcuucagugcuuuucuugcuuuuc

SEQ ID NO: 4227367 - RNA, 58 nt, Escherichia coli CFT073
ccguuuauuguauucaucaccgcguggaaagaacaugcgguggaagcauuugaacugg

SEQ ID NO: 4227368 - RNA, 120 nt, Escherichia coli CFT073
cgggauuauugccguuacugacgcccgggcgcggcauauucugcaaguaugugaacaucuacacauucccguaccggaaaaauuaugcgugauuggcaucgauaacgaagaacugacccg

SEQ ID NO: 4227369 - RNA, 75 nt, Escherichia coli CFT073
cugaagaaaaugcgucagcauuaugcucaacgucggcaauggauugagcaagcguugacgcagcaaggauuucag

SEQ ID NO: 4227370 - RNA, 55 nt, Escherichia coli CFT073
cguuggcagucaggccaggaugcugcgacgcaguaugcuggcgcuguugcuggcg

SEQ ID NO: 4227371 - RNA, 72 nt, Escherichia coli CFT073
ggcaucuuuaccgacggugauuuacgccgugucuucgauaugggcguggauguucgucgguuaaguauugcc

SEQ ID NO: 4227372 - RNA, 86 nt, Escherichia coli CFT073
cgguuaaaccuucuuucagacugagcuggaaccagucgcggcaggugacacgguugccgguccaguuauggaaauauucauggccg

SEQ ID NO: 4227373 - RNA, 69 nt, Escherichia coli CFT073
gcccagcagacaaacagcgucgaggugacgugaucuuucgaccacuccagcaccuguuugaucugcggc

SEQ ID NO: 4227374 - RNA, 56 nt, Escherichia coli CFT073
cagcuucgauggcgcuauugagaauuuccacaaucaucaccagcaucacggagcug

SEQ ID NO: 4227375 - RNA, 88 nt, Escherichia coli CFT073
gcagaguugcgcgugcaggcgcaguaagggguagcaacaaugagucagaauguuuaucaauuuaucgaccugcagcgcguugauccgc

SEQ ID NO: 4227376 - RNA, 66 nt, Escherichia coli CFT073
ggaguacaucgugcgcggcagucguuucuaucaaaccuugaugcugcugccguaugccguggcucc

SEQ ID NO: 4227377 - RNA, 84 nt, Escherichia coli CFT073
guugucuggguguuauuuuaaggccgcagguaccccauaaccuuacaagaccugugguuuuacuaaaggacacccuaugaaaac

SEQ ID NO: 4227378 - RNA, 72 nt, Escherichia coli CFT073
ucacgaccgccaguuugucucagguacggcugauggaaugacugucagcaccggacuggagcugggggcgga

SEQ ID NO: 4227379 - RNA, 87 nt, Escherichia coli CFT073
gccaacauaguuguuuuccuguaugaaaaaccauuacuguuauuguguacaguauaaacugguuuuauauacaguaaagaggcuggc

SEQ ID NO: 4227380 - RNA, 56 nt, Escherichia coli CFT073
uuaaucgugauuuuuugugcgcgcgauauuucccgcccgcgauuuguucugauugg

SEQ ID NO: 4227381 - RNA, 76 nt, Escherichia coli CFT073
gaaaaugagcgccgccuguuuuucuucagcgccaaaacgccauuagcccuuagacaacaguuggaugcucauuauc

SEQ ID NO: 4227382 - RNA, 76 nt, Escherichia coli CFT073
gugccguuguugcgugacgacgaaagugaucucauucuuugggaaucaaacgccauuguccgcuaucuggcggcac

SEQ ID NO: 4227383 - RNA, 63 nt, Escherichia coli CFT073
accuuuucgucugauuuuguuggaauagcgcuaucgacagcgugcgcaauccgacuaaaaggu

SEQ ID NO: 4227384 - RNA, 59 nt, Escherichia coli CFT073
uacgguaagcccauguuacccaaaauauuguucagauuuggguuaauggagcuuuugua

SEQ ID NO: 4227385 - RNA, 63 nt, Escherichia coli CFT073
ucguaaauacagccuggcggaacugauccacaccuggucagauuuggcgggcuuaucuuacga

SEQ ID NO: 4227386 - RNA, 88 nt, Escherichia coli CFT073
gcgcauaucaggagauccucggcaacaugcacaaccuguucggugauaccgaagcgguugacguguucgucuucccugaugguagcgu

SEQ ID NO: 4227387 - RNA, 78 nt, Escherichia coli CFT073
ggcgcauugguacagaacggucaggcgacugcgcuggcaaccgugcagcaacuugauccgaucuacguugaugugacc

SEQ ID NO: 4227388 - RNA, 61 nt, Escherichia coli CFT073
aguuucuugagugguaagggaaacuucccucaugaagugaccacuugcagcuuaaauaauu

SEQ ID NO: 4227389 - RNA, 56 nt, Escherichia coli CFT073
uaggccacgcacaaugcgccaugaauaaagaauucaauggucgcguccguggccug

SEQ ID NO: 4227390 - RNA, 62 nt, Escherichia coli CFT073
gcaggcggcuaacauaaaaagccacggauauauccguggcuuucgaauauuuuacugugugu

SEQ ID NO: 4227391 - RNA, 65 nt, Escherichia coli CFT073
gcggccagccggagcuggcaagaugaauaucaucggccaguuugauuugcuccgguuugagcugu

SEQ ID NO: 4227392 - RNA, 62 nt, Escherichia coli CFT073
acggccccagaagggguaaugccagucaguuaagcaacugacuggcucuuuuucggggcugu

SEQ ID NO: 4227393 - RNA, 63 nt, Escherichia coli CFT073
ggugauguugauaaggcguuaaaacugcuugaugaagcugaacgccuggggucgacaucugcc

SEQ ID NO: 4227394 - RNA, 56 nt, Escherichia coli CFT073
acgaguaagugugaaguugccggauguguugcauccggcauggcgaauuuauuugu

SEQ ID NO: 4227395 - RNA, 85 nt, Escherichia coli CFT073
cggauuaucuguuccgugaugguucgaugauuggucugaauaaagacauccucugccaguacguugaauacaucaccaauauccg

SEQ ID NO: 4227396 - RNA, 59 nt, Escherichia coli CFT073
cauaugaaucuucauguaauuggaaugaugcugucauugcauaucaugaagguauuaug

SEQ ID NO: 4227397 - RNA, 92 nt, Escherichia coli CFT073
gccuuauccgagauggcaacgcugcccuacacaaugccugauaagcgaagcgcaucaggcauuguguaggcagcagaaaugucggauaaggc

SEQ ID NO: 4227398 - RNA, 83 nt, Escherichia coli CFT073
uaaugaguugcguaaaauuucccagcuggaaauggugcuggcgauugucgguaccaugaaagcagggaaaucaaccaccauua

SEQ ID NO: 4227399 - RNA, 81 nt, Escherichia coli CFT073
gcaagccgccauugccuggcugcaggaacaccauguaaaaguagagguacuggguuaugucugagccgaugauguggcugc

SEQ ID NO: 4227400 - RNA, 110 nt, Escherichia coli CFT073
ccagcuucucggggucuugccagaucugguuaaacagacugagguaggucgccguaaacgucgacucguccauuuuguugacgagguuugagacagcauugcccugcugg

SEQ ID NO: 4227401 - RNA, 55 nt, Escherichia coli CFT073
ggauuuucgcugugguugcuggcugacugagaaaccggaaaccgcaaugaaagcc

SEQ ID NO: 4227402 - RNA, 63 nt, Escherichia coli CFT073
caguguaaaagguauguaacagaccauugacugacugaauggucugucauacuuuguuaccug

SEQ ID NO: 4227403 - RNA, 100 nt, Escherichia coli CFT073
ucacccacaguuguuuucaguuccuuauaauauucaaugaauugccuuuguuucucuucacugaauuuaugggggacgccugacgguuuuuuguagguga

SEQ ID NO: 4227404 - RNA, 70 nt, Escherichia coli CFT073
ugcccuugcucauauagauaauuuacugcaucaaaugcggcggucagauugucuauaugaacuguaggua

SEQ ID NO: 4227405 - RNA, 76 nt, Escherichia coli CFT073
gcaugacucgauacucgucauauuucgccuuacugcaaaugcgcgaugaaguaugacgaguaugaaagagugaugc

SEQ ID NO: 4227406 - RNA, 55 nt, Escherichia coli CFT073
gauuuuuuugcuggcuaucauggaaaccauuuacguggucaccggcaaaacaauc

SEQ ID NO: 4227407 - RNA, 69 nt, Escherichia coli CFT073
cucagcgagugugcguugaaugccgaccugaucgaugcccagguugaacaacugaugacgcuggcggag

SEQ ID NO: 4227408 - RNA, 110 nt, Escherichia coli CFT073
gaauggaugagggguuaguccggguuguuguuguggcagaaaaucccucccgcugguucagaagaugcccgguucuuacaacaauaucgcccugaugcgucucaauauuc

SEQ ID NO: 4227409 - RNA, 55 nt, Escherichia coli CFT073
auuguucacgcuugauccacacaacgggaaccccggugcgagucgccugaacagu

SEQ ID NO: 4227410 - RNA, 77 nt, Escherichia coli CFT073
aaggagcaguugccgguacucaaacggggucaucuguggauuaugagccugcuguaucuggcaaccuucggcuccuu

SEQ ID NO: 4227411 - RNA, 82 nt, Escherichia coli CFT073
cuuuguuauuuuguuaagcuuugcacuccauuuaucaauaguauuuugaacgauggugucagguuuaaauugaucugcaaag

SEQ ID NO: 4227412 - RNA, 69 nt, Escherichia coli CFT073
uuucccaccacuauuguugaauuccgaauuucauccuguaugacaaaagaauggcuguaggguggggaa

SEQ ID NO: 4227413 - RNA, 77 nt, Escherichia coli CFT073
ugcaaauuauuaauggguugcguuguugaaucauuauuuguuauggguuucgauauuguauuuuauuaagauuagca

SEQ ID NO: 4227414 - RNA, 63 nt, Escherichia coli CFT073
gaaacgcuggugcuaaagccggggcagggcauuugccugccgccgcgucuguaucaucgcuuc

SEQ ID NO: 4227415 - RNA, 58 nt, Escherichia coli CFT073
ugccauuaaccguuucagccucaggugccuuucuugaggcaaucgccuguugguggua

SEQ ID NO: 4227416 - RNA, 75 nt, Escherichia coli CFT073
ucaaugauacaugcuugguaugucggaaagaaaacagaugcuuguuuuacgauauauccacagccauaacauuga

SEQ ID NO: 4227417 - RNA, 56 nt, Escherichia coli CFT073
uaugcauaaaaagcagcggcugacgucuuccgacguuggccguuuuuuuaugugua

SEQ ID NO: 4227418 - RNA, 100 nt, Escherichia coli CFT073
ucuuucuuaucgacacgucugguucaaugauuucugaugaacguuugccacuuauccagucuucguugaaauuauuggucaaagaacuucgugagcagga

SEQ ID NO: 4227419 - RNA, 62 nt, Escherichia coli CFT073
aucuuggugaaaauaaagaugccugguuggauuacgacccggugagucuuauuucacaaggu

SEQ ID NO: 4227420 - RNA, 78 nt, Escherichia coli CFT073
gugguuccuucguuucgcuucugauguccaaauggauggcauuacgaucuguuggcggggaagugaucgagcaaccgc

SEQ ID NO: 4227421 - RNA, 55 nt, Escherichia coli CFT073
ugauuuuccgaaucaggcugcuugaugaugucagguagcccuggauggagaguua

SEQ ID NO: 4227422 - RNA, 77 nt, Escherichia coli CFT073
cccaugcauugaagcuagccugugcgccacggaaaauguccucuaccgucuugccaguacgcagcuucuugcugagg

SEQ ID NO: 4227423 - RNA, 59 nt, Escherichia coli CFT073
ucuggcuacucaggcgauacaguguggcgaggcugauauugucaucgccgguggccagg

SEQ ID NO: 4227424 - RNA, 76 nt, Escherichia coli CFT073
ggacauuggccugaauaucgccacuggcgguaagcugaauauugccgucgccagucaacgguaauucaggccaucc

SEQ ID NO: 4227425 - RNA, 62 nt, Escherichia coli CFT073
gacggcgaauuugcuggugcaggcuauuaguguguugcuuacucucgccagcgacucgccuc

SEQ ID NO: 4227426 - RNA, 72 nt, Escherichia coli CFT073
ggaggcgaaagccgggcgcagcuugccucgcugaaacuguuacaggucggcggcgcccgucuuucugccacc

SEQ ID NO: 4227427 - RNA, 71 nt, Escherichia coli CFT073
ggcgagucuggcguuaaucguauuggggauuauuggucugaaacucagcacucauuaacuaccgggcugcu

SEQ ID NO: 4227428 - RNA, 66 nt, Escherichia coli CFT073
gaggcggagaaugaugccacagugaacagcaggggaaaaagagcucugguauucaugacugaccuc

SEQ ID NO: 4227429 - RNA, 70 nt, Escherichia coli CFT073
gaucaaacacgaugauauucaccacgccgcuggcguucagcgcguaggcuucgauaucgucggucggguc

SEQ ID NO: 4227430 - RNA, 58 nt, Escherichia coli CFT073
gcgcuggaugauggcgagcuggaguuucuugaaggucgcugguuaaguauucaugugc

SEQ ID NO: 4227431 - RNA, 66 nt, Escherichia coli CFT073
gggcaauuagcaugugcauggcggccuguugugcggcacaacgggccauuuguacgguuaaugccc

SEQ ID NO: 4227432 - RNA, 73 nt, Escherichia coli CFT073
guuuugccauuggguauucacauugcggcgcaagaaacgcugccgcaacuggcaacccgacuggcagcucaac

SEQ ID NO: 4227433 - RNA, 77 nt, Escherichia coli CFT073
gccucgcagauggcgcgccgcuguucuggcggcacuuccgacugcucagcagcgagagcgcgcaucacaugcgcggc

SEQ ID NO: 4227434 - RNA, 100 nt, Escherichia coli CFT073
gcgcuggugaugauggucuuuuuugccguugcaagggaagggcuggagucggucuuuuuccugcuggcggcauuucaacaagaugucgggaucuggccgc

SEQ ID NO: 4227435 - RNA, 89 nt, Escherichia coli CFT073
gccgaacacguagggcaccuggucguaacggcuaauaucgucaaaaaagaucugcugcgcgauccaggucugcaccguucgauguuugc

SEQ ID NO: 4227436 - RNA, 125 nt, Escherichia coli CFT073
uugauaugcguauuuuucucuuacuucugaugcuaugcgguuuucagguauucgcugaacgauugccuucagugacugacuuaaccgggacauuaacgacagaagaacaaagugcuuuaaaucaa

SEQ ID NO: 4227437 - RNA, 101 nt, Escherichia coli CFT073
cgccagugcaccggauuucaccagcgccagcgcuucuggcagcgcaucgacgccaaacaccggaaugcuggacuuguugugugcuuucagugcuucuaccg

SEQ ID NO: 4227438 - RNA, 82 nt, Escherichia coli CFT073
cggaugcaucgggaaacuuacuuuacugcagauuuuuugauaccgccacuaaagucguaucaaguaagagauggugcauccg

SEQ ID NO: 4227439 - RNA, 85 nt, Escherichia coli CFT073
ugguuuuucacagccuccguuagcgcggcggauugagcacaucgcucaucugcgcaucgcuuaacgucaggccaaagaacugccg

SEQ ID NO: 4227440 - RNA, 59 nt, Escherichia coli CFT073
uucggggaggcacuggcggaagggcugaauauggucaugcauccgcuggacucccugaa

SEQ ID NO: 4227441 - RNA, 66 nt, Escherichia coli CFT073
gcaagauacagugauggggauuguuuuuucuggcauguuugccgcaggucugaucuuguauauugc

SEQ ID NO: 4227442 - RNA, 110 nt, Escherichia coli CFT073
auacaaccugggggccgauuucucucugccugccgaggccaaagauaaaaaaaucauccuggugccgggucagguagaagacgaugccucaauuaaaacaggcacugugu

SEQ ID NO: 4227443 - RNA, 101 nt, Escherichia coli CFT073
uucgguuucaacaguaaaauggcgcaauuuagcggguuggcgacggggcugcgguggcugccagcuacuuugugucaguacuugcuccagaccaaaccgaa

SEQ ID NO: 4227444 - RNA, 59 nt, Escherichia coli CFT073
accgacucuuuuucgauaaucaguuagcaacguuacuggaagaucaagagaaaguuggu

SEQ ID NO: 4227445 - RNA, 56 nt, Escherichia coli CFT073
gccgugauggugaucuucgucacuuuuuuccgcguggucgugaucaucaucaucgc

SEQ ID NO: 4227446 - RNA, 86 nt, Escherichia coli CFT073
gacuuauacccaggcccguaauaucacccgguucgggaccaucgaaucggucacuuaugauauugccgaggggucgguugucaguc

SEQ ID NO: 4227447 - RNA, 69 nt, Escherichia coli CFT073
cguuauuauugcagggcagcgccucgccggaugcgcggauuuuacuggcgcugccggucgauauugaug

SEQ ID NO: 4227448 - RNA, 59 nt, Escherichia coli CFT073
gcuuucccuuugacguauugcagcauaauaaauugcggcaaugucaguaaggggauggc

SEQ ID NO: 4227449 - RNA, 71 nt, Escherichia coli CFT073
agagacucggugucguugcuugccgcaucgcucacuuucugcugcagcgcguaguacgcaucgagggcuuu

SEQ ID NO: 4227450 - RNA, 130 nt, Escherichia coli CFT073
caaacgcaaaacugccugaugcgcuacgcuuaucaggccuacgaucuucuugcaauauauugaauuugcacgauuuuguaggccggauaaggcguucacgccgcauccggcauaaacaaagcgcacguug

SEQ ID NO: 4227451 - RNA, 75 nt, Escherichia coli CFT073
uugaauuuuugcgcuuuuguaggucggauaaggcguuuacgccacauccagcaugaacaaagcgcgcauugucaa

SEQ ID NO: 4227452 - RNA, 68 nt, Escherichia coli CFT073
gugaccuauauugccacgcaaaucgguuuugccaguucguggaugaacccguuuugugugguuguugc

SEQ ID NO: 4227453 - RNA, 60 nt, Escherichia coli CFT073
gcugcugugcagucgcggucauaaguguaugccugcuuguuacggugguacucacggcgc

SEQ ID NO: 4227454 - RNA, 68 nt, Escherichia coli CFT073
uccgccgccgggaugagaaaccgaugcucacccgcuccgcauggcaggagguucucguucaggccggg

SEQ ID NO: 4227455 - RNA, 63 nt, Escherichia coli CFT073
agguaaagcgcgcgaaauggcggcagcacagaaaguggcugacuggcagauugcggcaauccu

SEQ ID NO: 4227456 - RNA, 128 nt, Escherichia coli CFT073
ugcgguugauugccggaugcggcgugaacgccuuauccggccuacaaucauugcaaauucaauaaauugcagcguucuguaggcuggauaagaugcgucagcaucgcauccggcaaaggcagaucuca

SEQ ID NO: 4227457 - RNA, 62 nt, Escherichia coli CFT073
aggcugggcgcuaauaggagaugcaaugaaccacgcaauguuuccuggcauaguucuagccu

SEQ ID NO: 4227458 - RNA, 74 nt, Escherichia coli CFT073
gcuucugagcugggccguuguuaucgccgugcuggucgucucguggcagggcgcggaaauggccccgcuuacgc

SEQ ID NO: 4227459 - RNA, 65 nt, Escherichia coli CFT073
ccaauaugcaaaacugcggcgcauuacgaauugaucacgugaugucgaugcugcguuuguggugg

SEQ ID NO: 4227460 - RNA, 56 nt, Escherichia coli CFT073
uaccgaauugauggagugggcugacgggcaacuuucuaucacucuuaaucucggua

SEQ ID NO: 4227461 - RNA, 90 nt, Escherichia coli CFT073
gugcuugccgaagagaugucauuacugaugcuggacagccgccgggugauccaaagcauucaguugaugaaaucgcugggcggcggguau

SEQ ID NO: 4227462 - RNA, 84 nt, Escherichia coli CFT073
gucccgccagugcccgggcgugaguuaaugcugacguuaaauagucagcaagaguaucgcgccugugaaacgcaacugcgggau

SEQ ID NO: 4227463 - RNA, 128 nt, Escherichia coli CFT073
ggauauccucauugcguggcugcaggacaauaucgacugcgaaucgggaauuaucuuugacaacgaugaggauaaaacggauucggcagcacuguugcccuguaucgaacaggcccgggaggaugucc

SEQ ID NO: 4227464 - RNA, 86 nt, Escherichia coli CFT073
cauccaguuuauucaccgucaggguacggaaaguacggucuccuucagaacugauacggcuguuucugacgguaagaguguggaug

SEQ ID NO: 4227465 - RNA, 100 nt, Escherichia coli CFT073
aauuuuaugcgggagcgaguuuuuuaucaguaauaccgugaauauaaaaagaauguuuaccguuuuauagaugacagauuaugcgucuuucgcuaaaguu

SEQ ID NO: 4227466 - RNA, 75 nt, Escherichia coli CFT073
uagggaucgcgugcgccggguuuaucaagauuaagcaucgcagcacggucgggguaagccugcgcaaauucuuua

SEQ ID NO: 4227467 - RNA, 101 nt, Escherichia coli CFT073
cucgguuaugaauuaccgcgaugcuacaauguggcgcgaagaauguuaacccucuggagcguuuugugucgucguugcccguugcugccgucuuaccugag

SEQ ID NO: 4227468 - RNA, 62 nt, Escherichia coli CFT073
ggcuuaacgauaaccggcaaacccagagaagaaauuucugcuaacugcuuaucguuaaggcc

SEQ ID NO: 4227469 - RNA, 67 nt, Escherichia coli CFT073
uucugccuugaagggggugaucguuaugaaggauaaccccaugacaauuauuccuucaagucaugaa

SEQ ID NO: 4227470 - RNA, 60 nt, Escherichia coli CFT073
guugauugagcgagugggcgaggacaucaaugcgccauccuuguugacuggcaauccagc

SEQ ID NO: 4227471 - RNA, 83 nt, Escherichia coli CFT073
agacaaucgguaaauauugcuaaugcauuggcgagucgccgguuuuccagacuuaaugcguuuguaauaaauguugguucucu

SEQ ID NO: 4227472 - RNA, 59 nt, Escherichia coli CFT073
cguaggugaagcgaugaacgaugcugaaauuugcgcauucguugaaaaagccaucuacg

SEQ ID NO: 4227473 - RNA, 60 nt, Escherichia coli CFT073
uggcaaugaccacugguagugucuggcugcuuccccacaggaacagcacuaccagcgcca

SEQ ID NO: 4227474 - RNA, 62 nt, Escherichia coli CFT073
ugauggaugucggggccgucagggcucaacgaaaugaacuggugauggccaccacauucuca

SEQ ID NO: 4227475 - RNA, 62 nt, Escherichia coli CFT073
ucuggcggcacucucugucccuuuuucugccgcauuacgucagggauuagagaccugucaga

SEQ ID NO: 4227476 - RNA, 62 nt, Escherichia coli CFT073
ugucgcuuuuacucuucagauuguuaaucugaccacaagaacagucgaacaguacaacgaca

SEQ ID NO: 4227477 - RNA, 73 nt, Escherichia coli CFT073
ucgaaaguaaguucuaugacgcaucguccuaugcaggcaaaaccuguacgcugcgcauaaaacuggcacccga

SEQ ID NO: 4227478 - RNA, 70 nt, Escherichia coli CFT073
ggccgugaaacagcgcuggcagcagcaaggcgucacaccgucugccgcgcugcucacgcuguuugccgcc

SEQ ID NO: 4227479 - RNA, 67 nt, Escherichia coli CFT073
ucccgccucggagaagcaccugauuaucgcuucucgcuggcuaaugagcguacuuuucuggcgugga

SEQ ID NO: 4227480 - RNA, 104 nt, Escherichia coli CFT073
ggcguucugcugcugccagcaacgucgauuccuucuuggcaaaacagagacgaaucaguuuaugugggaagggaucggcgcaaaacaccgacagcggaaucgcc

SEQ ID NO: 4227481 - RNA, 115 nt, Escherichia coli CFT073
ucgauaccgguucuaaaauggacgaaguuaucuacgaagaguuuaaagguacaggcaacauggaacugcaccucucucguaagaucgcugaaaaacgcgucuucccggcuaucga

SEQ ID NO: 4227482 - RNA, 99 nt, Escherichia coli CFT073
gauugucuucucguuuacggugucgguguauucgucagcgaccguuacgccaggaucguugaaccucgcgccgaucgccauagccgauauggaucaauc

SEQ ID NO: 4227483 - RNA, 78 nt, Escherichia coli CFT073
cugccguuuuacggucgugcggugauguguguugaugauccggugauccgcgaauuguuaccgcguguggggcgucag

SEQ ID NO: 4227484 - RNA, 84 nt, Escherichia coli CFT073
cggucagcuauaccgugcgucagcuggaagaguggcuggcggugccgcuuuuugaacgacgucaccgugauguggaacugaccg

SEQ ID NO: 4227485 - RNA, 58 nt, Escherichia coli CFT073
agcgacgcauaaaucgauggggcagauccaacgugcgcuggucgggauugccguuguu

SEQ ID NO: 4227486 - RNA, 71 nt, Escherichia coli CFT073
gcaguacgugccuaaaaugcuggcauugagugauauucucaaaaacagcaagcguuauggcguacgucugc

SEQ ID NO: 4227487 - RNA, 98 nt, Escherichia coli CFT073
gcguuuagguuguggagaagguacgacccggcggaaagagugaccaucugcuuugaaaacccagccuuuuucugccuguaguaccugagucugagcgu

SEQ ID NO: 4227488 - RNA, 55 nt, Escherichia coli CFT073
uuuauggucaggaucgcucgcguauucuggaaccggguaugguucugaccguaga

SEQ ID NO: 4227489 - RNA, 66 nt, Escherichia coli CFT073
gcagguucuggucuucuuuacugacgccuggcaguuucgccagcuucgcggagguaucagagaugc

SEQ ID NO: 4227490 - RNA, 79 nt, Escherichia coli CFT073
ggcguaagcaaaagcggugaccgcuaugucgaccacaccauguucgauauggugcagucgcugaccauugccgacagcc

SEQ ID NO: 4227491 - RNA, 62 nt, Escherichia coli CFT073
guaaaucgcuacauguuaacacacaacguaaauguugugguguaagcacaguaguagaggac

SEQ ID NO: 4227492 - RNA, 129 nt, Escherichia coli CFT073
ccagcguucugccugugccgccuaccgcucaucaguugcugaugcgcugccaggcguuacuuauucaacugcuccauaacggcuggcgcuaucaggaacagagugcuauuggugaggcagaguugcugg

SEQ ID NO: 4227493 - RNA, 129 nt, Escherichia coli CFT073
aguuaugcaaauagucauguuugacaggcagucaauauuuauucauggaaugaaaaucaguuuacagcaucguauuccaggagugaguauucagggggccagucaggcagacgaguuauggcaaaagcu

SEQ ID NO: 4227494 - RNA, 89 nt, Escherichia coli CFT073
ggugucggaugcgacgcugaugcgucuuauccgaccuacggggagcgcauuuguaggccggauaaggcguuuacgccgcauccggcacc

SEQ ID NO: 4227495 - RNA, 60 nt, Escherichia coli CFT073
guucuccuucaacaaacagugcgccgggguaaucugucgucgccagaaguugaggaggau

SEQ ID NO: 4227496 - RNA, 72 nt, Escherichia coli CFT073
acgaugccucacccgguuaaagauguucgcguguugagccgcaucaccacugaagccuuuaaccagcgucgu

SEQ ID NO: 4227497 - RNA, 57 nt, Escherichia coli CFT073
agugcuggauaugaccaucgaagaggcgcgugaguucuuugaugcggugccagcucu

SEQ ID NO: 4227498 - RNA, 59 nt, Escherichia coli CFT073
ucacggauggucggcucgacguggguuuucauaaaguuuucggcaucaccauccgucgg

SEQ ID NO: 4227499 - RNA, 73 nt, Escherichia coli CFT073
ccugccccggugaugacagcgccgacugcccgauuaucgaaaaucucuccggcugcugucaucaucgggcggg

SEQ ID NO: 4227500 - RNA, 60 nt, Escherichia coli CFT073
gcgugacgaacggcaguauugcuuccgguaugggccggaauauugccaccuucguuuugc

SEQ ID NO: 4227501 - RNA, 66 nt, Escherichia coli CFT073
agagggcauguucccaagccagaugucgcuggaugaaggcgggcgucuggaagaagaacgccgucu

SEQ ID NO: 4227502 - RNA, 63 nt, Escherichia coli CFT073
gaagcgcgagguaacguacuggcuguaaucauucgcuacagccgggacuuugcccugcucuuu

SEQ ID NO: 4227503 - RNA, 60 nt, Escherichia coli CFT073
uccgggaaguagugcagcauguugagcuuaccaagcgaaugcugcauuuugcugaccgga

SEQ ID NO: 4227504 - RNA, 81 nt, Escherichia coli CFT073
acugaugccagcugaucuucgaagugaacugccgcugcaccggcuucaaucaucgcuuucaucaguucaaaggcauucagu

SEQ ID NO: 4227505 - RNA, 57 nt, Escherichia coli CFT073
ucgguggucgcuaaauagccgugauccaucacuccuaacuguuucgccaucgccaga

SEQ ID NO: 4227506 - RNA, 63 nt, Escherichia coli CFT073
ccagcgacgcgccagcaggaaagauccaguucagcgagaucuuuuucauucacgcggcgcugg

SEQ ID NO: 4227507 - RNA, 59 nt, Escherichia coli CFT073
guuauggcaaaacauuucacuccugugaucgcuacccggagugucaauuugccauuaac

SEQ ID NO: 4227508 - RNA, 56 nt, Escherichia coli CFT073
ggccgggcguuaucugauugaacgcggucaucgcgaaaucggcguuaucccuggcc

SEQ ID NO: 4227509 - RNA, 56 nt, Escherichia coli CFT073
cgucaguagcgguaugaaaggcgguuaucuugcggccugugguguauuuauuggcg

SEQ ID NO: 4227510 - RNA, 59 nt, Escherichia coli CFT073
gaauaaacacugcacuguguauucauuccaacgagugaauacacggagcaaugucgcuc

SEQ ID NO: 4227511 - RNA, 55 nt, Escherichia coli CFT073
ggccuuuaccgcucugauagagauagguuucaucuuuauaaaggugguaaacgcc

SEQ ID NO: 4227512 - RNA, 78 nt, Escherichia coli CFT073
cagucuguccuuuuucacagucuggucaggauauucuuccgccagaauguuucugacaucuguaagcaaugcagacug

SEQ ID NO: 4227513 - RNA, 84 nt, Escherichia coli CFT073
uuauucuccaguguuauauacuauagggggguaugcauugacauauagcauaccccccuauaguauauugcaugcagaugauga

SEQ ID NO: 4227514 - RNA, 88 nt, Escherichia coli CFT073
guugaguuaauggcaggcaagcgauuugugucauugcaaagcaguaauagagcuccgcgaugauaugguugcuggcggccagcucgac

SEQ ID NO: 4227515 - RNA, 129 nt, Escherichia coli CFT073
cgaacauauuuuccaguugcuuaaugcgcugugagacggcugauuguguaaugcacagcuuuugugccgcgcgcucaaauccucguucacguaucaccgcauccagugccuguaauguucuguaguccg

SEQ ID NO: 4227516 - RNA, 56 nt, Escherichia coli CFT073
cugaauugcaggaacguuaccaccguuuccgcaacgaugaagccuuccugcaacag

SEQ ID NO: 4227517 - RNA, 55 nt, Escherichia coli CFT073
gcugauauuugauaauaucgccucuucauggggggugagugcaucgggcaucagc

SEQ ID NO: 4227518 - RNA, 57 nt, Escherichia coli CFT073
ugcaugagcuggcuuucgcugaauacgcuguuaaucagcuggaauaccugcucugca

SEQ ID NO: 4227519 - RNA, 66 nt, Escherichia coli CFT073
ccggggugcgagaauucuggucguugccguuauuuguuucgccagcgaccuuaauuccgcgcccgg

SEQ ID NO: 4227520 - RNA, 83 nt, Escherichia coli CFT073
cagaaagcgauucugcugauugugcgccgucuugccgaaacuggcgagauggugauuggcagcggcgaggauaccuaugucug

SEQ ID NO: 4227521 - RNA, 63 nt, Escherichia coli CFT073
cugccgcuauguuuauuugacccgcaguaaaucagaacuucgcguuguauaacauggugaaag

SEQ ID NO: 4227522 - RNA, 69 nt, Escherichia coli CFT073
uuucaugagguguugauaucuguuuuuucagcaaaaaugaaccgucaucagauaucaacgccgcugaaa

SEQ ID NO: 4227523 - RNA, 58 nt, Escherichia coli CFT073
guccggcaguaaccgugaugucaccgccacuggucaugucuguucccugcugccggac

SEQ ID NO: 4227524 - RNA, 87 nt, Escherichia coli CFT073
auuauggaacgcuuacugauuguuaaugccgaugauuuuggcuuaagcaaaggucagaacuacggcauuaucgaggccugucgcaau

SEQ ID NO: 4227525 - RNA, 79 nt, Escherichia coli CFT073
guggaggcguucuguucauggucagcgugcaggaucagaauacgguccauagcacguuccagaaucggauuaacuucau

SEQ ID NO: 4227526 - RNA, 68 nt, Escherichia coli CFT073
ugucggaugcguuucgcuuaucugaccuggcaucgcguguaggccggauaagcgaagcgcauccggca

SEQ ID NO: 4227527 - RNA, 62 nt, Escherichia coli CFT073
gcgaaaacaucuauccgguacgccaggaacucuauuuuggcauggugguggaucgugaaagc

SEQ ID NO: 4227528 - RNA, 77 nt, Escherichia coli CFT073
gcgggcgguauuauuucugcggcagguuuuaccugguuugcaaaggaggaaccgcccgcagaaaaaacgucgaccgc

SEQ ID NO: 4227529 - RNA, 66 nt, Escherichia coli CFT073
gcgaccuugcaagcuucgggcggucuugaugucaugcugcaaauugccgagaagcugcugcgucgc

SEQ ID NO: 4227530 - RNA, 75 nt, Escherichia coli CFT073
gggaucgauuauaugcaggguuaucuuauugguaagccgcaaccguuaauugauacgcugaaugaaaucgaaccc

SEQ ID NO: 4227531 - RNA, 60 nt, Escherichia coli CFT073
gaaguccccgucaccaucgcaaccacgcugccgauaaaacagauggugaugaucgauuuc

SEQ ID NO: 4227532 - RNA, 56 nt, Escherichia coli CFT073
gcacauaacucauacugagcaaggcauaggcuuugcuuagcgcaaguuuauguagu

SEQ ID NO: 4227533 - RNA, 72 nt, Escherichia coli CFT073
ggcaaaagaguugcaguuaagugcgguuucgauggguuacaucuucucugcuuuuggcugggccuacuugcu

SEQ ID NO: 4227534 - RNA, 81 nt, Escherichia coli CFT073
gcugauuauuuauuuuuccugguucgcggugcuuuuaucacugugguacauggggaaagugauaaaaaugaugaucaacgc

SEQ ID NO: 4227535 - RNA, 58 nt, Escherichia coli CFT073
cugcaauugaccaucgcgguuagcaauaucaacaauauaaucguuggucaccaugcgg

SEQ ID NO: 4227536 - RNA, 86 nt, Escherichia coli CFT073
ggcggugaguggugacggcgguauacaucgcggugaaagaggauuuauacacuuucaccugaucgucgccguacugcucgcgcgcc

SEQ ID NO: 4227537 - RNA, 55 nt, Escherichia coli CFT073
uggguuuugaagcgccgggagaagcgaaauuccgcauuccgguuucggacacuca

SEQ ID NO: 4227538 - RNA, 70 nt, Escherichia coli CFT073
cagggaaaaggacaaaaucaauccggugguguuuuacacuuccgccggacugauuuuguuguuuucccug

SEQ ID NO: 4227539 - RNA, 73 nt, Escherichia coli CFT073
ugcacguuacggaaggcaaaaaagagcacgccgguaauaaccaguagcaccaguugcccuuccagugacggua

SEQ ID NO: 4227540 - RNA, 93 nt, Escherichia coli CFT073
gauccggcauuccgcaacaucacuuuugaccagcugguggcggcuuaucgagaauccaccaaagcgcugguggaagguggcgcggaccugauc

SEQ ID NO: 4227541 - RNA, 64 nt, Escherichia coli CFT073
gagaaauaccaucaaaaucgugaguguugucagcauuuucaccgguauuuggggcuguuucauc

SEQ ID NO: 4227542 - RNA, 56 nt, Escherichia coli CFT073
uuguagcaggcguucuacagccucgacaacauccuggacuguacgcacugcuuuaa

SEQ ID NO: 4227543 - RNA, 84 nt, Escherichia coli CFT073
cucaauuaaggugaacggucaucaagaaaucacauccaccagcaggacgugugaccaucuaaugaucgaccuugaaaccauggg

SEQ ID NO: 4227544 - RNA, 55 nt, Escherichia coli CFT073
acugcgaaucgggaauuaucuuugacaacgaugaggauaaaacagauucggcagu

SEQ ID NO: 4227545 - RNA, 75 nt, Escherichia coli CFT073
gcgcugguguuuggucagccgagcgugcaagugaguauuuacccguuccguaugaccgacgccaauaugaagcgc

SEQ ID NO: 4227546 - RNA, 90 nt, Escherichia coli CFT073
gccgcuggcgauugaucauuuucgcuauuuugccucguguauucgggcgcaggaaggugggaucagugaaauugauagcgaaaccguggc

SEQ ID NO: 4227547 - RNA, 63 nt, Escherichia coli CFT073
ccgcucgggauaucagcuaaaacauaagcaaaagugaauguuuuaagaacauuccguaagcgg

SEQ ID NO: 4227548 - RNA, 57 nt, Escherichia coli CFT073
cgucacgcugguggaucagggcggacaucuguuaacccaguccaacaccagcgggcg

SEQ ID NO: 4227549 - RNA, 84 nt, Escherichia coli CFT073
cuauucaucauuaaugauuuauuauuugggauaugaucguuuuuuguugaucuucuucacagauuauagcuauuucauggauag

SEQ ID NO: 4227550 - RNA, 80 nt, Escherichia coli CFT073
cuggacccaaacagauguguucaugacuggucgcaccacagguguugcaaccuaucguaacaacgacuucuuuggucugg

SEQ ID NO: 4227551 - RNA, 55 nt, Escherichia coli CFT073
uucgaguugaucgucagagauggugcagaccaagaaaaucgacgaucggguugaa

SEQ ID NO: 4227552 - RNA, 66 nt, Escherichia coli CFT073
ccgacgugcauuugccgcuuaaccugaacauugaagaguuuaagggcgagcagcugcgcgugacgg

SEQ ID NO: 4227553 - RNA, 69 nt, Escherichia coli CFT073
cggugaugguggggauguacguauaguucuggcuucgggacguguguuuaucuuccccgaaaauccccg

SEQ ID NO: 4227554 - RNA, 81 nt, Escherichia coli CFT073
gccguguuugucgccuauuauguguuggguauacgucagcauaugagcauggggacgaugcucacacauacggaaaauggu

SEQ ID NO: 4227555 - RNA, 59 nt, Escherichia coli CFT073
ccggaaaccaauggucagguagcuguaaaagccugggcugcccugagcgaguuuaccgg

SEQ ID NO: 4227556 - RNA, 77 nt, Escherichia coli CFT073
guaacaugcuaauguuauuuaaauaccauuguuaugcgaaaguuuauaagagguagugaaauggacauugcaguuau

SEQ ID NO: 4227557 - RNA, 68 nt, Escherichia coli CFT073
gugggucgaugaugcgcagacguucgaacugccagaaauuaucgaccugcgaaccaacauugauccgc

SEQ ID NO: 4227558 - RNA, 57 nt, Escherichia coli CFT073
ggcggcgaugggugugcuguguauuuucuggauuaucaaaucacugccuucgcugcc

SEQ ID NO: 4227559 - RNA, 78 nt, Escherichia coli CFT073
gcgugguuggcggagaauggucgccagacagaaugcgaagaauugcuggcauggcaccuuuuuccguggucaacacgu

SEQ ID NO: 4227560 - RNA, 65 nt, Escherichia coli CFT073
ugaagguuucugcguuauccagcgaaccguugaggauggcgucgauaauagcgcggguaucuuua

SEQ ID NO: 4227561 - RNA, 68 nt, Escherichia coli CFT073
cggcaaugaaaucagcuacuuugagccgggccuugaaccguucacgcuuaauggcgauuacauuguug

SEQ ID NO: 4227562 - RNA, 77 nt, Escherichia coli CFT073
uugaugcgcgccaguuggcgaucuacagaacccggacguuucaucaguuugagaaugcgcgggcuggcgugcugcaa

SEQ ID NO: 4227563 - RNA, 55 nt, Escherichia coli CFT073
ccgacuugcauaagauaaacgaauuguucauuguuuaugcucauuuguaggucgg

SEQ ID NO: 4227564 - RNA, 68 nt, Escherichia coli CFT073
uuucgucgugaaauggcuuaugaaucauggcauaugcaacauugcguaggccaguuugaugaucgaaa

SEQ ID NO: 4227565 - RNA, 76 nt, Escherichia coli CFT073
cugugaucauaaugguacacuuuauaggaauuacagcggggagaauguacuguaacuguugccauauggucuccag

SEQ ID NO: 4227566 - RNA, 103 nt, Escherichia coli CFT073
uugccugaugcgcugcgcuuaucaggccuacaaggggaauugcaauuuauugaauuugcacauuuuuguaggccggauaaggcguuuacgccgcauccggcaa

SEQ ID NO: 4227567 - RNA, 83 nt, Escherichia coli CFT073
ggcgauaguaagagaugguguugauuaacccaagcguuggcauauaagcaaacgaguuaaucaauaucacaaggaacaucgcc

SEQ ID NO: 4227568 - RNA, 74 nt, Escherichia coli CFT073
gcaacugugcuucuguuagcggcucuucaacguucgccagcggaugauccgccgccaugacaaagcgccauugc

SEQ ID NO: 4227569 - RNA, 130 nt, Escherichia coli CFT073
cuuaauaaauaucagcuauccuuauaaagaaaaucugaauuuuuuuucguugcguugaccaucgaacaacguagcguuaaaacuuuuagcucuuaucaggaugcuaaaaacaucaugauucacaguuaag

SEQ ID NO: 4227570 - RNA, 57 nt, Escherichia coli CFT073
uuggcggcacaaagugagugccugguugaggaaagaagagcuugcugugaucgucaa

SEQ ID NO: 4227571 - RNA, 76 nt, Escherichia coli CFT073
cggugcggcaaucauccacuuccugggggguauccacgaaaucuacuucccguaugugcugaugaauccgcgucug

SEQ ID NO: 4227572 - RNA, 62 nt, Escherichia coli CFT073
ggucgagcgucaguguccgcgucugguuguucaccgccagcacgcgcccgccgaugcugauc

SEQ ID NO: 4227573 - RNA, 117 nt, Escherichia coli CFT073
ugguagggaucaacuuacugcgcgaaggucuggauaugccggaaguuucgcugguggcgauccucgacgcugacaaagaaggcuuccugcguuccgaacguucguugauccagacca

SEQ ID NO: 4227574 - RNA, 66 nt, Escherichia coli CFT073
gccuguguagcuugucggagcugaucgccuccugacuuugcagauuugcgcgacgagcucuacggc

SEQ ID NO: 4227575 - RNA, 56 nt, Escherichia coli CFT073
uucuuaggcauugccggaugcgacgcuggccgcgucuuauccggccuccauaagag

SEQ ID NO: 4227576 - RNA, 73 nt, Escherichia coli CFT073
gugaugaauugcugggagaaggcagacguaguacugaugaucggaaaaaugugccuuauuccguauucaugac

SEQ ID NO: 4227577 - RNA, 79 nt, Escherichia coli CFT073
gagucugcggcggguacggcggcgggcgguaaaaccgguuugacggcuaucaccguuggcgugcuguuccugcugauuc

SEQ ID NO: 4227578 - RNA, 55 nt, Escherichia coli CFT073
uggugcaaaugcccuugauacgucaagccuuugaugucguacagggcauugccca

SEQ ID NO: 4227579 - RNA, 63 nt, Escherichia coli CFT073
gaaucacccggacacgauccuuggcaccgcgaaagcgcugaaaaugacucugucggguuuuuc

SEQ ID NO: 4227580 - RNA, 56 nt, Escherichia coli CFT073
gcuacuggaugauagccaacaucccgguaagucuacguguuggcaucaccaguggu

SEQ ID NO: 4227581 - RNA, 57 nt, Escherichia coli CFT073
uugugcuggaugaaguaccagauugcgaaacgcuauggaugcuggcaaccgguacag

SEQ ID NO: 4227582 - RNA, 97 nt, Escherichia coli CFT073
ugguuaugcuccggcgcaaggcggaaauacucgccgcggaacgggcagauaauaaagcccgguucgaggccgagcauuuucaccagccggucagcca

SEQ ID NO: 4227583 - RNA, 68 nt, Escherichia coli CFT073
gcuaaaaucccuauaacaguagaacccucccgagugcggaaggguugacgugauagagguuucaaagu

SEQ ID NO: 4227584 - RNA, 57 nt, Escherichia coli CFT073
uuugcguuugcggcuugggaucaggugcggcaguaccagaccgagcagcaagccaag

SEQ ID NO: 4227585 - RNA, 77 nt, Escherichia coli CFT073
ucaggacccggaagucaucaagcaguuugccgaagaaguucaaacggaaaaucgucugcgcuaucugguaugccuga

SEQ ID NO: 4227586 - RNA, 61 nt, Escherichia coli CFT073
ucaaacucccuuuacuuaccuuugcgugccaauuuaaguggaguaagugaagggaguguga

SEQ ID NO: 4227587 - RNA, 65 nt, Escherichia coli CFT073
augaauauuuagacuaaagaguuuguaacgcuauguaagugauuuuuucugguuuagauauuuau

SEQ ID NO: 4227588 - RNA, 55 nt, Escherichia coli CFT073
gguugcugcggugauaaacaguuuugccucagcaaaaccguauucccgcagcacc

SEQ ID NO: 4227589 - RNA, 56 nt, Escherichia coli CFT073
cggaauauuaagccgcuggcgaaucucgccaaucgccugccagucaauauguuccg

SEQ ID NO: 4227590 - RNA, 61 nt, Escherichia coli CFT073
gcaggaaggucgcgaugccgaucugcaggcgauuugcucaaugggcaucaaccuguuccgc

SEQ ID NO: 4227591 - RNA, 77 nt, Escherichia coli CFT073
gaugcgacgcugacgcgucuuaucaggccuacauacguuucaauuucguaggccggauaaggcguucacgccgcauc

SEQ ID NO: 4227592 - RNA, 67 nt, Escherichia coli CFT073
aucagguuacaacguuccggcaauccucgaagccuuaggcggugccgacaauauugucagccucgau

SEQ ID NO: 4227593 - RNA, 63 nt, Escherichia coli CFT073
aucgauaucggcgggcauagcaucaucaaccuccacgccaggcugugcgcguaacuugucgau

SEQ ID NO: 4227594 - RNA, 82 nt, Escherichia coli CFT073
gccagucgcggcugucgcuaugguagugcagguagcuucccaggagaaugcccagcaccauagcaaacagaaucugccaggc

SEQ ID NO: 4227595 - RNA, 58 nt, Escherichia coli CFT073
agauuggugucaaucauguguugcaggaugccgggauucaggugauugaaaccgaucu

SEQ ID NO: 4227596 - RNA, 83 nt, Escherichia coli CFT073
cugaaaguuaaugauguuuuaagcucugugagcgaauuaaugcuuucgcucauaaucagaucuaaaacgguaauaacuuacag

SEQ ID NO: 4227597 - RNA, 63 nt, Escherichia coli CFT073
ucggcagaacggcagcuacgaagucacguuuaauaacuacuucaguggugucauucagugcga

SEQ ID NO: 4227598 - RNA, 69 nt, Escherichia coli CFT073
gcugguauuuucaaucgguacgacggcauagucggccuggccgguuuccaccugauuaaaaauaucggc

SEQ ID NO: 4227599 - RNA, 103 nt, Escherichia coli CFT073
gcuguuaagccugguguucgcaccgaccuggcuuggguuaucguuuuacgauagccgcaccacgucguuguuacauccugcucgccagauccagcuucccagc

SEQ ID NO: 4227600 - RNA, 84 nt, Escherichia coli CFT073
ugcagggcagcagugcugcugaauccguuuuauccucaucguugucgaagauaaucccugauucgcagucaauauuguccugca

SEQ ID NO: 4227601 - RNA, 78 nt, Escherichia coli CFT073
gguacguuccuucgucgcacaagggguggaugcgaucuuuaucgcuccggugguggcgacggguugggagccgguauu

SEQ ID NO: 4227602 - RNA, 78 nt, Escherichia coli CFT073
agcuccguuacuggagguggaagggaugaaggucggucugaugaccuguuaugacuuacgcuuuccagagcuggcgcu

SEQ ID NO: 4227603 - RNA, 88 nt, Escherichia coli CFT073
ugccugaugcgacgcugacgcgucuuaucaugccuacaagucugugccgaaccguaggccggauaaggcguucacgccgcauccggca

SEQ ID NO: 4227604 - RNA, 91 nt, Escherichia coli CFT073
cagacccgcggugcaaauguguuuuacagcgugauggagcagaugaagaugcucgacacgcugcagaacacgcagcugcagagcgccauug

SEQ ID NO: 4227605 - RNA, 55 nt, Escherichia coli CFT073
gccgcuccaccgucgggcugacguuaagaaaacggaagcucagacggggaguggu

SEQ ID NO: 4227606 - RNA, 58 nt, Escherichia coli CFT073
ucuuacggucgauuucaacagaggcuuuuuucaggccauugaugaauuugcuguaaga

SEQ ID NO: 4227607 - RNA, 110 nt, Escherichia coli CFT073
aagcccguacucuggucacgcucuuauuucaucgguucaugugguggagcaccgcuggaaguugugaaaaaguauauucagaaucagcguggcugauaaacugcgggcuu

SEQ ID NO: 4227608 - RNA, 56 nt, Escherichia coli CFT073
guagccagguuuaaucgugcugguuucguacccuuuaucgcgcugaaccuggcuac

SEQ ID NO: 4227609 - RNA, 99 nt, Escherichia coli CFT073
gggcgggcaacggcaucuggaucgcccgguuuuugauucaaugaaagaagcgaugcgacaaacugaggcugaugccagcgugauuuaugugccugcacc

SEQ ID NO: 4227610 - RNA, 64 nt, Escherichia coli CFT073
guuuuuugacuuacucguaagccguucuacgcuucaaagaguggaagcgaaggagucaaaaaau

SEQ ID NO: 4227611 - RNA, 62 nt, Escherichia coli CFT073
auggguuccuggggugcggaguuuguuacccucgugguuauucuguuugccuucagcuccau

SEQ ID NO: 4227612 - RNA, 110 nt, Escherichia coli CFT073
acccaguuuuuugcgcuguuaaugacggugaauggccuggcaccgguguugucgccagugcugggcggguacauuguuagcacuuuugacuggcgcacuuuauucugggu

SEQ ID NO: 4227613 - RNA, 79 nt, Escherichia coli CFT073
guuggcaccggaaagaauaugcgccaggcguucgccgcgaauauuaugcugggcgauauauuuuuucaucccugccagc

SEQ ID NO: 4227614 - RNA, 93 nt, Escherichia coli CFT073
uguugcgugccacagacaaaaucgcuggcuggcgucgcggcguaaauuaauccgcguuuagucgggcguuggccgggcgacagcacuucaaca

SEQ ID NO: 4227615 - RNA, 81 nt, Escherichia coli CFT073
ugugacaccgacuuugguguaugugcgcacugcuacggucgugaccuggcgcguggccacaucaucaacaaaggugaagca

SEQ ID NO: 4227616 - RNA, 56 nt, Escherichia coli CFT073
uccccauuucugcaguguaaggggaaaugucccccuccucacugcucaaaugguga

SEQ ID NO: 4227617 - RNA, 56 nt, Escherichia coli CFT073
uaacggcagugaagauucguggcgaaaguaauuuguugcgaauuuuccugccguug

SEQ ID NO: 4227618 - RNA, 62 nt, Escherichia coli CFT073
ugagcuuauugucuucauuauacuuaauuuuguaauuaagugcgaaggucgcaauaugcuca

SEQ ID NO: 4227619 - RNA, 79 nt, Escherichia coli CFT073
cguuuacgcgccacguuguagggcguuaaccccgcacgggcgauaaacgguuuuagcgccgcaaaaacgggcgcaaaug

SEQ ID NO: 4227620 - RNA, 56 nt, Escherichia coli CFT073
uucucguugaaaaauacgcgcugguacgaacugaccagccgggauucagcgcagga

SEQ ID NO: 4227621 - RNA, 62 nt, Escherichia coli CFT073
guugcuuguacaggucaacgaaauugauccauaaucauuuucguuggaaucgugugcugcac

SEQ ID NO: 4227622 - RNA, 63 nt, Escherichia coli CFT073
cccguaacggcgaucgcgccagcggaguucccuuuauuucguugcgugagguugcuggcuggg

SEQ ID NO: 4227623 - RNA, 70 nt, Escherichia coli CFT073
cauuauggcgcugauggugauguccugcugcgguucgcugcuuggcuggcaguucaccauugcccaggug

SEQ ID NO: 4227624 - RNA, 84 nt, Escherichia coli CFT073
auccagcgguugaugggcggauucuugcgacaggaguucaagcauuuguucgaggaccuggcgagcaucccccacaaucgggau

SEQ ID NO: 4227625 - RNA, 84 nt, Escherichia coli CFT073
uccgguagaaaucacccguguacgucugcaacuggcccguaaugaaaaccaugcagcacgucacggcguggauaagcugcugga

SEQ ID NO: 4227626 - RNA, 81 nt, Escherichia coli CFT073
agacgccaguaucgugauucauguuccgcgcggggaugaaaaagggaaaacgccgcuacaugguacgguauuguugugucu

SEQ ID NO: 4227627 - RNA, 119 nt, Escherichia coli CFT073
ucccacgcuucaccaaucacuucagcggcaucagugaagguuuuguacaacugcgggucagccagcucgcuugccagcacaccgucaaaacgcuuauugauaaagccagcguuacggga

SEQ ID NO: 4227628 - RNA, 75 nt, Escherichia coli CFT073
gggggcuggccuuuuuucugguaugccgcucgauaaaaucgcagcgacgauggaaaaagggaugggaggcacccu

SEQ ID NO: 4227629 - RNA, 66 nt, Escherichia coli CFT073
gcguauuuuuauggaaggagaucauccaauaacgguuacucaccgaucuucuucaugguaauacgc

SEQ ID NO: 4227630 - RNA, 55 nt, Escherichia coli CFT073
gcggaucugauuuucagcuacuuugcgcuggauuuggcugagaagaagauucugc

SEQ ID NO: 4227631 - RNA, 92 nt, Escherichia coli CFT073
gccgauguguccggguuaaacggaagcucccccgccugugacagccccgccacaucgucgcacagcgucagcuucugcuccggacuguccgc

SEQ ID NO: 4227632 - RNA, 60 nt, Escherichia coli CFT073
ggauacuuacaccaccgacggaauaugaaaaucaauauuaucgacggcucagaagugucu

SEQ ID NO: 4227633 - RNA, 76 nt, Escherichia coli CFT073
gaucgcgaaucaacgcauuuuuaucgcuauuuuguagccauauggcauaaagcggccgugaaaguguugugcuauc

SEQ ID NO: 4227634 - RNA, 58 nt, Escherichia coli CFT073
aagccaguugcuggcauuuugugaagguaugcugucacgauuuguccgcagcgaguuu

SEQ ID NO: 4227635 - RNA, 69 nt, Escherichia coli CFT073
uguuuuuacugauguugcgaaaacgcuucgauacaacgcgaaucgcaaucgaaacaaucggugccagca

SEQ ID NO: 4227636 - RNA, 70 nt, Escherichia coli CFT073
gcuuauaagcgucccguuucgaucuuaguggucaucuacgcacaagauacgaaacgggugcugauguugc

SEQ ID NO: 4227637 - RNA, 94 nt, Escherichia coli CFT073
gaugccggaugcgacgcuugacgcgucuuauccggccuacuaauuaaugccgaaucguaggccggauaaggcguucacgccgcauccggccauc

SEQ ID NO: 4227638 - RNA, 59 nt, Escherichia coli CFT073
gauuguugacuuccgucaugaaguuuuuauacccggcauucaugaaacugucagccuuc

SEQ ID NO: 4227639 - RNA, 73 nt, Escherichia coli CFT073
caauucauaaaaaaccuuaauauacgccacccuaaacauaaccagcguuaauguaagguuuuuguguggacug

SEQ ID NO: 4227640 - RNA, 64 nt, Escherichia coli CFT073
cccgcuguuuacgcuaacugcugcgacuuucucuaugcgcggcaggcucuggcgaaacaggggg

SEQ ID NO: 4227641 - RNA, 92 nt, Escherichia coli CFT073
gacagggucauagauccuccuguuugauaguguagacgguuacucucgucuuaaacaccagcaaacaggaggguuaucgcugaaccaacguc

SEQ ID NO: 4227642 - RNA, 85 nt, Escherichia coli CFT073
ggccauucugggauacugguugcucauugcaggcguaacuuuacgcauucuaaugaaacgacgcgcaguucccuccgcgauggcc

SEQ ID NO: 4227643 - RNA, 112 nt, Escherichia coli CFT073
gcauugccgugacgaacaccgguguggcguggguaaugcuuugcaguaccggagagauauagguguagaggguaaacauugcaccagcgcccagcaccgucgucagcaaugc

SEQ ID NO: 4227644 - RNA, 63 nt, Escherichia coli CFT073
cagggcgucacggaaggccggaucgaaaauaucugguguagcccagccgagaucaccgcccug

SEQ ID NO: 4227645 - RNA, 84 nt, Escherichia coli CFT073
guuguuaucucgcgccugaaccgugcugguguugaauuaguugcaaguagcgauaucagccugcaguucggcgauauccucaac

SEQ ID NO: 4227646 - RNA, 62 nt, Escherichia coli CFT073
gagaauguugaugccgcauugcuggaaaaaaugccgaaacugcgugccacaucaacgaucuc

SEQ ID NO: 4227647 - RNA, 130 nt, Escherichia coli CFT073
cgcaguuaaagguuuaucucaaugaugaacugaugggcgugcugccagugaccaaagaacaguuggguaaaaaaacgcuggcacaaaugcccauuaacccgcuguuuauuacugauuucaaccgugugcg

SEQ ID NO: 4227648 - RNA, 67 nt, Escherichia coli CFT073
ggaacucaccugcgacugagcauccagcgacugcgcguucuggccauguucaguuguauccgguucc

SEQ ID NO: 4227649 - RNA, 56 nt, Escherichia coli CFT073
aaggcguuauuauuaauugccgaacaaaauaccgagugcauuauugguagcgccuu

SEQ ID NO: 4227650 - RNA, 79 nt, Escherichia coli CFT073
guggcuuugguaaucgggucaccaaauaugaacaacguuuuuguaauucagaauuuggcgaucugaaacugagcgccgc

SEQ ID NO: 4227651 - RNA, 59 nt, Escherichia coli CFT073
gcguuggucaucgcuucacugcgccgggcaucaauaagcguagugcgguuaaccagcgc

SEQ ID NO: 4227652 - RNA, 65 nt, Escherichia coli CFT073
gcauauuacguaacaccgcuggcgggcgauuauugucaaucaucacgcggucuacguagucaugu

SEQ ID NO: 4227653 - RNA, 84 nt, Escherichia coli CFT073
gaacagcacuucgucauagcauucgccguugaugcacugaccaggcagguucagcgcggugauguucuggugagguacgcgauc

SEQ ID NO: 4227654 - RNA, 79 nt, Escherichia coli CFT073
caugcucuaugucgcaccggguauacuaucuccaggacuugacuggcguuuuaucuugguaugggguccaucgagcgug

SEQ ID NO: 4227655 - RNA, 83 nt, Escherichia coli CFT073
ugaugccaaagaauuagcugacccagcguuuaaugcgcaaaaacaggcgcugaaauggggucuggcugguuuuuccagcacca

SEQ ID NO: 4227656 - RNA, 60 nt, Escherichia coli CFT073
uccgagugguuccggcaaaaccacguugcuacgcagcauaaaucugcuggaacaaccgga

SEQ ID NO: 4227657 - RNA, 60 nt, Escherichia coli CFT073
uuaauagucuucaaucuguaucagagcaggacgaacagcgcggauuugaagcacuauuaa

SEQ ID NO: 4227658 - RNA, 85 nt, Escherichia coli CFT073
uuguuaauugcucgacuagauacugacgauuacguaauucaccguucaauuccgcaacgucagugacugcuuuuucaauuuccag

SEQ ID NO: 4227659 - RNA, 66 nt, Escherichia coli CFT073
ggcgggcuuuggcaugcaggagaacaauggcuggcagaugcguuaccaccuguguauugagccgcc

SEQ ID NO: 4227660 - RNA, 79 nt, Escherichia coli CFT073
uuuaugauucuuguuuuaugugaucgugguagcguuaauuucgcuaauauaucauuguaaaauaugaguuuuauaugaa

SEQ ID NO: 4227661 - RNA, 63 nt, Escherichia coli CFT073
cuuaucaggccuacaagggaaccgcaauauauugaauuugcaauacuuuguaggccggauaag

SEQ ID NO: 4227662 - RNA, 79 nt, Escherichia coli CFT073
ugcuuaaugcccugguuuggcuggcgaucaaucugguuaaucgauuaagggaaagacucgucagccacagggaucagca

SEQ ID NO: 4227663 - RNA, 73 nt, Escherichia coli CFT073
cuuccgccgucaugauaaaacucacuaaacugucgauacguacaguauaggguuuuuauacagugcacggaag

SEQ ID NO: 4227664 - RNA, 83 nt, Escherichia coli CFT073
aggcagcaaggauuugcgugucaaucaaggguugugguaauucgccaaagacauugaggaacacuuccagaucuucacugccu

SEQ ID NO: 4227665 - RNA, 95 nt, Escherichia coli CFT073
gaugugaugaccgauaugcaaaaagccucaguuucuaugcaaauggggauucaggugcguaauaagcugguggcggcguaucaggaagugauguc

SEQ ID NO: 4227666 - RNA, 83 nt, Escherichia coli CFT073
ucgcacuguucaauguugcaugccgcaucucgcggacuuucuuacugccagugagauugcauacagccauugaauaauugcgg

SEQ ID NO: 4227667 - RNA, 82 nt, Escherichia coli CFT073
ugcaaagggccguuugaaggcuuauuaguuaucgauaugacgcauguccuuaaugggccuuucggaacucaacuucuuugua

SEQ ID NO: 4227668 - RNA, 81 nt, Escherichia coli CFT073
ggcgggaguuucacguaaaucgacgcgacuggcugaguacgcccgcgccaagucgagcaacguuuuacgacagcacuugcc

SEQ ID NO: 4227669 - RNA, 72 nt, Escherichia coli CFT073
accuuuggcuucagcguuuugcaggaaaccacgcaucugauggaaaaccugcucgaugaagccagacgaggu

SEQ ID NO: 4227670 - RNA, 78 nt, Escherichia coli CFT073
ccuucguggcgauuauggcgcugguuuccgccuguaucaucgauccggguguguacuucgccaugaacagcccgaugg

SEQ ID NO: 4227671 - RNA, 96 nt, Escherichia coli CFT073
uccgcaaccugaacguggcgagaugcggguucgucaaagguagaagcaacaacuucaccuuuuaccagacgcugcaucucgguuacuucuuccgga

SEQ ID NO: 4227672 - RNA, 56 nt, Escherichia coli CFT073
gcugcgaugcuucagguuucauuaaaggugauaaagaacgcuggaguaucagcggu

SEQ ID NO: 4227673 - RNA, 77 nt, Escherichia coli CFT073
cgcuuucguaccagaaccuggcucaucagugauuuucuuugucauaaucauugcugagacaggcucuguugagggcg

SEQ ID NO: 4227674 - RNA, 64 nt, Escherichia coli CFT073
uuugaucuccuugccccacagcucaacuggcguaccaauacccgcuugcgggcaaggcguuaaa

SEQ ID NO: 4227675 - RNA, 105 nt, Escherichia coli CFT073
uggucacagcaaacucauauuucccgucuaugcuuucagagcaaugcaucacgucugaccgauuuagacguaccacugacucucgaaaggagaagaggaugacca

SEQ ID NO: 4227676 - RNA, 61 nt, Escherichia coli CFT073
caugcugcgcguuggcgaucugcaacgcuccaucgauuuuuauaccaacgugcugggcaug

SEQ ID NO: 4227677 - RNA, 93 nt, Escherichia coli CFT073
guugccugaugcgacgcuuaacgcgucuuaucaggccuacaaagagcacuguucccguaggccggauaaggcguuuaugccgcauccggcaac

SEQ ID NO: 4227678 - RNA, 66 nt, Escherichia coli CFT073
cgcuaagucaugggaaaggugccaguuuucgcacucacuggcaccuucauucuuaauggccugucg

SEQ ID NO: 4227679 - RNA, 86 nt, Escherichia coli CFT073
gcuggugauggauaaaauuccgcguaaaacaauggggauggggcuauuaauccugauugcggugcucggauauaucuauucacugc

SEQ ID NO: 4227680 - RNA, 73 nt, Escherichia coli CFT073
cuuccgugcacuguauaaaaacccuauacuguacguaucgacaguuuagugaguuuuaucaugacggcggaag

SEQ ID NO: 4227681 - RNA, 101 nt, Escherichia coli CFT073
gagauacauggucaucaucagauguuuucgacaguguuaguauucguggcauaaaacuggaaucugacgaaaauauguugcccgauagucaaagugguuuc

SEQ ID NO: 4227682 - RNA, 72 nt, Escherichia coli CFT073
cugguuuccuggguuguaucguuuauuccgcgccgcccggagcggagcgaaacggcacaaccaucggaucag

SEQ ID NO: 4227683 - RNA, 71 nt, Escherichia coli CFT073
gcuguggccggugcuaacccgugaaccacaggaucacauuccguggucuucucugcuggcgcugccgcagu

SEQ ID NO: 4227684 - RNA, 59 nt, Escherichia coli CFT073
guaauuuucuguuucauguugccuuuccgugguagcggucccaugaaacgagagacuac

SEQ ID NO: 4227685 - RNA, 71 nt, Escherichia coli CFT073
gagaguugauucaugaaaucgacauguacgcacccgauguggucgugcuggcugguuuuaugcgcauucuc

SEQ ID NO: 4227686 - RNA, 70 nt, Escherichia coli CFT073
gcucaaaggcaugaccacuacucugguauugggcaacgccuucgauaaagaguacuggucgccgcaaggc

SEQ ID NO: 4227687 - RNA, 68 nt, Escherichia coli CFT073
uauuagguucaggggcucaacgagaacuugaagauguucaucucucccgcuaugccuguuaccuggua

SEQ ID NO: 4227688 - RNA, 77 nt, Escherichia coli CFT073
ccggaaccgguguaugucuggcgagcgaaaaaucccggacucuucuucgcuuauaugguggcauauaucggcuucgg

SEQ ID NO: 4227689 - RNA, 103 nt, Escherichia coli CFT073
acggaagauaaagcgagguaaacacuguugcggugagcggagaagacugagauuauucucuguaauuacaaacaacagugaucugauccgguuuuuuuaccgu

SEQ ID NO: 4227690 - RNA, 58 nt, Escherichia coli CFT073
gauggaaaugguguugauggcagcgggugguugcagugccaucgaugugguuucuauc

SEQ ID NO: 4227691 - RNA, 105 nt, Escherichia coli CFT073
acuucggcgcagaccaggugacgauggaagcgcguaacuaugggcuggcgcgucauuacgauccguuuaucgucaacaccguggucgguuuuauugggccggagu

SEQ ID NO: 4227692 - RNA, 77 nt, Escherichia coli CFT073
gacauagaaauauuugcccggcgcguucggaauuucaaaaccgaaauaaggcgcgucgcgggagauaucccacuguu

SEQ ID NO: 4227693 - RNA, 73 nt, Escherichia coli CFT073
cucuguuggucgucgggcguuugauucuuggcuuuggugaaagccaguuacugacgggcgcucugaccugggg

SEQ ID NO: 4227694 - RNA, 97 nt, Escherichia coli CFT073
gggauggcgcgcgcauugagcaguuugaucgcaaagguauggugaacaacaaguucaacuacuucauuaugagcaaacuggcugaagcggguauccc

SEQ ID NO: 4227695 - RNA, 81 nt, Escherichia coli CFT073
ucggcauucuggacgccgauaucuacggcccaucaaucccuaccaugcugggcgcagaaaaucagcguccaacuucgccgg

SEQ ID NO: 4227696 - RNA, 72 nt, Escherichia coli CFT073
aacguuugcguauuuucauggaaagagauuaccuaaucccccucguucuccuucauguuaauacgcaacguu

SEQ ID NO: 4227697 - RNA, 89 nt, Escherichia coli CFT073
gcugucauuagguuucacuuucggaauauagauugaaaauaagguaccgcagggaucauuaucuucgagagugauaacaccaccgcagc

SEQ ID NO: 4227698 - RNA, 88 nt, Escherichia coli CFT073
aaacggaaguuuaucacuugugcguuauaacggacaaaugcuacgguaccuguacguuauaacgcacgaggugacuaugcgucuguuu

SEQ ID NO: 4227699 - RNA, 110 nt, Escherichia coli CFT073
gcgcuguauuuauugcauuuggauauuaaauaugaaaaguuaugaugauuaucaacaugauucuucuuaugguuuuauaugggauaagguaaaugccagauuuauggcgu

SEQ ID NO: 4227700 - RNA, 121 nt, Escherichia coli CFT073
cgugguugggauauuacggcauaguuauucacacucccuucacuuacuccacuuaaauuggcacgcaaagguaaguaaagggaguuugauaugucuguuucacgucggguaauucaucacg

SEQ ID NO: 4227701 - RNA, 129 nt, Escherichia coli CFT073
cauugccggacuauugcugguugggaugugguuggugcuggggcuacaugccuugcuucgugcucguggcgugaagaaaucagccaccgaucauggugagaggauuuaucuuuacagcaaagcggucag

SEQ ID NO: 4227702 - RNA, 59 nt, Escherichia coli CFT073
ucgcuauaacagcgcauggaacacgcuggucaaccuggcaacgcugguuguuauggcga

SEQ ID NO: 4227703 - RNA, 93 nt, Escherichia coli CFT073
ggaucaguugaccgauccaguggcuguguaagaauccggaaacgcucacuuguuuccggauuuuuuuaugcacauuggacaggcucuugaucu

SEQ ID NO: 4227704 - RNA, 67 nt, Escherichia coli CFT073
cguagaacgugagcauuuauuaaaaccgcuacaacaggugagcgguccguuagguggucguccuacg

SEQ ID NO: 4227705 - RNA, 63 nt, Escherichia coli CFT073
guacagaauauccaucagcggcuggcgcagcguuucgcccaggcugcugaagguguucugcgc

SEQ ID NO: 4227706 - RNA, 82 nt, Escherichia coli CFT073
cucucgcauuuaaucguuuuuaucuggauagcauucuuuugaucggcaauguugaaauaaugaaagcggcauagauugaggg

SEQ ID NO: 4227707 - RNA, 71 nt, Escherichia coli CFT073
gucagcccguguuucuggugcgcguuggcuggucugccgauuacgccgaagcauuaaaacagccgguugau

SEQ ID NO: 4227708 - RNA, 68 nt, Escherichia coli CFT073
gaacgcgauccgggcuaucugcgcugguuguuuaauaaccucgacagcaugagcccggagcugcguuu

SEQ ID NO: 4227709 - RNA, 55 nt, Escherichia coli CFT073
ucgucguuauugcuuuacgcaugacaucgaucaugcgaaaugagaacaacgauga

SEQ ID NO: 4227710 - RNA, 95 nt, Escherichia coli CFT073
cuguuucagucacguguugugcgcuguuggucagcagcauuucucuuucguaugcugcugaaguuccgagcggcacaguacuggcagagaagcag

SEQ ID NO: 4227711 - RNA, 65 nt, Escherichia coli CFT073
cuaugcagagcagguauuccagcugauuaacagcguauucagcgaaagccagcucaugcagguag

SEQ ID NO: 4227712 - RNA, 94 nt, Escherichia coli CFT073
gacgcccaacugugaggcaagcuguucaccgaggaugacauuauauuuccccggcucgaggucaguuuguuucacauugaccagauacggcguu

SEQ ID NO: 4227713 - RNA, 69 nt, Escherichia coli CFT073
ccggacgccagcuauugcugacgcugcuggacauuccguuugccgugucgccggugguugcuggucugg

SEQ ID NO: 4227714 - RNA, 62 nt, Escherichia coli CFT073
uaaucacaguagucgaaguuuuuuagccgcuuaacuuacugaaauuuaacuacugaugauug

SEQ ID NO: 4227715 - RNA, 68 nt, Escherichia coli CFT073
cucaugguaucugagcguaucuuuaucacgauaaccacugauguaugguaugagagccagaugcugag

SEQ ID NO: 4227716 - RNA, 74 nt, Escherichia coli CFT073
uauguaccaaccguuguaugcuggcuaaggcaucauguucauugcuguagugagcuauuaguguuuggugcaua

SEQ ID NO: 4227717 - RNA, 60 nt, Escherichia coli CFT073
ucaucauucuggcagcaugggcagcagauaaacucuggccucugccauugcaagaaguga

SEQ ID NO: 4227718 - RNA, 70 nt, Escherichia coli CFT073
caauaucugaugggucgacaccggcugcgauuaaaucuuugcgcauggucaucggcucauuauaacuuug

SEQ ID NO: 4227719 - RNA, 71 nt, Escherichia coli CFT073
cgcaccguugcugauugcgcacguuugcggaacggaagcugauccgcaaauacgcagucagcagauaagcg

SEQ ID NO: 4227720 - RNA, 82 nt, Escherichia coli CFT073
uuuguucuucauaaauuucccuuugccaaaggcguaaugauaaugauuugcguuagcaaagaggaaauuuacaaugaacaga

SEQ ID NO: 4227721 - RNA, 58 nt, Escherichia coli CFT073
agcaaggugagaaggaggagcagacgcuuacguuugccgcucuucuuuaccgguugcu

SEQ ID NO: 4227722 - RNA, 66 nt, Escherichia coli CFT073
ggcagaucggucaucaaugcguccggauuguauuuacuuaccggaauugagugaccaauauagguc

SEQ ID NO: 4227723 - RNA, 83 nt, Escherichia coli CFT073
gucggcgcgaacaaugcggacaucaugcccgaggucgcgcagugugccauccgcgacuucggucagggugucguucaguugac

SEQ ID NO: 4227724 - RNA, 61 nt, Escherichia coli CFT073
ugucacgcgaggucacauugaugucacgacagaagauuuggcaagugcgcucgacgugaca

SEQ ID NO: 4227725 - RNA, 74 nt, Escherichia coli CFT073
gcgucgccagcaauucauccagugcuucaauaucacguacgcguccuacuggguguuugauuucguuggcucgc

SEQ ID NO: 4227726 - RNA, 63 nt, Escherichia coli CFT073
cuuaucaggccuacgaaaacucugcaauguauugaguuugcacgauuuuguaggucggauaag

SEQ ID NO: 4227727 - RNA, 55 nt, Escherichia coli CFT073
uggcggcgauauguucugguugauuugccaggaucaacgauucauacccgcccca

SEQ ID NO: 4227728 - RNA, 69 nt, Escherichia coli CFT073
ugcguugcgcaguugcgucaauaccggaauuuccgugcgcgguauggauauggcgcuaacuggcgcgca

SEQ ID NO: 4227729 - RNA, 56 nt, Escherichia coli CFT073
cguuuuuuugcaucccugaaagccaaaauucaggcuuaccagcggaaaaaaagaug

SEQ ID NO: 4227730 - RNA, 57 nt, Escherichia coli CFT073
cgucggcaguucaaaaucucuaucgguaagauggaagggauugaagagccgcuggcg

SEQ ID NO: 4227731 - RNA, 62 nt, Escherichia coli CFT073
aagcaccaggcuugcccgccgaucaacaauuuuucgccgaucuguucagcggccuggugcuu

SEQ ID NO: 4227732 - RNA, 59 nt, Escherichia coli CFT073
gggcauuuauuuugaguuuggcgauaacaaagccauugaccagaccacagagaaugccc

SEQ ID NO: 4227733 - RNA, 80 nt, Escherichia coli CFT073
gcaaauucaagaacugccuguccguucauugugccauagucuuucaucucgauaacggcuacaggcauuuuccccugugc

SEQ ID NO: 4227734 - RNA, 86 nt, Escherichia coli CFT073
cgccguucccgcauguuaauccugcguggucaggucgcgcuagcggcgauccugacuauugccgcagcgauuggcugguuugggcg

SEQ ID NO: 4227735 - RNA, 100 nt, Escherichia coli CFT073
ugccugaugcgcuacgcuuaucaggccuacaugauuucugcaauauauugaauuugguagaauuuguaggccggauaaggcguuuuagccgcauccggca

SEQ ID NO: 4227736 - RNA, 101 nt, Escherichia coli CFT073
agcaaucaccagccgcagcagcuaucggugaugcuugacgccuugcugcaccagcaacugggcuugaguuaccgcauugcugcuguucccuggucgcugcu

SEQ ID NO: 4227737 - RNA, 96 nt, Escherichia coli CFT073
gauugccugaugcgcuacgcuuaucaggccugcaaaaucuguugaaauuauugcuuuuguaggccggauaaggcguuuacgccgcauccggcaauc

SEQ ID NO: 4227738 - RNA, 78 nt, Escherichia coli CFT073
uuucugcgcagaauggugcaaacggugcguguaaauccugccauucgccguaugccccguuuagcgucguaccagaga

SEQ ID NO: 4227739 - RNA, 112 nt, Escherichia coli CFT073
agccuaccaaucagaagguagcauguguaguaucgcaaacauaaagagaaacugcucaugaauuauguuaucugcacuaccauugucgcccuuggucucauucugacaggcu

SEQ ID NO: 4227740 - RNA, 75 nt, Escherichia coli CFT073
ggggaaaaucaguuugcuucgcgcuauauccgccgcugacgacggcgaacagggcgagagcguuugguuuucucc

SEQ ID NO: 4227741 - RNA, 71 nt, Escherichia coli CFT073
aaccagacaacaaguauaugaauuaucggagguugucgaucaacucgauauacccguacuuuguuaugguu

SEQ ID NO: 4227742 - RNA, 55 nt, Escherichia coli CFT073
gccacggcguccagcacgguggugaugccgcucgccaccaucagcgcgucguggc

SEQ ID NO: 4227743 - RNA, 90 nt, Escherichia coli CFT073
aguuucaugccguuguaauccaucggguuauggcuggcgguaacuucgaugccgccauccacgccgagauggaacguggcgaaauagauu

SEQ ID NO: 4227744 - RNA, 59 nt, Escherichia coli CFT073
caauaggccguugcuguuggucaagcgccacuugcuugaucaccagcaccgguauuuug

SEQ ID NO: 4227745 - RNA, 65 nt, Escherichia coli CFT073
auauugcgcuuuaugucgcguggcuacucaaugacacaaauugccgagcagcuuaaacgcaauau

SEQ ID NO: 4227746 - RNA, 91 nt, Escherichia coli CFT073
cccggggagcugccgacaggguggcugugcgaugcgcuggaucagauauuuaucgccgcaccacaacugucagcaguggcucuccccuggg

SEQ ID NO: 4227747 - RNA, 55 nt, Escherichia coli CFT073
cggguugucugacuuacgagaaaucuugucaauuucaucgauguagacaaucccg

SEQ ID NO: 4227748 - RNA, 129 nt, Escherichia coli CFT073
ggucgccgggaaugcugauagcaaguccugaaguacugguugcccgguggagcuggcgaugcccagaucgccgugugccagauucaucagguaaugccagaacuggacggcuaacggcugauccaaucc

SEQ ID NO: 4227749 - RNA, 64 nt, Escherichia coli CFT073
gggugauuaugcgcaaggaucagcgccgaggcguuuauuuuuaucgcuucgcggauaauuuccc

SEQ ID NO: 4227750 - RNA, 94 nt, Escherichia coli CFT073
uaauuccugaacugugccggaugcgcuucgcuuauccggccuacacgcgaugccaggucagauaagcgaaacgcauccgacauuacacugauua

SEQ ID NO: 4227751 - RNA, 76 nt, Escherichia coli CFT073
gugauaucgaacugcggguguaugacacugaugaugaagagaaucaucaggaguuuaccugccagccagauaugac

SEQ ID NO: 4227752 - RNA, 100 nt, Escherichia coli CFT073
gauaaucguucuguuugcuguauagcgucguuugccaugcgaaggugaaaucacuauuaauaugguaagugacauauccaucccaacgaugaacguuauc

SEQ ID NO: 4227753 - RNA, 91 nt, Escherichia coli CFT073
ggccggaaccuucuaugauuaugaggcgaaguaucucucugaugagacacaguauuucugccccgcaggucuggaagcguuacaagaggcc

SEQ ID NO: 4227754 - RNA, 75 nt, Escherichia coli CFT073
uguaaugacaacguuucgcggcuauucuugaguggucuagguucaagauuagcccccgugauguugucaggugca

SEQ ID NO: 4227755 - RNA, 82 nt, Escherichia coli CFT073
caauagggguguaauuccgaaaauaaagccgaguauguuuauuaacauguucggcuuuauuuuuaucgauauacuuccauug

SEQ ID NO: 4227756 - RNA, 77 nt, Escherichia coli CFT073
gguugagauggaugguuuugaagguaacgaagguaucaucguuaucgcugcgacuaaccguccggacguucucgacc

SEQ ID NO: 4227757 - RNA, 66 nt, Escherichia coli CFT073
gcguuuuaucggugaugucugccagcuccugccacaagcuuucuuuaaucacccgcauaaagacgc

SEQ ID NO: 4227758 - RNA, 63 nt, Escherichia coli CFT073
agcgcuuauacaccgacauugacuuguaaccuguaaaguacaauaucgcuguguguaggcguu

SEQ ID NO: 4227759 - RNA, 55 nt, Escherichia coli CFT073
gccgaccugugacugccggaugcgacgcugucguguccggcagggcggguuacgc

SEQ ID NO: 4227760 - RNA, 70 nt, Escherichia coli CFT073
guagcaugaaugaucaaggccuggcauucuucuuccugaaagugcugugcccaaucgucuuuaucucugc

SEQ ID NO: 4227761 - RNA, 64 nt, Escherichia coli CFT073
gucggucagcagcaggcugccuuuguacucaggcuuccacagaucggcccagcuggugacagau

SEQ ID NO: 4227762 - RNA, 62 nt, Escherichia coli CFT073
cagaaagugacuacgcgugcacauaucgguuuucuggguuacaugcaucguguuauuuucug

SEQ ID NO: 4227763 - RNA, 57 nt, Escherichia coli CFT073
gaacaggaagauaagccacugaaagucgaagggauugaugugguuucucugccguuc

SEQ ID NO: 4227764 - RNA, 58 nt, Escherichia coli CFT073
cauccugagaagcuugcagugaugauguuucacuacccacugcacgugucucaggaug

SEQ ID NO: 4227765 - RNA, 68 nt, Escherichia coli CFT073
auccugauuugcucucucauuaucguauauuuaaucguuuuuugcguuaugagagaaaaguuauggau

SEQ ID NO: 4227766 - RNA, 71 nt, Escherichia coli CFT073
cggcugacccagugcuaacaaauguucugccaucgcgaacaauuucucugcacuggcuuuucccucggccg

SEQ ID NO: 4227767 - RNA, 65 nt, Escherichia coli CFT073
ggaaaaagaucugaucgcgcagcggcuuccagcgcagaccggugccggacaucggauuuuucacc

SEQ ID NO: 4227768 - RNA, 100 nt, Escherichia coli CFT073
accuuggugacucuuaaugagggcgguaauucuacggcaaaccgcuugaaucgccaaucuuuguugugaauuacuggcuuagcuuuauauucauuaaggu

SEQ ID NO: 4227769 - RNA, 101 nt, Escherichia coli CFT073
cguucaauuaacaggucggcguauuccuggauguugauauuuaagucuggauuaaguguucgggcuuguucauuaaucaucaguuggcggguaauggaacg

SEQ ID NO: 4227770 - RNA, 76 nt, Escherichia coli CFT073
ggugaacuggcagcguuaauucaaaaccugauugaaggauuagguggcgaagcacaacguuaauugcugauuuacc

SEQ ID NO: 4227771 - RNA, 68 nt, Escherichia coli CFT073
ccagacuaucaauauuuugcguauucagcggcuuaccgcuauagcaaccgaccauauugguggccugg

SEQ ID NO: 4227772 - RNA, 73 nt, Escherichia coli CFT073
cugauaucauuaaccaaugauucauucucaagggguuucauacccacuuuggugccauugguuaaaaugucgg

SEQ ID NO: 4227773 - RNA, 115 nt, Escherichia coli CFT073
ggcagccagugugacccgcagcaaacaacacaaauuauuacagacugcccgcuuguggcucgcgcgucauaaugggaguuuugauacuguggauugccgguucgaugugguagcc

SEQ ID NO: 4227774 - RNA, 61 nt, Escherichia coli CFT073
uccaguucgauuucccgcggaucgacuucgaucgagaucuccgcaucggcauugaacugga

SEQ ID NO: 4227775 - RNA, 77 nt, Escherichia coli CFT073
gucgcuugcgauucuccucaacgugauccggguuaucaccacaaugagcgccaagguugagagagucguaaggcggc

SEQ ID NO: 4227776 - RNA, 59 nt, Escherichia coli CFT073
uaguguggacugaugcucugcugcgcucgcuggcguaccagcggcaaccagccagacua

SEQ ID NO: 4227777 - RNA, 129 nt, Escherichia coli CFT073
gcaggaucuggagcuggacuggauugacugggauaacggugcacuacgaauuggcgcaaugucucgcuugcagucacugcgugaugcacgauuuauuccugcagcacugcgugaagcucucgguuuugu

SEQ ID NO: 4227778 - RNA, 80 nt, Escherichia coli CFT073
gcgaacuauuaaaauauccguuuauugaacuguugauuaaugagaauuacccgcauuucaaugaaggaaaagauaaucgc

SEQ ID NO: 4227779 - RNA, 77 nt, Escherichia coli CFT073
guggcgucugcugcacggcgagucgaaaaaaggcuacaucaacagccucggugcacugacuggcggucaggcgcugc

SEQ ID NO: 4227780 - RNA, 86 nt, Escherichia coli CFT073
cucaucuucgcuggugggggcuacgcgaguagugaaaucacccgcugccaguuugugcgugccauccaccagucguuuuaccggag

SEQ ID NO: 4227781 - RNA, 59 nt, Escherichia coli CFT073
auccagacgauaauaccggcgaucaccgcaccgaggaucccggugucgaucgacuggau

SEQ ID NO: 4227782 - RNA, 78 nt, Escherichia coli CFT073
uguucauuguaaauuuccucuuugcuaacgcaaaucauuaucauuacgccuuuggcaaagggaaauuuaugaagaaca

SEQ ID NO: 4227783 - RNA, 58 nt, Escherichia coli CFT073
ugcgcggauaauuauuuugugaaggcuauuauccuacacuuguaagaaaauccgcgca

SEQ ID NO: 4227784 - RNA, 61 nt, Escherichia coli CFT073
ugccguuacgcugcggugccagguaagugacuucaaaaccuucgcgcuccagcugacggca

SEQ ID NO: 4227785 - RNA, 65 nt, Escherichia coli CFT073
gacuuguagccgauagcggcgaugccguuacccagauuagcgguauagaaguuauugguaccguc

SEQ ID NO: 4227786 - RNA, 63 nt, Escherichia coli CFT073
cugcaagguauagccgcucaccugcacaaaagugucauuagcaugagugauauagcuuugcag

SEQ ID NO: 4227787 - RNA, 70 nt, Escherichia coli CFT073
ggcggugcugucgagaaacuucacgcucgacucaucaaucccguugaggcguaaauucucgcgcgucgcc

SEQ ID NO: 4227788 - RNA, 65 nt, Escherichia coli CFT073
caacaguguuucauuuuuaccaugugcugacgugaaaaucagcaguaagaaucagaauauugcug

SEQ ID NO: 4227789 - RNA, 78 nt, Escherichia coli CFT073
gcgaaaauugugauuauggaugaaccgacuucuucguuaaccgaaaaagaggucaaucaucuguucacuauuauucgu

SEQ ID NO: 4227790 - RNA, 64 nt, Escherichia coli CFT073
gaaugauaaaccggauuagugugauccgguucagugaaaucaacaggauaccgguaugucauuc

SEQ ID NO: 4227791 - RNA, 63 nt, Escherichia coli CFT073
ggggccgauggaguaugaauguacagcaccaaauuucgagcugucggucaggacuaucgccuc

SEQ ID NO: 4227792 - RNA, 74 nt, Escherichia coli CFT073
gccgccguuuuaccggugccugucggcgcagaaccgaguacaucacggccaucgagcgcaggcggaauggcggc

SEQ ID NO: 4227793 - RNA, 102 nt, Escherichia coli CFT073
gcgcuaccugcucaccagccaguuguuguuggauauguaaaauucgcugccagcguuguucaguauuuucagcguuaaucaggcuggugguggcaauagcgc

SEQ ID NO: 4227794 - RNA, 62 nt, Escherichia coli CFT073
aucaugagaaagaguaucuggugacgguugauaaaccgauuaccgaugaauuuauucguggu

SEQ ID NO: 4227795 - RNA, 73 nt, Escherichia coli CFT073
cuuauucuuuauaugaguguuguuauuacccgacuuacaggggaaucggcaauguucaugugcccagaauaag

SEQ ID NO: 4227796 - RNA, 57 nt, Escherichia coli CFT073
guggccagccagaugccacgcaucgguugugacgauuguugcgucguggcugguggc

SEQ ID NO: 4227797 - RNA, 73 nt, Escherichia coli CFT073
gcuggaugcgcugguggaacaguggcaacgaacgccugcggagguuguccucuuuccuccgggcgcguuuggc

SEQ ID NO: 4227798 - RNA, 74 nt, Escherichia coli CFT073
gcaguagcggaccgcgagaugccaggcuuuggugaacagaugcgccagaucagccugcauuuuguaccaacugc

SEQ ID NO: 4227799 - RNA, 61 nt, Escherichia coli CFT073
guugauggcgcaaaaccgaacgccgcaagcagaugcuuuuuuucuggauuuugccaucaau

SEQ ID NO: 4227800 - RNA, 64 nt, Escherichia coli CFT073
cgcgauguugugugcagcaagcguccaggaagcgcaagacuuugcucucauuucgcacaucgcg

SEQ ID NO: 4227801 - RNA, 57 nt, Escherichia coli CFT073
gaagaagccuuuaaaggccguggaguuucugcuugugcaaccugcgacgguuucuuc

SEQ ID NO: 4227802 - RNA, 65 nt, Escherichia coli CFT073
cgcagugcugauuuacaacaugcuuuuuuacuaucucacccgcaugauuguaaguccccacuuug

SEQ ID NO: 4227803 - RNA, 55 nt, Escherichia coli CFT073
gucugaccaugguugaugagagcgguuuaaugcuacgccaacucaugcgucaggc

SEQ ID NO: 4227804 - RNA, 73 nt, Escherichia coli CFT073
ccacuggcauuaggugccgaucugguguugcauucaugcacgaaauaucugaacggucacucugacguggugg

SEQ ID NO: 4227805 - RNA, 85 nt, Escherichia coli CFT073
cccuuucaaucagcagcuacaggccguucccuggaugcaaagucguggcauucagccagaagccugggcaccguuugcggaaggg

SEQ ID NO: 4227806 - RNA, 129 nt, Escherichia coli CFT073
guguaaacgauuccacuaauuuauuccaugucacacuuuucgcaucuuuguuaugcuaugguuauuucauaccauaagccuaauggagcgaauuaugagaguucugguuaccggugguagcgguuacau

SEQ ID NO: 4227807 - RNA, 71 nt, Escherichia coli CFT073
cuguggaacggaugucgauucgcuccgugggcgugcgccaggauaccggggcguaucacaucauuccgugg

SEQ ID NO: 4227808 - RNA, 91 nt, Escherichia coli CFT073
cgaguuagcgaaagaacuugaugcagauguaguagugauugguucgcguaacccaucaauuucaacucaucuguuggguucuaacgccucg

SEQ ID NO: 4227809 - RNA, 61 nt, Escherichia coli CFT073
gguauucgcuuugcuuuuacgaucaugaacagcauagagaauaaagggcagggcaaguacc

SEQ ID NO: 4227810 - RNA, 62 nt, Escherichia coli CFT073
ccugugccaacggguuccccucacccuaaccccagaggggcgaggggaccguucguacacgg

SEQ ID NO: 4227811 - RNA, 84 nt, Escherichia coli CFT073
caauuguucaauaugcgguucaucagaugcauuugcuacagaaaaacugguaugcgauuggugaaacgccauuaaaaauaguug

SEQ ID NO: 4227812 - RNA, 58 nt, Escherichia coli CFT073
caugguuucaccgguacccuggucgauuacacgcguaccuaccgguacuuuaaucgug

SEQ ID NO: 4227813 - RNA, 93 nt, Escherichia coli CFT073
ccuggcguccggacgauaaaaccaauuucaccuuccuuucuuacuuccagaacgagccggaaacugguuauuacggcuggcugccgaaagagg

SEQ ID NO: 4227814 - RNA, 76 nt, Escherichia coli CFT073
gguagaagacucggucacucaggugauugagcaaaauaugaaugggcuugauggccugauguacaugucuucaacc

SEQ ID NO: 4227815 - RNA, 63 nt, Escherichia coli CFT073
gccacgcgcaguugcccaaagguacgcguccacuaaugcuaaauuuugaccaacagugcuggc

SEQ ID NO: 4227816 - RNA, 89 nt, Escherichia coli CFT073
aacguggaucgaugacgaucaugcgugcauuugaacguucgcgggcuugcucgacguaguaagugacaccaccgccgcucauccgcguu

SEQ ID NO: 4227817 - RNA, 55 nt, Escherichia coli CFT073
gcucugcgacgggaagcggugcuaucgccauaaacugcucaauccguugcagggc

SEQ ID NO: 4227818 - RNA, 67 nt, Escherichia coli CFT073
ggcguuuuuauccgauacagcguucaguuauagcgguaacuggcgcgcaauguuggggguucuugcu

SEQ ID NO: 4227819 - RNA, 91 nt, Escherichia coli CFT073
gcagaugaaaaccugcauucauggcgaucaggugcuggcucagccgcugggcgcugaccguaaaggucgucgugaagcgcguauuguccgc

SEQ ID NO: 4227820 - RNA, 55 nt, Escherichia coli CFT073
gccgcagaaguggcgcuguuugccuauaauagucgggcggcgcaaaucugguggc

SEQ ID NO: 4227821 - RNA, 83 nt, Escherichia coli CFT073
ggauauuggcuguggugaaggguauuacacacacgcauuugcugaugcguugcccgaaaucaccacguuuggccuggaugucu

SEQ ID NO: 4227822 - RNA, 57 nt, Escherichia coli CFT073
uuaaucgucaugguuuauggaagacgaauuagcguguuuuguaaaucagaggauuaa

SEQ ID NO: 4227823 - RNA, 71 nt, Escherichia coli CFT073
gcgccuguucguugcugauagccggugguuuaccgcucagguugccggaggucaucaccagcgggcauugc

SEQ ID NO: 4227824 - RNA, 61 nt, Escherichia coli CFT073
ucgcugauggcgcagguagcgccucgcagggaggcgaaggugcgaugcucgccgucaauga

SEQ ID NO: 4227825 - RNA, 59 nt, Escherichia coli CFT073
gaugugguucagcuuuacgccacuguggauuuaacuggauguagagcagggccaugauc

SEQ ID NO: 4227826 - RNA, 110 nt, Escherichia coli CFT073
ggaagaacgucuucaucugaaaccgcugccgcuucgucgcagugcugacuaugaugagcugacugugaggguuagccgcagcaguaccaucaaugugaagcacgucgucu

SEQ ID NO: 4227827 - RNA, 55 nt, Escherichia coli CFT073
uuguaggugcgaauuggccaauugcgaucguacauauccaguuccggcaccacag

SEQ ID NO: 4227828 - RNA, 65 nt, Escherichia coli CFT073
gccgccugaaucaaacgguucgucugcugcuugagcaugagauggggcagguguggaucagcggc

SEQ ID NO: 4227829 - RNA, 55 nt, Escherichia coli CFT073
auagggaguuaaaugauggcugagaguaauacuuccagcaucguuuauucccuau

SEQ ID NO: 4227830 - RNA, 85 nt, Escherichia coli CFT073
gcuuuugcugugcuaguuugcuuucaaaaugaaaguaaagauucucuuucuucauuuuguaaggcgaacgaccaauaacaggagc

SEQ ID NO: 4227831 - RNA, 64 nt, Escherichia coli CFT073
gaauacgaggucaacggagcggacaaccugcuggaagcuugucugucucugggccuugauauuc

SEQ ID NO: 4227832 - RNA, 130 nt, Escherichia coli CFT073
cggagccgggacguuaucccaacccgagcgcguagaaggcgcagcacguugcggcugcguuugcgccaccugugcaggggccgcgacguugcucgucacugccgcuuguggcguuugcgucaccgguuug

SEQ ID NO: 4227833 - RNA, 69 nt, Escherichia coli CFT073
ccccuuuugauuuguuaaaacaccuugcggucuggcaacugcaagugucaaacaagaaaucaaaagggg

SEQ ID NO: 4227834 - RNA, 59 nt, Escherichia coli CFT073
guugugaugggguucaccgggaaagcugcugcggcaaucaaggagagcuauaucgcagc

SEQ ID NO: 4227835 - RNA, 62 nt, Escherichia coli CFT073
gcuacggcauguacgccuagcgaaagcaaguaaucgcguuucugcucgcuaccugcuguggc

SEQ ID NO: 4227836 - RNA, 56 nt, Escherichia coli CFT073
uauugguggugcacauaacgcauauuucacccgcaauauugugguacucaccgaua

SEQ ID NO: 4227837 - RNA, 63 nt, Escherichia coli CFT073
uggugacugugaaugaaagguuauuauaaaaauaaucaucuccguucaccaguccacaaacca

SEQ ID NO: 4227838 - RNA, 70 nt, Escherichia coli CFT073
ggcugggcagagcgcgacauggcagaacuguggcaauguugcacugcugucauucgcgcccugcuuaccc

SEQ ID NO: 4227839 - RNA, 57 nt, Escherichia coli CFT073
gaaguggcagcgcagcagguuucugaucaacagcuggaaacugcccgcuuccgcuuc

SEQ ID NO: 4227840 - RNA, 66 nt, Escherichia coli CFT073
gggacaggcgugucaucagcauggagcuuaccgucagucagcacauagccaugaagcgccucuucc

SEQ ID NO: 4227841 - RNA, 85 nt, Escherichia coli CFT073
uguauuagcacaucuaaauaguauguuuguuauggaaugaguguuccgugcucauuccacauauuguuuaguauacguugaaaua

SEQ ID NO: 4227842 - RNA, 82 nt, Escherichia coli CFT073
aguggaaaauugcacagaggaaagcuguugggacuguaauuauugcauucggcccagcuuuucccucucucguagugccauu

SEQ ID NO: 4227843 - RNA, 64 nt, Escherichia coli CFT073
gagcaucggcugaugcauacugcuggcccagaaggccagccaggcuuucaucgccgcacugcuc

SEQ ID NO: 4227844 - RNA, 64 nt, Escherichia coli CFT073
uagcggacgucgacuacuggaaacuucgcuaaaacccuguggcaaccagguuggcguccagcug

SEQ ID NO: 4227845 - RNA, 56 nt, Escherichia coli CFT073
ugcaaauaguaaugagaacgacuaucaauucgacgucguuuugauauuauuaugca

SEQ ID NO: 4227846 - RNA, 64 nt, Escherichia coli CFT073
ugucagugguggcgucgguuguuuuaauaucugugcuuguaaaacagccaaugcauuauugaua

SEQ ID NO: 4227847 - RNA, 61 nt, Escherichia coli CFT073
accgccuguaugugcagaacggcguguaugaccgcuuugccgaaaaauugcagcaggcggu

SEQ ID NO: 4227848 - RNA, 72 nt, Escherichia coli CFT073
aaaauagucagaagaguaagaucaauauuucguaagguuguaaauauuugugguuuaccuucugacgauuuu

SEQ ID NO: 4227849 - RNA, 55 nt, Escherichia coli CFT073
ucaguaaucagcgucaauguuggcgguguggugguugccugacguugauuauuga

SEQ ID NO: 4227850 - RNA, 57 nt, Escherichia coli CFT073
ugcagcaugucaucugcauuuucugcaggcacaccugaaaaugucaaugacacugua

SEQ ID NO: 4227851 - RNA, 61 nt, Escherichia coli CFT073
caucauguauggcuuuacguagcugaaccaggcaaauacaccugcguugccaaacauggug

SEQ ID NO: 4227852 - RNA, 56 nt, Escherichia coli CFT073
gcacagaagugguauaugcguucucccuuacgaagccuugcauaauccuucugagc

SEQ ID NO: 4227853 - RNA, 61 nt, Escherichia coli CFT073
uggguguggcgauuauugucguacucggcacugagcugggauggugguaacgucacaucua

SEQ ID NO: 4227854 - RNA, 56 nt, Escherichia coli CFT073
uauugcuggugugaaggucuggcgguauuacugcaucugaacccacaccugcaaug

SEQ ID NO: 4227855 - RNA, 89 nt, Escherichia coli CFT073
ggacguuugcuauugccggaaugggggcguuacuggcggcaucuauucgcgcgccguuaacggggaucauucugguucuggaaaugacc

SEQ ID NO: 4227856 - RNA, 55 nt, Escherichia coli CFT073
gccacuuucugccaguaaccgcugcccuucggcagcguuauuaccggagagacgc

SEQ ID NO: 4227857 - RNA, 90 nt, Escherichia coli CFT073
cucuacgagcgucaggaagaguggaccgcaaaagcgaugcugaacauugccaauaugggcuacuucucuucugaccguacgaucaaagag

SEQ ID NO: 4227858 - RNA, 97 nt, Escherichia coli CFT073
ggagccgcucuugcugucguugccgccagugcgcuuggacuggccuuuccgguuggacgcccacugcuggcaucuacggggggcgcguuauuguucc

SEQ ID NO: 4227859 - RNA, 80 nt, Escherichia coli CFT073
uuaccagaguacgcuaccuccaggcccguucgagauaaacgauauuuauccggccgggaguggaggugacuuacagguaa

SEQ ID NO: 4227860 - RNA, 62 nt, Escherichia coli CFT073
gcuaaguuucguaaugacccacuaaugccaugggauagugggauugcagagaaacaguuagc

SEQ ID NO: 4227861 - RNA, 71 nt, Escherichia coli CFT073
agcgauuccgacuucauggagucgaguugcagacuccaauccggacuacgacgcacuuuaugagguccgcu

SEQ ID NO: 4227862 - RNA, 84 nt, Escherichia coli CFT073
guauggagacauucagggacuggugacggucgaagauauucucgaagagauugucggcgauuucaccacgucgaugucgccaac

SEQ ID NO: 4227863 - RNA, 64 nt, Escherichia coli CFT073
ugacaacguuucgcggcuauucuugaguuguuuggguucaagauuagcccccgugauguuguca

SEQ ID NO: 4227864 - RNA, 77 nt, Escherichia coli CFT073
cgugaaagaaugguuugugccuccggaaugcguaccugauccagcauccgcuucgccucgaccaucgcuucuucacg

SEQ ID NO: 4227865 - RNA, 66 nt, Escherichia coli CFT073
aaguuugccguggcaguggcgauggggacaaugaucuucaccgucggcggugcgacggucgaauuu

SEQ ID NO: 4227866 - RNA, 70 nt, Escherichia coli CFT073
uuggcgcuaucgauuacgcuauuaacggcggcauacaaccgucgcggguggugguagucgauaucgacga

SEQ ID NO: 4227867 - RNA, 56 nt, Escherichia coli CFT073
caugaugggcaugaaugucauaaccuugagugauguggcuuuucuugccgauuaug

SEQ ID NO: 4227868 - RNA, 66 nt, Escherichia coli CFT073
ugguguggugcguuccuuggcaaaguggaggcccaugcaacuacgccuuucuggcgcaccauggca

SEQ ID NO: 4227869 - RNA, 77 nt, Escherichia coli CFT073
ccacagcuggucaggucguucugccacgaacugacgguuuacgcggucgccugcggcaacggcuuuccggcugaugg

SEQ ID NO: 4227870 - RNA, 62 nt, Escherichia coli CFT073
aucaucugguugauggaacguugucgcuuaucugggcgaaaacacguuuauuaagugaugau

SEQ ID NO: 4227871 - RNA, 55 nt, Escherichia coli CFT073
guagacagccagugugcgggugaagguuuuuccugccuggacagcagcugucugc

SEQ ID NO: 4227872 - RNA, 56 nt, Escherichia coli CFT073
agggcgcugauucaucgaccagguuuauuguugcuugaugaaccacucggugcgcu

SEQ ID NO: 4227873 - RNA, 59 nt, Escherichia coli CFT073
cuggauuggcagcgcgugggucgcaucacaaaucagcagcacgcggcuagucaguuuag

SEQ ID NO: 4227874 - RNA, 59 nt, Escherichia coli CFT073
cugcgcaaaugcagguuguugauuugauuaacgugcuggucgacggcaaauuugugcag

SEQ ID NO: 4227875 - RNA, 59 nt, Escherichia coli CFT073
aaggccgcaucaucgcuugcgaucuuuuaccuauggauccuaucguugguguggacuuu

SEQ ID NO: 4227876 - RNA, 75 nt, Escherichia coli CFT073
cguuuauccucggcguuaugccgcugguuaucaguacuggugcugguuccggcgcgcagaacgcaguagguaccg

SEQ ID NO: 4227877 - RNA, 78 nt, Escherichia coli CFT073
ggccagauaaggcguuuacgccgcauccggcauuugugcucugaugccugaugcgacgcugacgcgucuuaucaugcc

SEQ ID NO: 4227878 - RNA, 87 nt, Escherichia coli CFT073
acagguucggcagcggcggcgacagggaccucagucaccaucggcugcacuuguacuucuuccuguucgcgcugcucuucaaccugu

SEQ ID NO: 4227879 - RNA, 63 nt, Escherichia coli CFT073
ucucagucugauccaucaggggauggcugcggguauucauggccugaugcgucagauugaaga

SEQ ID NO: 4227880 - RNA, 63 nt, Escherichia coli CFT073
gcggggauugguuuuauaaaccuguuuggugcagugggcggguuuauugccccgauccugcgc

SEQ ID NO: 4227881 - RNA, 60 nt, Escherichia coli CFT073
ccgggcgagcuggcuuccuggcuugcggagaaucuucagucaugaauucacuacguccgg

SEQ ID NO: 4227882 - RNA, 72 nt, Escherichia coli CFT073
uuccagccaggcagcaagugcagcucgcuggcuguuggcuagauccgggcugauuugcugaugcgccuggaa

SEQ ID NO: 4227883 - RNA, 65 nt, Escherichia coli CFT073
ccagggauaucguggcggaaugaccauucucaggggauucauucguucucucucgguuccucagg

SEQ ID NO: 4227884 - RNA, 82 nt, Escherichia coli CFT073
gaucugccagacgcuacugaaucacaggcggugagcaguaacgauaauccgccagugauuguugaagugucugguauugguc

SEQ ID NO: 4227885 - RNA, 57 nt, Escherichia coli CFT073
gcucuaacgccagcugcgaaguggaguuucaggaugccauuggcugguuguuggggc

SEQ ID NO: 4227886 - RNA, 114 nt, Escherichia coli CFT073
ggcaucgaacaagcaauccguuuuuuaagccagcaguuucguggcggcaccgaucuugccaguuguuuucgcgccauuauggaacgcuugcaaagccgggaaugguuugaugcc

SEQ ID NO: 4227887 - RNA, 66 nt, Escherichia coli CFT073
agugcuggaagucaaagacagugagaugaagaacaaaaagcaucucgcgcaauggcguuccacacu

SEQ ID NO: 4227888 - RNA, 94 nt, Escherichia coli CFT073
ucgcccagagucgguacuccgucgcuguugauaaauacuuccgccagcgaguggguauuuaucaaccgcagauuugcugcuuucguauggguga

SEQ ID NO: 4227889 - RNA, 60 nt, Escherichia coli CFT073
gguacgcagugguaucccgcgcguuugccgacgaaaacgcgaucagcaucgcggcguacc

SEQ ID NO: 4227890 - RNA, 70 nt, Escherichia coli CFT073
cgacgcggucuucguuggcguaggcacuuaccguuccaugaaagcggguuuacccaaugaagaugcgccg

SEQ ID NO: 4227891 - RNA, 63 nt, Escherichia coli CFT073
ggugagaaugugguggccaucaccaguucauuucguugagcccugacggccccgacauccauc

SEQ ID NO: 4227892 - RNA, 94 nt, Escherichia coli CFT073
ggaaaauaaaggcaauaacccauugcugguucagaguugguuagauacuggagaugauaacgcugaaccaggcaguauuacuguccccuuuacc

SEQ ID NO: 4227893 - RNA, 73 nt, Escherichia coli CFT073
caccgcugguagcugaaauggcaucgcgugcggccacgaucgcauaagaagcuuucauuucagccagcgagug

SEQ ID NO: 4227894 - RNA, 55 nt, Escherichia coli CFT073
ccaguaaucaagacaguaccaguuuagcguaugcuguacgucgugauauugcugg

SEQ ID NO: 4227895 - RNA, 76 nt, Escherichia coli CFT073
gcgaacugaaacgcuauguugagaacggugaguuucugauugaagccagcgaucucggcguggugaauaugugcgc

SEQ ID NO: 4227896 - RNA, 111 nt, Escherichia coli CFT073
uaaagcucaaaagaugcgaauauuggauggcggcacaaaagcagaugaaacggguugugccgcuucuucugguuauuaugccugcauguucaaucgcgggaaugcgcuuua

SEQ ID NO: 4227897 - RNA, 69 nt, Escherichia coli CFT073
gugcauaaagguaaucaggcagccgauuuugauaccuucggcaaaggugccuggacuuuugaauugcgc

SEQ ID NO: 4227898 - RNA, 79 nt, Escherichia coli CFT073
caucaugaacagcauggggaaugaucagauccggacuguuaaucugauuaaaucugcccguguuggcuauacaaagaug

SEQ ID NO: 4227899 - RNA, 75 nt, Escherichia coli CFT073
cguucagcgacauguacuuacuggcggcggaaaaacuuaacgugccgaucggugagaucuuacaugucggggacg

SEQ ID NO: 4227900 - RNA, 64 nt, Escherichia coli CFT073
ucugaugcuggaguuacaggaaaaacagggcauuucguauauuuauguuacccagcauaucgga

SEQ ID NO: 4227901 - RNA, 58 nt, Escherichia coli CFT073
cggcuuuucuaccgucaucguaccguauuguaacuggucgaaaccgguggagagaucg

SEQ ID NO: 4227902 - RNA, 103 nt, Escherichia coli CFT073
uagaagcccuggacggugaccgugucaaacgguucaaucagaacagccugaucuuucggcaguucgacaacaccguuaauuacgcgauuacuuguuucuucug

SEQ ID NO: 4227903 - RNA, 61 nt, Escherichia coli CFT073
uugaugccggauacaaaacauugccgaugguggugccauuguuguuuuaucacgguauuga

SEQ ID NO: 4227904 - RNA, 120 nt, Escherichia coli CFT073
guacugagauugacgguaugaauugccagacgaagaauccguuuaacuauaaagauaacagcuauguuuucgugcuugaacgugguggugccugguguuacgacuacacugucucgguac

SEQ ID NO: 4227905 - RNA, 66 nt, Escherichia coli CFT073
agcguuuuacaucugauggacgcagugaauaaucauguucugaagccccgucagguaguaaaaccu

SEQ ID NO: 4227906 - RNA, 59 nt, Escherichia coli CFT073
gcaggauaaugaauacagaggggcgaauuaucucuuggccucgcuggucguuauccugc

SEQ ID NO: 4227907 - RNA, 56 nt, Escherichia coli CFT073
agcgcgguugcccaaguucgucgguauauuccaccaacgccuuccacaacggcgcu

SEQ ID NO: 4227908 - RNA, 76 nt, Escherichia coli CFT073
ggcagauugaccguauggaccgcuuugcgcugcguuaucgcgcgcguaaguauuccagcgaacaguuccguaugcc

SEQ ID NO: 4227909 - RNA, 75 nt, Escherichia coli CFT073
acugcauuauuuguuagcuaugacggcgauugucgcuacggcggcaacguuugucauaguggcgaacccaccagu

SEQ ID NO: 4227910 - RNA, 75 nt, Escherichia coli CFT073
ggcgauugcgccgagcgucagugggaauuuuuaggucuggaaaugccgcaguggcugcucgguauuuuuaucgcu

SEQ ID NO: 4227911 - RNA, 97 nt, Escherichia coli CFT073
ucaacguucaugauucgggccauauucuuaauccgcugcuggcagaaggucagguacacggcggaaugggaaugggcauuggcugggcgcuauuuga

SEQ ID NO: 4227912 - RNA, 120 nt, Escherichia coli CFT073
ggugugcuggcaugguuaauccucgguagcaugauuucuccgguggucauggcggcaaucauggcggcgguugcaggaauuaugguggcgcucuccguugacgaauuaaugccgcucgcc

SEQ ID NO: 4227913 - RNA, 84 nt, Escherichia coli CFT073
ggaguuugauuacccggcggcgagcgcgauugccucggugauccucgcggcaucgcugcuguugcuguucucaauuaacacucu

SEQ ID NO: 4227914 - RNA, 82 nt, Escherichia coli CFT073
uuuacugucuaccuacuaucuacccucucuaccugauuuuaccugaaucagacagggagguagauacgggguagauagugga

SEQ ID NO: 4227915 - RNA, 68 nt, Escherichia coli CFT073
gugaugaccgguuuccgcguagcgcuagcuggcgcacaggauuauuacgguguggaaccggaucucac

SEQ ID NO: 4227916 - RNA, 57 nt, Escherichia coli CFT073
ugggcggcgguaacagcgaaucugucggcaagacguuuugcguugccgccugccaca

SEQ ID NO: 4227917 - RNA, 76 nt, Escherichia coli CFT073
gauuuaaugaugauguucuuaucaaugcagagcaaaucauaccgguuccugaauuggaagaauaucaaguuaaauu

SEQ ID NO: 4227918 - RNA, 63 nt, Escherichia coli CFT073
cuguuuuucaaucgcuuuuacuggggcaggaaguuccucugcgaaggcgauugcaggaagcag

SEQ ID NO: 4227919 - RNA, 79 nt, Escherichia coli CFT073
cguaaggcggucguugcugcgguugacgcacucggccugcuggaagagaucaaaccgcacgaccugaccguuccuuacg

SEQ ID NO: 4227920 - RNA, 71 nt, Escherichia coli CFT073
guguaaaucggaugaugcuguaggcgguaacgccauggcgguugccagccucgaguucaucaccccgacgc

SEQ ID NO: 4227921 - RNA, 126 nt, Escherichia coli CFT073
gauauuauuaaaugcugguuuugaaaagaguucaucggauaagguauagucacaaaauaaguaucugcuaauauuuugugauuuauuuuccagaacgucgaaccggauuugcucauuuaagauauc

SEQ ID NO: 4227922 - RNA, 65 nt, Escherichia coli CFT073
gaagcguuggucagugguuguugccguucuuacauauccgggcauucuaccuuacccaacgcuuc

SEQ ID NO: 4227923 - RNA, 61 nt, Escherichia coli CFT073
guuugucggacguaggucggauaaggcguucacgccgcauccgauaaaacauccggcacac

SEQ ID NO: 4227924 - RNA, 62 nt, Escherichia coli CFT073
gcguuugcacuaccagaccccaaauaaguccgagcaggaagggacugaaguuggucagacgc

SEQ ID NO: 4227925 - RNA, 60 nt, Escherichia coli CFT073
cgucgccgugagagcugcuaaugugcucuucagccuuacguuucgcuuccauggcucgcg

SEQ ID NO: 4227926 - RNA, 55 nt, Escherichia coli CFT073
gauauuuuacgcgcaauaacuguuuggcgcauuaguuguuugagcggaaaauauc

SEQ ID NO: 4227927 - RNA, 97 nt, Escherichia coli CFT073
ggugaaugcugaauuaaaacgcagaauuuuguccgauagugguaucgguguaccauucgcgcagacgaaaauucuuaaccuuaaucuggaauacgcc

SEQ ID NO: 4227928 - RNA, 68 nt, Escherichia coli CFT073
uacuguguauucguaagcaucauuucugcgcagucuggcagauccugaaauccuuaugaaacaaagua

SEQ ID NO: 4227929 - RNA, 70 nt, Escherichia coli CFT073
gugauggcaauugccgguucgcuggugaguaaaaagagccaacccgccagcuccggcacauugccaacgc

SEQ ID NO: 4227930 - RNA, 127 nt, Escherichia coli CFT073
cccagccggugacguucgcucacuggugccuggccuacguugagaugcuggcgcgugaugaaagccguuugcaggacgcgcuuaagcgucuggaugucagcccgcuagguuguggcgcacuggcagg

SEQ ID NO: 4227931 - RNA, 82 nt, Escherichia coli CFT073
gcaagguuaaccacaugaaaaucauuaugguaacauaugaggcuuuccaaaccaccugaucauuuucauugguuaacucggc

SEQ ID NO: 4227932 - RNA, 59 nt, Escherichia coli CFT073
ucuugcugagauugauaaacugauuaacuaaguuaucugcauuaucaguuuuagccaga

SEQ ID NO: 4227933 - RNA, 69 nt, Escherichia coli CFT073
aaacgcuuuuucgaaaggcagaaaugcgagcaccagaucgguggcucugccuauuuugaaaacgcguuu

SEQ ID NO: 4227934 - RNA, 99 nt, Escherichia coli CFT073
guagcuacuacgggaggaguugguguuaccauugcaaacuauacugccaucacagaucagacuugcaauauaaucuuuagcuucugaguaguaaacugc

SEQ ID NO: 4227935 - RNA, 107 nt, Escherichia coli CFT073
uugccggaugcgaugcugacgcaucuuauccagccuacagaacgcugcaauuuauugaauuugcaaugauuguaggccggauaaggcguucacgccgcauccggcaa

SEQ ID NO: 4227936 - RNA, 73 nt, Escherichia coli CFT073
aaggcguaauacaggcuaaaccaucggaugagguguucacgccgcauccgacaucuuuugccugaugcgucuu

SEQ ID NO: 4227937 - RNA, 55 nt, Escherichia coli CFT073
guuuaucacgcggugguugauuacuucaaagcgggcaacaccauuacggaugaac

SEQ ID NO: 4227938 - RNA, 129 nt, Escherichia coli CFT073
ugauuugcggcaguugugguucaaggagcauugccgucaguaagucgauguuaaucaucuccaugaccccagcauugcuacugcccgcugcaggcguccauugaaucaaaaccggacugccuuuuauca

SEQ ID NO: 4227939 - RNA, 66 nt, Escherichia coli CFT073
ccguaagugucgaaaauggauugccacugcggguugguuugcagcagcaaaauaucuucuguacgg

SEQ ID NO: 4227940 - RNA, 130 nt, Escherichia coli CFT073
uuuagcgguggccauuccgguaauaaaguuacgugucgcaucgcuaucuggcugacugcuuaaaaaugucccggcauuagcggcaagcgacgcgacauuuuucuccacguuauuaucagcaguuaccgua

SEQ ID NO: 4227941 - RNA, 82 nt, Escherichia coli CFT073
cgaagaacauguagaugauaugaccuuuauauacucacuauagcauuggugggauauuccagaggaggucaucauguauucg

SEQ ID NO: 4227942 - RNA, 64 nt, Escherichia coli CFT073
acuggugaaaucggcguauuaagcauauuuauugaauguauaaggcgaggcguuuucauccagu

SEQ ID NO: 4227943 - RNA, 75 nt, Escherichia coli CFT073
gcagcauucaagaaauauucguuguugcggauccaucaacagggcuucgccaggcggaauauugaaaaaugcagc

SEQ ID NO: 4227944 - RNA, 71 nt, Escherichia coli CFT073
gcggcgauaggguggauggaggugauguuuugcggauguccggcacguugaaagcguucaccuauugcugc

SEQ ID NO: 4227945 - RNA, 58 nt, Escherichia coli CFT073
cgcggcuaaugagaggcuuuacccacauagagcuggguuaggguugucauuagucgcg

SEQ ID NO: 4227946 - RNA, 77 nt, Escherichia coli CFT073
cgaucugcucgaacagaauggccguggucguguucuugucgucgauggcggagguucuguucgucgcgcacuggucg

SEQ ID NO: 4227947 - RNA, 68 nt, Escherichia coli CFT073
ggaagucauugagcccgagaucagugaucgacacuccgguuuucaggucuuccagcucaaucacuucc

SEQ ID NO: 4227948 - RNA, 55 nt, Escherichia coli CFT073
ccuggggaucugacgaccauugaugauccggcgucguuggaucagauccgccagg

SEQ ID NO: 4227949 - RNA, 71 nt, Escherichia coli CFT073
gauaggaucaccguauuauugccggauggugacgauuacacgcaauucggcaauuaauagguuacaguguc

SEQ ID NO: 4227950 - RNA, 129 nt, Escherichia coli CFT073
gcuuucuuuucgcugcauugcuugcgccacucagcaauaaaaaguucaugacgggcagcgguaucauuuuccaguuugcugacuaucggaacuuuuuugcugcccugcugaauaauaugcagcgccagc

SEQ ID NO: 4227951 - RNA, 64 nt, Escherichia coli CFT073
ugucaucguggugguagcgucaguaucgacuauuuugcuggcugcgcugacgccacugcugaca

SEQ ID NO: 4227952 - RNA, 77 nt, Escherichia coli CFT073
cugccgcaaccuguuuguuaccaggcuggaggaaaucuucuuccguuaccggcgugccaacaggcguaacgcggcgg

SEQ ID NO: 4227953 - RNA, 72 nt, Escherichia coli CFT073
cgcagacugaccauccugcgcuggaaaacgucaauuucgcccugaaacccggucagaugguagguauuugcg

SEQ ID NO: 4227954 - RNA, 86 nt, Escherichia coli CFT073
ugccggaaguuugauugggcagaaacuggcgauuaaugaguuuguugcuuaucucaauuucucgcccuaucugcaaacgagcggca

SEQ ID NO: 4227955 - RNA, 108 nt, Escherichia coli CFT073
gcuuuaucgcccaucaguggcucagcgucagaaagagaugcugaaucucucgcugcaaaagcuggaggaagcaucacuuucugcccagucauccaccaaagaagaagc

SEQ ID NO: 4227956 - RNA, 87 nt, Escherichia coli CFT073
ugccagguagaagccaguuugaucagaauacgaucguugcuaauaccugcaucguuguagaguuugaucaggcguuuugcuuucgca

SEQ ID NO: 4227957 - RNA, 73 nt, Escherichia coli CFT073
gugccgcguuaaugucgcgaucauggucugcgccgcauucagggcagugccauuuacgaacauuaagaggcau

SEQ ID NO: 4227958 - RNA, 57 nt, Escherichia coli CFT073
gcgugauaacuaucgucugguugauggcgcaucgaaagacggcugguuauucacugc

SEQ ID NO: 4227959 - RNA, 64 nt, Escherichia coli CFT073
ggcggcuuucaacgagaaucgguucgaaauuuucaccaaucaccaguucuguagaaccgccgcc

SEQ ID NO: 4227960 - RNA, 61 nt, Escherichia coli CFT073
gcgguaguuggugcccagacaaucaccagaaucauggucaacguuucacacaacaugccgc

SEQ ID NO: 4227961 - RNA, 76 nt, Escherichia coli CFT073
uccuugcuaugaacaugcaaaucaccaaaauucucaacaauaauguuguggugguuauugaugaucaacagcggga

SEQ ID NO: 4227962 - RNA, 77 nt, Escherichia coli CFT073
ugccagacgguucauuuuguagcgccagagucagaacuuccucaaugcgcuucacaggaugaauguccagaucggca

SEQ ID NO: 4227963 - RNA, 55 nt, Escherichia coli CFT073
acgggcguugauacggcuguuggcgguggcgucagcgguaucauacagcgccggu

SEQ ID NO: 4227964 - RNA, 60 nt, Escherichia coli CFT073
ugguagauaucgcgcaggaagccauacagauucagguaaucgcugaugcggugcuuauca

SEQ ID NO: 4227965 - RNA, 58 nt, Escherichia coli CFT073
acacgcagcauacugacccgcgacgaccauuuugcgcaggucaccuuuaucugccugu

SEQ ID NO: 4227966 - RNA, 56 nt, Escherichia coli CFT073
cuggaugauugaugaguguuuaugcgcgauguaugacgcaucauccgaaucaccag

SEQ ID NO: 4227967 - RNA, 95 nt, Escherichia coli CFT073
gccggucgucugccgugucguaaagagugggucgccgacugccagcagcgcaaacgcacuuugcugcgcaaaacccacuucgacaacgugccggu

SEQ ID NO: 4227968 - RNA, 59 nt, Escherichia coli CFT073
gggcugaucuuacguggaccaccguucaucagagaugugugguuuucuucgaucagucc

SEQ ID NO: 4227969 - RNA, 76 nt, Escherichia coli CFT073
guuuaaacucuucgaucgcguuguuuugcagggcuuuaaccauguccugaacaaagcgcucggagugcauauaaac

SEQ ID NO: 4227970 - RNA, 76 nt, Escherichia coli CFT073
gugcugggcgaagauuauauccgcaccgcgcgugccaaaggucuuacccggaugcgggugauuaucguccaugcgc

SEQ ID NO: 4227971 - RNA, 70 nt, Escherichia coli CFT073
gauaucaggaucguagauaaaggucagguucggugaaaccugcuucagcucugcgucugcacguaauauc

SEQ ID NO: 4227972 - RNA, 56 nt, Escherichia coli CFT073
cucugcugucggggaaucgcgugaccguuaacgccggcgauaaccugacgguagag

SEQ ID NO: 4227973 - RNA, 66 nt, Escherichia coli CFT073
gaauuuucaggaauuucgccagugcauccgccacaaaacggguauugcaaccguuuuugaggauuc

SEQ ID NO: 4227974 - RNA, 59 nt, Escherichia coli CFT073
uucggguaaucgcaacuuuggugaggcauauggccgcgccggagaugugauugcccgga

SEQ ID NO: 4227975 - RNA, 87 nt, Escherichia coli CFT073
cgaauguaggccggauaaggcguuuacgccgcauccggcaaucaacgccugaugcgucgcugucgcgucuuaucaggccuacagccg

SEQ ID NO: 4227976 - RNA, 130 nt, Escherichia coli CFT073
agcaauaauagcuccagcaagauuuuuacugagguuuuugcaauauuuagcuuuugucguuggaaaaaucgcuauuuuuuugacuuaaguuaaacaacaucccuuauugcuggcagguuauuaaacuguu

SEQ ID NO: 4227977 - RNA, 84 nt, Escherichia coli CFT073
gccuggcuuggugguuucgggaucuucgcaaguuuagcugcugccaacgcagcuugacaaagugcgggaucgccaccuucaggu

SEQ ID NO: 4227978 - RNA, 98 nt, Escherichia coli CFT073
uacguuuaucacgaugggcauuauuacuguugcuucagcagcaauguucaugcuacugaaaacaaccgaugguaauaauuugaucaaaagacagcgua

SEQ ID NO: 4227979 - RNA, 63 nt, Escherichia coli CFT073
uggcgggcgacuggugcggcugacgaucuguugauagucagaccguaaaugccucgccuguua

SEQ ID NO: 4227980 - RNA, 60 nt, Escherichia coli CFT073
aaggguauuuucgcaaaucaggaagugaacuacucuuugcacuauugcgagaauacucuu

SEQ ID NO: 4227981 - RNA, 60 nt, Escherichia coli CFT073
uagcgacccauuuugccgguucccaauauugcaccugagaaucguguaaaccggucguua

SEQ ID NO: 4227982 - RNA, 55 nt, Escherichia coli CFT073
guugaugcgcuggauuuguucgcugacgguaguuaugaauuguuuggucgucagc

SEQ ID NO: 4227983 - RNA, 56 nt, Escherichia coli CFT073
agcgaacugucgcugcuggaagagucgcuuaaggcccugccgugggacaguuugcu

SEQ ID NO: 4227984 - RNA, 74 nt, Escherichia coli CFT073
accaaucgcaguguauugcugacggaagcaggaaaacaguuucuuguagauagucggcaaauccugucuauggu

SEQ ID NO: 4227985 - RNA, 60 nt, Escherichia coli CFT073
cgauuugagugugauggccugcuuauugagggacaaagaacgaacuacaugcucaauucg

SEQ ID NO: 4227986 - RNA, 60 nt, Escherichia coli CFT073
ucuaaauuauaauguacaccauaaacuaucucuagaugauggugguacuaaugauuugga

SEQ ID NO: 4227987 - RNA, 62 nt, Escherichia coli CFT073
ucccugcgcggcaauaauuugguugaucagcgagucgauaaccgggcuuugcacgccggggg

SEQ ID NO: 4227988 - RNA, 84 nt, Escherichia coli CFT073
gccgaagugggggcuaccgacguucgcgcgcuccaggcucgugugcuggcugaaaaagcggaucucgguauugccuucgacggc

SEQ ID NO: 4227989 - RNA, 80 nt, Escherichia coli CFT073
gccuuacgcgccgcuuugaucaccaguucacacuguucaauggucagugucaguggcgguucaaugcggaucguuuuagc

SEQ ID NO: 4227990 - RNA, 60 nt, Escherichia coli CFT073
uccguuuauucuguugaucaggguguaaaacgcauucucgaacaacugaagaaaaacgga

SEQ ID NO: 4227991 - RNA, 100 nt, Escherichia coli CFT073
ugccugaugcgcuacgcuuaucaggccuacgagacuccugcaauauauugaauuugcauguuuuuguaggccggauaaggcguucacgccgcauccggca

SEQ ID NO: 4227992 - RNA, 58 nt, Escherichia coli CFT073
ucugcgguacacccgggaucaugguuuugauauucaggucaucggcaugugcagcaga

SEQ ID NO: 4227993 - RNA, 100 nt, Escherichia coli CFT073
ugcugguggcguugaagcagaggguguagguggcuuucgaaauggcgggacagaacuuuacuggcucgccgcagccaacucuucuucugacaccccggua

SEQ ID NO: 4227994 - RNA, 63 nt, Escherichia coli CFT073
ggcugguagggcugacgcaccauuacgcgggccugucguuugguaaugaagccucuacccguc

SEQ ID NO: 4227995 - RNA, 71 nt, Escherichia coli CFT073
auauuguuacuuuacuaucguuuaggugcgcugaaugaaucugcgcccugaauucugguaaaaaacauuau

SEQ ID NO: 4227996 - RNA, 55 nt, Escherichia coli CFT073
acggucugcacgguggugguggucggaauguccggcagcuccaccugcagcccgu

SEQ ID NO: 4227997 - RNA, 63 nt, Escherichia coli CFT073
cuuauccggccuacaaagucuugcuaauucaauauauugcaggggcuauguaggccugauaag

SEQ ID NO: 4227998 - RNA, 69 nt, Escherichia coli CFT073
ugcugauuucuuugcgcuuggcggucauucgcuacuggcaaugaaacuggcagcgcaguuaagucgaca

SEQ ID NO: 4227999 - RNA, 85 nt, Escherichia coli CFT073
uugcucaugguugcagacaggucguuguugaagugagaguagcucaagcuaccgucaacaaagacguuguucgcgaagugagcag

SEQ ID NO: 4228000 - RNA, 55 nt, Escherichia coli CFT073
guguuuuaucuggccuacaaugccaguacagaauuguaggccagcguaaaauuac

SEQ ID NO: 4228001 - RNA, 74 nt, Escherichia coli CFT073
ucgacacggauaaucguuugcaugaugcagccucccuaaaaaaguggcuccaucguggcggauuauugugacga

SEQ ID NO: 4228002 - RNA, 92 nt, Escherichia coli CFT073
aagaagccaguccacacaaaaaccuuacauuaacgcugguuauguuuaggguggcguauauuaagguuuuuuaugaauugugacagcuuuuu

SEQ ID NO: 4228003 - RNA, 88 nt, Escherichia coli CFT073
uugccaguuguccagcgucggcacugugcggcacucgacgccaaugguuucagcgcugacgcuguacaugccguacguuggcgggcag

SEQ ID NO: 4228004 - RNA, 70 nt, Escherichia coli CFT073
uuggugcguaugcauccgcuacccagguaggacaguugccugccuaccuggcggaugacgccauagccgg

SEQ ID NO: 4228005 - RNA, 78 nt, Escherichia coli CFT073
caggugagcagugcggcgaugaaagccuggcuggccuucugggccagcaguaugcaucagccgaugcucuaucgcuug

SEQ ID NO: 4228006 - RNA, 56 nt, Escherichia coli CFT073
cagauuagagaaaugaaaaaagcacccgacaggugcuuuucucgcguucaaguuug

SEQ ID NO: 4228007 - RNA, 119 nt, Escherichia coli CFT073
ggcccaucuuguacucaaaugcuggccugguuuggcgcugacgucauuaaaauugaacgucccagcguuggugacguaacgcgccaccagcugcgagauauuccugauaucgaugcgcu

SEQ ID NO: 4228008 - RNA, 55 nt, Escherichia coli CFT073
gauuucaccaauuaagccgaggagugauuguccgguggcguaggcaagugaaauc

SEQ ID NO: 4228009 - RNA, 59 nt, Escherichia coli CFT073
gcaggauaacgaccagcgaggccaagagauaauucgccccucuguauucauuauccugc

SEQ ID NO: 4228010 - RNA, 62 nt, Escherichia coli CFT073
gcugacgagguuucaugggcgugauuaccugauuuagguuucaaaaugauaacuucgcaagc

SEQ ID NO: 4228011 - RNA, 78 nt, Escherichia coli CFT073
ugcggcaauucagcagauacagaagguucagguugauacaaauaauaaccugaacagcaugugggcugugaagcugca

SEQ ID NO: 4228012 - RNA, 68 nt, Escherichia coli CFT073
acuggcgugccacccaugcuuugaaucaucugcaaaucaauagcaagcguggucugguguacgccggu

SEQ ID NO: 4228013 - RNA, 63 nt, Escherichia coli CFT073
gaccugugucauuuucgccgugucugggcuacggcacagaaacuggcggcagaugacgauguc

SEQ ID NO: 4228014 - RNA, 76 nt, Escherichia coli CFT073
uggccccugaaugauauguuuaccaucaucggugauguacaacacaccgcuguuagucagaacugucuucaugcca

SEQ ID NO: 4228015 - RNA, 128 nt, Escherichia coli CFT073
ugaguuugccuuuguaguauuuggugcggcgcagauggcgaaugugcuggagccagagugggcgaaaucgcugacucuggcgguggcacugucgauggcggcaacgccgauucugcuggugauccuca

SEQ ID NO: 4228016 - RNA, 130 nt, Escherichia coli CFT073
gcacugggcgguuaugggcuguuuggugucgagcuguuugucuguggugaugaggugauuuucagugaagucuccccucgcccgcaugacaccgggauggugacgcuaauuucucaggaucucucggagu

SEQ ID NO: 4228017 - RNA, 59 nt, Escherichia coli CFT073
ggaccggggcaauacugucaccaucgacuuuaugucggcggaugguauuguuccaggcc

SEQ ID NO: 4228018 - RNA, 114 nt, Escherichia coli CFT073
ggaaauuggugcuaugaucggcauugcucaguccgguuggugauuuguuuugauuuggcgauugaucagaucgcacaauccgggcugaguucccucaaagugaucuacuauucc

SEQ ID NO: 4228019 - RNA, 64 nt, Escherichia coli CFT073
gcauuaggacgcaauggcguacaugauuucauccucguucgugcuaccgcuaucguccugacgc

SEQ ID NO: 4228020 - RNA, 100 nt, Escherichia coli CFT073
gauguuauucguucuaucuucuuugguuugcugauuacgccgugggcggucuacuuucuaucgguggucgucgagcaacuggaggagucacgacaacguc

SEQ ID NO: 4228021 - RNA, 89 nt, Escherichia coli CFT073
acgugccaguucgagcacuuucggguuaucgauaaggauuucaccgauguccuggcguaaguaaucgcggaaugcgcgaacgauuacgu

SEQ ID NO: 4228022 - RNA, 73 nt, Escherichia coli CFT073
cgcgguacucggcgguacguuaggugcggcggugauuuauaucgucuccaccaacgugauugccgggauugug

SEQ ID NO: 4228023 - RNA, 62 nt, Escherichia coli CFT073
cucgcgucgucauaugcgcacccugcucaacaccaugcaggaucgcggcuggcugacguggg

SEQ ID NO: 4228024 - RNA, 127 nt, Escherichia coli CFT073
cgcauccgacaccgugcgcagaugccugaugcgacgcugacgcgucuuaucaugccuacaggccugaaccguaggucggauaaggcgcucgcgccgcauccgacaccaugcgcagaugccugaugcg

SEQ ID NO: 4228025 - RNA, 73 nt, Escherichia coli CFT073
gcuccgcaggucuuucaguuucugcuggagguugucaguguaacccucagaaagaaaggccagcucagggagu

SEQ ID NO: 4228026 - RNA, 57 nt, Escherichia coli CFT073
gcgggauugucuacaucgaugaaauugacaagauuucucguaagucagacaacccgu

SEQ ID NO: 4228027 - RNA, 62 nt, Escherichia coli CFT073
gucggaugagacacgguuguagccugauaagacgugucaggcaucgaucucuuauuuuuggc

SEQ ID NO: 4228028 - RNA, 125 nt, Escherichia coli CFT073
uauugaguggccugugaacccugucagagaguaaucauugggauuaugccgcagcacgucgugcgcaagaacgugcugcggcuggaugcuauuuuuucccugaagcggaaaacauuacuacagua

SEQ ID NO: 4228029 - RNA, 59 nt, Escherichia coli CFT073
gagcgacauugcuccguguauucacucguuggaaugaauacacagugcaguguuuauuc

SEQ ID NO: 4228030 - RNA, 81 nt, Escherichia coli CFT073
acgaccugauucaguugauacugauuuuccugaaucugaccacgcagggaaucaauaucggauugauuaucagagaguugu

SEQ ID NO: 4228031 - RNA, 99 nt, Escherichia coli CFT073
ugccggaugcggcgugaacgccuuauccggccuacaaaccguucaaauccaggagauugcagcgaacguguaggccugauaggcguagcgcaucgggca

SEQ ID NO: 4228032 - RNA, 75 nt, Escherichia coli CFT073
ccgcaaugauggccuuuuuucuggugauguggcugaucucuaucuccaguccaaaagagcugauucagauugcgg

SEQ ID NO: 4228033 - RNA, 76 nt, Escherichia coli CFT073
guguuggggacgggcgaaaagccagcguggcauuuuacaccagauguuaccgcgggauuuacgccggaaccuucgc

SEQ ID NO: 4228034 - RNA, 75 nt, Escherichia coli CFT073
cagguaggcguuccguacaucaucguguuccugaacaaaugcgacaugguugaugacgaagagcugcuggaacug

SEQ ID NO: 4228035 - RNA, 63 nt, Escherichia coli CFT073
ggaaugaugugauacgccccgguauccuggcgcacgcccacggagcgaaucgacauccguucc

SEQ ID NO: 4228036 - RNA, 92 nt, Escherichia coli CFT073
gccauuaacguuucugaccagguuccggcgaaaacgacguuguuaauggcgaccggacaacaagcuggugcacugguugaagcguugcuggu

SEQ ID NO: 4228037 - RNA, 55 nt, Escherichia coli CFT073
uauuuuuacuuuguuccugcgcaguuaucaaaagcaaaaggaauagguaaaaaua

SEQ ID NO: 4228038 - RNA, 77 nt, Escherichia coli CFT073
ucgccagugguggcuggcagugagcgaagcacuggccgaaaugcugcgugcucagccauucgccaagccaguggcga

SEQ ID NO: 4228039 - RNA, 91 nt, Escherichia coli CFT073
ucuggugagaugcccugguaugacucaaauggguugcgcuuaacuuuuagcccgcgcgauuuuauucaggucaaugcgggugugaaccaga

SEQ ID NO: 4228040 - RNA, 79 nt, Escherichia coli CFT073
aguuuacgcaggcugcguucaaggugauggauauugcucacugcgaaccucccuugccacgcaguaguugcucauaacu

SEQ ID NO: 4228041 - RNA, 90 nt, Escherichia coli CFT073
uuggcguccagguuggguuugcacgcuugucagaaacaguggucaccauugucggugucagcgugucaccaccuaacugaccaaugccga

SEQ ID NO: 4228042 - RNA, 66 nt, Escherichia coli CFT073
cgcgcuuuguaauccgcuguuuugcugacgcccggauaaugguugccgucaugcaguggaagcgug

SEQ ID NO: 4228043 - RNA, 80 nt, Escherichia coli CFT073
ccugcucaaacaacggaacguugcgguuaacgugggucggcagcagcuugcugaucggcacaucgcaguuuuccagcagg

SEQ ID NO: 4228044 - RNA, 79 nt, Escherichia coli CFT073
gcauaauugaagggauguuaauggcauuagauauccgguuagauauggauaucguugcuaauaauucuaauugauaugc

SEQ ID NO: 4228045 - RNA, 64 nt, Escherichia coli CFT073
uagauaaccguaccaccagcaucguacaugcgauaaacgccuggcuggcugguuacgguuuuua

SEQ ID NO: 4228046 - RNA, 61 nt, Escherichia coli CFT073
gguacagguacguggcaauacccucccuguaacaguaaucgucguauccacugccugugcu

SEQ ID NO: 4228047 - RNA, 60 nt, Escherichia coli CFT073
acgaaacuggacggcacggcgaaaggcgggguaauuuucucgguggcugaccaguuuggu

SEQ ID NO: 4228048 - RNA, 60 nt, Escherichia coli CFT073
gcugguuaagcguauuagccaacguaagaaagagauguuggcggcugaagcuuaauuagu

SEQ ID NO: 4228049 - RNA, 58 nt, Escherichia coli CFT073
uuuguugccacugcacauggugaaagacuuugccuuccgccugccaguaggcaaugaa

SEQ ID NO: 4228050 - RNA, 74 nt, Escherichia coli CFT073
ucgcugccaguauucauggucauauuggcgauauggacaaaggcuuugccgaugccgaugugaucauugagcga

SEQ ID NO: 4228051 - RNA, 57 nt, Escherichia coli CFT073
uggugcgugguggcgaugucugccagugcauggcagauuucuucaaaaccacgacca

SEQ ID NO: 4228052 - RNA, 70 nt, Escherichia coli CFT073
cagcuggucaggucguucugccacgaacugacgguuuacgcggucgccugcggcaacggcuuuccggcug

SEQ ID NO: 4228053 - RNA, 130 nt, Escherichia coli CFT073
ugugucgaauuagaagggcagaguggaaccaccguggccuuuuccgguauagcggcagcagaaccguugcgauuuaucugggaagugccuggcggugggcgguuaauuccgccgcuaaagauucaacgga

SEQ ID NO: 4228054 - RNA, 68 nt, Escherichia coli CFT073
guuaaugacuaacacaccggcacaaaucaacaucaugccuaugauagcuggcagguccagucguugac

SEQ ID NO: 4228055 - RNA, 61 nt, Escherichia coli CFT073
ugugcaguugacguaauucaugaaaauuaaccggucuguuaaucauuacguucacugcaca

SEQ ID NO: 4228056 - RNA, 59 nt, Escherichia coli CFT073
uuccgccagcggcacgcuuuuuucaccuucgucaguaaccaggcgcgccgucggcggag

SEQ ID NO: 4228057 - RNA, 67 nt, Escherichia coli CFT073
cugguucaauagugaagcaaucaucgaaaccacgcggauagugguacucgaaguugucuuuauccag

SEQ ID NO: 4228058 - RNA, 61 nt, Escherichia coli CFT073
ggugaccgguuugcgcggcuuuaauggcaauuucugccguuucgccaucgcggaucucucc

SEQ ID NO: 4228059 - RNA, 58 nt, Escherichia coli CFT073
gcgugcagcaagaaccguauugacggggauguguuauucagucggcagugcuacgcgc

SEQ ID NO: 4228060 - RNA, 99 nt, Escherichia coli CFT073
acgucuucaucugaaaccgcugccgcuucgucgcagugcugacuaugaugagcugacugugaggguuagccgcagcaguaccaucaaugugaagcacgu

SEQ ID NO: 4228061 - RNA, 105 nt, Escherichia coli CFT073
ggcggcguuguuuaguucgcgggaauaaacguaauugccggaugcgacgcacgaguguuacgccugccgcauccggcgauuuucaucgcuuaacccaaauccgcc

SEQ ID NO: 4228062 - RNA, 61 nt, Escherichia coli CFT073
ucccgaugcgucugcugguggcggccuccaacgagcugccggaagcagacagcagucugga

SEQ ID NO: 4228063 - RNA, 111 nt, Escherichia coli CFT073
gguacccguggagucacuguuagaggacauguacaucagguuaucgauaccguucauauucuguucgauaaccugugucaccguguccugcacuguuuucgcaucagcgcc

SEQ ID NO: 4228064 - RNA, 95 nt, Escherichia coli CFT073
cguccguuugccgguuugccggugccaucaagguuugucacgguaauaucacuguuaaauuguuuaaugguauugaccagcaugguaccuggacg

SEQ ID NO: 4228065 - RNA, 69 nt, Escherichia coli CFT073
ugcagcugucggcuuuaaccucucuuuaggcauugguuucgaagcgggcaacaagccgaaagaacugua

SEQ ID NO: 4228066 - RNA, 67 nt, Escherichia coli CFT073
cggcgguacgcugguguuugccgccgccgcgguggcgugugcguuggcaaacaccaucgaucagcug

SEQ ID NO: 4228067 - RNA, 77 nt, Escherichia coli CFT073
agggaucgaguaaguuauuaucaguagcccugauauggucagggcuacugaaacugaugacaaacgcaagauugccu

SEQ ID NO: 4228068 - RNA, 77 nt, Escherichia coli CFT073
ucgccacuggcuuggcgaauggcugagcacgcagcauuucggccagugcuucgcucacugccagccaccacuggcga

SEQ ID NO: 4228069 - RNA, 57 nt, Escherichia coli CFT073
gcguaauaccgaacaguucaacacugaaaugaguuugucgcuggaagguauuggcgc

SEQ ID NO: 4228070 - RNA, 75 nt, Escherichia coli CFT073
gaccgucgcagaugcuguauauucaggugguguagcgcuucacggcuacgaaaguacagcguuuuauaaauuguc

SEQ ID NO: 4228071 - RNA, 64 nt, Escherichia coli CFT073
cccgaugaugacagcagccggagagauuuucgauaaucgggcagucggcgcugucaucaccggg

SEQ ID NO: 4228072 - RNA, 72 nt, Escherichia coli CFT073
gcauccgggaggaugacucacuggcgcucgcccuucgggccgcugcuggcgcaacguuauccucccuggugc

SEQ ID NO: 4228073 - RNA, 58 nt, Escherichia coli CFT073
ugcaacaucugucaguacuucuggugcuucuauuuuagaggcagcugucaggugugcg

SEQ ID NO: 4228074 - RNA, 69 nt, Escherichia coli CFT073
gaugucuguuugguuucaggcgcgguuuucauucccgccucaacaaaauccgccaguugcagcagcauc

SEQ ID NO: 4228075 - RNA, 57 nt, Escherichia coli CFT073
cggguuaugcuauugacguugcugauaaaaucccagguuaugucaucagcaaauccg

SEQ ID NO: 4228076 - RNA, 102 nt, Escherichia coli CFT073
ccgcuuacauuagauauaaagcgcuugugcggcgcgugcaucgggauuugccccagcaacugugcaaaaucgugcagcaucggcgucaucauggccgagugg

SEQ ID NO: 4228077 - RNA, 69 nt, Escherichia coli CFT073
gguauuccuggugauguaucuguucuugcagaacaugcgggcaacauugauacccaccauugcuguacc

SEQ ID NO: 4228078 - RNA, 57 nt, Escherichia coli CFT073
cgguuuauaagcgccaucagugaauucacaaagcucgcucauagcgccuuuaaaccg

SEQ ID NO: 4228079 - RNA, 73 nt, Escherichia coli CFT073
ucgcgagaaacaggaugaggugaaaaagccaugauuaucuucaccuuacgccguauuuuguuauugauuguga

SEQ ID NO: 4228080 - RNA, 63 nt, Escherichia coli CFT073
cuguucuucaaccugcguaaaaccaagcagcgucugggcugguuuaaccaggaugaagucgag

SEQ ID NO: 4228081 - RNA, 61 nt, Escherichia coli CFT073
ggucacaucggagaauugcagcguaccuuucaggggauagguuugaccguucuccaugacc

SEQ ID NO: 4228082 - RNA, 65 nt, Escherichia coli CFT073
gguugggagucauugcaucgucaacuucaggagaucgauccgguugcggcagcaaggauucaucc

SEQ ID NO: 4228083 - RNA, 80 nt, Escherichia coli CFT073
uagcuucccgaccgauuucguaacgcggcugcgcgaugguugucagcggcggaucacaaaauugcgucaggucgauguua

SEQ ID NO: 4228084 - RNA, 56 nt, Escherichia coli CFT073
cuggugucggcacacaguaaaaaccugaccgguuuuuggaucaugccagacaccgg

SEQ ID NO: 4228085 - RNA, 56 nt, Escherichia coli CFT073
cgucugguuuucaaugcgcguaucagaugcaccuggugcacggacaagaaucagcg

SEQ ID NO: 4228086 - RNA, 61 nt, Escherichia coli CFT073
gcccggaaagacagaugagcacaacgguaauaaugagcgcccguuucaucucuugcugggu

SEQ ID NO: 4228087 - RNA, 92 nt, Escherichia coli CFT073
ucaugugauagaaaucgccgauaaucuguacauguuuaagaucguuuucgacgauguaacgacgagcaucggcgaggguguugaucauguga

SEQ ID NO: 4228088 - RNA, 56 nt, Escherichia coli CFT073
gccuuccaucugcggguuggugcugaacaguuucaggcccagcgcccagguggugc

SEQ ID NO: 4228089 - RNA, 65 nt, Escherichia coli CFT073
gccgcgauuuaauuacaguccagagcugucggcgagcuuucagcgggcugcaauugagcaagggc

SEQ ID NO: 4228090 - RNA, 58 nt, Escherichia coli CFT073
cuguucaucagggacuaugguggcaaccaguuguugcaggccagucuccggugcacag

SEQ ID NO: 4228091 - RNA, 68 nt, Escherichia coli CFT073
uuucaaaauggugcggaauuuuacugcaauugcugcugcuuuguaaagcaccgcggccuuuuuugaaa

SEQ ID NO: 4228092 - RNA, 92 nt, Escherichia coli CFT073
gauacgguaaccgaaccagaaccggcugaaauccuggcagaguucauucgccagcauucugcggcugggcagcugguggcgcgcgcuguguu

SEQ ID NO: 4228093 - RNA, 63 nt, Escherichia coli CFT073
gcaucagcugcgcgaucgcgggcauacggugauuaucgucacccacgauccgcagguugcugc

SEQ ID NO: 4228094 - RNA, 81 nt, Escherichia coli CFT073
gcuucgcgccugaucuuuaucgacaaaggccggauugcagaagauggcgauccgcagguguugaucaagaacccgccgagc

SEQ ID NO: 4228095 - RNA, 71 nt, Escherichia coli CFT073
ugcugauguguucugggaucugcaggacacggcaacagaugcaggucugcuuaaccagaacgacguuacca

SEQ ID NO: 4228096 - RNA, 76 nt, Escherichia coli CFT073
ugcgcuuacugaugcgucugguaguggugaguggcguaagcgaaauagccacgcugacgcaucaguucacggcgca

SEQ ID NO: 4228097 - RNA, 130 nt, Escherichia coli CFT073
acagacgaugcgcugccauucccggaugcccuguuacggcaguugccgcgucagucgggcuuuaccccgcugcgacgagccugcgugaccaugcugggcgucaccaccguggcggguaucgccgcgcugu

SEQ ID NO: 4228098 - RNA, 55 nt, Escherichia coli CFT073
cagucgguaagccugcuuuucaucuucacaggcgaugaguacgcgcuuaccacug

SEQ ID NO: 4228099 - RNA, 90 nt, Escherichia coli CFT073
gcugaaaaacuggcucuggaagcggguuugcugacacuugaggaugauuacagcaaacugcuuuccccggaguuuaaacaguucuuuagc

SEQ ID NO: 4228100 - RNA, 75 nt, Escherichia coli CFT073
aaccuguuucagggcggugaaaaugguuugaucggcgagcugacgugcagaaauauuuaccgccacucgcagguu

SEQ ID NO: 4228101 - RNA, 59 nt, Escherichia coli CFT073
uccccaggcgauaaucgacgugauggcaccggcauggugccguccauuauuaucgcgga

SEQ ID NO: 4228102 - RNA, 56 nt, Escherichia coli CFT073
guggggaaccagguucgccuucuggauauuacucagcgcgaacacuucaucuuuac

SEQ ID NO: 4228103 - RNA, 66 nt, Escherichia coli CFT073
gaugaaauccuucacgcgcugcgugaccauauuguuggucugaacugcggucguugggauuacauc

SEQ ID NO: 4228104 - RNA, 58 nt, Escherichia coli CFT073
aagcaaccagcguauggcggacuucgccgucgccgaugucucccuguucuggcugcuu

SEQ ID NO: 4228105 - RNA, 103 nt, Escherichia coli CFT073
ccggcgguugcaugugcugcguuaaugguuuacccaugcagguaggguugaauaccuuacugcgucagggaaaaccagaccgcuuguugauagagccgaccgg

SEQ ID NO: 4228106 - RNA, 76 nt, Escherichia coli CFT073
ugcgacggucuauggcuuccugaaacaguuuggucuggaaaaagagauuaaacugaauauugaagcuaaccacgcg

SEQ ID NO: 4228107 - RNA, 77 nt, Escherichia coli CFT073
cgguaauaucaaaguuggccgcaucagauuuaucaagaagaucuucgauaaagcgauggccgaccauaccguuaccg

SEQ ID NO: 4228108 - RNA, 102 nt, Escherichia coli CFT073
guuacguuuaaccuuuucuuaguuuuuguguuuuuagucguuaaccugagacaagugucuuuauguaaaaacgcaaauccggcugagauaaccuggcgugau

SEQ ID NO: 4228109 - RNA, 66 nt, Escherichia coli CFT073
cauccuugagcggacuggaugcggcaauggcaguggcuauucagcaugguucguucauugaagaug

SEQ ID NO: 4228110 - RNA, 58 nt, Escherichia coli CFT073
ugccaggcccaacccuuucauauuaaugaagguggcaaaauuugggacaaaaauggca

SEQ ID NO: 4228111 - RNA, 85 nt, Escherichia coli CFT073
acgccugcccggugccggaagguuaauugaugggguuagcggcaacgcgaagcucuugaucgaagccccgguaaacggcggccgu

SEQ ID NO: 4228112 - RNA, 61 nt, Escherichia coli CFT073
uggcgcaugaaguacguaauccguuaacggcuauucgugguuauguacagaucuugcgcca

SEQ ID NO: 4228113 - RNA, 108 nt, Escherichia coli CFT073
ccucgaucaccguaucgcccgucguaugcucggucagaugagcaaaggcaaagauuuccucaaccuguucucuuauaccggcagcgccaccgugcaugcgggauuagg

SEQ ID NO: 4228114 - RNA, 72 nt, Escherichia coli CFT073
accguggucaaggaaggcguuaucggcaacguugauaaagaacuggcugguggcgcugucuuugucagcggu

SEQ ID NO: 4228115 - RNA, 84 nt, Escherichia coli CFT073
gcugauauagugccagaacuggugauauagcggcugauccaaccccagcugcugacgcaccaguucuauaaccugcgcaucagc

SEQ ID NO: 4228116 - RNA, 56 nt, Escherichia coli CFT073
gcguggagagcacaaucugcuugccacuuccggcgagugauuuugccaucuccagc

SEQ ID NO: 4228117 - RNA, 60 nt, Escherichia coli CFT073
gaucugcguauugcaguugacgucgcucggaaaacgggggcgccgcucaauauggggauu

SEQ ID NO: 4228118 - RNA, 67 nt, Escherichia coli CFT073
uauuuaucgucugauuaugaagagcgggucagauaacuuccgugcgucuucuauucaggggauuaug

SEQ ID NO: 4228119 - RNA, 88 nt, Escherichia coli CFT073
uugccugaugcgcuacgcuuaucaggccuacggggugauucagcacuacccuguaggccggauaaggcguucacgccgcauccggcaa

SEQ ID NO: 4228120 - RNA, 58 nt, Escherichia coli CFT073
ucaguuuuucuccugaucaugaacgaauuaaccauuugaugaaucagagaaaaaguga

SEQ ID NO: 4228121 - RNA, 78 nt, Escherichia coli CFT073
guggcggugguaacgcgccgucugaaaccgcugaauguaaacggucagcagguugaaacgguggguauuccaauccac

SEQ ID NO: 4228122 - RNA, 63 nt, Escherichia coli CFT073
cuuauccggccuacaaaaaucuugccaauucaauauauugcaggaccacguaggccugauaag

SEQ ID NO: 4228123 - RNA, 84 nt, Escherichia coli CFT073
cugcgcccgcaauaaucaccugauaaccguucucuucggcgcuuucggcgaagcugaacaguuuaucgggggugcggugagcag

SEQ ID NO: 4228124 - RNA, 86 nt, Escherichia coli CFT073
auguaucaacagauucagcaggaagaugccucucaguugcggcacauuugccugacagauaugguacuucccgcugaugauggcgu

SEQ ID NO: 4228125 - RNA, 89 nt, Escherichia coli CFT073
uggcucagaccacaccgcugauaucagcacaggaugagcaugcugucuggcuucgucuguugauaacagcgauugugaucuguuugcua

SEQ ID NO: 4228126 - RNA, 63 nt, Escherichia coli CFT073
aucaaaacguugcugaugggggacgauccgaguucggucgaucucuauuccgacguugaugau

SEQ ID NO: 4228127 - RNA, 61 nt, Escherichia coli CFT073
uugucuuugcuaucagucucaagggccgcgaaagcggcccuuuuuuacuuaguagagauaa

SEQ ID NO: 4228128 - RNA, 85 nt, Escherichia coli CFT073
cgugcgggccaaucaucgaggugugcaaagacugauagccguucgcuuuuggaauggcgauauagucuuucacgcggcccggacg

SEQ ID NO: 4228129 - RNA, 55 nt, Escherichia coli CFT073
gcgcacuugaaucgcgggaucgcauuauauuacggcggucgugacaaguuagcgc

SEQ ID NO: 4228130 - RNA, 80 nt, Escherichia coli CFT073
gccugcccggugccggaagguuaauugaugggguuagcgguaacgcgaagcucuugaucgaagccccgguaaacggcggc

SEQ ID NO: 4228131 - RNA, 56 nt, Escherichia coli CFT073
ggugauugaugacgauggcuaccgcccaaacguagguaucgugauuuguaaucgcc

SEQ ID NO: 4228132 - RNA, 64 nt, Escherichia coli CFT073
aaccgguugugcacuggucgccccuuguaccagcggcguggaggguauccaggcgcagccgguu

SEQ ID NO: 4228133 - RNA, 89 nt, Escherichia coli CFT073
caugcagcgaaccggcagguguuuccagauugcuggaauaccccaugugguauuucacaucgccugaaccacugccgaucgucugcuug

SEQ ID NO: 4228134 - RNA, 74 nt, Escherichia coli CFT073
gccgcgacuacgcuggcaucacaggcgucgccuguaaaaaccuguacgccuuguugcgccaguuucguggcggc

SEQ ID NO: 4228135 - RNA, 63 nt, Escherichia coli CFT073
ggugaugccgugguuaaguacucaagcccaggcaguggugaaugguuauuuaucggcaucgcc

SEQ ID NO: 4228136 - RNA, 76 nt, Escherichia coli CFT073
gcaucacucuuucauacucgucauacuucaucgcgcauuugcaguaaggcgaaauaugacgaguaucgagucaugc

SEQ ID NO: 4228137 - RNA, 83 nt, Escherichia coli CFT073
uggcuuugauuauuauucaguuccgcagaagauugaucggccauaguggugaucucuuccugcugagcuuuguggucuugcca

SEQ ID NO: 4228138 - RNA, 73 nt, Escherichia coli CFT073
gcuuguggacguuaucagcguuaauuugcuucaguggugaaaagcguugaccuuccugauugcgaccauaggc

SEQ ID NO: 4228139 - RNA, 56 nt, Escherichia coli CFT073
uaccgauccgauucugcuaacguugauagacacauuagcgggugacggauucggua

SEQ ID NO: 4228140 - RNA, 72 nt, Escherichia coli CFT073
uauuguuaauuucuucacuuuccgcugauucggugccagacugaaaucagccuauaggaggaaaugauggua

SEQ ID NO: 4228141 - RNA, 68 nt, Escherichia coli CFT073
ccaacgcuuucucgaaaauaucgugcaugucgguaaacggcacgucuucgacuucgagaauauggugg

SEQ ID NO: 4228142 - RNA, 84 nt, Escherichia coli CFT073
uauucgcuuaaucuauuaauuugcuggaaauauuuaagggaugaaugccuugaauaaaccaucaugauuuuuagacaguggaug

SEQ ID NO: 4228143 - RNA, 66 nt, Escherichia coli CFT073
cacgaccggcguaucaucggugagaucaauaaccguuguugguuucugcccgagauagccgccgug

SEQ ID NO: 4228144 - RNA, 64 nt, Escherichia coli CFT073
guauuuuuuaucugaauguucuggauauuccaccaaauaguccagaacaagaagguaagaaugc

SEQ ID NO: 4228145 - RNA, 56 nt, Escherichia coli CFT073
gcgggcgaggcgcauagacguugcguaacgcuucaauuucaaucgcgucgcccagc

SEQ ID NO: 4228146 - RNA, 56 nt, Escherichia coli CFT073
gaguucgaauaugacauucuggcgaaacgucugcgugaguugucguuccucaacuc

SEQ ID NO: 4228147 - RNA, 78 nt, Escherichia coli CFT073
gcgugguuacgaacaugcuggcgucuacaacccggaaggggucggugguacgcacguuauguacgugcugcaucaugc

SEQ ID NO: 4228148 - RNA, 59 nt, Escherichia coli CFT073
gugcugguucuugucgaugguguucgccagggaacggauaccggacaccugaauggcac

SEQ ID NO: 4228149 - RNA, 74 nt, Escherichia coli CFT073
ucaaccacggguccagacgauuacgcaauacgguauaagacgcguguugcggaacaucugguugcucgcgguga

SEQ ID NO: 4228150 - RNA, 67 nt, Escherichia coli CFT073
ggcuuuaucuaugugaauaaacaugacgacgguacuggcgauaugucgcguucacguaagaagagcu

SEQ ID NO: 4228151 - RNA, 87 nt, Escherichia coli CFT073
aaagcccggagcaacaacguuuacaguaauaccgcgugacgcaacuucgcgcgccagugauuuacugaagccgaucaagcccgcuuu

SEQ ID NO: 4228152 - RNA, 83 nt, Escherichia coli CFT073
gccagcuguucaucggacugauguacugcaauggucggcccuucugccagaauauucagguuggcaucggucaccagcguggc

SEQ ID NO: 4228153 - RNA, 72 nt, Escherichia coli CFT073
gaugauuauguuguugauaucccgcaaaauaccuggaucgaacagccgugggauaugggcgucguauucguc

SEQ ID NO: 4228154 - RNA, 72 nt, Escherichia coli CFT073
gcgcacguaauacgcucuuuagucgguucacccgcuauagcggugagcaaacgcaaaaagccgucgcggcgu

SEQ ID NO: 4228155 - RNA, 71 nt, Escherichia coli CFT073
ugccucuuaauguucguaaauggcacugcccugaaugcggcgcagaccaugaucgcgacauuaacgcggca

SEQ ID NO: 4228156 - RNA, 62 nt, Escherichia coli CFT073
caccaacguuggggcuggauuaccgguuaucgagaaccugcaaaaucugcucaaugcuggug

SEQ ID NO: 4228157 - RNA, 59 nt, Escherichia coli CFT073
uggcggagaaguccaugccgcauggcauuugcgcuaugcaggacgugacuuuuucguca

SEQ ID NO: 4228158 - RNA, 66 nt, Escherichia coli CFT073
aaaaguggaaacagguuaucccgguguccugauuuugugcuccacuacagaacuuguaucccuuuu

SEQ ID NO: 4228159 - RNA, 63 nt, Escherichia coli CFT073
guagccagggcgucaaacagccggaugggacugagcuguaucuggcgaaugcguccuggauau

SEQ ID NO: 4228160 - RNA, 75 nt, Escherichia coli CFT073
agccacugcucauaggucagugacacauuaugacggaacacuuuuucaucgguuucaaugacuuucgcagcggcu

SEQ ID NO: 4228161 - RNA, 73 nt, Escherichia coli CFT073
caguagauguaucuuaaaauaagagguaggcuuggauauaugucuaacacuaguucuaauuuugagauugcug

SEQ ID NO: 4228162 - RNA, 67 nt, Escherichia coli CFT073
ugcugaauuuuacccugcaauuccuggaaccuuccgagcgccaggcguuacuggauaaaauuuauca

SEQ ID NO: 4228163 - RNA, 72 nt, Escherichia coli CFT073
guuaaccaaugaaaaugaucaggugguuuggaaagccucauauguuaccauaaugauuuucaugugguuaac

SEQ ID NO: 4228164 - RNA, 64 nt, Escherichia coli CFT073
caggccgaagcgaucgauaagcucgacuuugaucucuuccaguucguuuuccguuuuggcgcug

SEQ ID NO: 4228165 - RNA, 69 nt, Escherichia coli CFT073
gggguaggagccagcgaucacuuuugccaguaagcccgguugcgccagaugaucgaugccuuuuacgcc

SEQ ID NO: 4228166 - RNA, 57 nt, Escherichia coli CFT073
agucagccaguugauaaaccggaauuuuuucuucugcuggcguaucaauggcuggcu

SEQ ID NO: 4228167 - RNA, 59 nt, Escherichia coli CFT073
guaaugaccguuaugugaauauggccggcuacacugacauguucaaugacggucuggac

SEQ ID NO: 4228168 - RNA, 68 nt, Escherichia coli CFT073
uagcaugugauucaauguaagcccgggccgucuguuccaguacaccaggcucagcguuguauguguua

SEQ ID NO: 4228169 - RNA, 82 nt, Escherichia coli CFT073
gcuggucuggaaagcguugucguugucuuccggggcgauaaugcgccccugcgaauccagcucgacgcuguguuuugccagc

SEQ ID NO: 4228170 - RNA, 60 nt, Escherichia coli CFT073
gucgaucgccauaccgaugggcaaugaaggcagcguuucuugcccgguguagcgauagau

SEQ ID NO: 4228171 - RNA, 58 nt, Escherichia coli CFT073
gcugggcuguugauaaugucauuaagcaugaugccagugggcauggucagcggccugc

SEQ ID NO: 4228172 - RNA, 62 nt, Escherichia coli CFT073
cagucgcugggauuugucgucaccgcgcaaaugccgcagguaggcacuaaauuugggcgcug

SEQ ID NO: 4228173 - RNA, 85 nt, Escherichia coli CFT073
acgccugcccggugccggaagguuaauugaugggguuagcgguaacgcgaagcucuugaucgaagccccgguaaacggcggccgu

SEQ ID NO: 4228174 - RNA, 58 nt, Escherichia coli CFT073
gcaccggaggauugcguuucgguguagagguuuucgccaaugcucuccaguccggugu

SEQ ID NO: 4228175 - RNA, 130 nt, Escherichia coli CFT073
gaacguugucccucgugccuucgaacguauuggcgguacgguguuggguucgauuuuaggucuuaucgcucugcaacuggaguuaauuucguuaccgcugauguuagucuggugcgcggcggcgauguuu

SEQ ID NO: 4228176 - RNA, 66 nt, Escherichia coli CFT073
gaacauuaucaggucaugcguaccgaucagcgucgcuauuucggucacccagaccuggugauguuu

SEQ ID NO: 4228177 - RNA, 67 nt, Escherichia coli CFT073
caguccuugcugacacagcgcgcucagaauuuugucuaaggcgcuuuguugcgcaacaucaagacug

SEQ ID NO: 4228178 - RNA, 94 nt, Escherichia coli CFT073
gcacacgaaacagaccugauauacauggcucggcuaacugcuucacugcaguuucaguuuaccgguauauggggaccaacgcuguuucgugugc

SEQ ID NO: 4228179 - RNA, 68 nt, Escherichia coli CFT073
augcagcucgauaaacccuuuuucaucuggcgucgaagccauugagaacggacguuugucgcgcucau

SEQ ID NO: 4228180 - RNA, 71 nt, Escherichia coli CFT073
ccaggauccaauggcaguagauaaacuggcggaagguauccguaaguuugcuguugaccaggaaaaacugg

SEQ ID NO: 4228181 - RNA, 77 nt, Escherichia coli CFT073
ccaugcggcaauuuguuccuggcuauggaugccaggugcaccugcguauccuuuugccugggcagaaauuugcgugg

SEQ ID NO: 4228182 - RNA, 84 nt, Escherichia coli CFT073
gccagguucuccagcguuuugguguguucgccuuugcgcucuuuaaugauuggcgcgagcagcaucagacgcuugccuuccggc

SEQ ID NO: 4228183 - RNA, 86 nt, Escherichia coli CFT073
ggcgguaucgauugaggaaucguggguuccggcacauuuaauucaugauguugaugccaucgggauuucucuuuaugacuacuucc

SEQ ID NO: 4228184 - RNA, 69 nt, Escherichia coli CFT073
ugcgcugcuaucuggugagagugucgguaucgugagaacaccgccgcuccguuaucgggugguuucgca

SEQ ID NO: 4228185 - RNA, 92 nt, Escherichia coli CFT073
uuacccucgauuuucaccgcgagcaaccagauguuccgcaacacgcgucuuauaccguauugcguaaucgucuggacccgugguugauggaa

SEQ ID NO: 4228186 - RNA, 90 nt, Escherichia coli CFT073
ugccggaugcggcguaaaugccuuaucaggccuacaaauucaauaaauugcaggaaucacguaggccugauaagcguagcgcaucaggca

SEQ ID NO: 4228187 - RNA, 71 nt, Escherichia coli CFT073
gcgacaacguugucagucacuaugucuuugaagcacccgugcggauauggcacuggcugacaguguuaugc

SEQ ID NO: 4228188 - RNA, 58 nt, Escherichia coli CFT073
cauccugagacacgugcaguggguagugaaacaucaucacugcaagcuucucaggaug

SEQ ID NO: 4228189 - RNA, 58 nt, Escherichia coli CFT073
gcugauuucccagcgacaacauaggcguacguaacguuauguguugugggaaacucgc

SEQ ID NO: 4228190 - RNA, 57 nt, Escherichia coli CFT073
gauaucguuaauuggcgugacgaugauucgcucaucuuucaccagauuaaugguguc

SEQ ID NO: 4228191 - RNA, 81 nt, Escherichia coli CFT073
aggcagcucaccacuuuguuuuuguccgggaaggacgcaaccggguuaaagcccuggcagaaauaaccggugacuuuaccu

SEQ ID NO: 4228192 - RNA, 62 nt, Escherichia coli CFT073
aagcccauaucuugugcuuguggcugaucggugcgaucgccgccugcauucagaugcagcuu

SEQ ID NO: 4228193 - RNA, 68 nt, Escherichia coli CFT073
gcuggcauucugcguauuuaucuuuugcaauuuucugccauugugggguauaaaacgcggcgcgcggc

SEQ ID NO: 4228194 - RNA, 55 nt, Escherichia coli CFT073
ggcuaucccuuaauugugcaugcuguugcgacuaugcacaauuaagggauacguc

SEQ ID NO: 4228195 - RNA, 89 nt, Escherichia coli CFT073
uccguuuuccugaugauccggagauuuuuucgcagacagaggcgcagcaacuggucgcggaagagcuuguggagaagugggaaaaagga

SEQ ID NO: 4228196 - RNA, 61 nt, Escherichia coli CFT073
uccuugcggaaguuuaucuggcgaugaccgguggucaaacgucgauggcuuuugcgaugga

SEQ ID NO: 4228197 - RNA, 78 nt, Escherichia coli CFT073
ccauuccucagaccaggaccaaaacgaaaaaagacgcuuuucagcgucucuuuucuggaauuugguaccgaggacggg

SEQ ID NO: 4228198 - RNA, 85 nt, Escherichia coli CFT073
cacuuuccagaaggauuuuuucaaaucccacuacgaaggccgaagucuucacaguauauuugaaaaaggacucuaagggaaagug

SEQ ID NO: 4228199 - RNA, 71 nt, Escherichia coli CFT073
aaccauaacaaaguacggguauaucgaguugaucgacaaccuccgauaauucauauacuuguugucugguu

SEQ ID NO: 4228200 - RNA, 84 nt, Escherichia coli CFT073
auggugccuggcguugaaggggggaugacgcgccauuuaccugacagcgaugucgucucuauuuaugaugccgcaaugcgcuau

SEQ ID NO: 4228201 - RNA, 60 nt, Escherichia coli CFT073
ugguuugaguuuugagcaggcgaugaaaacucgugucuuccagccacucaaacucaauca

SEQ ID NO: 4228202 - RNA, 130 nt, Escherichia coli CFT073
agcacuggcgcucggcaucggcaccaugauuggcuggcgucguguagcgaugaccaucggugagaagauugguaagcgcggcaugacguaugcgcaaggcauggcggcacaaaugacggcggcagugucu

SEQ ID NO: 4228203 - RNA, 82 nt, Escherichia coli CFT073
uguuaauccaucucuuccgcugagguaauaccaggcagaacguuuuccugucgguagccaccagggaggauaauauuuaaua

SEQ ID NO: 4228204 - RNA, 62 nt, Escherichia coli CFT073
gcgcggcggaucugcgucugaugaugcgcgcauugagcacauucuggguggaaccgccgcgu

SEQ ID NO: 4228205 - RNA, 58 nt, Escherichia coli CFT073
cgcaguauggcuuccgggucuuccaccaguuccguggaggucugccagccguucugcg

SEQ ID NO: 4228206 - RNA, 56 nt, Escherichia coli CFT073
ugucgaucucacgcagucggugcaggauuucuugcgcaugaaagaagaggucgcca

SEQ ID NO: 4228207 - RNA, 60 nt, Escherichia coli CFT073
gggcgguuguuguugucgggaugcguugucccgggcagugugucugacacgauaaagucc

SEQ ID NO: 4228208 - RNA, 110 nt, Escherichia coli CFT073
cgauacucuguucagugguuuuaauauuuucaucacuguggcguugauuguggugaugccauuuaucacccgcaugaugaugccaaaaccgucugacguggugaguaucg

SEQ ID NO: 4228209 - RNA, 77 nt, Escherichia coli CFT073
gcugcgguacuuugcgggagagcuuaucgauaucacucauggugaagucgauuuccgcuuccugcgccgccgccagu

SEQ ID NO: 4228210 - RNA, 64 nt, Escherichia coli CFT073
ggcgcaggccgucgaugacaaaaauauguacaugcauguuuuugaagagaugacggucuaugcu

SEQ ID NO: 4228211 - RNA, 85 nt, Escherichia coli CFT073
uauuuguacgaugucgguccuuaucugauuuccagugaugaauguauucagguaaaggaguucgagaaaaauuauugugcagaua

SEQ ID NO: 4228212 - RNA, 108 nt, Escherichia coli CFT073
gcgucguuuacuuauuccggggcgucgcucaauguuggggcguaagcuauuaaacugguuuaacucccagggcuugaacgucgaaauuuugggugaguuugaugaugc

SEQ ID NO: 4228213 - RNA, 61 nt, Escherichia coli CFT073
ccaugauaccuuguuccgacagcaaagagguuaacuugcugucgcucaacgguuucgcugg

SEQ ID NO: 4228214 - RNA, 55 nt, Escherichia coli CFT073
cuugagauuaaagaagaacggcaucuugucggugccuaacuuaucaaucaucagg

SEQ ID NO: 4228215 - RNA, 65 nt, Escherichia coli CFT073
ggccuggcaugccaaaagcugggagccgaaauuauuggcacuacgcuuucuggcuauaccacgcc

SEQ ID NO: 4228216 - RNA, 83 nt, Escherichia coli CFT073
gccgcauugucguuucacuccaaccuguucaagcuacggaauugaggcauugcgcagguuuggagugauaaaaggcaguuggu

SEQ ID NO: 4228217 - RNA, 68 nt, Escherichia coli CFT073
gcgaccauggcauuuggcaacauaugacgcaggaugauacugcgaucgcugacgccaagcgccugcgc

SEQ ID NO: 4228218 - RNA, 66 nt, Escherichia coli CFT073
gccccguuuugccucgccccaauauacuuccugaguaugaugaugauggugggcaaaaauauuggc

SEQ ID NO: 4228219 - RNA, 75 nt, Escherichia coli CFT073
ggccugagaaacuuugucgcguggacccaguuccauauauuuguuuuucggcucgcccagcggaguuuccgggcc

SEQ ID NO: 4228220 - RNA, 90 nt, Escherichia coli CFT073
aguuucaugccguuguaauccaucggguuauggcuggcgguaacuucaaugccgccauccacaccgagauggaacguggcgaaauagauu

SEQ ID NO: 4228221 - RNA, 108 nt, Escherichia coli CFT073
gguaagcgacugcugggcaugacugaaccgggcaaagcauuacuggucauugcagaacgcauucugaaugaagccaguaauguucgucggcucgcagaccuguuuacc

SEQ ID NO: 4228222 - RNA, 86 nt, Escherichia coli CFT073
gggauguggcaccaguuguuguuuucguuaauuccaccauccggugaaguauagccaagacaacccaugauggugucguacagcuc

SEQ ID NO: 4228223 - RNA, 68 nt, Escherichia coli CFT073
gccgaagaaaaagucggagcauggcuggauaugacagagaaaaguaugcuaccgacugcuuuuuuggc

SEQ ID NO: 4228224 - RNA, 82 nt, Escherichia coli CFT073
ggguuggcgauacauugcguauuagcgguacgggaauguguaauauucgcacuuccgguaccuggagcgcgaaaaccaauuc

SEQ ID NO: 4228225 - RNA, 76 nt, Escherichia coli CFT073
gcguguuuaugcgcugccaucugauuaaucgacggaagcaguuccguuuggucuaugaugcaguuguccggcaggc

SEQ ID NO: 4228226 - RNA, 84 nt, Escherichia coli CFT073
agccugucauuucucggccucggugcgcagccgccgacaccagaguggggggcaaugcucaaugaggcacgagcggauaugguu

SEQ ID NO: 4228227 - RNA, 86 nt, Escherichia coli CFT073
gcgauauuccggaugcagcggcagcgccaguuuccauuccaucgccauuuuauaaacuggcgacugcugcgcagccucaauaacgc

SEQ ID NO: 4228228 - RNA, 57 nt, Escherichia coli CFT073
ugaauuuccgaaguaucucgcgccggaguuaguagcgcgaaagacaaaggaaauuua

SEQ ID NO: 4228229 - RNA, 60 nt, Escherichia coli CFT073
gugaaauugaaaucugagguuggugcuucuauagaagcaaaagcuggguuuggauuugau

SEQ ID NO: 4228230 - RNA, 118 nt, Escherichia coli CFT073
ggugcuaugcagcgagugcagccagcgccagcuuuccagcaugacaguuuggcugucguaauaagccggaucguaaaccuggaagaaacguugggcgcggccuucguuguugaucacc

SEQ ID NO: 4228231 - RNA, 111 nt, Escherichia coli CFT073
ccguucuccaucuuauuccaucagguauucuccgcgagaauguaaccagcaucaucgguaacgguguugugcugucuccggcugcgcugaugaaagagaugaaagaacugg

SEQ ID NO: 4228232 - RNA, 86 nt, Escherichia coli CFT073
ggguguuaggcggugacaauggguuacauuaugaucaaauuauuaauaauaucaccaccagcccauugaguuauuuccuggcguuc

SEQ ID NO: 4228233 - RNA, 70 nt, Escherichia coli CFT073
gucgauuucuggcagguugaggaagaaaucguaauugauuuucucuucuucgacauguuccaggcgcgac

SEQ ID NO: 4228234 - RNA, 58 nt, Escherichia coli CFT073
augucguucggcgagguggugauauugguaaauuucaccugcauuuccgaacgcacgu

SEQ ID NO: 4228235 - RNA, 56 nt, Escherichia coli CFT073
aauggaccagucuguuuauucucuucgucgccgcagggcuggcagcuggugccauu

SEQ ID NO: 4228236 - RNA, 114 nt, Escherichia coli CFT073
augcaguugcuuaaaggugcucagaauauucgcuucgcugaccaccggaauaucauccuuuucuaggcuguuguaccacugguuacgggccugagcguccauaaucgacagcau

SEQ ID NO: 4228237 - RNA, 57 nt, Escherichia coli CFT073
acgugaggaagcggugaaggggauuaccagcaucgaucuuagccgugugucucgcgu

SEQ ID NO: 4228238 - RNA, 61 nt, Escherichia coli CFT073
acuggcgucuugucguaauguuuugaguuuguugaaggcgcgggcgacggcaggagccagu

SEQ ID NO: 4228239 - RNA, 67 nt, Escherichia coli CFT073
cguggacgcggugguuuuguucguucuuccuggcaggaagugaacgaacugaucgccgcaucuaacg

SEQ ID NO: 4228240 - RNA, 61 nt, Escherichia coli CFT073
guacaggccggaacagacggaauaccgccuccguuuuuucgcgaauguucugugccugugc

SEQ ID NO: 4228241 - RNA, 71 nt, Escherichia coli CFT073
guuugccgaaacgguaaaaaaugccgugcgcagcggggugcuggagcauggcaauauuuugcccggugagc

SEQ ID NO: 4228242 - RNA, 64 nt, Escherichia coli CFT073
ggcauaucgcuggcucccgcgccaaucaaugcacgcagagauucucgcguuucagugauuugcc

SEQ ID NO: 4228243 - RNA, 66 nt, Escherichia coli CFT073
gggacuucgaucggguguucgaggucuuuuacauccagaccgcgacgcagaccgucggaggaaccc

SEQ ID NO: 4228244 - RNA, 81 nt, Escherichia coli CFT073
aacgauaccgauauggcaaucaucgacaaacgucguccgcgugcgaacguuucccaggugaugcauaucaucggugacguu

SEQ ID NO: 4228245 - RNA, 58 nt, Escherichia coli CFT073
ucaagcgaugcgccaaguuuuaacugaauauaaggaaagccggugcgcauccgcuuga

SEQ ID NO: 4228246 - RNA, 96 nt, Escherichia coli CFT073
cuuagugccgucccauuucagcaacugacgcuucggaucccacggguuacccugcggaucugcggaggcgcgguuauacagaaugcggcgguuaag

SEQ ID NO: 4228247 - RNA, 71 nt, Escherichia coli CFT073
ggguuauagagcagguuguugaugacgauauucaccuggcguuccacgccaucauucaccuguuguaacuc

SEQ ID NO: 4228248 - RNA, 111 nt, Escherichia coli CFT073
gcgcaugggccaaacauaaguuaaccggaggaggcgaauacuggcguuggguuggucagggcgugccggacauucucucuuuuggugaugaauugucgccgcaaaaugugc

SEQ ID NO: 4228249 - RNA, 59 nt, Escherichia coli CFT073
gcaggcguuugcccgugcggcaauucucucuaacgagaaauuccgcggcgugcgucugu

SEQ ID NO: 4228250 - RNA, 69 nt, Escherichia coli CFT073
ggugacuuucucguugcuuuucagacgguccugcacacguuuguugaaagcaagaaagcuuucuucauc

SEQ ID NO: 4228251 - RNA, 65 nt, Escherichia coli CFT073
uuuugaucacaguauuaucaaugacccgaaucugauccucgggcagauuauucugcugaucagag

SEQ ID NO: 4228252 - RNA, 84 nt, Escherichia coli CFT073
cucgcgcagacgauuaacgguauucguaguuaugucgguccauuuggcaaaagcgaucgcgcguuaauauuuggucuguggggg

SEQ ID NO: 4228253 - RNA, 74 nt, Escherichia coli CFT073
ggcgcuaagaaucaucauugacuguuaaaauauuauuaaaaaugucaaugggugguuuuuguuauguaaauguc

SEQ ID NO: 4228254 - RNA, 73 nt, Escherichia coli CFT073
gcuguuuuugaaucauuuuugcgauauuuucgguauuaccggugucgcugccgaaaaagaugccagugauagc

SEQ ID NO: 4228255 - RNA, 88 nt, Escherichia coli CFT073
agcaacugauuaugaaucucucagguggaaaucagcaaaaagccauucugggccgcugguuaucggaagagaugaaggucauuuugcu

SEQ ID NO: 4228256 - RNA, 84 nt, Escherichia coli CFT073
gcauggacgagauguucgcuucgguuaaaaaaaggcaccuuacgaggugccucugauaauuagcuaaguacguguuguucaugu

SEQ ID NO: 4228257 - RNA, 68 nt, Escherichia coli CFT073
cccucgacgaagcgauggcauccggucaugugaaagagcaggaucuggugcagccguuuguggaaggg

SEQ ID NO: 4228258 - RNA, 91 nt, Escherichia coli CFT073
gacgcaacagagucuuacgcaaggcauuuuuacggaugcagaaauuuuaucugccgcguaaaaagucuucguuuuaccgaccugaugcguu

SEQ ID NO: 4228259 - RNA, 63 nt, Escherichia coli CFT073
aggaguuacaguuagaaauuguaggagagaucucguuuuucgcgacaaucuggcguuuuucuu

SEQ ID NO: 4228260 - RNA, 70 nt, Escherichia coli CFT073
augccuuauccggccuacaaaguauugcaaauucaauauauugcgguucccuuguaggccugauaagcgu

SEQ ID NO: 4228261 - RNA, 66 nt, Escherichia coli CFT073
auauguccacacuccggcggaucuguucaaacucaccgcaggcaaacugaccggacuggagcguau

SEQ ID NO: 4228262 - RNA, 86 nt, Escherichia coli CFT073
gcguuauugaggcugcgcagcagucgccaguuuauaaaauggcgauggaauggaaacuggcgcugccgcugcauccggaauaucgc

SEQ ID NO: 4228263 - RNA, 63 nt, Escherichia coli CFT073
cggcgcguugaaucuccucuguauuuuuuaauaaauacagugaguccuuuaaugucagggccg

SEQ ID NO: 4228264 - RNA, 70 nt, Escherichia coli CFT073
auggcggcuucuuuaccggaaagcucggcugcauaguccugcagagcauuaacgguagggucgucuccgu

SEQ ID NO: 4228265 - RNA, 63 nt, Escherichia coli CFT073
gauuuucugcugcgucuggcucauacccuugcagagcgggguauugcucacuggcagaccguc

SEQ ID NO: 4228266 - RNA, 60 nt, Escherichia coli CFT073
gucuucgcgcauugaugauaucgaucucaaccuggaagauuucguucagcgcgugaaugc

SEQ ID NO: 4228267 - RNA, 99 nt, Escherichia coli CFT073
agugccagcgccgcgucugacccuugcuguuuauagcagaugccaacggcggcgcguucaucguuauucauuaacggcagguugauagcggcgggcauu

SEQ ID NO: 4228268 - RNA, 65 nt, Escherichia coli CFT073
cgaaggccgugaccgcgaaacuggcgaagugaaauacacagccagccgugcggaucuggucuuug

SEQ ID NO: 4228269 - RNA, 77 nt, Escherichia coli CFT073
acggcacuacuaauacagcgaccugcgcccguguuuuauguguaauauccugcaguugcugugucagugauuguugu

SEQ ID NO: 4228270 - RNA, 64 nt, Escherichia coli CFT073
accgcguuuccgguggaaaugcuugagcgcauggaugugcuuaacaguuugaccggcgcgcugu

SEQ ID NO: 4228271 - RNA, 76 nt, Escherichia coli CFT073
ucaaaguuaucgacguauuccagacggugauaauacauuuccgccaccguuuucauggcaucgucauauuuuuuga

SEQ ID NO: 4228272 - RNA, 71 nt, Escherichia coli CFT073
cggaaaccguacagaaaaaguuuggcaucuucggcgaaccgaugaugguuggcacuauucugggcauucug

SEQ ID NO: 4228273 - RNA, 72 nt, Escherichia coli CFT073
ucguuggaagucaugugccauccggcguuugucgauaauacgauucgccagagugcuuauugcuucccucgg

SEQ ID NO: 4228274 - RNA, 59 nt, Escherichia coli CFT073
cguuacccgaccgagccgcgccaugcucgaagcgaugauggccgccccgguuggggacg

SEQ ID NO: 4228275 - RNA, 60 nt, Escherichia coli CFT073
uuugccugauucgacgugcucaagcgccagcgcggugauuaccccaaacgaacaggcaag

SEQ ID NO: 4228276 - RNA, 115 nt, Escherichia coli CFT073
uuccagcgucaugcgguuuucacgcagcgccgcuuccauguccuggaacgcuuuccgcaccccacuguuuuccggcaacagguagucgcgcagagaacgaguaauggcgcuggag

SEQ ID NO: 4228277 - RNA, 116 nt, Escherichia coli CFT073
auccacuaccagcacgcguuugucgccaucuuuaauggcuggcagguaauuuugcgccaugcaguagcgagugccaugcucagucaggguuucggcaaucacgccgagguuuggau

SEQ ID NO: 4228278 - RNA, 93 nt, Escherichia coli CFT073
gacggcaaugauaugugggaugccacuuucuucugcggcucaugugcggugauucgccguaagccgcuggaugagauuggcgguauugcuguc

SEQ ID NO: 4228279 - RNA, 78 nt, Escherichia coli CFT073
cugcgcgaggcuaacaaagugugucgucggcauggucagcauaauguccugcaccaucugcggcauacuuucgcgcgg

SEQ ID NO: 4228280 - RNA, 58 nt, Escherichia coli CFT073
ccggugauguuggcgggaguggugugguuuaucgucaccugucuggcaauauuacugg

SEQ ID NO: 4228281 - RNA, 79 nt, Escherichia coli CFT073
uguaggccggauaaggcguucacgccgcauccggcaaccagcgccugaugcgccgcugucgcgucuuaucaggccuaca

SEQ ID NO: 4228282 - RNA, 58 nt, Escherichia coli CFT073
uugcuaucaaagaagcaaacaaccuggguauuccaguauuugcuaucguugauaccaa

SEQ ID NO: 4228283 - RNA, 55 nt, Escherichia coli CFT073
uggucggugcggcugcacaauauuucaucaugaccuauggcaucgucaucgaccg

SEQ ID NO: 4228284 - RNA, 57 nt, Escherichia coli CFT073
gguaaagugcuuuccuguggcaacggcggcucccauugcgacgccaugcacuuugcc

SEQ ID NO: 4228285 - RNA, 90 nt, Escherichia coli CFT073
gugcgauaaaguccuaugccaucaauacggcugcccaguuuuucuucauguuccgggcuuaaaccggcauugagcauaacuuuaaugcgc

SEQ ID NO: 4228286 - RNA, 83 nt, Escherichia coli CFT073
uugccacucggcuuugucuucaccaaguuguauaucugccugacuaucuacagcggaggugaugaugaaaguauggauggcga

SEQ ID NO: 4228287 - RNA, 93 nt, Escherichia coli CFT073
aauaacacucgcuucggccucucuugcggucugguuucccccgagcgggaaaaauucgaucaacuguugcugggggcacgggcggggauuguu

SEQ ID NO: 4228288 - RNA, 61 nt, Escherichia coli CFT073
uggcgacauguuuccggcgaaaaaacuacugauauaaaccgguuuugcugaaacaucgcua

SEQ ID NO: 4228289 - RNA, 55 nt, Escherichia coli CFT073
cguauguguuuggagagcaacuaacgcugguggacuguuaucucugcaccaugcg

SEQ ID NO: 4228290 - RNA, 64 nt, Escherichia coli CFT073
ggcuuuccaguugcucaaccagguucacuuuaccuggugcaaacagguugauaacgguagagcc

SEQ ID NO: 4228291 - RNA, 72 nt, Escherichia coli CFT073
guugccguuccccagcuggauauccgggugaaaacggacaaaacccauuaccagccuggugaacuggucaau

SEQ ID NO: 4228292 - RNA, 68 nt, Escherichia coli CFT073
aucgauaugaccaccaucuugucucugauguaucuggcauuuguggcgacaauuguugguuaugggau

SEQ ID NO: 4228293 - RNA, 69 nt, Escherichia coli CFT073
gacagaacgcgauauacguguacguugauggauauaauucaucacgccaauacgugaucgcaauucuuc

SEQ ID NO: 4228294 - RNA, 80 nt, Escherichia coli CFT073
agcugaacaauuauugcccguuuuacagcguuacggcuucgaaacgcucgaaaaacuggcaguuuuagauugauuugguu

SEQ ID NO: 4228295 - RNA, 61 nt, Escherichia coli CFT073
ggauaaucuuaauaagcaggccggacagcaucgccauccggcacuguuuugaggcuuauuu

SEQ ID NO: 4228296 - RNA, 58 nt, Escherichia coli CFT073
aagcagccagaacagggagacaucggcgacggcgaaguccgccauacgcugguugcuu

SEQ ID NO: 4228297 - RNA, 84 nt, Escherichia coli CFT073
gaccgccagauaggaaugcauccccagcucuuucaucugcuguucgccgauaacgcgggugaugacauucuugcuguagcuguc

SEQ ID NO: 4228298 - RNA, 68 nt, Escherichia coli CFT073
ugucgguauugaugagugggcguggcaucggggccaccguuacaguacguuaaucgucaaucuugaua

SEQ ID NO: 4228299 - RNA, 58 nt, Escherichia coli CFT073
gaugcgucuuauuuacgccccaaccaccuucgccaccgcgugggcgaaacgaugcauc

SEQ ID NO: 4228300 - RNA, 63 nt, Escherichia coli CFT073
gcagaugcagcgcgaugcccgucagcaggcguuugcccugacggaaguggugcagcgucgugc

SEQ ID NO: 4228301 - RNA, 56 nt, Escherichia coli CFT073
gggucacagacuccgcuggaagaaagcaauggcuucuucgguaaaucugcugaacc

SEQ ID NO: 4228302 - RNA, 64 nt, Escherichia coli CFT073
gaucaacaagaacaugcugcuauggaucaaugacgcucugauggcgguauuuuuccuguugguu

SEQ ID NO: 4228303 - RNA, 108 nt, Escherichia coli CFT073
gguuuugaauaaacgcuuuacuauucucaugaaaacaguguuauguuguuauuuuaacaaccccgcauuguuuuuugaugggauggguauuaagacuuuagagaaacu

SEQ ID NO: 4228304 - RNA, 65 nt, Escherichia coli CFT073
guauuacucagcaucgauuucaacugcgucugaaucguucgcagcguggagucgccgaguagugc

SEQ ID NO: 4228305 - RNA, 72 nt, Escherichia coli CFT073
cuuauccgcaaagacgguuuucgcuucugggguucccgcugucugagugaugauccgcuuuuugccuuugag

SEQ ID NO: 4228306 - RNA, 75 nt, Escherichia coli CFT073
guacggaaaauguguaauaagccguagcguggacaauaccgccgauaauacaggcaguugcguagauuucuguac

SEQ ID NO: 4228307 - RNA, 92 nt, Escherichia coli CFT073
gcugguagauaucacugaggaugucguuaucagaagcuuccacccauuuggucagcuccaugagaaugucaucuucagugacaacaccgugc

SEQ ID NO: 4228308 - RNA, 79 nt, Escherichia coli CFT073
ucgaaucuuuucaggcaaaugccaguaaaaacugcuucauagcgcggauuuuuacuggcguuugccuggagucaagcga

SEQ ID NO: 4228309 - RNA, 67 nt, Escherichia coli CFT073
auguuaauucugcgacgauuaccagucaggagauaccugaaggucaggucauggucgcacaagacau

SEQ ID NO: 4228310 - RNA, 60 nt, Escherichia coli CFT073
gugguauugaugcucagucugcugaucaaucuauugauuuuggacaaguaucaaaauuau

SEQ ID NO: 4228311 - RNA, 55 nt, Escherichia coli CFT073
cguaccggcaucaaggacgacggaaucccccgcuuugaccauugacgccgcugcg

SEQ ID NO: 4228312 - RNA, 63 nt, Escherichia coli CFT073
gguguuuuucagaaagaaugugaugaagugaaaaauuugcaucacaaaccugaaaagaaaucc

SEQ ID NO: 4228313 - RNA, 59 nt, Escherichia coli CFT073
ccagcaaacaagugcuccaggguauggaucccucuuucuggcaucacuucuuuguucgg

SEQ ID NO: 4228314 - RNA, 66 nt, Escherichia coli CFT073
ggcagaaagacgggcgccgccgaccuguaacaguuucagcgaggcaagcugcgcccggcuuucgcc

SEQ ID NO: 4228315 - RNA, 75 nt, Escherichia coli CFT073
gcguucugcggguauucaggcguucgauaccgucuauuccgacgcuaacaacgaagccggauuccugcaagaagc

SEQ ID NO: 4228316 - RNA, 78 nt, Escherichia coli CFT073
cgggaagaguugcacugaagcugaguaauaacgguacugaucguuaucgcgauaguucaggcucagcuccccuucccg

SEQ ID NO: 4228317 - RNA, 58 nt, Escherichia coli CFT073
uccguucguuggugaccggcgaccgcguagucuggcguccggguaaaccagcggcgga

SEQ ID NO: 4228318 - RNA, 63 nt, Escherichia coli CFT073
augugugaagcaacagccgccacaaaagguguaugacucgguggugucguuugccuucaacgu

SEQ ID NO: 4228319 - RNA, 63 nt, Escherichia coli CFT073
uucuucaccauuugagcagugaggagggggacauuuccccuuacacugcagaaauggggagag

SEQ ID NO: 4228320 - RNA, 84 nt, Escherichia coli CFT073
guaggccagauaaggcguucacgccgcaucuggcauuuugcuuucaaugccugaugcgacgcuggcgcgucuuaucaggccuac

SEQ ID NO: 4228321 - RNA, 56 nt, Escherichia coli CFT073
gcgcugaugugggcaguacuggcguuuuugcucaacuacgugcccaauaucggugc

SEQ ID NO: 4228322 - RNA, 83 nt, Escherichia coli CFT073
ugaaugauuuuacgcauugcucaccucucaacacugguaaaguauacaguaauuucagggguugagaaaugcguaaagauuca

SEQ ID NO: 4228323 - RNA, 83 nt, Escherichia coli CFT073
gagcaccaucgcugauugcuuucuuucacggccacuuugccaguaugugcccguuucgauggcgguacagcgguuuuucgcuc

SEQ ID NO: 4228324 - RNA, 68 nt, Escherichia coli CFT073
uucggaucgaugaacuguaggcugcugcgguuaucuaaaucgccaaccugcaguuuauagucaccgga

SEQ ID NO: 4228325 - RNA, 84 nt, Escherichia coli CFT073
uauccgacauuucugcugccuacacaaugccugaugcgcuucgcuuaucaggcauuguguagggcagcguugccaucucggaua

SEQ ID NO: 4228326 - RNA, 56 nt, Escherichia coli CFT073
uuaugcaguucuucuuccgaccagacuguuccugucggguuaugaggauuacauaa

SEQ ID NO: 4228327 - RNA, 83 nt, Escherichia coli CFT073
gcucuaggaauauuuaaagauuccuuuguugcucuaaucugucuauuggagguugcuacaagaucuuuuauauuucuauaagc

SEQ ID NO: 4228328 - RNA, 75 nt, Escherichia coli CFT073
ggugcuuaugguaauacugcgaugauuauccagaaagguucugguaauaaagcaaauauuacacaguaugguacu

SEQ ID NO: 4228329 - RNA, 82 nt, Escherichia coli CFT073
ccaauguauaggccaacuggaaugcacugacaauccaugaauauuguucuuugguuauuccgguugucuccauaaucguugg

SEQ ID NO: 4228330 - RNA, 77 nt, Escherichia coli CFT073
gcgaagcacuguacgaugcguauccugauauugauccgaaaacgguucgauucaccgauaugcaucaguggauuugc

SEQ ID NO: 4228331 - RNA, 62 nt, Escherichia coli CFT073
cccgcuggcgagcuuguauuacuuuggucgcccgguagaagaauugagccucgaucagcagg

SEQ ID NO: 4228332 - RNA, 89 nt, Escherichia coli CFT073
agcguaccgccagugucgaucauaucaucgaccaguacgcagucacgaccugcaacgucaccgaugauaugcaucaccugggaaacguu

SEQ ID NO: 4228333 - RNA, 61 nt, Escherichia coli CFT073
guucaccgaaagauaaguauaucguucgugacgauaccacucgcgauacuuucuggugggc

SEQ ID NO: 4228334 - RNA, 71 nt, Escherichia coli CFT073
gccugcuggggcugacugccacgccuuuucgacugggcaaaggcuggauuuaucaguuccauuaucacggc

SEQ ID NO: 4228335 - RNA, 81 nt, Escherichia coli CFT073
ucugcaagguuucagguugcauuuccugcggauagauuggcccgauaaugccguagcgguugcggcuuggcaccauguaga

SEQ ID NO: 4228336 - RNA, 57 nt, Escherichia coli CFT073
gcugaauguugaaaaugcgcgccacaucauugcggcgcguuuccacaacguuacagc

SEQ ID NO: 4228337 - RNA, 65 nt, Escherichia coli CFT073
ugaaggcuguuccgcuccggugcgugacagcuaucaguuacacgcggcggugguggaagucauca

SEQ ID NO: 4228338 - RNA, 57 nt, Escherichia coli CFT073
uucgcuauuaucggcguaauuuguuuuauaugcuaaacaagauagucgaauggugga

SEQ ID NO: 4228339 - RNA, 83 nt, Escherichia coli CFT073
ccaaaugcagggauagccauaauaugccucuuuuaaugcuauuuucguuaacugaggugauuaugggcuucagacuguugugg

SEQ ID NO: 4228340 - RNA, 56 nt, Escherichia coli CFT073
uucuggcagugaucgucccugcucuguuaguagcagguacugcaaacgcugcagaa

SEQ ID NO: 4228341 - RNA, 130 nt, Escherichia coli CFT073
uaacguuuuuggaucaacaacagucccugacauuuguugguaugucguaucacuuaaaguguaaaagcccuggguugaauaacgauagccaauaauauggaaugcuguuccugucugaacuaacgauuug

SEQ ID NO: 4228342 - RNA, 68 nt, Escherichia coli CFT073
gccaugaugcugggugcggugcugcaaauuaccaacguuuuuggcaacccguuccugcaugauuucgc

SEQ ID NO: 4228343 - RNA, 75 nt, Escherichia coli CFT073
ggagcagaacagguuacggucgccguaaacaucauccagacguuucacggucggccaguauuugucugccacacc

SEQ ID NO: 4228344 - RNA, 60 nt, Escherichia coli CFT073
cguauacguaaccuuaccugucguucuguuuuaaaacggcaugagguugucacguacuug

SEQ ID NO: 4228345 - RNA, 105 nt, Escherichia coli CFT073
acccuuucaucaguucggguaaauacucaaacauuagcugggccuccgcucaaaacgugucgcgcgcaggucaaugcguuugagaauguacugacugagcagggu

SEQ ID NO: 4228346 - RNA, 61 nt, Escherichia coli CFT073
gcugcugggaugcgcuguacaguaagcgugcugaucuggucuacggugcuccucaugcagu

SEQ ID NO: 4228347 - RNA, 55 nt, Escherichia coli CFT073
guguuugguaucguuauuguuaacgcggcgcguucucguggcguuaccgaagcgc

SEQ ID NO: 4228348 - RNA, 57 nt, Escherichia coli CFT073
cgucauccuggugguuuucaccugauaaacgcagcagcugaaaggcgcuggaugacg

SEQ ID NO: 4228349 - RNA, 65 nt, Escherichia coli CFT073
agggcguauccgggcagaagauccugcccaggcguaccgugauucuuuggccugggugcguaccu

SEQ ID NO: 4228350 - RNA, 92 nt, Escherichia coli CFT073
gggcagcgaauucgugauguucgcacuggacccgacgguuauuuauacguucucaccgacgaguccaguggggaauuacuuaaaguuagccc

SEQ ID NO: 4228351 - RNA, 82 nt, Escherichia coli CFT073
uaggugcgacccgcguaauuuauccggcagggcaaaaacaagugcaacuugccgugacaaauaaugaugaaaauagcaccua

SEQ ID NO: 4228352 - RNA, 83 nt, Escherichia coli CFT073
guaguuuacgcaggcugcguucaaggugauggauauugcucacugcgaaccucccuugccacgcaguaguugcucauaacugc

SEQ ID NO: 4228353 - RNA, 84 nt, Escherichia coli CFT073
gaugccggucaggaaguggaguacuucaacaucacgcuugauaacgucaagcuggucagagucgcuccgcuuaugcacgacauc

SEQ ID NO: 4228354 - RNA, 101 nt, Escherichia coli CFT073
cuaccacuucgaagcgucaaaaggucuggcugaugaugaccacuuugucggucuggcuaucgacgaagaucgucagccggaacugaccgcugaacguguag

SEQ ID NO: 4228355 - RNA, 59 nt, Escherichia coli CFT073
gcauaaguuguaucacuuccgucuggaauggagccacuggagcuggaugcggguugugc

SEQ ID NO: 4228356 - RNA, 73 nt, Escherichia coli CFT073
ggugauugaacgcacgcuugaagaugauguugaaguuauugaacucucuguuccagccgugcucugcgucacc

SEQ ID NO: 4228357 - RNA, 66 nt, Escherichia coli CFT073
gccuguaauuaaaaccuggcucauauugccuccccccgguauguguacucauguuuaacuauaggu

SEQ ID NO: 4228358 - RNA, 59 nt, Escherichia coli CFT073
gcgagaaacaggaugaggugaaaaagccaugauuaucuucaccuuacgccguauuuugu

SEQ ID NO: 4228359 - RNA, 113 nt, Escherichia coli CFT073
ggcgguuuugaaucauaccaggaacgcguggaagggaauaaaguucgcgagcgcaguccaucguuuggcgaauauuauucccauccgcgucuguucuggcuaagucagacgcc

SEQ ID NO: 4228360 - RNA, 64 nt, Escherichia coli CFT073
auuugcguuugacuuccgccaugaccgcuucgguauuguccguggagccgucguuaacgcaaau

SEQ ID NO: 4228361 - RNA, 81 nt, Escherichia coli CFT073
acguuauacgcugguuuauuuugauaccguugaugagaucaaagaucgggugaauugauuaaagauaagccagauggacgu

SEQ ID NO: 4228362 - RNA, 129 nt, Escherichia coli CFT073
gcgccagauacagcuuaauggcgguauagagaacguugaugucaucagccagcuuacgcagcucuuucuccugccguggcucgccgugcaucacuuuauucaacccuuccaucaucuguuccauggcgu

SEQ ID NO: 4228363 - RNA, 72 nt, Escherichia coli CFT073
uccugugccaauugcuucuuaccugcugaaugaaaaacguucugcgguaaaugcgauugaaacucgucagga

SEQ ID NO: 4228364 - RNA, 57 nt, Escherichia coli CFT073
agcgccgcaaaauacccuguucugacagaaaguaguugaucaaguguaugcggcguu

SEQ ID NO: 4228365 - RNA, 56 nt, Escherichia coli CFT073
gcagaugauguucucucccguugauaucucccggcgggaaccagaaaucgucgcgc

SEQ ID NO: 4228366 - RNA, 63 nt, Escherichia coli CFT073
cugggagcgggggaucaugaugucgcgaacgcguuggucugcgauguccaucaccccuucgag

SEQ ID NO: 4228367 - RNA, 83 nt, Escherichia coli CFT073
gcaguuccuguaaucguacgcaccaaaacgagcgggucaguuuacuggcccgcuuuuuuuaugcgucauuauugcugaagugc

SEQ ID NO: 4228368 - RNA, 69 nt, Escherichia coli CFT073
gccgucaaauuuaaucagcgucuguuuacccugccagccgucgcugagggugaaaauacguugauaggc

SEQ ID NO: 4228369 - RNA, 69 nt, Escherichia coli CFT073
gcggcauaggaggccucggugcagaaugucaggaacggaaaauagacugcaagguauuuuugugcucgc

SEQ ID NO: 4228370 - RNA, 60 nt, Escherichia coli CFT073
uuguuccagacaacaaucuguuuuauucaauggguaugauagacacaggcuuuggaacga

SEQ ID NO: 4228371 - RNA, 87 nt, Escherichia coli CFT073
uggaucgcuugacuccaggcaaacgccaguaaaaauccgcgcuaugaagcaguuuuuacuggcauuugccugaaaagauucgauuca

SEQ ID NO: 4228372 - RNA, 129 nt, Escherichia coli CFT073
gauaaucuguucgggauugauuucaugcccgcuguuuacgcuaacugcugcgacuuucucuaugcgcggcaggcucuggcgaaacagggggauccuuuuugcaaucaucgagguuccgacaauguuauc

SEQ ID NO: 4228373 - RNA, 105 nt, Escherichia coli CFT073
cgaaccaugaacacgucugccugcugggcuguggcgugaccaccgguauuggcgcgguacacaacacagcuaaaguccagccaggugauucuguugccguguuug

SEQ ID NO: 4228374 - RNA, 90 nt, Escherichia coli CFT073
ccggggccagcagaccgcucuuuucgcccgcuuuuaccaggguacgguagagcgaaucgaaaagcgugggaaaauguuguaacgcaucgg

SEQ ID NO: 4228375 - RNA, 61 nt, Escherichia coli CFT073
guaagcggauugagauguggacugaauaucuacaguccacaucaagaucguguccgguuau

SEQ ID NO: 4228376 - RNA, 119 nt, Escherichia coli CFT073
ggaguuuaaugaugucgcuuacuggccgcagaucaaacaggugcuggaguggucgaaagaucacgucaccucgacgcuguuugucugcugggcuguacaggccgcgcucaauauccucu

SEQ ID NO: 4228377 - RNA, 76 nt, Escherichia coli CFT073
gggggcgaggacgcuggcaggugcguuaaucaauugauucugcacauugauuuccugaaaguugucuauuguuccc

SEQ ID NO: 4228378 - RNA, 56 nt, Escherichia coli CFT073
uuucagguauuuuuacgccucugaucgguuugauggcggcaaccgggauccugaaa

SEQ ID NO: 4228379 - RNA, 57 nt, Escherichia coli CFT073
guggggcggguaugaaucguugauccuggcaaaucaaccagaacauaucgccgccau

SEQ ID NO: 4228380 - RNA, 70 nt, Escherichia coli CFT073
ucuauucauuaucucaaucaggccggguuugcuuuuaugcagcccggcuuuuuuaugaagaaaauaugga

SEQ ID NO: 4228381 - RNA, 57 nt, Escherichia coli CFT073
gauauugaugagcgugagguuaucgcccugccagcgauacucucgcgucgugguauc

SEQ ID NO: 4228382 - RNA, 61 nt, Escherichia coli CFT073
uccuccuuucagagugcuccgcuucucacuauuaucucacgcaguauucuuaagggaagga

SEQ ID NO: 4228383 - RNA, 95 nt, Escherichia coli CFT073
cuuccuggcagaauuuaauguacuucuucaccccguucggaaacuuaauguaguuuccuucguugauggaguagguuuugccuuucuccgggaag

SEQ ID NO: 4228384 - RNA, 76 nt, Escherichia coli CFT073
agacggcuguaugcacugugaagauccgggcugccugaaggcgugcccgucugcuggugcaaucauucaguacgcu

SEQ ID NO: 4228385 - RNA, 68 nt, Escherichia coli CFT073
guugaagaauuaggugaguucgcugguguuccgguauggaacggacugaccaaugaauuucacccgac

SEQ ID NO: 4228386 - RNA, 90 nt, Escherichia coli CFT073
uuucgcgcugggaaaaguuggauaauuuuauuaaucgcccagugaaacuuaucauuggugauaaagaaauauuuggcauuucacgcggaa

SEQ ID NO: 4228387 - RNA, 84 nt, Escherichia coli CFT073
uggcaaucgggggaacugggaggccaguggcaagaaaguaaaucacuuuuuuaccacuggccuucugcuuucagacgcuuguua

SEQ ID NO: 4228388 - RNA, 69 nt, Escherichia coli CFT073
gauaaauuacacaccugugaugccguauuaaguggcuaucugggaucggcggagcagggugaacauauc

SEQ ID NO: 4228389 - RNA, 98 nt, Escherichia coli CFT073
cgccaucagaaucccuucaaugugaucuuugucuucgcuaaucaccgggaaacgugagugggcggacucaaugaugacaucaaggcauucguccagcg

SEQ ID NO: 4228390 - RNA, 81 nt, Escherichia coli CFT073
cuuucccuuagaguccuuuuucaaauauacugugaagacuucggccuucguagugggauuugaaaaaauccuucuggaaag

SEQ ID NO: 4228391 - RNA, 60 nt, Escherichia coli CFT073
auccguuuccagucgccgcucugucaucucuucggcaagauugguguagugaaacaggau

SEQ ID NO: 4228392 - RNA, 60 nt, Escherichia coli CFT073
cgaagcgcugggccugucgcagccgggcaacggcucgcugcuggcaacccacgcugaucg

SEQ ID NO: 4228393 - RNA, 87 nt, Escherichia coli CFT073
gcagauccaucuguuaccguuucaucaguacggcgagccgaaauaccgccugcuggggaaaacauggucgaugaaagagguuucugc

SEQ ID NO: 4228394 - RNA, 75 nt, Escherichia coli CFT073
cgccgcccagccacauguucccgcuuugggcgauauacagcagaaucgcgcuaagcggugcaguggugcauggug

SEQ ID NO: 4228395 - RNA, 79 nt, Escherichia coli CFT073
caccggguugaccaaugugauuauagccaucgcccugucgcacugggcgugguaugcacgcauggugcguagccuggug

SEQ ID NO: 4228396 - RNA, 61 nt, Escherichia coli CFT073
ucaccguaugggucgcgguaccaggcauaaucugcaucaggccgcuggccccuaccgguga

SEQ ID NO: 4228397 - RNA, 85 nt, Escherichia coli CFT073
cgcccgcuggaaagaucguuuugccgagaagcacggcgugaagcugggcuuuauguccuucuuuguuaaggccguuacccgggcg

SEQ ID NO: 4228398 - RNA, 59 nt, Escherichia coli CFT073
ucaccagguugaagcguggccguuagcugagcaauggcguugguuaacaaccuggcugg

SEQ ID NO: 4228399 - RNA, 101 nt, Escherichia coli CFT073
auguuucaaaugcacaaaacuuuuauacucuaagaaaucaggauugcaccaguacaagcagccugauguuugacgaguauuuaacuuguuaugaauaacau

SEQ ID NO: 4228400 - RNA, 72 nt, Escherichia coli CFT073
aaaggccaucauugcggucauaaagucggcauaagcaaucuuccacgauccaugugcugccccguggcuuuu

SEQ ID NO: 4228401 - RNA, 56 nt, Escherichia coli CFT073
ggaaguugaugaucauaugcucgccgcgcugggcugcauggcuguuaucaucuucc

SEQ ID NO: 4228402 - RNA, 56 nt, Escherichia coli CFT073
gcaggaguuggcgaugaaugaccgugacuuuaugcguuauagccgccaaauccugc

SEQ ID NO: 4228403 - RNA, 64 nt, Escherichia coli CFT073
gacguggcucaucgcuuucguuguguccgugcuuacggaagcagcaaauaucgaugaugauguc

SEQ ID NO: 4228404 - RNA, 60 nt, Escherichia coli CFT073
cagcaggaaaaaccgauuuagcgcgcgauaugcugcaaauguuacucgauuuccugccug

SEQ ID NO: 4228405 - RNA, 63 nt, Escherichia coli CFT073
gccugaugaucgagaaucgcuaugagcauaaucugacuucaucgcuuuucuggauuauuuggu

SEQ ID NO: 4228406 - RNA, 57 nt, Escherichia coli CFT073
gccgcagacaacgacuuauugcgcuuuaaaggcgugcaaucgguucguugcuuuggu

SEQ ID NO: 4228407 - RNA, 59 nt, Escherichia coli CFT073
uuuuccgguuaucaacuggccucgcccugcggcgaauuguuaguggaauggcuggaaaa

SEQ ID NO: 4228408 - RNA, 61 nt, Escherichia coli CFT073
gcugacagguuugccauccagcaagauuucgccgcuuugugguugguacaagcccgucagc

SEQ ID NO: 4228409 - RNA, 67 nt, Escherichia coli CFT073
ucggugucuucuucucacgcuuuuacguugguaaagggcgaaaccgggaagaggaaaacgacgcuga

SEQ ID NO: 4228410 - RNA, 58 nt, Escherichia coli CFT073
cguugaugucaucggcacagagaagcagcaaauuauucaucuggaauaugcaucagcg

SEQ ID NO: 4228411 - RNA, 58 nt, Escherichia coli CFT073
gaugauguugcauuucagauuaucaaugaugaauuauaucuugauggcaacgcucguc

SEQ ID NO: 4228412 - RNA, 111 nt, Escherichia coli CFT073
gagcaauuagucucaauuugcaaacgcuaacugaaugcagaauaggucagacaucaaugucugguuuauucugcauuuuuuauugaauguagaauuuuauucugaauguuu

SEQ ID NO: 4228413 - RNA, 82 nt, Escherichia coli CFT073
ggguuauucaggggauaggcggcgcaaugaugaugccuguugcucggcuggccuuacugcgcgcuuauccucguaaugagcu

SEQ ID NO: 4228414 - RNA, 67 nt, Escherichia coli CFT073
auaguaagguuguucacuguaaggguuguaaacuucccauuaucaccaguaaaacgcaccauacugu

SEQ ID NO: 4228415 - RNA, 55 nt, Escherichia coli CFT073
cguugugaagaaguuggcugccagaaucauggcaaugccgaagucgcucauagcg

SEQ ID NO: 4228416 - RNA, 66 nt, Escherichia coli CFT073
guaucgugcagcaaaacugcgcauuuacgaaaacgcaaaaguuugcgugguuaaugcugaugaugc

SEQ ID NO: 4228417 - RNA, 63 nt, Escherichia coli CFT073
ggcagacgaugaugcagauaaccagagcggagauaaucgcgguuacucuguucauugcugacc

SEQ ID NO: 4228418 - RNA, 114 nt, Escherichia coli CFT073
ccgcgcgcguuugcccgaacgaacaguaaacaggcggccaaugugucacuguggguuaguagcuuugugaugcaggcggccauguuacuuguuuauuuuucaaauaaugcuugg

SEQ ID NO: 4228419 - RNA, 63 nt, Escherichia coli CFT073
gccgagcagcaacgcuggcuggagcaccgccgccaggucuucacgccagaguuuuugcagggc

SEQ ID NO: 4228420 - RNA, 80 nt, Escherichia coli CFT073
agggcuggacagcaauaacguuauucggccguucacaccauacguggugaugcggauggguaaugucccgcuggugcccu

SEQ ID NO: 4228421 - RNA, 66 nt, Escherichia coli CFT073
guucggugcuuauguauugcgaaugaaccgcgcacuguuguucggcgcaaugaugggcgcacgcac

SEQ ID NO: 4228422 - RNA, 70 nt, Escherichia coli CFT073
gaugguugacggccuugaucuaaucgccuggguuauggauucugccagugaggucgaugccgagaucauc

SEQ ID NO: 4228423 - RNA, 69 nt, Escherichia coli CFT073
uugcguugguagguuugugcauuugccggaucguauuuuaucaacgcaucacgaauauuaucgacguaa

SEQ ID NO: 4228424 - RNA, 87 nt, Escherichia coli CFT073
ccaaccacauaagcugugggaugcaaugccgaagcaaccgucucaggaggagcuucgagauugcaucgccaaaguuuauucgggagg

SEQ ID NO: 4228425 - RNA, 76 nt, Escherichia coli CFT073
acuggucauauccgcucuguucauugauugcgaugggacucacgccgcugauuagugcagaguggaacuggcgggu

SEQ ID NO: 4228426 - RNA, 79 nt, Escherichia coli CFT073
ucaugaagcaauugauuuuuaucaucgcuauaaaacagauauucaguuauuugccgggaugggauucaaaugcuuucga

SEQ ID NO: 4228427 - RNA, 64 nt, Escherichia coli CFT073
agauauggccucagauuaauguuaagcgucuugcaggacgcguaauguuaacuggggcuuuucu

SEQ ID NO: 4228428 - RNA, 77 nt, Escherichia coli CFT073
uuauacgcccucaacagagccugucucagcaaugauuaugacaaagaaaaucacugaugagccagguucugguacga

SEQ ID NO: 4228429 - RNA, 69 nt, Escherichia coli CFT073
auuugcuccguaaaacgcaaucaaaaugaggguauuugcgcuuacggugagcuuuuuacguggguuugu

SEQ ID NO: 4228430 - RNA, 55 nt, Escherichia coli CFT073
auucccuucauggucgauagcgauuaagccaccgcuaccgccaagcgcagggagu

SEQ ID NO: 4228431 - RNA, 66 nt, Escherichia coli CFT073
ccacgauuaucaccuguugcccuuugcgcaugaauuacgcaaacggggcgugaauaaucgcauugg

SEQ ID NO: 4228432 - RNA, 59 nt, Escherichia coli CFT073
accaugauguuuucgauuaugugaugcucagaaaggaguuuacagaggauaaucaaggu

SEQ ID NO: 4228433 - RNA, 67 nt, Escherichia coli CFT073
guauuccauguuaagcauccacaggcugguaucugcaaccgauuauaacggaugcuuaacguaaugc

SEQ ID NO: 4228434 - RNA, 100 nt, Escherichia coli CFT073
ccauuaagccuucccgccuggccgcacguucaugccuggcaucuguuuauuauucgugucgaugaacaacguugugguaucagucgcgaugcguugaugg

SEQ ID NO: 4228435 - RNA, 65 nt, Escherichia coli CFT073
cgucguuaaaucgcgcaggaaaaugcccagcgcaugggcauccucuuuuggcagauuuuucgacg

SEQ ID NO: 4228436 - RNA, 98 nt, Escherichia coli CFT073
aaaaggguuauccaaaggucauugcaccaauauggugcuuaauguucccauugaagcacuauauuggugcaacauucacaucauggugcagcccuuuu

SEQ ID NO: 4228437 - RNA, 63 nt, Escherichia coli CFT073
auuaggucacugguuacaggaugguaaugcaugcgcaguuaucuccuuugccagugguuuagu

SEQ ID NO: 4228438 - RNA, 56 nt, Escherichia coli CFT073
auucccaaaaacucagauccuaaguggcacaucaauagaucugaguuuaugggaau

SEQ ID NO: 4228439 - RNA, 78 nt, Escherichia coli CFT073
cgucgcgucgaacuggaacgggcguugaguaaucaugaaaaugauaaccagcagcagcguauucaguuugagcaggcg

SEQ ID NO: 4228440 - RNA, 63 nt, Escherichia coli CFT073
ucgccuggcguaacggcuggcuugaugacgaaggcgugaagcgcgccgccagcucgcuggcga

SEQ ID NO: 4228441 - RNA, 66 nt, Escherichia coli CFT073
cgacauauaccggcgucagcaaacucaucacguucuguuuaguacgcugauccugguaaaugcucg

SEQ ID NO: 4228442 - RNA, 113 nt, Escherichia coli CFT073
caucaaccggcguuagcuggaauuuguucaguucauucggguucauccagauacgcaucgcguacugugaaccgaacaacugaacgucacccacgcccgacguacggcugaug

SEQ ID NO: 4228443 - RNA, 63 nt, Escherichia coli CFT073
guguaauggcugaaugcagcacggcgaaaaagauaaccgcacgcuggccuucagccgcuacgc

SEQ ID NO: 4228444 - RNA, 79 nt, Escherichia coli CFT073
gcgaugcguaaccguaccaucaccgacguguuugaaccgggcucaacgguuaaaccgaugguggugaugaccgcguugc

SEQ ID NO: 4228445 - RNA, 67 nt, Escherichia coli CFT073
uguucagguugugauggcugugcaauaacacccucugguuuuucgacacgaucgucaccaucuaaca

SEQ ID NO: 4228446 - RNA, 85 nt, Escherichia coli CFT073
cguuugauuuaugcgcuggggaagauggauaaauggcuguaugccgauaucacgcacuuuucccaguucuggcauuaccugaacg

SEQ ID NO: 4228447 - RNA, 63 nt, Escherichia coli CFT073
gcaacacuuuuugcugauugccgccggagagaaauucaaucgguuguucaguugaaggugugc

SEQ ID NO: 4228448 - RNA, 58 nt, Escherichia coli CFT073
uuaucuggcaccgccugcugcauuuuguagaaaaugccccgaucgguugccacgauaa

SEQ ID NO: 4228449 - RNA, 55 nt, Escherichia coli CFT073
ggccauugucgcagccuguccggccugcacaccagacagcgcugucuuuguggcc

SEQ ID NO: 4228450 - RNA, 76 nt, Escherichia coli CFT073
gcauccgaauucguuuauuuucgaacguauacauacaaauauguacaauaauaagcgaaauaauuuuuggauaugc

SEQ ID NO: 4228451 - RNA, 83 nt, Escherichia coli CFT073
gcggcaaugaagaccaacuguucaguauuugugacucuagugcguucuuucagaucuugcaaccguugguucagaucguccgc

SEQ ID NO: 4228452 - RNA, 56 nt, Escherichia coli CFT073
cgccgugauggcuccacugauauccgcauugcgggcugccagccugccauccggcg

SEQ ID NO: 4228453 - RNA, 65 nt, Escherichia coli CFT073
agaucagcaacgcauuguggcggucacacaauucacgcagaccuuguaaaaaugcguugcuggcu

SEQ ID NO: 4228454 - RNA, 130 nt, Escherichia coli CFT073
cccgccgcuugauucauuuuggucgccaggcggcacgcaguagcuuuccuguccugcuuuguggagaagagggcgugggcaaggcacugcuaagucaggcaauucauaaugaaagcgagcgugcagcggg

SEQ ID NO: 4228455 - RNA, 60 nt, Escherichia coli CFT073
uccagaauucagguugcauccgucugaauggaaugaagauggaaggaucuggauucugga

SEQ ID NO: 4228456 - RNA, 68 nt, Escherichia coli CFT073
acggcuuggcgagcgcaucgauccgacauggcauuggaagccgugcucuuucacugcguucgagccgu

SEQ ID NO: 4228457 - RNA, 87 nt, Escherichia coli CFT073
guauuuccugaaagaaaaaguggcggagaucccggaacugcaugcgguuucugaauucauccacuuugccuguacuucggaagauau

SEQ ID NO: 4228458 - RNA, 78 nt, Escherichia coli CFT073
gguuuccggcgcaucguggagcacggcaccuuugguuauaccuggugcuuugacgaauucuacgacgcagucaucgcc

SEQ ID NO: 4228459 - RNA, 64 nt, Escherichia coli CFT073
gguuugggugaguuauggcguggcgcaaaagguuuuauugcgucggcuggcuucaccgcagauc

SEQ ID NO: 4228460 - RNA, 59 nt, Escherichia coli CFT073
agcggugugugaaauugucagugcaaucaucccugcgaugauaguuuucgcauuccguu

SEQ ID NO: 4228461 - RNA, 84 nt, Escherichia coli CFT073
gcugugauguuucugaauccacuugcagcacuacgcggcgggcugacugccgcaggcucggugcugcgagugcuggcauccggu

SEQ ID NO: 4228462 - RNA, 61 nt, Escherichia coli CFT073
auggcuuugacaguaucagucagucaaccguuucacgacuacugaaauugcugggagucau

SEQ ID NO: 4228463 - RNA, 63 nt, Escherichia coli CFT073
ucggguauuuuaucugcgauuucagcaagcuucauucugagcaaugcagaugcagauaccgga

SEQ ID NO: 4228464 - RNA, 62 nt, Escherichia coli CFT073
uucaguguaaugguauugguccaggcuacauugcuacaccucaaacagcaccguuacgugaa

SEQ ID NO: 4228465 - RNA, 117 nt, Escherichia coli CFT073
gguucgggugcagauuguaggcaugauaagacgcgucagcgucgcaucaggcaucagagcacaaaugccggaugcggcguaaacgccuuaucuggccuacgccagacuuacuuaacc

SEQ ID NO: 4228466 - RNA, 84 nt, Escherichia coli CFT073
aaugccgucaguucggugagcgccugagcgucaaaaugcguagccagucgggcgcgcagggcaucaucgaccguuggcggcguu

SEQ ID NO: 4228467 - RNA, 62 nt, Escherichia coli CFT073
ugggccauccugugaaacuggaaauugaaccgggucgcuuucugguagcgcaggcuggcgua

SEQ ID NO: 4228468 - RNA, 78 nt, Escherichia coli CFT073
uccucuucuccuuucgagagucagugguacgucuaaaucggucagacgugaugcauugcucugaaagcauagacggga

SEQ ID NO: 4228469 - RNA, 63 nt, Escherichia coli CFT073
gcauguacaugcagcugauaaucugaccuuuaaaggaaaacugauuauuccugccuguacugu

SEQ ID NO: 4228470 - RNA, 78 nt, Escherichia coli CFT073
gccgaagguaagguuucucugauugcaggcguaucuaaggacgucacagaucgugugaaagcaggggaacugauuggu

SEQ ID NO: 4228471 - RNA, 62 nt, Escherichia coli CFT073
uucccgcuguacgucaaugcggcagcgaaagaucgcgccagcaaaauggcgacggcgacgaa

SEQ ID NO: 4228472 - RNA, 79 nt, Escherichia coli CFT073
uuggcaaagcuaauaucaaaaagugcuuaaggcaccggauuucgggcguuuaggaagauuugaaauuguuuuagcgcag

SEQ ID NO: 4228473 - RNA, 71 nt, Escherichia coli CFT073
aucaucugaugugagagggugucacgcagcucacggcaacgcuguugaaacgcauccucgcacuggguggu

SEQ ID NO: 4228474 - RNA, 96 nt, Escherichia coli CFT073
gauugccggaugcggcguaaacgccuuauccggccuacaaaagcaauaauuucaacagauuuugcaggccugauaagcguagcgcaucaggcaauc

SEQ ID NO: 4228475 - RNA, 61 nt, Escherichia coli CFT073
ucguuauucagauguacguuucuauucgcgaccgcgaccagaaccgugaccugacuggcga

SEQ ID NO: 4228476 - RNA, 88 nt, Escherichia coli CFT073
cguuaaggcgcauauagaacgcuuuaauaucuuucggauaguuuuuaaccacuacuggugcuuuaaaguguucuuccgccagauaacg

SEQ ID NO: 4228477 - RNA, 72 nt, Escherichia coli CFT073
ccgauccaguggcuguguaagaauccggaaacgcucacucguuuccggauuuuuuuaugcucauuggacagg

SEQ ID NO: 4228478 - RNA, 87 nt, Escherichia coli CFT073
guguaagguuuacagcgauuuagaccucuaucucgguguucaggcgaucaacuggacagagauguuuaauccuggcgcgaccuucgc

SEQ ID NO: 4228479 - RNA, 72 nt, Escherichia coli CFT073
guagccgccgcucaaaauccugaugcugaauacguuuacgcugccagcgggcaauuuucgguggugcgcuau

SEQ ID NO: 4228480 - RNA, 69 nt, Escherichia coli CFT073
acauggugccgcaggagacggcauuggugaucacauucugaucguuaauauucacuucgcagcgcaugu

SEQ ID NO: 4228481 - RNA, 81 nt, Escherichia coli CFT073
aaauacugcucggcgaucuaucagccaacgcccacgaauuuuuuguggccuuggaacgauguauccuaguuuuccguauuu

SEQ ID NO: 4228482 - RNA, 79 nt, Escherichia coli CFT073
ggcgugcuggucguaaaguuugucauggcgauccgucaccuguagauaagauggcccaacuuuagcgacuaacaaagcc

SEQ ID NO: 4228483 - RNA, 87 nt, Escherichia coli CFT073
accuuuucugaguuuuuguguuuuuagucguuaaccugagacaagugucuuuacguaaaaacgcaaauccgacugagauaaccuggu

SEQ ID NO: 4228484 - RNA, 126 nt, Escherichia coli CFT073
aauggcgggagcgggucaaugaacucaauuuuuaccgaagagaaucuguuggcauuuacuaccgcugcgcguuuuggcagcuucaguaaagccgcagaagaguuggguuuaaccacuuccgccauu

SEQ ID NO: 4228485 - RNA, 91 nt, Escherichia coli CFT073
ggagcaucaacuguaauaucuuaaucucuggucgauuuaugcaaaaccgaccaguauugucgauaaauuaucgucugacuuauuuugcuuc

SEQ ID NO: 4228486 - RNA, 74 nt, Escherichia coli CFT073
guguuucuucaaucugacgcaucaggccaugaauacccgcagccauccccugauggaucagacugagauccggc

SEQ ID NO: 4228487 - RNA, 101 nt, Escherichia coli CFT073
uauugucggaugcggcgcgaacgccuuauccgaccuacgcgaaguuaauccauaguauucguaggccggauaagacgcggcaagcgucgcauccggcaaug

SEQ ID NO: 4228488 - RNA, 58 nt, Escherichia coli CFT073
uauucccauaaacucagaucuauugaugugccacuuaggaucugaguuuuugggaaug

SEQ ID NO: 4228489 - RNA, 68 nt, Escherichia coli CFT073
uacucgccgugcggugaucgaacguaguaucgcgcaggcgaugcaacauuugucgccgcaggagagua

SEQ ID NO: 4228490 - RNA, 105 nt, Escherichia coli CFT073
gcgcaccgcccggguucagcccuugauaaauuuuauccaguaacgccuggcgcucggaagguuccaggaauugcaggguaaaauucagcaccaccaucgaugcgu

SEQ ID NO: 4228491 - RNA, 58 nt, Escherichia coli CFT073
gccggugaaacgcgcgaaauuugcacuuucccaccggcaaaacgugauuuuuacuggc

SEQ ID NO: 4228492 - RNA, 84 nt, Escherichia coli CFT073
gcggcggaaaacccagcgaaaccguugagcgacagcaaguuaaccucuuugcugucggaacaagguaucaugguggcucgccgc

SEQ ID NO: 4228493 - RNA, 58 nt, Escherichia coli CFT073
cuugugaguauacuuauaaguauauuugccgauucgauauugcuuguauacucacgag

SEQ ID NO: 4228494 - RNA, 73 nt, Escherichia coli CFT073
uuugauaacagccuggaaggcaacgcgguauacgcgagaacgcgcaccguaguagccuuuagcuuguuucaaa

SEQ ID NO: 4228495 - RNA, 56 nt, Escherichia coli CFT073
auguaggguuacgcgcaguuucccaagaugcggggauuuucgcaaucaccuuacau

SEQ ID NO: 4228496 - RNA, 80 nt, Escherichia coli CFT073
guuuaucguuauagcuggugacaauagcugguugaccacuaaugcgguuaaccacaugcuccgccaguggacgauguaac

SEQ ID NO: 4228497 - RNA, 60 nt, Escherichia coli CFT073
gcauaaguuguaucacuuccgucuggaauggagccacuuggagcuggaugcggguugugc

SEQ ID NO: 4228498 - RNA, 62 nt, Escherichia coli CFT073
uagugacaauagcgccggaggacauaagcuggggcuuauaucccucaucgcuauugucguua

SEQ ID NO: 4228499 - RNA, 130 nt, Escherichia coli CFT073
ucaccgcuuuucaccggcgcgccagcauucgcaguaccagcaucagcugucggcgucguugaugccgccacaccgcuuugaucgccgcugguugauugcgccgcugcaccaccgcugcugaggcugucga

SEQ ID NO: 4228500 - RNA, 57 nt, Escherichia coli CFT073
agauguacugaccgacgguauucagaccuucccugaccguaccgaucgcguguaucu

SEQ ID NO: 4228501 - RNA, 89 nt, Escherichia coli CFT073
gcugacgugcgcggcagaaccgguuuugaaucagcggacuacccgcaaggccgcugguugcgcgaagccugggaaguggcgcagucagu

SEQ ID NO: 4228502 - RNA, 80 nt, Escherichia coli CFT073
gucgccccauuugcguuugacuuccgccaugaccgcuucgguauuguccguggauccgucguuaacgcaaauuacccggc

SEQ ID NO: 4228503 - RNA, 59 nt, Escherichia coli CFT073
aagaccgccggucuuguccauuaccuugcaguaaugcgguggacaggaucggcgguuuu

SEQ ID NO: 4228504 - RNA, 65 nt, Escherichia coli CFT073
gucacuaauuagccaucgauaaaaaugguugaguaaccauuuuuggauggucucauuauccuggc

SEQ ID NO: 4228505 - RNA, 55 nt, Escherichia coli CFT073
uugccggugucugggggcauaguaugcagcagcaagguguucuggaaaccggcga

SEQ ID NO: 4228506 - RNA, 83 nt, Escherichia coli CFT073
uuuaccgcuguuuuuaucuucuucuuccagggcguugaucucuucaaugcucaugaaggugaagaacuucaggaagcgguaaa

SEQ ID NO: 4228507 - RNA, 56 nt, Escherichia coli CFT073
gacguuaucugccuuuugaugaguugcaguaccgcaucaaaaaaggagaaaacguc

SEQ ID NO: 4228508 - RNA, 61 nt, Escherichia coli CFT073
uuauagaacuggugcgucagcagcugggguuggaucagccgcuauaucaccaguucuggca

SEQ ID NO: 4228509 - RNA, 59 nt, Escherichia coli CFT073
aaccgggugaugcaaaaguagccauuugauucacaaggccauugacgcaucgcccgguu

SEQ ID NO: 4228510 - RNA, 64 nt, Escherichia coli CFT073
aagagccguuuacuguuaaucugucagggagucaccucccuaacaguagcagagaucagcuuuu

SEQ ID NO: 4228511 - RNA, 61 nt, Escherichia coli CFT073
ccaguauuugccgccagagaugacgcuaacaccugaacagcgucaacuggcgcaaaacugg

SEQ ID NO: 4228512 - RNA, 59 nt, Escherichia coli CFT073
ggcagguuguugaacucguacgccagagugggcgugagacguuacggcaacuggaaguc

SEQ ID NO: 4228513 - RNA, 122 nt, Escherichia coli CFT073
cguccauuaauacgaggugguuuuacagguuucauuguuaauuccugauucaggugugauuuucccuacgccagauggagaauuagcgcacagagacucacgaaauauuuuuauuaaauacg

SEQ ID NO: 4228514 - RNA, 69 nt, Escherichia coli CFT073
ucgacgguuuugacgcugaaaaucugcggguuggcgaugacaucgacaggaagcgucaguccaucgcga

SEQ ID NO: 4228515 - RNA, 73 nt, Escherichia coli CFT073
aggcuuguagcucaggugguuagagcgcaccccugauaagggugaggucggugguucaaguccacucaggccu

SEQ ID NO: 4228516 - RNA, 64 nt, Escherichia coli CFT073
gcgcgcgaacguucuuuuccagcugucccgauaaccccucgaccuguagacggacguucgcggc

SEQ ID NO: 4228517 - RNA, 66 nt, Escherichia coli CFT073
gcaccugcgcgucuguagcccguuugagcagcaccaugcccaaaccacugcuguagaccguaccgc

SEQ ID NO: 4228518 - RNA, 89 nt, Escherichia coli CFT073
guuuuaucgcaggcgguauuggcggaacagucagcuugccacuaaaguaauagucaucgcuuuccagccagucagccugacgacgaagc

SEQ ID NO: 4228519 - RNA, 57 nt, Escherichia coli CFT073
ggaugaugaggguuauacgguaguaccagauuuuacgcgauugcaucuucaucaucc

SEQ ID NO: 4228520 - RNA, 62 nt, Escherichia coli CFT073
uguugaaacuguagcccguucccgacuguuuaccgucgaaagcguggaucuggaguucagca

SEQ ID NO: 4228521 - RNA, 91 nt, Escherichia coli CFT073
augcaguacgucgagcaguugcugaauaucggcgaagugcagaccgguggucggcucgucgagaauauacagcgucugcccggugccgcgu

SEQ ID NO: 4228522 - RNA, 78 nt, Escherichia coli CFT073
aucaacccgaccggucguuucguuaucgguggcccgaugggugacugcggucugacuggucguaaaaucaucguugau

SEQ ID NO: 4228523 - RNA, 80 nt, Escherichia coli CFT073
cagggcaacagugcugccgaauccguuuuauccucaucguugucgaagauaaucccugauucgcagucaauauuguccug

SEQ ID NO: 4228524 - RNA, 58 nt, Escherichia coli CFT073
acaguggguuagcuuuaugagauuauccuuaucgccccuucaagagcuaagccacugu

SEQ ID NO: 4228525 - RNA, 61 nt, Escherichia coli CFT073
cucacugcaggacaacaguaaaaucagagcguuucugcuuuuacugaugucuggcggucgg

SEQ ID NO: 4228526 - RNA, 93 nt, Escherichia coli CFT073
ggcgaguaaaguuggcagcauaaaaucaccagaaauuaugagccuaugucuccuuguaaacuucugccauuuuguguggcccuugcgcuaacc

SEQ ID NO: 4228527 - RNA, 69 nt, Escherichia coli CFT073
gaagcggcuaugcgcgccacggcuuucgguacggaaguuggcagaaacagccguugcauacgccguuuc

SEQ ID NO: 4228528 - RNA, 57 nt, Escherichia coli CFT073
gccagccgcuacugcgguuuucaucaucaaaaacggcgaccgcguggguuggcuggc

SEQ ID NO: 4228529 - RNA, 58 nt, Escherichia coli CFT073
uugguaucaacgauagcaaauacuggaauacccagguuguuugcuucuuugauagcaa

SEQ ID NO: 4228530 - RNA, 59 nt, Escherichia coli CFT073
ggcagcgcguagaauuuaccuuugugcacacgagaaggcaccagguagucacgcgcgcc

SEQ ID NO: 4228531 - RNA, 80 nt, Escherichia coli CFT073
cgagcguuacggcaaagauaccggucauuucggcaugauugacgccauugaugauccgcagguuuuugccgcguuguuug

SEQ ID NO: 4228532 - RNA, 102 nt, Escherichia coli CFT073
cgccgcgcggaguauuuuucuggcgagcuggaaaccuuccugcugauggcgcgcgacgagcaggacgauccgcucaaucugaaagguuccuuugccggggcg

SEQ ID NO: 4228533 - RNA, 80 nt, Escherichia coli CFT073
uugccgcaauauuauuuuuugauauguugaaaggcggaugcaaauccgcacacaacauuucaaaagacaggauuggguaa

SEQ ID NO: 4228534 - RNA, 64 nt, Escherichia coli CFT073
gcuucgguugcuguucccgccacuguucguacauuugcauagugguauccagcacccgucgggc

SEQ ID NO: 4228535 - RNA, 130 nt, Escherichia coli CFT073
cauggggcgaauugucguugacgucgaugguauugaccccgcugaguugaauaauaaggucgcugaaaacgguuauucacuccgcgugguggaugcucccgaacagcagacaaccgacucuccaccaccg

SEQ ID NO: 4228536 - RNA, 71 nt, Escherichia coli CFT073
guuuguuggcuuuugcuucaaucacggcuaagggaaugccugguuugugauacagcacgaugucagcagau

SEQ ID NO: 4228537 - RNA, 118 nt, Escherichia coli CFT073
ggcgcuuucuaugcugccgaacgccccagcaugguugucaauuuccgggauuauugucgcaguaguugcgaugucgaaaucauuccuggguacguacuuuggcguuauugaaggugcc

SEQ ID NO: 4228538 - RNA, 95 nt, Escherichia coli CFT073
gacaaaguuuugccggaacgggaucgacccugugggguguuggcgugguugguucgcuacauaucgggcgggugauuucguggaacgguauuguc

SEQ ID NO: 4228539 - RNA, 57 nt, Escherichia coli CFT073
ggucgcgccgggauccuggugaccaauacugcguucaccgagauaacuggcgcggcc

SEQ ID NO: 4228540 - RNA, 130 nt, Escherichia coli CFT073
gcggcgaagcggcguucaguugcgcuaucgccuggcggaccuccugccagagggcgucgauaucgaaaucgacaucgcccuguggggagaucugcuuugccgucacgaauuuaugcgcgcccaacgucgu

SEQ ID NO: 4228541 - RNA, 82 nt, Escherichia coli CFT073
cguccgauuaucgacgagcugcaggaacguauggcggacaaaauguacgucaacuucucgcuguuccagucgaugccggaug

SEQ ID NO: 4228542 - RNA, 76 nt, Escherichia coli CFT073
ucggugcgcgaaauugguuuucguacccgcuacggauugaauguaguggggcuaaagcgcaauggcguggcgcugg

SEQ ID NO: 4228543 - RNA, 102 nt, Escherichia coli CFT073
gccggaugcaacgcuggcgcguuuuauccggccuacaaugagcacaacauacugauuuguaugguuuuguaggccggauaaggcguucaagccgcauccggc

SEQ ID NO: 4228544 - RNA, 68 nt, Escherichia coli CFT073
uugucauuaaccgauuguccgauugaaacaagugcagugacggcaaucgugacagguucaacugacaa

SEQ ID NO: 4228545 - RNA, 70 nt, Escherichia coli CFT073
uggccguucacuggugagaagcaguaucaggcggaugaucugaaacugaaacuuaccggcaaaaugaccg

SEQ ID NO: 4228546 - RNA, 79 nt, Escherichia coli CFT073
cccggcguaugcauccgccugcaguacaccacugaaccccgcaagaugggucugcggauggaugccuuuucuguccggg

SEQ ID NO: 4228547 - RNA, 79 nt, Escherichia coli CFT073
cggcgaaguuggacgcugauuuucugcgcccagcaugguagggauugaugggccguagauaucggcguccagaaugccg

SEQ ID NO: 4228548 - RNA, 67 nt, Escherichia coli CFT073
ggacaauacuucaugaugggcgacaaccgcgacaacagcgcggacagccguuacugggguuuugugc

SEQ ID NO: 4228549 - RNA, 71 nt, Escherichia coli CFT073
gauccguggcuacauuggcauugguggacgugagaucgccccauuacaugcgcagaguggcggcauggauc

SEQ ID NO: 4228550 - RNA, 63 nt, Escherichia coli CFT073
uuugguagcuaugucgcguuuauuccagaaaaagagcuggguaucgugaugcuggcuaacaaa

SEQ ID NO: 4228551 - RNA, 61 nt, Escherichia coli CFT073
ccgucaacgucggcaucgcggaaggcuuccaggaaguguuccauggugcccgcgccaccgg

SEQ ID NO: 4228552 - RNA, 75 nt, Escherichia coli CFT073
auucacugccgcuggcgggugguggcagcacgcugguacgccuuaaccugaaagccauugccgagcgcagugaau

SEQ ID NO: 4228553 - RNA, 81 nt, Escherichia coli CFT073
auucgucccugauacagcacauggacguaaucaggcuugauguagucgagaaugcguugguagugcguaacaaugaugaau

SEQ ID NO: 4228554 - RNA, 61 nt, Escherichia coli CFT073
auugcgguugguaauaaaagucuggcucccuauaaugagccagacuuuuuaccgcuguaau

SEQ ID NO: 4228555 - RNA, 128 nt, Escherichia coli CFT073
gguauugauaacgccacaguugcuauuuaugguugugacaacuuugugauugauaauauugaaaugauuaauagugccgggauguuaaucggcuaugggguaauuaaaggcaaauaucucucgauacc

SEQ ID NO: 4228556 - RNA, 106 nt, Escherichia coli CFT073
caucagcauugagcuucgugacgauggggauauucgucuguuaacgcccguugaaggcguggaacaugaagauaaccugaucguucgcgcagcgagguuguugaug

SEQ ID NO: 4228557 - RNA, 62 nt, Escherichia coli CFT073
aucucauacgcgggacugcguuggaucgugcaaaaaacaggcuagauucuacguaugaugau

SEQ ID NO: 4228558 - RNA, 82 nt, Escherichia coli CFT073
cuggcgcgccgugauguaguaucauuccucggcgcgaguuauuuccgcgccguugaugacacauaucaauacgguuugucgg

SEQ ID NO: 4228559 - RNA, 123 nt, Escherichia coli CFT073
gaugccaucagccguacgucgggcgugggugacguucaguuguucgguucacaguacgcgaugcguaucuggaugaacccgaaugaacugaacaaauuccagcuaacgccgguugaugucauu

SEQ ID NO: 4228560 - RNA, 89 nt, Escherichia coli CFT073
gcugugacugcucgauaauuuuggcugcgcccgcuuuuuccagcgguagcgcauuccaguauugcugacggucuuuauguugaaacggc

SEQ ID NO: 4228561 - RNA, 68 nt, Escherichia coli CFT073
ugguaaaaucauggagaaaaugaaacaagguuaauuuguuguuucauuguuaaaaaaugauauugccg

SEQ ID NO: 4228562 - RNA, 85 nt, Escherichia coli CFT073
ggucugcgagccgacgaacauuacuggcuucauucagaaugcguucugcaaugaccaguaaugcuuugcccgguucagucaugcc

SEQ ID NO: 4228563 - RNA, 59 nt, Escherichia coli CFT073
ucaacgaugaacuuuuuugccauugcgucacgucgcgcaacugcuccauucguuguuga

SEQ ID NO: 4228564 - RNA, 94 nt, Escherichia coli CFT073
uuuuuuaacagguuagauaauugcaauggcagucacugaacaggcaucucuugccauaaaacugucaucaaucaucuugacaaauguuaaaaaa

SEQ ID NO: 4228565 - RNA, 100 nt, Escherichia coli CFT073
caaauucaguuuucaucguaguaucacuuuaucagccaagucauaaaguucagcuguauuuugggagguaaagcgauauuaugauuauauuuuauguuug

SEQ ID NO: 4228566 - RNA, 91 nt, Escherichia coli CFT073
gcugguguugauggcucguuguuauccggaguuggaguaacuggaguuuccgguguuuccggaguuggaucaaccggagucacagcaccgc

SEQ ID NO: 4228567 - RNA, 64 nt, Escherichia coli CFT073
gcgcguaucagcccgugggccagggaugaacuggcgaucaaaccuggccuguggcuguaugcgc

SEQ ID NO: 4228568 - RNA, 57 nt, Escherichia coli CFT073
ucgguaucgggauuauuuaucaggaacucagcguuauugaugaauuaaccguacugg

SEQ ID NO: 4228569 - RNA, 79 nt, Escherichia coli CFT073
ggugcuguuugguaacgacgaacgcaaacugaauggucauuacgccguuuauuacgugcugucgauggagaagggcacc

SEQ ID NO: 4228570 - RNA, 60 nt, Escherichia coli CFT073
aaaaaugaacugguugcguaauuuucauccguaacggauuaaagcuaaccaguuauuuuu

SEQ ID NO: 4228571 - RNA, 63 nt, Escherichia coli CFT073
uucugccugggaagauguaagccgccagcuuuuuguuggcguacucuuuuuccagcgccagga

SEQ ID NO: 4228572 - RNA, 69 nt, Escherichia coli CFT073
guucaauggauucagugauggcgcaauaucaaaaaaccgugcgcccgauguuucugcaauucauugagc

SEQ ID NO: 4228573 - RNA, 73 nt, Escherichia coli CFT073
guggguggugauuaccagcgccuccggcaaugaagaaaaucaggagaugcagguggugguggucagugccgac

SEQ ID NO: 4228574 - RNA, 56 nt, Escherichia coli CFT073
acaaugguuagcauacuuuuccugauuaaguuauugccaaauaugcuggccauugu

SEQ ID NO: 4228575 - RNA, 78 nt, Escherichia coli CFT073
gucuuuuuuggcgauagugauguggaacgagucgaucucucuuaucacgagaguuuacaacgcauuguuaaaggcgau

SEQ ID NO: 4228576 - RNA, 63 nt, Escherichia coli CFT073
gguagauuguuuugccggugaccacguaaaugguuuccaugauagccagcaaaaaaaucagcc

SEQ ID NO: 4228577 - RNA, 58 nt, Escherichia coli CFT073
gaauuuuuuccgcaaucuucgcucguugaccugcgaguuugagauuguugaagaauuc

SEQ ID NO: 4228578 - RNA, 69 nt, Escherichia coli CFT073
gaggcuguaacgaucaauuucuucaggauugguaauacccagacuuuucagauugucguacauagcguu

SEQ ID NO: 4228579 - RNA, 56 nt, Escherichia coli CFT073
gacguuuucuccuuuuuugaugcgguacugcaacucaucaaaaggcagauaacguc

SEQ ID NO: 4228580 - RNA, 119 nt, Escherichia coli CFT073
ccugccaauuaaucaggaauccgcagccacuaagcguuuucucgcgggggauauugauaucaccgaauccuucccgaaaaauauguaucagaagcuguugaaggauauuccggggcagg

SEQ ID NO: 4228581 - RNA, 56 nt, Escherichia coli CFT073
guacgaugaacggcgguaaagaaaucguauucuuuaugcgucauaacuucacguau

SEQ ID NO: 4228582 - RNA, 63 nt, Escherichia coli CFT073
ggcguacagggcgcugcgggugucuacuuguugauuguucuuaacuugcgcaccuugugcgcc

SEQ ID NO: 4228583 - RNA, 57 nt, Escherichia coli CFT073
cuggagcgcgucguaagcggguuuguaugcguccagccacgccugcggcaguuccag

SEQ ID NO: 4228584 - RNA, 97 nt, Escherichia coli CFT073
gacgcauugcguucuguacagcacgcuucauagcacgacggaacauaacgcgacguuccagcugagaagugaugcugucagcaaccaguuuugcguc

SEQ ID NO: 4228585 - RNA, 58 nt, Escherichia coli CFT073
gucgagaaaacgggauagcacagugaauaauaaugcacguguucguuccuuuucugac

SEQ ID NO: 4228586 - RNA, 103 nt, Escherichia coli CFT073
caguacgcaacgcggguauucgauagcuggaaaccgggugauaaagaccgugaugauggcguucuacuguuagucgccuggcaggaucauaccgugcguauug

SEQ ID NO: 4228587 - RNA, 57 nt, Escherichia coli CFT073
accguuucuugauggcgaguauuggccuuggugccauucuugcggugaagaagcggu

SEQ ID NO: 4228588 - RNA, 84 nt, Escherichia coli CFT073
agcuugcgcagauuauuggauuuaucucgcgaaaaugcggucauggccgccuuuucgugaagagguuuuguaaugcgccaugcu

SEQ ID NO: 4228589 - RNA, 59 nt, Escherichia coli CFT073
gcgcuucugguagauucgggauugggcgaguagcgcaaccgaagcgcauccagcggcgu

SEQ ID NO: 4228590 - RNA, 75 nt, Escherichia coli CFT073
cauccuggucgcggauaugcugcaucgcaaaguugucgaaaguagauugcagaugcucauauucucgccacagug

SEQ ID NO: 4228591 - RNA, 130 nt, Escherichia coli CFT073
ggugaugacgauucuccagaaacccauauguacucccuauaagaaaauuacucauuguuuaaaaagagauuuuaucucuuaagcguaguaauuuuagcggagccugccaguuucagcguacgcuuuuacu

SEQ ID NO: 4228592 - RNA, 67 nt, Escherichia coli CFT073
caaugaacgcgugcuucaggaagcggcggacaaaucuaacccgcugauugaaaggaugcguuuccug

SEQ ID NO: 4228593 - RNA, 55 nt, Escherichia coli CFT073
ggccuguaugagcuuuuccccgaaaaugagcagguaaaaaacucacucgcagguc

SEQ ID NO: 4228594 - RNA, 89 nt, Haemophilus influenzae Rd
uuuaacagaaaucaaauuugcugauuccgacaaauuacgcguaggcgauuucacuguugcaaucgguaauccauuugguuuaggucaaa

SEQ ID NO: 4228595 - RNA, 58 nt, Haemophilus influenzae Rd
aagaauuacgcaacagcgguugguaugaaaaaaccagccaagccuucagcguauucuu

SEQ ID NO: 4228596 - RNA, 64 nt, Haemophilus influenzae Rd
gcguauuagugauuuuacuuuguggcggagauaaauccacacaagauaaagauauuaaacaagc

SEQ ID NO: 4228597 - RNA, 93 nt, Haemophilus influenzae Rd
ccuaaggcuauugaguacggagauucuguuacauuagcauuugcccccacagcuauugaugcggcaggauuaucaggugucuuauccuuuggg

SEQ ID NO: 4228598 - RNA, 59 nt, Haemophilus influenzae Rd
auugcagccaguguauuuguggcaggauuaaaaucuacaggugcaguggaugcugcaau

SEQ ID NO: 4228599 - RNA, 58 nt, Haemophilus influenzae Rd
uacaauggugguuucacguugguuggugauaccgauagcagcgauuucaucagaugua

SEQ ID NO: 4228600 - RNA, 65 nt, Haemophilus influenzae Rd
gagagacuaaaucaggcgaacgcaaaaucguaucggcaauuuuuuucucugauuuaguuaaacuc

SEQ ID NO: 4228601 - RNA, 71 nt, Haemophilus influenzae Rd
uuccguaauguaggugaaauuacugaacuugcagguugcgaucguuuaaccauugcaccagcauuacugaa

SEQ ID NO: 4228602 - RNA, 61 nt, Haemophilus influenzae Rd
acuucauaucaaugcuaccauuguugcaaucauuguaauggugcuuuguauuguauuaagu

SEQ ID NO: 4228603 - RNA, 71 nt, Haemophilus influenzae Rd
uguaccuaggguaguauacucuagguuaguucuucaauaggacugaaccuaggauauacuuaccuacagca

SEQ ID NO: 4228604 - RNA, 130 nt, Haemophilus influenzae Rd
guacuugugcugcuuuaguuucacgcacaaucgcauugauaauaaguuguuuuguuucacgaucugcaccagcaacuuuuacuuuaaugaguucgugaugauuaagugcauuuucaauuucagcaaguac

SEQ ID NO: 4228605 - RNA, 87 nt, Haemophilus influenzae Rd
cggcuuuggcauuaaucaacaaaagccaacgauugucuaaaaccaccuguaaugcuuugguuuguugauuuugccaaucuucaacug

SEQ ID NO: 4228606 - RNA, 67 nt, Haemophilus influenzae Rd
ucaauaugccuucuuccaagcuaaaaguggcaauugccaacguauuagcugcugaagguuauaucga

SEQ ID NO: 4228607 - RNA, 97 nt, Haemophilus influenzae Rd
ggcuguuuaugcacaaauugaugauuuuuuaauagaaaguaguuuccuauuggaacaauuacgucagagaaaucaauaugacuaguuuugcacagcu

SEQ ID NO: 4228608 - RNA, 71 nt, Haemophilus influenzae Rd
gauuugauaugggcgugaccgcacuuuuaccuguaauagguaaaaaagaaguggaacgccguauuaugauc

SEQ ID NO: 4228609 - RNA, 64 nt, Haemophilus influenzae Rd
uuagcgcaauaugcggauuuaauuaaaggcuuauuggcugaguuugauugcaauguugugcuga

SEQ ID NO: 4228610 - RNA, 65 nt, Haemophilus influenzae Rd
uuggggugugccgaugacguuguucgugcauaaagaaaccgaagaacuucauccgcguaccuugg

SEQ ID NO: 4228611 - RNA, 65 nt, Haemophilus influenzae Rd
auuuaaaauggcaucggcuuguucaucgcuuaaauuaaagcgugccauaagcucugcuuuuggau

SEQ ID NO: 4228612 - RNA, 130 nt, Haemophilus influenzae Rd
ucugaucuuucacaccacugacuuuacgcuguucuuucucaauaguuuuauuguuauacagugcgauaugcguauuuagauaaggauuaucuggcguuaaauaauaguuaaauaccgugcuuugaucagg

SEQ ID NO: 4228613 - RNA, 86 nt, Haemophilus influenzae Rd
uacgcgaaauggcacagcuuaccguuccuguuauuuguaccguuaucggcgaaggcgguucgggcggugcguuagcuauuggcgug

SEQ ID NO: 4228614 - RNA, 89 nt, Haemophilus influenzae Rd
cauaaacguaaaaugucgccaccgaauuuauccauuacuucuuguggugucacgauguuaccgauagauuuugacaucuuacggccuug

SEQ ID NO: 4228615 - RNA, 86 nt, Haemophilus influenzae Rd
gcuucugugaauucagcaggaaugccgauuggggauucguuggcauccacuuggcaacgccaaaucggcuuggauuacggcaaagu

SEQ ID NO: 4228616 - RNA, 57 nt, Haemophilus influenzae Rd
cuugugugguuaagccuugcgccgcacacucgccugcaaugguguaugcuacacagg

SEQ ID NO: 4228617 - RNA, 90 nt, Haemophilus influenzae Rd
uguacuaaaagagaaugcuuuaauugaagguguagauuuaucauucuuaaacuucaucacuuucauugggguuauugcugguuuagugca

SEQ ID NO: 4228618 - RNA, 130 nt, Haemophilus influenzae Rd
aagccauucaaugcuuacuccuguaacuucugcaauuuuuacaagguuggaacgagauggaucggcuucaccuuuucgccaucuuguaauuguagaaaguguuacgccuguuuuucgagcaaauucgcuu

SEQ ID NO: 4228619 - RNA, 92 nt, Haemophilus influenzae Rd
uauuaacgagugguguuuuagcauuuaugcuuuucagcgaaggggcaaaagucuucucugaggguuaugaagguuauccaaacugguuugua

SEQ ID NO: 4228620 - RNA, 66 nt, Haemophilus influenzae Rd
gugagaaucgguaaaagucgcuaaaccuucaacaacagucacuuuacgugcuuuugccauucccgc

SEQ ID NO: 4228621 - RNA, 56 nt, Haemophilus influenzae Rd
aauccgcagauugaauugcaauuucagcaaguuguucugcaguuggaucuggguuu

SEQ ID NO: 4228622 - RNA, 71 nt, Haemophilus influenzae Rd
gcaauuugcaucacuuguucuugauacaaaauaaugccguaagucggcucaagaauagguuucaaacuugc

SEQ ID NO: 4228623 - RNA, 67 nt, Haemophilus influenzae Rd
cggguugauaaccaucagguaaacaauaaguacaacgaaaauuacacugaucgguaaucgacagccg

SEQ ID NO: 4228624 - RNA, 73 nt, Haemophilus influenzae Rd
uacgauuauuuagugauugccauuggcaguaaaucuaaugauuucaacacaaaagggguggcugauaauugua

SEQ ID NO: 4228625 - RNA, 69 nt, Haemophilus influenzae Rd
uugcuuacagugcaucaauuggugguaugggaacccuuguaggaagcccaccaaaugcaauuguagcaa

SEQ ID NO: 4228626 - RNA, 75 nt, Haemophilus influenzae Rd
cuucggcgaggcauucauucauuuugucguaaugaaaaccuucaauugggcaagagucgaugccaagggcugaag

SEQ ID NO: 4228627 - RNA, 79 nt, Haemophilus influenzae Rd
gucugcauuauccaacgcaauuacaggcacaauuuugaguucacgaaguuuuucaauaauuuguugaguuguguaugac

SEQ ID NO: 4228628 - RNA, 74 nt, Haemophilus influenzae Rd
gccuuuccaauucgugaacauacgcauuugccugaaaauuuaauucgccaaauuguguugaugaaauuggaggc

SEQ ID NO: 4228629 - RNA, 83 nt, Haemophilus influenzae Rd
ccuuuacggaaagauugauaaccgaaaaccgauuucaaaacagaaagugcggucgguuuuucuauuauuuuugauaguaaagg

SEQ ID NO: 4228630 - RNA, 57 nt, Haemophilus influenzae Rd
uugucuggaauuagacgaagaagacuuggcguuauguucuuucguuuguccaggcaa

SEQ ID NO: 4228631 - RNA, 97 nt, Haemophilus influenzae Rd
gaguuugauguugccacaaacaucacaucagaaagaucauaauccacuucuaaauagugaucguuaaaugugguguuuugcucgggaucuaauacuu

SEQ ID NO: 4228632 - RNA, 99 nt, Haemophilus influenzae Rd
gucugcugauuuucugcccuuaauuaauuguagagcaucgcuguuauagcguggcauacccagcgcaaugucuuuaccugauugagugcguauuuugac

SEQ ID NO: 4228633 - RNA, 62 nt, Haemophilus influenzae Rd
guuauuuacguucuuuggguuacgauuuaacuuaugugcguaauauaacggacguagaugac

SEQ ID NO: 4228634 - RNA, 60 nt, Haemophilus influenzae Rd
cuguuggauucguuuccauacaacuuacuguaccgagcgcgugagaaaccgaaccaacag

SEQ ID NO: 4228635 - RNA, 81 nt, Haemophilus influenzae Rd
ggcucugugggauugcagauagucuugaggcguuaauuauuuuucgcgucauucaaggugcugucgcaggcccagugaucc

SEQ ID NO: 4228636 - RNA, 87 nt, Haemophilus influenzae Rd
uugauuaccaauucagaaauggcgaagccuaucuuaugccuaaaucagauuuaguauucguucauuucgauaaugguguauggucaa

SEQ ID NO: 4228637 - RNA, 57 nt, Haemophilus influenzae Rd
cguuuauuccauugaugaaagaaauuauucgccauucuagucgucaagggguaaaug

SEQ ID NO: 4228638 - RNA, 77 nt, Haemophilus influenzae Rd
uugguggcgguguuuacgauaugaaaacugugcaagaauauaaugcucgaguuauuagugguaauacuguuacacaa

SEQ ID NO: 4228639 - RNA, 56 nt, Haemophilus influenzae Rd
gagcggauuauucagaugcacagugagccuauuuauacuguguauaugauuggcuu

SEQ ID NO: 4228640 - RNA, 65 nt, Haemophilus influenzae Rd
uacgaagaaugucguacuagaaaaaagcuacgacagcuauuuuaacggugaugacaaucaacgug

SEQ ID NO: 4228641 - RNA, 74 nt, Haemophilus influenzae Rd
cccuauucuguugauuuacgguaacgguaucacgaacaccguagauucuuuuauugugaaucaacuugguaugg

SEQ ID NO: 4228642 - RNA, 60 nt, Haemophilus influenzae Rd
ugcggaucguuugguacagcauuuuuauucacgguaauauuugcuuugcccaaugccgca

SEQ ID NO: 4228643 - RNA, 73 nt, Haemophilus influenzae Rd
uuggcaaagguuuguuaguuuugcuugguguagaaaaagaagauaaccgagaaaaagcggauaaacucgcuga

SEQ ID NO: 4228644 - RNA, 66 nt, Haemophilus influenzae Rd
gugaguacgaauauggucagacacgguacaaaucguuaaugcuuuugcaccauauucugcagccac

SEQ ID NO: 4228645 - RNA, 111 nt, Haemophilus influenzae Rd
ucgauacuucugcuuuacugcuaauauuuauuaucgguauguuaaaagguauuauuuauuuuggcuuaucaguaaauguacucuuaguauuaggcguauuaacuguauuga

SEQ ID NO: 4228646 - RNA, 70 nt, Haemophilus influenzae Rd
uucgcugcuaugaccugcaguuaaagcacgauuauucgcggcuugaauaacugggccaucgaguagcgga

SEQ ID NO: 4228647 - RNA, 67 nt, Haemophilus influenzae Rd
uaagauagaaucuuaauagucaugaagggcggauauuucugcccuuuuguuauuauagagcaucuua

SEQ ID NO: 4228648 - RNA, 56 nt, Haemophilus influenzae Rd
ggcuaugcguugguggaugaaguggauucuaucuuaaucgaugaagcgcguacgcc

SEQ ID NO: 4228649 - RNA, 105 nt, Haemophilus influenzae Rd
aaauaauugucuaaguuuaaaguuagcgcugaucccauuauuaauacuauuauuuguuguuaugggaucggugcuuucuuuaaucgcaaaauuagauuuuuauuu

SEQ ID NO: 4228650 - RNA, 82 nt, Haemophilus influenzae Rd
ugcgauccacauuccaccaaauuaacgcccauuuuuucuguccgugagaaauggguucguuauuggcuuguuuacgaucgua

SEQ ID NO: 4228651 - RNA, 69 nt, Haemophilus influenzae Rd
cuuuaaugacuuuagugggauugucggcgauuauuaaauuugucgaacaauuucguaguguagguaaag

SEQ ID NO: 4228652 - RNA, 55 nt, Haemophilus influenzae Rd
uuagcuggugggguuuagcuuuguuacuugugaucaguuacccuaaaucagcuaa

SEQ ID NO: 4228653 - RNA, 56 nt, Haemophilus influenzae Rd
gcuguuuugccacaaagcaaauggcaucaauauuaugugcuugggcaauuaauagc

SEQ ID NO: 4228654 - RNA, 112 nt, Haemophilus influenzae Rd
gcguuacaucaaugcuuucuugaauagcuuuguuacguacagcccccaucaccauuugauuggcaauuugcugacggaauguauuuaaugaaaugccuugauaaucuaacgc

SEQ ID NO: 4228655 - RNA, 62 nt, Haemophilus influenzae Rd
gugcauaugcguaaagugucuguugcgcaagauguugaugcaaugacguuagcgcgugguac

SEQ ID NO: 4228656 - RNA, 87 nt, Haemophilus influenzae Rd
uagaagcgacagcagcagcaaaucuugcagcagcucaagcucgugcagcagaaguuacugcauuagguucugugacuaucgcaucua

SEQ ID NO: 4228657 - RNA, 84 nt, Haemophilus influenzae Rd
uuaucaauuagaauauggucaagauacuuuggaaaugcacguugaugcaauuucagaaggugacaauguuuuaauuauugauga

SEQ ID NO: 4228658 - RNA, 103 nt, Haemophilus influenzae Rd
caacguguucauguauuuagcgauacacuucgucaaaauuuacaauuugcaagugcggauaaaauuucugaugaacaaaugauugaaaugcuacaucaaguug

SEQ ID NO: 4228659 - RNA, 69 nt, Haemophilus influenzae Rd
uuuccuuggcaaggauuucaaauacuuugacauuacguucaagcaaaggguugauuucuuccauggaaa

SEQ ID NO: 4228660 - RNA, 83 nt, Haemophilus influenzae Rd
cuuuaaauuauuagauuuauaugauguagaacaacgcuuuaucugcacagcgucuuugcagaaauuuaaauuagauaauagag

SEQ ID NO: 4228661 - RNA, 75 nt, Haemophilus influenzae Rd
gcuuucgauauaaccuucagcagcuaauacguuggcaauugccacuuuuagcuuggaagaaggcauauugauugc

SEQ ID NO: 4228662 - RNA, 76 nt, Haemophilus influenzae Rd
ugauucacuaauagaucuaaagugcggucagauuuuacagugauuuuuaaccgcacuuggguuucaaugaguguca

SEQ ID NO: 4228663 - RNA, 56 nt, Haemophilus influenzae Rd
auuguguuagcccgugaaaugacuaaaacuugggaaacgauuacggggaauacgau

SEQ ID NO: 4228664 - RNA, 60 nt, Haemophilus influenzae Rd
guuaaaaaaagaggcgugauuauagcaauuuuuguuauaguuccaaccuuuuuaguuagc

SEQ ID NO: 4228665 - RNA, 69 nt, Haemophilus influenzae Rd
ugaaggauuauuucugaugcaggaagcuuaugaaaaaauggguuuaaccgcauuagcaaaugauacuca

SEQ ID NO: 4228666 - RNA, 83 nt, Haemophilus influenzae Rd
ugccuuuuucaucacguucaagaguuaccuguguuggacuuacccaaauacgcucauugguuggacuuguguaguagaaggca

SEQ ID NO: 4228667 - RNA, 77 nt, Haemophilus influenzae Rd
auuuuaucuugauacaaauaauagccaucggcaauaucccaaugggcuuguaacuggcuuuuaucuguagauaaagu

SEQ ID NO: 4228668 - RNA, 109 nt, Haemophilus influenzae Rd
uacugccgaaauagcuuucaucggcuucaauuuugccuucaaacauuuccaaaugugggcuuguuugauaaaugaguaagcguaaucgaugaaaguaauaguggcugua

SEQ ID NO: 4228669 - RNA, 57 nt, Haemophilus influenzae Rd
gguuuagugcaaaugcucgggguguuuguugauacaaugaucguuuguacuuguacu

SEQ ID NO: 4228670 - RNA, 86 nt, Haemophilus influenzae Rd
uccguuuuuaaacagacuuuuaaugcaauuagugauccuaaagagcagcugauuguauuggaagauuuuuucaauuuaauuuugga

SEQ ID NO: 4228671 - RNA, 92 nt, Haemophilus influenzae Rd
acaucaauuuguguggaagaacuugcucaacuugguguucgcacuuucuuacguauuggcacaacgggugcaauucaaccgcacauuaaugu

SEQ ID NO: 4228672 - RNA, 89 nt, Haemophilus influenzae Rd
augaaauuuuggcaaauucggguuuagguuuaaaucaaguugaugcuuuagcuuuugggcgugggccugguaguuuuacugguguucgu

SEQ ID NO: 4228673 - RNA, 69 nt, Haemophilus influenzae Rd
agcacuagaacaguuuuagaaugcuaauuugguuuaacaaaggcuguguuuuaauacuguguuaaugcu

SEQ ID NO: 4228674 - RNA, 71 nt, Haemophilus influenzae Rd
guagggugggcuucagcccaccguuuuuauuccauuuuuuaugguuaauuggugggcuaaagcccaccuac

SEQ ID NO: 4228675 - RNA, 96 nt, Haemophilus influenzae Rd
aguuuaacuaaucuaauguagggugggcuuuagccacgcucuuacuaacauaauaaauugugggcuaaagcccacccuacggaaaaucaaugaacu

SEQ ID NO: 4228676 - RNA, 57 nt, Haemophilus influenzae Rd
aaacaaugccacugccauaacgaauuaauuuugccauuuguucuggcgugauuguuu

SEQ ID NO: 4228677 - RNA, 58 nt, Haemophilus influenzae Rd
ucaucuucuucuggguugcacguaugauaauguuuacgaugcacuucguaaaagauga

SEQ ID NO: 4228678 - RNA, 71 nt, Haemophilus influenzae Rd
uucgauuagugaucaaugcuggaucuaugcacgaagaugacgaucaaaaaggcauugcucauuuaguugaa

SEQ ID NO: 4228679 - RNA, 105 nt, Haemophilus influenzae Rd
gcgcagcauuugucuacccugaaauugaugaugauauugauauugaaaucaauccugcugauuuacguauugauguuuaucgugcaucaggggcagguggucagc

SEQ ID NO: 4228680 - RNA, 80 nt, Haemophilus influenzae Rd
gaguaguaauaagcuaaguacaaaagagcgguugaaaauuuaauuguuuucaaccgcucuuuuuauuuagaacaauacuc

SEQ ID NO: 4228681 - RNA, 85 nt, Haemophilus influenzae Rd
uaaaagccucaguuucuggaacaguggcaacgauagcacaaucuaaacgccccguuuccaauuguucuaauaauugaugcguuug

SEQ ID NO: 4228682 - RNA, 75 nt, Haemophilus influenzae Rd
gcaucaauuauuagaacaauuggaaacggggcguuuagauugugcuaucguugccacuguuccagaaacugaggc

SEQ ID NO: 4228683 - RNA, 58 nt, Haemophilus influenzae Rd
agaaccaauggcagcugcaauuggggcuaaauuacccguuucuacugcaguugguucu

SEQ ID NO: 4228684 - RNA, 67 nt, Haemophilus influenzae Rd
ucccaauuuagcugccgugauuuugccucgcucgggucuuggccauaaacacggcauuguguuagga

SEQ ID NO: 4228685 - RNA, 56 nt, Haemophilus influenzae Rd
aucaucgauaaaacuuuuucucgacguucuuuggcggaaaguuuuguauugaugau

SEQ ID NO: 4228686 - RNA, 62 nt, Haemophilus influenzae Rd
ggugugagugaagaugcaccguucaauuuaacuaaugaaaaagguaucgcucaauuuacgcc

SEQ ID NO: 4228687 - RNA, 74 nt, Haemophilus influenzae Rd
gguucugccaguggcuuacggguaaaauucgcaauguuuuauuaaacagcaccagugaggacgcuggcgcuauc

SEQ ID NO: 4228688 - RNA, 62 nt, Haemophilus influenzae Rd
uguuuggcaggauugguuguguugauggauauucgccauccgcuuaaggaucuugaccaaca

SEQ ID NO: 4228689 - RNA, 80 nt, Haemophilus influenzae Rd
guuucugugagaauuucagcauauuguugugaauuuucggcaaauucacuugcacguuguugcaauucuucuacagagau

SEQ ID NO: 4228690 - RNA, 77 nt, Haemophilus influenzae Rd
ugccaaaaaguuauguucgccuuucugcaggucgcagugguaugacugaagaaaugcaagcgauguguuuuauggcg

SEQ ID NO: 4228691 - RNA, 84 nt, Haemophilus influenzae Rd
guguauuacaaucuguuguuauuaauguagaaggugaugaaaaaaucacuuuugcaaaauauagcacagaacaauugaauacac

SEQ ID NO: 4228692 - RNA, 67 nt, Haemophilus influenzae Rd
guguggucagauuuugcgucauauucaagaauugcaucaauucuauggcgaacaaaaaggcuaucgc

SEQ ID NO: 4228693 - RNA, 79 nt, Haemophilus influenzae Rd
agacgauaacacaauucguauuaccuuaaacaagacagaugcgacuuucuuggcuagucuugguauggauuuuauuucu

SEQ ID NO: 4228694 - RNA, 69 nt, Haemophilus influenzae Rd
guguucaaggcuuucgcggguucuuuuacgagucauuucuacaaggccuaauugcguaaagccauucac

SEQ ID NO: 4228695 - RNA, 60 nt, Haemophilus influenzae Rd
aaguuuuucauauaacguugacggaauucuucgcgaucgucguaaguauaagaaaaacuu

SEQ ID NO: 4228696 - RNA, 76 nt, Haemophilus influenzae Rd
cggauuuuaaagccagcaacagauuuacgagcuuuaguuacuaaagguuuuugaccgcugauugcugcuaaguccg

SEQ ID NO: 4228697 - RNA, 64 nt, Haemophilus influenzae Rd
uacuuuugcaccaagcuguuguaauaaggcuuuugcuucauuacgccccauuuguguaagagug

SEQ ID NO: 4228698 - RNA, 62 nt, Haemophilus influenzae Rd
cuguaaaaauggaauauaaaaagcggcuuaaaaauaagccgcuugucaucguuauuuuucag

SEQ ID NO: 4228699 - RNA, 79 nt, Haemophilus influenzae Rd
uuuaucaacugaaaaugcuuuaccauaauuugcacaaauaaucugagcagcauuauaaagcguuguaucagguguuaaa

SEQ ID NO: 4228700 - RNA, 90 nt, Haemophilus influenzae Rd
gugaauuucuaugcguuuaucuuacagcuauuuguaaaaauaaugucucguuugcagguuuugucuagauaaagugcgguuaaaauuuac

SEQ ID NO: 4228701 - RNA, 80 nt, Haemophilus influenzae Rd
uggucagcguugguuaagugaaagugaaaacgcuuuaggauuagguguuauuaccgcauuagaucaacgaacuguuacua

SEQ ID NO: 4228702 - RNA, 77 nt, Haemophilus influenzae Rd
guuuugguucugguugggcgugguuaguauuaacugcugaagguaaauuagccguaguaucaacagcaaaccaagau

SEQ ID NO: 4228703 - RNA, 62 nt, Haemophilus influenzae Rd
aaucugcgcaaucugcaacaaguaacugggguaaagaugcaaaagcugcaggugcgcagauu

SEQ ID NO: 4228704 - RNA, 61 nt, Haemophilus influenzae Rd
aucuguggaauuucgugaggcggugcuugguuuggaagugacgccacauauuucuaaagau

SEQ ID NO: 4228705 - RNA, 60 nt, Haemophilus influenzae Rd
acuguuuucuaacaucgcaaagccccauuuggcuucaucaaaugguguuggacgaacagu

SEQ ID NO: 4228706 - RNA, 78 nt, Haemophilus influenzae Rd
uucaaagguuuaguuaaagaauauacgcuucauccauucaaucauugggcguuuauuccuguuaauuuuauucuugaa

SEQ ID NO: 4228707 - RNA, 91 nt, Haemophilus influenzae Rd
gagcagauugggcgauaguaucagaaauagagcauaaugaugaugucauuuuuaaaccgcucuuuucuuaugaaaugguugggauuugcuc

SEQ ID NO: 4228708 - RNA, 57 nt, Haemophilus influenzae Rd
uuguaauuuaagcacuugaagcggacgcacgucgccuuuauuugcaagagauugcaa

SEQ ID NO: 4228709 - RNA, 79 nt, Haemophilus influenzae Rd
cuccgaaaauauaauggaaucgaccgaaaaaacuuuccuuuauucuugaaggaaugugaauuucgguuuaacuuuggag

SEQ ID NO: 4228710 - RNA, 66 nt, Haemophilus influenzae Rd
ugguuggaugauacgucuaaauccgcguucccauuagcgcguauugcugauguguuacuccaucca

SEQ ID NO: 4228711 - RNA, 60 nt, Haemophilus influenzae Rd
guaaaggcguguuagaacuuguucguuuauuagaaacaaacgaugaaccagcacgcuuac

SEQ ID NO: 4228712 - RNA, 78 nt, Haemophilus influenzae Rd
ucuuuucuuuugauuguucgucuucuuucuucagauuauguuugagcaaaguaaguugaauuuguaaaaaugauaaga

SEQ ID NO: 4228713 - RNA, 73 nt, Haemophilus influenzae Rd
cgccagcgauauuuaaugugauuuuacuuuuacgauauucugcgucagggcaaaauugcauuaaauauuggcg

SEQ ID NO: 4228714 - RNA, 95 nt, Haemophilus influenzae Rd
gaguuugaaauagcuucgcuggugcuauuugcuugcgcaaguuuuuuugcuuuugcccgagcaauggcggcggcuacggcugcuuuuuuaggguc

SEQ ID NO: 4228715 - RNA, 121 nt, Haemophilus influenzae Rd
ggauucaaauucgccugaacagcaccaaugaaaaagcagaacaaaugagcgauuuuuuagaagaaaucggcuccgucucuguaacuuuuauggauagucaagauacaccgauuuuugagcc

SEQ ID NO: 4228716 - RNA, 96 nt, Haemophilus influenzae Rd
aguucauugauuuuccguagggugggcuuuagcccacaauuuauuauguuaguaagagcguggcuaaagcccacccuacauuagauuaguuaaacu

SEQ ID NO: 4228717 - RNA, 70 nt, Haemophilus influenzae Rd
uugucuugccuguaccaguuugagcuuguccugcgacaucucguccauuuaaacugauaggcaaggauaa

SEQ ID NO: 4228718 - RNA, 58 nt, Haemophilus influenzae Rd
aguuaaaguuguugguucagguguaggugguauuacugaaacugaugcaacuuuagcu

SEQ ID NO: 4228719 - RNA, 123 nt, Haemophilus influenzae Rd
gggcauuggcgauacacuacgcgucucuuuggcggcagauccuguagaggaaaucaaagucgguuuugauauuuugaaaucuuuacggauucguucaagaggaauuaacuuuauugcuugccc

SEQ ID NO: 4228720 - RNA, 61 nt, Haemophilus influenzae Rd
gucaauuucggguaaagguuuugucauuucuugacgauggagcaaaaucuuuggaauuggc

SEQ ID NO: 4228721 - RNA, 86 nt, Haemophilus influenzae Rd
gugggucuuggaaaaucauuugaauaucuuuacgcguuucuuuccauuguuucgcugauuguuuucguaaauguuuaccaagccac

SEQ ID NO: 4228722 - RNA, 60 nt, Haemophilus influenzae Rd
gcacaaaauggccauuuauuuauagugggaauaucaauaguaaaauaggcuauuuugagc

SEQ ID NO: 4228723 - RNA, 61 nt, Haemophilus influenzae Rd
uugguaaaagaugggcgagaucggaaauuuuauugccaucuucgccguuaauuuuuacuaa

SEQ ID NO: 4228724 - RNA, 63 nt, Haemophilus influenzae Rd
cuugguguaauuagaaaagucacaccagaacuuuaugauguauucguucugacuuauaucaag

SEQ ID NO: 4228725 - RNA, 59 nt, Haemophilus influenzae Rd
guagggugggcuuuagccagcaaucauuucaaaaaacggugggcuuaagcccacccuac

SEQ ID NO: 4228726 - RNA, 129 nt, Haemophilus influenzae Rd
uuauauuguuugcuguugaauuugguuauuuggaugacguggaauuaucaaaaauugcaaguuuugagaccgcacuuuuagauuauucuaaccguaaucacgcugaauuuaugcaagagcuuaauaaaa

SEQ ID NO: 4228727 - RNA, 78 nt, Haemophilus influenzae Rd
gcuugucucaaaugaaauuugccacaacaaucugcguaaugauggcuagauugacauggacaauuuucuaaagaaagc

SEQ ID NO: 4228728 - RNA, 66 nt, Haemophilus influenzae Rd
cgcuacucgauggcccaguuauucaagccgcgaauaaucgugcuuuaacugcaggucauagcagcg

SEQ ID NO: 4228729 - RNA, 66 nt, Haemophilus influenzae Rd
uuugcaaaauuuagcugccuuguugccauuaaauaaaguggaagaagugcgguugguuuuuuuaaa

SEQ ID NO: 4228730 - RNA, 65 nt, Haemophilus influenzae Rd
acauuaucugcucguaaaauuauuaauuuguucuaucaaagcaaugaaagugcgguagauuuugu

SEQ ID NO: 4228731 - RNA, 69 nt, Haemophilus influenzae Rd
uucuguugcuuucgucuuguauauuuugacuuaugccuacauaaccucaggcggaggcauuacacagaa

SEQ ID NO: 4228732 - RNA, 80 nt, Haemophilus influenzae Rd
cacuuguuauuuggcaaacugguucugguacacaaucuaauaugaaugugaacgaaguaguugccaaucgugcucaugug

SEQ ID NO: 4228733 - RNA, 63 nt, Haemophilus influenzae Rd
gcgcauuacguuuuagcaagguaauuccuuacgcaggaaauauugugacaaaugauauugcgc

SEQ ID NO: 4228734 - RNA, 60 nt, Haemophilus influenzae Rd
uguggcauaggaccaucuguugcugcuacuacuaaaauagcaccauccauuugugccgca

SEQ ID NO: 4228735 - RNA, 74 nt, Haemophilus influenzae Rd
uucaguuaauugucuguauuacugaggguauuccuacauuggauaugcuuaaagugaaacagaaauuaaaugaa

SEQ ID NO: 4228736 - RNA, 68 nt, Haemophilus influenzae Rd
auuuaucagcccugugccuuauaucuccgcccugaaggacggaguuuuacggcacagggcugauaaau

SEQ ID NO: 4228737 - RNA, 74 nt, Haemophilus influenzae Rd
gcauuacgcgcuaaauaggcuguuuuaugauguuguuuagcaaaaucgcgugcuuguuucagcgugucuuccgc

SEQ ID NO: 4228738 - RNA, 66 nt, Haemophilus influenzae Rd
ggaguuugccguuagccauuuuuguggcguggcucuuagcgcgcaaaaacuucuaugguaaauccc

SEQ ID NO: 4228739 - RNA, 66 nt, Haemophilus influenzae Rd
guuaugcguuuugaaggagauauuuucgguaauaaaaaaccgauguauuccguucaagaacaaaac

SEQ ID NO: 4228740 - RNA, 59 nt, Haemophilus influenzae Rd
cuuugcuauuuuuucuaaaacugggaaacuuuuauucagugauggacgaaauggaaaag

SEQ ID NO: 4228741 - RNA, 58 nt, Haemophilus influenzae Rd
ucaucuuuuacgaagugcaucguaaacauuaucauacgugcaacccagaagaagauga

SEQ ID NO: 4228742 - RNA, 79 nt, Haemophilus influenzae Rd
gguuaaugugaaauguauuccaaaugccguauuugaaguugugcauucucuugcgaaauggaaacgccauacauuagcu

SEQ ID NO: 4228743 - RNA, 73 nt, Haemophilus influenzae Rd
aaaguauuaguguuagucgcugcaccagaaggaauuaaagcucuugaggcugcacacccugacauugaacuuu

SEQ ID NO: 4228744 - RNA, 83 nt, Haemophilus influenzae Rd
gguucuaagaucacuuuagcauguguugaacuaauuuguucaauaucuacuaaacgugguuuuaaaaauucuguaacagaacc

SEQ ID NO: 4228745 - RNA, 55 nt, Haemophilus influenzae Rd
guucugauuuagugccuagguauuuugcguuauacuuagcucgcauucucagggc

SEQ ID NO: 4228746 - RNA, 112 nt, Haemophilus influenzae Rd
uuuggauaagcuaaugcugacauuaaauuuccuuguggcacauacggcuuuugugacaagaaaagcugauugugcguagggcaauuuauuucccccucggcauagcuccaaa

SEQ ID NO: 4228747 - RNA, 74 nt, Haemophilus influenzae Rd
cgccgauuaaauauuguaagcucaucgggucaaucacaaguugaaccccugauuuuucaaugguuaaaucgccg

SEQ ID NO: 4228748 - RNA, 60 nt, Haemophilus influenzae Rd
guggauuucgagcauuggggaaacaaccgcuuuguugccgucaaucaauuggaaauccgc

SEQ ID NO: 4228749 - RNA, 104 nt, Haemophilus influenzae Rd
ggauagucaaauuacccaagguaaugaaauuauucaaucaaugggcuuaacaaacguucguuugcuugaauauuuuauuuaucaaguugguucauuuacuauuc

SEQ ID NO: 4228750 - RNA, 76 nt, Haemophilus influenzae Rd
acgacuuugcagcuauugcugacuuugauauggcacaagccgcuguucaagcugcaaaagcaaaagguaaagucgu

SEQ ID NO: 4228751 - RNA, 83 nt, Haemophilus influenzae Rd
ggaguguuuauuuuguuggaagccuguaggguucaauaugcgauuuugugggcaaccuugaguuucuugcugaauuauauucc

SEQ ID NO: 4228752 - RNA, 56 nt, Haemophilus influenzae Rd
uaggaaaauaaaaugccgucuaaaaauuaaaauuuaggcggcauuuuuucuuccua

SEQ ID NO: 4228753 - RNA, 66 nt, Haemophilus influenzae Rd
caauuaauguuaaccgcacagccuuugccaaugacagcuuuggcuaaagugguugcacauugguug

SEQ ID NO: 4228754 - RNA, 62 nt, Haemophilus influenzae Rd
guaagaguuuccuauuuagaauaggaaugucaaauucagucugaauauaaggaaacucuuau

SEQ ID NO: 4228755 - RNA, 56 nt, Haemophilus influenzae Rd
gucguugauggcauacggcuuaauaaaucuaaagagccagaugcaaaaucaauggc

SEQ ID NO: 4228756 - RNA, 60 nt, Haemophilus influenzae Rd
cugcuguugagaauacuugcgauuuuuuaguuggaaucgugguauuuuucucaauuaaag

SEQ ID NO: 4228757 - RNA, 110 nt, Haemophilus influenzae Rd
ccaaugaauaucgcacaucaugcccaggucggucuuuuacaaaagucauuaaaucuucguaauacuuaaugugauuaggcuuacuuggcgcaaguucuucgaguaauugg

SEQ ID NO: 4228758 - RNA, 56 nt, Haemophilus influenzae Rd
guaguggauuauaugguggcucgcuauggcaauuuuguaaccuaugauccuccuau

SEQ ID NO: 4228759 - RNA, 71 nt, Haemophilus influenzae Rd
ugauuucguuauuuuccgccgaaauugcuuagcguuaggcuugcccgaucccgcagagaaaaaugaaauua

SEQ ID NO: 4228760 - RNA, 62 nt, Haemophilus influenzae Rd
uguaggugggcuuuaagcccaccgauuaaugaaaucuuuggugggcagaaacccauccuaua

SEQ ID NO: 4228761 - RNA, 70 nt, Haemophilus influenzae Rd
gauugguggaaagaaucucaauuaauuccgcacuuugguuuuauuauugaaugguucuuucaacaacuuc

SEQ ID NO: 4228762 - RNA, 70 nt, Haemophilus influenzae Rd
ggggggagcugucgcgaagugacugagggggauacguaaucccccuuccgcccuucgggcaccuuccccc

SEQ ID NO: 4228763 - RNA, 60 nt, Haemophilus influenzae Rd
uuguuccccuuuguaauaaaguguaacgaucacuccugcacuuaauaauaaggugagcag

SEQ ID NO: 4228764 - RNA, 80 nt, Haemophilus influenzae Rd
ggaauuagguaaauaugcaacagaauuaggcuacgacugcuuaucugcagugacgccauucuauuacaaauuuagcuucc

SEQ ID NO: 4228765 - RNA, 81 nt, Haemophilus influenzae Rd
uuuaccuuagcggaaauugaucgcauugaggauacaacuaaugaauugcauucaauguguuuagauuuugcggcggaugaa

SEQ ID NO: 4228766 - RNA, 69 nt, Haemophilus influenzae Rd
cgacuuuguuugauuauuugccggagcaaacgcuguuuguagauauggaaaauaaucaaacgcaaggcg

SEQ ID NO: 4228767 - RNA, 102 nt, Haemophilus influenzae Rd
ugauaguucguaucaaaccauuuggucauuucaauugcgaauugaucuuuguuaccacgugcaaguuggaaauauugaucaaggguuaaauuuuggcuauca

SEQ ID NO: 4228768 - RNA, 59 nt, Haemophilus influenzae Rd
cgguguuauuuugacuugggguguggcagugccauauuucacaaugucagaagauauug

SEQ ID NO: 4228769 - RNA, 101 nt, Haemophilus influenzae Rd
ccugaauuaguuacaucgaaacaaaaacgcauuccagugauucaacgcgcacaaauguuggcggagauuaugcguuuucgucacgguauugcuguugcagg

SEQ ID NO: 4228770 - RNA, 74 nt, Haemophilus influenzae Rd
agcgauugcauuuuuagucaauggcacgguucuugauguaccguuuuuugucauaggcaaaaaugcaguacguu

SEQ ID NO: 4228771 - RNA, 67 nt, Haemophilus influenzae Rd
uuggauuuguugcaagaaucacuucguggaaagauucuucuacuaagcguuuuugcaguaaaucuaa

SEQ ID NO: 4228772 - RNA, 72 nt, Haemophilus influenzae Rd
gaacccguucgcuguauuagcuaauuuaaagcaaaaguaaauuaaauuuaggaguauagccaauggcuguuc

SEQ ID NO: 4228773 - RNA, 78 nt, Haemophilus influenzae Rd
ucaaguuuauuaauauucuuuuuauuagauggagcaguaauacuuucguucccaguaauaguaauauuagcgacuuga

SEQ ID NO: 4228774 - RNA, 69 nt, Haemophilus influenzae Rd
cuuuaugugcuacaagagcguauuaaucaacaagcggcacaauuuagccgucguaugcuuggcacagag

SEQ ID NO: 4228775 - RNA, 79 nt, Haemophilus influenzae Rd
aaucguaaacguugguuacgcacagggaaauguucuuucuuaccggaagaacgagcgugguaucaacguuuguaugauu

SEQ ID NO: 4228776 - RNA, 67 nt, Haemophilus influenzae Rd
auugugaaauuugcauuuggaauggcgcaucaaguucuacuuuuggcgguucuacauguuucacaau

SEQ ID NO: 4228777 - RNA, 68 nt, Haemophilus influenzae Rd
cauugcuaauuuaauugcugauuuagugauuaguuuagauauucaaaaaaucgcgauugguggcagug

SEQ ID NO: 4228778 - RNA, 55 nt, Haemophilus influenzae Rd
ugaauguugguagagaguuuccaaaauguccuuugcauuuucuaccaacauugca

SEQ ID NO: 4228779 - RNA, 116 nt, Haemophilus influenzae Rd
caauccaugccgcaggugguauagcuauuauugcgcauccauuacguuauaacaugacggggaaaugggugcguaagcugauagucgauuuuaaggcuuggggcggugauggaaug

SEQ ID NO: 4228780 - RNA, 71 nt, Haemophilus influenzae Rd
uacagccaauggcaagauauaauaaaccugcaauacccguagaauuuaaugauauuugccaguuuucugug

SEQ ID NO: 4228781 - RNA, 112 nt, Haemophilus influenzae Rd
uugugcauuucuucuggaucguuacggauguuguaaaguucgcaaacaucagucgcauuaaauacgaguuuguaaucuuuacgacgccacauacgcuguucaaaauacacaa

SEQ ID NO: 4228782 - RNA, 73 nt, Haemophilus influenzae Rd
ggagaaaucaaucgccguauucgugguaucacuuucugugcaagaaguuuaccaaauaugguagaacauuucc

SEQ ID NO: 4228783 - RNA, 59 nt, Haemophilus influenzae Rd
uuuuagcgcgccaauuugaauuaggcgauuauaugucgcuugguucuggcgagcuaaag

SEQ ID NO: 4228784 - RNA, 56 nt, Haemophilus influenzae Rd
aaaaaugaccgcacuuuaguuuguuuuucggaauagauuaaagugcgguuauuuuu

SEQ ID NO: 4228785 - RNA, 79 nt, Haemophilus influenzae Rd
guauuccgugaagaacgugaauuugaaggcccauuaaauguguauggcuauucuaaauucuuguucgaucaauaugugc

SEQ ID NO: 4228786 - RNA, 80 nt, Haemophilus influenzae Rd
gugccugaaaucaaccaaugggcgaaaauggauuucuuuaugcguguuuauuggcuuguuugguugauuguauuagccgc

SEQ ID NO: 4228787 - RNA, 69 nt, Haemophilus influenzae Rd
gaucaccguaucaaucucaccauuuaccguuuggaugaagugaugaaugguaaaauugaugaacugauu

SEQ ID NO: 4228788 - RNA, 55 nt, Haemophilus influenzae Rd
gcgguuuggcugugauguugccuguaagaucgguuucgauauaacagacaagcgc

SEQ ID NO: 4228789 - RNA, 92 nt, Haemophilus influenzae Rd
cuucgaucgugcaaaagcaacugcugaacgcuuagguauugaaguacaaaaaucuugggguuuaggcagcauugucaaugcaaucuuugaag

SEQ ID NO: 4228790 - RNA, 64 nt, Haemophilus influenzae Rd
ugggcacuuguugauugacuuguuuuaaaacuauuuuuaauuuugaagucuuaauaggugcuua

SEQ ID NO: 4228791 - RNA, 77 nt, Haemophilus influenzae Rd
guuguaggugggcuuuagcccaccaauuaaccauaaaaaauggaauaaaaacggugggcugaagcccacccuacgau

SEQ ID NO: 4228792 - RNA, 60 nt, Haemophilus influenzae Rd
gguuugcacggugaucauguaggcggugaauuaaauucagccaaugcauucaccgaaacc

SEQ ID NO: 4228793 - RNA, 58 nt, Haemophilus influenzae Rd
gaaaaugugcggugcaaaacauuugauuauauuuuucauuuugcgcuuguagauuuuu

SEQ ID NO: 4228794 - RNA, 67 nt, Haemophilus influenzae Rd
guggauugugugagguagauuuuuguucaaucgaaauugcaggggaaagucccucaauagaauccac

SEQ ID NO: 4228795 - RNA, 84 nt, Haemophilus influenzae Rd
caggcaaaggucaauuagcggaagaugugcaaagcguguucuuuaaaaugaaagaacagcuugaauuuauccgaacuuuguuug

SEQ ID NO: 4228796 - RNA, 65 nt, Haemophilus influenzae Rd
gugaaaaaucacugaugcccaaaaauaacguggauuuuuucguucacgcaucauugauuuuacau

SEQ ID NO: 4228797 - RNA, 110 nt, Haemophilus influenzae Rd
gguaaaaaugcggcugugauuggugaaguaauaaccgauaaaaaagugcguuuaguaggcauuuuuggacaaagucgauuguuagauuuaccaacaaaugaaccauugcc

SEQ ID NO: 4228798 - RNA, 55 nt, Haemophilus influenzae Rd
guaaaaccuaaugcauauagaugcgucaucguuuuauuuggcacagagguuuuac

SEQ ID NO: 4228799 - RNA, 65 nt, Haemophilus influenzae Rd
ucgcccuuguuuacaacaugcugauauugauaaauuguuagcuauugaagauaaacaaggugcga

SEQ ID NO: 4228800 - RNA, 55 nt, Haemophilus influenzae Rd
ggcugauaaagaucuaauggcuuuugaugcgccugauuuagaacuuuaucaugcu

SEQ ID NO: 4228801 - RNA, 57 nt, Haemophilus influenzae Rd
uuuguaauguugaaaggguuugcuuaagagaaugagcggaguuuggaauauuacgaa

SEQ ID NO: 4228802 - RNA, 94 nt, Haemophilus influenzae Rd
acggugcucgcauuauuuuaauggaacguuuugcugaagaugcgggcuuauuagcgaaaguccgugauuauuuagcgaaaaaugcgguuaucgu

SEQ ID NO: 4228803 - RNA, 66 nt, Haemophilus influenzae Rd
gcaacauggcauugaaggcauugauauggucguugugaauuuauaucccuuugcugccacuguggc

SEQ ID NO: 4228804 - RNA, 70 nt, Haemophilus influenzae Rd
agcauucaccacgcaagauauugagcacgccaucaaaggcguucgugcauuaggcauccgugguugugcu

SEQ ID NO: 4228805 - RNA, 82 nt, Haemophilus influenzae Rd
acguuauguugauccguuagaugcuggaaaugacgcggcuucgcaacguuauuauucaaguuuaaauaauucuauagaaugu

SEQ ID NO: 4228806 - RNA, 73 nt, Haemophilus influenzae Rd
uuuuuuccugaaauuguaauuguuccaaugaauugguuaucuugauuuauuaggaaguuacaucaugaaaaaa

SEQ ID NO: 4228807 - RNA, 63 nt, Haemophilus influenzae Rd
acuuguaugccaggcgauuugcuuuggcguauuacgcacaaaauaaucuucuggacaacgagu

SEQ ID NO: 4228808 - RNA, 69 nt, Haemophilus influenzae Rd
cugacaaaccuuuaggugcuaaaauauaacggcguucaccgucuuuauaaagcacuaaagcaauguuag

SEQ ID NO: 4228809 - RNA, 68 nt, Haemophilus influenzae Rd
uuguaggggcgaauuacauucgccugauaaaccaccgauguuuuugggcaaauguaauuugccuacaa

SEQ ID NO: 4228810 - RNA, 65 nt, Haemophilus influenzae Rd
gacgauaaucuugcauugcugcagcaaaaauuucugaugcggaagcacuguaacgauuaaucauc

SEQ ID NO: 4228811 - RNA, 94 nt, Haemophilus influenzae Rd
cucuuguggucaauguauuguuaaagugaaaaaugguggcggagaaauucuuccaaccgaacuuucucacauuaacaaacgugaagcaaaagag

SEQ ID NO: 4228812 - RNA, 67 nt, Haemophilus influenzae Rd
gcaauugguacaggaaauauucgagaagggauugcuacgaugagucucgguacuucugguaccuugu

SEQ ID NO: 4228813 - RNA, 80 nt, Haemophilus influenzae Rd
acuccauuaauggcacguuguacagaaaaugaaagugaaggucgcuucauuuucuacggugcaaugauuacugagggggu

SEQ ID NO: 4228814 - RNA, 71 nt, Haemophilus influenzae Rd
cgguauuggucgugaugaauauaauccagauaaauuacguuaucaucauaucauuauuaugaccgaugcug

SEQ ID NO: 4228815 - RNA, 55 nt, Haemophilus influenzae Rd
ucaacgaaugaacuuguccguuuucagguaaaacuggacaaggucgauuuguugg

SEQ ID NO: 4228816 - RNA, 76 nt, Haemophilus influenzae Rd
agauccuaucggagggggauuuucucguucguuuaaauuaaaacccgaaccgauuuuaaauucuccccgaugauuu

SEQ ID NO: 4228817 - RNA, 79 nt, Haemophilus influenzae Rd
aaaaagccacacuuuggcaaggaauuucacacgcgcuugguuguuuugugaagauguauuuguuaaaagcggguuuuuu

SEQ ID NO: 4228818 - RNA, 59 nt, Haemophilus influenzae Rd
uuuuguaguauccauucauuuguagaggaaauaaucggcugauaauggauacuauaagg

SEQ ID NO: 4228819 - RNA, 102 nt, Haemophilus influenzae Rd
gguuacguagugaguauuccaauuuucguagauucugcauuuguuauccuuuauccaguagcaaaagcucucgcaaaaaaugguaaacgcucauuauuaacu

SEQ ID NO: 4228820 - RNA, 63 nt, Haemophilus influenzae Rd
gguaagauuauggcguuguugaugggcuugucuuaguucuucaacccuuaccguaaucuuacc

SEQ ID NO: 4228821 - RNA, 73 nt, Haemophilus influenzae Rd
aagcuguaacaggucaaaaugccauugacugguuacauaaucaacaacgcauucugacccaaagcgcagacuu

SEQ ID NO: 4228822 - RNA, 58 nt, Haemophilus influenzae Rd
ugcucaccaauguuauuuccuuuguuaucaagcagcagacgaauaggcguuggcggca

SEQ ID NO: 4228823 - RNA, 72 nt, Haemophilus influenzae Rd
uauggcuuuacgcaaaagcugcauaacggcaaguuucagacagguuaugcucgccauuugcgugaugcuuua

SEQ ID NO: 4228824 - RNA, 69 nt, Haemophilus influenzae Rd
cuaacaaaaaacccucuguuuaaguagcgaaaaacagagauuuucgcuagaaugaggcguuuaauuuag

SEQ ID NO: 4228825 - RNA, 64 nt, Haemophilus influenzae Rd
uguaaaaaaugaccgcacuuuuugaugaauauuuaaaaauaucaaagcgugguuaauuuuuaua

SEQ ID NO: 4228826 - RNA, 89 nt, Haemophilus influenzae Rd
gauuuuuuuagaauggaaugaaagugcgguuaauuugaaaacuguuuugaaauugaccgcacuuuuuuacuuaauuuuuuaagcaaauc

SEQ ID NO: 4228827 - RNA, 72 nt, Haemophilus influenzae Rd
gaggagaaauaguacagcaagguaaauuuaccgaauuacaacaugaagguuucuuugcugaacuacucgcuc

SEQ ID NO: 4228828 - RNA, 90 nt, Haemophilus influenzae Rd
gacagauugccauauuuucuuccauugacucuucagauaaaucgaucauaugugaagagaaaaguggacgacccguuucggcaaaauguu

SEQ ID NO: 4228829 - RNA, 58 nt, Haemophilus influenzae Rd
ugcaauugcaacaguaauugguaugcguuuauauggcgaugccggcguggcgauugca

SEQ ID NO: 4228830 - RNA, 58 nt, Haemophilus influenzae Rd
guacgguuauugauguucaagucuucacucgugacggcguagaaaaagauaaacgugc

SEQ ID NO: 4228831 - RNA, 67 nt, Haemophilus influenzae Rd
gggcguguuguucaaaaaauucgcaggcaucaacguguuugauauugaagugaaugaacaugauccc

SEQ ID NO: 4228832 - RNA, 77 nt, Haemophilus influenzae Rd
auuuuuuuagcacuagguuuauugcuaccuagcguauuuauuauuaugucaaaagcaguggaguuugcuggaauugu

SEQ ID NO: 4228833 - RNA, 76 nt, Haemophilus influenzae Rd
aacuuuugcuauugaaacuuuugaagaagguaaagacuuaguuuucacugcaacuuucgagguuuauccagaaguu

SEQ ID NO: 4228834 - RNA, 61 nt, Haemophilus influenzae Rd
gugcugaugguugguuacgugcagaaaguggcgcgcuuucuacgggugaagcuauugguac

SEQ ID NO: 4228835 - RNA, 79 nt, Haemophilus influenzae Rd
guucuuuaucaauuaaaacaucagguuuauuaggugagcaauauauugccuugacaauggguuuugaugauggagauac

SEQ ID NO: 4228836 - RNA, 68 nt, Haemophilus influenzae Rd
auggucguauuaaucgcuauugccguguuacuuucuaauaaucguaaagcgauuaguauucgaaccgu

SEQ ID NO: 4228837 - RNA, 68 nt, Haemophilus influenzae Rd
gguaaaagcacuuauaugcgccagaccgcauuaauuacauugcuggcguauaucggcaguuuugugcc

SEQ ID NO: 4228838 - RNA, 57 nt, Haemophilus influenzae Rd
gcuuuugcuucuucucgugaugguguucugaauauuuacguuaugggagcaaauggc

SEQ ID NO: 4228839 - RNA, 55 nt, Haemophilus influenzae Rd
gaaaauuguccaugucaaucuagccaucauuacgcagauuguuguggcaaauuuc

SEQ ID NO: 4228840 - RNA, 66 nt, Haemophilus influenzae Rd
auagcuaauuaucuucgauuuuugaccgcacuuuugguugauuuugucuguaggaugauuagcuau

SEQ ID NO: 4228841 - RNA, 57 nt, Haemophilus influenzae Rd
uauuagauccuuuugcugguagugguacuacauuauuagcagcuaaagaauuaaaua

SEQ ID NO: 4228842 - RNA, 56 nt, Haemophilus influenzae Rd
uugcucuauuuuagcagaagaugcaauuaaagcagcaauugcugauuauaaagcaa

SEQ ID NO: 4228843 - RNA, 60 nt, Haemophilus influenzae Rd
uucaucagauaauucacgggguaacauuggaauguuaaagcccgguaaauaauuugugaa

SEQ ID NO: 4228844 - RNA, 90 nt, Haemophilus influenzae Rd
uuguucuucuugauuauagguuuuuucugcaucaggacguuuuaaaauaugaaguucaaaugcggcaaaagcgauaugaucaaagcgcaa

SEQ ID NO: 4228845 - RNA, 83 nt, Haemophilus influenzae Rd
cuuuguaaacagucuggcaugaaguuggguauuuauggcgauuuagccguaaauaguucucguggcagugcugauguauggag

SEQ ID NO: 4228846 - RNA, 79 nt, Haemophilus influenzae Rd
uacuucacuucaguuguuaguuuagucacugggacaauguuccuuaugugguugggugagcaaauaacugaaagaggua

SEQ ID NO: 4228847 - RNA, 58 nt, Haemophilus influenzae Rd
auuagcaggguuaucucgcaaaucaaugauuggcgcagugcuugauaaaccuguugau

SEQ ID NO: 4228848 - RNA, 73 nt, Haemophilus influenzae Rd
ugggacaaaaagugauggcgacuguuggaucugggaucaccgauuuaacgccaagccguggcuuugccgcuca

SEQ ID NO: 4228849 - RNA, 65 nt, Haemophilus influenzae Rd
gucagcgaaaugguacaagugaaugacauuacgcuaacaagcacuugugaacaucauuuugugac

SEQ ID NO: 4228850 - RNA, 73 nt, Haemophilus influenzae Rd
cguagaaggcuuggaauuauuugggcagauuucuuacuugaaaucaggcuuguucuauuccgaugcaaguacg

SEQ ID NO: 4228851 - RNA, 76 nt, Haemophilus influenzae Rd
gcuuuaauaaagguggugcgaccguagaagauguugcauugaugaaaaacacggucggcaauauugguguuaaagc

SEQ ID NO: 4228852 - RNA, 86 nt, Haemophilus influenzae Rd
gauuauuuggacagacuucacgcucaacaguuauaucuagaacauaaucugcauggcgugcgagcguggaauuuuuguuacucguc

SEQ ID NO: 4228853 - RNA, 107 nt, Haemophilus influenzae Rd
gcaacccuauuaaaaguggcagcggcagauauuuuaggugcauugccaguaaugaaaguaagcgaucauuuaaccuaucuugcugaagccauuauugaagugguugu

SEQ ID NO: 4228854 - RNA, 76 nt, Haemophilus influenzae Rd
uuuagcauuugcgguggcaacggcuauuucuuggacaaauuauuuauuuguauuagcaaugccguuguuagcuaaa

SEQ ID NO: 4228855 - RNA, 69 nt, Haemophilus influenzae Rd
ugaucuuguggaucuuugccugaauaaccuuuuacguaagguuucacuaagcguggauucacauaguua

SEQ ID NO: 4228856 - RNA, 66 nt, Haemophilus influenzae Rd
cuggguuugcuuuugagaaugcugcuuuaaaugcuaaagacgcagcaaguuuaaaugcuaacucag

SEQ ID NO: 4228857 - RNA, 59 nt, Haemophilus influenzae Rd
gcaauagguuuauagccgacaacuugcacucccugcccuugcaaggcuugaaucauugc

SEQ ID NO: 4228858 - RNA, 75 nt, Haemophilus influenzae Rd
ugcggcugcggauuuccaauugauugacggcaacaaagcgguuguuuccccaaugcucgaaauccaccaaacgca

SEQ ID NO: 4228859 - RNA, 71 nt, Haemophilus influenzae Rd
guuaccuuggguucauuugaaaugaguuucuucucaaugaaauugcguggauuaaugaauccaguuuuaac

SEQ ID NO: 4228860 - RNA, 55 nt, Haemophilus influenzae Rd
guugccauuugcaaaauacgaguuaaaagcgaagucgucauuuuuugaguggcac

SEQ ID NO: 4228861 - RNA, 80 nt, Haemophilus influenzae Rd
gcugcauaaaguaaaaauagggcauugcgaccaucaacaaaaguguuuggcaauucauucucuuuuugcucaauaugcgc

SEQ ID NO: 4228862 - RNA, 75 nt, Haemophilus influenzae Rd
uuuuaucggaugucagcuuaucugugaaaaaaggggaaauauuagguauucacgguagaagcggcagcgguaaaa

SEQ ID NO: 4228863 - RNA, 70 nt, Haemophilus influenzae Rd
aaaaccuuucgaguguuuuauuguacaaagugaagcgaugaaaagugcgguagaaaacgcgaaacguuuu

SEQ ID NO: 4228864 - RNA, 122 nt, Haemophilus influenzae Rd
aagugcgguaaaaauucgcuuaguuuuuuucaaugagaucaagauguuguuucauccauugcauaaaaucaggauccaucguuuuaaucauauuggaaccucgagugauuguggcggcacuu

SEQ ID NO: 4228865 - RNA, 89 nt, Haemophilus influenzae Rd
cuccccaaguauuacuuauaugaucauagccuaaaccaaugauauaacggcugggcugaauggcaucaaauaaauaacugcuuacggag

SEQ ID NO: 4228866 - RNA, 70 nt, Haemophilus influenzae Rd
ucaguggcgaauugcccaaaaacaauaguaaaccaacuuauucgaaaauuuuuggcgauuggcuauguga

SEQ ID NO: 4228867 - RNA, 56 nt, Haemophilus influenzae Rd
agugggguauucugucagcgguuuugaagauggauuacuugauacaaugcuucauu

SEQ ID NO: 4228868 - RNA, 64 nt, Haemophilus influenzae Rd
gaaucugcgcaccugcagcuuuugcaucuuuaccccaguuacuuguugcagauugcgcagauuu

SEQ ID NO: 4228869 - RNA, 83 nt, Haemophilus influenzae Rd
gcggauuucuuuaagaauuuuuuccgcaauuugugcuuuuugaccagugagagaaagugcgguaaaaaauucgaggguuucgc

SEQ ID NO: 4228870 - RNA, 85 nt, Haemophilus influenzae Rd
gauugaauccguuuuuguagaaauacauaccgagguaacuauauccuaaugccccgauuguauaggcuaagaagcggcuuucuuc

SEQ ID NO: 4228871 - RNA, 102 nt, Haemophilus influenzae Rd
cagugauaaugcuuguaccuucugccaccauauuuaauaaaguaaauugagccugcauaucaguugggaacccuggauguggugcaguacgaauauucacug

SEQ ID NO: 4228872 - RNA, 61 nt, Haemophilus influenzae Rd
uaucuucggguaaauuacgaagaccugcuuguaaaacagcaaucguauuuggacgaggaug

SEQ ID NO: 4228873 - RNA, 80 nt, Haemophilus influenzae Rd
gguuaugcaaaaggaaaaaugcugaaugcacugacuuuagcuugugaauuucagcaaguuuuuccuguugaugaaguacc

SEQ ID NO: 4228874 - RNA, 75 nt, Haemophilus influenzae Rd
cuguacaacuugcacagauucuucaagcuaaauuaauuggcgaugaaaaugugcaaguugaaaaaauuaauacgg

SEQ ID NO: 4228875 - RNA, 56 nt, Haemophilus influenzae Rd
caauauucguuacugaaagagcguucaguauguuuauuuugaguaacggaauauug

SEQ ID NO: 4228876 - RNA, 64 nt, Haemophilus influenzae Rd
ucaagcaucuugucaucccauuguuuaguauggauguuaaauaacaugguacgagaugcguugg

SEQ ID NO: 4228877 - RNA, 71 nt, Haemophilus influenzae Rd
gcuggaggaguaaauaaaaauaauguaucagauuacgccaaauuggguauucguuuauuuaucacuucugc

SEQ ID NO: 4228878 - RNA, 60 nt, Haemophilus influenzae Rd
uugcacauaauguucauauuggcacugguacagcgguugcggguggcguuauuauggcag

SEQ ID NO: 4228879 - RNA, 123 nt, Haemophilus influenzae Rd
aaugcuucauauuuugcugaauaaacuccgccaguaacaauaguuuuaacauuggauuuauuaacuagggcauuaauguuaaacauugaauugguuacuacuguacaaggaauaucgggcauu

SEQ ID NO: 4228880 - RNA, 88 nt, Haemophilus influenzae Rd
guugcgaaugaauuauuagugucauuaguucgugaguuuuuugauuuacguccuuauggcuuaauuaaaauguuagauuuaauccaac

SEQ ID NO: 4228881 - RNA, 55 nt, Haemophilus influenzae Rd
uaacguugggaaauauugucggcggggcaauuuguauugguguauuccaacguua

SEQ ID NO: 4228882 - RNA, 87 nt, Haemophilus influenzae Rd
aagaaaaauugcagcaacuuuaugaaggugcauuuggguuuggggcgaaaauucaacccgaagaacuugauagagccgaucuuucuu

SEQ ID NO: 4228883 - RNA, 63 nt, Haemophilus influenzae Rd
gguaagauuacgguaaggguugaagaacuaagacaagcccaucaacaacgccauaaucuuacc

SEQ ID NO: 4228884 - RNA, 85 nt, Haemophilus influenzae Rd
gauuauuuagaugaugaaagccguacgcauuuugaacaauuauguucauuauuagaugcaguggguauucaauaugaaauuaauc

SEQ ID NO: 4228885 - RNA, 62 nt, Haemophilus influenzae Rd
gccguaacccaauguauuuaaguuugcuguuaauuuugcuugcuuggacgcuuugguuaggu

SEQ ID NO: 4228886 - RNA, 66 nt, Haemophilus influenzae Rd
guucgguuuauuuucucuaguucuuuagccauauuugguggagaacuaccugaaacuauuuuagac

SEQ ID NO: 4228887 - RNA, 114 nt, Haemophilus influenzae Rd
uguuuaauuucagggaagcuaaauuuguaauagaauggcgucacugcagauaagcagucguagccuaauucuguugcauauuuaccuaauuccaccgcuucuuuuaaguuuaca

SEQ ID NO: 4228888 - RNA, 100 nt, Haemophilus influenzae Rd
aggguaguauugaagaugcuuaucaacuugcuaaagauuuaguuacagaugaugcgguaaauaaauugaagcaauugguuggcaauaaaaaugcaauucu

SEQ ID NO: 4228889 - RNA, 58 nt, Haemophilus influenzae Rd
uaucuuuaggugcaagagaauggccagcuuucgcuuuuucuucccaaccuaaacgaua

SEQ ID NO: 4228890 - RNA, 60 nt, Haemophilus influenzae Rd
guucgcaguacacaccgauuucacgcacacgacgcgcaaucaguugaguguauugugaac

SEQ ID NO: 4228891 - RNA, 92 nt, Haemophilus influenzae Rd
ugggguauuuccuaucaguggcaugguaauagccaauuaacucaagcugauuauuggcuuuauuugcucacugaaacggguagcguaccuua

SEQ ID NO: 4228892 - RNA, 126 nt, Haemophilus influenzae Rd
acgccgauaccacauuccauaccguuacgaacuucagauacgucgucuuugaaacggcgaagagauucuaauuccccuucaaauauaacgacguugucacguaauacacggauuggguuguuacgu

SEQ ID NO: 4228893 - RNA, 116 nt, Haemophilus influenzae Rd
cagagaaugaacaucgguuaaaaguucagugauagcaauaauagcguggcguuuaccgcgaauaaugcuacguucaauuuguugaauuaauucuucacgauuaaauucaauuucug

SEQ ID NO: 4228894 - RNA, 64 nt, Haemophilus influenzae Rd
gcacuucuugguggcugguuaacaacacaauaccaccucguugagcaugcucaucaaaaagugc

SEQ ID NO: 4228895 - RNA, 55 nt, Haemophilus influenzae Rd
uugugaaguaaugacuauucgcgaugaagaaauugcagaaggucgaauuucgcgg

SEQ ID NO: 4228896 - RNA, 73 nt, Haemophilus influenzae Rd
gguauacaauauuggcuaugaugcaccaagcaaaaaauggggcauggauguguauaucaccgauguugcagcc

SEQ ID NO: 4228897 - RNA, 55 nt, Haemophilus influenzae Rd
acagaaucugccauuguugcagcagcauacucuguaauuauugguaaauucgugu

SEQ ID NO: 4228898 - RNA, 76 nt, Haemophilus influenzae Rd
gcugcugccgugguuuucggaaaggcaaucacaucacgaauguuuuccgugccuguuaaaagcaugguuaagcggu

SEQ ID NO: 4228899 - RNA, 62 nt, Haemophilus influenzae Rd
uggugcgauugaagcaguggucgguggcuuuagcuaugaacaaaguaaauucaaucgagcca

SEQ ID NO: 4228900 - RNA, 61 nt, Haemophilus influenzae Rd
uucagguuacagugcugaagguuugcauuaccuuacagacaauaaacauuuuaauccugaa

SEQ ID NO: 4228901 - RNA, 93 nt, Haemophilus influenzae Rd
caucuuuuugagcuugcggaaguugugauccaguuggcgugcuuccauuuggaauacucgcggaucacuuucuguuuuuaccgaaguaagaug

SEQ ID NO: 4228902 - RNA, 93 nt, Haemophilus influenzae Rd
auuagguuauaugggcuuacucggcgcauuuggcauuauggcguauuauauggugcuugguggcuggguuauuucuuauaucauuagccuaau

SEQ ID NO: 4228903 - RNA, 89 nt, Haemophilus influenzae Rd
gcuuggcguugcaauggauaacgagcaaaaccuuugccuaagguuucuccuugcugauuauaauaacgaccauuugcagcuugcacagc

SEQ ID NO: 4228904 - RNA, 63 nt, Haemophilus influenzae Rd
gcgaugaaaaaugcgaauguugucacggcauuuaauauuguucgcaccgcgcuuuuuuaucgc

SEQ ID NO: 4228905 - RNA, 70 nt, Haemophilus influenzae Rd
gcugguucaguuucaucauuaaauguaucugucgcaacagggguauguuuauuugaaauuguacgucagc

SEQ ID NO: 4228906 - RNA, 57 nt, Haemophilus influenzae Rd
ggucgugagugauugcuaccacuguacccucguagucguguaagaaucgcucuaacc

SEQ ID NO: 4228907 - RNA, 70 nt, Haemophilus influenzae Rd
uauuuaucauucuuaucguugcuggugugauuaguucucucaguuuggcaauuaugagcaguaauaaaua

SEQ ID NO: 4228908 - RNA, 104 nt, Haemophilus influenzae Rd
auccaguuacucacuuugauaaaaaugauguggaauaugcagggcuugugaaauuugacuuccuaggcuugcguacucuuacuaucauuaaaugggcauuggau

SEQ ID NO: 4228909 - RNA, 62 nt, Haemophilus influenzae Rd
uuaaguuugaaaacggcgauaaauuuagccucugaugcaaaauuuaucgauuucgaucuuaa

SEQ ID NO: 4228910 - RNA, 84 nt, Haemophilus influenzae Rd
uuacgcgauugaguuuccacauuuagaugaugaaccgcaagaugaauuguuagcacguauugaauguggcgauuuugugcgugg

SEQ ID NO: 4228911 - RNA, 83 nt, Haemophilus influenzae Rd
uaucgcucgccaauauuuaaugcaauuuugcccugacgcagaauaucguaaaaguaaaaucacauuaaauaucgcuggcggua

SEQ ID NO: 4228912 - RNA, 64 nt, Haemophilus influenzae Rd
cgcauuuuuugccuaauuucgcucguucaaugguaggaaugaagccaaguagggcaaaagugcg

SEQ ID NO: 4228913 - RNA, 65 nt, Haemophilus influenzae Rd
aaaauucaaccgcacuuuauucauuuuagauugcguuuguuauagauaaagugcgguuguuuuuu

SEQ ID NO: 4228914 - RNA, 77 nt, Haemophilus influenzae Rd
uaaccagugguuggucagguacguuauugccugacuggcgggucaggcaguaacucaaucucgaucagcuuuguuua

SEQ ID NO: 4228915 - RNA, 97 nt, Haemophilus influenzae Rd
gccacaaguucuauuauuugaugaaccaacggcugcgcuagauccagaaauuacugcgcaaguuguagauauuauuaaagaauuacaagaaacuggc

SEQ ID NO: 4228916 - RNA, 101 nt, Haemophilus influenzae Rd
aacggauaucacauugccaucgcgucaucuuguuuuuaugccugaaaauagccacguaggcguuucacaacgcauugaaagcgaagaagaacgcgcccguu

SEQ ID NO: 4228917 - RNA, 55 nt, Haemophilus influenzae Rd
uaguuuguguuugcagagaucgcuugauccacgaauuuuugcauaauaccgacua

SEQ ID NO: 4228918 - RNA, 65 nt, Haemophilus influenzae Rd
aucgggguaacaaugauugcuucucucuucuuuugggcaguagauucgauuauugugacagugau

SEQ ID NO: 4228919 - RNA, 71 nt, Haemophilus influenzae Rd
ggucuguagcucaggugguuagagcgcaccccugauaagggugaggucggugguucaaguccacucagacc

SEQ ID NO: 4228920 - RNA, 69 nt, Haemophilus influenzae Rd
gaucgaaucggguuuaggggaauaguauggcaagcgucguaaccauuaccuuaaaugccgccuaugauu

SEQ ID NO: 4228921 - RNA, 59 nt, Haemophilus influenzae Rd
auuuuccagcucugcugcgaaauuagaacuuuuaucuuccaaauaaagggcuggagaau

SEQ ID NO: 4228922 - RNA, 80 nt, Haemophilus influenzae Rd
ccgaaugcgaguuugaugauuaucgaaaaugcagaacguuuagguuuaucgcagcuucaucaguuacgagggcgcgucgg

SEQ ID NO: 4228923 - RNA, 79 nt, Haemophilus influenzae Rd
uggucguacuuuaguggcuguacuugaaaacuaucaaaaugccgaugguucaauuaccgugccagaagagcuacgucca

SEQ ID NO: 4228924 - RNA, 60 nt, Haemophilus influenzae Rd
gguuucggugaaugcauuggcugaauuuaauucaccgccuacaugaucaccgugcaaacc

SEQ ID NO: 4228925 - RNA, 63 nt, Haemophilus influenzae Rd
gaugguauuuugacgaaagcguaaccaaauuugaaagauugaggugcuuucgcggaauucauc

SEQ ID NO: 4228926 - RNA, 83 nt, Haemophilus influenzae Rd
caucgugacaccacaagaaguaauggauaaauucgguggcgacauuuuacguuuauggguugcuucuacugauuauacgggug

SEQ ID NO: 4228927 - RNA, 60 nt, Haemophilus influenzae Rd
cauuuugaagaauggcgguaacauuuuuucuucauaaaguuuugcugcaguuucgauuug

SEQ ID NO: 4228928 - RNA, 87 nt, Haemophilus influenzae Rd
gucuuaauuuaucaucgugaagaaggucgcggaauugguuugauuaauaaaauccgugcuuauucuuuacaagauaaaggaauggau

SEQ ID NO: 4228929 - RNA, 100 nt, Haemophilus influenzae Rd
uaaccguuacauugaauggguuaucaaaagcuuaucgaguugcaggcuuccgccaaggcuggaugauuuugaacggcccaaaacauaaugcgaaagguua

SEQ ID NO: 4228930 - RNA, 64 nt, Haemophilus influenzae Rd
agcaacguuuagauauggcauuugaucguuuauuuacgcgaaaaagccagcguuugaaacagcu

SEQ ID NO: 4228931 - RNA, 61 nt, Haemophilus influenzae Rd
uuaucgugaaagaucuugaagcaaguacaggucaucgugaaccacaagguuuuucagguaa

SEQ ID NO: 4228932 - RNA, 56 nt, Haemophilus influenzae Rd
cugguuuaggcucuagugcuuguucuauuguugcugcauuaguggcauuaaaucag

SEQ ID NO: 4228933 - RNA, 84 nt, Haemophilus influenzae Rd
gcuacuuagguggaaguguugauaaauuucgucgugccauuuugauugguacugcgauuccauuagccgcuuaccuuguauggc

SEQ ID NO: 4228934 - RNA, 78 nt, Haemophilus influenzae Rd
guucaagaauggcauuuugcgcaccguuaucaaugguaauaauaccugccgauggugcggcgaaaagccauuguuugc

SEQ ID NO: 4228935 - RNA, 56 nt, Haemophilus influenzae Rd
cgacgugcagccuucauucuuucuuguuucauuaaaggaucgaaagcugaauguug

SEQ ID NO: 4228936 - RNA, 75 nt, Haemophilus influenzae Rd
guugguugcacuuggguaaauauaaaugccgccuuuuaauaaauugcgguggaagucugcuacaagugaaccaau

SEQ ID NO: 4228937 - RNA, 69 nt, Haemophilus influenzae Rd
aguguauucaauuuaucuugaucuagggcuaaauuuuuauugaguucauucagcguagauugaugcucu

SEQ ID NO: 4228938 - RNA, 69 nt, Haemophilus influenzae Rd
ugaugaagaucguugggaugcaguguuaaaguuacaaacuuuaccacgugauucuagcccaucucguca

SEQ ID NO: 4228939 - RNA, 84 nt, Haemophilus influenzae Rd
caggcaguuuaauguugcgcaucgcagaggaagaaaaauugcaaacgauuucugaaguuuuugccgaucgacauuauaugccug

SEQ ID NO: 4228940 - RNA, 93 nt, Haemophilus influenzae Rd
gcgauggcuuacuuccauuacagaaacaccuugauugagccaguuuauaaguucauuuugugcuuuuugcaacacuucugggaaaaucaucgc

SEQ ID NO: 4228941 - RNA, 63 nt, Haemophilus influenzae Rd
gauugcgauugguucugguggauuaagcggaaaaggcuggaugcaggggacucaaucacaauu

SEQ ID NO: 4228942 - RNA, 73 nt, Haemophilus influenzae Rd
uacguuauuaauugcugaccaaaaugggccuuuagcaauggcagggaucuuugguggugcagccaguggcgug

SEQ ID NO: 4228943 - RNA, 75 nt, Haemophilus influenzae Rd
auggcaauguguaaauugagugauggcaaauuagaagauucuucugauauucagcuacucaauaauuaucgccau

SEQ ID NO: 4228944 - RNA, 87 nt, Haemophilus influenzae Rd
gauaccaccuucaagaccgaugaagauaccgaaaucagugauagacuugauuuuacccguuacuuuaucgccuuuguugugaguauc

SEQ ID NO: 4228945 - RNA, 76 nt, Haemophilus influenzae Rd
ugguuuaacugguuucaucuuuaugaucuuaaccacugcagcgguuguugcguacuggaugaacccagcuacacca

SEQ ID NO: 4228946 - RNA, 73 nt, Haemophilus influenzae Rd
ggcuuaaaaucagguuuuuuaaucggcggaauugcggguaauuuuggcauuucagcucguuuaggagauagcc

SEQ ID NO: 4228947 - RNA, 99 nt, Haemophilus influenzae Rd
uccuucugaguuuugguuagauugcucuauuuuuaauugugauaagccugucaggguuuauaaauaucaguauagcaaccaagaaccagagucgaagga

SEQ ID NO: 4228948 - RNA, 107 nt, Haemophilus influenzae Rd
gauuuuugguuuuaaugaugucgagucuuuagggguauuggguaacagcauuggugcuuuauuguuuaucguuagcuuuagcuugauguggcauuauucuaaaaauc

SEQ ID NO: 4228949 - RNA, 82 nt, Haemophilus influenzae Rd
uauugaugcaaaugcaauuacgccugauccgaguugauuuuuuaaaucaucgaccauuacgcguaaugauuuuguuucuaua

SEQ ID NO: 4228950 - RNA, 58 nt, Haemophilus influenzae Rd
ugcgguaguaaugcaaugauuaucugauaaggucgucagcacaacugcauuugccgua

SEQ ID NO: 4228951 - RNA, 104 nt, Haemophilus influenzae Rd
guuccaauuuauaguuuuuugcuugugccauuaauuuuauuugccguuuuuacuaacggcacaauguuuucuuggcaacuagcaaacaagcuagccgaaggaau

SEQ ID NO: 4228952 - RNA, 57 nt, Haemophilus influenzae Rd
aagcugauauugccauuauccaugcucaaaaaggugacaugaauggcaauuuagcuu

SEQ ID NO: 4228953 - RNA, 71 nt, Haemophilus influenzae Rd
aucuuuguuccagucuuauuaccaguguuaagagcauauaauauugauauugcguauuuuggaaucaugau

SEQ ID NO: 4228954 - RNA, 74 nt, Haemophilus influenzae Rd
cgcacuuuuggcuugcucgguaaauucaacagucaguuuuacugguaguuuuucuugggcaaagcucgauugcg

SEQ ID NO: 4228955 - RNA, 71 nt, Haemophilus influenzae Rd
ucuguuuacacugaauuaagcaaagugaacgcaaaauuauuauuagccacuuauuuugguucaguugcaga

SEQ ID NO: 4228956 - RNA, 68 nt, Haemophilus influenzae Rd
guaggggcaaguuacauuugccccuauauaucaacgaauguucaagggcaaaugugauuugccccuac

SEQ ID NO: 4228957 - RNA, 68 nt, Haemophilus influenzae Rd
aggcagcaauaaugacgaaaaggagauaagguuauauuccuaguuuccuacgucaguauuaacuguuu

SEQ ID NO: 4228958 - RNA, 56 nt, Haemophilus influenzae Rd
ucgugguagauugugcaaauggugcaacuuaccauauugccccuaauguacuaaga

SEQ ID NO: 4228959 - RNA, 77 nt, Haemophilus influenzae Rd
guuggacgcugggcuguaauaggauauauugaagauuucugguugauauucuuauugcaacuuaugcacaguuuaac

SEQ ID NO: 4228960 - RNA, 58 nt, Haemophilus influenzae Rd
gugguggaauugguugaucgugauaauguauuuguucaacucgacuauuuucaugcac

SEQ ID NO: 4228961 - RNA, 76 nt, Haemophilus influenzae Rd
gccacagcauagccuuggguaauuaacauuucugcuaauuuugcauaaugauaauguggccaacguuuugcugggc

SEQ ID NO: 4228962 - RNA, 78 nt, Haemophilus influenzae Rd
auggugcuucaauaccauuuacuaauaagcgauugccuacaaagugcgguugauuuuguuugaauaauuggagaccau

SEQ ID NO: 4228963 - RNA, 76 nt, Haemophilus influenzae Rd
guuggaugauuguggaucuguguuugugauuuauuauuugcuuuuucaauggcauaacagaacccaguuaaacgau

SEQ ID NO: 4228964 - RNA, 63 nt, Haemophilus influenzae Rd
ugccugaagucaaugcugugcuagcuaaaaugaaagauuucugucagcguauuauuucuggcg

SEQ ID NO: 4228965 - RNA, 56 nt, Haemophilus influenzae Rd
auuuuugugaaaucucaucaggguuacaccuuuagaacugauggugauacaaaaau

SEQ ID NO: 4228966 - RNA, 55 nt, Haemophilus influenzae Rd
caacuugcacauuuucaucgccaauuaauuuagcuugaagaaucugugcaaguug

SEQ ID NO: 4228967 - RNA, 82 nt, Haemophilus influenzae Rd
agcugugguuuaaaauguauuuaccgauuuugguuguaccugugguaucgaagucaagagaugcaaugauuggaccauaguu

SEQ ID NO: 4228968 - RNA, 65 nt, Haemophilus influenzae Rd
accugauaagcuaucgcaccgugagguucacauaaauaaccuuucgacugcaucgcuuuuaaggu

SEQ ID NO: 4228969 - RNA, 115 nt, Haemophilus influenzae Rd
ucagaaaagcaguuaauuggucguggcgugcguuauuuuccauuugcguuugaagauaaacagccgaauaaacgcaaauuugacaacgauaugcaacacgaauugcguauuuugg

SEQ ID NO: 4228970 - RNA, 56 nt, Haemophilus influenzae Rd
gucguugaaaucgugugcuggggugauuuucacgacaccuguaccgaauucacgau

SEQ ID NO: 4228971 - RNA, 89 nt, Haemophilus influenzae Rd
auauucucauuacauuguagggugggcuuuagcccaccguuuguuaugguuaauugugggcugaagcccacccuacaguauuguuauau

SEQ ID NO: 4228972 - RNA, 79 nt, Haemophilus influenzae Rd
gcuauuuauuugcuuuaguggcgggagauuuugauuuauuacaagauaaauuuauuacuaaaaguggucgugaaguggc

SEQ ID NO: 4228973 - RNA, 79 nt, Haemophilus influenzae Rd
uggcacagcgauuaccaaagguucuguauuccaugcagguaugcgugcaguaaucgcaaucuucgguauugcuugguua

SEQ ID NO: 4228974 - RNA, 112 nt, Haemophilus influenzae Rd
cuguucauuguuauuagaaggcgaagccgauucucguuaucguacuuugcguagucauaaaaaccguuuuggugcaguaaaugaauugggcguguuuggaaugacagagcag

SEQ ID NO: 4228975 - RNA, 57 nt, Haemophilus influenzae Rd
augacauuaggcaauauugccgagcguuuauuugauccucgcgauuugcuugguuau

SEQ ID NO: 4228976 - RNA, 60 nt, Haemophilus influenzae Rd
uagguaaguauauccuagguucaguccuauugaagaacuaaccuagaguauacuacccua

SEQ ID NO: 4228977 - RNA, 77 nt, Haemophilus influenzae Rd
caaaugugcgcgugauuugcacaucacagguuccacuucauuugcuuguugagcaagguaaaguacgugcugauuug

SEQ ID NO: 4228978 - RNA, 120 nt, Haemophilus influenzae Rd
aauauugccguauuggugcgugauaaaaaugaagcggcuuuaguaaaaaaugaauugcaaaaauuggggaucgcgucgguuuaucuuucugaucaaaauagcguauuugauagcaauguu

SEQ ID NO: 4228979 - RNA, 72 nt, Haemophilus influenzae Rd
guggaaggcgugcgucguggcauugauauguuugacugcguaaugccaacccguaacgcacguaauggccau

SEQ ID NO: 4228980 - RNA, 61 nt, Haemophilus influenzae Rd
gaagauucggugauuuuagucgaacaaguucguauuggcgcggcuuaucauccugaaucuc

SEQ ID NO: 4228981 - RNA, 68 nt, Haemophilus influenzae Rd
uucaucgcuuuaauagcugaaacuuuaucgcccauuaaacgaauaacaucugcuguugggccgaugaa

SEQ ID NO: 4228982 - RNA, 56 nt, Haemophilus influenzae Rd
uaagcggucaaauucuucucauuauuugcaaaaugagggaaaaauuugaccgcuug

SEQ ID NO: 4228983 - RNA, 82 nt, Haemophilus influenzae Rd
aaugaguauucgcacccaugauuuagcugaaauucgcgauccuuacauagcacucgguuuugucgugguugcaguguuuauu

SEQ ID NO: 4228984 - RNA, 59 nt, Haemophilus influenzae Rd
gcguuauaucaauuggacaggcugcggcaauaugcucaauuuauccucugauguagggc

SEQ ID NO: 4228985 - RNA, 73 nt, Haemophilus influenzae Rd
ggcgauuuuuguugggcaaucugguguugguaaaucgaguuuaauuaaucauauuuugccuagcguaaacgcu

SEQ ID NO: 4228986 - RNA, 80 nt, Haemophilus influenzae Rd
ccuuuaacucuagaagccguacguuugcaaaaugcgggcgcagucacuugucauacgcauuuugaugaacgcgguuuagg

SEQ ID NO: 4228987 - RNA, 97 nt, Haemophilus influenzae Rd
gguugagcuuugaguugcccaaauuuccauuggguuauguucuacccaaccagcucgaggguagauuuggguaaauucacguugugcaauuucaacc

SEQ ID NO: 4228988 - RNA, 63 nt, Haemophilus influenzae Rd
uugguuuuuacucgauucuuuuuguuguucuuguagauaacgccaaagauugaggaaagccaa

SEQ ID NO: 4228989 - RNA, 59 nt, Haemophilus influenzae Rd
gagacaauuucaguuggaacgguaaucgcuacgcggcguucuaaaccuugaguuguuuc

SEQ ID NO: 4228990 - RNA, 60 nt, Haemophilus influenzae Rd
gcugagaaugaucauuucgggcaaacgcucuuuaauuguuugguagaguaaauucucggu

SEQ ID NO: 4228991 - RNA, 107 nt, Haemophilus influenzae Rd
gcacuuuuacggucuuuauaggauggguuucugcccaccaaagauuucauuaaucggugggcuuaaagcccaccuacagauuacauuacuaagcgacguaaaucugc

SEQ ID NO: 4228992 - RNA, 67 nt, Haemophilus influenzae Rd
uuggcgauggggcaaaugacuuggcaaugaugaauguggcagggcuagguguugcguuccacgcuaa

SEQ ID NO: 4228993 - RNA, 78 nt, Haemophilus influenzae Rd
ugacgguacauucuggguuaauuaauuuuacucgcucugacaugacuucaguuuuuaauuugccgauugugccgcuca

SEQ ID NO: 4228994 - RNA, 64 nt, Haemophilus influenzae Rd
uggggcguuuacguaaauuggcuauggggccugaauauuuggcagcuuuuaccgugggcgacca

SEQ ID NO: 4228995 - RNA, 82 nt, Haemophilus influenzae Rd
guguuuuauuuaucagcccugugccguaaaacuccguccuucagggcggagauauaaggcacagggcugauaaauuucuaac

SEQ ID NO: 4228996 - RNA, 99 nt, Haemophilus influenzae Rd
gcauaguggagcggauucauuuauuugcaggcgaaguggauagcgcacaagcaaaaggcauucacgguuuggcugaagaaaaugaagacauuaaagugc

SEQ ID NO: 4228997 - RNA, 102 nt, Haemophilus influenzae Rd
cacaaacugcgaccguucacaacggcacgucauuguucccgaaaguuacggcuucgggcuguuuauugagugcugugugugcggcauuuuuagcaguaagug

SEQ ID NO: 4228998 - RNA, 59 nt, Haemophilus influenzae Rd
agugaauauuuaccgugaaccacuucaucgugagaaagugguagcacaaaauuuucgcu

SEQ ID NO: 4228999 - RNA, 73 nt, Haemophilus influenzae Rd
ugguuuguugugugcguucuauugcuuaauuuuaccaauuagcuuggcauggcguacacguauugaaaaucca

SEQ ID NO: 4229000 - RNA, 85 nt, Haemophilus influenzae Rd
uuguugaaugaaaaaagugaaaggaaaagugcgguuauuuuuaaccgcacuuuuuguucauauucugauuaaauuucaucacuaa

SEQ ID NO: 4229001 - RNA, 100 nt, Haemophilus influenzae Rd
caggauugguuuuaugguauuucaucacgucuuacuuuuaguuaugccaaccgaguguauagagagaaagauuugauugguauacagcaaaaaaaucgug

SEQ ID NO: 4229002 - RNA, 78 nt, Haemophilus influenzae Rd
uugcgugcaauuugaaucauuuucugaacaucuuuaagcgugccuuugccguaaucagaaagaaucaaagcaccguaa

SEQ ID NO: 4229003 - RNA, 60 nt, Haemophilus influenzae Rd
ugcacguuuggcauucgauagcuaucaaaaggcuaauaaacuugaaccagauaaugugca

SEQ ID NO: 4229004 - RNA, 83 nt, Haemophilus influenzae Rd
ggcuuaccuucagaagaaaacuacaaaggucguggcguuucugcuugugcaaccugugaugguuucuuuuaucguaauaagcc

SEQ ID NO: 4229005 - RNA, 73 nt, Haemophilus influenzae Rd
ugccaauaaagugguaagcaaaggaugaucuggauaauguguuuguagcaccacuucaccuuguuuaucggca

SEQ ID NO: 4229006 - RNA, 118 nt, Haemophilus influenzae Rd
ucgcaguaaaccguguaucaaaaacuguaaaagguggucguauuaugaguuucacugcauuaacaguggugggcgaugguaauggccgaguagguuuugguuaugguaaagcucgcga

SEQ ID NO: 4229007 - RNA, 73 nt, Haemophilus influenzae Rd
ggucucggcacagaacaauuagaagaaaccuugaaaacucuauuuccucauuauucuguggcucgaaucgacc

SEQ ID NO: 4229008 - RNA, 78 nt, Haemophilus influenzae Rd
gcaauuucuuuauugagauuuucgacaccuaaauuguuauuacgaagugcgguuaaaaaucucacagaauuaaauugc

SEQ ID NO: 4229009 - RNA, 61 nt, Haemophilus influenzae Rd
caggggcaaauuuaucuuaauacuuggccgcuggaggcgaaguuaggcauuauuuucccug

SEQ ID NO: 4229010 - RNA, 81 nt, Haemophilus influenzae Rd
gccaaaucgcggauuguuuaaucguaaaaaucgagcguuaaguucugguugugugcguguugaaaaaucugaucaauuggc

SEQ ID NO: 4229011 - RNA, 85 nt, Haemophilus influenzae Rd
uuaacaaaaagugauuuaucuuuaauuacaucagcucguuauacggagcuuuuaggcgugguaaaagaugaauuagauaaguuaa

SEQ ID NO: 4229012 - RNA, 106 nt, Haemophilus influenzae Rd
gauucggagugaauuucauugacgcguuuuuggaaaccuucaauuugcucacggaaaggcuugagcaagguuuccaaugccguuugauuugauugacuaaaugauc

SEQ ID NO: 4229013 - RNA, 81 nt, Haemophilus influenzae Rd
gaaauagcuucgcuggugcuauuuguuugugcaaguuuuuuugccuuugcucgagcaauggcggcggcuacggcugcuuuu

SEQ ID NO: 4229014 - RNA, 66 nt, Haemophilus influenzae Rd
gcuaaggcauccauuaacauuacagaaucacuauauuuuuugucauaguugcguggcugccacggc

SEQ ID NO: 4229015 - RNA, 80 nt, Haemophilus influenzae Rd
cgaguauguaucaauuauuccgucacggcauuuuccaaauggaugcugaaaaggcucauaauuucacgauucaaugcuug

SEQ ID NO: 4229016 - RNA, 82 nt, Haemophilus influenzae Rd
gaguuugugccauuucgccuucuaaauaugcggaacgaaugccucguuuacgcaauguuucggaaaguucacgugcaucuuc

SEQ ID NO: 4229017 - RNA, 64 nt, Haemophilus influenzae Rd
ugcugcacucauccaguuggcagaaaguuuaauacguuucaucucgccaauuagggugccagca

SEQ ID NO: 4229018 - RNA, 80 nt, Haemophilus influenzae Rd
gcacuuucagcuaaaaaugguugguugccacucuuugacuuugcuuaucaagguuuagccaacggauuagaugaagaugc

SEQ ID NO: 4229019 - RNA, 65 nt, Haemophilus influenzae Rd
aguuuaauucaacuugucgauaaaaugcuugauaguuuuuccguugagcaaguugaaggcggauu

SEQ ID NO: 4229020 - RNA, 111 nt, Haemophilus influenzae Rd
ccuaaaagagauggcaaaagacgugaagccuguuuuagagaguaucggcucggucaugagcugggucucugaaaaggcuggcgguuacggcaauuuagccaaauuuauggg

SEQ ID NO: 4229021 - RNA, 75 nt, Haemophilus influenzae Rd
ugauucgugaugaucgcacugaugugauguuugaaaaugaacaauauaaauuuaaugcgauuauugaagacauua

SEQ ID NO: 4229022 - RNA, 98 nt, Haemophilus influenzae Rd
ucgucuugaucgugaacauuacauugcugauuucgucagugaguugagcgguuauuuacgugaaaauaucgagcaaguggaagucuauggucguccga

SEQ ID NO: 4229023 - RNA, 90 nt, Haemophilus influenzae Rd
ccuugguuuuuaucggggugauguuuagacgcuaaacguuuauacgcacguuugauuucguccucacucgccccuuuuuguaggccaagg

SEQ ID NO: 4229024 - RNA, 62 nt, Haemophilus influenzae Rd
gugaugauccuauucauaucguaggcuggacuuuagcccacccuacaccaaaggaucauuau

SEQ ID NO: 4229025 - RNA, 70 nt, Haemophilus influenzae Rd
uuaaauuugaccgcacuuuggcacguggaaugcgcuuaaauguuccaucuggcaaugcggugcguuuuga

SEQ ID NO: 4229026 - RNA, 61 nt, Haemophilus influenzae Rd
ggugcaauguugguagaaaaugcaaaggacauuuuggaaacucucuaccaacauucaaucc

SEQ ID NO: 4229027 - RNA, 65 nt, Haemophilus influenzae Rd
gugauccuuuuggcauucguccuuugguguuggguaaacgcgaggaaaauggcaaaaccgauuau

SEQ ID NO: 4229028 - RNA, 65 nt, Haemophilus influenzae Rd
gucgugacguauaaaaucgccauaaacggcacaauuaccgaugaugcgguugcaauacguuuuac

SEQ ID NO: 4229029 - RNA, 65 nt, Haemophilus influenzae Rd
cacuuuauaaguugcggguuuuuuaucuaaaaaauacaggaaaaacgcaccgcacuuuuggagug

SEQ ID NO: 4229030 - RNA, 64 nt, Haemophilus influenzae Rd
uuuaaugaaaagugaagaaaaccugucuauuuaucaaaaacagguggucuuuauuuucgaugaa

SEQ ID NO: 4229031 - RNA, 84 nt, Haemophilus influenzae Rd
gcgaaugaacuuuuuuaacacgcuuuugucugaacaagcaacaagagcuugcugucuugauauuaaggcguguuagauauuggc

SEQ ID NO: 4229032 - RNA, 67 nt, Haemophilus influenzae Rd
gaugcgguuaauccauucacgacugaaaguuuaauuaucuguucgcugaauugguuagaaacgcauc

SEQ ID NO: 4229033 - RNA, 64 nt, Haemophilus influenzae Rd
ucgcaaugccacauuuagacgauuauuuuaaucgcacggugguguuuaugugugagcauaauga

SEQ ID NO: 4229034 - RNA, 105 nt, Haemophilus influenzae Rd
uguucuugauuguuuagcgcaugacuuaugccuucguaaauaaaaucaugaaugaggcguuguugaugaaagcguacuucauguuugguuggaugaacauugaca

SEQ ID NO: 4229035 - RNA, 58 nt, Haemophilus influenzae Rd
guuugguaaguaaaugcacuagaugaguaucacauugaguguauuucauuacauaagc

SEQ ID NO: 4229036 - RNA, 63 nt, Haemophilus influenzae Rd
aaucagugauagaacagauccugaacaaaguauuaaagcugguucagaguauuuacacugguu

SEQ ID NO: 4229037 - RNA, 89 nt, Haemophilus influenzae Rd
uucuucauuaacuuaugauuucuauuuugaaaggcuugcaacaucauagcaaaacuucaggcuguaguaaugaugauuacuugagugaa

SEQ ID NO: 4229038 - RNA, 83 nt, Haemophilus influenzae Rd
cgcgauuaagcucgccuuguuccguuaaaauuugagccccaaaauguucaacaauuuuugacaauaagggggaaucuuucgcg

SEQ ID NO: 4229039 - RNA, 65 nt, Haemophilus influenzae Rd
uuuucauuacagccgagccuuugccuuagguguauucaaggcaaaaaauuucgcugaaauggaaa

SEQ ID NO: 4229040 - RNA, 95 nt, Haemophilus influenzae Rd
gcggcuaaagugaguuggugugugguuuuacgcuuaucacguaacucugauauggaaaaacgccuuaaucgccgagagcucgcuuauuuaucugc

SEQ ID NO: 4229041 - RNA, 92 nt, Haemophilus influenzae Rd
agaaaauaaacuuaaucaaguagcuggcgcauugacuuauagcacaauguuagcaaugguuccuuuaguuaugguuauuuuuucuauuuucu

SEQ ID NO: 4229042 - RNA, 75 nt, Haemophilus influenzae Rd
aauuuguacugaugugggucagcaucaaaugugguuagugcaacacauuuuacgcguagcacgucacugcggauu

SEQ ID NO: 4229043 - RNA, 78 nt, Haemophilus influenzae Rd
cgccacaucaucggucucaagaaugguuugaaaugcugucaaaaguugcucaguuaagcguucuugaaccuguggacg

SEQ ID NO: 4229044 - RNA, 77 nt, Haemophilus influenzae Rd
uuagugagauacauuaaugguguuuuggauauuggaauuggauaauccauagcuaaauuuaaugugacauucauuga

SEQ ID NO: 4229045 - RNA, 97 nt, Haemophilus influenzae Rd
gagaaaauucgugauguggcggcagaguuauuagauguuuacgcacaacgugaagcgaagaaaggcuuugccuuuaaauaugaucgugaagaauuuc

SEQ ID NO: 4229046 - RNA, 73 nt, Haemophilus influenzae Rd
uaaagguauucaagaacaacuuaaaucugguccauuagcugguuacccaguaguugaucuugguguacguuua

SEQ ID NO: 4229047 - RNA, 59 nt, Haemophilus influenzae Rd
ugucuggguuagauaaaguccaguuagaaacuuuagcgaaacuuuaugcugauccaacg

SEQ ID NO: 4229048 - RNA, 59 nt, Haemophilus influenzae Rd
gauccaccauauucgcuaaugcaccaccaauaaucagugcauaagcagaauuuuggauu

SEQ ID NO: 4229049 - RNA, 99 nt, Haemophilus influenzae Rd
gaauaauuuucacuagcuucaauaaagaagcucucugcguuaccacuaucuaauucaucaauagcugcuaggguuucuuuauuugggcgaagauaauuc

SEQ ID NO: 4229050 - RNA, 56 nt, Haemophilus influenzae Rd
gcgucuauggcaaacagugcuaccgcuuucuaucauggcaauguuuuacaaggcgu

SEQ ID NO: 4229051 - RNA, 83 nt, Haemophilus influenzae Rd
guuguaaaaagcaccauuuuaguucguucauuaauugaaagcgguaaauauuacguaacugaaaugcuuagcucacuugcaau

SEQ ID NO: 4229052 - RNA, 68 nt, Haemophilus influenzae Rd
uagauuuuaaccgcacuuucaucuuccucuuuuauugaugggagaaaauaaagugcgguugauuuuua

SEQ ID NO: 4229053 - RNA, 57 nt, Haemophilus influenzae Rd
uuugccaauggaaugugccacacgcucuuucaucucgcgugcggcuuuauugguaaa

SEQ ID NO: 4229054 - RNA, 60 nt, Human
gcccaaaauuguugaugcugcuuugcgggcaugcagacgguuaaacgauuuugcuagugc

SEQ ID NO: 4229055 - RNA, 68 nt, Human
ccaguagagaaauauuuguagugcuguagcauaagcauguuuaguuuucuuuuguguuauucugcugg

SEQ ID NO: 4229056 - RNA, 113 nt, Human
gagauuuggugaaauugaaggagaaaauuuaagugagucuuuaaaauauauucugaaugaaaacuguauugaggauucauuuuuguuccuuuuuuuucuuuuucucuuuucuc

SEQ ID NO: 4229057 - RNA, 67 nt, Human
aggucaccugcaaauuccagauuucugaauacaaaaaucagaauccucuagggauggcagggaaccu

SEQ ID NO: 4229058 - RNA, 65 nt, Human
auguggaaagcuugucuuagagggcuuuucuuuguauguguagcuugcuaguuuguuuucuacau

SEQ ID NO: 4229059 - RNA, 67 nt, Human
ugaauggcuuauggguccucccucuucccugggcuugcacugaagagggguggucugugaggauuua

SEQ ID NO: 4229060 - RNA, 75 nt, Human
gaggcauuagcggcauucugcauaggcuauauuuguucagccacauugaauaacuuacucuaugcuuaguaccuc

SEQ ID NO: 4229061 - RNA, 84 nt, Human
gagccaugugcagucgcuggaccaucagagccuugagcugcagcaaguucugagauucagugacugggagauuuacgaaggcuc

SEQ ID NO: 4229062 - RNA, 83 nt, Human
cacugccauggauauucuugccccugcuuuggaacaaucuaucauuggauuguggagaggaagcaaggaggcagcuggcagug

SEQ ID NO: 4229063 - RNA, 74 nt, Human
ucacacauuuuuggguugaugucugauauuuugcaucacaaaugucaauuggcuacaaauaauguaauuuguga

SEQ ID NO: 4229064 - RNA, 75 nt, Human
ggcagaggaagcuggaagugggagauguagcaacugaaagacacgcugccuucccccacacucagcagcccugcc

SEQ ID NO: 4229065 - RNA, 59 nt, Human
gcuuggagaacguuuucuagaaaaggguuagcuuccuguuggcaugaaauuuuccaagc

SEQ ID NO: 4229066 - RNA, 67 nt, Human
gaugaugcauaucuccuaucuccucaaauguauuccaguaugaggaacaugggagaaaugucuuauu

SEQ ID NO: 4229067 - RNA, 59 nt, Human
caggguuuuauuuggcuuuaaacucaggaaccaaguuaauuaugccagauugaacuuug

SEQ ID NO: 4229068 - RNA, 56 nt, Human
gugaugugugaaggucugcaggcagggauuccagccugcugggccaucuugcaugc

SEQ ID NO: 4229069 - RNA, 85 nt, Human
gcucaacucauuguuuacugucuuuuuuccuaguaaucuuaaaauaauuugccucacagaaauagagacaguaagugucugcagc

SEQ ID NO: 4229070 - RNA, 60 nt, Human
cagggacgugagccaugucagugucuguaaauagaggcaguugcagguucacguaucuug

SEQ ID NO: 4229071 - RNA, 69 nt, Human
ugaaaaucauagccaugaacauuuguaugcuuacaaagcugccaaaugaugcauggcuagugagucuca

SEQ ID NO: 4229072 - RNA, 67 nt, Human
ucaagguauuauuuuugugguguuguuacuaaacaaauauaaaaauucaacaaaaauagugcuuugg

SEQ ID NO: 4229073 - RNA, 60 nt, Human
uguuuccugagccagcacacucuucacacuacacuuugaguagcauggcucuauggaaca

SEQ ID NO: 4229074 - RNA, 108 nt, Human
agggaagggauaaucugagaauuuuuaaaagaugauuuaaugagaagaagcacaauuuugauuuugaugagucacuuucuguaaacaaucuuggucuaucuuuacccu

SEQ ID NO: 4229075 - RNA, 67 nt, Human
gcucuaccucauguucaggaggaucagggggcagcgaacuccaagugaccucaagcaugcggagggc

SEQ ID NO: 4229076 - RNA, 64 nt, Human
agcuucucauguuuauuuuuacauauuucaaaucccucauuaugucuuguaaacaagaggggcu

SEQ ID NO: 4229077 - RNA, 67 nt, Human
ggaucgaggcuugcaaggacgaggaggagcuauuggcguuuuuccugacacuggcaggcuucuuucc

SEQ ID NO: 4229078 - RNA, 76 nt, Human
gggauagauauuucaggccaaagaaacagcaugaacaaaagucuuaugcugaaugaagcacuguaauucucauucc

SEQ ID NO: 4229079 - RNA, 61 nt, Human
cugagaucaugggucaggugguuuguacucuagcaauaaaagcacuugacuuguuucucag

SEQ ID NO: 4229080 - RNA, 98 nt, Human
auguucuugagcagcacagauaaucugccuuaccacuucaagugaagccaacugaauggaaggugauucucugguuaaaauuacucgauguagaacau

SEQ ID NO: 4229081 - RNA, 80 nt, Human
gaaauguagguggaggcaacacagccacuucugaguagaagcuuuaagagucaguguaggcuuuguuacuuucccuuuuc

SEQ ID NO: 4229082 - RNA, 76 nt, Human
agucuuuagauaguaaauagcacuaagucuaaaagcaaggagauaagauuucauguuggauacuguuucaagaacu

SEQ ID NO: 4229083 - RNA, 67 nt, Human
guggauuucaggcuccccucagcccuguaaccuggcaucaggaucugagggcuggucugaagucugc

SEQ ID NO: 4229084 - RNA, 58 nt, Human
cacaaagugucaggggagagaauagcuuucacuuuuuugucaucccucucacuuucug

SEQ ID NO: 4229085 - RNA, 109 nt, Human
acauaaaauuauuucuacaaugucaagacuagccaaaggacuuuauaauacaauauuauauuacuaaagaaugaguuaaguuugagauuuugaugauuugauuuugugu

SEQ ID NO: 4229086 - RNA, 66 nt, Human
auguguuuugaccccugcuaaacaugaggucaaggaagguucaaaguauaguggguccaagcacau

SEQ ID NO: 4229087 - RNA, 88 nt, Human
ugugggcuguacuuagauguagacaugcuuuucugaugaaauauaauuauauacucugaggaauaagaugucuaaaacuaagcccaua

SEQ ID NO: 4229088 - RNA, 55 nt, Human
ggugggggugaggaauguucuauuuuuccuucgaugguuacgcccucacccuacc

SEQ ID NO: 4229089 - RNA, 114 nt, Human
ugaaaauagguucuggaugacugagugguggugauuugggucuagcuuuaaauagugggcuuuguguagcugaagugagcauccuaguuaaccuaguguccaggacuauuucca

SEQ ID NO: 4229090 - RNA, 56 nt, Human
gagggaaaggggccaugauuggcugcuuugugguuuuauuuugguucuuuccauuc

SEQ ID NO: 4229091 - RNA, 57 nt, Human
cagcucugcugggaggaugcagaaauaaaugaucagcgucccggcgugagagagcug

SEQ ID NO: 4229092 - RNA, 129 nt, Human
uccuccagacgucuccucguggaucguguaucccagcggcaagguguauguggcagccgugcgccuggagcguguggugcugaccugugagcuaugccggcccugggcagaggugcgcuggaccaagga

SEQ ID NO: 4229093 - RNA, 64 nt, Human
gcaaucucgcuguuccugcuucaggugcuaggccauuucacuaaagcagcucagacgagaaugu

SEQ ID NO: 4229094 - RNA, 73 nt, Human
aggcuggguguggugggugcugccgaaaaaaggguuccucccauccauuugcacgucacccuucccaccuccu

SEQ ID NO: 4229095 - RNA, 64 nt, Human
gcaacccugggucaugguugacauuguuccuaguuuauguaugaggacuguggcucagaguugc

SEQ ID NO: 4229096 - RNA, 86 nt, Human
uguagugcacaggaguaggauguuuagcccuucuuacggagagcaugagcaguagaagaggaggcuggaauccuaaaguguauuca

SEQ ID NO: 4229097 - RNA, 102 nt, Human
aauucuugagggggcaggcucuggcuuauucugggcaacugacuucaagugggaccccugagcuaccuauguaagcaaagagucagccaucucuggagaguu

SEQ ID NO: 4229098 - RNA, 107 nt, Human
gggccugagguuccuucuagcuuuaacuuucuuugcaucuaaguuucguagcucaagcaucuggaauuccaggugagagaagguaugguagauugaacuguuggccc

SEQ ID NO: 4229099 - RNA, 67 nt, Human
cagguuugggcuucaaaacacaugucaagauagugaauaugguggcaauuuuuggggucaacgcuug

SEQ ID NO: 4229100 - RNA, 105 nt, Human
uccaauaucauacuuuaugggcaagaagcuggaagcauuccccuugaaaaccagcacaagacaaggacgcccucucucagcacuccuauucaacacaguauugga

SEQ ID NO: 4229101 - RNA, 79 nt, Human
gggcggagcuugggaggggcgaggacgcugaaguaggggcggaaccugugcggugcagcccugcccucucccuccgccc

SEQ ID NO: 4229102 - RNA, 109 nt, Human
caacuuacacagguagcccagacucaaguggcuugguauuaaggugccaguuacgagacugguccaugcuccaggcacauucuucuuugcguuggcugucuuaagcuug

SEQ ID NO: 4229103 - RNA, 81 nt, Human
ggugccugcugcggggucauugcgugacgcgagcaccgcagcaucucaggugcacgcgcccuucgauggcccugaggugcc

SEQ ID NO: 4229104 - RNA, 58 nt, Human
guccuucgcggcugaggccauugccaugaaccggcagcuggcccagcacgacgaggac

SEQ ID NO: 4229105 - RNA, 68 nt, Human
gccucuggagucucacuuccuggaauucucucuccccuucugauaauuuuagcuaaagauccaugggc

SEQ ID NO: 4229106 - RNA, 60 nt, Human
cggagcgagaaggggaaagccccgggaagaggaagucuccgggcuuugcccuucgcuccg

SEQ ID NO: 4229107 - RNA, 99 nt, Human
cccgguuguuccuaguagaggaagaagaccuuugcaaagagagaaaguggguccuggaugggcguggaggucgcauauuccucucugggugcagcuugg

SEQ ID NO: 4229108 - RNA, 86 nt, Human
auccagucccuaccauaaagcaggcaaaugagaaacuacaaauccuguggagcucuuuucaaaccuguuuauggagaauauuggau

SEQ ID NO: 4229109 - RNA, 89 nt, Human
gggaggcagaggugggaggaucauuuaaggccaggagcucacucaaggucagccuggccaacauagugggacccccaccucucucucuc

SEQ ID NO: 4229110 - RNA, 63 nt, Human
cuuuggcccugaaucaaggccagcaguuugcugaagcuguugguuucaagcaggagccuaaag

SEQ ID NO: 4229111 - RNA, 77 nt, Human
ugcccuuuaaaaagacagcguaucaauugaacauaaauauauuguguuuaaacuauaugccugcuugaauaagugca

SEQ ID NO: 4229112 - RNA, 60 nt, Human
cuauaugcucugcuaggagaagaaugaggauaauucauuuguauucuacaaagcacuugg

SEQ ID NO: 4229113 - RNA, 129 nt, Human
ccagaguuugcugguggaccucaggauucgaagugugcaacagacggagugcgcuugcuguucagggcggccccgugcaggagcaccagcucacccucaggcaucucggacuggagggccagcagaagg

SEQ ID NO: 4229114 - RNA, 77 nt, Human
uuuuguggacugauccgaggacaucauucaauauccaaagagcugcagaauguuauccuugaauugcguccacaaga

SEQ ID NO: 4229115 - RNA, 64 nt, Human
caucauuuggcuuuagggccugugcucugaaacaugcaaaccccuugagacacagccaaagaug

SEQ ID NO: 4229116 - RNA, 106 nt, Human
gcaguuaacucaucuagcaaagauggugcuuuucacaagcaugggacaaagacuucuuuugucccugcgugagaaagcacuuagugcacuggaauguaaagauugc

SEQ ID NO: 4229117 - RNA, 59 nt, Human
ucauuagauuccugugguggauaauaauuucuucagauucuaaaacaggugucuaguga

SEQ ID NO: 4229118 - RNA, 102 nt, Human
ccaaauagaauguaugugaauuccaugguauugauuguuuuaaaagauuuuuuucuguuugaggucuuauaauuaauuuaggcuuucauuuucuugguuugg

SEQ ID NO: 4229119 - RNA, 88 nt, Human
cacauuauaagugaggcccaggugaaauuaacuuuaaaaaacauagguagaucaugaaaauucacugcugaggcuuuacauguaagug

SEQ ID NO: 4229120 - RNA, 63 nt, Human
gugccucuaguuuucuccuaaaguuuuaguuuuucuauccuuugggaaauagccuauaggcac

SEQ ID NO: 4229121 - RNA, 60 nt, Human
aucagcucuugaugccuuucuuuuaaauuaauuauagacagagagaggcauuuagcugau

SEQ ID NO: 4229122 - RNA, 69 nt, Human
ucaauguugaaagaacaauucugugaugacuucuggugucauauuaugcauguuguucuuucuauuugg

SEQ ID NO: 4229123 - RNA, 83 nt, Human
uaguuuuguuuucuguuuuauaacuauagugagaaugauguuuugaagcaaaauuuuugguuauaaaauaguuuucaggauua

SEQ ID NO: 4229124 - RNA, 78 nt, Human
ccugaacauccucuaccugcacaugccugacugcccgguaucccugcuccaguggcuguuccaggugaggaccgcagg

SEQ ID NO: 4229125 - RNA, 111 nt, Human
agcagcggggccgaucuugcuggcgcuucauugugggggcccccaaacuauucuucuagcuuauggggagucccaacgguggaagauccccauaggaugggcagcccugcu

SEQ ID NO: 4229126 - RNA, 98 nt, Human
ugcaccagucauuuuucacugugaguuuucgugacacuauuuugcaggagcccauggaagugugugagaaggggucgcaauggagaucacugggagug

SEQ ID NO: 4229127 - RNA, 61 nt, Human
gagagagacugggaaaucaucaguauguaaaugguaauugaaguauuuccgaguuucuuuc

SEQ ID NO: 4229128 - RNA, 102 nt, Human
uacauuuaucugaucuuuucucacaauuuccauugagcagcaguugcuacaaccaccugagcaucaaaugggcaauuaauuggaacagauuuaauaaaugua

SEQ ID NO: 4229129 - RNA, 73 nt, Human
caaggaaaaucugaaaggagaguagggcagaagcaggcagaugcucauccugucucuguucggaaugcccuug

SEQ ID NO: 4229130 - RNA, 85 nt, Human
ggaccuuguuagucuuaggcgugugcgggugaggcgacccuggcgguagccuggccaaucgccgucuaggauuggcuguggugcc

SEQ ID NO: 4229131 - RNA, 58 nt, Human
ugggggagggagaguugaugggcagguggagggugugccguuauucuucccaccccca

SEQ ID NO: 4229132 - RNA, 64 nt, Human
guauggggacucacugacuaucuugagauccagucaucaugugguauugugagauccacuauau

SEQ ID NO: 4229133 - RNA, 67 nt, Human
gagacaguggagccacguugggagccuguauuuuuugcugcuucccuacuucagugcucccugccuc

SEQ ID NO: 4229134 - RNA, 56 nt, Human
gggucuggagauccgggugaaggucucagacuauguacaagaccggauucgggccc

SEQ ID NO: 4229135 - RNA, 124 nt, Human
caagagaggcaaagagggaggcgcaggaagaaugaaaugaaagaacuaaaguuacaguuauugcuguuguuguuauuauuauuuucguucuuucuccuagcugucccuaaaauuguaucuguug

SEQ ID NO: 4229136 - RNA, 94 nt, Human
ccacccucuugcauuggccaguggaggaagaucuuugaugaugaaccaacuaucauuagaagagcuuuuuacucuuugggcaauuauauugugg

SEQ ID NO: 4229137 - RNA, 56 nt, Human
aauugaggaaccuuagggcaaaucagugaacuucugaacugccuucgucuucaguu

SEQ ID NO: 4229138 - RNA, 87 nt, Human
ucucauagauuguaccuguacauaacuacauaucacucccccccuuuuuggcguauacauaggauauguacgugcauacauauuaga

SEQ ID NO: 4229139 - RNA, 60 nt, Human
ucuucacagaugcauauacuucauccuggcuuccacccacagagguugcaucugugcaga

SEQ ID NO: 4229140 - RNA, 71 nt, Human
ugcgugggugggggauggcgugugggucuccauucgcuuggauucuacgcuccgucucuaucaugcacaca

SEQ ID NO: 4229141 - RNA, 71 nt, Human
gugacuuggugcgaagagucaggggaaagaggaaaaacccaauuucuaaaugaccuccuugcccagcuuac

SEQ ID NO: 4229142 - RNA, 58 nt, Human
ggaaagauagaaugauguuggcucacaauguaaaauguagcuugaucauuuuauuucc

SEQ ID NO: 4229143 - RNA, 129 nt, Human
gugccccccgagaggaggugagggugcugcucaggcugaggccucuggggagggacaggaggccucccugucuccccucuggucugggcucugggagaaugaaacgaccccagcuucucuacggggccc

SEQ ID NO: 4229144 - RNA, 58 nt, Human
aaucaaagccugcaaguugacugcugcagacagaauggagaaacuuguuguuuugguu

SEQ ID NO: 4229145 - RNA, 72 nt, Human
gugugugcucguauguaugugugcagcuacguaucuauguggaaacacccacgcaugcauaugugugugcau

SEQ ID NO: 4229146 - RNA, 61 nt, Human
gucccucauaacuggcaggugucaccugguuggccgcagaagggccugccagccgagggac

SEQ ID NO: 4229147 - RNA, 62 nt, Human
cauuuaaccccuugguacugaaaaugagaaaauccccaacuaugcaugccaagggguuaaug

SEQ ID NO: 4229148 - RNA, 59 nt, Human
agggaacuuugugagacuggagaaugauuugucgaucuucaggaaaaccaaaguuguuu

SEQ ID NO: 4229149 - RNA, 61 nt, Human
ggaaaaacucagugggggucuuucagggaccuggugggagagagaccuaagcugagauucc

SEQ ID NO: 4229150 - RNA, 61 nt, Human
guggagaugagauauaccccuuugauguagaauuauucauuugguuuguuucauacuucau

SEQ ID NO: 4229151 - RNA, 87 nt, Human
guugaucuuuuucuucucauucugaccucagaacagaccuauucauuuuacaucugacaucagacugugagaagaguaaguuuuagc

SEQ ID NO: 4229152 - RNA, 97 nt, Human
gaaagauuuaaggggauauuuuacagcucucguugaaggacccaaguccagcaguuuguucaacacaaguugugcaguaauuuuauguagcuuuuuc

SEQ ID NO: 4229153 - RNA, 67 nt, Human
cauuuguaggguuucugucuaguauggacucuccuauguucaguaaggccugaggaccagauaaaug

SEQ ID NO: 4229154 - RNA, 68 nt, Human
cagugcauuugucaggaauugaaaaguuuuggagccaguucgaggacuuucuccugcacaaaguguug

SEQ ID NO: 4229155 - RNA, 90 nt, Human
uaccaguucaaagucaaaagaagauuauuacucauugcagggaucagugaugucucuguaacaucaguguaauuuuugcuuugucucaua

SEQ ID NO: 4229156 - RNA, 95 nt, Human
guaaaggaagcuuuaaaauguuguauuuuuucccugaaauaaacuuuuaugauuuaaugucuuggaaaaagacucacaugaaaaguggcuuuuau

SEQ ID NO: 4229157 - RNA, 69 nt, Human
uugcugauuguagccacugugaugaauuaaucuauuagagcuuuucaauuuauguggcuauucauucaa

SEQ ID NO: 4229158 - RNA, 95 nt, Human
guuuuuucucguuucuuuuuguuguuguuguuauuuaguuuuuauuucauaaucauaaacuuaacucugcaauccagcuaggcaugggagggaac

SEQ ID NO: 4229159 - RNA, 106 nt, Human
gauuaauuuauuuuuauuuugcauguuuuaaggcuguggggauuacugcucugaagcagauccaaauauaguucuugaauucuauguagagcugaaagaaucaguc

SEQ ID NO: 4229160 - RNA, 64 nt, Human
ucuauuugguguuuucaggaauauacgugaaaagacaugccauguuuugguaaauaccaucaga

SEQ ID NO: 4229161 - RNA, 62 nt, Human
gcacccacagcucaggcccaucaacccccacuucuggaggggaauguuccugagcuggcugc

SEQ ID NO: 4229162 - RNA, 73 nt, Human
uuccuuagcuggguaacuuugggcaaaccgcuuggucucucaagccuaagguucuucagcuauaaaaugggaa

SEQ ID NO: 4229163 - RNA, 73 nt, Human
uacauuuuuaaaccuaucuaagaaauagcccugauauugaaauggcuucuguggaauagguuugacagaugua

SEQ ID NO: 4229164 - RNA, 96 nt, Human
gugggggcagccaagggggugcugagcccguuugugcugcaggagaucgucauggagacgcugcagcggcugagucccgcucaugcccacaaccac

SEQ ID NO: 4229165 - RNA, 64 nt, Human
gugagaacacuuuucucuuugcucagucuuuucgaucugguuggguagggaagguguuccucau

SEQ ID NO: 4229166 - RNA, 80 nt, Human
uagcgcuagacucaugugccuucuucauuuaauuuaaacuaaaauuuuuuuaaaauuaggacggcacguuuuuuguguua

SEQ ID NO: 4229167 - RNA, 56 nt, Human
cugaaacucaagauaggaggaacauuucucccacguucuccuuacuguaguuucag

SEQ ID NO: 4229168 - RNA, 125 nt, Human
ggucugguuguucucagccuucccuccuagaaucuuuuugaaggaggagagaaguuucuguuugucugguugcucuugcucuguucuaaaggauuuucuagaccauggaggcuguuuacuagguu

SEQ ID NO: 4229169 - RNA, 59 nt, Human
auuuuuuuaggcugucagccgcuucuuguugaaguugucucacaaccaccugagaaaau

SEQ ID NO: 4229170 - RNA, 61 nt, Human
caggcuccucugggggccccggaguugggaagcggcguccgggagcccccggaggaggaug

SEQ ID NO: 4229171 - RNA, 71 nt, Human
gccgaggccugcccuuggggagccuucccggcccggggccgugucugaggcuccgccggggcgggccgggc

SEQ ID NO: 4229172 - RNA, 67 nt, Human
cugcaggccuccccugcuggagcugcaggcugucccuucccugagccccggugagggaguccugugg

SEQ ID NO: 4229173 - RNA, 73 nt, Human
cagagaaaaaauguugagaaucucucuucuaaagccaugcuuuugaagaaacagucuuaagaguuuuuccuug

SEQ ID NO: 4229174 - RNA, 84 nt, Human
gcagggaggagaccacaggcagggagcuggaaaggaugccaggcccagcaaaggggaucucaguuaccuuccaucccgcccugc

SEQ ID NO: 4229175 - RNA, 57 nt, Human
caggugcucugauauggggcuggccagcagacuggcuucuguggcagguggcgcuug

SEQ ID NO: 4229176 - RNA, 67 nt, Human
gugacgugcagguguggccagcagcuuguguuugucaaugguaggugguggcuauggcugugcucgc

SEQ ID NO: 4229177 - RNA, 79 nt, Human
aacgccgggacucgcagggagcccucgacccgcccagcugagccugccccaaacuacagcucccgaagugcucggcguu

SEQ ID NO: 4229178 - RNA, 74 nt, Human
accuaggacaaaggaccagaucuggaaaguuccuguccuugaagagcuuucacaaacaacuguuuguucugggu

SEQ ID NO: 4229179 - RNA, 75 nt, Human
aagccaagagcucccagaccugggcagcucaggagcugacagaaaccaccccccaggucuggaguucaaggguuu

SEQ ID NO: 4229180 - RNA, 105 nt, Human
aguguguuaguaacuugucuaauugaacuaauguuguguccuaauuguuuacauggaaauacuguugagaagaccauuuuguucacuuggcaguuucuucacacu

SEQ ID NO: 4229181 - RNA, 62 nt, Human
caguuuuauacacugcagcuccuggcuuuaccauucauccagcagcucaggauauagacuug

SEQ ID NO: 4229182 - RNA, 58 nt, Human
guuagaguaagugugugcugagcuuuuguguuugaaagcgagccugugcacuucuaac

SEQ ID NO: 4229183 - RNA, 74 nt, Human
gagccccccagauaggccgguggaggagguggaggagcuguccccccaaaacuacuggccuguggucuggacuc

SEQ ID NO: 4229184 - RNA, 84 nt, Human
caguucucucaugccuaguuuaaaucauuuucugugcuuuuugacgcgagaaaauagguaguagacgggcuaggaaguggguug

SEQ ID NO: 4229185 - RNA, 55 nt, Human
cuccucguccucuucauccucugaguccuccucugaagaugaagaggaagaggag

SEQ ID NO: 4229186 - RNA, 58 nt, Human
gggccggagaagguagcugaagcuauuuauaaaacguuguguaccuucuuccgagcuc

SEQ ID NO: 4229187 - RNA, 67 nt, Human
gccggauuugggagccaccagggaaggauccgcgcaggggagccgcccuccuuggccccagacccgc

SEQ ID NO: 4229188 - RNA, 73 nt, Human
caguucacauccuugugaggauuuucauuucuguuuugcugaugaagaacccaaggcccagggaugugaagug

SEQ ID NO: 4229189 - RNA, 82 nt, Human
agauaaaaagcacaacgugcauuacucaaaucucaacgucagagcuacuguugaauuuagguuuaugugaaaaugugcaucu

SEQ ID NO: 4229190 - RNA, 58 nt, Human
aggcagaaaacaauaaccauuucaaggaucacuuaaggaauccugguguuuucugccu

SEQ ID NO: 4229191 - RNA, 63 nt, Human
gaggagagcuggccagguuucuguucaaaccgaacuacgccuauggaacgcugggcuccccuc

SEQ ID NO: 4229192 - RNA, 56 nt, Human
uccucacaugcaaaaugguauuaagucucuacuauaccgcagagucauugugagga

SEQ ID NO: 4229193 - RNA, 61 nt, Human
ccgcagaaugcucggcuuucuuucuuucucuuggagcaaggagcugaaaccgggcuagugg

SEQ ID NO: 4229194 - RNA, 107 nt, Human
gcagugucagcuaaauggugccauuugcuuaucacucuucuuuuugguuauuuauccuaaagauaagaacauuaguaagccguaaaugcccauuuuguaaaaacugc

SEQ ID NO: 4229195 - RNA, 70 nt, Human
gcuacaacugugucuguggggcauguucaagcaccuacauguuuguucccccacaugaauacaguguagu

SEQ ID NO: 4229196 - RNA, 79 nt, Human
cuguucugcuguuuucuuuguccuagcauucuacauagagaaacugucuaguguuaaggcaaaguaaagguaagaaggg

SEQ ID NO: 4229197 - RNA, 60 nt, Human
uuaguccucaugaccaccaaguucaagcuccugugcaauuugcugaucguagaugacuag

SEQ ID NO: 4229198 - RNA, 61 nt, Human
guuaucauccucagaggcaguuucuguggucaucuucccagugacuccugagaugugaaac

SEQ ID NO: 4229199 - RNA, 61 nt, Human
ucagacucuaguggaggugcuaggaaguuccacuuucugguagauuauuuagaguacagga

SEQ ID NO: 4229200 - RNA, 61 nt, Human
gaguucuacaacuucgcuugcagaacuuggcuuuuuccuuucuguuguguguugaggacuu

SEQ ID NO: 4229201 - RNA, 126 nt, Human
aacuguuagcuuugcugguguguugguggccucuagcgguuauggcagagauuacaggcuuccuggacuugauaacuuagcugggcugcugugggucggccaugggagcuacugaguauaacgguu

SEQ ID NO: 4229202 - RNA, 60 nt, Human
gcaugcauaugugugcaagugugugugugugugugcaagugugugugcgcaugugcaugu

SEQ ID NO: 4229203 - RNA, 103 nt, Human
uugagguaggguuuugcucuguugcccaggcuggaguacaguggugugaucacaacucacugcggccucaaccucccaggcucaagcgauccucccaccucag

SEQ ID NO: 4229204 - RNA, 87 nt, Human
caggugugagccacugugccgcuggagcuggaauugaauccuugucuguuggacuccaguguuagccacugugcggcucugccccug

SEQ ID NO: 4229205 - RNA, 63 nt, Human
gcaauuauuaagcuuucuccaguguuagcuugugcuaggccacuggugggguuuaaaagaagc

SEQ ID NO: 4229206 - RNA, 60 nt, Human
cugauuucaaauggugcuagauacaaagauggaaaaaucuaagccaccaugugaaaccag

SEQ ID NO: 4229207 - RNA, 95 nt, Human
gcucuuuaacauggcauuaugggguuaaauuucuccuagcacaaauucugggucagauugagccccuggugauugucucuuuccaguugguaggc

SEQ ID NO: 4229208 - RNA, 100 nt, Human
gcagucuccucccuuguggcccagacccagcugggucccuuccuccuaggcagcugagggaaggacugcuggguuggccacgggccugggaaggggaagc

SEQ ID NO: 4229209 - RNA, 78 nt, Human
ucuuuccuuuccuguccugguacuuggcaccuuguagacaguugcauguccccugcccagggaugggaugaggagagg

SEQ ID NO: 4229210 - RNA, 81 nt, Human
cugcucgaaugccucuugagagccagugcuuguauuuugguccuugugguaugggccuggcacauaguaggcagucagcag

SEQ ID NO: 4229211 - RNA, 72 nt, Human
ugcuguugacauuuccccaugugaugcuauugcuucucuuuggaggcuaagcaguaaaugggguuaacagca

SEQ ID NO: 4229212 - RNA, 93 nt, Human
uccugucaacuuuggaggagaacugauuuggcuugaguuuucucagacaugggaacuuuugaccuaaguuuguauuuuacauuguugaaaggg

SEQ ID NO: 4229213 - RNA, 58 nt, Human
ugguggcccuugaagcucugacccgcuuccgcgaagcuguccccuucaagggcaucca

SEQ ID NO: 4229214 - RNA, 62 nt, Human
aggacuguauacucuaggugaacugaauuaccuuccguucacuaugcccagaauacaguuuu

SEQ ID NO: 4229215 - RNA, 64 nt, Human
cauuuaauauuuauugguaaucacugagagccaagguaaagugaugauccaaaugaauugaaug

SEQ ID NO: 4229216 - RNA, 59 nt, Human
cucgugggggcaacgaccccuccccuggcaguaggggugggguaggugacucucgcuag

SEQ ID NO: 4229217 - RNA, 59 nt, Human
gggcggcaagggaauggagaagagcuggccauagcgcucugaccaggcucuuguagccu

SEQ ID NO: 4229218 - RNA, 65 nt, Human
uccccacucagaagaaacaagagaguuugcuguugccuuuccugaaaucucuucugcagcaggga

SEQ ID NO: 4229219 - RNA, 78 nt, Human
auuuuagacuuggaagagacauuggaugcugccacuaaucauuauagaguccacuguguagucucccaaguuggaaau

SEQ ID NO: 4229220 - RNA, 94 nt, Human
gacacaggacaggaaagcuccauauggcacaccauuuagaauuaaucagugauuucagauugaugugaccauuggaagauuucaaguaugcauc

SEQ ID NO: 4229221 - RNA, 79 nt, Human
cccaagcugaagcugccugggaggaagggcugagcaugccuagcccagccccuucuuuggggagcugacugccuauggg

SEQ ID NO: 4229222 - RNA, 68 nt, Human
gcaauaauugcuuuccagaguuagacuucaaaucacugaguagcugacuuauuaaaaguuuuuauugu

SEQ ID NO: 4229223 - RNA, 89 nt, Human
ccggcucgggcgcggggccggcuggggcggggcggggcggcggcgcgcguuccccgccggccacaccggccgcccugcacucggcgagg

SEQ ID NO: 4229224 - RNA, 110 nt, Human
gacucgcguuuccuuggccagugguaacacaggacgugugugcgcaugugcaaguguggauguaugugugugcguguguuuugcucauuucuuuagggaacuugggaguc

SEQ ID NO: 4229225 - RNA, 98 nt, Human
uuugcggaugcucuccagaaagucuuugagaucggacauagaaacaucuuuuauuucuucucgaagcuuggggauguuguccaccaucaccuugcaga

SEQ ID NO: 4229226 - RNA, 95 nt, Human
agaugcugcuuuaaguuguuuugagaugugguucaaggguguuuguugaucaaacaccaagagcuagcuauuaccaagaauaauaacuagcauuu

SEQ ID NO: 4229227 - RNA, 79 nt, Human
ccugcccuccaggagcucacaaucuagugggaaagucagaaagguaacucaauagacugugagcuccuugagggcaagg

SEQ ID NO: 4229228 - RNA, 126 nt, Human
uucccuucaauuacugcucccugcccgucuuggcacagcuugucauaaacucauuuauacuaaugugugaguggcuaagugugccuucgaacuuggccggcagaggggugaaucugauggagggaa

SEQ ID NO: 4229229 - RNA, 115 nt, Human
ggaagaugagguucaaacuauaagcuaaaaugagguuuuuggauuauuagccccaccuggguuugaauccuggcuuuccugauuuacuagaugauagaugaguaucuuuucuuuc

SEQ ID NO: 4229230 - RNA, 62 nt, Human
gagagaaggaagugaauuucccaaccagaagcguagggaaauucagauggcuuucuuuucuc

SEQ ID NO: 4229231 - RNA, 129 nt, Human
guaacagugucgaguuuaauaguuaaccagugaagagaaaaaucuuaaucuaguucauuuagaguuaguuaacguuacuuggcuaggguuuuuaucuugcuuggauuaugauuaaauuuuaauuguccc

SEQ ID NO: 4229232 - RNA, 85 nt, Human
gccgcucugcccgccuccuuccgaccucaguccugccggguccacggcggcaggugagaacguggaggggcggagggcugggggc

SEQ ID NO: 4229233 - RNA, 62 nt, Human
ugcuacaucuacugguaaggguacuggugcugccauuagaacuguuauugguguauguggca

SEQ ID NO: 4229234 - RNA, 89 nt, Human
gucagggcaguguucccuucuggaggcugcagaaaagaaaguguugucuuguuuuuuccagcuucuagaggccgcccacauuccuugac

SEQ ID NO: 4229235 - RNA, 77 nt, Human
ugcauuucaaacaguuacagcugcaaggauuacucauaguaauagcagugacagacaacuguuugagcuuuagugua

SEQ ID NO: 4229236 - RNA, 69 nt, Human
gaguuggcguuuccuguucugggugcuacugccaaacguuaugguacuuagagucgggaugcacaacuu

SEQ ID NO: 4229237 - RNA, 63 nt, Human
cggucgagcgcaguuaccgcgcggggcucugcuccaaagccgcgcuguuccugcugcuggccg

SEQ ID NO: 4229238 - RNA, 79 nt, Human
gaggaauggaggugagccccccauccugcggacccucacagaugggaaguaggaggaggacucgccaggccaugcccuc

SEQ ID NO: 4229239 - RNA, 118 nt, Human
cgccgaggugcuugugggacaggcccggggggccuuggaggagaaggacuuucagaaagcagaagggcugcugcuccgggcccagagaccaggccuggcccucaauuauuauaaggug

SEQ ID NO: 4229240 - RNA, 56 nt, Human
cagguugaaaguggaggagcuagaaaagcccacaagaaauuccucacuguagccug

SEQ ID NO: 4229241 - RNA, 62 nt, Human
cugguggguccuuugacagagauguucuagaggaaauguuuaagugguuaaaggauucaagg

SEQ ID NO: 4229242 - RNA, 61 nt, Human
aagguggauguaagcggcaauguuugggugccaaauauuacugcugcccuaagaccaccuu

SEQ ID NO: 4229243 - RNA, 90 nt, Human
gcauuucauaaccagccaugcuuaugcaguuaaaguucaaaguuuaaaauuccuaugcaugcuuuccuucccuauguugagaugaaaugc

SEQ ID NO: 4229244 - RNA, 80 nt, Human
caucuucaugcagaaaguauguucuaguaguuucuguaaaaauggcaagccacaugcuuuucucacuugacauguagaug

SEQ ID NO: 4229245 - RNA, 90 nt, Human
ugaccaacacgaauggagaaaagacaauguugaguauacauaaaguggcaguuguuuuucgacguuguuuuuucucuguccaugauguca

SEQ ID NO: 4229246 - RNA, 121 nt, Human
uguaagguaugugauaugguaaagcuucagcuaaugcuccaaagaagcaaugagaauagucucacuacugugacucuguuucuuggauuuggaugaagucaaccaaaguuacagccuuaca

SEQ ID NO: 4229247 - RNA, 59 nt, Human
ggugaggagaaacucugccccugaaacucauaacuuuggggagccucauuuucuucauc

SEQ ID NO: 4229248 - RNA, 62 nt, Human
guugcuuacauuuugcuggucuccccaagugaccauugguggagaccaauuaaugaaggaau

SEQ ID NO: 4229249 - RNA, 57 nt, Human
gggaagcuggucacccacaggccuaccguuuuccaggaacgagggugcccauuuccc

SEQ ID NO: 4229250 - RNA, 83 nt, Human
cauaucuugucauugaaaauauucuauaucaaagauaaaacacaugucuuugaccuuaagaaguuugcauucugaaagauaug

SEQ ID NO: 4229251 - RNA, 99 nt, Human
gagauggagucucauucugucacccaggcuggagugcaguggcgccaucucggcucacugcaaccuccaccuucaggguuaaagcgauuuuccugccuc

SEQ ID NO: 4229252 - RNA, 115 nt, Human
gugaccccucugugcuucugcuuguggggacaagggugucaguaggcaaagaugacaugguaagugaccugguggccauugucccaggcauagagcaggcgguccuugggguugu

SEQ ID NO: 4229253 - RNA, 129 nt, Human
ucccaaggccccauaccguaucugauuuuacuuuauuuuuguuuguuaagccuaacagcuucugaggagccacguagagcucaagaagcaaaagcuacugagaguagaugcuauguaaacugcacaaga

SEQ ID NO: 4229254 - RNA, 81 nt, Human
gcggccgcgcaaggaggcgcgcugcgagggcgcggggcuggcccccgccgcgcccccggcugugccccccgccguggccgc

SEQ ID NO: 4229255 - RNA, 62 nt, Human
uuuacgaauggggugacaacuuaugauaaaaacuagagcuagugaauuagccuauuuguaaa

SEQ ID NO: 4229256 - RNA, 85 nt, Human
ggcacgaagcugaagcuguuagggagugguagguuuggaguacaguacaugcucugaaauaucuagccuuuagcagcuucaugcc

SEQ ID NO: 4229257 - RNA, 92 nt, Human
accauaugaugagugcccaaucaauuguagcuauugcaauuauguaaaagagaaauguguaauagcuuuuuguuugguguauucaauauggu

SEQ ID NO: 4229258 - RNA, 70 nt, Human
cuguugccaggcuggagugcaaugacaugaucucggcucacugcaaccuccaccucccagguucaagcag

SEQ ID NO: 4229259 - RNA, 59 nt, Human
ggcacagaguguaaaaguuucauggguuagaauguuggugaaauuguacacucaguacc

SEQ ID NO: 4229260 - RNA, 84 nt, Human
guuaccguggccucugguuucccaguuccuccgugguguaaugaagucccagguuuuagaagcugaagccaagccuaggguagc

SEQ ID NO: 4229261 - RNA, 55 nt, Human
gcaguccuugcuguguaauaaauauggagucacauuuguucacacacagggcagc

SEQ ID NO: 4229262 - RNA, 83 nt, Human
gucagggucgguuuuuaaaagucucuucuacccacuacaucaguugugucucuugggauggacuuuagagaaucgauucgagc

SEQ ID NO: 4229263 - RNA, 100 nt, Human
gggacaagccugauccgugagcgagcgagcacccagcagcaaccaccacuuugggcaacuugcggguuuccugcucgcggguagcgaacgggagauuccc

SEQ ID NO: 4229264 - RNA, 93 nt, Human
gacaggguugccuugacuucccuucuagcucccagacgaugagcacgaccucucagacagggagcuggagcuggaagacucugcagcucuguc

SEQ ID NO: 4229265 - RNA, 65 nt, Human
gcuuuaggucacuccaccgaagagccugaaagggaagugguucuugcgaaagaaugagcugaagc

SEQ ID NO: 4229266 - RNA, 65 nt, Human
uguguacugauggagauaggcuaucaagaaaucgaaggguugugaccauauauccaucagauaua

SEQ ID NO: 4229267 - RNA, 60 nt, Human
gacuacucagcaaacauuugcugguuacucucuguguucuaggaacuguucugagugguc

SEQ ID NO: 4229268 - RNA, 82 nt, Human
gacagcuggaggcaggaagggaggguuguggcgcccgagcugggcgcguucccagcgccugcccuccgccgcuggcccuguc

SEQ ID NO: 4229269 - RNA, 69 nt, Human
cucucauuaucugcccauuguagaauuggggggagcaucacaguucacggcugguaugaauugguggag

SEQ ID NO: 4229270 - RNA, 107 nt, Human
gggaggauuccccaaaagaauaacugucuucugacacuguuaggagggcaaagccuugccaguguugcagaagcucagucguguuuugcuggcacaggaacccaccc

SEQ ID NO: 4229271 - RNA, 96 nt, Human
ccagauacccauuacaaaugaucaucucuuugaaaacuucugcuuggcauuuucaagaaacuuuucggcagaaagucauuugucuccuuuuucugg

SEQ ID NO: 4229272 - RNA, 68 nt, Human
uaguaguuaagagaagaguaucuagaacaaggaugccuagguucagauucuuucucuuucacauacua

SEQ ID NO: 4229273 - RNA, 74 nt, Human
guuuucagcuucccuaagggacuggcauaggguuuuguggggucaaugccaggaaccugggggaaacuggaugc

SEQ ID NO: 4229274 - RNA, 78 nt, Human
gggggaaaauacauauuuuguuuacauuaaauuuugaagugauuuaggcuuuauugaaaacaauacuggccuucccuc

SEQ ID NO: 4229275 - RNA, 93 nt, Human
cugcugcugaaaaggcugugaccaagaaggaacuucagggcgaauggacugcuccagcuccugaguucacugcuacucagccugagguugcag

SEQ ID NO: 4229276 - RNA, 62 nt, Human
cucagaagaacaaaggcucuacaaccugacaggccagccaugggacccuggguucuucugag

SEQ ID NO: 4229277 - RNA, 115 nt, Human
aaaccgaaaauuuccaucaucuucuguugcuuuuaaauuaucugacaauggagacucuauuccuuauaccaucaauagguauuugagagacuaccaaagagaaggaacccgguuu

SEQ ID NO: 4229278 - RNA, 85 nt, Human
cagcuguccaggggucaccugccuggguggucaccugccuggguggucaggcugucucaccucaggagggcccccggaccagcug

SEQ ID NO: 4229279 - RNA, 82 nt, Human
ugcagauucccaaggaaaugucagaaaggcaaaauggccagcauuauccauuugcuuuuugggguuuacugggugaauagca

SEQ ID NO: 4229280 - RNA, 64 nt, Human
ucaugggccacguggagucuguagggcuacucgcugggcugugcuggcuucugugagcugauga

SEQ ID NO: 4229281 - RNA, 75 nt, Human
guuaguguguguauguguguaugacugaaucuauuuuuauggaaagaucaguuaacgccaucaagacacccuaau

SEQ ID NO: 4229282 - RNA, 69 nt, Human
auugaguccaaggugcagcccauggugaagauagagaagaucuucccugggggggccgcuuuccucagu

SEQ ID NO: 4229283 - RNA, 76 nt, Human
guaacauuuauguuuugaccaagugccagugguagucauuuguuuaauuaaacuuugucuugaucaaagguguuac

SEQ ID NO: 4229284 - RNA, 65 nt, Human
uugaacguguaggaagcugguucuaaaaggcaaagugucuagaggcccaguuuuuuaauauucaa

SEQ ID NO: 4229285 - RNA, 59 nt, Human
gaaccaaguaaagagguuucauuguuuuaaaaaaaugcagugagauuuaugccugguuc

SEQ ID NO: 4229286 - RNA, 76 nt, Human
ggggaaaauugagcgagggcuggaggggagacagagggaagcggcucugggucuaucccaugccuuugcagucccc

SEQ ID NO: 4229287 - RNA, 69 nt, Human
cccuuauggugacaucuaccuagguaaaagccugacauguggcuuuauaauuguuauguuacccaaggg

SEQ ID NO: 4229288 - RNA, 105 nt, Human
guugagauggagucucgcucugucauccaggcuggagugcaguggugugaucucggcucacugcaaccuccaccucccggguucaagugauucuccugccucagc

SEQ ID NO: 4229289 - RNA, 91 nt, Human
gaugagggaggagugcccagagaacaggcagcuggugccggcuagauuggcaucucggugcugguucuugagcucucaucucccuucuguc

SEQ ID NO: 4229290 - RNA, 57 nt, Human
gguuuucagaaugcaguccuguuuuuguguggauucagagcucacaaacugaaaacc

SEQ ID NO: 4229291 - RNA, 67 nt, Human
uggccaugggugggagugaaggggcucagccuuaggggcgggaagucuuuucuuccacccaaaucca

SEQ ID NO: 4229292 - RNA, 66 nt, Human
uaugaaagcaguuuuucaaaauuacaugaucuacugguuccuaaauuugaaggacuuuaguucaua

SEQ ID NO: 4229293 - RNA, 104 nt, Human
cagaagaaauggaugugacugcuuuacauuaauuucuacugaucccauccaaacagauaauaucagaagaaauggaugugacugcuuuacauuaauuucuacug

SEQ ID NO: 4229294 - RNA, 92 nt, Human
cuuacuacuguguaagugagagcaaggguugguuuucugacaaagacaucuauaugcagagagccagcucucucggcaagacauuuccuaag

SEQ ID NO: 4229295 - RNA, 71 nt, Human
cuccaggacugaggacagagcugcucuucuucuucuacguuacuguggcccucuugucuggcagccuggag

SEQ ID NO: 4229296 - RNA, 77 nt, Human
caaaaauacuugccuguaucugaguagauaguaaugauauuagaauuaaugcuacaaaagaucaggauguauuuuug

SEQ ID NO: 4229297 - RNA, 73 nt, Human
ggugccugccugggcucacuugccagcauccugcaauuagagagggaccuggccagccucccagguacccgcu

SEQ ID NO: 4229298 - RNA, 77 nt, Human
cggccuuggcgcccccugcccccggcugcccaggggaaccaaguucccgcugcuggaguuggggcagaggagccccg

SEQ ID NO: 4229299 - RNA, 71 nt, Human
gcuucuguuaggauguggcuuauaucacaugcuuacauuccagagcaagucacacagccugacaauggagu

SEQ ID NO: 4229300 - RNA, 106 nt, Human
ggccaggcuggcugugucccugucaugguugggccgugagacgucucugggauguccagugaacaucauggcuccacccagcaggguggcaucugccaggcugguc

SEQ ID NO: 4229301 - RNA, 69 nt, Human
gacaggcaagguugugacccaaugaccagaguuaaucaucuggcgacuggaauuaaucuuuugucuguc

SEQ ID NO: 4229302 - RNA, 71 nt, Human
ggccuuggaaauaguugugagucaggcaguaugcuuuuguugcuucucacccuuacuaucucuuugaugcc

SEQ ID NO: 4229303 - RNA, 56 nt, Human
ugaagacuucuuuuggucaccagagaaucucuuugaguaucagauuggaguccuca

SEQ ID NO: 4229304 - RNA, 127 nt, Human
guagaacucuuuuguaauaauggaaugcaccaaaaggaaaauggaccagaguuguuaaacuccuuuugauggaguaacaaaagggcccauuuuccuugccuuuucccuaauuuagaaaucguuuuau

SEQ ID NO: 4229305 - RNA, 72 nt, Human
auauuuugucuguauuugaggacauuguaaauguuuguacaguuuucugagaaucacaggagugcaaaaugu

SEQ ID NO: 4229306 - RNA, 77 nt, Human
ccgggucggcggcgggcuuggcuccagggcccaggaggaacugcugcugcucuucaccauggccucgcugcacccgg

SEQ ID NO: 4229307 - RNA, 72 nt, Human
uuaagaaagggaauagagcagcaaaaaugauaaggaaaauguuaaaaguuguaauauuuccuuuacucuuaa

SEQ ID NO: 4229308 - RNA, 59 nt, Human
agucaguguagaaagcccaggcauugucccauagcuggcccuguguguuugcacugauu

SEQ ID NO: 4229309 - RNA, 56 nt, Human
caggccagcuggaggggcagcugcugccgacugaggagcuggcccccgguggccug

SEQ ID NO: 4229310 - RNA, 107 nt, Human
acauuccaacuucccaucauggugaacaaggauucccaaagaagaaauguccaaguaauuuuuaccucguuguguccuuguuccuuaggaaaaauauggcccagugu

SEQ ID NO: 4229311 - RNA, 104 nt, Human
auuaggacugaaaucauagaauucuuuaucaggccaucuuaugucugcuugcaagaauaagcagacaaggggauuuuugaugguaguucugcauucaucuugau

SEQ ID NO: 4229312 - RNA, 68 nt, Human
uuucacaagacagucuuggauuccaggagucauguccugauuccugcuauucacagggcuaugugaaa

SEQ ID NO: 4229313 - RNA, 62 nt, Human
auggcugggaagaguuagagacagcugcagaugcagcuuuugcagacuucuugcccagcugu

SEQ ID NO: 4229314 - RNA, 72 nt, Human
gauuuccuuuucucuuucaaucugcaguacuuuuuaugaagacuggucuuuugugauggaugaagagagguc

SEQ ID NO: 4229315 - RNA, 77 nt, Human
gagccaaauccagcagcuggcuuacuugagaugcaucuggcaaauuccagggcaaagccagugacucccagcggcuc

SEQ ID NO: 4229316 - RNA, 61 nt, Human
ucaucgauggggagcucuacaacgaagugaaggcggaggagagcucguggcucauugagga

SEQ ID NO: 4229317 - RNA, 84 nt, Human
acaguccagcuuuagugaguguggagcuagacucugaucuggauuugaauucugguuccugcauucauucaacuguguuacugu

SEQ ID NO: 4229318 - RNA, 80 nt, Human
cacaggcccuggggcaggagcagaggcugagcccacaccaggugcuguuucucugaccuccaccccaggagcuaaaugug

SEQ ID NO: 4229319 - RNA, 86 nt, Human
aaguguuauaagacaguacuuacaguuuacauaagaauuguuuaccugaggauuuagcaugaaaugugaaaacuguuuuaauauuu

SEQ ID NO: 4229320 - RNA, 55 nt, Human
ugcguugaggaccgcgagggcgcgcgucucgggugccgccgugggucccgacgcg

SEQ ID NO: 4229321 - RNA, 55 nt, Human
gucacuguuucacuguucauuaacaccuccaggagagggugagcugagucaggac

SEQ ID NO: 4229322 - RNA, 91 nt, Human
uauuaaguugcaagccacugcugugcagacagacucucuuugugaagaugagaguuagccugcauaguucaauggcugacauccucagaua

SEQ ID NO: 4229323 - RNA, 56 nt, Human
gugcucuauguugauuccuugaugcagugcuuaaggcuuuggucaccauggagcac

SEQ ID NO: 4229324 - RNA, 69 nt, Human
caugucuguacauuuuuagagggcuucagcagggcauugaggaggugcucuguguaugcauagaauuug

SEQ ID NO: 4229325 - RNA, 61 nt, Human
cugcuagcugugcuuggaaguuugcuuggaaacuagcagcuuaccucccacagcucuccag

SEQ ID NO: 4229326 - RNA, 64 nt, Human
ggagugaaugguggccguguuugcuuuacuagauuuauagcaugaaugagccccaguucguucc

SEQ ID NO: 4229327 - RNA, 57 nt, Human
ucuguuuuucagaccuuuuuggcaucuaacauggugaagaaaggaguaaagaagaga

SEQ ID NO: 4229328 - RNA, 121 nt, Human
gcugggcacagccaggcuggcugccagcugguucccugccccguggcugggggacagagcagcacguaucagcugggcuagggucagggggccacuggugcgcagccuggcacagccuggc

SEQ ID NO: 4229329 - RNA, 130 nt, Human
uuugccacguugcaauaaugacaccuagauuuucggguugugguaagcauuaagugagggaaugggugugcagcucucaccauagugcuuaaaacaaaaugaaaguagccagcauuauuguuagaauaag

SEQ ID NO: 4229330 - RNA, 83 nt, Human
uuauagaaaguguuuuaucuauguaauuauaaauguuaaggacucuuguauuuuauaaacacaagaugggcucacuuugauga

SEQ ID NO: 4229331 - RNA, 79 nt, Human
guccuuuuuuuauacccaggcccuaugaaauaaaaacaagucaacauggcuguuuggguggcuagagaaagaaaaagac

SEQ ID NO: 4229332 - RNA, 69 nt, Human
cggagcauacugccuggagaugcggugagcacugucucagcacuaacucucugguagcucugugcucug

SEQ ID NO: 4229333 - RNA, 76 nt, Human
gucuucauaucuccagguucugcuggagcaauuaccucccccaucuggcuccuuaggaccuagagguaguaaaggc

SEQ ID NO: 4229334 - RNA, 55 nt, Human
ucaugauaauacaggccuucuacccauucuguuaaagguuugcuguauaucaugg

SEQ ID NO: 4229335 - RNA, 82 nt, Human
ggggucuucuuggggcagcccaggcugagccucucccccugcgaccugcuccuggccgggcugcuccuggaugagguacucc

SEQ ID NO: 4229336 - RNA, 79 nt, Human
guggauaguuuggguauuaguuuagcuagaaauacaaagaaacuugacuucuagggcaguacaaauucaagccuuccac

SEQ ID NO: 4229337 - RNA, 67 nt, Human
uucuggaguugaggguuaguaaauagcuaggguucuuaaaauauuuaucuagcucuuaaaaguagaa

SEQ ID NO: 4229338 - RNA, 55 nt, Human
ggagacagauggcgucucaguucccagcucugggucugaccagcagccugucucc

SEQ ID NO: 4229339 - RNA, 74 nt, Human
agaauguucaaauccaucaaaucuucuagaacuuuacacacagguacugaaagagugguggacucuggcauuuu

SEQ ID NO: 4229340 - RNA, 58 nt, Human
gucagacucuggggccccaggcggagggcaaccagaugucuucagcuccaagucuggc

SEQ ID NO: 4229341 - RNA, 72 nt, Human
uaccuaucugcuggauuuguuguuagggcugaaugaacuaaaaugcccucacacgguggccagcaguaggug

SEQ ID NO: 4229342 - RNA, 84 nt, Human
uuaauguccauaaacaagaaaggucugggaacaaucuguaugauuuuucuuucacauuuucuuaucuuugccacuggagguuaa

SEQ ID NO: 4229343 - RNA, 68 nt, Human
ccaggaggugaacccaggugcuucacgggaccagacuuccccagcagugaagcaagggucaccugugg

SEQ ID NO: 4229344 - RNA, 82 nt, Human
ggaguauugaggaacuaaacauaucacugcuuuacuuucucauuaguucaugagaacgugccugcucauucucaauauuacc

SEQ ID NO: 4229345 - RNA, 74 nt, Human
gguuuuccuaguucauucucucuauuccuguucuacuuuuaaggaugggaacuggaaaaaaugaaguauuuacc

SEQ ID NO: 4229346 - RNA, 55 nt, Human
uuuccagaaaucucuguugauuguggucugaccucagauucaugauuucugggaa

SEQ ID NO: 4229347 - RNA, 60 nt, Human
ugugcccagccgcuguggucuagggugaagugacaccuuaaacagauggcggcugggcca

SEQ ID NO: 4229348 - RNA, 74 nt, Human
gcguaggucagcgcuguguucccgugggcaucucgggccaugacguccaccccguaccagaucaggagcugcgc

SEQ ID NO: 4229349 - RNA, 73 nt, Human
cucccagggaagagaaacaaagauucaaaguaagcaugauacuaguggguuuaccaguguuucuuccaaggag

SEQ ID NO: 4229350 - RNA, 55 nt, Human
gauccagauauuugggcugguauacauaaugaugccauguucuugaaucuggguc

SEQ ID NO: 4229351 - RNA, 79 nt, Human
ccucucccauuucuccagggcuaccagguuuuagcagcaacuuacaaccaggcugcccagcucuggaaggugggggagg

SEQ ID NO: 4229352 - RNA, 67 nt, Human
aggaagaugacaucggaucugucugcagaaaucaucugucaagagucagaaggugucagaucuugcu

SEQ ID NO: 4229353 - RNA, 80 nt, Human
agugggcuuggaagguggugaucaucuugaaggcuguuaaauucacccugaagaugguugauccccuugaaggcuauccu

SEQ ID NO: 4229354 - RNA, 78 nt, Human
ugaaaucacagacuguuggcagauguuugaguacaaugacuuuaauuucacucuugacuaaugcuaaugucauuuuca

SEQ ID NO: 4229355 - RNA, 57 nt, Human
gugugucgccaacaauugugucucauggggaguugagauagaaggauugugacacau

SEQ ID NO: 4229356 - RNA, 75 nt, Human
agaaaagccguguuaaucauuuuugauuuugccuuuaugaggguaaaaucaugacagauugacauggacaauucu

SEQ ID NO: 4229357 - RNA, 55 nt, Human
ugacacacagggggauggaguugguccuuguccauucucucacccuugcugugca

SEQ ID NO: 4229358 - RNA, 56 nt, Human
gucacuuugcuugcgaugcucccuugggagaucaacaugguaaguacaaagaugac

SEQ ID NO: 4229359 - RNA, 84 nt, Human
ggguuggaggaaggacaggaacagcaaagauggaggcucuucaugccggccccaauaccuuuccaugucuucuuucuccacccc

SEQ ID NO: 4229360 - RNA, 58 nt, Human
ccgguguggguuucucgguagugaggagugguccgggcuagagaagagcccacaccgg

SEQ ID NO: 4229361 - RNA, 58 nt, Human
caaggcuggaguacagugcaguggugugaucauaccucauuguagccuccaguucuug

SEQ ID NO: 4229362 - RNA, 104 nt, Human
cagaugugcucucagaaauaaugaauucuuuugcaaaguccauugaaguuaugggagaugguugccuuaaugaugaacacuuggaagaacugggaggaauacug

SEQ ID NO: 4229363 - RNA, 130 nt, Human
uuucauacuguuuaaguucuguuucaugguuuguuuucuuucagcauacacuaucaugucuggcuuaugacagaguucugcuuuccaauaaaaucaccaauagcuaugugugguucuugagcacuugaaa

SEQ ID NO: 4229364 - RNA, 58 nt, Human
ggggaacagugacugugagggaccuguguccagcccugcucucuaguccugccucccc

SEQ ID NO: 4229365 - RNA, 72 nt, Human
aaggaauguaacuguuuugaauauugugguuugagauuaaacagagcauuuuaaaacuaguuaccauuuuuu

SEQ ID NO: 4229366 - RNA, 60 nt, Human
aggaaaaugaaggaagugggaaucauggaguacagcucuucucauugcuuucauuuucuu

SEQ ID NO: 4229367 - RNA, 71 nt, Human
gggcaaaaaugggacaguugguugggcucuugugccuccugcaugggccuccuauuauccccaucuugccc

SEQ ID NO: 4229368 - RNA, 63 nt, Human
gcauaaaggacuauaaggaucaaaaagcaagcagaaaugaauccacauucuaguccuuuaugc

SEQ ID NO: 4229369 - RNA, 62 nt, Human
accaaacacuuuccuggcuuugcaagguaaucauugcuuucaaaacucagaggaauuuuggu

SEQ ID NO: 4229370 - RNA, 77 nt, Human
gggggggcagcgagcagcacagaccaaacagaaggccuggccccuccuggcgugggcuggcugcagugagcccuucc

SEQ ID NO: 4229371 - RNA, 61 nt, Human
gcugucggccuuuggcuucuccuguguucuagaaccaggaguuuugaccaggggcggcggc

SEQ ID NO: 4229372 - RNA, 77 nt, Human
gagggguccugggcaguccagcuggaaacggacuucacagcacagucuggguucuagaacgagcccgaggagcccuu

SEQ ID NO: 4229373 - RNA, 56 nt, Human
uugggugcugcacccuucaacacugaaaccacacuguggagggaggaggggcccaa

SEQ ID NO: 4229374 - RNA, 55 nt, Human
ucccagcaggcaccgcuucugcggccgacgcgcguggcggcggugccggcuggga

SEQ ID NO: 4229375 - RNA, 124 nt, Human
gacuacaucacagcagcauacguggagaugaggcgagaggcuugggcuaguaaggaugccaccuauacuucugcccggacccugcuggcuauccugcgccuuuccacugcucugguaagugccc

SEQ ID NO: 4229376 - RNA, 73 nt, Human
uuacccaaaugccacuguuuaugucacuuaauguugagugcuuucauuaagauauugagugguaauuugguag

SEQ ID NO: 4229377 - RNA, 70 nt, Human
cccggcccccgccuggcccauugcagggcagcacccaguuguuaucguggaggcccaggcggcagccggg

SEQ ID NO: 4229378 - RNA, 55 nt, Human
ccgaggaguagggugucuacggggcgggcccguguagaccagcugugcuccucgg

SEQ ID NO: 4229379 - RNA, 76 nt, Human
ggcagugucacugcaggucccaucaccugcgagcucgcuuguuggccgcuagggagcacuuggcaguggcagcucc

SEQ ID NO: 4229380 - RNA, 76 nt, Human
uaccagccccagagaggguccaggucauuuaaaaaguccuccagaggcagaggagcauggcuucuuggggcuggug

SEQ ID NO: 4229381 - RNA, 81 nt, Human
guucccuucccuuuucauccuaucccagccauccuuuuggaagggagagaggugggugggagggugggagggugggggaac

SEQ ID NO: 4229382 - RNA, 57 nt, Human
uucucuugccuucucuuuuaucucauauggcacaaguagagggggaagccaggagga

SEQ ID NO: 4229383 - RNA, 73 nt, Human
uucuaaaacauaaagaggagaauuaagucagcugcagaacaauggggcugauucuucugcuuuuucucuggaa

SEQ ID NO: 4229384 - RNA, 82 nt, Human
ggaugggggcuuggguagagcagaaacauggagaaagguacauuuccucugcuugucuucagguuccucaccacuccccacc

SEQ ID NO: 4229385 - RNA, 66 nt, Human
uuuuagaagcaaagcaaacacauucuggauacacgugagauccaaguggugacugugcuacugaga

SEQ ID NO: 4229386 - RNA, 67 nt, Human
cuucuacaaauuguuuugccacaaaguuacugggagaaagugcugugguuuuauuuauuugaagaag

SEQ ID NO: 4229387 - RNA, 66 nt, Human
ggaucuuguaccuuuguguuuauuuucuguuucaacuaaggauagacuucagaaggcauagcuucc

SEQ ID NO: 4229388 - RNA, 65 nt, Human
agugcucucuccuuuuugauauuuagccucuaguuuuugggcuaguuuucacaaaggaagggccu

SEQ ID NO: 4229389 - RNA, 62 nt, Human
gguaguggcauucgauuuuggugggaaauguaucucuuugccugccguuaaauguuacuucu

SEQ ID NO: 4229390 - RNA, 61 nt, Human
cauggcacagaagaugucguuuggcuucuacaaguacagcaacauggaguuugugcgcaug

SEQ ID NO: 4229391 - RNA, 74 nt, Human
agucaacuaaaacaugacagugacuuuauaagagcuuuccuuuuaaaagguugcuguuauaaaaaaguaugacu

SEQ ID NO: 4229392 - RNA, 62 nt, Human
gcuccugggaagccaguaucagacuaauccuaucggauugggaacaggcuucccacuggagu

SEQ ID NO: 4229393 - RNA, 82 nt, Human
aauuacucuugaacuuacauugaggaauucuuacuuuuucauuuucuugaauagaaauccugauggagucugaagaggaauu

SEQ ID NO: 4229394 - RNA, 55 nt, Human
agugccuuaaaggucuugcagcggaacugugccgcguaccugaaauuacggcacu

SEQ ID NO: 4229395 - RNA, 125 nt, Human
aggcucugcgucugugcccccaaguagucagagagcccagaucccacccuggagaaaugggaagugucccaucacauccacagggaugccugcggcuucuaguuucuggcccaagaccaggacuu

SEQ ID NO: 4229396 - RNA, 82 nt, Human
cuggguugcuuauuuaaaauguagguugggacuuagagggugcagcaguucccauccuagaccuacugaaucagacucucag

SEQ ID NO: 4229397 - RNA, 55 nt, Human
uucugagguagccacucacugggugccagaaaacccugagccuguuuauccagaa

SEQ ID NO: 4229398 - RNA, 71 nt, Human
cuuuuccaccaucuaagagaaaggaaguucagagccuuagcuucaacaccacaauuucuuaacuggaaaag

SEQ ID NO: 4229399 - RNA, 65 nt, Human
ccaugaacugcaguauaaacuugggcccagggagacuggcuccgauuuauucugacaguuuaugg

SEQ ID NO: 4229400 - RNA, 107 nt, Human
guaccgaaaucauaaugaacagaauuauaauucauuaggcuuaguuuauaauauauuuauguuaauuucucaggaauuaagucugacuggauuguaugguuaugugc

SEQ ID NO: 4229401 - RNA, 105 nt, Human
cuuacugcgaggaauugcagauggaguuuguagguuaggaucagcacuggcaaaauuaauuugaccguguuauugccucaugagacucccaguccugcaguuaag

SEQ ID NO: 4229402 - RNA, 130 nt, Human
cuuuauuuaaaaucacuccuaauaacccacuggagaacucugugcuucacuuuccccaacucuggguugaguagaauuacagguuuucucucuugcaaagggguagagcgggaauccauugaacuauaag

SEQ ID NO: 4229403 - RNA, 66 nt, Human
gaaggccgcgguggcgaaggcguugaagaugccagcauugaugccggggucguagccgugguacuc

SEQ ID NO: 4229404 - RNA, 92 nt, Human
ggaaguguuuuuauguuuugcaaauaucaaacagcacagagccguucugcaacuuccugacugguauuuguaaaccauagugcuacacaucc

SEQ ID NO: 4229405 - RNA, 59 nt, Human
uagccuguuuuuaugagaauuuaugcucuuguuugaaaguugucauguaaaaugggcua

SEQ ID NO: 4229406 - RNA, 61 nt, Human
uacuugaaaugggcaucaagagaccaccaaauguuuacaguuucuguggcccguuuaagug

SEQ ID NO: 4229407 - RNA, 67 nt, Human
gcaaguaaaacagguuugaacuucuuaacuuccagaagauaggaggaugggaccugugauacugugc

SEQ ID NO: 4229408 - RNA, 67 nt, Human
ccggccacugggacacguugugcuuuaacaagaucgaaauugauugcugccagcguguccgugucgg

SEQ ID NO: 4229409 - RNA, 69 nt, Human
gugcagcugggcgcugaccuuccagguagagcacagauggcacaaccccgaggcagccccaacuugcau

SEQ ID NO: 4229410 - RNA, 68 nt, Human
uuugccaucagaugugguaggugcuuauuaggcuguagcuacacaggacuuccacaucacugaguaga

SEQ ID NO: 4229411 - RNA, 65 nt, Human
accucuuuuugaauauagcauuugcaaaacaaucuuaaaagacugcuguagauucacaaagaggu

SEQ ID NO: 4229412 - RNA, 77 nt, Human
cccuagagugugugucuccacugugcuauuuuucagaagaauaugaggaacaguacucggaggccagacuugugggg

SEQ ID NO: 4229413 - RNA, 66 nt, Human
ccaaauuaccuucuuggauucaaauuuuacaaauguuggauugauagaauucugaagauaauuugg

SEQ ID NO: 4229414 - RNA, 99 nt, Human
agaaaggagccugggugggcagagucuaagauauguuacacucagacauauuguauuagcucuuggagauuucugccuugcaaacuuagacuuuuuucu

SEQ ID NO: 4229415 - RNA, 74 nt, Human
gcugucucauccccagcccuuuuuugccauuccuuccuacucuggucaguaggaggcaaaugagagggcucagc

SEQ ID NO: 4229416 - RNA, 60 nt, Human
ucauaggaguagcagugagaggacagugucacagcaagggccucucugcaugcucccuga

SEQ ID NO: 4229417 - RNA, 62 nt, Human
accugccaguaucuuuggggcuguguccuucaaggacauguccccagacugcugugcagugu

SEQ ID NO: 4229418 - RNA, 89 nt, Human
gaugcuagaagagcaaagguagcagcucccaggcaaagcugaagacaggcaguuuggggcucauuugcuuuugucuuuuaauugggauc

SEQ ID NO: 4229419 - RNA, 84 nt, Human
ugugcaguggaacuaggggucccaagggugcucuagcuccaaaggcuaagggcguacuuucgccccuccuccuuccacugcaca

SEQ ID NO: 4229420 - RNA, 83 nt, Human
ggggugaacccggcgggcacucagggucgaggugggggccaucacucccuugagcccugaggucccuacuggagggucacccc

SEQ ID NO: 4229421 - RNA, 74 nt, Human
ccaggacauauaggaaaaagaagaaaagaaucauccccugaaaugcuucucacuucuugguuuccaugaccugg

SEQ ID NO: 4229422 - RNA, 93 nt, Human
cugggugauaauggaauacuaugcagccauaaaaaggaaugagaucaucuccuuugcggggauguggauggagcuggaagccauuauccucag

SEQ ID NO: 4229423 - RNA, 87 nt, Human
ucgcaauggaacucaaucuuagccacuccgcagcaccggguuucauaacagacucggcggccucgagugcugggaagaaacgugcga

SEQ ID NO: 4229424 - RNA, 69 nt, Human
uugcccuuugcugggaagccuucacucuccagcuuuccugggguagggaaggucucccacauuaugcaa

SEQ ID NO: 4229425 - RNA, 80 nt, Human
ggcaugagcacgugggcggggcucacggugcggcagcgcuucagugcuggcccauccggcuccuccuugaugugcauguc

SEQ ID NO: 4229426 - RNA, 60 nt, Human
gggguccuggugccaccugcgggaugggagugcccagccugagucugcacauagaacccc

SEQ ID NO: 4229427 - RNA, 97 nt, Human
gacaaaccugaagucaauuaugacaagaugacaucauggcuucugucucagguaacagcagccaugcacgucauuaugaugaucugacuugguuuuc

SEQ ID NO: 4229428 - RNA, 84 nt, Human
uagaccguauaggguaacuuccuuggguugccauggcauuuauaaacugucauggugcuggugggaguguauuuuaaccggcua

SEQ ID NO: 4229429 - RNA, 64 nt, Human
guaaucucugcuacuugggaggcugaggcaggagaauugcuugaacccaggaaguggaggcugc

SEQ ID NO: 4229430 - RNA, 67 nt, Human
gcgcagaggcaugaacucccguagccagagagugugagcuggacucuaccuggagcagccucggugc

SEQ ID NO: 4229431 - RNA, 64 nt, Human
aagagaaacauauggccagauucaagucugugcaaaacagaagcuggcucgccaugguucuuuu

SEQ ID NO: 4229432 - RNA, 78 nt, Human
gcggauccgggaggguaagcugggacuccucgcgagcaguagcugcaggguaccaagcuucgcccucugcguccccgc

SEQ ID NO: 4229433 - RNA, 92 nt, Human
ccuaaacuuuccuaaauguucauauggguagcagauuuuguggugauuagaaacaucagguccuuaaauacgaugaacaugggauacaaagg

SEQ ID NO: 4229434 - RNA, 99 nt, Human
ucccagauaauaagcugucuuccuccagagcuucauccugccccgcugggaguugacuggggccaagaucaggggauuuggcaggcaggcagccuggga

SEQ ID NO: 4229435 - RNA, 55 nt, Human
uuaacauuguccuuagcagauuucuaauuuuugguuuguucaggggcaaaguuaa

SEQ ID NO: 4229436 - RNA, 58 nt, Human
gggaaaaaggaguuagagauaauuaggauaacaaaauaucucuuuuucuucuuuucuc

SEQ ID NO: 4229437 - RNA, 83 nt, Human
gcuuuggaaagcacuggaaaaauggauccugucuuucuuagccaaggacuggucucuuuucuccaaugugucccuaacagagu

SEQ ID NO: 4229438 - RNA, 63 nt, Human
ucaugcagcggucagaggaacucagagacugacauuugucaccugucccuggagagcugcaga

SEQ ID NO: 4229439 - RNA, 81 nt, Human
guauuuugcaugaggcugaauucuuguugucggagcagaggauuuuuguuccaacuacugaauuggcaaaauguuaaauau

SEQ ID NO: 4229440 - RNA, 56 nt, Human
ugggaaaauagcuauuuugaaaguuauugcagauguagggaauagcuuguuuccca

SEQ ID NO: 4229441 - RNA, 63 nt, Human
uggcaguugcaguaacuuguauggaaagagaaaaugcaaugagcccaguuacugcacuugcca

SEQ ID NO: 4229442 - RNA, 60 nt, Human
acugugaagagcauucuggcugaauacaagauucauaaugccgaugugacucuacguagu

SEQ ID NO: 4229443 - RNA, 76 nt, Human
ucauuguauuugaaaacuuagugaagaagcaucuuuaguaccauugaaauuugcuuccucacugugauacauggga

SEQ ID NO: 4229444 - RNA, 77 nt, Human
gccagccugccaagcugcagacccccugucucauggaggcuaucuugagggaggggaaugugugcagagcaggaggc

SEQ ID NO: 4229445 - RNA, 61 nt, Human
ugggugaaucaaugaauugcacuucaacagcaaaauuggauuguauugauugguuggcuca

SEQ ID NO: 4229446 - RNA, 62 nt, Human
gccuuuugcaaugguguuggugagaggaaagaguagcuucaauuaagacaauggcaaugggu

SEQ ID NO: 4229447 - RNA, 80 nt, Human
uuugucacauuuuucacugacuuggucuggaauacaccaucacuauuauaaauuauuucaucccugucagugaaggcaaa

SEQ ID NO: 4229448 - RNA, 55 nt, Human
gauggcaaugcuagaaauuuaggagcuacagcuccucucuaacaugaaugcuauc

SEQ ID NO: 4229449 - RNA, 82 nt, Human
acuuaauggaaagcaaaauaguuuuagauacugagaaaauuacaauuuucuacaaaucuggacuuuuaugcagugauuaggu

SEQ ID NO: 4229450 - RNA, 89 nt, Human
cauuaaaggacuugcuauugguuuacucuguaaaccaggaaccugacauaguugcugguuucugaguaaccacagcaguacaacaaaug

SEQ ID NO: 4229451 - RNA, 96 nt, Human
gcauacaaaucaccugggaucuuguuagaaggcaguaggucugggguggggccugagauucugcauuucuaaccagguccugggagaugcugaugc

SEQ ID NO: 4229452 - RNA, 107 nt, Human
uuggcauaucacagguaaaagaaaaccacuaggugucauuauagaccagauacuaucuagguaucauuuuacugugacauuuugguuuccugaaagauagaugcuaa

SEQ ID NO: 4229453 - RNA, 59 nt, Human
ggauggcgggccauggacaaugcgcugaccuagcuguaagucaccuggcccgauaaucc

SEQ ID NO: 4229454 - RNA, 61 nt, Human
cagaccucuaugggguaaaucuggggauuucuuggaagaaagugcacucauggagggucug

SEQ ID NO: 4229455 - RNA, 88 nt, Human
gggggaacugggugauucaggcuguuucaacacugacuucuucaaaguccaacaaucagagaagcaguuuagucaucgggauuuucuc

SEQ ID NO: 4229456 - RNA, 72 nt, Human
gggcucuggcugccuuaguuuuguauuauuucuuuucggauauuauggcagggcucuggagucaggcugccu

SEQ ID NO: 4229457 - RNA, 62 nt, Human
agugacuguccuacuuuguagacaugcaaucguuuuguaccucuagaccuugggcagucacu

SEQ ID NO: 4229458 - RNA, 67 nt, Human
gucaguggggaggccaggauagaacuagagcuggugucccagguuccagucugggcucuucacugac

SEQ ID NO: 4229459 - RNA, 82 nt, Human
aauucaaucuuuauuucccuaacuugcuagcugucagaucucagacaagucauuuauauuggcaaacgggaauaaaggaauu

SEQ ID NO: 4229460 - RNA, 70 nt, Human
gaggccgggaggcggaaguccaagcagguugucccaauuuuggccugcaaagacuuccuucucucgccuc

SEQ ID NO: 4229461 - RNA, 75 nt, Human
augugcucgguaucuuuauuuuaauuaagauuuguuucuuuauuagaucuuaguuauuuggagaaaccaggacgu

SEQ ID NO: 4229462 - RNA, 86 nt, Human
uccauuuugagccaucuggugucaaugauucccuaaguuuggaaauugaagcgcuggaauuagacggcaucacaugggcaguagga

SEQ ID NO: 4229463 - RNA, 80 nt, Human
ucaguauuugugcacauuucauugaccugcuuucuuuuaugugaguaguguuauuucuuaugugcuauacaaauaauuga

SEQ ID NO: 4229464 - RNA, 55 nt, Human
aguagucuuaggaaugauuuuguugaauuguuugacaaaaccuaacuuggcugcu

SEQ ID NO: 4229465 - RNA, 100 nt, Human
gggggcugguggggcagaggcagguacacagaggauggaaaugagaacaagggcccucuuguuucagcuuccuccuccaucucgguccccaccauccccu

SEQ ID NO: 4229466 - RNA, 66 nt, Human
cugggugagcuggccagaggguagaagggaggcaguauagucugcucugauaccagcuacaucuag

SEQ ID NO: 4229467 - RNA, 62 nt, Human
cuguggcaaguuuucugacaaggaucucugucagcuggcuuccuuguaccauuugcucacag

SEQ ID NO: 4229468 - RNA, 58 nt, Human
agccccuaaaguagcuguucuuaaccuggaaucugaagaacagccuguugguggggcu

SEQ ID NO: 4229469 - RNA, 76 nt, Human
acacaggaucuagaagaacaugucaaacuauaaacugcuugugauugugaaugacuguguucuuugcuucuugugu

SEQ ID NO: 4229470 - RNA, 83 nt, Human
acagaguuuuauucauugccauaauagagccauguaggaaaugcacugacugcauguuauuguggcaagaauauccuaaaugu

SEQ ID NO: 4229471 - RNA, 71 nt, Human
ugcaugaccucugagcaaggcagaggguauugaagaaagcauuggccucucacucccucauggguucugca

SEQ ID NO: 4229472 - RNA, 68 nt, Human
ggcugcagucuggggauggcuggaggguccuggaagugcgcagcucacagccucccccggccugagcc

SEQ ID NO: 4229473 - RNA, 56 nt, Human
uaucuccauucuagccccuuguaggaaaacugaaaagggaaaagcugaaugagaug

SEQ ID NO: 4229474 - RNA, 99 nt, Human
ugggacaaaaaauuagggaacuaaaauaauucaaaggaaagagaaaaagucuuggucauguuugccaagcuuugaauauuagaccuugcuuuuuuccca

SEQ ID NO: 4229475 - RNA, 130 nt, Human
cucuggguggcagaggggggaagguuaagcggggcugcuggcuuggggaauuuggggccguccgcggggcucuccucgggcuccaagcuuucaccccagaaaacagcccugaaccccaaauuugcuccag

SEQ ID NO: 4229476 - RNA, 68 nt, Human
cacuugaauuuugggcuuuguuuuaagguauguuuuggugcauguccugacaguccaagggcgaagug

SEQ ID NO: 4229477 - RNA, 60 nt, Human
gagacuguaagcuccuugaggacaggaaccauagguuugucuaccguagagcacauucuc

SEQ ID NO: 4229478 - RNA, 81 nt, Human
ugaguuucuguucuguuuauaauuugcaguuguccagaauggauuaacgcaucuggaaacaggacagguuucuguaauuca

SEQ ID NO: 4229479 - RNA, 75 nt, Human
uggaagguaaugugugguggugaggcaagggguguugagaacacagugaccuacauuccaaauacaacucuucua

SEQ ID NO: 4229480 - RNA, 130 nt, Human
guugaauuuauugguauaaaguuauugacaguauucccuugauauccuuuuaauggcuacaaaagccauagucacuuguccucuuuuguucuuaauauuguuaauuuauaucuucucuuuuguucauugc

SEQ ID NO: 4229481 - RNA, 89 nt, Human
cauaucugugagacaguuggugagaguuagggauuuaaucuguggcgacuggagcugaaguacucucacuaaguguauuugacgauaug

SEQ ID NO: 4229482 - RNA, 59 nt, Human
uguccugauggccauuuuucacuaguuucuuccuucuaggauaaaugggucauuaggca

SEQ ID NO: 4229483 - RNA, 59 nt, Human
caggucauaacuaugcaugaacauuuuuuaucaggaauggccgauguguaugugauuug

SEQ ID NO: 4229484 - RNA, 77 nt, Human
cugaacugacaaagucuuuccuuuaguuucugcuaggucagacuuggugcuaaauggaggagaguuugucaguauag

SEQ ID NO: 4229485 - RNA, 62 nt, Human
uucaguuugaauucuguagaacagacugcuaagaauuguuuuuucacagaucucuaacugag

SEQ ID NO: 4229486 - RNA, 85 nt, Human
ccccuauggagccagcccccuaaguccccuaucuucccaggucuuccucugucccuucuggaggcugcuggucuuucauaguggg

SEQ ID NO: 4229487 - RNA, 57 nt, Human
ugaguccagaugggccagcagggaggaaaaccgcagccuggugccuucugcgauuua

SEQ ID NO: 4229488 - RNA, 130 nt, Human
gagccuucagaaaugaagacccauuaucccccaaagcaaggcgccacagugauugcaaagcgguagugauuuguaguuguggaugcugaaguugugugagauguugauucugaaccucuguuuggcaauc

SEQ ID NO: 4229489 - RNA, 58 nt, Human
gaagcggguucacuggauggcuuugaggaauuaucuguacuguccacacacucgcuuc

SEQ ID NO: 4229490 - RNA, 67 nt, Human
cuccgaacggcagagagcccguccccagcguggggguuggcgggacgggcuagcugccguggcgggg

SEQ ID NO: 4229491 - RNA, 57 nt, Human
uaguccuggaagggaugguugaggaugggagugccuuccugccuggccuucugacua

SEQ ID NO: 4229492 - RNA, 129 nt, Human
uaugccuggcuaauuuuuguauuuuuaguagagaugggguuucaccacguuggccaggcuaaucuugaacuccugaccacaggcgauccacccgccucagccucccaaagugcggggauuacaggcaug

SEQ ID NO: 4229493 - RNA, 64 nt, Human
gguagggcugaaugcaucuagggaggaaagguaccucgcaggccccagaccauuuugccuuacc

SEQ ID NO: 4229494 - RNA, 63 nt, Human
gggcgcgggcgccgggagugagagugaggaccacgccuccucccagcccaggcgccacgaccc

SEQ ID NO: 4229495 - RNA, 83 nt, Human
ccuugcuaccaggauauccacccugcaggccaacucucagacccaggaugagagugucaggaggguggaugucggcuguuugg

SEQ ID NO: 4229496 - RNA, 59 nt, Human
cuucuagucaaaauggauaagcuacaaaaugaaacuguuauuuccauugagacaagaag

SEQ ID NO: 4229497 - RNA, 76 nt, Human
ugaaaugaagguggacagauuuuuuuggcuuuccaucaaauugaguaaagaaaagguaaccgcuuaucuaauuuca

SEQ ID NO: 4229498 - RNA, 68 nt, Human
ugcugcggcaccaaccccuucaugcauugcccuuuucuugcugcuguguugggauggugcgcgcacca

SEQ ID NO: 4229499 - RNA, 79 nt, Human
aaaguucuaggagcacuucagcauaaaucacagagaauuccuuucuguggcaauauggaauguguuucucuauuucuuu

SEQ ID NO: 4229500 - RNA, 55 nt, Human
uaaggagagaauuuagagguuuuagacuggcaucugcuucuaaauucuguuuuua

SEQ ID NO: 4229501 - RNA, 129 nt, Human
uccaaauccauuucauacaggugaaguauaugugcuauguagacuucaucagagcguacuguuuugaguagggacagcguguuuugcaugaacacaucacagucccauuuccgugaaaugagauuggca

SEQ ID NO: 4229502 - RNA, 93 nt, Human
gacaguggggugcucaucuucuguaacuguugggaaggcucggugguccauuuucaccaguuaaagaauaugaggccagcccagaaaucuguu

SEQ ID NO: 4229503 - RNA, 70 nt, Human
cacccaacacuagcgcaaauacgcccaugagcugcucuauuuauaguguguaaagugcagugauuggaug

SEQ ID NO: 4229504 - RNA, 58 nt, Human
uuggaagaggaagaugaggcagcaggugcccaggccugcugccucccaucccucccga

SEQ ID NO: 4229505 - RNA, 55 nt, Human
gaggaggucaccuggugagcaaccaaguaagucuucauccagguccugcuucuuc

SEQ ID NO: 4229506 - RNA, 65 nt, Human
gagaugacagucacagcagaaacucggguuuucagcucagcauucuacuuugugaacuguaacuc

SEQ ID NO: 4229507 - RNA, 105 nt, Human
ugccaguaugacugcauuaucuagacaauuccauccuacgugggcacucgauacaaagauacguccacagugguggaauuguucaggcagagcagcagcacggua

SEQ ID NO: 4229508 - RNA, 67 nt, Human
uccaaaguauuaaaucuuagcaacugaugaaguaaaaagcuauuuuugcuaagguuuaacuauugga

SEQ ID NO: 4229509 - RNA, 80 nt, Human
agaaagguuuuuugaauaauucagaaacagcaaagcaaguggugguuugucuguacugccguuauucagagagaacaucu

SEQ ID NO: 4229510 - RNA, 55 nt, Human
ggugcagucuggggcacauuauuuauuuaagccaugugaacuccagcugccaacc

SEQ ID NO: 4229511 - RNA, 57 nt, Human
gagagaggggaagagaagcucuggguugcaugcugcugggagcucuucccuuuucuc

SEQ ID NO: 4229512 - RNA, 130 nt, Human
uaagaaaaucagaugcaaauuagcuuagguuuaagguuaaaagagugaguggauauugcaacuuuuauacgaagugucuuucuuucucuugacagaaguaaccuauucacuguagaaauuuggaaaugua

SEQ ID NO: 4229513 - RNA, 63 nt, Human
gcuccuacccucaagggccugggggcugcccagcugccucuaugcccuucugggggucucagc

SEQ ID NO: 4229514 - RNA, 68 nt, Human
uauauaaauauuuaccuaccugucaucugcaaaauugaugcagugauguaauggugaaugugauuaua

SEQ ID NO: 4229515 - RNA, 93 nt, Human
uagaccaugggcauggauggccgagucuggggaucagcaucguaauuuguugagaaggaggccgugcugugcugccaguuauuaauugguuua

SEQ ID NO: 4229516 - RNA, 71 nt, Human
uuccagcucuuccuccauucuggccagucccugcauccucccugggguggaggauggaaggaaagcuggga

SEQ ID NO: 4229517 - RNA, 55 nt, Human
gagcgugaggcagcuuucuaagauguaauagccuuggcuagccacuuccacgcuc

SEQ ID NO: 4229518 - RNA, 78 nt, Human
cuuuuuacaaguuauugggagagggaaugggagggacuuaauucuucccagauuccugcucuuauauaauguaaaggg

SEQ ID NO: 4229519 - RNA, 87 nt, Human
guuguaauaucauuuuuucagaaaggcuuaucaugcuauaagaagacuuauggaagggagcuggaauuuggaggauaauuuugcaau

SEQ ID NO: 4229520 - RNA, 75 nt, Human
uaguuuucuccucuauuucuguauguauuuccuuaauauguaguuucagaaguggaauuuauuagagauaaacua

SEQ ID NO: 4229521 - RNA, 77 nt, Human
cauaaaaacaaguagaaaaccgcacuggacuaguguaaguuaugaguucccuguuuuuuuccacuguacauuuugug

SEQ ID NO: 4229522 - RNA, 72 nt, Human
uaagaauacacauuguauguuucugugcacaugacagugugugugugugcacguacauacuguauagucuua

SEQ ID NO: 4229523 - RNA, 64 nt, Human
ccuucucucucucuuccagcauguugcuuuugaaaguaucaugggauagugggacgagcacugg

SEQ ID NO: 4229524 - RNA, 56 nt, Human
ucuccucuuaaugcacguuucccuugguauuaguggaagcuguguucaagauggga

SEQ ID NO: 4229525 - RNA, 71 nt, Human
cucaguacuuugacuagaggcagcugggaaagugacguccuguagcauuugcuguucuagaaaguacagag

SEQ ID NO: 4229526 - RNA, 88 nt, Human
caggaagguugggggaggccugcugcccaugugccaggcccccaggggcuguuucagggcagagcguuuccugcccccacccuuccug

SEQ ID NO: 4229527 - RNA, 68 nt, Human
cucuggacuuuaaaucuguugcuuagcuacugauccacaauagcucccaauugacuugaacuacagag

SEQ ID NO: 4229528 - RNA, 110 nt, Human
gcgggucucuguggcauaggagaguaguggaaacagacugagcccggccaucguggguucaaauccugguuccaccacuuacuaccugggggccucagacaagacacugu

SEQ ID NO: 4229529 - RNA, 65 nt, Human
gccugacuuuuccuggguagcuccugggucaaaauuucaggcaggaucccagggaaggggcaggc

SEQ ID NO: 4229530 - RNA, 98 nt, Human
gcgcucaccgcacguccaugaugcugcugcgcuggccgucacgguggcucuccaggugggacagcgugaaggcgggcagucggcggauggcgaagcgc

SEQ ID NO: 4229531 - RNA, 61 nt, Human
aggugugucuuuggcgaugucuggacagcucuguccauuagagaugcuaaaggacaucccu

SEQ ID NO: 4229532 - RNA, 76 nt, Human
cgugugccacgugccgggcugcggcaagguguacgggaagacgucgcaccugaaggcgcaccugcgcuggcacacg

SEQ ID NO: 4229533 - RNA, 62 nt, Human
uuuuaucuuacauggaaucuccucaggucaucugcuuugggaauuucagaugugaaauaaaa

SEQ ID NO: 4229534 - RNA, 64 nt, Human
uuuuucugacugcuaacaaaaauuaaagugauuacauuguucuuuuuuggagggguggggagga

SEQ ID NO: 4229535 - RNA, 60 nt, Human
uccuugugagacagaccuuggaccauguagaguucuagaugucauguguugcuccaagga

SEQ ID NO: 4229536 - RNA, 129 nt, Human
cuggggcccuggcccaggcccagugugugcgugcauggccguguguaugcggggccccuggagagggacgggaggagagguagcaucacacgcacauacacacacacagaugggcugggccuggcccag

SEQ ID NO: 4229537 - RNA, 83 nt, Human
gaggacuugguaaccaaucaaaugugaggaaaaacucuggcaguuuuuggcuguuucauauuuaauuggucaucaaagcccuc

SEQ ID NO: 4229538 - RNA, 68 nt, Human
ugagguauuuggauuuauauuuagaggaugacaaaaugauauuugacaaaguauauaucuuuaccuca

SEQ ID NO: 4229539 - RNA, 61 nt, Human
accaacacgucugaguauuuccgaauagguuuuauuaccaggugcuuaaagaauguguggu

SEQ ID NO: 4229540 - RNA, 64 nt, Human
gauccaggguuggggucacgagugauccauaagaagggacuaacuguggcugcuacccuggcuc

SEQ ID NO: 4229541 - RNA, 93 nt, Human
gcagguaguggaaccggucguaguucuucagcagguacuugggcgcauacaugugcucgcuggggucugcaggcggguacuccugcugcgugc

SEQ ID NO: 4229542 - RNA, 66 nt, Human
ucuucggugagcugcgggcgaggacuggggugcggcuccuuagccagggcagcucaaaauccagga

SEQ ID NO: 4229543 - RNA, 122 nt, Human
gagguucagugacuugcccaaggucauagagcuggaaauuggcagagcugggacuggaagccaggccaggcaccuggcuccugaguuucagcucuaagccuaggccauccuacgcugaccuc

SEQ ID NO: 4229544 - RNA, 76 nt, Human
agaaaaauaaaugagcaccucuaguuuugcggccugcuacaauaccuaacauuagcuuugcucaugcagucuuucu

SEQ ID NO: 4229545 - RNA, 74 nt, Human
uuguuuucggccacaaugaguccuuuagugccauuguggacucacaaugcacauggacaucaggcugugaauga

SEQ ID NO: 4229546 - RNA, 97 nt, Human
uucuuaaaaugguaauuauguccaaaugaacuaagagucauuaguguaggaaauuuucuuccacaauaauguuuuuagguuauuuaguaucaaagaa

SEQ ID NO: 4229547 - RNA, 62 nt, Human
uuuccuaggaaaugauugaagucagggagguuugugauugacuuuagucauuuccuaggaaa

SEQ ID NO: 4229548 - RNA, 72 nt, Human
ggguuuugguuuuuugguguaucuuauuccuucaaagcaggaaugugucauuauccagaauaaccauaacuu

SEQ ID NO: 4229549 - RNA, 130 nt, Human
aguagugugugugcgugucuuaagugugcgaggauaaggaggaagagaccagggggcuuuggauuuguucccucaaacucccucaacuuccuucucucuuccgauucaaacagaaccgucucacaucccu

SEQ ID NO: 4229550 - RNA, 73 nt, Human
cucuccaagacagauaccuagaagagacacgaaauaaacucucccuuuggauuuguuuuggcaaccaccagag

SEQ ID NO: 4229551 - RNA, 119 nt, Human
uuuccaaguguucuccucagugcucuuaaacaacccucaucuucuuccuucuuuuccuugggcucagggaaaggaagggaaggagaugcacagugagagaaaagagagcaucuuagaaa

SEQ ID NO: 4229552 - RNA, 55 nt, Human
ggagagagggaucuuuguggagggggaauuauuucuccuacauugacccucuucc

SEQ ID NO: 4229553 - RNA, 77 nt, Human
ggcaggugguucagugguuagggccaaccaucuacuucaguuccugucuggcccagaucucugaccuugaccaugcc

SEQ ID NO: 4229554 - RNA, 62 nt, Human
gugccuggaaucuuuucuucacaauugaaaugaaaugugcugaaggaggugaauccaugcau

SEQ ID NO: 4229555 - RNA, 73 nt, Human
ugaggagguuuaguccauaguauuuaaugaaagauuuacccauuccuugaaucuuguuuacugauuccuccca

SEQ ID NO: 4229556 - RNA, 78 nt, Human
cccuauguucagggaaguauuacauguuucccaggauauauuuggaagcucaauacuuuccucuucaaugcauagugg

SEQ ID NO: 4229557 - RNA, 64 nt, Human
acaaaguaggcuaagaccuuccacuuaaaagcauguuuaacuggaaguugagagucugcuuugu

SEQ ID NO: 4229558 - RNA, 57 nt, Human
uuaccugcagagacguggaggcgugagggagaacaugcuuguuaaauaugcagguag

SEQ ID NO: 4229559 - RNA, 80 nt, Human
gagauauccagauauccugguucuaucaaaaggggaaagccucaaauucuuuugaacauccaggaugucuuaauaaacuc

SEQ ID NO: 4229560 - RNA, 73 nt, Human
cagcauacucacuaggaaguaaauaugucaucccaaauaauuaagaggagggcauugucuucuuaguuugcug

SEQ ID NO: 4229561 - RNA, 64 nt, Human
uauguuucccagggaucucuaguauuucuagcaaugaaaauauuagacauaccuggagaagaua

SEQ ID NO: 4229562 - RNA, 68 nt, Human
uggggauuucuucucauaacugagaccaaaacaguuuugugcagucucagaaaugacaggagguacca

SEQ ID NO: 4229563 - RNA, 57 nt, Human
uccauggucgauggcugcugggccuugacucucugcccagcgccucuacugcaugga

SEQ ID NO: 4229564 - RNA, 64 nt, Human
uuugcuguaaugcaugucagagcaguuuggucuagaauugucuugugacagcaauuauagcaag

SEQ ID NO: 4229565 - RNA, 84 nt, Human
ggagcuuggguuucacauacaguguauaguagauuauagcauaccauuuucuguucagugcauauguauugauuuccaaguucc

SEQ ID NO: 4229566 - RNA, 113 nt, Human
cucuucacuuacucaaguuacuuuuccccauuauuacucgaaaucagagagaauaacaaaugcuauuguuuucuaguguuuugaauaagggaaguguuugaauaagggaaggg

SEQ ID NO: 4229567 - RNA, 63 nt, Human
ccacucagcaccuagaaagugugccuagcacauaggaggcacacaaaaauauguguugaaugg

SEQ ID NO: 4229568 - RNA, 62 nt, Human
ucauaagucucauauauguccauacaagaucaugaaaauggacaugucucuggguauuuuga

SEQ ID NO: 4229569 - RNA, 76 nt, Human
gggugcuuugaggggcugggguugacuccaagacccccgcguccuuggagaaagcugcaggcucuggacagcaucc

SEQ ID NO: 4229570 - RNA, 61 nt, Human
gccggguccagugggcacugggcggggugguguguucggcccagaggccccuggccugagc

SEQ ID NO: 4229571 - RNA, 56 nt, Human
ggguguggaggugacacauuugacugacaucagcaucuguguuccauccaccaccc

SEQ ID NO: 4229572 - RNA, 97 nt, Human
gcuaauuaagcauaaauggaauaauuuugaucagaagggagcaguguuuuuuguuguuuccuuuuuaauuaaucuaauuaugagaugcuuacugggc

SEQ ID NO: 4229573 - RNA, 65 nt, Human
guuuucugugguggguaguucagagguguauagggcagguuugagaaugucaaucacaagagaac

SEQ ID NO: 4229574 - RNA, 81 nt, Human
uugccuggacauuagcacauauuuagaucuugauguucuaacuaaugaaugacagcuaaggaauguguagcuuccugguaa

SEQ ID NO: 4229575 - RNA, 76 nt, Human
gcucugcucuuucaggcauagaccuugcugguucaguggcaguggcuagaucaugagugagcaucucuuuuagagc

SEQ ID NO: 4229576 - RNA, 83 nt, Human
ggcuuuccuucuuggcacagaugagauucuucuugugagaaaugguggaaucuucagccaugccaagauacagggaccgaguc

SEQ ID NO: 4229577 - RNA, 91 nt, Human
gggcuggcucuggagggcugggcuuggcaggcuggggagagcaaggagguggggaacccccagucugccggcccggccccuggucagcacc

SEQ ID NO: 4229578 - RNA, 69 nt, Human
auggaguaauuuucuuaaaacaucaugauggccgaaauaauggugaugccauaguaaaauuugcuucau

SEQ ID NO: 4229579 - RNA, 79 nt, Human
uucugaucuuaacacucaugcucagcuggugcucuaauacucaagagcaggagaaagaguaugggcucugugguuagaa

SEQ ID NO: 4229580 - RNA, 79 nt, Human
cucggccagggugagcuucuucugccuugucccuggcuuaguagccagggcagaguuaagaugcuggcuuuggagugag

SEQ ID NO: 4229581 - RNA, 85 nt, Human
caguccugacaaaaaccugcaagaugaaaucagaaccagauaaggcugaucccuuuucauuugcagguccugagaucauggacug

SEQ ID NO: 4229582 - RNA, 102 nt, Human
cagguuuuucuuuucuuuuuucuuuuuuaaaauguuuuauuuauuuaacccgccauuguguguuuuuaaguauuuucuuuuuuuaaggaaaggaaaagcuug

SEQ ID NO: 4229583 - RNA, 68 nt, Human
agaguuuggcugucauuugaaaauguuuuccugcuaaauguuuucauuuagaagcuaauuuauacucu

SEQ ID NO: 4229584 - RNA, 66 nt, Human
gaagauaacauguugcagauucugccuccauagugaucagaguagcaaucugugauguguguguuc

SEQ ID NO: 4229585 - RNA, 59 nt, Human
gugacugagcuggcaaaguaugguggggaugaagucuugcaacucugaagcuaagucac

SEQ ID NO: 4229586 - RNA, 65 nt, Human
aaguuuaagguagugaugaugagcacaagugcucuucagguagucauuacuguuaccuuauucuu

SEQ ID NO: 4229587 - RNA, 63 nt, Human
ugagacugugucugucaagcuaggaugugugaugacucgaccuacugacugaccauaguuuca

SEQ ID NO: 4229588 - RNA, 100 nt, Human
cuccgcugguuccgcugggucaggcgcugacgggaccgggcugcggcaaucguuagcgggucaugucggccgcccagggcugggacaggaaccgccggag

SEQ ID NO: 4229589 - RNA, 67 nt, Human
aggaagucucucaaaacuggaagggaaagguguuuucuccacaucaauccaguuuuggagacauucu

SEQ ID NO: 4229590 - RNA, 64 nt, Human
accaccaccaaaauaucccuuuguacauguaugugcgugugcgcgugugcuuuguguguguggu

SEQ ID NO: 4229591 - RNA, 90 nt, Human
gggggccacagagcacacccguggagaagcaggagcgggcccugggccuccucagcuuggccacggaguugcugcccugccuugguuucc

SEQ ID NO: 4229592 - RNA, 62 nt, Human
guuuucuccugcuauacagugccuaccaccuugagggcacuucaguacuagaggaugaaaac

SEQ ID NO: 4229593 - RNA, 61 nt, Human
ucuccacagcuggcccccaagaggacccuuuccaaguccccagcugggggcccuguguaga

SEQ ID NO: 4229594 - RNA, 112 nt, Human
aaaagggaaauugaaggaugcaaccggauugauccuucuuugagcaccauuugucacaagaagaaauuaaacuguaaugcacauaagauuccaguaacaagcuuucccuuuu

SEQ ID NO: 4229595 - RNA, 59 nt, Human
guagccacugaaguaaggccacuuacacaaaagaacagugguuuuaucuugguggcugc

SEQ ID NO: 4229596 - RNA, 77 nt, Human
uguaccacaucuggaguagaagggcuccuggaaccugauucggucagcacagcugcuuuuacuucuggcauggugca

SEQ ID NO: 4229597 - RNA, 83 nt, Human
augccuucugcaaaaggaacaauaugguauuuuuaagaguugaagaaaccauauuaguuccugguuuaugacuguuaugguau

SEQ ID NO: 4229598 - RNA, 76 nt, Human
guggccccauuuuucuggagccuggaguaguugugggggagcagggagcaggaaggcugcagaagaauagggucau

SEQ ID NO: 4229599 - RNA, 68 nt, Human
caggcccagaaguucaccugcauuuacuaaacguggugcuucuaguuacgucagggaaacuuugccug

SEQ ID NO: 4229600 - RNA, 73 nt, Human
ucaguauccuuguucugauuuuucugggaacuagauguuacugggagaugacucagagcaggccaagcccuga

SEQ ID NO: 4229601 - RNA, 82 nt, Human
gcgcgggcuggaggccggcggguggagcaugcgcgggagggcucgcgcgugccacgcgccgcgggucuggccaguuccgcgu

SEQ ID NO: 4229602 - RNA, 58 nt, Human
cgcagucaaauuugaaaacuuugaggaugcagcacuggaagaaaaugguuuggcugug

SEQ ID NO: 4229603 - RNA, 57 nt, Human
caccugguaaccugccugacuaauggauuaauuguccuuugguuuguugcuuaggug

SEQ ID NO: 4229604 - RNA, 58 nt, Human
ggguuuguggagcuggaaacacugaaugaaugucagugcagcuggaucucagagagcc

SEQ ID NO: 4229605 - RNA, 118 nt, Human
uacgggccucugcgcaucaaggaagagcagguuucaccgucucaguacggagggagcgagcugccuucugccaaggacggugcaguacagaacucuuucucagagcagagugcuggug

SEQ ID NO: 4229606 - RNA, 93 nt, Human
gcucagugguuaaguucuguccacacccccuccuugcagucuccauucaagcuauucugagacggcagggcuguugaccaaggaccacaaagc

SEQ ID NO: 4229607 - RNA, 68 nt, Human
gguggcacaggcagaaggugccgcagaugcugaggagagugucacaguggacuuuggucugugccauc

SEQ ID NO: 4229608 - RNA, 64 nt, Human
gucagagcuuugcugaaaaaccacuugaguuugaagaaagucauuguguucaguaaaaucuagc

SEQ ID NO: 4229609 - RNA, 62 nt, Human
uuccaggacuggguguuugaaggaggagaaaauaacuuacccuucugcucuagagucuagaa

SEQ ID NO: 4229610 - RNA, 55 nt, Human
cuuuuuaaaguaaauggcuagauuuaguugucuuagccagguuuccuuugaagag

SEQ ID NO: 4229611 - RNA, 55 nt, Human
uagggggagugugcugaagccauucucggaugcuucccagaccaggcucccucug

SEQ ID NO: 4229612 - RNA, 63 nt, Human
cccaaauugcauuuuaaagguagaugccucucaugagacauuugcaucagugagcgauguggg

SEQ ID NO: 4229613 - RNA, 75 nt, Human
uaucacauaaaugaggaauauuguuuucagaggcagcaaauaaacuaguuuugaauuuuucagaaggaugugaua

SEQ ID NO: 4229614 - RNA, 62 nt, Human
guugggucagcuuucagguaguaggauaccaguacuuucuacagccaugucgcugauuuaac

SEQ ID NO: 4229615 - RNA, 130 nt, Human
ucuccgucagacgucaguagagucggcagaaacagcgagugcugcaugagcaucacguagaccaccgggagcuggaugagcuucgugcgcacggagcuuucugggcuguacaggagcuguacggcgguga

SEQ ID NO: 4229616 - RNA, 57 nt, Human
ugcccugucccuagguuuguggaauucagucuccacaaaccuagagaggagaggaca

SEQ ID NO: 4229617 - RNA, 73 nt, Human
gcugcagggagcuggaaggcucccagcaacacagccugcccccucugggcagccaaccagcagccuguucagc

SEQ ID NO: 4229618 - RNA, 62 nt, Human
gcuccugaacuugugauccgcccaccuuggcuucccaaagugcugggauuacaggugugagc

SEQ ID NO: 4229619 - RNA, 71 nt, Human
ggauuguguuuaaucuguuccacuaaacugcauuaacagcagucucuuauagugggauuuugaacaaaacc

SEQ ID NO: 4229620 - RNA, 74 nt, Human
uguguaccuucucucucuucuuuguaggggcccuuuuaggcuugggcucuggcuuuggaggagcagguuuagca

SEQ ID NO: 4229621 - RNA, 74 nt, Human
gaagaaacaauggcagauaauuuuccagauuugagaaaggcauugauuuggaaacaugcugaccaugguuaauc

SEQ ID NO: 4229622 - RNA, 57 nt, Human
ggauuuagaguucuaaggacggguuguccagcgcagcccagcagagaaccuaggucc

SEQ ID NO: 4229623 - RNA, 76 nt, Human
uugugauuaauaacuuuucucuuucagauaugccaugaauuaaaucagaaucccacagagaacaguuuggucacag

SEQ ID NO: 4229624 - RNA, 73 nt, Human
ugccccgguggcuuauguccagcagauauuugugaaguccucaguguuucccuggcacaagaaccuccuggca

SEQ ID NO: 4229625 - RNA, 91 nt, Human
uauuugccauagacaugagaaugggaauuauggugggacuguucccagauaguauccauccugcuguuucuaggacauguuuaugcauaua

SEQ ID NO: 4229626 - RNA, 61 nt, Human
gugguggggaguuggauggaagacaaaaaaauuacauaguuugucauucuuccaccauuac

SEQ ID NO: 4229627 - RNA, 69 nt, Human
aucaugaauucaacccacuauauaucaaacagauuuguuaucaguccaggguuuugugacauucaugau

SEQ ID NO: 4229628 - RNA, 57 nt, Human
cgcauugcaauucaggggauaauuacugcuauaaaguauaucccccauagcagugcg

SEQ ID NO: 4229629 - RNA, 71 nt, Human
auauuaaaagagaaaaagccacccuaccucaaaaaagaauggaauuuugggggguuuuguucuuauaaugu

SEQ ID NO: 4229630 - RNA, 129 nt, Human
ggcuuggaccacgagaggcaccugagucaggcagucacauacuucccacuggggucuaccaugugagacauggugugggauccugggaaggagaccaagccucauuucaguuugcuuauggccaaagac

SEQ ID NO: 4229631 - RNA, 118 nt, Human
gucucuucgcugagaugcagguuuuaaaugagacuuggggggcugagggcaggccucaggccucccagcgccccaaccccuccuuggucuaaugaaaugcaguucuuagugcagagau

SEQ ID NO: 4229632 - RNA, 110 nt, Human
cugccgcugcagggcgcacggcuucccggcggucggcgacuucugcucuggcaacuuacgccaggguugugugcuggccgcugggagcccaggugacgccaugggggcag

SEQ ID NO: 4229633 - RNA, 69 nt, Human
uaaguguuugcagacuauguaaacuucugaauaauaacuuucaguaaggcaggagucuuaaaccucuua

SEQ ID NO: 4229634 - RNA, 55 nt, Human
agucagcuuggaacuuuuuuccuggguaguauuugggagagggaaaggcuguacu

SEQ ID NO: 4229635 - RNA, 60 nt, Human
auguaacauaugugaucgcauuuuuguaaaagaaccauguguguuuauauguguuuauau

SEQ ID NO: 4229636 - RNA, 72 nt, Human
uguuuuuuagagugauacuuuucacauuacaaaaauaaaccaaaaugaagaaaaggucacuguaaaaugacg

SEQ ID NO: 4229637 - RNA, 62 nt, Human
ggguuggaggucucuguggugguggaggagcuaucaucaucagccaaagaguccuucagcuc

SEQ ID NO: 4229638 - RNA, 79 nt, Human
uguuugcuuguuuguuuucuuccauucagugccuuucaaacuguuuuuuacuggaugaagaaacucaaccaagaaaaua

SEQ ID NO: 4229639 - RNA, 57 nt, Human
ccucacaaagaaugucuagacaaacagcagcuuagucuccugacaccucuugugggg

SEQ ID NO: 4229640 - RNA, 65 nt, Human
uaccaugggucaguuggguuuguucccaaaccuauuuauacaacugcaccacuauuauuauggua

SEQ ID NO: 4229641 - RNA, 79 nt, Human
ccaauggcucaucccaugaguuugguguagucuggagcacccaggcugaagcacacucaugcagaagggugugcccugg

SEQ ID NO: 4229642 - RNA, 75 nt, Human
acccuucugugaccugccugucaucccagcccgcucuccuugggcugacccugggcugcagggaacaggaugggu

SEQ ID NO: 4229643 - RNA, 126 nt, Human
cguugcucuccuuggagccaggagauuuagauucuaauaagcguuuugucgccaguagccauggcccuuugggcagacuaacuuuugucagccucaaguuuucuguuuuguuaaggggaggcgaug

SEQ ID NO: 4229644 - RNA, 59 nt, Human
uucccugggacuggccugcaccucuugucgcuugcuggugcugugcccucugcugggaa

SEQ ID NO: 4229645 - RNA, 87 nt, Human
agugauuauuuuugugucacaucuaggaaaaccggcagcauguuucuaucuauagccagcuucuucgacuguauaaaaguauucucu

SEQ ID NO: 4229646 - RNA, 60 nt, Human
aggugcggagggagcagucggcugugggcgcucggaccacaggcugcccgcuccccaccu

SEQ ID NO: 4229647 - RNA, 77 nt, Human
ggcuggggucugcccugaaggccuccaggacucugacuuucagcaguugguccagccucggcugguggacuccuucu

SEQ ID NO: 4229648 - RNA, 69 nt, Human
cccaccagcugcugcaccgugcaugggucugagguggccccaugugaccugugucaguugcuuuuuggg

SEQ ID NO: 4229649 - RNA, 83 nt, Human
uccagcaucuccaguuagcaguacugauuuuuuuuccccccaacaaaggaacacuacaucaacacuguuggcggggaccugga

SEQ ID NO: 4229650 - RNA, 56 nt, Human
gguugagaaucucuagcuuaggagucucuuuugaguccuaaaggaaauacucaauu

SEQ ID NO: 4229651 - RNA, 126 nt, Human
accagaaucaccacuaaaaacuauuaaaacuacagauucugagaucucuucuaggccuaucauacaccaucuauaggcgaugaggucuuagaaucuaauuuuguaaagcuucugggugauuuuggu

SEQ ID NO: 4229652 - RNA, 60 nt, Human
cucuggagggaggcugagcuggagaugggagggagucuuugcugccagcgcccugcaggg

SEQ ID NO: 4229653 - RNA, 58 nt, Human
ggcagaggcaaagucuggaugaccuguuccaugaggucaccuccccuugccuucuccc

SEQ ID NO: 4229654 - RNA, 95 nt, Human
guuaguguugcugugcauaugucuugaggucucaucugaaguaaguuuguguaugaucgaagauuucaauggauauugcaagguaacuaauuaac

SEQ ID NO: 4229655 - RNA, 75 nt, Human
gcugggggaagugggugauacugccgugggaggagccaccuggcccucuggggaagugcacucgcugucugcagc

SEQ ID NO: 4229656 - RNA, 77 nt, Human
auuuagggcaggccgauuuguuagaagucacugaugcuccaguaggcuuuuguuauaaucaggccuguuuccugagu

SEQ ID NO: 4229657 - RNA, 57 nt, Human
uggggcuauggcccgaccacgugugcucagggcaaaugugcucaggucuauaucuca

SEQ ID NO: 4229658 - RNA, 71 nt, Human
cuuuaagcccucagagccucuuugacuuugaauuguagaaaagagagcucagagaaaacuggggcuugggg

SEQ ID NO: 4229659 - RNA, 83 nt, Human
gaugugacuuugacuugaggauugucuccugugaugugcuccuaguggggcuacaggggucaguccuuugcuuugagcaccuc

SEQ ID NO: 4229660 - RNA, 56 nt, Human
ggaaguggauucagggcugcuaggauaucacaugguggcaguuauggcccacuucc

SEQ ID NO: 4229661 - RNA, 75 nt, Human
uucuaggcagaaauuggcagagaagaccuagcguucaaggguucuagacuucucuuggcuauauuauuguuugaa

SEQ ID NO: 4229662 - RNA, 71 nt, Human
augaaaagcauuauuagucugggugguucuuuuucagaugcaaaaaucacucaaacugaaauccuuuuuau

SEQ ID NO: 4229663 - RNA, 57 nt, Human
uuacgaccuuugucaugcuugggauuuguggaaauuucacagugguaaggguuguga

SEQ ID NO: 4229664 - RNA, 57 nt, Human
ggacaaagugagaugggagucagaggagcaauguccucagcaaacacuucacucucc

SEQ ID NO: 4229665 - RNA, 55 nt, Human
gggcggccugcucuguggggaggggccugccgccucccugcagccccaggccccc

SEQ ID NO: 4229666 - RNA, 118 nt, Human
uguguuauuccuuggguguucugauuucauaugacagcuuuuucuaggauucaaaccauaaacauuuccucuagagacuguaaugagagguacaauuaucaacccaggggacuguaca

SEQ ID NO: 4229667 - RNA, 68 nt, Human
ucuuuuguguggcuuaauauuuauagcagauuccaagucuccuuugaaaguuaggacuguccaagaga

SEQ ID NO: 4229668 - RNA, 128 nt, Human
gcccaagggugucucugaucagggagcaauuucagggaagccugggugauccuaaagucaccucccaguucaaagauguauuuaggauaacuccaguuuucccuagaaacucuucaguacucuuuugc

SEQ ID NO: 4229669 - RNA, 57 nt, Human
ugaggucaggcagggguuuggccacaguguuagccauuggcccugcauugauccuca

SEQ ID NO: 4229670 - RNA, 103 nt, Human
acaauaaaacacgaaguucagauggucauucacuagggugugugauauuuuggaguauagaccuuaagugauuaugacauaucaaaauaauguggucuuaugu

SEQ ID NO: 4229671 - RNA, 81 nt, Human
gugacccauguuaucuguuuuaaugaauaauuuuccuaauagaaaauuauuauguggaagacgacgacgguagcggguggc

SEQ ID NO: 4229672 - RNA, 112 nt, Human
agugcugaugaugcaacaaguaauuaacuuucugugacgcaaagcugggaaggcagcuguggcuauuuuccaguuguucuagaaagcuagcgccuaggccuuugucagcgcu

SEQ ID NO: 4229673 - RNA, 72 nt, Human
gcucagcgccagggcuggguuugucgguguucccaaaacugggucauauuugcccccaugcccuggccuugc

SEQ ID NO: 4229674 - RNA, 87 nt, Human
agaagcucggcagugacuugcucaaaucagauuuuagacacgauuuaaagcauguuucaguaagguuaauauaguguccgaguuucu

SEQ ID NO: 4229675 - RNA, 76 nt, Human
uugugaaaagcguucuguuccaugcuaacacacuguugcacaucguguuaacugccaggacagaucgaucucacaa

SEQ ID NO: 4229676 - RNA, 58 nt, Human
gcaggaaugguacauaccuguuuuucuuggagcuguuaacagguuuccuaccacuugc

SEQ ID NO: 4229677 - RNA, 82 nt, Human
uucuuuuauuguguaccuuucuaucuagaagguagcacauuauuacaguguuuccugcuggucaaaguugccuauuagagaa

SEQ ID NO: 4229678 - RNA, 63 nt, Human
ggaggcgugcccuggccccgaggcugcugcaccgccucagccucacugucagugccgucgucc

SEQ ID NO: 4229679 - RNA, 71 nt, Human
aauaacaguuuauuugagggcuacuuucuuagcccucucaaucuuuaaaauacaaaaaaauagacuuuauu

SEQ ID NO: 4229680 - RNA, 81 nt, Human
ucaccguugucccaaaacuugaagcaagccucguauccaaggggccaggcauguugcuucgggcuuugugcaaacaggugg

SEQ ID NO: 4229681 - RNA, 90 nt, Human
cugcuguuuuggucacaaagcuucaucuguuguuuuguuucuguucggggcugauuugaaugaacugaugaacuuaacuaaacacagcag

SEQ ID NO: 4229682 - RNA, 65 nt, Human
gcaaaugacuuagucacuccaggcuuguuucuuuaccucaaaaaugagaggguuaggauauuugc

SEQ ID NO: 4229683 - RNA, 81 nt, Human
auggugagcuuaugauguuuacauaaaaguucuauaagcuguguauacaguuuuuuauguaaaauauuaaaagacuaugau

SEQ ID NO: 4229684 - RNA, 62 nt, Human
gaaagagaugucguuugucuucguauagacggaaauagggggaaaucaaaagauauuucuuc

SEQ ID NO: 4229685 - RNA, 60 nt, Human
guuggggccuggagucucuugggaaccccuuucuauuucuacuagacucuagccacuagc

SEQ ID NO: 4229686 - RNA, 121 nt, Human
uccagaucuuucuugcagucccgguggaggaggggcggggaggggagcagguucuggaagauucaugggcuccuuccuccgcccuuccucgagagcugagauuguucuggaagcuucugga

SEQ ID NO: 4229687 - RNA, 79 nt, Human
ggcgaccccaccgcuggcacuggggacggggucaccgggagccggacuccagucccuccuugcccagccagaggguccc

SEQ ID NO: 4229688 - RNA, 60 nt, Human
gccgaggccgcuucauggcuggcaguucuucagcuucaggacuauccaguggucucuugc

SEQ ID NO: 4229689 - RNA, 56 nt, Human
gcccgaccgcgccggcccgcaccucccggcccggagcugcgggcugcggucagggc

SEQ ID NO: 4229690 - RNA, 95 nt, Human
uagcggcaugggaggugcugggaggcccaggauggaaucggggagccgggacccagauccgauccucuuguguguuccgguaccggaugcuggug

SEQ ID NO: 4229691 - RNA, 86 nt, Human
gagucuugcucuguugcccaggcuggagugcagaggcacgaucucggcucacugcaaccuccaccucccggguucaagcgauucuc

SEQ ID NO: 4229692 - RNA, 57 nt, Human
agggaaauaggagaagaaaggaaaaguuaaauuugauuuuucuccagaguuuccacu

SEQ ID NO: 4229693 - RNA, 74 nt, Human
ggcuguaacacacagaaggaagccccacuuaaucaaaaguaacugggccaacuccuccugcccaaccccaugcc

SEQ ID NO: 4229694 - RNA, 63 nt, Human
gagaggcagggaguagcugaauucugguguucagguuuuuaaguucugccuccccagucucuc

SEQ ID NO: 4229695 - RNA, 78 nt, Human
ccgucgccauuuuucuguuuuuauucuaucucugccaugugauagauggcggggggguuggaaaagggagagagacgg

SEQ ID NO: 4229696 - RNA, 70 nt, Human
ggagccaaugggagggugaggaggcagcuguuggaaagcccuugaguagucacuucacccaucccacucc

SEQ ID NO: 4229697 - RNA, 77 nt, Human
ggggaaugggcaguguggacuagaguaggaguugcauuguugcuauuuuguuuucaguccauuuggccuaagacccc

SEQ ID NO: 4229698 - RNA, 76 nt, Human
uucucugucuuccauuccccuccuacgcccccagacugugagggguguaaggaagauggaagauguugcgggaggg

SEQ ID NO: 4229699 - RNA, 58 nt, Human
cagaaagaaguccuugaggcgcacccuguccgagcguggccugcugaaggacuuccug

SEQ ID NO: 4229700 - RNA, 69 nt, Human
ggagggcuggacguacuagggcucagagagcagcaugucccugccuccuuguguaucuccagccacucc

SEQ ID NO: 4229701 - RNA, 58 nt, Human
caggaguggugagguuagcagaggcaccugcacccaagccuucugaccuuuacuccug

SEQ ID NO: 4229702 - RNA, 78 nt, Human
gcugggcuaccaugacuucugaugugugcucuuaguucaaaugcaggaacuaaggccacaagaggcaaaguagccugc

SEQ ID NO: 4229703 - RNA, 58 nt, Human
ucucuucugugggugcuaugucaguucguggagaaucaugauaugcgguacagagagg

SEQ ID NO: 4229704 - RNA, 98 nt, Human
guauuggaauuauuuuacaugcaacauugguauuaguguggcugaucaaagaauugauuguacuuaaauaugcaaauaguauuaggauaauacaauac

SEQ ID NO: 4229705 - RNA, 98 nt, Human
ugccagggcuguuggcaaggaggguaaccacauuucauccuggggccucagguuagagaacuguguauucuuuuucaauuaaaccgacauuccuagca

SEQ ID NO: 4229706 - RNA, 69 nt, Human
agaaggaggugauucaccuuuuggauuguaaauauaugaaaaugucuacaaggucuuuaucugcuuucu

SEQ ID NO: 4229707 - RNA, 61 nt, Human
acaggauuuucagggaaggugauacauuuugcuuuguacuucauuccugaggaauucaugu

SEQ ID NO: 4229708 - RNA, 86 nt, Human
gggaggucugcuaugugucugacagugugcaagaaaugggggauaugucccuaggauuccuccacuuagcgccacugggcccuccc

SEQ ID NO: 4229709 - RNA, 60 nt, Human
cacuuuuucagacuaauagggcauaauuuacuuuauuguuuucuauuaccugagauugug

SEQ ID NO: 4229710 - RNA, 87 nt, Human
uucacucuagugcuuuauggcuuuuuauuccuaugugauaguaauaaagucucauguagggauggaagccaugaaauacauugugaa

SEQ ID NO: 4229711 - RNA, 63 nt, Human
ucuuuuaucuguuguguaacaaucaugcuacugaauguuagauauuacaugacauaugaagga

SEQ ID NO: 4229712 - RNA, 76 nt, Human
aauauucauauagcgcuuacagccugcuaggcagcaauuaggguacugccuagguuguaagcuuuauauaaauguu

SEQ ID NO: 4229713 - RNA, 84 nt, Human
gugagaaguucaugggagaaggagcagaaaaucuccuccauauauccuaaaaagggaggauucuccuguuucccacccuuccac

SEQ ID NO: 4229714 - RNA, 57 nt, Human
agggaccgugagcuccuuggggucacugcucugucuccacagcagagcacgguaccu

SEQ ID NO: 4229715 - RNA, 75 nt, Human
agguaaaaccuuucucccugcacacuggaaaggccagaacuucugcccccaguccugucaggggaggggaggccu

SEQ ID NO: 4229716 - RNA, 90 nt, Human
uuauauugcaaucagauggcauucacaaacuuaacuggagcauauacaaauauauuagucuaaguuuuguaugcuaacagaaagauauaa

SEQ ID NO: 4229717 - RNA, 129 nt, Human
cagucaggucaccaaccaucuuccuguccauagacuuccuguccuagacuucacagaguagaugaaugcuaugaaguccgggcagcaggaauucuugaagaggguguugaauagggaccagacgacaug

SEQ ID NO: 4229718 - RNA, 77 nt, Human
cuucugccaaacacacaacauauuuuggaaaguuacccuaccccauuccaacaugugcuuguguugagagguaccag

SEQ ID NO: 4229719 - RNA, 70 nt, Human
gauagcaaaucgacuguagagacuuggcggcgguggcauugccccaggucgucagcagugugguauuauc

SEQ ID NO: 4229720 - RNA, 58 nt, Human
caagccacugggagcugcacacccugcagucgcucuuagcagcugacccuagugcuug

SEQ ID NO: 4229721 - RNA, 93 nt, Human
ccaugggcccuucucacacugcguucucugcgcuccggcccaguuccgggaggaccucccgacggcgcgggagaaggcuguaagggcucuugg

SEQ ID NO: 4229722 - RNA, 86 nt, Human
ccccugcuuuuggucguucugcuauucuaugagguagucauuaugaucccccucaucagaaagcagaaagcaugagauucagaggg

SEQ ID NO: 4229723 - RNA, 58 nt, Human
uuugcuuugacuuugggaguaucuggaucauuaaguaauuuccggaggucagaguaaa

SEQ ID NO: 4229724 - RNA, 76 nt, Human
uuuguaaauaugaaggauacaccucugauuuucauuuuauuggguugagaacagggcaguuccuuauaguggcagg

SEQ ID NO: 4229725 - RNA, 61 nt, Human
uggcuggucaaacggaaccaaguccgucuuccugagagguuugguccccuucaaccagcua

SEQ ID NO: 4229726 - RNA, 68 nt, Human
gauuuugucaugauccuucuguuaggugcaucucuuauuccagcccuaacagauugggugacaauauc

SEQ ID NO: 4229727 - RNA, 79 nt, Human
ggggauuuggugcaggauuuauuuaacuaucucaggaacccaguuuugaauuagucauaauucuugcugccuucucucc

SEQ ID NO: 4229728 - RNA, 88 nt, Human
cugaaaccaagcaauggaguccucuuccucuuuguuauuuaauuuuuuuagaaagaauuucaagauucccacaguugccugguuucag

SEQ ID NO: 4229729 - RNA, 64 nt, Human
cuugcccauuugaccauguggcccaggccaaagcccaguguuggccuuacgcauggucggcagg

SEQ ID NO: 4229730 - RNA, 61 nt, Human
cuuauuagaaagaaaagacaugguggguuuuuuccccuuuauucuuugcuuuucuaagagg

SEQ ID NO: 4229731 - RNA, 83 nt, Human
auauguacuucauaagcauaucaaguuuuaugugccaugcauauuucaugguaucugaaaaagaauucugacaaagugugugu

SEQ ID NO: 4229732 - RNA, 61 nt, Human
cuugaggagcuucagaggaaucuuagcaaagccaaguucaguuccccaaagccuccuagag

SEQ ID NO: 4229733 - RNA, 55 nt, Human
ggccaaugugcuccacgccagagcccaugugcucuauggucuggcccacaugguc

SEQ ID NO: 4229734 - RNA, 56 nt, Human
accccuauaugccugcagugauuauuucuucuggcauaaucacaagcaauaggggu

SEQ ID NO: 4229735 - RNA, 62 nt, Human
ggggcuuggguagagcagaaacauggagaaagguacauuuccucugcuugucuucagguucc

SEQ ID NO: 4229736 - RNA, 72 nt, Human
acagauguuaauaaccuuagggcacaagcggaacaaacucagcucucugcauaagguuaaauuagcagaugu

SEQ ID NO: 4229737 - RNA, 68 nt, Human
uuuagcgcucucuccauucuuaacaggaguucaguauuuuuucguuaauguggaagaguuuggcuaag

SEQ ID NO: 4229738 - RNA, 55 nt, Human
ucuucuuauuuuaugaucgcuuauguaauuugagggcgacauggguaaugggaga

SEQ ID NO: 4229739 - RNA, 109 nt, Human
gaucuucucugccacccaccaccgccauguccagcgucuucggggugucuuccacuggcacaaacacccuccugaagggggcgagggguggcggcugggcaggcagguc

SEQ ID NO: 4229740 - RNA, 65 nt, Human
ccagcaucagcucuuggcuggcgaagccagucuuuaucuccugucagccuugguuuugguguugg

SEQ ID NO: 4229741 - RNA, 64 nt, Human
cucccugugucaucagcuguggcuacaaggacaggcuugugcagcagaauauggcugcagggag

SEQ ID NO: 4229742 - RNA, 61 nt, Human
gugaagcacaugggcguuggguuugcucaucacaagcugccugcugcugaugcuguuucac

SEQ ID NO: 4229743 - RNA, 91 nt, Human
ccacgcauuuagacaaaaaaagcacaggacacagacacuaaauauaugagaucccguguguguguguguguguuugugugugugugugugg

SEQ ID NO: 4229744 - RNA, 57 nt, Human
gagcaugacgcaacaccaagugcugggccaccuucacuaggugggugucacugacuc

SEQ ID NO: 4229745 - RNA, 94 nt, Human
uccuuucucuagcuaguguuugaugugcacgugugugugcacagugcgugugugcacacgcacaccugugcacucguguguguuuaagaaagga

SEQ ID NO: 4229746 - RNA, 75 nt, Human
uccccggaucucagacucuccggguuccgaagcccccgccgaagacccuuuggaacuagugucugagaugggcga

SEQ ID NO: 4229747 - RNA, 80 nt, Human
cagacugcuugguuuggagggcccaccuacuugccccaucugcuagcauaguuuguguucccauccacaccaagccucug

SEQ ID NO: 4229748 - RNA, 77 nt, Human
gggagggauaugugggugaggaggccauuguauucuagagauaguaauaagccugccuuaucuccagaucauagccc

SEQ ID NO: 4229749 - RNA, 64 nt, Human
gcaggcagguccugaguccugaggccacgugccgcacucugcuugaggaacucagacuugaggc

SEQ ID NO: 4229750 - RNA, 75 nt, Human
gguauuuggaauauagauuuuuaaaaguaguuuugaagacuuuuuuaaaacagcauuuaaaagguuuuuggugcc

SEQ ID NO: 4229751 - RNA, 65 nt, Human
gugguaugaaggaggccggcagccagguuugcacuuucacuuguugccuuugcaucuucauccau

SEQ ID NO: 4229752 - RNA, 79 nt, Human
ugccuaaugccucuccugcugggagcccuuuuuagaauuuaagucuuaaaggauggaagcccagaaggaagcagaagca

SEQ ID NO: 4229753 - RNA, 56 nt, Human
gcacaguuuuaucuuauacugaugcagacagcaugguugccugagauaagacuggc

SEQ ID NO: 4229754 - RNA, 125 nt, Human
guauacaaauuuagaauuaaaauguuuucuauuuuuuucaugauuaacuuagugaauaacuuaaauccuuaauccucguagugguuagaaagaugaggagacuuuuuugacuuacauuuguaaau

SEQ ID NO: 4229755 - RNA, 89 nt, Human
cugcugagggcggguggaggagggacgggcaggcugugggaagcgugauggugagaugucccguguucucucucccccgcccccugcag

SEQ ID NO: 4229756 - RNA, 89 nt, Human
aauaauuuauaacacuauaaugugauuucgcccuguggguggauaggcuuuuuacuaggguaauaacaguauggugauuccaaauuauu

SEQ ID NO: 4229757 - RNA, 68 nt, Human
gcagauuucacucuuaauugcuuccugauaaucuugauuagcgaaaagaauggaguggagucauaugc

SEQ ID NO: 4229758 - RNA, 66 nt, Human
gagggugacauuggagagacagguguucucucuggaauucacuuguuaaaugccaauggcaccuuc

SEQ ID NO: 4229759 - RNA, 68 nt, Human
uguguuuuuaguuuaaguuuuugcagugccuuaguugcauaagugcaagagcccaaacuauauacaca

SEQ ID NO: 4229760 - RNA, 72 nt, Human
gggcucaggugauccuaccaccuuggcuuccccaaaugcugaaauuacagcguaagucacagcgccuggccc

SEQ ID NO: 4229761 - RNA, 95 nt, Human
gcggcugguugccaccgaccuguuguucacuuugcuggugagccaggugaccaucaccauguacaugaagggcggguaaccugggggccagcugc

SEQ ID NO: 4229762 - RNA, 87 nt, Human
cgcuuaucagcagaucucaggagaguguucaguggaggcccugccggucugcacagcucaccucccugggaacugcucgccugagcg

SEQ ID NO: 4229763 - RNA, 57 nt, Human
gcugcccucccagggcaagcuugcugcuucccaggagguaugucccccgagugcagc

SEQ ID NO: 4229764 - RNA, 88 nt, Human
ggacccaguagggaugcagcagagaccuggaguccugcuuagggauccugugggguauugcugcaucacccuccagaucugcuggucc

SEQ ID NO: 4229765 - RNA, 66 nt, Human
uucuuaaugcauccuguguucagcaaguuuuuuuuaauauauacuguaccauggguguguuaagaa

SEQ ID NO: 4229766 - RNA, 70 nt, Human
uaugaagucauugcugugggcauuugcugccugaccagagcacaaguccuccgacagcacguucuuggug

SEQ ID NO: 4229767 - RNA, 105 nt, Human
cuuuuauacuugaaaaugacaggcuuaaaugcucauaucagucacaaauccaggauguacugucuuguuguaugugagcuuuguagagauuuuuaaaaauauaag

SEQ ID NO: 4229768 - RNA, 130 nt, Human
uaaaugagucaaagugauaagcaugucuuugcucucaacccaucauuagucuuucaggauagguucuccuuauucaugcaagagugugagguccaugagggcagcuaugucugcacugacuauaacagug

SEQ ID NO: 4229769 - RNA, 71 nt, Human
gguggggguaggggguuuucuggaugauuuucccaucgugaucaaacaccagucgagucccaaccuucgcc

SEQ ID NO: 4229770 - RNA, 64 nt, Human
uagaaaguaucuucaaggacgccaagaucccaguguugggauccuuccuggugaagacuggcua

SEQ ID NO: 4229771 - RNA, 90 nt, Human
uggagaguccagggagacgacuuaaccacggucacaugguuacuagcagccguagagcugggaccuggcccugggucuccugacucccca

SEQ ID NO: 4229772 - RNA, 63 nt, Human
gagaacaaaagauagcccaaacauacaucucuaaugauaggugugccuuuaucuucuguacuc

SEQ ID NO: 4229773 - RNA, 80 nt, Human
aauauugacuugcguaguaaaucccucucuuuguagauaguguaucugcugccuaggguuugucugauuuaguaaauauu

SEQ ID NO: 4229774 - RNA, 57 nt, Human
caaucuaauguggcaaguugcugaacuggcucgggucucaguuucccuauuagguug

SEQ ID NO: 4229775 - RNA, 59 nt, Human
ugucaucaguaaaguacuuuuauguuaugaggauauaaugugugcuuuauugaauuaca

SEQ ID NO: 4229776 - RNA, 68 nt, Human
gggcagguggggcuacugagcuggaacuggguuugucugcuccagagaaucauagacuccaucaaccc

SEQ ID NO: 4229777 - RNA, 93 nt, Human
caauaggcagcccuugcugggagagcuuuagagaugguuuucagcaucucugcguucaucccaucacagggugacugguuuauuugccuuuug

SEQ ID NO: 4229778 - RNA, 94 nt, Human
uggauggccaagaagaauuuguaucuacggugugcuuuauguguuuuugacacugcuguauucugugugaucaagugauuugcagcugguucca

SEQ ID NO: 4229779 - RNA, 91 nt, Human
gcugcugaugcuggcggugaucccgauggugugagcuggaaauggggugcuacgucaucguugucaucgucaucaucaucauccgagcagc

SEQ ID NO: 4229780 - RNA, 83 nt, Human
caggcucuuagguuuaaauuucuuucagcugcuuuaaggagacccagaaguugcuugagagagagcuauuuuuagcagcucug

SEQ ID NO: 4229781 - RNA, 83 nt, Human
gugcaauugguaaguuacaugucugccuccucugcucagcugugagcuuuugagaacagauaugaugacuucaucaucugugu

SEQ ID NO: 4229782 - RNA, 60 nt, Human
gacagcuauggaguucacuucuuugaaaggcagacaauuagaaguuauuccauggguguu

SEQ ID NO: 4229783 - RNA, 108 nt, Human
ucauuuuccuuuuaacauuucugcacauuucucacaauguacaagucuauguuugacucagugugcaucuggaggcaauguuucacagcaguugagcagaagcuauga

SEQ ID NO: 4229784 - RNA, 77 nt, Human
cgaccgggagcggcaguccuuccaguacaggcucgcaucgcucuaccugcacuaccuggggcugcugcgccgcuucg

SEQ ID NO: 4229785 - RNA, 83 nt, Human
gaacauaaauuccuagugcuuaaaacagaauuuucucauauuuuugagcaggacuucuguuuaaccagugggguuuauggcuc

SEQ ID NO: 4229786 - RNA, 61 nt, Human
auagucucagaauauuugcugauuugcacacuugugaggcauuggcagaucucuggauugu

SEQ ID NO: 4229787 - RNA, 66 nt, Human
auuacacagauguuugaaugcuuaccacaggucaaucccuguguuaggugcauuaaacgugguaau

SEQ ID NO: 4229788 - RNA, 59 nt, Human
ggucucugggacguuggaucgcuacgcaaggauuggggggauucaagugcuuagagauc

SEQ ID NO: 4229789 - RNA, 56 nt, Human
ugcaucuaaguggcuaacaacccaugagugccuggguugccuuugcaguuggauca

SEQ ID NO: 4229790 - RNA, 90 nt, Human
ugagagguacaagggcugggagacagagauggugaugaggaaaaaugaaaaucaugauucuaccaaugccaucuuguucuuguccucuca

SEQ ID NO: 4229791 - RNA, 56 nt, Human
uagccucauuauuuacucaugauuucuugccaaaugucauggcgguaaagaggcug

SEQ ID NO: 4229792 - RNA, 55 nt, Human
gacuuaaaugcuccccucagggcagcaacagccuuaaggaagagcauuuuagguc

SEQ ID NO: 4229793 - RNA, 62 nt, Human
gagguuauucuucuaucaguaucucuagcaaaucaaguaguaaucugguggggaauaacuuc

SEQ ID NO: 4229794 - RNA, 59 nt, Human
uuggcaaaaauacuguaggccuuucugguccauauuuauccuuaaaguauuuuugccaa

SEQ ID NO: 4229795 - RNA, 64 nt, Human
cuggcaagguuucgaguucccaaccacagcacccucagugaugguuuucagaagaccuuguuag

SEQ ID NO: 4229796 - RNA, 110 nt, Human
ggagagaggaaaugagaggagucggcuggggcgaguguggaccgcagcccagaguuagucuuggcugcagugcaacucuuucuaaaauguuauucucacgcccuuucuuu

SEQ ID NO: 4229797 - RNA, 59 nt, Human
gccuucgauaugaggguuugccaucaggacuuccguagcguaaacccacguauucaggc

SEQ ID NO: 4229798 - RNA, 58 nt, Human
gagagucuuaaguuacagaacuacuuguuuaaguucguuuuguagucuggagacuguc

SEQ ID NO: 4229799 - RNA, 61 nt, Human
gggagcucaccaugcucugcauccagucuagguggcuccuagcggggcuugguggguucuc

SEQ ID NO: 4229800 - RNA, 69 nt, Human
ggagaggaggugagaggaaguauccugacugagugacaaagcagcuccuccuccuuucaccccuucucu

SEQ ID NO: 4229801 - RNA, 125 nt, Human
gggggcaguaagcacauucccgcaaccccaccucgguugcccauggagaccucaggcuggguagcaucugcagccuuuguccuugggcuagugacagugacuggugaggguguuuaucuuccccc

SEQ ID NO: 4229802 - RNA, 55 nt, Human
aagccuuagauuggcgaugucguauuuuccucacguguggcaaugccaaaggcuu

SEQ ID NO: 4229803 - RNA, 67 nt, Human
aagggauggcagcggagcuggaaaugauuacaaagucagagaaugaguccaucaauugccacaucuu

SEQ ID NO: 4229804 - RNA, 73 nt, Human
gaggucaugcagcucugaguucaaauccauucuccccacuuuacuggcuauguaacuuugagugcaugacuuu

SEQ ID NO: 4229805 - RNA, 63 nt, Human
gaggauugcauaugcauucugauaccauuagcauaugguauuaagaaaugccugugaaaacuc

SEQ ID NO: 4229806 - RNA, 96 nt, Human
uuuaaucguggccauuuucaaacacagaucugcacagugaacaauuuucugaggaauucuuacaaagcagagucuguucagaggaugcugauuaaa

SEQ ID NO: 4229807 - RNA, 83 nt, Human
agagcaugcgguguccuggaagaagcuacaagcggugagugauagccucucuccagcugaggccuucuucccaucacaacucu

SEQ ID NO: 4229808 - RNA, 60 nt, Human
guguuaacugagaaauacccaagucugguaguucuaccaaucugguauauuccagaauac

SEQ ID NO: 4229809 - RNA, 88 nt, Human
auugugaauggugauaggcuaaaugaaaugaagugaaagcuaauauauuguuaguuuuguuuguuuguuuguuauuaccuuucagagu

SEQ ID NO: 4229810 - RNA, 67 nt, Human
gcccaauuugaacaaagauacuucaaucauuauagagaggaaaacaguacuuuuuguucaauugugc

SEQ ID NO: 4229811 - RNA, 67 nt, Human
cagggccaaccaguuucuuggcuuuaggacuguguguuuugagcagccauuagcuggggugauccug

SEQ ID NO: 4229812 - RNA, 78 nt, Human
cagaaagggacuugugucuguguuuuuguuaacuaugcacaucgauuugacugagagacauagcacaguuuuucgcug

SEQ ID NO: 4229813 - RNA, 77 nt, Human
gggaacuguaguuuacgcugcccugguuguggcgcaaucuccaaagcauuuccuucaaguguugaacuacacuuccc

SEQ ID NO: 4229814 - RNA, 89 nt, Human
aagaccacacaugugggggauucaucucagagcguaaugaucuagugucucagauacauguaugagagauucuuuuauuguguuuucuu

SEQ ID NO: 4229815 - RNA, 59 nt, Human
ggcagaggcugccgugggcaggaagcgcaagugguccucgccgucacgcagccucuucc

SEQ ID NO: 4229816 - RNA, 55 nt, Human
cugggcuuucaggcccuaaggccagugggucccccuccucggggucugaagucag

SEQ ID NO: 4229817 - RNA, 130 nt, Human
gucugaggauuucuguacauauuuucuucuguuuuaugugaaauuugggcucugggaauaagaaaauauuccuuucaaauuuauuugacauauuaaugcugguuuugauauguacccauuccuucaaggc

SEQ ID NO: 4229818 - RNA, 58 nt, Human
gggauguauguuuguguggagauguuuuuuucugucuguaggcacauguauauauccc

SEQ ID NO: 4229819 - RNA, 64 nt, Human
ccggaggccgccugggagaagccagaaaccgcagggcuuccugccucgggcuggccgacuccgg

SEQ ID NO: 4229820 - RNA, 81 nt, Human
ggcucuccgccuucauuuucuugucucuguuguagguaauauauuugacaccaggagagaaaacacggaggacacagaacc

SEQ ID NO: 4229821 - RNA, 72 nt, Human
guccaagguuuauggagcaccacaucuacugauguacaaauuggagcaauguuggccuauauaccucuggau

SEQ ID NO: 4229822 - RNA, 78 nt, Human
uuugcuugaacccaggaaguggagguuacagugagcugaaauuacaccacuuuacuccagccugggcaacagagcaag

SEQ ID NO: 4229823 - RNA, 62 nt, Human
guccaugugcuaacagugcuuaugggagcuacugccuugucuugggcuuguuggcaaaugac

SEQ ID NO: 4229824 - RNA, 107 nt, Human
ggaugagguaauauacuacaacuuaugucuauugacuuaggauuuuaucuuuaagaggauagauccuagaugugaauagcuaaggaaguuugaguguuuucuccucc

SEQ ID NO: 4229825 - RNA, 65 nt, Human
agcggccucgcugccugcucagcuuggaagugcuggcgcacaaccccguggcggugagcgccguu

SEQ ID NO: 4229826 - RNA, 55 nt, Human
gaaaagaaggcaggagcccaaggauguaauuucuuuuuggacccaucuucuuuuu

SEQ ID NO: 4229827 - RNA, 103 nt, Human
auacuugugaauaggacugaaauuuauauuuugggcacucuuuaccucagauucagaguucuuaggauuauuuaaaauucauuugcuggauguuuucaaguau

SEQ ID NO: 4229828 - RNA, 129 nt, Human
ggccgacucccaggguccguugcggcgcggcggagcagccaauggcgagccccacagucucgcgagagugcucaggcgcucuucguggcugcccucuuagcugcuagcggagcuccucagggggcggcc

SEQ ID NO: 4229829 - RNA, 56 nt, Human
uccuaguucugaccucgcucaccaacacauggugccagcugucccugacacuagga

SEQ ID NO: 4229830 - RNA, 79 nt, Human
ggccugaaggaugaugguuuuguccucuuugguucucaccugcuugagaaguaaaacaguaacuuuguucuucugggcc

SEQ ID NO: 4229831 - RNA, 77 nt, Human
gaaacccgguuuucccagcaccuccuccugcccuacucuucaguauuaauuggggugugcugggagaagggauauuc

SEQ ID NO: 4229832 - RNA, 87 nt, Human
gcaaaauuguguauauguguguguauguauguauguauguauguauguauguauguauguauguauauguauuucuaacaccagugc

SEQ ID NO: 4229833 - RNA, 76 nt, Human
cugccgagaucagaguaggauuuggaacccaagcaccagggaaccaauguuaggcucugguuuuagauccuggcgg

SEQ ID NO: 4229834 - RNA, 58 nt, Human
uaugaucuuaggauggaacuucguugugucauugcaauuauucgucauggggaucgua

SEQ ID NO: 4229835 - RNA, 65 nt, Human
gguaguuuuugagcuguaaucuuguccagccuuauuuuagagaagaaugcuucugaagagcugcc

SEQ ID NO: 4229836 - RNA, 61 nt, Human
uauagcaaugugggugggcuccaaggacuguuccuucagaccucaaauccacaugcuuaua

SEQ ID NO: 4229837 - RNA, 126 nt, Human
auuagccuaccugaguuagauauguuuacuuucauucuuacuaaguagaguacucagaaggugugucuucuucugaggcuuucacuuggcaaagauaaaauuaguagucucuaacguauagcuagu

SEQ ID NO: 4229838 - RNA, 76 nt, Human
agacgacucuuaaggcagaauuaggacuaaagauagaaacccguuuguucugacuguugugaccaugggaguugcu

SEQ ID NO: 4229839 - RNA, 66 nt, Human
ggguuuguggaaaagagcccaggagugccugcagaucccgcccuggacuccauuuucccguagucc

SEQ ID NO: 4229840 - RNA, 60 nt, Human
ucuuuuucaugggugaugaguggguacauagauggcugcacacaguucucaggaaagaga

SEQ ID NO: 4229841 - RNA, 64 nt, Human
gcugaaagacagccaggcaaagcgagugcacucccccuugcucagccuuuuguucuauucaugc

SEQ ID NO: 4229842 - RNA, 56 nt, Human
uuaccugagcggauuuguugcaggguccagacugcaagaaccuagcgaucagguaa

SEQ ID NO: 4229843 - RNA, 80 nt, Human
gaguaguucugaauagcauugaagaagcuuaaaacaggaagaaaaccugccuuuucaaucaaguuuauuuauagcuacuc

SEQ ID NO: 4229844 - RNA, 84 nt, Human
uuuaggugggcaccuagcaggacucagcagauauugagugaaugcagaugugugugcccugggccugccagugucugacccgaa

SEQ ID NO: 4229845 - RNA, 55 nt, Human
ggauggugauguacccagucaugcuuucaacugauuugggaagccuacaccauuc

SEQ ID NO: 4229846 - RNA, 86 nt, Human
uuuauaacaugcacuacuagaugcaaaaguuuacaucaaaguuuacuuuaaauaucauuugguagggacuaaaugugugugauaga

SEQ ID NO: 4229847 - RNA, 62 nt, Human
agagcugggacuuggacucaauucugauucagaaggaaaugcugauccacucucauugcucu

SEQ ID NO: 4229848 - RNA, 59 nt, Human
ccuggugacuauucauugcccauguuugugaauuaucagaaagcagaauucuugccagg

SEQ ID NO: 4229849 - RNA, 76 nt, Human
aauuauuuuuuaauucucauguuuuaaaaaaguuugauauuaaauuauguugaaauaugagaacugagugguaguu

SEQ ID NO: 4229850 - RNA, 72 nt, Human
gccccagacccuuugacuugugacauuacugguuugcagacauaauaacuacacucagaggaccauggaggc

SEQ ID NO: 4229851 - RNA, 78 nt, Human
gagaagcacuguuuuagugauaagaacaccaauuuaagaaucagaaaauuuguguuacaguccuagaacugccuuuuu

SEQ ID NO: 4229852 - RNA, 60 nt, Human
gaugagugcacaggccacucuucaagucaccaaauuuaaauguugcuugugcugcucauu

SEQ ID NO: 4229853 - RNA, 56 nt, Human
cgccugcaggaaggugugccuguccggccccgugagcacgcccaccuccugcggcg

SEQ ID NO: 4229854 - RNA, 55 nt, Human
ggguuuugugauugccucugaagccuauguaugccauggaggcacuaacaaacuc

SEQ ID NO: 4229855 - RNA, 58 nt, Human
uuaggaauugcuucauguuuggcuguuuucucagcacugaugaaauagcauuuucuga

SEQ ID NO: 4229856 - RNA, 76 nt, Human
ucucccaguucucuuaauccuaguugguacucccacaggugcaugccauuggucuuaaggcuagcugugcaggaga

SEQ ID NO: 4229857 - RNA, 56 nt, Human
uaccuggauaaauguacaaccguguccuuccacaucuacuguguauucuccaggug

SEQ ID NO: 4229858 - RNA, 67 nt, Human
agucauuuuguggacugugagggugcaugaagaacauguucuucaaacucaguuccacauuuaagcu

SEQ ID NO: 4229859 - RNA, 82 nt, Human
guuggaacaaguagaauagguuuuuuucuaugaaugcuuuauagacauuauaaugaaaaaaacuaauuuuaaaugugaaaau

SEQ ID NO: 4229860 - RNA, 76 nt, Human
gcugcaguguucucagcacccacuucaugcuguuucuguuaagaauucccagaagggcugcuuagaauauacuagc

SEQ ID NO: 4229861 - RNA, 63 nt, Human
aauugaguggugagaauacaacggaaguccaauuuagauucugaguguugucaccaugugauu

SEQ ID NO: 4229862 - RNA, 94 nt, Human
ugacuccuccaggucuuggaguaggucauuggguggauccucuauuuccuuacgugggccacuggauggcuccuccaugucuuggaguagauca

SEQ ID NO: 4229863 - RNA, 83 nt, Human
gcucccgagggaggccagagaagagccaggcagagaaaaccugcauccucugggcuuguuaacuuggcuuccacucgggcugu

SEQ ID NO: 4229864 - RNA, 71 nt, Human
ggacagcaggucacagcugauuggccaggacucuccauagguuauggccagucuuagcugugccugcaucc

SEQ ID NO: 4229865 - RNA, 62 nt, Human
agaggcagagcugggguuugaccccaggccgcugggcccccgagcccacacuccuguccucu

SEQ ID NO: 4229866 - RNA, 78 nt, Human
gaagaaaguggguuuauuguauuucccuuaagauugugagggaguguggauacaguagaaugagccaacaguuucuuu

SEQ ID NO: 4229867 - RNA, 57 nt, Human
cuuccuaaucuuggguuauuuuugcccugauguuaaaauugccuaauauaugggaag

SEQ ID NO: 4229868 - RNA, 66 nt, Human
gaguguuuuuucccccccuucuaaaucauugaaagauaauuauaguggcuuggggaaaaaagccuc

SEQ ID NO: 4229869 - RNA, 67 nt, Human
gggcuacugcacagucauuuccucucaaugcacuauuuacauugucaggaacuaugauuaugccccc

SEQ ID NO: 4229870 - RNA, 89 nt, Human
acccaccagugucaaccuguuuuugccugugacaaaaacaaagaucauuuguuuugauacaaguuguaaaaaagugaauacuagucagu

SEQ ID NO: 4229871 - RNA, 56 nt, Human
agugacauuauuuuguguacuaggauguccucuuguuuagacagauuuguguuacu

SEQ ID NO: 4229872 - RNA, 102 nt, Human
uccauuaugucacaauguucccuauuuuauuuagguuuaguuguugugcaacugcugauuauugaaguagaggguggaggacauauguauuucauauaagga

SEQ ID NO: 4229873 - RNA, 80 nt, Human
augggggugggccacucugauuuuucuaauacuucagcaucugguuaaguauguuagaaaaucaagugcuaacaucuuau

SEQ ID NO: 4229874 - RNA, 66 nt, Human
gccgguccaccuaagucuccgggagcugagccacaucuugcagcuccucagauuuggguggcgggc

SEQ ID NO: 4229875 - RNA, 86 nt, Human
cuucauuaauuuauguuaauuaccagcacugauucccugcaucaucgaggaguuauuagugguguauuuggcacuaguuuuagaag

SEQ ID NO: 4229876 - RNA, 63 nt, Human
gcuggagagcaaugaggggcaggcugugaacuccaaacgccuccuccaucauugcuucauggc

SEQ ID NO: 4229877 - RNA, 128 nt, Human
uuccuuuaagucuggagucuuacuuucugcucuuuggugaguagaaguaguuggcuuuuccaaaucugcaggggaauaaguuaauugcuucuaguuaauacagauuauaggcugcaggcauaggggga

SEQ ID NO: 4229878 - RNA, 55 nt, Human
gcacucugggucaucugcugcccuggcagugagcgacucuuuuaguccagagugc

SEQ ID NO: 4229879 - RNA, 59 nt, Human
cagcuacauauguuaugccauuuucaaggcacauaguuuuaauaguaugacaugagcug

SEQ ID NO: 4229880 - RNA, 117 nt, Human
ggcacacaggauuucaauagaaauugcaugccuuuuuagaugugcgaauguuucauuaagcguaugaauauuugaagagauguaugacacuuuaaaaacuguuuccucuacuguguu

SEQ ID NO: 4229881 - RNA, 73 nt, Human
uuguccaguuguucucagcagaagaacugcucugauacaagcuaguucauucuagcugggagcagaagugcaa

SEQ ID NO: 4229882 - RNA, 74 nt, Human
gacucuccuugggguuugggggcuugaccugggugcgcuuucuggacagacuuuacagccccgggggcacaguc

SEQ ID NO: 4229883 - RNA, 55 nt, Human
gugcucgagcugugcgcgcugcggcccgcgccccgcgcgcucgugcucgacgcgc

SEQ ID NO: 4229884 - RNA, 65 nt, Human
ugugcuugucuguuuugauugugauuuaauguaugcaacaccuauucuaggacaggcaaaguaca

SEQ ID NO: 4229885 - RNA, 60 nt, Human
gcaaauugauuuugugcuuuccuacguugaugauguaaagaaagacgcagaguuaaaggc

SEQ ID NO: 4229886 - RNA, 80 nt, Human
ugauuauccauucagguuaaaucaggcaucauuucagucaccuccagguauuaauguguaugauauaaauuggaaaguca

SEQ ID NO: 4229887 - RNA, 99 nt, Human
gccuguacuacaauuuucaacuuuauuuucccccaguuugcucuccuuaaguacacauucaaacuggaaagaagacugugguugagcaagugguuaggc

SEQ ID NO: 4229888 - RNA, 87 nt, Human
ggagaauugcuugaacccggcaggcggaguugcagugagucgagauugugcuacugcacuccagccuugccaacagagugagacucc

SEQ ID NO: 4229889 - RNA, 59 nt, Human
ugaauuuguaggaauucuccaugcuaaauaagcuuuuuggagagaaguucuauaaauca

SEQ ID NO: 4229890 - RNA, 110 nt, Human
ugugggcgugugcaaggaaucugugaaccgacaggggaagauugugcuuucuucagaacacggcuucuugacuguggguugcagagaaggaaaggucuuugcugccagca

SEQ ID NO: 4229891 - RNA, 56 nt, Human
ucugcguggcgugguucugugccuugggaagagaugaaugggaagcggccagcgga

SEQ ID NO: 4229892 - RNA, 65 nt, Human
caccagauaaacauuccuuggccuuuguugaaugcauugaaggauugauggcauguuuacuggug

SEQ ID NO: 4229893 - RNA, 79 nt, Human
gggccgcgcgcucuggggcuggccaggaggagucugcucacggcggagaucuuggacuggccggccuugggcgaggccc

SEQ ID NO: 4229894 - RNA, 80 nt, Human
guuucuggucacuuucccaggugugagugaggugagaauucuuucaguuuaucuagcugggggaauguagugagcauagc

SEQ ID NO: 4229895 - RNA, 80 nt, Human
ccugauuuaauucugaagugcuaauccugugcuuguggagacaugggcugagguaguagggcacugaagcuggaauuggg

SEQ ID NO: 4229896 - RNA, 82 nt, Human
gcaaacuuggcuacaauucaggacucuuccuugaagaugaguuggauauuuuugggaagaauucugauauuggucaggcugc

SEQ ID NO: 4229897 - RNA, 63 nt, Human
ggugacucacauuaggacuucgagaccucauucaacuuucuaagaagucauguuuuagucacu

SEQ ID NO: 4229898 - RNA, 66 nt, Human
cacgggaagaacugauuucacaccagcucagcgccugaugauggugaggacccagauuuuccuuug

SEQ ID NO: 4229899 - RNA, 65 nt, Human
gacuggccucuuucuucccuuugacugggaaugggucaaaggcggugcaggaggaggaucugguc

SEQ ID NO: 4229900 - RNA, 64 nt, Human
cacagccaagacuuggccccaugcuauacugucuacccucugggaccaagucuuugugguugug

SEQ ID NO: 4229901 - RNA, 69 nt, Human
ggacucuuauaaagaugucucuguugcggggggucucuuaccuggaaugggauaggucuucaggaauuc

SEQ ID NO: 4229902 - RNA, 77 nt, Human
ugggaaaucugcuuccuagggcuguuagaaggaaauuggucuccuuaaauuacgucagcaucugaggcaguuuccua

SEQ ID NO: 4229903 - RNA, 59 nt, Human
uggggggacagauggagaggacacaggcuggcacugagguccccuccacuuuccuccua

SEQ ID NO: 4229904 - RNA, 116 nt, Human
gcauauucugauacaagaaaacggcugaaguuuaugguacaggaaugcuguucucagucucucuauuaugaagagcugcauucguaucauauugugccuuaugcuucggagaaugc

SEQ ID NO: 4229905 - RNA, 66 nt, Human
gcgccaggcaggagaaaaggcgcgggcccaccuuacagcccggcgccucguuuccuaguccagugu

SEQ ID NO: 4229906 - RNA, 96 nt, Human
ccaguucugaaugcucugugcuuugcuaggaccgauugugggguuuuguuuucuucuucuacaaaucccuguaaacacagcuguauucaguaaugg

SEQ ID NO: 4229907 - RNA, 57 nt, Human
agaguuuauggauuagaguuugauucuuuuaugaggcucagcaucugauucauaucu

SEQ ID NO: 4229908 - RNA, 71 nt, Human
uuaggauauugagagagugagguguagaauuuaaaguuaaaaaauuuuacaucacuuuacuuaauaauuga

SEQ ID NO: 4229909 - RNA, 61 nt, Human
uggguguuccuggggugcaagggcaggccagguaagucuugccugcacccuaagggcccca

SEQ ID NO: 4229910 - RNA, 69 nt, Human
gugagcggcucaggccccgugggcuggcugggaaggcgcccuggaccauucgcggcuugaucugcuugc

SEQ ID NO: 4229911 - RNA, 93 nt, Human
cuuauuuuuucacaagccugguuauuugaggaugugcuuguaacguaugcuuucucuucuauuucucauagccaaugcuuguaccugaauagg

SEQ ID NO: 4229912 - RNA, 66 nt, Human
cuuaccagggagcggggagaucucggggaggaagcgauucucugauucucuuguugaccuagugag

SEQ ID NO: 4229913 - RNA, 66 nt, Human
uccuucuuccccauugcaaccccaaaaagaacaaaagccaaacacuguugguugugggaaggagga

SEQ ID NO: 4229914 - RNA, 68 nt, Human
uuuguuaugguuggaagcaggauucaauuugauuugccucuagaauucucacucuuccccaugucaga

SEQ ID NO: 4229915 - RNA, 63 nt, Human
gggcaggggcagugguggcauucuggggacaugucucuugcaguaccaucucugccucugccu

SEQ ID NO: 4229916 - RNA, 72 nt, Human
auggcugugguuauggaacuggcuauggcuguggauguggcucuggcucuggcuacuguggcuaccggccau

SEQ ID NO: 4229917 - RNA, 61 nt, Human
cccccuuuuuuauggaguuggccaauaggauugaguuggggcuccaguagagaaggcaggg

SEQ ID NO: 4229918 - RNA, 58 nt, Human
gaccagaacuucuagucuaaguucuucauuguuaggaauuuaacuggccuucuggcuc

SEQ ID NO: 4229919 - RNA, 86 nt, Human
ucacagugugacaugauggcgucauguaacaaggcuaagaaucgguugcaugacaauugccgucaaguuucguggaggugcuguga

SEQ ID NO: 4229920 - RNA, 56 nt, Human
ggcagcccuggacccuggagaaucuggacuggaggagcucuggcuccugggcugcc

SEQ ID NO: 4229921 - RNA, 93 nt, Human
gcccucugcagcaaucuauaguaugcaucaguaugguuggaaaagcuucuucuaucaaguuuaacaacuuucugguguaacuucugagagggc

SEQ ID NO: 4229922 - RNA, 107 nt, Human
cucuuccaauuacauucucauuguccuuucucuuggauaccgauugcuaagauaaacagacacugauuaagugguagaaagagaaagguaaaaugcaacuggaaggg

SEQ ID NO: 4229923 - RNA, 92 nt, Human
gaggaaggaucucuugaacccaggcuuuugaggcuguagugagcugugaucgcaccaugguacuccagccugggugacagagaccuugucuc

SEQ ID NO: 4229924 - RNA, 59 nt, Human
gcccagaagguagcgaguagucuccaccccacaucgcugcuccucugcaugucugcggc

SEQ ID NO: 4229925 - RNA, 94 nt, Human
aguaggggaauucaguaacagaaagugaagauagagccaggucuggggagaacuagaacuguaaauuaucucuccuucuuguaguuccuuugcu

SEQ ID NO: 4229926 - RNA, 112 nt, Human
uuuggaaagcaugguuuagaaacuacaggcauugucaaguggccgggucuuuuauaauuugaauaggcauaacacugauguccucuguguuuccaaaaacaugguuuagaaa

SEQ ID NO: 4229927 - RNA, 60 nt, Human
cuggaaauggcagaguugcauuuuuucuuccccauggagugagagucuguguauuuuuag

SEQ ID NO: 4229928 - RNA, 58 nt, Human
ggugucuuugauguugggcugaugaggucugguuccucuagcuucaccuagagauagc

SEQ ID NO: 4229929 - RNA, 68 nt, Human
gucagguugaagagguuaacgauauaacauggcaagaauacauuuauugucuuuuucuuccaccuggc

SEQ ID NO: 4229930 - RNA, 93 nt, Human
auacauaacuucguuuuuuguggcuggaagaaaaaguuucuauauuuuguauuugucuuuguucuucucaugcacacaauuuacuguuggugu

SEQ ID NO: 4229931 - RNA, 60 nt, Human
uaguaagaauauacccaggagucaguucugugagugcucacugcuuguguucaguugcug

SEQ ID NO: 4229932 - RNA, 62 nt, Human
uaagucaagagcuagaaaaagcuguaguucugguguuagcagaacucuggguuucugauuua

SEQ ID NO: 4229933 - RNA, 59 nt, Human
auguuguugaacucuuugcauguuauuuaguaugaugugcagaaaacacuuaagaacgu

SEQ ID NO: 4229934 - RNA, 87 nt, Human
ucaccaucuuucaaaucuuagcucaacucucaccaagugaaaauuggcuacuugggagaaaguuaacuuucuauggugggaugguga

SEQ ID NO: 4229935 - RNA, 68 nt, Human
gcauuucaagcaggaaaugaaaugcuugcuuuaauggcaaagcagcguuaacauuuuuccugucgugu

SEQ ID NO: 4229936 - RNA, 85 nt, Human
uuucuuuaccgcucaaggccgccccuucaugcuccugcgggggaguuagcgggaccucuggagucggccuuacgcaaagaagaga

SEQ ID NO: 4229937 - RNA, 78 nt, Human
gccaaauguacucgaaugauguuaagggcucuguaaaacuucauaccucuuuggccauuuguaugcaugauguuuggu

SEQ ID NO: 4229938 - RNA, 130 nt, Human
ugugaggcacaagugugucaagaauggacuagaacaagaaacccgaaaaguguuagaacucuagaaguauuuccugcguuucugugagcuucugguuuauucuuauuuccccugcuucucuguccucaug

SEQ ID NO: 4229939 - RNA, 90 nt, Human
uaccaauucaaaugaguuuguucuauuauuugcgugcgucuuaaaacacccaaaucagaucagagacaggcuccugguugaaauuuggua

SEQ ID NO: 4229940 - RNA, 91 nt, Human
cuugaucugauaggagaaaaugguaauauuucauaguuguuuuccaaagacaaauuuaaauguugucuguuaucuccuuacuuaguuuaag

SEQ ID NO: 4229941 - RNA, 111 nt, Human
aacucacaugauuauuuuggggaaaaugaaagaguuguauucuuuuugagguaguaauuccacuuucaggggcaaauacauuuugauuauuuuaucacccuucagugaguu

SEQ ID NO: 4229942 - RNA, 129 nt, Human
ugcaucuggaauccagccucggccuugaccccuuucgcuuguucggagugcuuucgcccagcuucuggcggagguucacgcagggaggggacucagguggaaaaggcuggccccuuugaucucuuugca

SEQ ID NO: 4229943 - RNA, 56 nt, Human
ugucauggacuggauuucugcugugagcuuccauuaggacuuguccauccaggaca

SEQ ID NO: 4229944 - RNA, 67 nt, Human
ggacaagaagaacggagguuucaggcuccaguugcuacgugagaccuaaaccgucuguccuugcccc

SEQ ID NO: 4229945 - RNA, 60 nt, Human
gccaaucaggaggcuguacaucagggcgggggcgggaggagcugcagcuuugugauuggc

SEQ ID NO: 4229946 - RNA, 64 nt, Human
gcuguggguuccuccccuguccucaggguuuaggguugguagagagugaggaggggcucacagu

SEQ ID NO: 4229947 - RNA, 56 nt, Human
uuguacaaauaggaaccucugaugucauucuucaacguuuguuccuguguguacaa

SEQ ID NO: 4229948 - RNA, 55 nt, Human
auggagugggaggacaugaaggaugaggaacuaccuucaggaccuuccaguccau

SEQ ID NO: 4229949 - RNA, 59 nt, Human
gggaaaugugucuuggcauucuaaaaaagaaugaauggagaacccuggacacuguuccc

SEQ ID NO: 4229950 - RNA, 59 nt, Human
cagagcagaaaccugggugauucuuuuacucccagagagagaugcccaacucuguuuug

SEQ ID NO: 4229951 - RNA, 58 nt, Human
uguagaccuuugaaugggaaauggcacucauaguuuuuccauucuuggugguucugca

SEQ ID NO: 4229952 - RNA, 86 nt, Human
agcagacgggcuguggggccugcagaaggggcuggcugccggccuucuguaccaaggccucaugaauggcguucguuucuacugcu

SEQ ID NO: 4229953 - RNA, 76 nt, Human
gacagggcaaugugacaagugugggcagggcugccagggaggguggcugggccucuuacuucuuacgguccuuguc

SEQ ID NO: 4229954 - RNA, 76 nt, Human
ucgcucuguugcccaggcuggagugcaguggcgcaaucuugggucacugcaaccuccaccucccggguucaagcga

SEQ ID NO: 4229955 - RNA, 71 nt, Human
ggacugauucuuggcaaaguggcaaaauuagggaaauauguuuuuggugaugcccaccuuuucauuggucc

SEQ ID NO: 4229956 - RNA, 87 nt, Human
guucccaauuuacuagaugaaugauguauguugggcaaguuacucagcuucucuuugcccuaguuucuucaucucuaaaaugggaac

SEQ ID NO: 4229957 - RNA, 98 nt, Human
gauaacauaagcaaagggauagcuauuauuauuucuguuauuauuuagauuucaacaagcagucaacagaagugauagcuauuauuaagagugauauu

SEQ ID NO: 4229958 - RNA, 72 nt, Human
cuguacuuguuuuaggaugaugcaucauagccuaaucuaauuuacugagcaucuacuaagugccaagcacag

SEQ ID NO: 4229959 - RNA, 77 nt, Human
ggcugagcagcucuggcuauugaggaccacccugaggaauaagggugguccucacccuacccagcugcuccucaccc

SEQ ID NO: 4229960 - RNA, 62 nt, Human
acagggugcucauggauaaggcgaaugggauauuuccuuuucugcuucccauagcacuuugu

SEQ ID NO: 4229961 - RNA, 77 nt, Human
gcgcuuagaagauucugaaauuaacagacuggacugaauauuuucauuuuaguccuaaauuuagauuuucuuaguac

SEQ ID NO: 4229962 - RNA, 71 nt, Human
gccaaacacauuaagcccaagcauagaacuggcuuagcaagucugguucccuuggcuuugauuguguuggu

SEQ ID NO: 4229963 - RNA, 69 nt, Human
gagacagaaccuucgguuuggcugccauaaggccugugggagaggugggcagagccaggguuuuguuuu

SEQ ID NO: 4229964 - RNA, 129 nt, Human
acuucaaggcccagcucuacgaaugcuggugcuggcuguguguuugugcaucuguaugucuuacauuugccaguuacucacaccacuguccggcauuugucuauacauccugacccuugccccuccagu

SEQ ID NO: 4229965 - RNA, 125 nt, Human
cugauuguaugaauuuuaauuguucaguuaacguguuucuagguuguaauuuguaguaaagcacuucaaugcuuuugcacuuaaauuuacaacacuguuggugugugauugauuuacucauucag

SEQ ID NO: 4229966 - RNA, 76 nt, Human
ccaaccucuuagccuccaguuuucucauuuauuucucagcucaauuuaugcauggaaaagggaugcuaacuauugg

SEQ ID NO: 4229967 - RNA, 60 nt, Human
agguagggaggguuugggguggaggaaccgucuggaaucuccccuccagcccucccuccu

SEQ ID NO: 4229968 - RNA, 76 nt, Human
gucaaagucaaucuucucuagaguauucuaggguuuaaugcucucuuccugguuacagaugaagaucggcccugac

SEQ ID NO: 4229969 - RNA, 62 nt, Human
gaaagugcugagacagacugggaagccuuuggcuaccggcuuccacugucccuggcacuuuu

SEQ ID NO: 4229970 - RNA, 59 nt, Human
uggacuucuuaaagaggugaggaauaucucugaguauuucugaguuuuuuaaaagucca

SEQ ID NO: 4229971 - RNA, 100 nt, Human
gggcaagggccaaggccugggcuguacccccaggacacugccucugaguuggaaccccuucaugggcaaacuuggggaucagccccagucuccccgaccc

SEQ ID NO: 4229972 - RNA, 55 nt, Human
aggcuuaacuacaauuuuugccaugaauuuaagcuggcauuuuuuaguugagcuu

SEQ ID NO: 4229973 - RNA, 59 nt, Human
uacaagccagccaguuccagcagcuuuuucccaaagccuggagcaggcucugcucugua

SEQ ID NO: 4229974 - RNA, 66 nt, Human
gagaguuacauagugggacuggaggcuuugcaccaaaucuuuuaucacucccacugcuguagucuc

SEQ ID NO: 4229975 - RNA, 59 nt, Human
uccagggaggggcggcaggggugucucaaaaucucccaccugucagcccaacuuuugga

SEQ ID NO: 4229976 - RNA, 64 nt, Human
gaauuagguacuaguuaaaaauagaauuaguagugacuuuguucuagauaacugguaauaauuc

SEQ ID NO: 4229977 - RNA, 67 nt, Human
uuuuaacuuuaccauuucuucaguuguaaaaugaugcaccaacugacagugugcccggagguuagaa

SEQ ID NO: 4229978 - RNA, 57 nt, Human
ugaagaauuccauggcuuccaugucucagcagcucaaggccaaguuggauuucuuca

SEQ ID NO: 4229979 - RNA, 101 nt, Human
acgaucguauuguagucucucaaagugcucuagaaauugucagugguuuacaugaaguggccaugggugucuggagcacccugaaacugcaccaaaguugu

SEQ ID NO: 4229980 - RNA, 59 nt, Human
guaguuagaguugugcuggagaugacgggaaaccuggauuagcacagacuuuugcuuac

SEQ ID NO: 4229981 - RNA, 59 nt, Human
ugugguuuguaagcaaagcaaacauuuuuggaaauguuugcaaauuggacacaaccaca

SEQ ID NO: 4229982 - RNA, 67 nt, Human
uuuauugcugaaggauaauuuugcuggauguagaauucuaggucggcuuuuuuccuuucacauuaaa

SEQ ID NO: 4229983 - RNA, 110 nt, Human
auucauguggccccuggacuaacuggaucgauuccaaauguagaucuuccaaaugaaacugaagacauugaauugaauccagauuuuacaggggaauagcuaaaaugaau

SEQ ID NO: 4229984 - RNA, 115 nt, Human
augggugccagcaguacaugugccaggugaggcaguucuuacuuguauuugucauaaacugauaccugccaagcugcacucaggcccuuggggcuguagcuuugcuggcauccau

SEQ ID NO: 4229985 - RNA, 109 nt, Human
uugagucagggagccuggaccugugacuuggugaggccccagggauuaggccaaccacaggucugggguaccuggcccuggggcugcugccuagucauuucugacucaa

SEQ ID NO: 4229986 - RNA, 63 nt, Human
cagagcagauggagcuggaagaggggaagacaggcaacagacucugccaguauuaucugucug

SEQ ID NO: 4229987 - RNA, 65 nt, Human
uguuaaaaagucccuguuuuguccugaaauuuuagucuauucuggauaaauaggauuuucugaca

SEQ ID NO: 4229988 - RNA, 55 nt, Human
uccagguggcuuuccugggggaaugccugguaauuuucccagaggaaugccugga

SEQ ID NO: 4229989 - RNA, 74 nt, Human
ugaggcagcaaugaaaauuuaaguugcagcuauuaguugauugcuguaacuuuuucauuuucaaaccauguaca

SEQ ID NO: 4229990 - RNA, 117 nt, Human
ugcugcuggaggcagcgugguuggggcggagagacaagucugcuuuggggaaagguugcucagacucaguuuugucuccugcauuccaucuugggccacugcuguccuccugccgca

SEQ ID NO: 4229991 - RNA, 83 nt, Human
guguucccauucugaguuuuucaaaucugaauuugcuuuugucagcggcuuacagauaaugaggagacuccuguggcggaugc

SEQ ID NO: 4229992 - RNA, 62 nt, Human
uuucuuuagacuacuaugcugccagaaaaacacauaguucucugggagaguagauaaaggaa

SEQ ID NO: 4229993 - RNA, 87 nt, Human
aggagacgggcaguuuaaauuguucuaucagaaccgaguugccuguuuuugaagcucauucuagacaauugaaaacuguucucuucu

SEQ ID NO: 4229994 - RNA, 93 nt, Human
ggucccugcccucuagaagcucacagucuaguuguguucaugugcaagucauuuacccccagcuagauuguaagcuccuugagggcaguuacc

SEQ ID NO: 4229995 - RNA, 67 nt, Human
cuguguggaggugggugaugucuuccugugcuaaaaggugaauaaauaagcuccucaccucucgcgg

SEQ ID NO: 4229996 - RNA, 67 nt, Human
uacauaggcagggauuaggguugauuacguaacaggcguaaucaucuguuguucccuuggaaaugua

SEQ ID NO: 4229997 - RNA, 70 nt, Human
gucagucauugaaugcuggccucuuggaggaaaggugacaacaggugaggccagcaccauaggggcugac

SEQ ID NO: 4229998 - RNA, 65 nt, Human
gaucuggcauuguugcaagccuggaaucugggguccccagcaggagacuagcaacauaccagauc

SEQ ID NO: 4229999 - RNA, 82 nt, Human
cugaccucucaauuaaggccuuuaaaugucuucuguccauuaugcacuuaaacuuggaagggcuugggggccuugaaggcag

SEQ ID NO: 4230000 - RNA, 129 nt, Human
uugggugggaaguggcagaaugguuaugcacaaggagaaauagauauugacauacugaggaauacuuagauucgucgauuucucaguguccuucguucuuguuguuucauuugucuugauuccccaaaa

SEQ ID NO: 4230001 - RNA, 98 nt, Human
cagauccuaaguuguuuugguuugaguauuuuuuuuaacacauuagauuaaugauagggagaauuauacaugagcuauuugguuuagacccuuauuug

SEQ ID NO: 4230002 - RNA, 90 nt, Human
ccagguuuacuggaugauuuuguaacuggggacaggauaccucacuuucuuguaccucagauuauugaucucuauaauuuagaaauuugg

SEQ ID NO: 4230003 - RNA, 78 nt, Human
uuuguguuuuucuuugguaacucuuccuacucuaucaagggugcgugaaaaggaacaguuucaaagagugaaaucaga

SEQ ID NO: 4230004 - RNA, 87 nt, Human
cuucuuguaauuacaucuaaaauaagccuuauaaugauuggguguuauaaugauuguuacuggguuaauuuggacuugaaagagaag

SEQ ID NO: 4230005 - RNA, 61 nt, Human
ugcuuuaccuuccauuuaaggaggaccagggaguuaggaacuucuugaggaaaguaaggca

SEQ ID NO: 4230006 - RNA, 68 nt, Human
ccaagagggcuguuggugcccucgagggcaguggugggcugugugggcgaagacagccuuugccuugg

SEQ ID NO: 4230007 - RNA, 65 nt, Human
gcaaguugggaaaugcugcaguagucuaagauuuacugucagauuauuucaggguuuugacuugc

SEQ ID NO: 4230008 - RNA, 65 nt, Human
gagggaggcucagagggacuuucaagauacuuuauuucaguuccucuuuugggcucugaccccuc

SEQ ID NO: 4230009 - RNA, 100 nt, Human
gagacaggagaaucgcuugaauuggggaggcggagguugcagugaaccaaggucgcgccauugcacuccagcccgagcaacaaaagcgaaacuccgucuc

SEQ ID NO: 4230010 - RNA, 62 nt, Human
gguggggugagggggcgaggccgcagcuagggcggcgaaacucuccuccccucggccccacc

SEQ ID NO: 4230011 - RNA, 76 nt, Human
guaaugguaaguuuuuaaaaagcgucaggguuguaaacuugcauauauaauauguuuuuugaaaauguauuuuuac

SEQ ID NO: 4230012 - RNA, 97 nt, Human
gcuauuuuaaaucacagugugcucaagacauuaggaauauaaagcacacucaacuucaauguuccuuaaugugcuuguagcucauaccugaaacugc

SEQ ID NO: 4230013 - RNA, 60 nt, Human
uuacuugucuuuauuuuaaugcugucugaagggaacuugguauccaaauaaagcagguaa

SEQ ID NO: 4230014 - RNA, 87 nt, Human
gggcaggcuggguggugguccccuagguaucagccucucuuacuguacucuccgggaauguuaaccuuucuauuuucagccugugcc

SEQ ID NO: 4230015 - RNA, 71 nt, Human
ccugcuuguguugaaaaguagcacugcuucuuggaaacacaagaugcugcuccuuuucaggcauuugcagg

SEQ ID NO: 4230016 - RNA, 61 nt, Human
ccauccccacuuauuuuuccuuugugauugacaugaaaaugguucagcagcgugggggugg

SEQ ID NO: 4230017 - RNA, 56 nt, Human
aguccagggcuuagucagcggggcccggaguggcuucccuggcuggcaucuggacu

SEQ ID NO: 4230018 - RNA, 64 nt, Human
aacugcauuaucaccaagauguaaccgaacccccucgguuugucccuaugagugguaaucaguu

SEQ ID NO: 4230019 - RNA, 71 nt, Human
uucaguuauuuuucacuauuaggcuuauuaagcuugaagcuuuaggaaaucucuugggaagagugagugga

SEQ ID NO: 4230020 - RNA, 57 nt, Human
gcugguggcagagcuccgcggcagcgugcgccaggcagugcggcucuaccacucggu

SEQ ID NO: 4230021 - RNA, 91 nt, Human
guaacauuuguauuucguuuuuaguauaguaugugcucaaaguguaguacucuguaguaugguacuuauuuaaacgaaucacucauguuac

SEQ ID NO: 4230022 - RNA, 103 nt, Human
agaggaagaggcuggagcgcaggagguagcuggugcugggcuccuagucuuggcagaggagcccaaagcacuuggcugcccugcgugucacucaucucccuuu

SEQ ID NO: 4230023 - RNA, 84 nt, Human
cugguaauggcaagaugugggaggaugggccccuagaggagcugcuccuuuuucugccucucucccacauuccucacuccccag

SEQ ID NO: 4230024 - RNA, 72 nt, Human
cucauuugccaagucggguugcagacacauccucuuucuggagaggcugucucagccugcuugcagaaugag

SEQ ID NO: 4230025 - RNA, 105 nt, Human
ugcucaagcagcuauaacccaagauguugucucuuacguuugauaaugaaucaaaucugauaggcgacaccucaggaaaaacugggcuuauauuugcuacuagca

SEQ ID NO: 4230026 - RNA, 70 nt, Human
uccgcuuuuucguugaagcaacgacuuuggccggaugacuccccagggucggcaucagcgugggacuggg

SEQ ID NO: 4230027 - RNA, 78 nt, Human
ccacggacauggcagccugcgugaaggagcuuguuuuccaucuccuggcagagcuccugcgcacggugcacacccugg

SEQ ID NO: 4230028 - RNA, 71 nt, Human
cuugccagggacucagucaggggacuuugggagaaagacuugauagccaggcugacuggguucuaggcagg

SEQ ID NO: 4230029 - RNA, 56 nt, Human
accccuauugcuugugauuaugccagaagaaauaaucacugcaggcauauaggggu

SEQ ID NO: 4230030 - RNA, 71 nt, Human
gagcuguaaauugcuuaaaucgcuuaaacuggagauuucagugagauuuuuagcaguagauuacuaagcuc

SEQ ID NO: 4230031 - RNA, 74 nt, Human
ggcuagacauuuacuuugaaaaaauuccacuggguguuuccagggcuauuucauuuuagaaauaaguguuugcc

SEQ ID NO: 4230032 - RNA, 67 nt, Human
gguugagcuauuucaccauauagaucuccuacgacuuugagacugugauguaaagaaauaggcaacu

SEQ ID NO: 4230033 - RNA, 62 nt, Human
gcuugcgccccgcgggccuucgggcuccgcagagggacgccggcccugcgcggggcggaagc

SEQ ID NO: 4230034 - RNA, 76 nt, Human
gguacagaagcuacaaaaccagggcaaaggauguuaaauugauacuuccaaugugccuuauuuugagccugauacu

SEQ ID NO: 4230035 - RNA, 57 nt, Human
uucaaugcaagggaggucugaagaagugaucacaauuucuucaggcucuugcaugaa

SEQ ID NO: 4230036 - RNA, 70 nt, Human
agguggccacaagguggcuggccaggguuagagcugaacuucaggaagacaagccaugguugugacaccu

SEQ ID NO: 4230037 - RNA, 78 nt, Human
ccagucgggaggaggcggagcucguucagcagauggcagcgaacaucaaggagcggcaggacgucuucuucgacaugg

SEQ ID NO: 4230038 - RNA, 74 nt, Human
uaucagagagggagagauuggcaaucaguaugcuggugaaauucugagcuuuucucugcuucuuaaagaugaug

SEQ ID NO: 4230039 - RNA, 57 nt, Human
gguguguguguguguguguguguguguguuuaugugcacgcauguauaugcaucacc

SEQ ID NO: 4230040 - RNA, 57 nt, Human
ugacguuugcgccgcgcacgacuauguccgccauguuagugucugacgcaggcgcca

SEQ ID NO: 4230041 - RNA, 69 nt, Human
gugagaagcauaagggcuuugccagcccagacuguuaauucuacugacacagccauuguccuuguucau

SEQ ID NO: 4230042 - RNA, 120 nt, Human
cuggguagaggaugagucagcauugguguaaaggacuggagcuucaggguucucgggauucgaguccuggcccugcugcuugccagcucugugcuguggcaaguuacuuccucuccccag

SEQ ID NO: 4230043 - RNA, 68 nt, Human
auggaagugggcaucaccauccagcaugccuaugagaagcagcaccccuggaucgaccucacuuccau

SEQ ID NO: 4230044 - RNA, 78 nt, Human
ucuuuauuucacuuuuucucugcuugagacuagccagagugggucuggcucuuaagcagagaagaaguugauuaaaga

SEQ ID NO: 4230045 - RNA, 78 nt, Human
gccuugggugagagaaaagaaacacuguucuuuguaaagaaauguucucuaaucuuucucuuuauccaaucucugggc

SEQ ID NO: 4230046 - RNA, 77 nt, Human
acuuuauaaggaauugugaaugccugucagucuuuucuccuauugcaagaaggcugaccaguuuacacuuuauuagu

SEQ ID NO: 4230047 - RNA, 57 nt, Human
gaaagugaauguaacauguuaugagaaaccucauauugccuguagaucuucacuuuc

SEQ ID NO: 4230048 - RNA, 67 nt, Human
ucuauaagaaaguguuaacacuggcuacuuuugcaaagaaggccuaggaguugacaugggggguaga

SEQ ID NO: 4230049 - RNA, 94 nt, Human
gauggccgccaggcggcccaggagauggccucgaccauggaggacugggaccugcaccuccgccaucuucggcagccgccugggaaagcacauc

SEQ ID NO: 4230050 - RNA, 60 nt, Human
ugggugaagaggcuaugcuacuguugcaucuaagggaauaguggcacuguuucuucccua

SEQ ID NO: 4230051 - RNA, 86 nt, Human
aaauuccuuuuagucucuugaguaaugcaagccuuuguauuacauguuaauuaaagaguuuauuacuuguaagacuaguuguguuu

SEQ ID NO: 4230052 - RNA, 79 nt, Human
agacaagagcugaggacauauucuagcccccaagaagugcuggaguauucccacuccucagcaauuuuuacuuuugucu

SEQ ID NO: 4230053 - RNA, 63 nt, Human
ugauucagagcugcaacaaagaagcuguuaaaauguuugcaauuucguuucaguguuggauca

SEQ ID NO: 4230054 - RNA, 76 nt, Human
gauuuuuauaguauuguguuguuugacagugaaguuggugacuuacuguugugaauaaugaaaugcauuguuaauc

SEQ ID NO: 4230055 - RNA, 55 nt, Human
ccggcugcugaggcggccccggcugcagcgacagaggagccgcucccgcagccgg

SEQ ID NO: 4230056 - RNA, 58 nt, Human
uguguuucucugaggggucccuuuaaaggaaugcccuuaaucccccucaggaaguaca

SEQ ID NO: 4230057 - RNA, 75 nt, Human
caguugcuauugagagaacacauagguacacaguugucuuuccuuucuugcccuuguuugcuuuuggagcaacug

SEQ ID NO: 4230058 - RNA, 130 nt, Human
ggaagaugaaaaaggagauauuaacaugacuaucuauugucuucuucaugaaaaugauggugacacaauugagcgugaagaaguaauagguggugaugucaaacguaccauucauaauuuauugucuucc

SEQ ID NO: 4230059 - RNA, 93 nt, Human
uguauuggaagucugaguuccaucauucagaaauuuuugagucucaugugaaauuuaguauuuuuugaaugaugaaugcaagauuuuuaugca

SEQ ID NO: 4230060 - RNA, 104 nt, Human
cagaaacagacggaguccaagguggguucagcugcuugccugaagucagaguuaucugguagacaacagcagugggacuuagaugucuuuuuccucuggauuug

SEQ ID NO: 4230061 - RNA, 56 nt, Human
ugacaagagaccccuccgcaggcgcaguugcuagucuuuaaggggccuuuguguca

SEQ ID NO: 4230062 - RNA, 81 nt, Human
cugaggcguggcgagcagacugcacaguucuugccaacaucagaguuaauuugguaaaucuuggcaucugcuuuccuucag

SEQ ID NO: 4230063 - RNA, 118 nt, Human
ucaggaagcucauuucggucauguugcggugcuuugcuggaaucgaggaaugugcuuaauucgaaggugucuuugucgguuacagcaacgcugcugcugaaugccgugagaagccuga

SEQ ID NO: 4230064 - RNA, 87 nt, Human
gagaaagucuugcuuugucacccaggcuggagugcaguggugcuguauuggcucauugcaaccuccuccuggguucaagcgauucuc

SEQ ID NO: 4230065 - RNA, 63 nt, Human
auucugggguaagcacugaggauuuagguagagaagugucuguucuaguauuugccuuaggau

SEQ ID NO: 4230066 - RNA, 79 nt, Human
auaguaguaacugaaccaacuuuccaaagugccugguagcuguccagaugaauuaggcugcuuuggaaaacuguacugu

SEQ ID NO: 4230067 - RNA, 68 nt, Human
cuuuggcucucuucacuuguaugcuaucauugauauucccaguggugcccguggaaagagggagaaag

SEQ ID NO: 4230068 - RNA, 56 nt, Human
guccaucuugcaaugagaccuaacuugcaccugccuguuuuucugcaugauuggac

SEQ ID NO: 4230069 - RNA, 86 nt, Human
cuuuaaacaagguaaccucauuguuucugcuuuucaugauggucucaucaaggaagggguaggaauaaucauagccuguugcaaag

SEQ ID NO: 4230070 - RNA, 65 nt, Human
cucaaauggguuuguagaauauuuugucuuggugccuggaauuugcuuuuacgaacucacuugag

SEQ ID NO: 4230071 - RNA, 66 nt, Human
uggguuaggcagugugguauagcagauaugugguuaacaucauugcugugucauuuguuuaaucug

SEQ ID NO: 4230072 - RNA, 55 nt, Human
gagcuggacauacaggaaaccauuccauuuggaugacuuucuuuuauuccagguc

SEQ ID NO: 4230073 - RNA, 69 nt, Human
cccgcgggaggcggagcuccgcgggggccgggccggcccuccccagccgaaugcucccuuccccgcggg

SEQ ID NO: 4230074 - RNA, 64 nt, Human
ucugugaaugguggccacgcguuuggauguuacagagcaagcacguucuucauuacuucacaga

SEQ ID NO: 4230075 - RNA, 56 nt, Human
caguggguauauauaugugugcugugugugcacacacguguacauuuaugccccug

SEQ ID NO: 4230076 - RNA, 78 nt, Human
agcaagaccaggguuuuguguuugugaaccuaucuaauauugcugggguuugaaaacugaacccugaguuuuauugcu

SEQ ID NO: 4230077 - RNA, 61 nt, Human
gcuuauauuuguuucuaguggcagcaaguucuguuuugcucaccugagaagaauagagggc

SEQ ID NO: 4230078 - RNA, 77 nt, Human
cccucugccuuccuguggggugucaucauagccuggucaaugagaaguuggguaacuucccagagggucacggaggg

SEQ ID NO: 4230079 - RNA, 130 nt, Human
aggagcagacuuuucucuugucacuuuggaaggagaggauugugaggcugccccuuuaaauagcauucccguaggaggcagaucacauccauccgucaccuacugccaaagcaucauuuuugguuucuau

SEQ ID NO: 4230080 - RNA, 64 nt, Human
gugcagguuguugacugcauauaggcacccaccuagccugugcuucacucaacaagccguguac

SEQ ID NO: 4230081 - RNA, 56 nt, Human
uucucuuguaaaauuccuuuuucagagacauaacugcagggagagucccaagagaa

SEQ ID NO: 4230082 - RNA, 66 nt, Human
cagauuauaguuuucaaggauuggagcuggaaggaguugccuguuugagagcuguguuaaggucug

SEQ ID NO: 4230083 - RNA, 80 nt, Human
cugagggaguggagaggucuugagugacuuagcaggacauaaagucuuaguuacuugacucaagaccccucucccuucag

SEQ ID NO: 4230084 - RNA, 76 nt, Human
agguucaagcacuguauuuaaauauuuaaaagauaggaguuucuuaaaauaccacauauggugcucuugugagcuu

SEQ ID NO: 4230085 - RNA, 112 nt, Human
uuauuauuuaucaagguucaguauugaucuuugaaaccuuggucccguuaacuuacuagucacauugaccaauguuuuauagaaaugccuagaauuuugagacuaauaguag

SEQ ID NO: 4230086 - RNA, 55 nt, Human
gccccagcucaccggcucacugccccccagcugcgcuugagccgguagauggggu

SEQ ID NO: 4230087 - RNA, 88 nt, Human
uauuuucuguuucagaaaauucuuccaggaggaaauacaucauuugauguaguuuuucuugcaagaguaguaggaaauguagaaaaua

SEQ ID NO: 4230088 - RNA, 71 nt, Human
ggauuggagacacagcaauaacuacuguugccauggaaggguuaacaguguaggagcugguuuaucagucc

SEQ ID NO: 4230089 - RNA, 80 nt, Human
gcugcugugugauuguugagacugaaguucugaaagcaccaguguuugccggaucugucuccagcuugucucuacaaggu

SEQ ID NO: 4230090 - RNA, 72 nt, Human
gacccuaaagaauguggcauaaaagccaagcccauuaggcuaggcaaguggaccagagguuuauuggagguc

SEQ ID NO: 4230091 - RNA, 66 nt, Human
ggcccggccuuugcccgucauucugggccgagcuuggcccagaacgacgggcagaggcgcgagguc

SEQ ID NO: 4230092 - RNA, 130 nt, Human
gggggauaaauggaggggauaagauucaguugguuuuggaaaauguuaaagucuuaaaauaaugcguccaucugaagaauuuuuucuaaaaccagaguuuauaaaaauaucacugauacagccugccccc

SEQ ID NO: 4230093 - RNA, 92 nt, Human
gggacucucacccugcggagcguuucccugggggucugcccacuuccugggaggggcgccaggccuggguggagcgcucugcggcagagccc

SEQ ID NO: 4230094 - RNA, 81 nt, Human
ugauucaguagacucugagguuuuccaaguacauuaaggacuuaaauacagaaugucuuaaaauuuuagggcuauugauca

SEQ ID NO: 4230095 - RNA, 60 nt, Human
gagcuuuguuccgugguggcacacaaaucuuggcuugcuguaccaucauuggcaaaccuc

SEQ ID NO: 4230096 - RNA, 84 nt, Human
cagggcccuagggcucagccuccuccucagcccacgaagccaugugacugcugggcuggggaucgaaggcagagccugguucug

SEQ ID NO: 4230097 - RNA, 56 nt, Human
gcugcgcgcagccggcgccgagauccagacggacgcacggugcugauuggugcagu

SEQ ID NO: 4230098 - RNA, 119 nt, Human
gccaccccuacccccaggucacagucuaguuacugggugagcugggcugggacccagguguccugacucccgcccugcguucucccaugcuccauuguucucuugggagaccucauggc

SEQ ID NO: 4230099 - RNA, 106 nt, Human
ggcagguacccaaguuuaucuguguuuauggggaucugcaguguugaucuguggugcauggaagcgugcagguccguauacuccauagucaauuacguuuccugcu

SEQ ID NO: 4230100 - RNA, 70 nt, Human
guuggaggggucugguggaguuguauauacugaaaucacauggacugguccauuaugacaucuuaccaac

SEQ ID NO: 4230101 - RNA, 57 nt, Human
ucuguagcuuuagaggacaggagacuucaugacuucacugccaagaaaaguuacaga

SEQ ID NO: 4230102 - RNA, 130 nt, Human
cauguuucuaaucauaaaagcucuaauuuccucaggagagucucugucuguacuaguuucuaaaacagcuaagugggacccagauuuucuugaacaaaaucuagguaaauaugacuuacaaaagaaaagg

SEQ ID NO: 4230103 - RNA, 60 nt, Human
ggugcuggggaaauuaggguaggagaugcugcauuguuuacuaugaaaauuccagucacu

SEQ ID NO: 4230104 - RNA, 56 nt, Human
agggaugugcagggcuugccauguacagaagaacagguuaugcacugcacaacccu

SEQ ID NO: 4230105 - RNA, 70 nt, Human
ugccaccuccuuccucuuucaaauuuguuucucuuacuguugggaaccaagaguccaagugagguuggca

SEQ ID NO: 4230106 - RNA, 70 nt, Human
cuguuuugagaagauaggggaauacuuugucagccucagcguauuggaguauuguucaucuucaagacag

SEQ ID NO: 4230107 - RNA, 78 nt, Human
ucugaugauucuuugaccaaaaaauugagacauuugggaaaugaugaagugcacauuguuuggucagagcauacuaga

SEQ ID NO: 4230108 - RNA, 129 nt, Human
ggguaaaaacaggagugugugugucuuuggggguggucaagaccgggaauaggauaggccuugggucucagccuauuuuauaaaaccuguuugaccuuugaagagacucaucuacucacucacccaucc

SEQ ID NO: 4230109 - RNA, 62 nt, Human
cagugcuccugccccugcccuucacugucauaggacccucaggcagccuggcaggggcacug

SEQ ID NO: 4230110 - RNA, 78 nt, Human
ggggcuccacuaaggcagcagcggcucggcaggccaugucuuuuggccucugcaccaaccugucaagaguuaagccuc

SEQ ID NO: 4230111 - RNA, 67 nt, Human
ugucagauucuuucauuugcugauucuguuuaagcucaagggucagucacugugaaaugaauuugca

SEQ ID NO: 4230112 - RNA, 65 nt, Human
ugcacacguuuagcuucuggcggcccaggucuuccuagccgcagauucugagacguguaucugca

SEQ ID NO: 4230113 - RNA, 62 nt, Human
cugucacuguuuuaaccaacaaaagcuagccuggaacugcuaugguuaaagugggugagcgg

SEQ ID NO: 4230114 - RNA, 65 nt, Human
accgguucccaucuggagaguuuauuuauaacucccucuauaacucucuguuuggaggcacuggu

SEQ ID NO: 4230115 - RNA, 59 nt, Human
uauugugaaggccaugugcuaaauccagcaauccgcuccaguagguguccuucaggaua

SEQ ID NO: 4230116 - RNA, 67 nt, Human
agugaugcagauggaguuaguuucuaacaugugaacgugagaacuguuuugguuuggguccaucauu

SEQ ID NO: 4230117 - RNA, 77 nt, Human
cagagcuggagagauagucauucuagagccuggcccuaguggugccuuuucagaacugucuguccuuuucagaacug

SEQ ID NO: 4230118 - RNA, 65 nt, Human
cuuuugucucuuuugauuuuucacucagagcuaauuuuaagggaagucuucaggagacacaaaag

SEQ ID NO: 4230119 - RNA, 87 nt, Human
cggaguucugcuuuaaucuggguaacugaggcuaauaugagcaagacuuugguuaauuaacuggguucucagaugccacagacuccg

SEQ ID NO: 4230120 - RNA, 62 nt, Human
ggauuuaucugcucuucgcguugaagaaguacaaaaugucauuaaugcuaugcagaaaaucu

SEQ ID NO: 4230121 - RNA, 58 nt, Human
ugcauguuuuaagugaagcugaaaccgcgaaggcucagguuacacuuuaaaauaugca

SEQ ID NO: 4230122 - RNA, 63 nt, Human
gaguacagaagauaaaggcacaccuaucauuagagauguauguuugggcuaucuuuuguucuc

SEQ ID NO: 4230123 - RNA, 95 nt, Human
ccaccauccagguucgcaggacgcgcuccagcaggugcuucacagaggaaguggucuguccgggcagcuccuggagcuguaccuccugguuuugg

SEQ ID NO: 4230124 - RNA, 58 nt, Human
caucccaacaggugaucugguaaucauguccauugaucaccagacagcuguuggggug

SEQ ID NO: 4230125 - RNA, 90 nt, Human
aaaacuuuaaagguuauacuaauuuaaugauuaauguggacccaaauacauaauuuggccaaaaaagucauuagaauggguaaugguuuu

SEQ ID NO: 4230126 - RNA, 66 nt, Human
uaugcagauaguuugccauucauacugacaguucugccaggucagauggugcaauuaucgugcaug

SEQ ID NO: 4230127 - RNA, 85 nt, Human
guugguuccacuggaaucuuggccuucuccuggaguggcuugaggcggcacgcuuugacuuuagaaggccaaaguuagaaccuac

SEQ ID NO: 4230128 - RNA, 58 nt, Human
ggggaggguuuggaugagagucaggaaugggacauggcucucugccaaccaccuccuc

SEQ ID NO: 4230129 - RNA, 130 nt, Human
guggaaaaauagcaacuuaguaugauggagagagagagcagacaggccuggguucaaauuugggcucucuaguuugucagguuugcaaccucgggcaaauucucuagcuucccugaacuugaauuucccc

SEQ ID NO: 4230130 - RNA, 65 nt, Human
gacagugauagaagguaaugccccaagggucugucccuaguuuauuugccuucuuuaugucuguc

SEQ ID NO: 4230131 - RNA, 57 nt, Human
uccugcaugcuagugagugcuugucauaagaccaaaguuaccacugaugcaacagga

SEQ ID NO: 4230132 - RNA, 59 nt, Human
cagaguccuguaguauugcuggugugcugcagaaaagccagcagaugccagggucucug

SEQ ID NO: 4230133 - RNA, 85 nt, Human
ccaggcguuuccaacucugaguuuacaguauguuuugauuugaucauuacagauuauaaauuugagcugguuuuaaaauuucugg

SEQ ID NO: 4230134 - RNA, 91 nt, Human
gagagugaggggggugguuccuggaucugacugccugugcacagcuuuggcacuaguuaggauucccaggaaaccagcuccugcuagucuu

SEQ ID NO: 4230135 - RNA, 74 nt, Human
gggcccuuuaugauguagccuagagcugugcaguguacaaccugugcagcuguacgugaucuacaugguggccc

SEQ ID NO: 4230136 - RNA, 80 nt, Human
uucuuccugaugcucuggauguagucaagaacuuaaaauuguuggagauuggaaauugacacauuagagcuuguaaagaa

SEQ ID NO: 4230137 - RNA, 68 nt, Human
guggcaugugaauuguuacauugggcccaugggaaagaagguguauguaacaccauuuacaaagucau

SEQ ID NO: 4230138 - RNA, 115 nt, Human
gggagucagaacaguuaaguacuaaaaagacaaggaucuggagugagagucccuagggcuaugucacuggauucauguuucuuuaugggcaagcuacuuaacaucucugcauccc

SEQ ID NO: 4230139 - RNA, 68 nt, Human
uguugaacagucacccugggaguuuggugagcagcucucgcuccaugcuuucagggucacugucaaca

SEQ ID NO: 4230140 - RNA, 129 nt, Human
ggacuugccacggucccuggucuuggugggcugggcguggagcuggaaugaugugaggcucuccaggggagcagggacacacacucauauaugcacagccugcccaggcugugggguguggcucggucc

SEQ ID NO: 4230141 - RNA, 60 nt, Human
cugccccuagaggcguugcagcuguggcugccgugucacaucugugucauuagguggcag

SEQ ID NO: 4230142 - RNA, 82 nt, Human
ccuacaucccaagccagcuggaggagcagcuuccagucuucagagaugggccccucuucuucaguuggccuugguagucagg

SEQ ID NO: 4230143 - RNA, 85 nt, Human
agaaugugcuuuaaacaaugacagccuauacugucugcagggcgugcgugcugcacacuguaugcugguauuuggaagucaugcu

SEQ ID NO: 4230144 - RNA, 88 nt, Human
uuccugcacuccagaacggugcuccacaacugcccuaguuaggcucaagagacccuagguauggcuuguggcacagcucuggaaggaa

SEQ ID NO: 4230145 - RNA, 57 nt, Human
cugaccuugugauccgcccacuuuggucucccaaagugcuaggauuacaggugugag

SEQ ID NO: 4230146 - RNA, 67 nt, Human
gccgggagaggcggcgcaggggcccaguccaccgagcgccgggcggcccuugccugcacuccucggc

SEQ ID NO: 4230147 - RNA, 90 nt, Human
aggggucauuguuaauucuguugguuagaguuggagagggagcaucaugcugcuguuuaacccaaauaaccacaggagccaguggucucu

SEQ ID NO: 4230148 - RNA, 91 nt, Human
gacuguuuuugucuaaacuuuguaauuugguuagauuucuuuaggcuaaaaguguuuaacaaauugcuuuuagagcaugaaguuuacaguc

SEQ ID NO: 4230149 - RNA, 68 nt, Human
agaagagugaguagcuugguuggugguacccuaaaauuagggcaugauuaagguacgucauuucuuuu

SEQ ID NO: 4230150 - RNA, 58 nt, Human
uguuuuuagcuguuuuuuggaugaguugauaagcugguacaaagucaaggugaaaaua

SEQ ID NO: 4230151 - RNA, 65 nt, Human
ggcaugcuggcacugaccagccuaaugcuggaaucacaugccuggguuucagugccaaugcugcc

SEQ ID NO: 4230152 - RNA, 71 nt, Human
uguagcaccuagaguauuuuaucacugcucaaggaaacauuugacuuguugugcggugcuuuggguuuaca

SEQ ID NO: 4230153 - RNA, 63 nt, Human
gcggcggccgcgggauggcgggcagcaggggcgccuagcugcgccgggagccggggccgccgc

SEQ ID NO: 4230154 - RNA, 82 nt, Human
ugaauaugugcuuuuuugucuugaagaaaugguguaucaauugauucugucaccgucagguuagaaugagcacuuccauuua

SEQ ID NO: 4230155 - RNA, 84 nt, Human
agaguuggggagaguuggaggguauguuaguaaaggguguauacaccuggaggcuccccaggcccuccacucucgcucugcucu

SEQ ID NO: 4230156 - RNA, 93 nt, Human
uucaaaguguaaugaauggagugcacagaauuaagggagaaauaucagauuugggacugaguuuuugccucgaauucugcguauaacuuugag

SEQ ID NO: 4230157 - RNA, 93 nt, Human
ccuuuuguuccaauccccaagcucuuuccacuaaaccacugcagaauagcaaucaugauuuagaagaaauuaauccuagguauggauaaaagg

SEQ ID NO: 4230158 - RNA, 99 nt, Human
ggcugagaaugucccuucuucuucugaucaggagucagagcuaaggcacaugucacagcagcucucucccaagaggcaggggagcuggaaggguaagcc

SEQ ID NO: 4230159 - RNA, 67 nt, Human
cugauguaguccuuauuugacauaaguauuuuauucacugcuuaauuguuagauagauuauagacag

SEQ ID NO: 4230160 - RNA, 58 nt, Human
ggccgggugggaggcagcggaggaaggaggcuggggcugcgcugcucccgcuguggcu

SEQ ID NO: 4230161 - RNA, 67 nt, Human
ccccgccucucgcucccagcuugccguacgacagcggcggcgcggcgggcggagccgggaggcgggg

SEQ ID NO: 4230162 - RNA, 68 nt, Human
aagauaagagaguacuuucaucagggaaguugguuucugcaggauucccuagagagauuuuuauucuu

SEQ ID NO: 4230163 - RNA, 72 nt, Human
gagauuuguccauguugauaaucuugugaaggccuuaccugcaauggauaucugaacguggaagcagaauuc

SEQ ID NO: 4230164 - RNA, 116 nt, Human
gguggagaccagauuugaacuagggcagucagauucgggggccugugcauuuauccacuguuacacagugagguccaucugaaucuuauuccuguuucccuccucgggacuccacc

SEQ ID NO: 4230165 - RNA, 67 nt, Human
gaaacauuuguugaguacuugcuuuggacucaugaaaaaaguaaugaugaguacuuuacaaguuuuc

SEQ ID NO: 4230166 - RNA, 55 nt, Human
cauuucuugugagccgcauccuacuaaucuuguggcauugguuugcucgggaaug

SEQ ID NO: 4230167 - RNA, 55 nt, Human
acaucucacuucuuugaaggcuugagaucucagguccaaaggagacugagugugu

SEQ ID NO: 4230168 - RNA, 83 nt, Human
gcauagaguuggugacuuuuggcaucagccucaggaauaaauuaaauauuucuugggaaaugucagaaguguugauaucuagc

SEQ ID NO: 4230169 - RNA, 59 nt, Human
ccaaacauuucaaauuuagagauauuucuuuuaaauaucuuggggagacuaguguuugg

SEQ ID NO: 4230170 - RNA, 63 nt, Human
cuugggacucccuguagcagugccuggaaaaugguauguuuugcugcugcaggaauucucaag

SEQ ID NO: 4230171 - RNA, 110 nt, Human
cauacugaagaucaaauaucauaauguagaaauuugggaaauaauuaaugugaagucaggucuugaucacucuguaaauucucuaucugugaguauuguuucguuguaug

SEQ ID NO: 4230172 - RNA, 55 nt, Human
auggaggaugugcagcaugggcaggaaaagagccuucagugguguacauuuccau

SEQ ID NO: 4230173 - RNA, 72 nt, Human
ggaugagucugaagagagaauaagguaagauuuaugauuuuuuaaucuguccuuuccucuucaugacuuucu

SEQ ID NO: 4230174 - RNA, 60 nt, Human
gccugcuagauugucacuugaguguccuuagcuuaaugugggcaucugacaacuaguugc

SEQ ID NO: 4230175 - RNA, 94 nt, Human
acugaccauuugcuuugugggaaacagccuugcuucuaauguuuaucuguuuaguguaguagcuguuguuuuuuaaacaaagaaaaggaucagu

SEQ ID NO: 4230176 - RNA, 83 nt, Human
gaguuugagaugacuuaaaucacuguguugacccucuucugaaccaaaucuuuagcauugaugaaaauaguuauuuuauucuu

SEQ ID NO: 4230177 - RNA, 129 nt, Human
ugugccagggacugggccaggcagaggcugggguauccguuaguaagaugggcacggucccucgcugccugcucugauuuuugccccagcucugagagcagauuaaugguauuguaaguccucauugua

SEQ ID NO: 4230178 - RNA, 59 nt, Human
ucugcuuuucuuaaggggaucacucacaaaggggaaucuagcccuaaaaagagagcaga

SEQ ID NO: 4230179 - RNA, 91 nt, Human
cuggaagugcacagcaccgagaaggaagcaugccuuugcuggcagagucagauggguguuugugacuuugcucggggaagugcaugcccag

SEQ ID NO: 4230180 - RNA, 57 nt, Human
cagggugaagaugcgccuccuguugaaccuagcacagcaggggccugcuuggccuug

SEQ ID NO: 4230181 - RNA, 62 nt, Human
uuaagguggcauacaacacagcugguguauucugaaacggcuggguguuccuuucauuuuaa

SEQ ID NO: 4230182 - RNA, 129 nt, Human
auuaaaugcuucuuccuugguccgagugcuggugggagggaguccugggagcaccuuuuuacuggugcugcacccuucauuuucccauguagcugcuccccaacaccaccccaaggagcauuccuuagu

SEQ ID NO: 4230183 - RNA, 75 nt, Human
ccuuguguaugugaguaccugucaugugcccacguauccugguggcacaaaagguacuucauguagauugucagg

SEQ ID NO: 4230184 - RNA, 90 nt, Human
gcacagaggggaaggggggcaccugcaugcccggcugggucucuguagacaguggaucaugcgaggccuccccucuccuugacccugugu

SEQ ID NO: 4230185 - RNA, 62 nt, Human
ccagggaagaaagaugaagugccugguggcuccaaggcagccaccucauuuauccucuuugg

SEQ ID NO: 4230186 - RNA, 61 nt, Human
ugggccaggaugugguucauuuuaaaauaccaguguuuuaggaagccuggaguccugccca

SEQ ID NO: 4230187 - RNA, 72 nt, Human
gugggugccaguagcuuuuugcagacaagaguccuucugugcugugcugcagcgagagcuacgacauuccac

SEQ ID NO: 4230188 - RNA, 59 nt, Human
gagaagguggaccugaaggagcggguagagaaacuagagcuucaauucauccaccucuc

SEQ ID NO: 4230189 - RNA, 130 nt, Human
agcucagcaguguuuucagguuuucucuugucuauuuccugcaguuuuuccaugauacaggaugcuaaagaguaaauguauggguaggaaacagcuggauuuggauacugaaagauggaauguaggagcu

SEQ ID NO: 4230190 - RNA, 70 nt, Human
gaaggggacuccauggaaugauugcauagcagcccgcagcguagacagccuguuccgugguguccuuuuc

SEQ ID NO: 4230191 - RNA, 59 nt, Human
aagugauacgccugccucggccucccaaaguacugggauuacaggcagauguuuuauuu

SEQ ID NO: 4230192 - RNA, 72 nt, Human
ucuuuaaagaggaguagaacagauagucaagaaucaccagauucucuggggacugucucuauucaugaaaga

SEQ ID NO: 4230193 - RNA, 100 nt, Human
uuagacugugagcuccuugagggacuuugucauaaucacuguuacaucccagugccucacacuaugccuggcccuuaagaagugcucaauaaaugucuga

SEQ ID NO: 4230194 - RNA, 78 nt, Human
gaagaggaagggguagccguugggguaacuggacagccccaggcucguauaguugcugcagaugguccuuacuuuuuc

SEQ ID NO: 4230195 - RNA, 98 nt, Human
uacagaagcuuggaagugccaguuaguagacuuuuccauuuaguaaagugcugaauaaauaaacuuuuacuacaacugguuucuuuaaaguguuugua

SEQ ID NO: 4230196 - RNA, 125 nt, Human
aagguggcuuuuagcauucuguguuuccaaauaaugaauuugaacaccagguuggguuaauuaaagcuuuugguauaauuuaaaauuaaauuuauaaaugcaguugucuuguuacaagccaccuu

SEQ ID NO: 4230197 - RNA, 65 nt, Human
caguuuuggaagaaacaaggaaggaaacggcuccugugcagcucccuguuucagggccagaacug

SEQ ID NO: 4230198 - RNA, 115 nt, Human
ccagccgcuucccagagcuggaggcagcggcgucccagcuccgacggcagcugcggacucgggcgcugccugggcuuccgggacccgggccugcuaggcgaggucgggcggcugg

SEQ ID NO: 4230199 - RNA, 76 nt, Human
ggggagggcugagcacgguugagacuuugccacuuaguuaacaucagagaaucaaccucccugcucaccccuccuc

SEQ ID NO: 4230200 - RNA, 106 nt, Human
ggcuagagggggcagcagugaggugacuucugaaccuggagugagcuuuccugcucuauuaauggccaggagucaugcauuuauucucugcugauucucugaagcc

SEQ ID NO: 4230201 - RNA, 80 nt, Human
gacagcaaagaugaucacagugucagucauuaggaauagaaguccaauccuuuugccuauuguaucaucguauugaaguc

SEQ ID NO: 4230202 - RNA, 59 nt, Human
gggggggcagccuagaggguggggucaguuggccuccccugccugugcuguugguuucc

SEQ ID NO: 4230203 - RNA, 79 nt, Human
uaguuaggguuuguagccauuuucuagagaguuaaagccaugaugcaucugacaucuagauaaaugggacaccaaacua

SEQ ID NO: 4230204 - RNA, 55 nt, Human
gcauguucaaguuaguauauuugagguugaacuaaaugugcuaauauuaauaugu

SEQ ID NO: 4230205 - RNA, 72 nt, Human
cugauaaaagccuggaccgacacaggaagggaaacaagguccuuucccuuucuucuugguccaccuugucag

SEQ ID NO: 4230206 - RNA, 76 nt, Human
gugauauaacaauuuagggaauaaugggagaauaaaaagcauauuaguuucaaucagauuuccuggcauauaucac

SEQ ID NO: 4230207 - RNA, 58 nt, Human
gugagugggaaaauugugauucuuucuagucuaggauuuaauugcauuuuucucucac

SEQ ID NO: 4230208 - RNA, 62 nt, Human
auucaggugccucugccccacgcgguguccuggagaagcccgugggaugagaggcccuggau

SEQ ID NO: 4230209 - RNA, 111 nt, Human
gugauuguuacaagaguaauauuuuguuuaucaguagacucaaguucuuuggucuggacuucugacuugaagcucucugguuuugugaagauuuucaaagaguaaugucac

SEQ ID NO: 4230210 - RNA, 67 nt, Human
cugaaacuauggggaggggagcagaguucaaguaccaaauugugguucacccuucucuggcuuucag

SEQ ID NO: 4230211 - RNA, 72 nt, Human
ugggaguccgugccuuuaguuucuucuguagcaugagccacaggacaaaaaucuggauggcaaguguuccca

SEQ ID NO: 4230212 - RNA, 79 nt, Human
agagacacauuagaugacucuuucuuucuguucaucacuaacacuaagcuagaggggaagaacaauuuaauuuguuucu

SEQ ID NO: 4230213 - RNA, 59 nt, Human
guggcaagcuguuggcagauagcucugcagaaauaccagggccaggcagcagcugucac

SEQ ID NO: 4230214 - RNA, 62 nt, Human
guugcuuuuggcagcaguguuuauauuuucaacgugagggugaacaaugcuccaggagauac

SEQ ID NO: 4230215 - RNA, 61 nt, Human
uuccuaauguccaccuaguccucuuuuacuuuucuugguaggguuaggguggcauggggaa

SEQ ID NO: 4230216 - RNA, 79 nt, Human
ugcacaucacuucuaugaucugucucuugcauuugaggccaagcgcccggagaggcagcucaggaggucagaugcugca

SEQ ID NO: 4230217 - RNA, 56 nt, Human
acuauauaaugcacacaguauauuauauuguuugugugucugugugugauaauagu

SEQ ID NO: 4230218 - RNA, 68 nt, Human
ucuucagacuguuguucuuuuggagccacaguccaauggucccagccacagaaacaacauucuggaga

SEQ ID NO: 4230219 - RNA, 64 nt, Human
gacuuauuugcccauguuuagcagauuuuuaccugagaacaaccucugggccacuugauagguu

SEQ ID NO: 4230220 - RNA, 104 nt, Human
cucacaaauggaugucgaugucauuuauucucuuauucuacagaccuucauuggcuacauggguaguaugggcaagagauaggugguccugacggaggaguggg

SEQ ID NO: 4230221 - RNA, 59 nt, Human
ccgugcaguuucucacacacaucucuuuuucugauucuguguucagaagaggcugccgg

SEQ ID NO: 4230222 - RNA, 106 nt, Human
guggcgugcccggcuucucuccuuggccaccuccaugaucuccuggaaggaggcauuguccucacucguguagcggcucaggaagacaucuaggcugggcagcggc

SEQ ID NO: 4230223 - RNA, 66 nt, Human
guugguggcagggucguagcgcuccacagcauucaggucauugugguagucacggcccgccacagc

SEQ ID NO: 4230224 - RNA, 72 nt, Human
ccaucgggaauaguuaaaggaagccauauguucggucuguuauuuuagacuuaguggguuccauuucuaugg

SEQ ID NO: 4230225 - RNA, 70 nt, Human
cccagcguguauuccagaccuuaacgaagcaacaaggccugcacguagacaacugaaaugcacagauggg

SEQ ID NO: 4230226 - RNA, 69 nt, Human
gagaccaagcgugggugauaaugaacucugaaaacauuuuauaaaacaauuauccccauucuuguucuc

SEQ ID NO: 4230227 - RNA, 56 nt, Human
cauaggcuguggcagcuggaagugguagugacuaaugcuggaugccaagggcugug

SEQ ID NO: 4230228 - RNA, 63 nt, Human
caucaaaugcaagagcguucuuaacuuuacgacagaaaggauacauggggcguguauuugaug

SEQ ID NO: 4230229 - RNA, 76 nt, Human
aagaaaggagauauucuuuuagcugguuuucaaucuaugcccuaaauuagaauuuugagaaugucauuccuuuuuu

SEQ ID NO: 4230230 - RNA, 83 nt, Human
gggacucacuggagaucuuuguaaguaaucaaagcuggcccuuuaucuuugauuuuggcuuuuagggaauucuagggacuucc

SEQ ID NO: 4230231 - RNA, 66 nt, Human
caucaugacaacuucaguaaaguagauuccaugagggucugauaccugcagguuguccgucugaug

SEQ ID NO: 4230232 - RNA, 65 nt, Human
gcaggacugauggagcauauguauauguagaaaaauacccagucauguguucugauagugcuugc

SEQ ID NO: 4230233 - RNA, 65 nt, Human
uguugcccaggcuggagugcaguggugugaucucgacucacugcaaccuccaccucccggguuca

SEQ ID NO: 4230234 - RNA, 83 nt, Human
cgccuuuagcaaacgcccguuuagcaaacgccuccuccguccuuuggaggagggcggggcuaaaagggagaugcugccuagug

SEQ ID NO: 4230235 - RNA, 78 nt, Human
uguggcagguauuuuuuuaacauuuauuguaggcucagcugucuacuggguguucugagaaaauacaaggaagcuaua

SEQ ID NO: 4230236 - RNA, 72 nt, Human
uaugauguuuagcuucacuuuuguugaugcggucacacagauuuugcacagagggaggcauaaaauuuuaua

SEQ ID NO: 4230237 - RNA, 55 nt, Human
acagagcucccagccaucuccucccuguucuggaagacugaugggaagacucugu

SEQ ID NO: 4230238 - RNA, 87 nt, Human
gcauuaauaaagacaauuucgagcuguagucaaauuuggagggaauaaacuaccccuuuuccuuauacugaaagucuuuuaauaugc

SEQ ID NO: 4230239 - RNA, 110 nt, Human
gcugacguuuuauacacuuuugcagaugaaccucuuugugaaugucaugagcaguuaucagucuaucaugcagaguagaaagggcaaagcugaacuguaagggcgucagc

SEQ ID NO: 4230240 - RNA, 79 nt, Human
aaccuaagaccuuuuugaaaucacugucuagccucucuguauuuugcugguuuagucaauuagaaagaggccuuggguu

SEQ ID NO: 4230241 - RNA, 78 nt, Human
ggccccauuucucuaaauggucucuuuguucccugcugggcugcucaguaucagaugugauuaaagggagaugggguu

SEQ ID NO: 4230242 - RNA, 69 nt, Human
uccuuuucauuucauggaauacaaugccuaacucaaaaugucuuugugcuuguacuuaugugagaagga

SEQ ID NO: 4230243 - RNA, 72 nt, Human
guguucccaccuaggaguguuaggaaguuguguuuguguuucaagcagaaaaacugagcuccaagugagcac

SEQ ID NO: 4230244 - RNA, 60 nt, Human
gagcgcggcgcggguccucggccuagcucucgccggacgaaggccgcccgcugccgcuuc

SEQ ID NO: 4230245 - RNA, 64 nt, Human
cuccuauaaucccagauacucagguggcugcaacacaggaauugcuugagcccaggaaguggag

SEQ ID NO: 4230246 - RNA, 62 nt, Human
ucuugccugcccugugucauaaaaggggagucccuuacugcauuaucaaggggaagguaaga

SEQ ID NO: 4230247 - RNA, 81 nt, Human
ucuccacauacauauauaggcugaaaaauagaauuaaacagaguuauccugaaauuuuauuuuuuccccuagauuuggagg

SEQ ID NO: 4230248 - RNA, 59 nt, Human
gcggcggcgguagcaaaaaugaccccgggacuuugcccuggccgcuaccguugggcugc

SEQ ID NO: 4230249 - RNA, 55 nt, Human
gauugauguaggugauaaaucugaccuacuuccuagauuuaacgcugcgucuguc

SEQ ID NO: 4230250 - RNA, 55 nt, Human
caaauguuugguggcauuuuguucacaaaaggauagagugugugcaucauauuug

SEQ ID NO: 4230251 - RNA, 55 nt, Human
ugccuuguagccaccgggucacuugauaauuaaagugaccuguuaugcaaaggca

SEQ ID NO: 4230252 - RNA, 57 nt, Human
uguagcaauauaucagugcacaggcgcaucccaggccuguacagauguaugucuaca

SEQ ID NO: 4230253 - RNA, 71 nt, Human
uaauauuuaugaguauagugcaccauggugauguacacguucugucacuagcacgccuuaccguaagauua

SEQ ID NO: 4230254 - RNA, 89 nt, Human
gucaggccugagagggagagggagagaccuccgugccuuuuagccaaagaggauauguccuuuuuuuccccuucccuuuccaccgugac

SEQ ID NO: 4230255 - RNA, 66 nt, Human
cagaacugaauaaagccaggauuuccccccaaccuccaagaugucuggacucuuuguuuaguucug

SEQ ID NO: 4230256 - RNA, 97 nt, Human
ggaacacuuugaaacuuuacagacuagagcuuuccagguagcuaagguagaauuccauagugaguagccucagucugcaagugugacaaggugaucu

SEQ ID NO: 4230257 - RNA, 66 nt, Human
ugucuuggcuccuucacagggagaucacaugacaugccaaaguccccuauaugaggaagccaugca

SEQ ID NO: 4230258 - RNA, 67 nt, Human
gccuccggggacgcagucgccgccugcagcagcggcagcagcuggcggagggcuguguccccggcgc

SEQ ID NO: 4230259 - RNA, 84 nt, Human
ccgucugucaguaggaaguaaucgugaucgagagaucagcaugucuguuggucugggaagaucacaauuagauucuaaaggagg

SEQ ID NO: 4230260 - RNA, 82 nt, Human
acauuuuugguaagggugcuucauaggugaugcuguguauuucauacugcaucacagcaggaggcacauaauauuaguuugu

SEQ ID NO: 4230261 - RNA, 71 nt, Human
uggcuguagggaggaaggguuggaaaaaagagaagauguuuucuaucuuggaccuuuaccuaaaauaggca

SEQ ID NO: 4230262 - RNA, 57 nt, Human
gcuuuuaguuacuucuuaaggcuggauuauagccuuuccaguuuguguaagaaaagc

SEQ ID NO: 4230263 - RNA, 57 nt, Human
guauggaguuuuguugcacuucaggucauuccaacagguggugacgaugcuccguac

SEQ ID NO: 4230264 - RNA, 58 nt, Human
ccccagugguugcaacagcagaggcuuauugcuugcugugcugugugucuacuguggg

SEQ ID NO: 4230265 - RNA, 68 nt, Human
gucuuccauagcuagcaccuucuuuucuaggaaacuuguaaggaaaagaauuguuaguuagugaaggc

SEQ ID NO: 4230266 - RNA, 77 nt, Human
cuuuuguuccagaaacccaggggaagccagaccucuacaaucgggcacuuaaauuacccuugaauuugugacaaaag

SEQ ID NO: 4230267 - RNA, 88 nt, Human
aagguuuuguucauuuuuuuggucauaugagauauguuauuuuacauuuugcuugucuuuagagugaacagaagauugguugagcuuu

SEQ ID NO: 4230268 - RNA, 122 nt, Human
aucucacacccaaacucuuuagcuaacuuucucuacuccuucauauuuuaauugaaggcuucccugaucaagugauacuuuaggaagaucugaaggaagaaauaguuaacaguuugggagau

SEQ ID NO: 4230269 - RNA, 83 nt, Human
gaaugcaguaucuuccucaugaacacguacagcucuuacaagaaaaugagaauacgguuuggggaggaggaucccucacauuc

SEQ ID NO: 4230270 - RNA, 117 nt, Human
uccaccccggacucuuggucacuguuggcugacagaucuggaucugaacuuuucagauugucuuggguuagaaucagagcagaaucuucaucgccuugugaagggcuccgggaugga

SEQ ID NO: 4230271 - RNA, 70 nt, Human
guggaagggaaaccgcacuggccuuggccugucuugggaccugaacuuggccugcuguucacccugccac

SEQ ID NO: 4230272 - RNA, 66 nt, Human
guuugcagaugaucaagaauuuuguauuccagcaggaguucaaaucuuuuggaucuucucgccaac

SEQ ID NO: 4230273 - RNA, 60 nt, Human
ggagcagaggaaagaguagcaugccuucguauuuuaacgcaaaugucuuuuuccuccucc

SEQ ID NO: 4230274 - RNA, 72 nt, Human
gcauuuggguuuuuccuuagggacuggcauuuaaauugauuugucagucaaaaaaccuagaaacaccauggc

SEQ ID NO: 4230275 - RNA, 118 nt, Human
cccauuugucaucuaaaugguccguccccuucuuaaacaucauuuuggcccaagguccauucauggggccugccggguguuccugggaagaugggcagaaaaucccaaggcaaguggg

SEQ ID NO: 4230276 - RNA, 80 nt, Human
aauuuuucacauuuugggggacauggucuauauuuuucucagauuucugauauguugucuuuuaaaaauguguaaaaguu

SEQ ID NO: 4230277 - RNA, 67 nt, Human
aguggggaaauaucaauauuugaucaaauuaacacuaccuccuucccaguguugguguucacucacu

SEQ ID NO: 4230278 - RNA, 55 nt, Human
caaauacguuuggcuggagcacccugaagucucugcuaccauccaagcugguuug

SEQ ID NO: 4230279 - RNA, 58 nt, Human
ccagggcuggaggaggucaggaugcuaggagguccucccugagucccccagacccugg

SEQ ID NO: 4230280 - RNA, 74 nt, Human
uccauuuccccaucugugaaauggggcugcaacaccugucaugcagaaguauuguacggugggaaguauaugga

SEQ ID NO: 4230281 - RNA, 67 nt, Human
cguguggaucauagcguuuacauguggauuaacauuugcuaauccaaaacugaaucuguggcacaug

SEQ ID NO: 4230282 - RNA, 129 nt, Human
cgagagggagcucccgaugcuuggggaccgugugccgguggccaguggcggcgagggcucggccaugugggaagaggcaccuuccgcccacugaccgcccucuccccgagcuuuggcgccauccucucg

SEQ ID NO: 4230283 - RNA, 68 nt, Human
cagguaguuagaaugaccaggacuguuuuacugcuaaauucaguuuuccuucugguacauacugccug

SEQ ID NO: 4230284 - RNA, 64 nt, Human
ggugcuugcuguccgaugggucuguauucaacauuaaauacaaauugccugacggcagguaacc

SEQ ID NO: 4230285 - RNA, 55 nt, Human
caccgagagccacuuccggaacaagcgucgcguuucugaggagaaacucuuggug

SEQ ID NO: 4230286 - RNA, 76 nt, Human
cugaaucugccuccgaggguuugaaugaagagagucuaaugaagggacuacugcagaccccuggggaggauuauag

SEQ ID NO: 4230287 - RNA, 67 nt, Human
ccaguggggcuuccagacgcugagucgcugucacucugagcugcucagccgcuggcgaguccacugg

SEQ ID NO: 4230288 - RNA, 75 nt, Human
gaguaagaugcuggaguucauauuggacauaagcaguggacauuguuuuccuucugauacuccauuuaucugauc

SEQ ID NO: 4230289 - RNA, 62 nt, Human
gcugccucucaugccugcuugcugcugcuuccuucuaagcagccacggcaaugauaggcugc

SEQ ID NO: 4230290 - RNA, 63 nt, Human
uuuauuugggauuucucaucugacuaggcuugcuuuuuagagacugauggaucaccaaauaga

SEQ ID NO: 4230291 - RNA, 81 nt, Human
uuaucuaaaacacaguuucucuaugagaguucagugaaaauuccccuucccaaacugauucuaugaaugacuguuagauaa

SEQ ID NO: 4230292 - RNA, 81 nt, Human
gagaacuauagaaaccuggucucucggugagaauaaauauaccccagauuuucuaauauaccaucaggcuucuauuuucuc

SEQ ID NO: 4230293 - RNA, 73 nt, Human
gaauauagucuuaaguaguagacucuuguuuuaauuaauaaagcuacgaguuaaauagcuuaggauucauuuc

SEQ ID NO: 4230294 - RNA, 90 nt, Human
uacuacuuuauguucaauaccagguucuuuucauuucucuggauuauuuugcaaaucauuggacagagaauuugggaauauaaaucugua

SEQ ID NO: 4230295 - RNA, 81 nt, Human
ggcucgaacucuuuagaaugaaugcaagagaauuauauuugagauaacacuuacugcauuuuucuauaggaagucagggcc

SEQ ID NO: 4230296 - RNA, 78 nt, Human
aaauuaaagaggaauaauaaaaauugcaaaaauaaaaaaaaacuuuugcaaauuuuuuuauuuuuccuucuuucuuuu

SEQ ID NO: 4230297 - RNA, 87 nt, Human
ggagucuugcucuguugccaggcuggagugcaguggcgcaaucucugcucacugcaaccuccaccucccggguucaagcgauucucc

SEQ ID NO: 4230298 - RNA, 78 nt, Human
augaguuuuuuaauccucuugguaucuuaauuucuccaucuacccaguaaggcuguuaggaggauuaaaugugcucgu

SEQ ID NO: 4230299 - RNA, 82 nt, Human
gcgacggugcaggcuggggcuuggcucacagaagcugcaggagcuucagcgacuguaagagggccccgggcuccgcagacgc

SEQ ID NO: 4230300 - RNA, 63 nt, Human
cuaugauagccacagaauucugaguagaaaguuuuucgacuccauuuuucuugguucacguag

SEQ ID NO: 4230301 - RNA, 117 nt, Human
guaguggauuuaacauuaauuauuaucauuaucuuccugugacaccaugcucugcucccuuugccugaaaaguugcaggaaaauaauggugaugggaaggggaaaacguccaacugc

SEQ ID NO: 4230302 - RNA, 78 nt, Human
gauguuuugaaagaagaauacauaagccuuaugacucaguucucaguagcuucuucaguaucuuucuuuuaaaauauc

SEQ ID NO: 4230303 - RNA, 66 nt, Human
aagaaaagcaucuuuguaguagugcuggaaaacuauucagaauauacagauaaaaaugcuguucuu

SEQ ID NO: 4230304 - RNA, 66 nt, Human
gauuagauacaugacucacacauucugcagucguauuuugcaguaaauugagagucauguuugauc

SEQ ID NO: 4230305 - RNA, 129 nt, Human
uggcuuagaagauggagaaaggggaaaauaagccaagggcuguaggagcuggaaugggcauaaaaauagauuguuugcuagagccugcagaaggaacuuggcccugcugacaaccuugauuuuaggcca

SEQ ID NO: 4230306 - RNA, 57 nt, Human
guaugucacguaaaaacuagauuucuggauucuuuagaaaaucuaaugugacaaugc

SEQ ID NO: 4230307 - RNA, 60 nt, Human
cuggaaugguuagugaacaaauuugcuguccagguaaauuugugaauuagcuaucaucag

SEQ ID NO: 4230308 - RNA, 97 nt, Human
uguuuuguggcuuuuuaaagaagugucuuacucccucuucucucauuuuuuucugccuugaaaaggggugguauuucuuuuggggucaacaaauaca

SEQ ID NO: 4230309 - RNA, 74 nt, Human
uaggcuaggccuaggauuaaaauaauaauuaguaugagagcugugcuaauuauuaauuuuagguugcuugucug

SEQ ID NO: 4230310 - RNA, 90 nt, Human
uuccagauuuugcccagaaauuucccugcagugcuuaggaagcugccugguagagcagguuucuaaguuugaggcgaagcagcucuggaa

SEQ ID NO: 4230311 - RNA, 65 nt, Human
cuccccacacaugugggcacagggcugcacacuuuguguguuccucuuagucuuauguguaggag

SEQ ID NO: 4230312 - RNA, 55 nt, Human
uauauauacauauagaauauguauauauguaugcaugcccauauguguauauaua

SEQ ID NO: 4230313 - RNA, 119 nt, Human
cuggcucuuuccuuuuuaaauccgucuauagucuuggcaugccaguagccggcuugacuuucacaguuaagguuaucagagagucacuguucugucaugucaagucagccaggagccag

SEQ ID NO: 4230314 - RNA, 62 nt, Human
gaaaagaaugaugggagcuggguuugacccauucacucacucaguuuugaucguucuuauuc

SEQ ID NO: 4230315 - RNA, 123 nt, Human
uuuuccccagaagcaugcagggacuauuuucagaugcuugauuauggcaagaagaaagaaaaguaacgauuuuugguguaauacaagcaauuuguagauucgagcauacaauuuugcauaaaa

SEQ ID NO: 4230316 - RNA, 97 nt, Human
auagcacacauaguucaguaugaaaauaagagaauaaaaucuguuauaagcaagugauuuagguauuuucuuuuguguuuaugcauuaucugacuau

SEQ ID NO: 4230317 - RNA, 64 nt, Human
gguugagggaggugacaaggacauaggaguggcuagugggguccacuuccuucacaucaaugcc

SEQ ID NO: 4230318 - RNA, 109 nt, Human
acccugucauccagaucugcucgcugggccugcgcuggggggagccggagcccuuccuacgccuggcgcucacccugcggcccugugcccccauccugggugccaaggu

SEQ ID NO: 4230319 - RNA, 57 nt, Human
aaaagggucugacacugcuugaaacaaguuaacuuggccagcagugcggaucauuuu

SEQ ID NO: 4230320 - RNA, 121 nt, Human
ugugacugcucaagcacuuuguaaagaaauuaggauauuuuagaaugguacacuaugcauucaaaugaaaugugccuuucacuaugucauucuaagaaaacaaguguuuuuugcagucaua

SEQ ID NO: 4230321 - RNA, 59 nt, Human
gagaacaggaagaauccagaugguggccuuuugggggcacuaggauccuucuucuucuu

SEQ ID NO: 4230322 - RNA, 85 nt, Human
auggguuuauagaaaugagagauacauucccaaccugaguggaaauccaguucaguuuaauuggaucuuuuuccugauuucccau

SEQ ID NO: 4230323 - RNA, 67 nt, Human
ucuuuuuuuguagguguaugaaaacauuauagacugguauuuucaauuuucauuugcaagaaaauga

SEQ ID NO: 4230324 - RNA, 77 nt, Human
agcaucuccuucucugggaugagcuguuuccuggucacagucuggcucggcuggcucaucucauguucuggagagcu

SEQ ID NO: 4230325 - RNA, 79 nt, Human
cugucuucuguauuaaaggaguguauaauuguaguaguuuacugaaauggggacaguccuuagugguuguuuggagcag

SEQ ID NO: 4230326 - RNA, 58 nt, Human
guggguuggguuuuugaagggaagccagucauggaagcuuuucuagucccagccccgc

SEQ ID NO: 4230327 - RNA, 57 nt, Human
ccuauuuucaaaauuguuuaucccuucuaguggagaagauagcacaaagagaauggg

SEQ ID NO: 4230328 - RNA, 83 nt, Human
ccauuuagugagugugaaucaaaugcuaggcaccagacugaugcuuucuuuuugcuauuucauuugauccucacaauaaaugg

SEQ ID NO: 4230329 - RNA, 71 nt, Human
ucuauuuuuauaagagcagcagaguugucuucucaaaacggcugccaagcucugcuucuugggaagaugga

SEQ ID NO: 4230330 - RNA, 65 nt, Human
aaggauguuuaaacuacuuucccacuccaaggaccuuugggauaauuaaguaguuugagauuguu

SEQ ID NO: 4230331 - RNA, 111 nt, Human
ggggauguggaagaggcuuggaagcuuccaaagaccaggauugagggccaccuccaucacuucugcuccuuggaugccugauucuauuucucuuagaagauuccagacccc

SEQ ID NO: 4230332 - RNA, 58 nt, Human
guuguggguggucagcgugugauggcugcugucgucauguuauggcucauucuaaaac

SEQ ID NO: 4230333 - RNA, 77 nt, Human
guuccucugaaggauuuucagaauagaaaggaguucugcucugaaaauacugauuucugacugucccguagaggaac

SEQ ID NO: 4230334 - RNA, 63 nt, Human
cugugaagcuaguauuaacucagauuauucagaugagaucaaguuauuaaguagcuuucacag

SEQ ID NO: 4230335 - RNA, 55 nt, Human
gaggagcugggucagggagacaaaagucuucuauuagucuuauggauagcuccuc

SEQ ID NO: 4230336 - RNA, 57 nt, Human
gggcuuuuccauuccaggguucucaucccuuugagcauucaaagaagaggaaggccc

SEQ ID NO: 4230337 - RNA, 63 nt, Human
ggguuuuaccagauguguggugaguagauagacacugaugagaaacacgcaacuguaaaaccc

SEQ ID NO: 4230338 - RNA, 75 nt, Human
cccacuucugccacuaccaugcuggaugaccuucagaaggucauuagaccucucugguucagugagcuagguggg

SEQ ID NO: 4230339 - RNA, 67 nt, Human
agcaaggaagaagggacagaauuuugggaauaagaagcccuaaauucuauauccuugcuucucuguu

SEQ ID NO: 4230340 - RNA, 61 nt, Human
agggggauuaaaaaucaccaaaguacugaaggaacacgugcuuugauuauuauucccaccu

SEQ ID NO: 4230341 - RNA, 59 nt, Human
agauauuauuuucuauuuaucaacugcauucaggcagugcuaaguagaugacugaugcu

SEQ ID NO: 4230342 - RNA, 84 nt, Human
gccuuggucuuggguguugguuccugggaggugacagcaaaggcaacgccggcuucucugaggaagcgaucuuuaggccgaggc

SEQ ID NO: 4230343 - RNA, 117 nt, Human
gccccgaggaggcggaggcacgcuccggcgaggcgagaggguuggguuagcaggcaucccggucgccccuuccuucuuuucgccggaguugaaucugugcugcccguguccaggugc

SEQ ID NO: 4230344 - RNA, 59 nt, Human
agaaaagagacaauguuuuuggcauaccagaauaagucuaauauauuggucucuguucu

SEQ ID NO: 4230345 - RNA, 63 nt, Human
uuucgucauuuguaaaugaucaagaguucuugugcagcucugaucagaagacaaaugaggaga

SEQ ID NO: 4230346 - RNA, 61 nt, Human
uuucuggaaacuguaaagaggacaaggccagcaaauuguucauuugccugugguucagaag

SEQ ID NO: 4230347 - RNA, 97 nt, Human
ugggucagaugaccuuguuagcgacuugacagacauguccuggaugcucuuuguucccaggaggcucucagguccucccccaggguccugucacuca

SEQ ID NO: 4230348 - RNA, 66 nt, Human
cccgcuaaaucaguucugagucaagauuuaugcuugacucacuguuuugaaauugaacuuaggggg

SEQ ID NO: 4230349 - RNA, 56 nt, Human
gcaauaaguuuucucuucugucaagauagugcuaauggaagggaagucuugguugu

SEQ ID NO: 4230350 - RNA, 68 nt, Human
caggggagggcuggccuuuggauggccuucugaucccaagcccauccuccuggggcagucuucccuug

SEQ ID NO: 4230351 - RNA, 111 nt, Human
uauugacgaaagaagagaaacagagacacggaagcuaaagaguugggaauccuaaaggucaaaggauguuucucaguuacucugauguccuguguuuucuuucaguuggua

SEQ ID NO: 4230352 - RNA, 86 nt, Human
ucccaaggacuuagucuagcagagauaaagacgugaauuacaagauaaugcucuuaauugcuagauaaguacaagaauccuuagga

SEQ ID NO: 4230353 - RNA, 80 nt, Human
ucaaguuuaaaacagggcgugaauaaugaagagguccccaaauggcacucucauaucuguacacccuuguuuuucucaga

SEQ ID NO: 4230354 - RNA, 68 nt, Human
guucucuccugcuggugauggacuaggccuuuuagaacuagcaagaucccucacacagcugggagaac

SEQ ID NO: 4230355 - RNA, 55 nt, Human
ugauugggacauuuuguuuucuuagcuaugcuuuauaacaaaauaguucuaguua

SEQ ID NO: 4230356 - RNA, 66 nt, Human
ugccuggccuccugauucccuccuguccccuucucauuccccaggggcuuaucugaggccugggca

SEQ ID NO: 4230357 - RNA, 63 nt, Human
ggccugagucucccauaggcuaaguauuugcccugagucauaaagccagugggaggcagugcu

SEQ ID NO: 4230358 - RNA, 68 nt, Human
uucuaccaguuuuuugaccauggguggguuaaaaucaagccucacuugauugucagaaaaauggugaa

SEQ ID NO: 4230359 - RNA, 68 nt, Human
aauauagccuuacaagauauuauacuuuggugauugcagacuauguauauccagguaagggcuacauu

SEQ ID NO: 4230360 - RNA, 55 nt, Human
cggggcuccgaagagcucgguucagaucccggccgccugggcuccaggagccccg

SEQ ID NO: 4230361 - RNA, 79 nt, Human
gugugcacaugugugugcgagcguguguguguguggacuugcucacgcgggcacauaugcuguaagcacauguguucau

SEQ ID NO: 4230362 - RNA, 59 nt, Human
gcucugaacugucaugaauuggaauuuucuaguaaaacacaauguuggcaguauagagc

SEQ ID NO: 4230363 - RNA, 71 nt, Human
guuucguguuugcguuuaguuucaagacacgucgacaaaacgacugucauuaaugaauguaauaacgaaau

SEQ ID NO: 4230364 - RNA, 59 nt, Human
uucucaauggcaacuuguugcuuggauucucaucagaagcaaauaauugucuuugaggg

SEQ ID NO: 4230365 - RNA, 75 nt, Human
augugaauuauaggguuucaugcugguuuccagauuuuauuguuuggcuacguacaauggaacuuuaagucauau

SEQ ID NO: 4230366 - RNA, 75 nt, Human
ggcuuugagggagcaggucuuugguaaugcuuacgaucgguggagagcuuuagcugagaccugcuuuuacagacc

SEQ ID NO: 4230367 - RNA, 55 nt, Human
uagcagcacuauuuguuguagugcagagcuagaugcaauccacagaagucugcua

SEQ ID NO: 4230368 - RNA, 63 nt, Human
uacauggauguuauccuuacugcuaugaauaucaaacuauugcuugaggauugagguccagua

SEQ ID NO: 4230369 - RNA, 59 nt, Human
ucuuuucacuucgaucagaguuuuuguucuagcacagagaccugaaugaguugaacaga

SEQ ID NO: 4230370 - RNA, 80 nt, Human
ugguaaggaugagggaaagaugaaaaucuaggagucugcucucagauuucuuugcccauguuuccuaagcucuuuaucca

SEQ ID NO: 4230371 - RNA, 61 nt, Human
uuuguuuaguuuugcaccaauaaaacuguguacuacuguuuguugguuuaagaguagcaga

SEQ ID NO: 4230372 - RNA, 62 nt, Human
cuggucuaauugguuugaauaaauaaagaaccggaaucuuucucauccaaacuaguugccag

SEQ ID NO: 4230373 - RNA, 98 nt, Human
guccaucaugcgccauuaagaaggucucucgggcuuugcugaggaacucuauaaacucacuauagugccgaggacugaugugugugagccgugagugc

SEQ ID NO: 4230374 - RNA, 78 nt, Human
augugacuaucaacagcaucaggguguucuuuaggaugguggaacuguucagcauccugacuaugguggugguuacau

SEQ ID NO: 4230375 - RNA, 79 nt, Human
aggugcaacaguaagguuggaugcaaucaacuuugauugugggcuucucagaguugguucgucucgccuugaguuuccu

SEQ ID NO: 4230376 - RNA, 64 nt, Human
uuuccaguaaguggcaaggagcuuaauguacuaauauuuucauguuuuguccaccugcaggaag

SEQ ID NO: 4230377 - RNA, 130 nt, Human
ugaaaauucugaauuacuuucauugcaaauaaaccuuaacaauugugagaguuagagagcauacuuuucacauaagacuuugguaugcugccuaaagcuacuuacauaauuugcuauucagagaaaugca

SEQ ID NO: 4230378 - RNA, 98 nt, Human
cuuugggaguuuucaguggguggauucgggaacuuguuaaaaugcagauuugcugggauaagugauucugauucacauggcuggaaugaggcccagag

SEQ ID NO: 4230379 - RNA, 67 nt, Human
ugcucuuugguugguuccugaugccugaagucuuuuucuucuguguacaguuagccaccaaauugua

SEQ ID NO: 4230380 - RNA, 79 nt, Human
cgggaagcugugccuauucguggcaaguucaagauaaaaugcauauguccuugcaaugaaggcacacuuauuuaucccg

SEQ ID NO: 4230381 - RNA, 63 nt, Human
gcauggccauagccuuauagcaggaccuuucauaacaguccuuuuauccccuaauuggccugc

SEQ ID NO: 4230382 - RNA, 65 nt, Human
aaucuggccuuaucacaaagcuagagagacccaaaauucucuuugggaaacuuaggggucagauu

SEQ ID NO: 4230383 - RNA, 61 nt, Human
guggaaggaauuaacagacuagaucucuuuucacucuggucuccucuuaauugccuacuac

SEQ ID NO: 4230384 - RNA, 60 nt, Human
uuucguugcacucauaugguuguuacugcgaaggugaagaacuaaugacugcagcaggaa

SEQ ID NO: 4230385 - RNA, 58 nt, Human
uucaaaaugcagaauaguuuggucugcauuuuucugccagucuuaucugcauuuagaa

SEQ ID NO: 4230386 - RNA, 94 nt, Human
gggaaaagaggauuuagaugcugagcuuaagagaauuccuuauaguagaauaaguagguucaaucucucaugcauuuucucuuccuuuuuuccu

SEQ ID NO: 4230387 - RNA, 102 nt, Human
ccuaagccuagcgcccucaccuguucaacagcaauaaucaggccugucuugccuaccucacuagauuauugcaagcagugaagggacgugaacaggcucugg

SEQ ID NO: 4230388 - RNA, 78 nt, Human
auaaauucuaugauggauugggaauaaacagcuuauccacaagaugaguaauaaacagcuuauccacagggaauuuau

SEQ ID NO: 4230389 - RNA, 66 nt, Human
acuaguguuaagggauugagauggaaugaucuuuuucaaguucauacuuuuuugacccuugugagu

SEQ ID NO: 4230390 - RNA, 61 nt, Human
gucagaagauagaggaaguuugggucccugagagagacacagacuucuacuaucuuaugac

SEQ ID NO: 4230391 - RNA, 73 nt, Human
caaaucuucuaaacugacagugagggagaguaauuugaaaggacugcucaacucaacgucauuugaagauuug

SEQ ID NO: 4230392 - RNA, 123 nt, Human
gguccaguacucuagcgcggccuggauggagauggguggugaaauggaugggaagauuugucaguuugccccagcacauuuacuauccuucccaccaccccgcccagcacauucaacuggccc

SEQ ID NO: 4230393 - RNA, 86 nt, Human
cuagcguuuaagcauguauauguguguagcauguuauacuguaacaagguaugugcgucuguguacagauguguuuugagcccuag

SEQ ID NO: 4230394 - RNA, 55 nt, Human
auacuagccugggcaucuccuaggggccaagucaggagacccaguuuucuagugu

SEQ ID NO: 4230395 - RNA, 77 nt, Human
ggaguaaguggggaacuuggcaggaaaauuauuuuaugauaaaauaaucuuuccagucaguuucccucccugacucc

SEQ ID NO: 4230396 - RNA, 73 nt, Human
ggggugaguuaggggccaugauggacgaggugauggccucauccucauccucguccucuggugcccucacucc

SEQ ID NO: 4230397 - RNA, 88 nt, Human
gaaaugguaaaguugacuguuuuacuuauguuuuugcaguaagaagcuaaacauccaguaucagaagcaucaguacuuuuacucuuuc

SEQ ID NO: 4230398 - RNA, 79 nt, Human
aaggcagaauguccuuccaccuguuuuaugcuguaagacaaacuuccaagugcgaggcaguguggagggcuguugccuu

SEQ ID NO: 4230399 - RNA, 57 nt, Human
ggguguuuuuggugacagggagaauuaagaggugauuccguucgguuaaaaaggccc

SEQ ID NO: 4230400 - RNA, 101 nt, Human
guaagaagaaauccucagacucuuauuuugaaguaauaauugaaaauuuaguaucaaauaauacaugugaugagaauuuggacuggauuuacugaacuuac

SEQ ID NO: 4230401 - RNA, 70 nt, Human
ugcuucaauuuuucucucaugugcaacuaguaggaaauuuucuggacuaaagggagagauugcuuaagua

SEQ ID NO: 4230402 - RNA, 69 nt, Human
gcaucaugggagugacagggccacuggcaagacuuuuugccagucagccuaguucuucuuuuaagaugc

SEQ ID NO: 4230403 - RNA, 61 nt, Human
cgggagagacagaggaggcgccuggcuucccccgcacgcccgccaccucugcucuuucccg

SEQ ID NO: 4230404 - RNA, 64 nt, Human
gugcuuuaccuuauuggucucgguucugaguuuucuaaaccuggagacauugaggagagagcau

SEQ ID NO: 4230405 - RNA, 78 nt, Human
agagaauuuagaaauggggugaagcaaaugggaucuguugauaagcuauugguaucacacugauuucaaauauuuucu

SEQ ID NO: 4230406 - RNA, 93 nt, Human
caguccaagcaccauaaacacugacaggaaugaagaugagagagugccuuugagacugugcacuuacuuucuauucuuguagguucuggucug

SEQ ID NO: 4230407 - RNA, 70 nt, Human
aguuguuuuccaaggcagacacauuuuuugucuuuucuaaaauaucguaagauaugugucuguuacaacu

SEQ ID NO: 4230408 - RNA, 60 nt, Human
gggcuguuugcauauguuuauagaguauuuaguuuacucuaaaagaugacaagacagcuc

SEQ ID NO: 4230409 - RNA, 99 nt, Human
agaaucgacagaauaauuagagaauagacuuuacccuguccuugaaggugggggauaagggggcuggguaaauauguauuccugaaugucuguuauuuu

SEQ ID NO: 4230410 - RNA, 64 nt, Human
guccuguguaaguacuugcucagcaugcucagagauucccaugccagcuuauuuacugcaggac

SEQ ID NO: 4230411 - RNA, 103 nt, Human
uugagaaggagucucacuccguggcccagguuggagugcagugacacgaucucggcucacugcaaccuccaccucccggguucaagcgauuuuccugccucag

SEQ ID NO: 4230412 - RNA, 64 nt, Human
gggcuucacucugagacuuggagccuagugugcuaagcucccaguucccaaagugaccauuccc

SEQ ID NO: 4230413 - RNA, 77 nt, Human
ggcgaauggaugcuggucaguuuggcaaauucacugaaacucaucaagaacccagcugaacuugcauuccaacuucc

SEQ ID NO: 4230414 - RNA, 68 nt, Human
ccuuuuguuucccuuuauguuccucucuccagcccacacauuccaggaagaugggggaggaggaaagg

SEQ ID NO: 4230415 - RNA, 96 nt, Human
caauuaagggguaucaguaugugaaauggaauauagaaaaguaggcaauucuuuacuuuucuauauucaguuucauaaauuaauaccccauaauug

SEQ ID NO: 4230416 - RNA, 80 nt, Human
gcauucagaaggagagcugucagcguagcaccgaauucaagaccaaggcgugcuaccugagcugacagcuuuuugaaagc

SEQ ID NO: 4230417 - RNA, 72 nt, Human
guggaggguugaagucugguccucauccagcucuguccauucugagaugcugccuccucuucagccgcccac

SEQ ID NO: 4230418 - RNA, 77 nt, Human
aggaaguacuuggaaaaaugcccacuccaguuguuauuuguaaaauguccaguuggcauuuuauuuaaguauauucu

SEQ ID NO: 4230419 - RNA, 70 nt, Human
gugaggcaguuuccagacauuauugauauacuuucaaguauaucaguagaacaauggacauugagugcac

SEQ ID NO: 4230420 - RNA, 63 nt, Human
uuggaggaaguucuggaauuacuaggaacaggguuucuacgugggaguucaggauuccuucga

SEQ ID NO: 4230421 - RNA, 89 nt, Human
ggggaucucuuccagucgggacuucuggggacuguagauugacuggggucgcucuccuugcuagagguucuagauuggcuaugauuucc

SEQ ID NO: 4230422 - RNA, 91 nt, Human
uugaagccuuucacaaguagugcgcugagcuuuucuuauugaagagagugaauuaguuucugagaagucagucuauugugaaaaguuucag

SEQ ID NO: 4230423 - RNA, 81 nt, Human
ccuugcagagauaagaagccgguaggggauucauaggcuuggcccuaggagcccccuggacugagcuccuugaggccaagg

SEQ ID NO: 4230424 - RNA, 74 nt, Human
aaugcagaggaauuuuaauaugcuugucucuugaagaauugagucaguaugacuuauaguucucucuuuguguu

SEQ ID NO: 4230425 - RNA, 79 nt, Human
gaacuuuugagcccuuuuaagggagacuagagaucuguaagaucuagucccugcccuugaagagcuuacaaucuaguuu

SEQ ID NO: 4230426 - RNA, 64 nt, Human
ucccaaagugcugggauuacaggccugagucaacaugccuggccuccuacaguacuuuuuaaga

SEQ ID NO: 4230427 - RNA, 63 nt, Human
gguagaggaugaggagguuggacguggugguggcuuugccuuggauauuccucuuccucuauc

SEQ ID NO: 4230428 - RNA, 93 nt, Human
cucccaccuccuugcgcgggugagauucgagagaugggggacaggccaggagcucagaccgcucuuugagacucucccgaaggagaaugggag

SEQ ID NO: 4230429 - RNA, 69 nt, Human
gcaggcucccccauggcugacagaccacgaugugcagaugcuccgucuguuggcacagggggagguggu

SEQ ID NO: 4230430 - RNA, 102 nt, Human
ucacauucugcguugacuccuuuaagaggucugaaacggugggagcaaacuuacucugcccguucaaauccuuguugucaauguuaaucgcaaagaguaugg

SEQ ID NO: 4230431 - RNA, 56 nt, Human
cacaggacuuggcuucucacaguucaggacaacagggagaauuccagguuucugug

SEQ ID NO: 4230432 - RNA, 70 nt, Human
gagggacuuguuuacaagcaguucugaccaccuuagugguguacuguuuucuaggcaaaaaauaucuguc

SEQ ID NO: 4230433 - RNA, 72 nt, Human
ucuuguggcuggguggaacugagucuuuuuuggugaaauguacacaguaguucuguucccccaguuacauga

SEQ ID NO: 4230434 - RNA, 69 nt, Human
ucugcgggccuggcucccagcgggcaccgaggucgcagcagggccugcugggagcugggccucgacagg

SEQ ID NO: 4230435 - RNA, 86 nt, Human
guuuugacuggcucuaucaggauaaauugacccuugcuucccaugguauuuauggcauuuauccuugggguagagccaguaccgac

SEQ ID NO: 4230436 - RNA, 78 nt, Human
ggcucugaggacccugggucagagcgacuucuccagccugcgcaggggguguuagucuuacccagaggguccagagcu

SEQ ID NO: 4230437 - RNA, 55 nt, Human
caaguauuuauugaggcccuguaacaaacaugucaggaacucuucugggugcuug

SEQ ID NO: 4230438 - RNA, 76 nt, Human
ggagcuggacagugguggggaggaggacgagaaggagucauugucggcguccucguccucauccgcgucaucaucc

SEQ ID NO: 4230439 - RNA, 64 nt, Human
uuaugccuguuaggcagcaucuuacgcccaguguucucccagauauucugccuaacagguuuaa

SEQ ID NO: 4230440 - RNA, 123 nt, Human
gagugggcucucagccuccaagauccggucccucaaccucgggcugcacuuggcacuggccucagagccggggcucccugagguccggcgggagggucggaggacuuggggacagccccacuc

SEQ ID NO: 4230441 - RNA, 58 nt, Human
ugcuguuuucccauagcuggucauucucuguuuggcugaaugcuaaaggaaaacagua

SEQ ID NO: 4230442 - RNA, 64 nt, Human
gaaacacgcugagcucauggagaugcagcuucuucuguagcuccuaaagcccagcugagguauc

SEQ ID NO: 4230443 - RNA, 55 nt, Human
gucugggguaucugccacaacucugcaaugcguagaguggcaccuuaccugagac

SEQ ID NO: 4230444 - RNA, 55 nt, Human
caaaucugugaggaauaaugaguugauuaaugucaacuuucccaauccagauuug

SEQ ID NO: 4230445 - RNA, 62 nt, Human
uuugcggauguccacgucacacuucaugauggaguugaagguggucuuguggaugccgcagg

SEQ ID NO: 4230446 - RNA, 124 nt, Human
aggagcgaggggagucagccggcuuuuccgaggaguuauggauguuggugcauucacuucuggccagauccgcgcccagagggagcuaaccagcagccaccaccucgagcucucuccuugccuu

SEQ ID NO: 4230447 - RNA, 129 nt, Human
aggaauuaacagucuuuauugggcucagaccaggaguccgugggucuugaggaccucuguguauuugucaauuuucuucuccacguucuucucggccuguuuccguagccucaugagcuguuucuucuu

SEQ ID NO: 4230448 - RNA, 81 nt, Human
gcaggacugacucccuugugggaucuggagacaccgagguuguuuggaguguuggucccacugaggcaugguuggcgaugc

SEQ ID NO: 4230449 - RNA, 128 nt, Human
cgggccccugagauagacaugggacagcccgaaaaggugggacugagaggggacacuuguggccagcaguguaucucugacacagucucaccccgcagggcuccugcagucucgauucagggugcuug

SEQ ID NO: 4230450 - RNA, 69 nt, Human
accugcuuuguacccaccuuggggccucagagcuagcuacucuagaggaccacagggugcagagagggu

SEQ ID NO: 4230451 - RNA, 91 nt, Human
cagcguggcguaccuugggcacacugaaucugcuauuggguacaacuucaaaaccaaagccagggacagugugcaugcgugugaaaugcug

SEQ ID NO: 4230452 - RNA, 89 nt, Human
accuauucccuguggcuuaggugagcaugugaccaggccuggccuccugagucccacagcuuccuagccacagugauaaaagaaugggu

SEQ ID NO: 4230453 - RNA, 55 nt, Human
gggugugcuaaaccuacgcacaggagacuccaucugcguaugucuuguauuacuc

SEQ ID NO: 4230454 - RNA, 103 nt, Human
aagacagucuaggaggaggaggagguagggugugaaacagccaggcucucuccaaaucccaaguguugacacagccaucuugucccaucccuggaagccucuu

SEQ ID NO: 4230455 - RNA, 68 nt, Human
gugauaacaggguaguaauuuaauacaaguguuuuaauuuguauuucaaggcacucucagguuuuuac

SEQ ID NO: 4230456 - RNA, 66 nt, Human
uuuguuuauuuacuuugggccuugcucaaaacuaguagcaagcugccuggaaugcaaugugacgaa

SEQ ID NO: 4230457 - RNA, 73 nt, Human
agacugaaguuggcagagaacagaaugauuuauuuuuaggguaaauggaaguuuguucucagccucuugguuu

SEQ ID NO: 4230458 - RNA, 59 nt, Human
ccaguguguuuuucucugacucaugcacauuauuggcucaaggagaagaacagaugugg

SEQ ID NO: 4230459 - RNA, 62 nt, Human
ccaugaggcaaagacugauauacuuguaaaugcccaaaguauguaaugucaaucuucagugg

SEQ ID NO: 4230460 - RNA, 65 nt, Human
gggaauuuuaggaugacuccuaccgcccucuuuucccccugguuuggaaguauccacaaauuccu

SEQ ID NO: 4230461 - RNA, 71 nt, Human
gcuuuuuuccuuccugucucuuuauuccccagguagcucgccauagauuaguaaaggaaggaagggacagc

SEQ ID NO: 4230462 - RNA, 64 nt, Human
aggaguuggaggagggaguucaggaguauucccuggaguuacuacccacccuucuccccuuucu

SEQ ID NO: 4230463 - RNA, 110 nt, Human
uguucguaggaagccuacaaguuuugguaccucucgucacaaugaucccagauuccuguuggguguguuguaaacagaggagccauuccucaggcccccugcucugagca

SEQ ID NO: 4230464 - RNA, 80 nt, Human
gcacuggguggagaucuggugcccccuggaggccggacaggaagggccagggcggacaaggucuuugagaacucgguggc

SEQ ID NO: 4230465 - RNA, 67 nt, Human
ucuuuuauucauuuuuauuugugacuguagugauaacuuuacagauggagaaagagugaauggauga

SEQ ID NO: 4230466 - RNA, 76 nt, Human
auuugaagguuuaugaaggauagggcaaaauuuucuaaggaaaguugcauccuaugaccucaggcugacuucaagu

SEQ ID NO: 4230467 - RNA, 76 nt, Human
ugguuuuucucuuugcuucucuaaaauuuuuuuugaagggauccacuuuuagagacagcauggagaaacuuugcca

SEQ ID NO: 4230468 - RNA, 125 nt, Human
ggucaccagacuucucugacuuuaggguuuuaaacugguaauuuaguauuacugauccaauauccauggauugaguacauuugauuaucagaggcuucuggaaucaucccggggagucuaagacc

SEQ ID NO: 4230469 - RNA, 62 nt, Human
aaccugaccuggaaauacaagaaguaugucauugacauaucuuuaugauauucaagcagguu

SEQ ID NO: 4230470 - RNA, 88 nt, Human
gggucuugcucuguugccuaggcuggagugcaguggcgcaaucucagcucacugcaaccuccaccuccuggguucaagcgauucuccc

SEQ ID NO: 4230471 - RNA, 57 nt, Human
aagcucugggacugaggcuccuguuggaggggagauugggcuuugagcucagggcuu

SEQ ID NO: 4230472 - RNA, 62 nt, Human
ugguucugucugugcuggggggcagaguuucagugccuuagaccuagacacagggagggccg

SEQ ID NO: 4230473 - RNA, 122 nt, Human
gcagaugaccgccugaaucuagauggagagaaacccaccauuuuucuaggcccuggauuauguagaagauuuagauacuaagccucaagagacgucuuuccucucauuuacggucuuccugc

SEQ ID NO: 4230474 - RNA, 60 nt, Human
cucacaccauugaaaccacuaguucuguccccccaggagaccugguugugugugugugag

SEQ ID NO: 4230475 - RNA, 81 nt, Human
uccgauuugucaaacagcuauuuaaaggcuuuagguuucaaauccugccugacgcugauauauaguuaagaaaacaaagga

SEQ ID NO: 4230476 - RNA, 76 nt, Human
cucaccuggagagcuugcuaauacacugguccccauccuaaucccccaagguaaaggcaaacucuccaaggauggg

SEQ ID NO: 4230477 - RNA, 63 nt, Human
ggcuuccuggugcagaguuauauuuauggcggugacuccgucugaacucugccgaggcaagcc

SEQ ID NO: 4230478 - RNA, 63 nt, Human
uuagguuuaugaggucugcauuguuaccaagaagugauaugguuugcagcuguaugagcuuaa

SEQ ID NO: 4230479 - RNA, 68 nt, Human
cgcccgggcagccccgcacuggagcuggaacgaguccuggcagccggcuccgcgggagcucccgggcg

SEQ ID NO: 4230480 - RNA, 73 nt, Human
caguuuggauccugcuaaaccagaauaaaaagucuagaacauggauguccucuugauuuagcagaucuagcug

SEQ ID NO: 4230481 - RNA, 56 nt, Human
ggauuguaugcagcaguaggcaacaguuaacugugcugcuggaguaucuacaaugc

SEQ ID NO: 4230482 - RNA, 60 nt, Human
gugggaguggagcucagcaugucaaaagaagaauugaucgagugaugaugccacuccaac

SEQ ID NO: 4230483 - RNA, 56 nt, Human
uuuuuaccugguguccagcuucuaagaagcaggaaggugaagccaccaggugagga

SEQ ID NO: 4230484 - RNA, 70 nt, Human
gcuuugggcccaucauugcugugggcauguggacacuugacacuggcccugccauugaucggcccagggc

SEQ ID NO: 4230485 - RNA, 67 nt, Human
ggcugcuugggcuguuucuuuucucugaugaggucuugugaagacggcagaaagccaagcaaguguc

SEQ ID NO: 4230486 - RNA, 85 nt, Human
uggcaucucuggagccaagucucuagaaugcaauagucuuugacauaauagugcuuuugcaaagcuggagaauuagacaaugcca

SEQ ID NO: 4230487 - RNA, 129 nt, Human
uuuauggaugcccccucagaaaaauaugcaaagggguaacuggcuuggaaauggguauuuaugcauaguaaaucccacucacgaguuuugccuauuugaagcuucucucaaugacagugcaucugugaa

SEQ ID NO: 4230488 - RNA, 88 nt, Human
uuagaauguguuaugucauuugaauuaauuuugacuacacuuuggcuugggagaggaauuauuuuaaauagacauugguacuuuuuga

SEQ ID NO: 4230489 - RNA, 79 nt, Human
uuuaaagaauguaguauuuucugaggacugguaugguacaaaaauguaaucaaaauuuucagauacuacauuuuuaaaa

SEQ ID NO: 4230490 - RNA, 56 nt, Human
gcuggguuguucuccugguccacgauggcgaagagacacagcuggagcaucccggu

SEQ ID NO: 4230491 - RNA, 56 nt, Human
gcgucuaaggaacuccauucacaucgaagucuaugugaauggccuucuuuagaggu

SEQ ID NO: 4230492 - RNA, 79 nt, Human
guacgccuucaccagguuggccaccuucacgggguugaucucuccacucuugcuguggcagaucuggagaaagaggugc

SEQ ID NO: 4230493 - RNA, 56 nt, Human
ggaggaaauccuuaguaaggcaguccggcucguccaggccugcguggauguccucu

SEQ ID NO: 4230494 - RNA, 70 nt, Human
uguaucuuggaucuugaugcuccaagagugaaacuguuucuuucaacuauggaguucagaucuugagcca

SEQ ID NO: 4230495 - RNA, 57 nt, Human
gccuucauuggaaucuagcuucuaacccacuggaguauggaauuuuuaaugacaggu

SEQ ID NO: 4230496 - RNA, 76 nt, Human
uaugcaaauugucuuuaaucaggucauguuagacaaacuuaaaaagaugugacucuacuuaagauuaagcugcgua

SEQ ID NO: 4230497 - RNA, 66 nt, Human
aagagaaaugcuuuaacuuuauaaaaaaugugauaauacagcaagauauuguugggguuuucuuuu

SEQ ID NO: 4230498 - RNA, 65 nt, Human
gacuauuuucccauaugguugacagagcuucaccagguccuggucggugguguggggaggcaguc

SEQ ID NO: 4230499 - RNA, 73 nt, Human
aagggggagaauaugugaagggggcuuccaugggaggcuucgauggcccacccacccuuccauucuuccucuu

SEQ ID NO: 4230500 - RNA, 85 nt, Human
acuagccuuuucccagguuuggaagucacgaagcuguaacucauaccagcucuucugacucuaggcucaggaauuugggcauggu

SEQ ID NO: 4230501 - RNA, 87 nt, Human
gugagugugucuggugguggguguagggcacugggauucugguuccuucuggcuucuuugccgcacucggccaccagcugucuucau

SEQ ID NO: 4230502 - RNA, 106 nt, Human
agcacucuuacuagcugaccuucccuauaauauggcucuucucucccuuuuuucuuaggguaggaaaagccauauuauaggcaaggucaccuaguaagaguuggcu

SEQ ID NO: 4230503 - RNA, 59 nt, Human
aggcaggauuugcgaugugguuccagagccuacuccuuaacuaccaugcaauuccgcuu

SEQ ID NO: 4230504 - RNA, 57 nt, Human
gggaaguugguaagaggcuguuuagacccaaaggauagucuuaaaccagacuucacc

SEQ ID NO: 4230505 - RNA, 61 nt, Human
gaguguagcucaaggaauuguucucucucuggaguggauaaguuguuugaccuacugacuc

SEQ ID NO: 4230506 - RNA, 57 nt, Human
gcaagacagugacagucacaauuggaauuuaaguuuccaacacugcccauuguuugc

SEQ ID NO: 4230507 - RNA, 71 nt, Human
gugucuuagugcuucauucuauugguuuauuggaacauguaauaaauaggaguagugauguauuaaaacac

SEQ ID NO: 4230508 - RNA, 86 nt, Human
guugcaugggcuauugguagauggagagagacauguuaauaaaauaaccaacaauguuuuucaagcauuuauuaaugcuaggcaac

SEQ ID NO: 4230509 - RNA, 69 nt, Human
ggacagaguggggaguaggaggggaacagagaggacauccucucuggcucuccagugcucuuagugucu

SEQ ID NO: 4230510 - RNA, 86 nt, Human
ccagauauugcuaauaccaaugacaggaguuagggcaauugggaggcucuugguccccaguuccugucaaggguaagcccaucugg

SEQ ID NO: 4230511 - RNA, 72 nt, Human
uguuucuguggacucugcuuaggaauugacugucuccacaguuucaucugagugacguccugacaggacaca

SEQ ID NO: 4230512 - RNA, 61 nt, Human
uauaugcacucagguguaugugagcgcuccuguuugugccuguguguaccgaguguguaua

SEQ ID NO: 4230513 - RNA, 114 nt, Human
gcauaacugauuuuuuuuuuaagaagguugaaugacuacuuuuaaaagucuccuaagaguugagaauggaaaauuuccuuggaccauuuuuuaaaagaaaaucuagaagaaugu

SEQ ID NO: 4230514 - RNA, 74 nt, Human
gcgggcgccuguagucccagcuacucgggaggcucaggcaggagaauggcgugaagcuggaaggcggagcuugc

SEQ ID NO: 4230515 - RNA, 70 nt, Human
cagcugcuggcccccuaggaccccgcggcgcaggccggaucccagaggcggggauaggagccaauagcug

SEQ ID NO: 4230516 - RNA, 72 nt, Human
uaagacuauacaguauguacgugcacacacacacacugucaugugcacagaaacauacaauguguauucuua

SEQ ID NO: 4230517 - RNA, 91 nt, Human
cuuagcaugcaccuugguuuagcaauuuuucuuuagugaaaguucaagguugucaaaaggaaaguuaagguaaacucuaaagguauguaag

SEQ ID NO: 4230518 - RNA, 64 nt, Human
guauucaagauagaaggauuuucauuaacacccagaaagugaacuguccuuguugucuagaaac

SEQ ID NO: 4230519 - RNA, 75 nt, Human
gcggggggccccgggcgcggcugcgggccuugcgagccccccugccucugcggccuagcgcccggcgccgccugc

SEQ ID NO: 4230520 - RNA, 55 nt, Human
guccuuuauuugaacaugacaucaaggauugaugucugccuaucaugugaaggac

SEQ ID NO: 4230521 - RNA, 66 nt, Human
caaaggauggguuugagauguuuggguugguugagugggcauuuagacaacaagccuucuccuuug

SEQ ID NO: 4230522 - RNA, 89 nt, Human
cacccgacagcuuguuagcaaugcagaaucuugggucucuucccugaccuccugaaccagaaucugcauuuuaacaagauauccaggug

SEQ ID NO: 4230523 - RNA, 65 nt, Human
ucugagcacuuuagaauuuagaguugcaauugaaugccagcuguggagauggggugcauaucaga

SEQ ID NO: 4230524 - RNA, 58 nt, Human
agaucauuaaccaccuguucugccugggagcugauggcagcagcagcuggguugaucu

SEQ ID NO: 4230525 - RNA, 90 nt, Human
ggagagucuuggggaauguaguccacagagggcagggucaggcugggggcagccucugucucugucaggcugcugccgccaagacucuuu

SEQ ID NO: 4230526 - RNA, 67 nt, Human
cuuaguagcgcgcuuugggcaguguggcuguguagugcauagcuaccucugcaaggugauaacuaag

SEQ ID NO: 4230527 - RNA, 68 nt, Human
ugcacccugacggugggcagcuugagugucuaaaccuucggcccucaggaggucugcugcggggugca

SEQ ID NO: 4230528 - RNA, 76 nt, Human
uaauuaggagccaguuuagaccucaguugcuugaugagguagcuucaacuguugucacgaauguggcuccuuuuug

SEQ ID NO: 4230529 - RNA, 59 nt, Human
ucccagucuagagccggauuggcgaguuagacgcuuguagauccaagguuggauugggg

SEQ ID NO: 4230530 - RNA, 91 nt, Human
ggggcagcugguggcuccacugccccugggcaccggggcccugcgugccagucuggugcacgugggcagucggccauacaccgaguucccc

SEQ ID NO: 4230531 - RNA, 79 nt, Human
gcagcccauguugcggaguguagcgaugcuuggugagagcacucauuaugcgcugugcacacucuuaacagcugguugc

SEQ ID NO: 4230532 - RNA, 65 nt, Human
uguggcccagguuggagugcagugaugagaucauaacucacugcaaccuccagcuccugggcuca

SEQ ID NO: 4230533 - RNA, 62 nt, Human
gguaaugugauaauauuauuagagcucugaagaguauucuauguauauuauuggauaauacc

SEQ ID NO: 4230534 - RNA, 111 nt, Human
uuuucauggcuacucuuaagaauuuuccuuaauaguuggucuucauuaaaugcuuucuucaauuucacuggaauaguggagacugggauuuguaagaggaagcuguggaaa

SEQ ID NO: 4230535 - RNA, 73 nt, Human
gaggacugguugggaaugugaaggaaagaaagguaagacaauguuuggaauguccuuccauuuuucagucuuc

SEQ ID NO: 4230536 - RNA, 70 nt, Human
cuugggauagagagaaaccaggguuuggggagcgguccuccuggagacuuucucucugcaagucuccaag

SEQ ID NO: 4230537 - RNA, 90 nt, Human
gggggcuugaggcaggaaggaccaggagcaccugggacucagaauuugagcuugucuuuuugcccuugggcuuccugcccuggaguccuc

SEQ ID NO: 4230538 - RNA, 69 nt, Human
aucagugaaaacugaaucaccuuccuugcaggcggaucugccauuggaucguauuucaguuuuuugggu

SEQ ID NO: 4230539 - RNA, 87 nt, Human
ccucucuaggucaucuucuucauucccuuacuuccgagcccuucuucaugguuuuggauguggggauggagugggauguuuggaagg

SEQ ID NO: 4230540 - RNA, 69 nt, Human
acacccuuuagcaauucuucaaugcaaugcuuuucacauuauuauaugcauaagaaucaccaggggugu

SEQ ID NO: 4230541 - RNA, 73 nt, Human
gcacauaucccgacuacuaacuacuguagaaagguuaacccaccuuucuacacuucgugguguuuuuaugugc

SEQ ID NO: 4230542 - RNA, 78 nt, Human
uuccucagaauaaaccucuuuaaaagggauauugauggaaauguacaauuaccaguaauugagguuuuaucugagggg

SEQ ID NO: 4230543 - RNA, 64 nt, Human
aagaggcuacagcccugugucuggccaugugagcccuggccuuucaccggguugcugguuucuu

SEQ ID NO: 4230544 - RNA, 59 nt, Human
ggaaauucagguuauauuugcaacuaugcucuaguugugagaaugaacacugaauuuuc

SEQ ID NO: 4230545 - RNA, 55 nt, Human
ugugucucucuuagguugucuggggccacgugugugucagaucugaaggagaaca

SEQ ID NO: 4230546 - RNA, 60 nt, Human
cagguuucuggaugcagccccaacaagcaaaagugcuacacuccugcaccgggaacacug

SEQ ID NO: 4230547 - RNA, 75 nt, Human
gguugauaacagaaguuuguuauguaaacaaaugcuaucaaccauuuguucaccuagcaaacuuuuguuaagacc

SEQ ID NO: 4230548 - RNA, 64 nt, Human
caccuguuuggcuuccacugcuucugugaacuccuucccaaaggucagaugugucgaggaggug

SEQ ID NO: 4230549 - RNA, 68 nt, Human
gucuccuuuuccuacucauacuauaccuuccuguaccuggguggauggagcgggaggauggaggagac

SEQ ID NO: 4230550 - RNA, 85 nt, Human
ggagagaccagagauugagcucagaagaccugaguucuuuucaacagaacuaacaccauggucugcucagucucuugaccucucc

SEQ ID NO: 4230551 - RNA, 60 nt, Human
gcuuucccaaccuucuugguauaaagguaaacaauuauauuaccagggguuugggacagc

SEQ ID NO: 4230552 - RNA, 56 nt, Human
uaauuugauuucucccuggaaagcaguuguuugccauccuaugagcuguuaaauug

SEQ ID NO: 4230553 - RNA, 101 nt, Human
aggucauagagcuggaaauuggcagagcugggacuggaagccaggccaggcaccuggcuccugaguuucagcucuaagccuaggccauccuacgcugaccu

SEQ ID NO: 4230554 - RNA, 69 nt, Human
ggugugcgccaccuugugauccacccgccuuggccucccagaguguugggauuacaggcauaagccacc

SEQ ID NO: 4230555 - RNA, 59 nt, Human
cuggugaagccuucggagacccugucccucaccugcguugucucugguggcuccaucag

SEQ ID NO: 4230556 - RNA, 114 nt, Human
ccagcaaaaggaacugcagggagguuuuuaaaacaugucaaaaugugguguaaaucagcaagucauguggaaaugcaugcuuuuuaaccugccagaagcugcagagccggcugg

SEQ ID NO: 4230557 - RNA, 76 nt, Human
ucuugugugguauuuuuaucuaaaauccacuuuguggaaaacaaagggaugauuucugaagauaagccaugcugga

SEQ ID NO: 4230558 - RNA, 130 nt, Human
auuaaacuaaaaacauaaagaagauucuaaguaugcuuuuuuuagaaagaucauaguuaauauuauuaauguaaauaauuguaaaauuuaaguguauuugguguuuucuuugugugcuagaaacuauuau

SEQ ID NO: 4230559 - RNA, 64 nt, Human
gugguaagugcuccuauuggcgggaagaauaaauccggaagagcaggaccaguggacuugcuac

SEQ ID NO: 4230560 - RNA, 60 nt, Human
ggaagguauuucuccuugaguguugggccuauugugccaagcucaguggagaaaugcacc

SEQ ID NO: 4230561 - RNA, 70 nt, Human
ucacugaucacaaauggaaucaccucccugggcagcgagacgcaguugcucugggaagaugccacaguga

SEQ ID NO: 4230562 - RNA, 65 nt, Human
uaucugcauguggcagguggauucuggucuucguaauuaaugagaguuguacuguauagcagaug

SEQ ID NO: 4230563 - RNA, 79 nt, Human
uucccugacaguucugggaggugcacguccaagaucaggguguccucagaguuggugccuuccgagagcugugagggag

SEQ ID NO: 4230564 - RNA, 112 nt, Human
guaucaaaaacacuauugucuucaaugagaauuuaacuugauuaggagguuauguagauuuacuuaauuuuaaaagcuagauguucaguauugcaaacggaguuuuuccuac

SEQ ID NO: 4230565 - RNA, 60 nt, Human
aagcacagggacucaggaccgggcgcuuucuaaucucuucagucucugggucuccugcuu

SEQ ID NO: 4230566 - RNA, 101 nt, Human
ggagucuggcucugucacugaggcuggagugcaguggcgccaucuaggcucacugcaaccuccaccucccgaguucaagugauucuccugccucagacucc

SEQ ID NO: 4230567 - RNA, 64 nt, Human
ggccaguuggagacccuuggaaagcccuucaagugagagcaugaggcuuggaucuagacaggcc

SEQ ID NO: 4230568 - RNA, 56 nt, Human
cauagacauugauagguuauauuuguuuuauaacaauuguguaccuaauguuugug

SEQ ID NO: 4230569 - RNA, 56 nt, Human
ggauccucagacccuccucuggucaugagggagugaucagaggacaucucagggcc

SEQ ID NO: 4230570 - RNA, 88 nt, Human
gcaauucugaauacuggagcucacuacgaaauaagcugucuucccccaguauucaguuagugagcuaagguauccuguuggaauuugu

SEQ ID NO: 4230571 - RNA, 58 nt, Human
ggcguuccccgagccuggggaagcuggccgucccggacugaccugcucggggagagcc

SEQ ID NO: 4230572 - RNA, 76 nt, Human
ggugccaccagaugcuguugcuacuaccacuggcaaaguuuaaggguaaaauagcauaaaguuucugugugguucu

SEQ ID NO: 4230573 - RNA, 130 nt, Human
ggucggagcgugggcgcacgggccgcgcgcuccgugaguagggggccucucccgcggcgccugagagccggguccgcgcgcagaggcccugggggcgcgcgugccgggugcgcgcuggccagcugugacu

SEQ ID NO: 4230574 - RNA, 75 nt, Human
ucagagcuugcugcgcugaccuccagugagacccauguccuuagccauggucacagguuuaguccagcagucugg

SEQ ID NO: 4230575 - RNA, 81 nt, Human
uagucaauuauuuuguagcucugaucuuuucccccugcacccgacaggacagaaagguggugguuagggaauaugugagua

SEQ ID NO: 4230576 - RNA, 68 nt, Human
ucugguuccuauauagccuuaaggauuaauuuuagugauccucaaggaauuaaauagggaauuucaga

SEQ ID NO: 4230577 - RNA, 66 nt, Human
aucacauaccaguagaggacugcccaagaaauauguaguuuuugaacucagcuacugguuggugau

SEQ ID NO: 4230578 - RNA, 76 nt, Human
aaaagaaaaaaaauucuggcaaaauucacaagaaauggcaaauuagugaauuguugcccauguuuuuauuucuuuu

SEQ ID NO: 4230579 - RNA, 66 nt, Human
caaugagcuaauguauguugaaagcacuuugugaauuguaaagugcuacacaaauguuaguuguug

SEQ ID NO: 4230580 - RNA, 79 nt, Human
uacccuguuuuucaguuccaucucugcucuguccuauagcuuuauaaaaccagaguguguggggcugaggucaggagua

SEQ ID NO: 4230581 - RNA, 73 nt, Human
ugacuuacuguggacaccuauuaccagugagagaaaaacuucaucgcuauuauuuuagguucucaguaucuca

SEQ ID NO: 4230582 - RNA, 59 nt, Human
ggguacaccaauggaugccagggcacaucagugcacaccugugcaugccaggguacacc

SEQ ID NO: 4230583 - RNA, 91 nt, Human
guaucuccugacuuauaaguaagggucucuggcaggaugcaaacauuuuaggucaaggccacuucuuggaauuuguuucagguuuagguac

SEQ ID NO: 4230584 - RNA, 77 nt, Human
uauuugguuucuugugauuuugaugaacuauacuuucaagcauugucaguucauccucauuuacaaggaaacauuug

SEQ ID NO: 4230585 - RNA, 63 nt, Human
ucuagcccucauggcugaaggcccaguccuggcuccaccacuccuccagccagagggucugga

SEQ ID NO: 4230586 - RNA, 79 nt, Human
ucggagaugccgcacuugugagcgacagggcuucauuugaauuuucgcaccucgcgaguugcggagccugcaucucuga

SEQ ID NO: 4230587 - RNA, 62 nt, Human
uggcuuuggcuucuccuggcaggaagucaucaggcauccucuccaggugagccgaaauucca

SEQ ID NO: 4230588 - RNA, 68 nt, Human
gguucuucagcgucgucaguguugcucagucuugcucuuuguggcgacuacugaaugcuugaaaaauu

SEQ ID NO: 4230589 - RNA, 60 nt, Human
gcgcgggcuugggcaccugcggagaggcguggguggcugcugcgggacccgagcgcgcgc

SEQ ID NO: 4230590 - RNA, 85 nt, Human
ccggauuuggauuaggacuugaauucagccuccaacauuuacugcuguguaaagauuugaggcugaucacuccuauaaaauuugg

SEQ ID NO: 4230591 - RNA, 108 nt, Human
uauaggaguugaguuauagauuggaaggaaauguguaucauaagaaggcaaaaaauaccaggagcuuugcaaauuguauuaauacacuccuuuucuauugcucuugua

SEQ ID NO: 4230592 - RNA, 86 nt, Human
uuuauuugauaguuaaugauagggagaggggugauagaacaaauggguauuaucuuuucuucuuuccuauaauuaauuaaaaugaa

SEQ ID NO: 4230593 - RNA, 58 nt, Human
gccuagaagaaugagcgcagggguucagaacgcuaccuuggguucaguuguuucuggc

SEQ ID NO: 4230594 - RNA, 79 nt, Human
ccucgccccucucagcccugcaaguugcgugguuguguuuacaaauucugccacaauugcaaaggaaauaggggugggg

SEQ ID NO: 4230595 - RNA, 81 nt, Human
gguguacgacagauuauuuugugacugcagucuguucaaaucacaucacuaagcagcgcugagaugauuuguuggugcauu

SEQ ID NO: 4230596 - RNA, 73 nt, Human
gaggcuuaauuaaggcauagcuuguguugacauggguauaaagucaaugcuuaguuugccugaagaaaguuuc

SEQ ID NO: 4230597 - RNA, 70 nt, Human
agugggaguagauaauuuuggaaagcugggugaagccaguuguggagaauuguuugaauauuaucccauu

SEQ ID NO: 4230598 - RNA, 69 nt, Human
ucaaaauaucuugaguuauaaauucaaauagaaagaaaauuaugaugaguuuaggccaggauaugguga

SEQ ID NO: 4230599 - RNA, 82 nt, Human
agcugugauggaucuguuggcggguuuuggauguguaaagaaugauauauauauuaaauaggucaaucagacuaugacagcu

SEQ ID NO: 4230600 - RNA, 105 nt, Human
uucuuauaucugcuuuaaagcuaucugguucuagaugagaugaugagaccugaugacucagucucauagguuuggaaccagguagcacuaccaagggcuuaagga

SEQ ID NO: 4230601 - RNA, 76 nt, Human
gagcagaggaugccaaagauagagguuugagucagcuugacacuggcuuaggcgcuccuuuucacucuccuuguuc

SEQ ID NO: 4230602 - RNA, 61 nt, Human
cgguguggguccaaccugugugugugcgagaccucccacacgagcccuggagccagcagug

SEQ ID NO: 4230603 - RNA, 59 nt, Human
uagaggccagggugucuugagugcuguaacucccaagcacugggcuagccugacuucug

SEQ ID NO: 4230604 - RNA, 115 nt, Human
ccuccucuugaagucuggagagucauaggcguccuccucgucugaggcggcguacugccccgcgcugcuucucucuaggaagacgcuccuuuucucuaacuuggaaagaaaaagg

SEQ ID NO: 4230605 - RNA, 55 nt, Human
ccccaggcuaggaccgauuucccugugucuuggggaaauauuucugaccuguggg

SEQ ID NO: 4230606 - RNA, 56 nt, Human
guugguggccccugggagaugcuggcccgggagccaggggcuagggggccaccagc

SEQ ID NO: 4230607 - RNA, 60 nt, Human
aguauugguaaguguagcaaauaagccauguacauuuaauguguucuacuugcuaguauu

SEQ ID NO: 4230608 - RNA, 55 nt, Human
ggaucagcgagaagggcugaaagggcuuacagcuuuccugguucuuuuccugacc

SEQ ID NO: 4230609 - RNA, 84 nt, Human
ggcaggcgcugucagcccgggagggcugucugggauuucuagagggucccagaacggguucuucccaggccgaucccgccugcu

SEQ ID NO: 4230610 - RNA, 96 nt, Human
gcauaauuacuaaugagaaaacauacuuaguguccucauuaguugaucauuucaaguauuuuucagcauacuaggauguuuucugguaaucagugc

SEQ ID NO: 4230611 - RNA, 56 nt, Human
caguaaccaguaguuuuggaaaauagucuaugcaugguccaaaauacuuguuacug

SEQ ID NO: 4230612 - RNA, 93 nt, Human
cccagacccgaaggugcuguaugaaugggagggagcagugaguguuauuugggaaauauugaagacacaacuucccucccacauuugucuggg

SEQ ID NO: 4230613 - RNA, 56 nt, Human
gaccacugaaugcacuucuaauagagcuuuaaucuaaagaaguuaguucagugguu

SEQ ID NO: 4230614 - RNA, 68 nt, Human
uuuuauguugagcaaaauaccacuuguugaauuuuaauaacuauagugguguaaaugccaaaaugaaa

SEQ ID NO: 4230615 - RNA, 55 nt, Human
gugugaugagaugaacuguagacaaccauguuugucuauucaucauucaucaaac

SEQ ID NO: 4230616 - RNA, 77 nt, Human
aacaauucucucucuuuuuuucccuuguuaacagcaacuuucauuguuagagagaggagagagagagaagccuuguu

SEQ ID NO: 4230617 - RNA, 59 nt, Human
uaaacgaagcuucaugcuugaaagugggcuguuucaauaagagugaggagcaucguuua

SEQ ID NO: 4230618 - RNA, 75 nt, Human
gcgguauuaagugcugucguggaacugggcugcuguccuacugcaguacugucuuccugauggcaaggauaccgc

SEQ ID NO: 4230619 - RNA, 56 nt, Human
gcuuuguuugcugagugaauucaaggacacuuugaaaaaugcccagcagacaaagu

SEQ ID NO: 4230620 - RNA, 83 nt, Human
cuugcuuuucaguuccaaauuugcaagaaaaugaggaaucugagauuacacaugguuuucuuguuaauuuugaacguggcggg

SEQ ID NO: 4230621 - RNA, 68 nt, Human
uaaacgaugauaaauuguucucugcuucacuaucaacauccaaguagcagaacaauagucaaugauua

SEQ ID NO: 4230622 - RNA, 59 nt, Human
uuucgugacuggacaaacuuggguggcuuuaagccacggccgaugacuccagcauggaa

SEQ ID NO: 4230623 - RNA, 104 nt, Human
ucugucugucuaucuaucuaugugugucucaguugcuccgaaguccuuuuagaaacacauggaguuucacugaguaggagagcacugaaguaggagucagaaga

SEQ ID NO: 4230624 - RNA, 105 nt, Human
ucccaaagcagacugacaaagugacuaauugcuggcugcuggcagaggacugauuuccccucucucugcuguccagcguuauuacccucguccauuuuacaggga

SEQ ID NO: 4230625 - RNA, 77 nt, Human
ucauguuggcugcuagguggcagcacuccgagguaucuaaaggguagaccuggaccugccaccuaugaguuguguga

SEQ ID NO: 4230626 - RNA, 56 nt, Human
gcagaagggucagggcccaggggccuguccacgggcgugcugggcugacccuuggc

SEQ ID NO: 4230627 - RNA, 62 nt, Human
caucaggcugggaacacagaucaggauuucaaaugcccccuucucuguggccuucccugaug

SEQ ID NO: 4230628 - RNA, 100 nt, Human
gaggcaggagaauugcuugaacccaggaaguggaggcuucagugagcugagaacacgccacugcacuccaguccugggcaacagagcaagacucugucuc

SEQ ID NO: 4230629 - RNA, 67 nt, Human
gugggagaaugggaggaguaauauauuaaccuuacugauacacaaaguugcuccuucuuuuucuugc

SEQ ID NO: 4230630 - RNA, 66 nt, Human
ccuggcauuagaaauuccgucacaaucaacauuaagcuuuauucauugugauggcuaagagccggg

SEQ ID NO: 4230631 - RNA, 91 nt, Human
cuguccccguuguucuggaucauccagcuccugggggccaccgugugacccacggggccccuguggcuugaugcccacagcuaggaaacag

SEQ ID NO: 4230632 - RNA, 88 nt, Human
uuuucagagccuuccauuuuccuguauggacucgagugcuucgaggggaaggagaucgagcucagcagggaggugcggagccugcaag

SEQ ID NO: 4230633 - RNA, 72 nt, Human
guauauauguauauauguauauacacauauauguguauauauguguguaugugugcauguauauauauauac

SEQ ID NO: 4230634 - RNA, 125 nt, Human
acagcauguuccccacaugcuaguggguuccuuaagauguuaauauguuucaccaaaugcugucauuuucggagaauguuaauguguuccccaguugcuggcguguucccgggguauucaugugu

SEQ ID NO: 4230635 - RNA, 63 nt, Human
agugcuuuauguuguugugcaaauucagcaaaaggccaaaacagccaacaguacugaagcacu

SEQ ID NO: 4230636 - RNA, 87 nt, Human
gggaggaaugugggcacguccuacugucacugugcuacagcucucagcaggguggcuugcugguaggugugcugcgcugcgcccacc

SEQ ID NO: 4230637 - RNA, 107 nt, Human
guuguguguuuuucuuuauauuuuuguuacugauuauuaaaauugucuaaaugaguaaauuuuaccauuaguuuguaauaaaagugggagggaaaauguuacaucac

SEQ ID NO: 4230638 - RNA, 64 nt, Human
uuacacuuccagugcauagguagaucauuucuauaugcuaucuagaaauacuggguuuugguaa

SEQ ID NO: 4230639 - RNA, 69 nt, Human
cacauuaaaaugauggagaacaaagaaaaucuggcccaguuuuucuagaaaucuccuccuuaaggugug

SEQ ID NO: 4230640 - RNA, 66 nt, Human
ccuacuggggaggaagaguaggaauuugaggaugcugcuuugucaaaucuuuuuuccuucccuggg

SEQ ID NO: 4230641 - RNA, 64 nt, Human
ggugcuugacucagcaucggcaauuauuucccagaaggaaaguuaccgaccugauucggcagcc

SEQ ID NO: 4230642 - RNA, 99 nt, Human
cuuccauagucauuccacaaagauguguuuccaagucucucaacacccagaaaacgucaagggguuggaugccuuggaaauugugagauuguuaggagg

SEQ ID NO: 4230643 - RNA, 57 nt, Human
gcaauuucagaccaacgagucaggggaggcuuuggcuccccaggaucugaaagcagc

SEQ ID NO: 4230644 - RNA, 55 nt, Human
gcuagagaccagaggccuugaaggaaggaagcccaagggucucuccuggcucugc

SEQ ID NO: 4230645 - RNA, 63 nt, Human
caaaugcaguggucgugcuggagcucaggccucaggacucuaagccacgugacccuuuauuug

SEQ ID NO: 4230646 - RNA, 72 nt, Human
guaaacccaggguuuugucuuccccauuuccaucccacaaggccuugggggaagguuuguccugagguuugc

SEQ ID NO: 4230647 - RNA, 57 nt, Human
accaucuccugugccuccagcuucgcuuuugggguugguggcuuguaggagggaggu

SEQ ID NO: 4230648 - RNA, 57 nt, Human
ucacucagucugagcaauugcugauuugguuggcuuggugguucucaaacugacuga

SEQ ID NO: 4230649 - RNA, 55 nt, Human
gauuagcuagacacucagggccucaguaaagacauggguccuuggucuaguuuuc

SEQ ID NO: 4230650 - RNA, 56 nt, Human
gcaggggccaaggcaaacuugagggccaauucccagguugaggccuugccugaugc

SEQ ID NO: 4230651 - RNA, 55 nt, Human
gaguggccaaacugaggaccugcugcaccagcuccugggucucuguuggcuucuu

SEQ ID NO: 4230652 - RNA, 79 nt, Human
cuugccuguucccuugccuuuaguuugauugauggauuguuaaguuagggauggaaggggagguagggaggagggcagg

SEQ ID NO: 4230653 - RNA, 68 nt, Human
uguuggaauaagugcuugaaggaguuuuucuaaugccucuuccucucuuuugucaacugcauccagca

SEQ ID NO: 4230654 - RNA, 67 nt, Human
ugcugaaaugccucuuugguucuaauuguguagaaugaacaguucaggaucuaggaguauuuuugca

SEQ ID NO: 4230655 - RNA, 82 nt, Human
gaguggaaggagggcugggagaggcagcuuucggaucggcggucgcuuucuaugaagucuuccuuuccucccugcuucccuc

SEQ ID NO: 4230656 - RNA, 58 nt, Human
uggagaugcacgagcagguggagcagcugaagcagagcauccaccgcgugcaccucua

SEQ ID NO: 4230657 - RNA, 59 nt, Human
uccagugccagcuguuaaaguuucaucgucucaucgugaaagacacuguccccacugga

SEQ ID NO: 4230658 - RNA, 57 nt, Human
cucagaugcacacaggugaggggcaggaaucugcuguuuuguguugcgcacuuugag

SEQ ID NO: 4230659 - RNA, 71 nt, Human
ucuggcucaccccauccccucccaauucccagcuucugauggaauugagcaagggguggggcuuagucaga

SEQ ID NO: 4230660 - RNA, 69 nt, Human
ugggagcucaucuguucccuugacuucucuuuuuccaguucuuuggcaaggccacaggugcaguucuua

SEQ ID NO: 4230661 - RNA, 58 nt, Human
guuuugaugugauuucucauguggaaaugggcuccagcauggcgagucagcacaaaac

SEQ ID NO: 4230662 - RNA, 68 nt, Human
gggggagccaugagauaagagcaccuccuagagaauguugaacuaaaggugcccucucuggcuccucc

SEQ ID NO: 4230663 - RNA, 77 nt, Human
gagagguccuaugggaagggauccuggagggguggagguggguugcuuggcugaaccagccuucugaugggacccuc

SEQ ID NO: 4230664 - RNA, 58 nt, Human
aggcauccaaggagcagaagugauggagguggcccucaauccuggucuuuggaagcuu

SEQ ID NO: 4230665 - RNA, 89 nt, Human
gcuaugauuagggauaggaagagauuuucacauggcagacuuuagaauucuucacuuuagccaguaaaguaucuccuuuugaucuuagu

SEQ ID NO: 4230666 - RNA, 117 nt, Human
gguauaauaaggaaauacagcaaucgugggcuuuuuugaaaccugaaauuccuuacaagcucucauuuugugguuuugagagaguugcaggacuaggcuguauccuauuucuauacc

SEQ ID NO: 4230667 - RNA, 74 nt, Human
auuuggaaaguaagaaagaaugauaggccuuauuuuaucacaauguaggcaucguguuuuucugcuuuggaaau

SEQ ID NO: 4230668 - RNA, 87 nt, Human
ugcucaggaacccugaacuuaguucuaggaaugcaacaaauucuaauuuuuggauugcuaacucaggguuaaaaagaauccuguaca

SEQ ID NO: 4230669 - RNA, 68 nt, Human
gacguuguuugcuaaugagugcugugugaaguucugggauuuggcuacucuucauuggugauuauguu

SEQ ID NO: 4230670 - RNA, 59 nt, Human
uaagcgagccaguggaaaaagcacauucauuaucagugucuuucucacugagucguuug

SEQ ID NO: 4230671 - RNA, 55 nt, Human
ugguaaaugucuaacaaucacuggacaaaagagccauuauuugugauauuuaccg

SEQ ID NO: 4230672 - RNA, 87 nt, Human
ugcccccugcucuggcuggucaaacggaaccaaguccgucuuccugagagguuugguccccuucaaccagcuacagcagggcuggca

SEQ ID NO: 4230673 - RNA, 64 nt, Human
gaggugcaggggcccgggcugggacagugaagagugcugggcagucugugguccucuguaucuc

SEQ ID NO: 4230674 - RNA, 60 nt, Human
cugcuguuuuccccaccaucucguggaugucgucccucggguggugagagaacuuugcag

SEQ ID NO: 4230675 - RNA, 64 nt, Human
cuccaaaugaugucccuggaggggacaggaggugccucccucuuccucuccuggggcauuugag

SEQ ID NO: 4230676 - RNA, 106 nt, Human
gcuauguuuugauaacuuggagucaaaaguaauuugugaaggcauguuaagcagagaguuagcaugaauugccauuuauuaagacuaaaaguaauuuucaguuagc

SEQ ID NO: 4230677 - RNA, 113 nt, Human
gccauuacuggcuucuaaaaccacuaaagcuaugcagauagccugguccuaacauguucuaaacugggcauuagugaggggcugccugcuggcuuguuuaggggccaguuggc

SEQ ID NO: 4230678 - RNA, 75 nt, Human
gcagcagcccaggcccagcaccagcggucuuccggcuccucugagggcugccacguugggcgaggggagccaugc

SEQ ID NO: 4230679 - RNA, 86 nt, Human
gugaaauggugauaauaccuaacauugugcagagguuucugauuucagacucgaaggcccucucuacauguuagacgcuguuucau

SEQ ID NO: 4230680 - RNA, 128 nt, Human
guaucagaauccuggaaggcuuguuaaaauacagauugaugggcuuuacccucagagcuucugauuugggagguccaggguggggccugagaaucugcauuucuaguaaguuccggugaugcugaugc

SEQ ID NO: 4230681 - RNA, 60 nt, Human
gguucccuugaugcuagaacuuccaagauaggcgcaaccugucugcaauuccagggaacc

SEQ ID NO: 4230682 - RNA, 65 nt, Human
ccaauuuuggaauuauuaggcaggguuuaaaauuauuaugcuaaguacauuccaggacuuauugg

SEQ ID NO: 4230683 - RNA, 81 nt, Human
uucacgagcuucagggucgucacuuuuaagggccuuuucuaccuuguugggaagaaacaagcccuagaaguccugagugaa

SEQ ID NO: 4230684 - RNA, 62 nt, Human
uuccuccuuccugccccuaacuucagagaaacagaccuagaaagagggaaggaaggagugaa

SEQ ID NO: 4230685 - RNA, 55 nt, Human
cugccugaagccugccccuggguuugcugugggacucgggggccgcugcagggag

SEQ ID NO: 4230686 - RNA, 75 nt, Human
gagggggaaguggggaggagaagacugacaugaguccucugcacggauccgucucucccuccccaucaccccuuc

SEQ ID NO: 4230687 - RNA, 124 nt, Human
ugauuuaguucaauaauccauaguaguuaggaaauaaguugaguuucaucuaagcuaguuuuucuguuuuaaauucagcagguuucaaaagccacaggaugaaaaaccuuuugaauucugauca

SEQ ID NO: 4230688 - RNA, 65 nt, Human
augaaggguugugcaaaacaggaaggucugggaaugaccagauaucuuguuggcauaaauguuau

SEQ ID NO: 4230689 - RNA, 65 nt, Human
uagggucucccuuuaaucuaacuaaggcucucuaagccccuguuggucccugaagagagaccuug

SEQ ID NO: 4230690 - RNA, 77 nt, Human
gucacuuuuucaucauuuuccauuccucuuugggcaguaauauauuugcaagagaaagggaaaaugguaaauuaugc

SEQ ID NO: 4230691 - RNA, 70 nt, Human
cacuggaaccuggcagcccuauaucugcagugcacuucucagggggacuuguuagguuuuauauauagug

SEQ ID NO: 4230692 - RNA, 62 nt, Human
cagcauuggcacauguauucugggccuccuucagacgcugagcaaugcacugccgcauccug

SEQ ID NO: 4230693 - RNA, 57 nt, Human
ggagugaagacagagugaacuuucaagagcaguuaagaguucagguuauuuuccucc

SEQ ID NO: 4230694 - RNA, 65 nt, Human
auuuccugugaacuuuucugauuucuguugguuuguauccuuggucagaaucguuccagguagau

SEQ ID NO: 4230695 - RNA, 61 nt, Human
uucucagucucuugcuucauuaguuggcccucaggcuagugcuagaagcaaagacaaagag

SEQ ID NO: 4230696 - RNA, 57 nt, Human
ggagugggaaagcugccuuguagaucccagaguuuacaagucuguugaucccaaacu

SEQ ID NO: 4230697 - RNA, 70 nt, Human
cuucuuggugagcuccuggcgcagcaggugguagaggcggacgcugcgcugggacgccaccaacaggaag

SEQ ID NO: 4230698 - RNA, 65 nt, Human
gugcuaaguaaguauuuuggagagccacagcuugaauucagcucuuccgaaucaugacuuugcac

SEQ ID NO: 4230699 - RNA, 61 nt, Human
auugaauuagauguuguaguccuaauuucugggguuagaggacuacaauauguaaucuaau

SEQ ID NO: 4230700 - RNA, 60 nt, Human
ggucuugcauauguccagccaugcauguggacgggcaugugauggacgugugccugggcc

SEQ ID NO: 4230701 - RNA, 69 nt, Human
uuuuauuuccuuuuuguuauuuagguguagagaaagcuuaacgcuuacauagucaaacagguacuaaga

SEQ ID NO: 4230702 - RNA, 64 nt, Human
gggucaugaacaguuucccuguagaaaauggaccugaacacucugcaguaaggaauuguuuccc

SEQ ID NO: 4230703 - RNA, 59 nt, Human
gcuaaccaaaccuguuguuuggaaguacuagcagcuugcaguagcgcgacaugguuagc

SEQ ID NO: 4230704 - RNA, 130 nt, Human
acagugucaucuuuuuuaaagccguggauaagacuagguauagguaauaacuguagaaaaccugggaaauuuaguuaaucuuguauuaaugguugucagcuauguuuugaaaaggccuaaugaaaauugu

SEQ ID NO: 4230705 - RNA, 68 nt, Human
cuucuuaauucaacagucaguuaucucagaggguuucucucuagugucucuuccuguuugaaaggaag

SEQ ID NO: 4230706 - RNA, 81 nt, Human
guucacauuuccugggguguagagaaaauaguuguauguuaaaaaaacaugcacuugacucuauuccacaggggauuaagc

SEQ ID NO: 4230707 - RNA, 83 nt, Human
ggaggacuuagugaguuaaguguccugagcggcaccugcacucaggugacacucagugcugcuggcuccugucacaauucucc

SEQ ID NO: 4230708 - RNA, 57 nt, Human
gaugguggaggaaucgcugaagagcccaguaccaguucagcaagugucucuacuguc

SEQ ID NO: 4230709 - RNA, 57 nt, Human
cagaguaaugugauuuccauguuguccuucucugugaaguagaauuccauugcucug

SEQ ID NO: 4230710 - RNA, 90 nt, Human
ucagggcugcaaguuuaagcagauugcugugguguauacacaugauuuuagcaugauaacacuucuguuuaauguccuuaguuguucugg

SEQ ID NO: 4230711 - RNA, 95 nt, Human
gagguucauggcauguucguugcauguuuucuugucuggagaaguguuggaauaagaaacacuggggcaggaaaguaugcuguacuuugaauuuu

SEQ ID NO: 4230712 - RNA, 69 nt, Human
ucuuguuaaagguuaaaggugaaagugaauuuuaaugacuguaguuuugauuugaaaccuuuggcaaga

SEQ ID NO: 4230713 - RNA, 85 nt, Human
gauccucaguuugcaucucuguucugauggauuacaugucugauaaucaaccagaaugucaagucaagaacaaugauugaguauc

SEQ ID NO: 4230714 - RNA, 68 nt, Human
uccaggaauguugagacauggcuaaguuucuagcugauacuuagucauucccucuugauauuguuggg

SEQ ID NO: 4230715 - RNA, 71 nt, Human
uuuuucuccucucucuuucauuguuugacuuaauuaaaauauuguaaugcaagaaggagagaugaggcaaa

SEQ ID NO: 4230716 - RNA, 59 nt, Human
uaaccaggaaaaagauaugcaugugcuguaagucccuaggugcaagcuuuuucuuguua

SEQ ID NO: 4230717 - RNA, 59 nt, Human
cacagcugagaugcuacuuguggcgaucaucuucucccaagcuccacauuuuagcuuug

SEQ ID NO: 4230718 - RNA, 58 nt, Human
guuauuguuauugcguugucgacacauaugacaacggcaaugcaauguuaucaauaac

SEQ ID NO: 4230719 - RNA, 57 nt, Human
uccuagucaccugaaucaugcaaagaaauuccgcuuuccaggagcacgggacuagga

SEQ ID NO: 4230720 - RNA, 57 nt, Human
ugaggggucuccuaccaugaugccuagacacuggcagccuggcuagaagagcucuca

SEQ ID NO: 4230721 - RNA, 61 nt, Human
uccgaagcuuuuguuggcgugucggcuguagggugccccgagagccugcaggaccuucgga

SEQ ID NO: 4230722 - RNA, 92 nt, Human
uuugucagguggggauuucaccccagccuuaugacucaguuuuagauuuaacuugauucauuuaagguuggaguuuauuucuggcuggcaaa

SEQ ID NO: 4230723 - RNA, 71 nt, Human
ugguucuggaggagagccuggugugaacuacaaacaagccacugugaauaccaaugaaucccugagaauca

SEQ ID NO: 4230724 - RNA, 74 nt, Human
ggcuucauuuuauauuagagcuguuaaaagauaaccuuuagacaggaauuaucuaaaguagaucauauguagcu

SEQ ID NO: 4230725 - RNA, 130 nt, Human
cucagaagaauaggcuuguuguuuuacaguguuagugauccauucccuuugacgaucccuagguggagauggggcaugaggauccuccaggggaaaagcucacuaccacugggcaacaacccuaggucag

SEQ ID NO: 4230726 - RNA, 66 nt, Human
uauauauguacauauauguguauauauauauuuguguguguguguguguauacauguauauauaua

SEQ ID NO: 4230727 - RNA, 127 nt, Human
gcuucuucaaauucuagcucacaagaguuuaaaauacugacaacuuuuucugugaaagguaggaaacaauaggaaauaggaccagacaaagccauaacucuuugagcaggcagaaugaggaggaagc

SEQ ID NO: 4230728 - RNA, 57 nt, Human
guagaauggggcucucaaagcauuuuaacucaguugcuuuaggguccauuuuuuuau

SEQ ID NO: 4230729 - RNA, 72 nt, Human
auugagacugaaauuacugaagauaugacucuuuccuccucuucagaauuaucauaauuuugagguuucaau

SEQ ID NO: 4230730 - RNA, 56 nt, Human
gaugaugaugguuuaacuucaggaaagugacuuuucugacuucuuuuauuaucauu

SEQ ID NO: 4230731 - RNA, 68 nt, Human
gacuccuaucauuaggagugcugcucggagguuacucaccuuugggaguaauacugaagagagggguc

SEQ ID NO: 4230732 - RNA, 57 nt, Human
ccagacucucucauuuuccuguuucuucauggaauauagggaggcggagggagcugg

SEQ ID NO: 4230733 - RNA, 106 nt, Human
cuuggugaacaguuuuaaaaagcagagggcugugcuaaauuucaggguauugauagcuugaguuuacauuguauuagcccugcucguuaucauuuuuuuccccagg

SEQ ID NO: 4230734 - RNA, 62 nt, Human
gaaugggaaacucuaaacuugaguaaggcauuucaccuugcucuguucaguguaucuuguuu

SEQ ID NO: 4230735 - RNA, 79 nt, Human
gcugcagugcuggguacaaccaugucaguucaaaccagauucaauuugguugguuaaugugcccauuucccauugcugc

SEQ ID NO: 4230736 - RNA, 107 nt, Human
guucugaaauagguuuuacuuuuuuuggagguaauauuuugaaacacauguuuauuuuaaccauccaaaagcuuuucaucaagugaagcuuaacugcuuuuuagggc

SEQ ID NO: 4230737 - RNA, 118 nt, Human
aaugcuucuuccuugguccgagugcuggugggagggaguccugggagcaccuuuuuacuggugcugcacccuucauuuucccauguagcugcuccccaacaccaccccaaggagcauu

SEQ ID NO: 4230738 - RNA, 57 nt, Human
ccaaggcuguggggcugugcagggccucucaagugguacagccguaaugguccuugg

SEQ ID NO: 4230739 - RNA, 122 nt, Human
ggccuguggcucggggcgcuggcggggggccccgggcgcggcugcgggccuugcgagccccccugccucugcggccuagcgcccggcgccgccugccgcgucaacugcucgggccgcgggcc

SEQ ID NO: 4230740 - RNA, 88 nt, Human
guccagugugaggugcagcugguggagucugggggaggugugguacggccuggggggucccugagacucuccugugcagccucuggau

SEQ ID NO: 4230741 - RNA, 98 nt, Human
agcaaccauuugaucccggcuucauuucaggcugaagaauaauuucuucugguuguuuuucuucggugcuggguugauccuggggccgaguggcugcu

SEQ ID NO: 4230742 - RNA, 76 nt, Human
aguuaugaucugaguucuagauguauuauuaauggcuucaaaagugugaggcuaugaacgcacugagaucauaauu

SEQ ID NO: 4230743 - RNA, 74 nt, Human
cauuuuuaaauucuguacuagaucuuaucaguucacaugauaaugaauuuaagacuguggugcaguuuaaaaug

SEQ ID NO: 4230744 - RNA, 65 nt, Human
ugaacuuuuucuuaggggaaagcagaaauccuaucccauccugcugcacucacaggaagaguuug

SEQ ID NO: 4230745 - RNA, 78 nt, Human
guuuaaguuaguauggguuagguuuucugauaauuacaggagaaagcauucuaaccgaucgacgcagcuaauauaaau

SEQ ID NO: 4230746 - RNA, 60 nt, Human
gcugcuucgcugcacacccgagaaaguuucagccaaacuucgggcggcggcugaggcggc

SEQ ID NO: 4230747 - RNA, 79 nt, Human
uugaauaaggcauaaagauacucugcaguauugacauaaauaaaaauaacagcaaaaaguguuuuaugugccaguuuaa

SEQ ID NO: 4230748 - RNA, 113 nt, Human
cccgucuugaacuuugagaaauuccccgggucugugugaaauuccaguuccaaauaauucacaugaaugguucacaagaauccagguagguuugaucuaguucccuagauggg

SEQ ID NO: 4230749 - RNA, 86 nt, Human
gugguucaaucagaauaaaguauuccccaaguauucuggaucccuaaggaccagugcuuccaggaauacgguacugaugauuccau

SEQ ID NO: 4230750 - RNA, 82 nt, Human
acaaacucaaagcauuuuagauaaagcaucagucuaauauauuauagauugauggaguauaauaaaaugacauauagucugu

SEQ ID NO: 4230751 - RNA, 58 nt, Human
acccaggcuggaaugcaguggcgcuaucuuggcucacugcaaccuccaccucccgggu

SEQ ID NO: 4230752 - RNA, 77 nt, Human
cacauacugaucuuaaguaacauuauuuuauagaacuguuuaaauggguuuaaaugguguucuuuagaugaaaugug

SEQ ID NO: 4230753 - RNA, 85 nt, Human
gugccgcacuugggguauuugacaaacugacacucuaccacauggaguguccaacucagcuugucaaauacacggagcguggcac

SEQ ID NO: 4230754 - RNA, 74 nt, Human
acauauuaaaguucucaagguuaggaaaagucacuauauuuguauacuuccuuaauuuggggaaaauaaaaugu

SEQ ID NO: 4230755 - RNA, 76 nt, Human
uguuuuccaaauuagaagcuguuagcaaaauaugucacuauaucauucugcugccuaguuuaugaauuggaagaca

SEQ ID NO: 4230756 - RNA, 94 nt, Human
ugugagacaaggguggccgggugcucuggaggugcuggggugguccccucacggccccucugagcuuacucugucuuccacacuuuguugagca

SEQ ID NO: 4230757 - RNA, 64 nt, Human
auauuuuugguuucaccugcacgccagguauauucauuuggcugagcagaacaauuagaaauau

SEQ ID NO: 4230758 - RNA, 73 nt, Human
cuggggucccgcagucggaauuucucaguguucuacguaggggaugcuaggagccucgacucuggagucucag

SEQ ID NO: 4230759 - RNA, 56 nt, Human
ucagcauggagacaaagugggcaugguaugccugcacgcacuugcucuccagcgga

SEQ ID NO: 4230760 - RNA, 66 nt, Human
ccgauuuaugucucugacuugauuuauggaaauaauacuaguuguugcaucagcaggcauaauugg

SEQ ID NO: 4230761 - RNA, 64 nt, Human
gcggcuggcuguccaaacugggcccgcguccugaagugaccccagccugaucucggccagcugc

SEQ ID NO: 4230762 - RNA, 82 nt, Human
gggacaucauguauaugcagcguuuguuuggaauuuucuuugcuuuuguuuucuuugcgguuguucugugugcauggauucc

SEQ ID NO: 4230763 - RNA, 69 nt, Human
ugcuaccgaacagauucaucuaguggcuacaucagcaccuugugcuuucagauaucuguuucaauggca

SEQ ID NO: 4230764 - RNA, 80 nt, Human
gcacaggcugggacgacgggccccguggccacccuucccgccagggugguggucaggagcgcccguuggucagccugggc

SEQ ID NO: 4230765 - RNA, 59 nt, Human
uugacuauacucuggcggaaaaaggagacaaugucuucaauuccucaggugugaguuag

SEQ ID NO: 4230766 - RNA, 75 nt, Human
cagcagcucagccuccuucccauugguucucacaaagcaugcuucucuggguggagcaggcuggugcuucaguug

SEQ ID NO: 4230767 - RNA, 75 nt, Human
uauuuucacauugcauuuucucauuugauuauuaaaaaaguaggcagggcaagugaguauguauuguguagagua

SEQ ID NO: 4230768 - RNA, 84 nt, Human
uguucaaggucacacacaagacuaaguggcagagcagugguuagaaccuagccugcuuaucuccuuaguuuuugcccuuguuca

SEQ ID NO: 4230769 - RNA, 60 nt, Human
cccuucauguagcuguguguccaaggggacagagacuuuggaauagcuuaaagugagggg

SEQ ID NO: 4230770 - RNA, 85 nt, Human
gcuucuuccagacuguaauuccacacucccgcaagcgcuggggcugcggaaucguuugagggaguuggaacugcaucagaugagc

SEQ ID NO: 4230771 - RNA, 55 nt, Human
cccagggguugaggccguagggggcccgcucugcugcguugaccagacuccuggg

SEQ ID NO: 4230772 - RNA, 89 nt, Human
gcaugacuguggguggaaugugagugugugugugugagacagacagugugugugugugcgcacacaaaugcauacgccagugauuaugc

SEQ ID NO: 4230773 - RNA, 120 nt, Human
uacccucgaugccacuggauacucacaagcaggguuaugcuccuucaucuugggcuuguuugccuaaaugaaaggguuuaauuuauuuuguaccuccuaugcgugggauaguccagggug

SEQ ID NO: 4230774 - RNA, 67 nt, Human
gcugggugggcacccagccugggcugugggcacagggacagccaucccaggcuggggcuccuccagc

SEQ ID NO: 4230775 - RNA, 68 nt, Human
gcuguugggcuguuucuuaaggauaugauauuuuauuuauuuuaacauauucagaaacaccuaguggu

SEQ ID NO: 4230776 - RNA, 69 nt, Human
guuuuuuccugguuacagauuguguucaccuauugaaaauuaaaaauacauuuuguuuauggaaaagau

SEQ ID NO: 4230777 - RNA, 93 nt, Human
guggcaugaauggcccccagauuccuggccugaucucuggaugggcgaagaagaggggaggcagaggagcuggaaacauggggcaggguccac

SEQ ID NO: 4230778 - RNA, 82 nt, Human
ggagggggcugggggucaggaugaggccuugggcuuggcccaggcucuucccucuggccaagacuuguccagccccaccucc

SEQ ID NO: 4230779 - RNA, 73 nt, Human
ccucccaaagugcuggaauuauaggggugagccaccgugcccugccccucaguuugcuaguauuuuguggagg

SEQ ID NO: 4230780 - RNA, 127 nt, Human
guauuuuuccggcuuuuucccacacaugccaggcccuccgcagcugggguuggcgcuggucguuacccucagccccaauuacagcugugcuggaagcugggagugggugcuggggcugggggauugc

SEQ ID NO: 4230781 - RNA, 129 nt, Human
gggggugacccacacacguuuaauuugcacugacguuguuuguuuuggugucaugcgugaagccuuacuuguucucagucauguuuaccagacguauuaucaugcauuuuuguuuucugucucuucccc

SEQ ID NO: 4230782 - RNA, 60 nt, Human
aauguuugaacuuugcauauuugacauaguuccugguaggaauagcacagcucaaacauu

SEQ ID NO: 4230783 - RNA, 80 nt, Human
gcugaaucuccaaaucugauugcuaccuuuugagauucagaauuacuguuaggaaggugcauuaguuuggaggggguagu

SEQ ID NO: 4230784 - RNA, 65 nt, Human
ccuuuguagauuuucucuccaguaugaauuuucuuauguuuacuagacugagaaucagcugaagg

SEQ ID NO: 4230785 - RNA, 75 nt, Human
cccaaaagaugauuccagaacaauguggacguauagcgacagagauauacacauguuauuguggaagcugcuggg

SEQ ID NO: 4230786 - RNA, 83 nt, Human
cacucacucacuugcagugcagcuggaauaucuugggcauuaaucugagagaaugcugcauugaaaugcaaaaaugaugcuug

SEQ ID NO: 4230787 - RNA, 78 nt, Human
gguucaguuuguauauaagauaauaacuuuuuuauugaaaaacuugugaaggggaaagucuugcuauauccuugagcc

SEQ ID NO: 4230788 - RNA, 92 nt, Human
cguugaucugagaaaaacaaggguguacagauaugagagugccauuuggggaccucuucauuauucacgcccuguuuuaaacuugauuuuug

SEQ ID NO: 4230789 - RNA, 73 nt, Human
cagcguagcaggauggaguaacgugaaaugcaauucuacagcaguuuuuacgucuuugcugccucguucguug

SEQ ID NO: 4230790 - RNA, 73 nt, Human
ggagauagaaauguggaguugguuuccuuccuuuccuucuuggggaaaaucaaaccauuuacaguucauuucc

SEQ ID NO: 4230791 - RNA, 65 nt, Human
uagcguucuugcaugcuaaccuaagguagaagauuagcagccuguuugcaugcagccggaugcug

SEQ ID NO: 4230792 - RNA, 61 nt, Human
ggcugugguggacgcgggaaacaacgggaaaguucuugacagagucuguguccgcucaguc

SEQ ID NO: 4230793 - RNA, 83 nt, Human
ggaacugcaugcacguuuaauauuacacuuaccuugucacaaaacauuucaauaaggaaagugagugcuuaaagugcagaccc

SEQ ID NO: 4230794 - RNA, 59 nt, Human
uuaggggcuuaggcagaguuugcugagguauaaggcagcaagugcuguuagcugccuga

SEQ ID NO: 4230795 - RNA, 72 nt, Human
aagauaagaggccaguauacaaacuuccggugugcugggcacugggacuguaugugcuggacugaaaaucuu

SEQ ID NO: 4230796 - RNA, 58 nt, Human
gcuuccuuuugcuucucuaccuuuacaaaaauuaauuuugggugagggagcuggaagc

SEQ ID NO: 4230797 - RNA, 67 nt, Human
agggacucagaggcugagcugcgggaugagcugcuggacucgccccccgccucacccucgggcuccu

SEQ ID NO: 4230798 - RNA, 60 nt, Human
cuugcuuguuuuguggcuucagcuguguggauacagagcaggaaggcuagaagcaggaag

SEQ ID NO: 4230799 - RNA, 62 nt, Human
gcaccugguucuuagguacucauauuuaauuucuaguuggaauuugagaccaagaaaagggc

SEQ ID NO: 4230800 - RNA, 58 nt, Human
ggccauggugagccaccugguggggggcauccugcccacaugugagcccaccgugccc

SEQ ID NO: 4230801 - RNA, 65 nt, Human
gagaauuggcaggcugcauguuuaugugaaccuucagaaaacauggaaacacgcagccccaacuc

SEQ ID NO: 4230802 - RNA, 66 nt, Human
uuuugucuguggaaagcugcuacccccaggagacaagcaucugggagagcaucuccacagaaaaag

SEQ ID NO: 4230803 - RNA, 59 nt, Human
uuaucuuuuaaaaacacuugugauugauuuugaucacauugguagaauuuagaagauga

SEQ ID NO: 4230804 - RNA, 81 nt, Human
ggaacccugggucucuggccaccccagccccauaguacuggcucagcaaguggcugagggauggccggggcucaggagucc

SEQ ID NO: 4230805 - RNA, 77 nt, Human
gauuuuuaauacacuucauguuuucaucuguggauguuaauuacagaauagcugacagcagaagaguauuuuagguu

SEQ ID NO: 4230806 - RNA, 57 nt, Human
uggagucguguuugggaucggagcugccugugguucugaaccauugagcacugccua

SEQ ID NO: 4230807 - RNA, 77 nt, Human
ucaguggaacacuaaaggucaguuagaagauaaucaguugaagugcuuuuaaucuaauuuuuauauugauucauugg

SEQ ID NO: 4230808 - RNA, 67 nt, Human
gcccaggaggcugaauugggguucuaggugugcagccuugguuucccuuuuggccucuccuuugggc

SEQ ID NO: 4230809 - RNA, 56 nt, Human
aggucuuuaguggcagagucuaggucuuuuccuuacucuguaauucugaagcaccu

SEQ ID NO: 4230810 - RNA, 72 nt, Human
ggggcuugagcuggcuaagauccaagaaaggcauccauguaaggugggcuguuuuucuucuuuucaggcucc

SEQ ID NO: 4230811 - RNA, 56 nt, Human
uauuuaggcagaaagugauauuuugaauauagcaaaauuccuuucuauccugggua

SEQ ID NO: 4230812 - RNA, 74 nt, Human
guuuaguuuuauuuuaguaauacuuuggccuuuguaguugccgagugguaaaguguacugaauaugaauaaagc

SEQ ID NO: 4230813 - RNA, 59 nt, Human
cacccugacuggcccugcaggagaggguggcucuuuccccuggagacaaagacagggug

SEQ ID NO: 4230814 - RNA, 64 nt, Human
uagcacaagguauaaauaacucgggaggucaucucuaucuucuuuccuuuugugcauuuggcua

SEQ ID NO: 4230815 - RNA, 61 nt, Human
uguuuucuuuccccuucuuuucuaugguuaaguucaugucauaggaaggggauaaguaaca

SEQ ID NO: 4230816 - RNA, 63 nt, Human
acugaaugguuacuacccugggucuucuaccgaaagaaagaacaugggugugggcauucaagu

SEQ ID NO: 4230817 - RNA, 60 nt, Human
ggaaaggggaaaauacagagagagaaauuaaaucaguaucucaaagguuuuccucuuuuu

SEQ ID NO: 4230818 - RNA, 95 nt, Human
cuacuguuguggcuuuugcaaauuacuaaauuucucugugacuacuuuuccauuucuuaaguaauuugguugguuuccaaaagucaauaaugugg

SEQ ID NO: 4230819 - RNA, 116 nt, Human
ucaucaucuggcaaaaaagggaaacaggguaagagagagugacauuuuaacacauuacuaaaauguuuaagcuuuuauuuacacauccccuucucucaguuucccagguuauauga

SEQ ID NO: 4230820 - RNA, 67 nt, Human
agacuaggaugcuguaauggugucugguauauauauccacgauacaaucauauaguaccuccacucu

SEQ ID NO: 4230821 - RNA, 130 nt, Human
uuggcacuguccaaguucuuggcauauuauaguucaguuaugauuuucaugguagaguuacaauacuuguuuuugcccuaaagaagucauucacaugguuuacaaauguuaaggcaaugagauaggacag

SEQ ID NO: 4230822 - RNA, 67 nt, Human
cauuuucuuuaaagucaggcuguagugguuccgaaaugaaaauuaggcccugauuuuauguaagaug

SEQ ID NO: 4230823 - RNA, 69 nt, Human
ccgaacccaagacaagcacuggccaugccuccuucccagcauugccccugcccucugugguccauucgg

SEQ ID NO: 4230824 - RNA, 56 nt, Human
gaaaagcucuuuagaagagguuauauuuuuauuauccuuauuuuggagaacuuuuc

SEQ ID NO: 4230825 - RNA, 68 nt, Human
caucuaugaaccauuuaauggagaugcuccugaaaggugcaucuguaauuacaauggugccauagcug

SEQ ID NO: 4230826 - RNA, 58 nt, Human
guugcaaaugggaagaugguuaacagcugaaaggagguucaucuuucaaauuugugac

SEQ ID NO: 4230827 - RNA, 63 nt, Human
gcaccuggaggcagcaccgggcugggagcucugagcucaggcucguaaaggccucacaggugu

SEQ ID NO: 4230828 - RNA, 72 nt, Human
guaucgcccaggcuggagugccaguggagccaucucggcucacugcaagcaagcuccgccucccggguucac

SEQ ID NO: 4230829 - RNA, 56 nt, Human
acugaaggcuggaccaugcauccuuaaaaguauugcaugagcaucuccaccucagu

SEQ ID NO: 4230830 - RNA, 76 nt, Human
ccuguugauaaaaugaaacuaguagaaucuuugugucaaguauuacagucugcuggcuuuuucagcauugaccagg

SEQ ID NO: 4230831 - RNA, 76 nt, Human
uauaucuaggcugaauguaaaaucccuuauguuguaucaauggggguaaaaacuauuuuuauuugccuaugauaua

SEQ ID NO: 4230832 - RNA, 75 nt, Human
auccuugacuguagugauauuaguuuuugauguuauuuuauugucaguuuaguaguguuauuaauuaguaaggau

SEQ ID NO: 4230833 - RNA, 110 nt, Human
ucacgagaaagcugaucaagaaggcggaccagaagggagugaccaucaucggaccugccacugugagcuuccccuccggaaagccuuuuacguucgaugcuaucuuauga

SEQ ID NO: 4230834 - RNA, 58 nt, Human
ugugccgaugaggccuggcauucuuguccagagacagaguaaggaaguguuggccaca

SEQ ID NO: 4230835 - RNA, 102 nt, Human
gcagaccuacguacucuuuaguuaauaaauauugagugucugguaugugccaugcccuauacuagguggauauacaaagaugaacaaaaacagugucucugu

SEQ ID NO: 4230836 - RNA, 57 nt, Human
ccuuagcagacagauggagagagacauuccaguuuguuuccagccuuuugucuuugg

SEQ ID NO: 4230837 - RNA, 79 nt, Human
uccaguaccccaaauguguagaggggagagccgcaccagggcuggcauggcuucagacuucugcuacguggcuacuggg

SEQ ID NO: 4230838 - RNA, 103 nt, Human
uugagauggagucuugcuuugucacccaggcuggagugcaguggugugaucuccacucacugcaaccuccaccucccagcuucaagugauucuccugccucaa

SEQ ID NO: 4230839 - RNA, 68 nt, Human
ugggaguggaugggggcuggagaagaggggcuugccaggugaagcuccaggcccucaauccauuucca

SEQ ID NO: 4230840 - RNA, 82 nt, Human
uaccuuugccucugcuagaaggucaaucucuuuuccgcuuaagaggagaucugggcuguuucuggcaggggaaagaagagua

SEQ ID NO: 4230841 - RNA, 69 nt, Human
uuggaaguagccuguuauguaguucaaaaugaagcaaaucaacugagcaaacacagauaggcuuaccag

SEQ ID NO: 4230842 - RNA, 86 nt, Human
ugccaguauccuucugagacccauucuuaacuuuauggcuuuuuuucucuucucuugucucacaaucuuugaaggaaucucaggca

SEQ ID NO: 4230843 - RNA, 67 nt, Human
uguuuuuagcauaugucaaaucagacucuaaggauucuagaaagcugaaauucagaugcuaaagaua

SEQ ID NO: 4230844 - RNA, 93 nt, Human
gagugcgcugcggaggcugcagcggcgcgucuccgagcuggaggaggagucacgccuccaggacgccgacgugucggcugccucguugcaguc

SEQ ID NO: 4230845 - RNA, 95 nt, Human
gaacagcacaugggggaagagagaagaaugaucuuuacaacauagccuuagucgagaacauaucuguuuucuaacucccucucucuggguuguuc

SEQ ID NO: 4230846 - RNA, 118 nt, Human
ucagcaccugcaaggggaugcugggugagauccugucugcauucgaguucauggaugcugugugcaugcagcuggucgggcgccaucuccaccuggccagcccggugcaagguacuga

SEQ ID NO: 4230847 - RNA, 56 nt, Human
gcguggaugauuuugagucgguuugaacaaaagccaccaccaguaccaucacacgc

SEQ ID NO: 4230848 - RNA, 77 nt, Human
uggacugaugaauggaccuuaaauugcuucagguuguucaacuugaacaguuuugucagguucacuuucaucuuuca

SEQ ID NO: 4230849 - RNA, 60 nt, Human
gcagcaggccaccuaagguugugcaucaauuagcaauuaggucacacauugggugguugc

SEQ ID NO: 4230850 - RNA, 85 nt, Human
uagcauuuguucaacaugcaugaucccgguaugugaaguacagauaugacauuuauaagccagacacugcguuugacuaauguug

SEQ ID NO: 4230851 - RNA, 75 nt, Human
agguucuguugucauuuucuuaauguuccugacacuuugucaagaaauacagaaauggcaguaauuucaguaccu

SEQ ID NO: 4230852 - RNA, 87 nt, Human
gugcucaaggcuuguccuucugguugucuuugcgugggagggagaggagcgcaggacguaacccaggacagccuuccagaaagcagc

SEQ ID NO: 4230853 - RNA, 65 nt, Human
ucuucacaaugggagaugcagaacagcuggcaggaaucaauguacucuguguuucucaugggaga

SEQ ID NO: 4230854 - RNA, 66 nt, Human
ugcuuucuaagcaugaaauaauguccuuguucucaugggaguaacacauguuuaugcuugggggca

SEQ ID NO: 4230855 - RNA, 114 nt, Human
cuuuucuuuuuaaaaaucccccuuacuauagauuuguauagaugugguugaagucacagaugccauauucuucaucuuuauaaugcaaguuuucuuuccagguagaaggacaag

SEQ ID NO: 4230856 - RNA, 58 nt, Human
gagcugcucaggacuccgcuuaccaaaaucugcuggguugugguagguugggcaguuc

SEQ ID NO: 4230857 - RNA, 70 nt, Human
agccuuuguacauagaauauauaaaugucgugagucaucuuuacgagguuuaugaguuuguguucggguu

SEQ ID NO: 4230858 - RNA, 55 nt, Human
auuucucuuguauuugaaucacugaggggaaaacaguagucgauucaggagaagu

SEQ ID NO: 4230859 - RNA, 90 nt, Human
agaauugauuguuuuaccuuucucagagaaagcuccucauguaguuguuuaguaugaaagguuuuuucuugaaaagguuaaaaaaguucu

SEQ ID NO: 4230860 - RNA, 84 nt, Human
uugcaacauggaauuucagaagagcauguauuucuagucugagcacccuuuuugaaauguuuaauuugaaauuuuauugugcaa

SEQ ID NO: 4230861 - RNA, 73 nt, Human
uauaguaugugccuguugucucugcuauaucuaucaccuucaugugaagacagagaaaauagaauaugcugug

SEQ ID NO: 4230862 - RNA, 60 nt, Human
uauugauuuuguugcuaccugggcugaaagauacagccacaggcagaaaucaagacggua

SEQ ID NO: 4230863 - RNA, 61 nt, Human
guggaggcugcuggcaggcguggacgucucagaugucugauccuucaggagcccccuccac

SEQ ID NO: 4230864 - RNA, 75 nt, Human
auaacuaguucugccauucagugucacaugucugugucugauuuuaugaccuccuaagugacagaauucgguuau

SEQ ID NO: 4230865 - RNA, 60 nt, Human
ucacccccucuuccccucauugcuuagacacagcuaagcagugacucucagaggcagugg

SEQ ID NO: 4230866 - RNA, 85 nt, Human
ggagaaucgguugaacccaggaaguggagguggcaauaagcugagaucauaccacugcacugccuggguaacagagcaagacucc

SEQ ID NO: 4230867 - RNA, 78 nt, Human
guauguguauaucucugugugugcauguguguauacauauauauguauauacacgcacauauacauauauacauauau

SEQ ID NO: 4230868 - RNA, 109 nt, Human
aaccuggcauuuccuaggguucauuugccggguaguuugggguccuuucuuaacucucccaaauuuauaacuuaaagugaauaaccugggccacuccgaugcguagguu

SEQ ID NO: 4230869 - RNA, 79 nt, Human
uuagaaggaaaaaaauuaaugugagucaaauuuggaacauugcuaaauuggauuaaaauaucuuuuuuuuuuuuuuuga

SEQ ID NO: 4230870 - RNA, 89 nt, Human
cuugcagugccuucguucgucuguggugugaggugcugguccaggcuuacgcgcuaacagugaauuagaaggagaaaacgcucugcgag

SEQ ID NO: 4230871 - RNA, 62 nt, Human
uaucgagugauuauucuggcugagauguguuauuugguuucuuccuucuugaucauuuggug

SEQ ID NO: 4230872 - RNA, 73 nt, Human
ccugauaugcaucccugaggcauuauccugagcagccacuagauguccauaaugccucauaggguguuccagg

SEQ ID NO: 4230873 - RNA, 60 nt, Human
cuuugugcagcagaaauguguguccucccauccccaggccauuauuucuucugcccaaag

SEQ ID NO: 4230874 - RNA, 93 nt, Human
cacaagugcauuugucauugaauguguacacgauuguuugaggaaaguauuugguuuaacgaauugugcauaauuccacuguuugcacuugug

SEQ ID NO: 4230875 - RNA, 81 nt, Human
accucuugauaguguccuguagaaacuguuccagcucagggaaaggggagaugcugcggauauacaggaucuggagggggu

SEQ ID NO: 4230876 - RNA, 76 nt, Human
acgcgcugagccccucacgcgcccuccugggcccuggcggacccagaggccccauuggcugugcgucucaaggugu

SEQ ID NO: 4230877 - RNA, 82 nt, Human
aguucgccaccccuaccgggcagcucugccccugccagggauuggccggcagguggcacugcugcucccucugguggccgcu

SEQ ID NO: 4230878 - RNA, 109 nt, Human
accugucuguugauuucucauuaauuaaaucccagcuggcaaaggcguccuugaaacucaaguggugagacccugcugaaauuugguugccaugggugcagauugaggu

SEQ ID NO: 4230879 - RNA, 77 nt, Human
gauauuagaaugauauuaguuuuggaaggaggggauggagaucuuccccuucuaauacucaauuuuguuuugguauu

SEQ ID NO: 4230880 - RNA, 79 nt, Human
ggccccggccaggccccagggacugggcgcuuguuuucuuagagcacagcguacuugaggcuuggggccagguggagcc

SEQ ID NO: 4230881 - RNA, 55 nt, Human
gcuagaaacuguuuaaucucuuuuauaugaaaguaggauugaacuauuucucagc

SEQ ID NO: 4230882 - RNA, 68 nt, Human
uagcuuaucucuuuuuuuaaaacucuaugcuaacagcaauggagccaagaggaggaaaacauaagcua

SEQ ID NO: 4230883 - RNA, 122 nt, Human
caggauccuacuccaacaaugcgaauggcugaugucuguucuguuaugaaugcucuacuuccgucucauaggcggagccauaucauccaccccauuuugccuauucggacuaucauuuccug

SEQ ID NO: 4230884 - RNA, 81 nt, Human
cugccucaacaaucagcacugaguuuaucuuuaugcuuggcaccaaguaggugcucaguaauugauuguuaacugauguag

SEQ ID NO: 4230885 - RNA, 69 nt, Human
gcuguguccucaucauccuuuuuugaagaguuuggcaaacuguugagggaagcagaugaaauggacagc

SEQ ID NO: 4230886 - RNA, 67 nt, Human
cuccuuuaaaaauguauuuuuguggcagcuucaaggcaguugcaagauaguguauuuuucaauagag

SEQ ID NO: 4230887 - RNA, 69 nt, Human
ucuuucuugguugaaauguguucaugcuuugacuuagcauugguggcauuugcagcuauuuuggagaga

SEQ ID NO: 4230888 - RNA, 61 nt, Human
augaagcuucucaacugguggaaugcugccagaggauuucaacagaguuugaaggcaacau

SEQ ID NO: 4230889 - RNA, 128 nt, Human
gagggcaaaaggaguccuggggaaaacagcagggaaagguugaagagggcaggcugguuggggucugugggaggcaggcgcccucccuguccgucuucccuggccccuccagccuccagcucacccuc

SEQ ID NO: 4230890 - RNA, 60 nt, Human
gcggcaccaucagacuucugggcaggcaagauuaccugugacucugucugauggucucgc

SEQ ID NO: 4230891 - RNA, 55 nt, Human
acugaaaguugaugagucacugugccucucgggguagugaguuaucagcuacagu

SEQ ID NO: 4230892 - RNA, 94 nt, Human
cccaaauaagaaacagagugggucccacgauguaccugucugaaaugcaaaugcagcuggacuguaaauuggggacucuuugaucucuuguggg

SEQ ID NO: 4230893 - RNA, 59 nt, Human
guuggaggccacagucaucuuuaacaucuaguauguugacagguucuaugguuuccaac

SEQ ID NO: 4230894 - RNA, 66 nt, Human
ugcagguggaagcagcagacucagcauaggucucacugcccugaccgucagcugucuuccauuuca

SEQ ID NO: 4230895 - RNA, 64 nt, Human
ccuggagaucaguuggacaacaguaucuucucagagcuguucuccacuccugacuucuccuagg

SEQ ID NO: 4230896 - RNA, 55 nt, Human
caguguuuagcacagugcuuggcacauaguaagcccuaguaaauguuaaauauug

SEQ ID NO: 4230897 - RNA, 97 nt, Human
cagugugaagguuuuuauacuucugccagaggacaacguaauaugaaacaccgaguuuuauuugucucuacagagaguaguagugucuuucaggcug

SEQ ID NO: 4230898 - RNA, 61 nt, Human
gaaaaagagaaggaguucaguaauggugaugccaucaguccacagagauccucucuuuauc

SEQ ID NO: 4230899 - RNA, 56 nt, Human
caggaggugugucccaccgggugugggugccacugccugcuugaaagcacuuucug

SEQ ID NO: 4230900 - RNA, 92 nt, Human
augugcuuucugcaugguuauauacuacuagugauuuuaucaaaacuucuaaaauuuaaauuacgugguaaaagaucuguaaaaggcugcau

SEQ ID NO: 4230901 - RNA, 75 nt, Human
aguguacuuaagcacuaauauuuuggcaccuuugaaaagaacagggcugcaagacguuauuagcgucaguacauu

SEQ ID NO: 4230902 - RNA, 127 nt, Human
aagggugcaacuuacggcaagccuguccaucaugguguuaaccagcuaaaguuugcucgaagccuucaguccguugcagaggagcgaguuggacgccacuguggggcucugaggguccugaauucuu

SEQ ID NO: 4230903 - RNA, 73 nt, Human
gaagaagguggaguagaacaagcuauuguacauuuuaaaaccaucagggaguuugauuugucuaucuucauuc

SEQ ID NO: 4230904 - RNA, 63 nt, Human
ggaaaaugcugaagcaucugaauaaguuuaggucggccccuuucuucaggcuuuucauuuuuc

SEQ ID NO: 4230905 - RNA, 60 nt, Human
acucucagugacuuccugcucaauuccucuugggaaucuugggacagggacacuauuagu

SEQ ID NO: 4230906 - RNA, 96 nt, Human
ggguguggggcaggcagagagggaugguguccagagauacaucacacuuuacauccuaucuuacuguccucuguuuuucuuacccuccuuacaucc

SEQ ID NO: 4230907 - RNA, 73 nt, Human
cgagaagucgaucaccucguccuccgugccguggaugaugagcacgggcgacgugaucuaggacaccuucucg

SEQ ID NO: 4230908 - RNA, 75 nt, Human
uugguugcaguggugcuuauacaaaucuacucaagugauaaaaugacacagaacuguauacacacauuguaccaa

SEQ ID NO: 4230909 - RNA, 126 nt, Human
auguuuaaaucacuuuuauuccuugcuuucuuacauuguuuuugugacuucuauuauugauguuauaauagaagugaaaagggaugacuaaggaaaaacgggggguaacgaaggggauuaaaauau

SEQ ID NO: 4230910 - RNA, 103 nt, Human
gaaacaagcugggaaccaggcauggcaaaacccugucucuacuaaaaauacaaaucuauuguauuaggagagugggugcuaagucuaguucccugcucuaauc

SEQ ID NO: 4230911 - RNA, 65 nt, Human
uucugaaaaagucuuaaaguaaggcaaaugacuugggguaaugccuacuuuaguacuuuaaagaa

SEQ ID NO: 4230912 - RNA, 64 nt, Human
gcuguacauccuuuugaaaucccagagaucuucagucucccuguggauuaaggagaugugcagu

SEQ ID NO: 4230913 - RNA, 62 nt, Human
gagggggaaaagggcagcagaguguacagcugggaacgcuauguuggccuucauucucuguc

SEQ ID NO: 4230914 - RNA, 125 nt, Human
uuuuuaacuagagggcauucuaagccuuuugucuguuuuuaucuauucuguuaauacuucagacagguaauauuagcacauaguaggcacaggcuacauuuuaguuuuuguuccuuuauuagaag

SEQ ID NO: 4230915 - RNA, 87 nt, Human
guuuuuaauacugugucuuuuuuaaugaaaaaauggacagaccauuuaaaaaccauuaauaccauugacagagguguaguugagaau

SEQ ID NO: 4230916 - RNA, 66 nt, Human
uugaaaucuucccuccugucugaggguuuguuuuuccauuugcuuauacaggaaggaaaauuucaa

SEQ ID NO: 4230917 - RNA, 72 nt, Human
cugauucugaaauuuuaguuauagaaaauggaacagcuuucccauuucagguggaaguuuuagaugaaucag

SEQ ID NO: 4230918 - RNA, 130 nt, Human
agcauuagagacauaggcauuauuaagaaauaugugaagugaugggugaccgagugagugauugauugguugacuuacgaccuuggcacccaucuuuccaccuaagugguuacugguugaauggugaguu

SEQ ID NO: 4230919 - RNA, 76 nt, Human
gugcuucccuuacgguguuucucguucaggguuaguguuaacuagaauccugagggaaauuuggcaaggagaauac

SEQ ID NO: 4230920 - RNA, 82 nt, Human
caggagcuggggcuggaacuucuucuggcauuugcuguucauucacaacugccauauuaggagcuucagccaucaguuguug

SEQ ID NO: 4230921 - RNA, 94 nt, Human
gugcucucuguccccaggaauccaaccaaagggccuaaggucuccagcacuuccccugagacuggagucuccuuuggagccuggagaagagcau

SEQ ID NO: 4230922 - RNA, 63 nt, Human
caauaguaaucaaugcaguuaggauguuucuguguaauuuaggaagacugccuugaacuauug

SEQ ID NO: 4230923 - RNA, 55 nt, Human
gaugaguuugccuggccugcagcugggaaaggcugguuguuagggaagauucauc

SEQ ID NO: 4230924 - RNA, 71 nt, Human
uagagggaggagaguucuauccagacucauguguugaccaaacaagugauuuagagagcucuuagccucua

SEQ ID NO: 4230925 - RNA, 71 nt, Human
uuccagguccuacuggcccauagugucaggacccuggcuguuugggcugugggcucucaugggaccuggag

SEQ ID NO: 4230926 - RNA, 55 nt, Human
gcacuuuuucccccuggugucaugucuuuggauauguaccgccuuggagaaaugc

SEQ ID NO: 4230927 - RNA, 75 nt, Human
gcaugcagauugccaggcucccuccacaccuacugaaccagaaauucuggaggugggcuuagaaaucuguauugu

SEQ ID NO: 4230928 - RNA, 88 nt, Human
ccuccccagcuuggcuauucgaucacugccgaggaccuagacuuagagaagaaggcuucauuacagugguucaaccaggccuuggagg

SEQ ID NO: 4230929 - RNA, 71 nt, Human
agaugcaucccuucccagacggcucagcuguugccccggguaacggugagacuggcgaaggaaaaaaaucu

SEQ ID NO: 4230930 - RNA, 82 nt, Human
gagcucaagacaaaugaaaacggaccagagcuauuccaccacguagugaaauccuggauuuuucaagucauguccugagguc

SEQ ID NO: 4230931 - RNA, 83 nt, Human
ucuuuauggacauggcucugcugggcaaagcaaggacgggcacauccagccuaugcgguccaucaggggcacucacauuuaga

SEQ ID NO: 4230932 - RNA, 82 nt, Human
auuagguuggaccauaugaaguugcccauauuugacuguuucaaccuacaaaaaaagucaaguucaugugguuuaacuuaau

SEQ ID NO: 4230933 - RNA, 57 nt, Human
auucugaagcagaaaaggcagagaaugaggacagaacagcucugccaguuuuagaau

SEQ ID NO: 4230934 - RNA, 61 nt, Human
uguuuucccacugguuuguacaugucauaguuaaagaccaauguagacuagcggggaaaua

SEQ ID NO: 4230935 - RNA, 71 nt, Human
ggggagucggggagcgugaccagagagagugacgucuguucgccuuuuucuuugcuuuccacuggcuuccu

SEQ ID NO: 4230936 - RNA, 88 nt, Human
guaaauuuuuguucaggaaugacuugcucauucuguguuuuuaaaaauaggaaauaaggcauagugagucaucauuacaucaauuaac

SEQ ID NO: 4230937 - RNA, 84 nt, Human
ggcccaggcccgcagccagggcugcuccgcccgcugcgccccagguaagccgggccagcgugggggaguagcggggccugggcu

SEQ ID NO: 4230938 - RNA, 84 nt, Human
ugaagcuaauccguuccuagaggagcugcuucuggguccgaguuuucucugcagcagagcagcucccuggaugggaucuguuca

SEQ ID NO: 4230939 - RNA, 75 nt, Human
aaugaaugaaugaaugauuauguacaaagugcuuagcauuguguugggcucaauaagugauauuuauuauuuauu

SEQ ID NO: 4230940 - RNA, 81 nt, Human
ucucuucccacugcaggaagauugcagaaggcuguggauuaauuguagcauuucacugaucuucacuccagucacuaggga

SEQ ID NO: 4230941 - RNA, 60 nt, Human
guccuguccugcugagcuccuguggacccaggagcugaggccccgcagcagggucagggc

SEQ ID NO: 4230942 - RNA, 56 nt, Human
cuauaagguguuucuauuggucauaccacaccagagaccgguaagugccuuuauag

SEQ ID NO: 4230943 - RNA, 60 nt, Human
uccccaccuaagauacccaucucccauuccucgggccagagggaagagcuuagaugggga

SEQ ID NO: 4230944 - RNA, 67 nt, Human
ccaucucaucugguugggggugcagauaucacucuuaguagagccucauucucaccaugugacaugg

SEQ ID NO: 4230945 - RNA, 68 nt, Human
gauccucagcaagacgcuggcagcccugcgccacuucaccccagaugucugccagauucugcuggauc

SEQ ID NO: 4230946 - RNA, 58 nt, Human
aaacccacauuccugcuuaggcaagucaagaauucuugccucuuuaguugauggguuu

SEQ ID NO: 4230947 - RNA, 71 nt, Human
gaggcggugguggcgagagucagucuuucagagcacaggauggaacaagaacuccagccacugacugucuc

SEQ ID NO: 4230948 - RNA, 127 nt, Human
uuaauaaggaugcuuugaauguucuuauacaagucuuugcauggacauguguuuucauuucucuuggcuaccuaucugagaauacaauuguucaguaauagaguagauauauguuuaacuuuauuag

SEQ ID NO: 4230949 - RNA, 57 nt, Human
cuucuguggcugagaaggcagcugcuuuaucagucugcagcuucucugcaacaggag

SEQ ID NO: 4230950 - RNA, 58 nt, Human
uagggggcuuugcugcuugacacaggcgcucccuaccauggcacccagagucccccug

SEQ ID NO: 4230951 - RNA, 57 nt, Human
acugcucugugguuggaagccugaaugugaaucgcugcaaccagaccacagggcagu

SEQ ID NO: 4230952 - RNA, 86 nt, Human
ggaggcgccggaggaggagacggaggccuggggacggcagaagaggcuucgccugagccgagcgcucuuucucucgccgcgccguc

SEQ ID NO: 4230953 - RNA, 84 nt, Human
uguuuucucugaaacccucuguucuuuaacgcugaaguccuggaugccugcuaggagcagcucgagaaggaagcagggacagca

SEQ ID NO: 4230954 - RNA, 55 nt, Human
uuaacagaugucauuucggcggcggcuggcccacugcugcugggccauuuguugg

SEQ ID NO: 4230955 - RNA, 61 nt, Human
aggugggaauaauaaucaaagcacguguuccuucaguacuuuggugauuuuuaaucccccu

SEQ ID NO: 4230956 - RNA, 68 nt, Human
ccgccgugcagucagcccagaagcggcucauugaaagcagacccucuucggcgcucgcugggcggagg

SEQ ID NO: 4230957 - RNA, 64 nt, Human
ugugcuugcgcauaacuggggccgccuggccucccgcgggcggccuuuuuaaccgcgagcgaca

SEQ ID NO: 4230958 - RNA, 64 nt, Human
cugguuuuccaauguuuugacuggagggcaaaauuuuacuacuacucaucuuuuuggagaccag

SEQ ID NO: 4230959 - RNA, 100 nt, Human
gcgaucuggaggaaguagccaaguguuuuucaugacccucaacagaaauuccaugaugaacugguaacagaagagcacuuggcacuuaucuucauggcgu

SEQ ID NO: 4230960 - RNA, 82 nt, Human
acacacaaguuagauggaauuuuuagagugaaagaauuaaguaggauuuaauugggugcuuuguaaauagucaacugugugu

SEQ ID NO: 4230961 - RNA, 109 nt, Human
gcaacaggacaagacuguacggcuaccagguugucuaauuccaaggggcacuuuaacauuauagucucugugaauggcgucaccugggguugugcagugcacugucugc

SEQ ID NO: 4230962 - RNA, 64 nt, Human
ggagguacauauggcagguugaucaauguuuaaauggaaacgugaucuguuauauagugagccc

SEQ ID NO: 4230963 - RNA, 63 nt, Human
uuuuuugguuuggggauuauuuuuagaucauaaggcuggagauggaguccugaagccagaagg

SEQ ID NO: 4230964 - RNA, 69 nt, Human
cucuauucuuuuaauuucugucugcagaagggcuaauauucaggacagaaauaaggaauauaauaagag

SEQ ID NO: 4230965 - RNA, 77 nt, Human
auuuauauacugccaggccacagcuaaagaggauucuuuacagaaucaaauuucuugugguuguuccguauacaagu

SEQ ID NO: 4230966 - RNA, 64 nt, Human
aucugcuugaggcuugucaucuaacacacuacguguaguugggugccagaggcuucacguggau

SEQ ID NO: 4230967 - RNA, 63 nt, Human
aaggcugugaacuuuucgggaacuggaacuguuuaacuugaacccaggauuguuuaaagcuuu

SEQ ID NO: 4230968 - RNA, 62 nt, Human
uguugcauguggcuguuugccaaggcacacaaagugcuuguaggcagcaaccauaugcuaca

SEQ ID NO: 4230969 - RNA, 56 nt, Human
uuaccuuggaccggguaucagagaugguguucuugacuacccggauagccagguag

SEQ ID NO: 4230970 - RNA, 64 nt, Human
auggugaaaugauuugaugucaugaccuuggcaagaacaagugauacaguucagcuuuuacuau

SEQ ID NO: 4230971 - RNA, 75 nt, Human
aucugcuggcuuuaguaauaaguuucucccuuaaaaggugaacgggcuuugacuaaaguguaaauaaacagugau

SEQ ID NO: 4230972 - RNA, 55 nt, Human
ucagcgucuccaaaagagcccgaacagcugaggaagcucuucauuggaggguuga

SEQ ID NO: 4230973 - RNA, 82 nt, Human
gugauucgaguaguccagccauaucuuguagcccuucuuugaaugagaggguggcuggaguggucuggugcugggauaucac

SEQ ID NO: 4230974 - RNA, 75 nt, Human
uugcucgcucugccugcccuaacuucccagccaggaucaggaggucaggaagccugggcgcaggcaggggaacaa

SEQ ID NO: 4230975 - RNA, 90 nt, Human
cugccaacucccuccccucucugcgcucccaggucaaggugcaauaauaucauuuggggacagaguggggguaaaggggcaguagggcag

SEQ ID NO: 4230976 - RNA, 96 nt, Human
aaaaauuuagcccaccgugguuuagccuucauuaaccugguaugcauuugaagaauucaauagaguuaaugcaggccaagccugaacuaaauuuuu

SEQ ID NO: 4230977 - RNA, 64 nt, Human
gugggccaguuccucacagguauaggauuuuuuaauuuccucucuuggagacucuuggccacau

SEQ ID NO: 4230978 - RNA, 98 nt, Human
gugugacagucaugacagaggagcuggaaugauucuguuuuucagaucuguucuuuuucucucugcauuugaacguugauaacccugacaaaucacac

SEQ ID NO: 4230979 - RNA, 77 nt, Human
gggcggagcuaccagcccaggcucagauguuggggugugaaagccucaagugacucagccugguuggagaacugccc

SEQ ID NO: 4230980 - RNA, 72 nt, Human
gagaccccugcuggggcugcuguauggacagagaucaauaacgcagucacagcaauccuggcagaggguuuu

SEQ ID NO: 4230981 - RNA, 61 nt, Human
ggaggcacugaaaguccuacagugaagaaacgcaucuaaguuuguuagguucaguguuucc

SEQ ID NO: 4230982 - RNA, 62 nt, Human
gcagaguauaaguguggagcugaucucucuaugucgauguccauuccacugcuuagcauugc

SEQ ID NO: 4230983 - RNA, 73 nt, Human
ggcuucggcuggcucuucucaagcauuggcuauuuggcacucaaguaaccaggcgagagagcggucaguagcc

SEQ ID NO: 4230984 - RNA, 127 nt, Human
cgcuuucucaugcacuuucucccuuucucucuccucucugaucuugcuccggggugagaaaauauuugaguuuuuguggaauggagcaagaagggaggcagaagcccagaacaggugcagggaugug

SEQ ID NO: 4230985 - RNA, 58 nt, Human
cuugaccuugugauccgcccacuuuggccucccaaagugcugggauuacaagcaugag

SEQ ID NO: 4230986 - RNA, 59 nt, Human
gguugaagcuacuuucuggaugccuaguuacugcugaugucuagacauuagcuucagcu

SEQ ID NO: 4230987 - RNA, 95 nt, Human
ucuauuuucauaauugcuuuuaugccaaaaauaaguuuuaugcaaacaaagauuuugugaugaugccaaaauuuggcauucagguugaaaauaga

SEQ ID NO: 4230988 - RNA, 122 nt, Human
uuucauaagagcugaauucuggacugcagauaaguguuuugaaaaggcuuggaaagauuuuucggggcgacuuagguucuguuuuguuuguuacaguccaaauacauaaaguuauuaugaaa

SEQ ID NO: 4230989 - RNA, 110 nt, Human
cagggccauggaaggaaugaucuaaaggagaggagucauugggauaaggccagccucucauauucuucaacuuuucuccucuggucccuguucuuucccuccauucccug

SEQ ID NO: 4230990 - RNA, 63 nt, Human
uaggguagugggaaacuggacgacuuuuuauaaaaggcugguguaaaguuuccuauugcccua

SEQ ID NO: 4230991 - RNA, 81 nt, Human
ucuaacucaaaauccauaaaaucagguuggcgccccaaaucugccacuaguuaccucuuucuauggauuuuuugggccagg

SEQ ID NO: 4230992 - RNA, 70 nt, Human
uucauauuguggucuugcauucauuuuccaaagaaaacauauuaggaguagcaugcugacacaaugugga

SEQ ID NO: 4230993 - RNA, 130 nt, Human
gugucucuguguuugcagguguccagugugaggugcagcugguggagucugggggaggcuugguacagccugggggaucccugagacucuccugugcagccucuggauucaccuucaguaacagugacau

SEQ ID NO: 4230994 - RNA, 81 nt, Human
uguuuauugugggacgccucuuucugggggucgugcuggcugugagggaacccucacaauccccaggucccagaacagaca

SEQ ID NO: 4230995 - RNA, 130 nt, Human
gccucuagccuuuuguucaguuucuccugcuuagggcaccuuucaucccaucuagaugugucucucuuuaacuauucuaggaguugauaaaagggcuaggaaguaggaaguugggaagaaggggaggggc

SEQ ID NO: 4230996 - RNA, 88 nt, Human
cugggguagggguugggggguuuagaaucugcccucaccuagccuagauggccugaagcuaaccccccuauggacuccugaacucugg

SEQ ID NO: 4230997 - RNA, 82 nt, Human
gaauguaucauuuuagaaauguccuacuaauauggagauaaaacauccuauaugaggauauuuuaaagcucaguguacccuc

SEQ ID NO: 4230998 - RNA, 67 nt, Human
ccugccgaugcgcaguggcgccucccggaggcggagccacguacgagcgccgcugugauuggugagg

SEQ ID NO: 4230999 - RNA, 65 nt, Human
uuggauguccucuguggaguauguacagugguguuuucugcgccaacuuucacaugaacauuuaa

SEQ ID NO: 4231000 - RNA, 81 nt, Human
cgcccuggagggaggggugggagauggaccuagugcaaacuacuguuaaagaccucccuucccaccccugccuuuugugug

SEQ ID NO: 4231001 - RNA, 55 nt, Human
ugucacagagcgugcaacagaagggccucuccccaagaugcaugcgucugugaua

SEQ ID NO: 4231002 - RNA, 64 nt, Human
gccuggggaacuugauccuguccgucaagugcgaggaagcagaggggaucgaguaccuccgggu

SEQ ID NO: 4231003 - RNA, 59 nt, Human
uuguuccuuucuucuguagucgguuuucauauuacauugguuaucagaggauaggacaa

SEQ ID NO: 4231004 - RNA, 90 nt, Human
aggugaacuauaggauaugggggauauggcuccauacuucucugugguacccagggaggugauauuauguauuucuauucuauuucuccu

SEQ ID NO: 4231005 - RNA, 93 nt, Human
ggccaggcuggucuugagcuccugaccuugugauccgcccacuuuggccucccaaagugcugggauuacaggcgcgagcuaccgcgccuggcc

SEQ ID NO: 4231006 - RNA, 65 nt, Human
guuuugucaucuuccauauuugcaggaagguauuuucugacuugcaaugcagcuagauguaaaau

SEQ ID NO: 4231007 - RNA, 71 nt, Human
uauggcauucuguuuaauacacgaaagguuuccacuugauauacauuguguuaaaacagaagauagccaua

SEQ ID NO: 4231008 - RNA, 75 nt, Human
uuagauauggcaggggaaaaggggugggagggggagacugagucuaucucauaauuguuucccagcuauauuuga

SEQ ID NO: 4231009 - RNA, 65 nt, Human
aaugugccuuaauauaggcgcuggggcuugcccauggugcucucgauauauaaggcccggacauu

SEQ ID NO: 4231010 - RNA, 72 nt, Human
agaagcggaaaccauggcaaccagguccuugacugcagcuucuaggagcccggucgucaugguaacgcggcu

SEQ ID NO: 4231011 - RNA, 75 nt, Human
ccugcaaacagcuggaggucugugagcacugcguggagggagacagagcgcgcaaucucuccagcugcauguggg

SEQ ID NO: 4231012 - RNA, 61 nt, Human
uggggaaggugagugcugugugauuacaguuagcugaauccaaacaggauuaccuauccca

SEQ ID NO: 4231013 - RNA, 81 nt, Human
guggggcggguagggguucagcccacagagggggccggcgggaagcugcaccugcuggucgggcugcaucuuccggcccac

SEQ ID NO: 4231014 - RNA, 59 nt, Human
augcauuuucuaccacacccacugccucugagagcagugaugcuuuggagaagauccau

SEQ ID NO: 4231015 - RNA, 60 nt, Human
auguuuaaguguuuugccccaaaauucacaacuaacaaggcagaacuaggacuugaacau

SEQ ID NO: 4231016 - RNA, 59 nt, Human
aaagagccaacuaccgcaaauucaguugaacuucacagcuagauucuaguuggcuuuuu

SEQ ID NO: 4231017 - RNA, 61 nt, Human
guugcugagcugaaccagccaccuguugagcauuuacaagguugcggaccagcugggcugc

SEQ ID NO: 4231018 - RNA, 86 nt, Human
ggcagugggaggugggggaggaggagacagacuguuuggggcuguguuuuccgguccugcucuuccucccguugccuccugaagcc

SEQ ID NO: 4231019 - RNA, 69 nt, Human
uacuuguaagcuauuccugaagaagguugccucagcaggggaaaacuuucugaaaagcuugaucaagua

SEQ ID NO: 4231020 - RNA, 99 nt, Human
cuccccgcuccaacucuagcccaacccccgucgacgcccccuucuacgcuacguggcuagggaucuagaccaggacugggagccugagggguggggcag

SEQ ID NO: 4231021 - RNA, 56 nt, Human
caccagcgacugugaccagcaauagcccccuggcuccagcuguccgguagcuggug

SEQ ID NO: 4231022 - RNA, 61 nt, Human
uugucuguacuggcugcaucgauggcugcaggaaggagaguugagcuuuuaguacagacag

SEQ ID NO: 4231023 - RNA, 129 nt, Human
ggaguucuggcagcaggagggcugagccuggagccuccugggccuugcucugugauguggguagggagucaccagucaugagcacaggugcagggaccccagucuuucucucugcuuccuaaggucucc

SEQ ID NO: 4231024 - RNA, 78 nt, Human
gcagugugucccccaacgucugagaccccuccucucacuucugggugagaagugggggucugggaugagggggucugc

SEQ ID NO: 4231025 - RNA, 87 nt, Human
aggagaccacagagggagagaaaagagacaacaacaacuucuagcaugccugggggaugacuugcucuuucauauuuguggaacccu

SEQ ID NO: 4231026 - RNA, 65 nt, Human
ccuggggagcccuacgccucucagaaagcuguaacaagcaggaggguuuuguagagucccauagg

SEQ ID NO: 4231027 - RNA, 68 nt, Human
gauuguagacauauuagacugccauaguccaaaucaaugcugaucacauuuuaaugugugcugcaauc

SEQ ID NO: 4231028 - RNA, 72 nt, Human
ggcgacccauccuccacuuggcagcgcagggugaaguucuggcccaccggcugccaaggaggcaggggugcc

SEQ ID NO: 4231029 - RNA, 61 nt, Human
ucuguaauccacacagguggaugguuuuauagauugauguguaauuuguggggguuauaga

SEQ ID NO: 4231030 - RNA, 78 nt, Human
gcuccuggugaucucuggcucugcuuguacuucauacugaaugaaccacuugcaucuuagagacucaccuaaaagagc

SEQ ID NO: 4231031 - RNA, 86 nt, Human
guuucaggagguuugggggacuugguuuuaaugagcuucugucauuuagggcuucucuuggccauggucccccuuccuucuggaac

SEQ ID NO: 4231032 - RNA, 57 nt, Human
agguuuggaaguggcgauccauugccuugugagucugugagcugccacuucuaaucu

SEQ ID NO: 4231033 - RNA, 65 nt, Human
gucugugguccugguugucugagagaaagugaguaguuucuacuccaucugccagggcuuuggac

SEQ ID NO: 4231034 - RNA, 59 nt, Human
ggcauggaacauuaaucuucaaaugagccagguuccuuugcccugagaaauguuccgcu

SEQ ID NO: 4231035 - RNA, 60 nt, Human
ugguuuccucauuuauaggaaagagauaaugccuaucucugagggugaucaugagaacca

SEQ ID NO: 4231036 - RNA, 76 nt, Human
auggcagaguauuacuaaaauucgccuaaacaaaccgucacgauguuuucagguuuuaugguaaugcuuugacuau

SEQ ID NO: 4231037 - RNA, 55 nt, Human
gggcaugcagcaauucugugguuggacaaggaccaacccaaagcucagcgugucc

SEQ ID NO: 4231038 - RNA, 56 nt, Human
gcuccagcuccauaaacauaagcaaagcuacaugcuuauucuucuggacuuggagu

SEQ ID NO: 4231039 - RNA, 78 nt, Human
gagaagugguuguuggcagugcuacagucaguaacagcgcuucugugaacaaggccaagcauucuagcaacaaaccuc

SEQ ID NO: 4231040 - RNA, 77 nt, Human
ucgcuugaacccaggaaguggagguuacagugagcugagaucacuccacugcacuacagccugggcgacaagagcga

SEQ ID NO: 4231041 - RNA, 70 nt, Human
ucuaaauuuuuuagugaaauagguucuauguauccaauccaaaggucuuauaucaacuggaaaaauuaga

SEQ ID NO: 4231042 - RNA, 81 nt, Human
gaccagguagccuucaggaccugaagcccaucucauacuugcccuccugucaaagaugacuuuguccugagcugagugguu

SEQ ID NO: 4231043 - RNA, 69 nt, Human
ugaagggaaggaugggcauuuacaugcauuuucgaucacuguguuguagaccaaaccuucuaaacuuca

SEQ ID NO: 4231044 - RNA, 66 nt, Human
caaggaugaggauuagcaucugcaaauugaacucuaucuaauuugcauguuuauuucuuagaauug

SEQ ID NO: 4231045 - RNA, 68 nt, Human
uucggcauguguuucuuaagccaggcccaacaguggaccugcuggucgguuggagagaucaugaagaa

SEQ ID NO: 4231046 - RNA, 60 nt, Human
uauucuacucuccuacaggucuacucacaaaugaaguugauuugcagaagguguagagug

SEQ ID NO: 4231047 - RNA, 77 nt, Human
ggggacagauaaugucuccaggggcagggucuggaggggccaacacccucaucagagcccuccucuggccugucccc

SEQ ID NO: 4231048 - RNA, 61 nt, Human
ggcucuuccaaacaaaaaucuguguuauaaauuaacagcagguuauuguuauggcagaguc

SEQ ID NO: 4231049 - RNA, 61 nt, Human
ccagggaggucauagugcugguguggggaggcuuuggagaaucagaaugugacccccaugg

SEQ ID NO: 4231050 - RNA, 73 nt, Human
accuccaggucagcguuggccuccuccagggcacgcgccuuguccagguaggagaccaggcugucguugaggu

SEQ ID NO: 4231051 - RNA, 108 nt, Human
agguuuauguccgagacuaaacugugcaugaaccgaaacaaaaagcaaguucauaccgcugcauucuguucucuuguucugacgguuaauucacuggacaucaaauuu

SEQ ID NO: 4231052 - RNA, 76 nt, Human
guuucugggcgggaucuggcggggagaggaaggaagaaugacuuuuucucugugcuggguccugaggcuugggggc

SEQ ID NO: 4231053 - RNA, 90 nt, Human
uaauuaaggaugaauuucuuuuuaaaauauuauuuuggcuuaaauuucuuuagcuggcaugauaugguaauaagauauucuacuuaauua

SEQ ID NO: 4231054 - RNA, 55 nt, Human
ucuaggcugugugugggcaggggcagauacucugcuccuccuugcagagcccaga

SEQ ID NO: 4231055 - RNA, 84 nt, Human
uugaaagacgaagcaccgugaaaugcagaaaguugugguucggauagcucagcugauuaauuucauguugccacaguuugucag

SEQ ID NO: 4231056 - RNA, 58 nt, Human
agagcaauggugcuuuaauucuuuuguugguuccauuguaguucaagcauuuugcucu

SEQ ID NO: 4231057 - RNA, 60 nt, Human
uacaaucauguguaaugggcagaccacagauaauggggucugagcaaguuaccaugggua

SEQ ID NO: 4231058 - RNA, 61 nt, Human
uauuucuagggcaugaaaauaacuugagucuauuuuaaggaauuguuucacucuagaggua

SEQ ID NO: 4231059 - RNA, 57 nt, Human
uuuuuuccuguuugucuuuggguauucuuggauaacagauacaacagcaggaaugaa

SEQ ID NO: 4231060 - RNA, 64 nt, Human
ugccgcuuucuggcccucagucuccucaccuauaacaugauaaggacgaacuagaacaguggua

SEQ ID NO: 4231061 - RNA, 123 nt, Human
uggcuuuggcugugcuguuccucuuggaggugaguggggucuccagggugagcgaggcauuggccaucuccuggggcuugucgcuggccagaaagcggagcagguugugcagggccuuggcca

SEQ ID NO: 4231062 - RNA, 86 nt, Human
gcugcagcguggcuuuuuccuugagucggggcacaguuaggaucugggcuggcggcccgaggcagaggagccgggcgcgcugcagc

SEQ ID NO: 4231063 - RNA, 72 nt, Human
guuucuagaaugugaaaauaguaaccuggcuaguuaauuuaauuaaguccuugguaauuuucuuuuagaaac

SEQ ID NO: 4231064 - RNA, 74 nt, Human
uuaauaaaacuuccucagguuuuuaaggagcuaggaccaaauccuucucagggagacuugauaguugacuuuga

SEQ ID NO: 4231065 - RNA, 130 nt, Human
uaagcauuuuauccaaguacaaauguuaaaagcagaguaacuuaagcaauuguguauacaaagguauacagacacuguagguuauuuuucuucuugaaucauuuuugcugcauaguaaauugcaauuaca

SEQ ID NO: 4231066 - RNA, 87 nt, Human
ggaaacuugcaggucagguuuuccuuuuaaaaggaauguugaaauauauucuuucgaacaagagaaguucaccuuauuuguguuucu

SEQ ID NO: 4231067 - RNA, 91 nt, Human
cuaucugucgcuuuccugaggggucucaugcccauccuucuccaacuuuucuaaugaugucugagauucuguucagaaaaaugacagacgg

SEQ ID NO: 4231068 - RNA, 65 nt, Human
guuaugaugaugaagaaauauuaucacucuuuuacuaagaguauaagaaaagucauuaucaaagc

SEQ ID NO: 4231069 - RNA, 77 nt, Human
guguuuauacugaguguaguuuuaggagggguaaaugaagauuauuuccacaaauuaagauugcacuuaguacacgc

SEQ ID NO: 4231070 - RNA, 56 nt, Human
gcuggaagggccagcuuucaggccucaggaaaaagcuugaaagucagggcuccagu

SEQ ID NO: 4231071 - RNA, 76 nt, Human
guacaauuugccaaugauuccacaauggaaccaauuguuuuacagucuguuccacaugaucauuguaauaagguac

SEQ ID NO: 4231072 - RNA, 118 nt, Human
ggucaacagaaaggucaauucuuucauguaagaagaaaaccguauggacagggcaccucugugcaucccaaacaugguuuccuuccuaaucaaagaguugucuuugccacuguggacu

SEQ ID NO: 4231073 - RNA, 78 nt, Human
gguuugaaaugaacuuuaauuagcuuuugucuccagaauuccccaucgaugccugggcuuuaggguucuccucacccc

SEQ ID NO: 4231074 - RNA, 73 nt, Human
gggaguggagagugaagcuaauguaaaauaguuuaguggcagugggaaucuuuggacuucauuuaccucucuc

SEQ ID NO: 4231075 - RNA, 58 nt, Human
gcggggugugacggugcgggccucgccacccggcaggugugcacccggucgcuuccgc

SEQ ID NO: 4231076 - RNA, 76 nt, Human
ucuuugugaaguuugggaaguaauuaauugcagcgacaagcuacaggguguugcagaauucuucccacucagaaga

SEQ ID NO: 4231077 - RNA, 90 nt, Human
ucaaguaacugauucacaauagcuauguaaccugaagaggcagcauuguguagcgucuaaggacauuggcuuuggagucaggcugccuga

SEQ ID NO: 4231078 - RNA, 95 nt, Human
ugugaaacucuagaugccuuugucugggaccuagacccauuguucuugcuuggcaauaaugguuugauucucacauuaaaugcauuaguuugaua

SEQ ID NO: 4231079 - RNA, 77 nt, Human
gacauuaaauuggaauaaugagaagugggaagguauggcuuuucuuucacucuucucucauuuuccuuuugguuguc

SEQ ID NO: 4231080 - RNA, 58 nt, Human
ugcugcuguuaucauuuuaccagcaaaccaccugccaugcaaugcauugacagcagca

SEQ ID NO: 4231081 - RNA, 56 nt, Human
uguuugagaauuugcugauguuauccugacagaaguuucagcagauuuugcaaaca

SEQ ID NO: 4231082 - RNA, 63 nt, Human
uaauagcauugcuauuucuguuaguguugcaguugauaacgauaacaauaguagcauguauua

SEQ ID NO: 4231083 - RNA, 76 nt, Human
gugggucacacagcagaugacuauuggagcuggaaucugaaccagaucucauuccuaccauaucugcucuuuccac

SEQ ID NO: 4231084 - RNA, 61 nt, Human
gccccaggccaggggucuguguugugguaagaagcucagagcacaggguuuugugccgggc

SEQ ID NO: 4231085 - RNA, 112 nt, Human
caggcaccaaagagcucauuucauuuccugcugccagcuuaauacucaccagggcagauucacaccaaguugggguuucaguggcagucaggaaguuuagucauggugugug

SEQ ID NO: 4231086 - RNA, 90 nt, Human
ucagucaaggagcagcagaaaggcaguauuguguguggucauggagagcauccgaaccacacgacagugcucacugucugugcaugcugg

SEQ ID NO: 4231087 - RNA, 93 nt, Human
ucucugaagucaauuucauaaaaucaguguccauuguaucccaugauaaaugcucgccagguuuuauuaucuuagagacaauugcugcagaga

SEQ ID NO: 4231088 - RNA, 101 nt, Human
aguaaaaugacuccuaauaaaagcucuguauauugagugcuuacuauguuccaugcauccugguaagcacuucauguacaugaucuaauuuagcacuuacu

SEQ ID NO: 4231089 - RNA, 83 nt, Human
gaaaugaaugaaaauuauaagaaacaaggcaaauuuugaggguaucauuuaucaugauaucuuguuuuucaugcauccauuuc

SEQ ID NO: 4231090 - RNA, 61 nt, Human
uugcuguacaagacccucuguuuuaauuccuuuuuaaagcaacccagugcuuguauagugg

SEQ ID NO: 4231091 - RNA, 65 nt, Human
uucagucccacccuacugcuacccaggagggaggaccccugccuguguuugggguggggaaggaa

SEQ ID NO: 4231092 - RNA, 81 nt, Human
cccugaaaucacucgggagaugaggagagcuucgguguccgccgcccagcgccgcagucugcaaucucccugguugcgggg

SEQ ID NO: 4231093 - RNA, 86 nt, Human
cauuccugcucuuuauuuuaaucaauaaccuccugggugaaugacauuuccaccuuagugauuuaaaaucagaagaccaggggaug

SEQ ID NO: 4231094 - RNA, 62 nt, Human
aggucuacaugcuuaauauaucaaacaaauuauagcuuuaggugauugagcaugacagaccu

SEQ ID NO: 4231095 - RNA, 57 nt, Human
uagaccuccagcggaggagauugcacaagcucccucagucucccaugccugugucua

SEQ ID NO: 4231096 - RNA, 91 nt, Human
ggguaggaaggggaggaugggggggcagguuggaugucagggucuuccucucacucccuccuucccucuuuuuacccuuuccucuuuaccc

SEQ ID NO: 4231097 - RNA, 87 nt, Human
ggccggcaugaagacuacaggaggaugugcagccagggagaacgaagacaucuuggcauguucaucugcuugguacagauccugguc

SEQ ID NO: 4231098 - RNA, 87 nt, Human
ucaauauaagaauaguacuugauuuuaaauguuaauaugcaaauauuaacaguauacuacaucauauuuuauguguucauauauuga

SEQ ID NO: 4231099 - RNA, 84 nt, Human
gcaggacuucuuuugcaugauucuuuaauacaucagggcuguaucguccaauagcaugaauagucaaagcacaagaggucuugu

SEQ ID NO: 4231100 - RNA, 56 nt, Human
cugucagcaaaucagugucuggacagccagcugcagggccugagcauggcuggcag

SEQ ID NO: 4231101 - RNA, 64 nt, Human
cagacagguagacaugaauauuaauugauaaugacuauuaauugaucuggaaaauacuuguuug

SEQ ID NO: 4231102 - RNA, 85 nt, Human
cgccgguccggcauccuaagacgugugguuugaguugcgggcgagaccaggcuuuuuuuaggaccuugggccugauaagugggcg

SEQ ID NO: 4231103 - RNA, 59 nt, Human
cgcccaccuccaggcggaugcuuuccguggaggccagcagcuccuggaggugagaggcg

SEQ ID NO: 4231104 - RNA, 72 nt, Human
uuguccuaauaaguaggagccagaauugcauuaguguaauccacugagcaaaacugauccuguugcagacaa

SEQ ID NO: 4231105 - RNA, 62 nt, Human
caaggauuuucaguggcccgcacccagauagaaauuuggcugguggcugguucuggaccuug

SEQ ID NO: 4231106 - RNA, 62 nt, Human
gagacaaggcaauagagggugaggaggaucauguuggauucuugcuucucugucugccucuc

SEQ ID NO: 4231107 - RNA, 55 nt, Human
gcagaugccauagguauaguauacuagaggggugugugugugugugugugugugu

SEQ ID NO: 4231108 - RNA, 70 nt, Human
cuguggguugcaggguaggugacagguagucaggauauugacuccugccucucuacuucuguggccccag

SEQ ID NO: 4231109 - RNA, 76 nt, Human
ugcuccuggcuagauguguggccaugaagagguuacuuacuccuuugaagcccaaguuccucaucuugcuuuugca

SEQ ID NO: 4231110 - RNA, 56 nt, Human
gggauaaauaguguuuggggacauugaaauggauguucucagguuguauuuauuuc

SEQ ID NO: 4231111 - RNA, 57 nt, Human
ggccugcucuggcuguggucagcgccucggggcucguggcccgagccgggguuggcu

SEQ ID NO: 4231112 - RNA, 67 nt, Human
uggcaaagcuccaaauggguggaaguggccagaaaugggcccagcuuccuccaucuggggcuugcua

SEQ ID NO: 4231113 - RNA, 73 nt, Human
gccagcuggagaggaagugccugcucccaguagcgucugcuggugagaccgacuuccacuugacuagcugagc

SEQ ID NO: 4231114 - RNA, 76 nt, Human
cgcagccggcagcgcuuggcugcucgacaacuuccuucauuucuggccaugccgggcugagcaagugcugccugug

SEQ ID NO: 4231115 - RNA, 68 nt, Human
uuucucugucaguguccucgugugguuucuagucuggggagaacacaucagcacacuaacggaagaaa

SEQ ID NO: 4231116 - RNA, 58 nt, Human
guauuugcaaucacaaacaaaacccuagugaugaaaaauaauuugugauggcagaugc

SEQ ID NO: 4231117 - RNA, 78 nt, Human
gaugaguuugcauuugagagaggaaacaauacucaaauuaacuacucugagaaauguuuuuauucuuaauguuucauc

SEQ ID NO: 4231118 - RNA, 68 nt, Human
agguacguaauagcuuuauuuugggggacuaaauaaaauaaugccuguaaaacaccguuauugcaccu

SEQ ID NO: 4231119 - RNA, 61 nt, Human
cgugccauuguugcuguugaacccugcugaggucccugucuugcuccaggaacacuggccg

SEQ ID NO: 4231120 - RNA, 55 nt, Human
gaccgggcucugcugacggucugugcaccaucuacgagacugaagggcccgaguc

SEQ ID NO: 4231121 - RNA, 69 nt, Human
gaggugggaggaucacuuugaguccaggaguuugagaccagucuggaaaacaaagugaguucccauuuc

SEQ ID NO: 4231122 - RNA, 80 nt, Human
acugguucugcuuuuguaucagaguauucaguaccacaggauuugaaccaugaauuacaggagcaagaaggugagccagu

SEQ ID NO: 4231123 - RNA, 62 nt, Human
ucccauuuuuuggauguguggaucccuuugauuaacucagauuauccucucuagaaguggga

SEQ ID NO: 4231124 - RNA, 94 nt, Human
gagacuggaggaugggaauggauugagugggugggccaagcaauagagguggugauguagcuaguugguucuucucuguuuauucuccaguuuu

SEQ ID NO: 4231125 - RNA, 62 nt, Human
uauccagaaguauuuuggguacuuguuuaaggauuguaaaacaauguuuccauuucuggaua

SEQ ID NO: 4231126 - RNA, 76 nt, Human
auacacucagcucauccacuaaaucccuuuucagguagacaggguuauaugggaagaugagcuagaaugagucuau

SEQ ID NO: 4231127 - RNA, 79 nt, Human
ugucaaaacuuucagggauacagaaaugaauagguuaugguuuauguuuguuucugguuuuauucugggguuuuguaua

SEQ ID NO: 4231128 - RNA, 55 nt, Human
aaggcuuguugucacgcucuuguauagccagaaugggaggugagaauuuggcuuu

SEQ ID NO: 4231129 - RNA, 61 nt, Human
cuccuagagcacaaaaggccauugugaaucaucccagugcugcacuuauggcucugaggag

SEQ ID NO: 4231130 - RNA, 105 nt, Human
ggccagaaacugcagcacggcccgaggcccuggcgagcugggccugggggaggagaagucccuucccauuccagcucgaucaaucuugcugggcugcgaucgguc

SEQ ID NO: 4231131 - RNA, 75 nt, Human
uucuuaguaucugucagaccuuggucacagcaucacuggaggaauacuuguuaguuaccacugcagaucuuugaa

SEQ ID NO: 4231132 - RNA, 68 nt, Human
gcuugacagugucccucugggguggaaaugaguuccuuagcuccaucaccacagaggacagaguaagc

SEQ ID NO: 4231133 - RNA, 63 nt, Human
cgaaggaaucacuuaacacuuucaaagcuauaaaugguuuacaaagugguaaggauuauuuug

SEQ ID NO: 4231134 - RNA, 62 nt, Human
uccuuacuccuggagauucugauuucacugugcgaccugauggggaguugccaggagaagga

SEQ ID NO: 4231135 - RNA, 83 nt, Human
uggcucaccccacuucccucccuacccuccagcugaccaaaaccuucccugcugacuggccgucccuagagaugggguugcca

SEQ ID NO: 4231136 - RNA, 63 nt, Human
uuuaaaccuuggaagccacauagcgaagcauguguauauguggauguguguguuuuguuugaa

SEQ ID NO: 4231137 - RNA, 56 nt, Human
ggcugcuauuggucuggcuugggucaugugcccaagccugaaccaauauagcagcc

SEQ ID NO: 4231138 - RNA, 79 nt, Human
uaaacaaggaucaguaggauaguuaucauauuuacuuaauauaugucugauauucagugcugguucuuuuuccuguuug

SEQ ID NO: 4231139 - RNA, 56 nt, Human
gguagacugagcuccuugaggacagagauugacuguuuuuaaaauaucaguauucc

SEQ ID NO: 4231140 - RNA, 85 nt, Human
gacgggggccagggagguuggauuggggccuuuguguaucuuugccuggggacucugaaucuagauuccugccaccuuugagguc

SEQ ID NO: 4231141 - RNA, 65 nt, Human
ugaucauaccaguuuccaucaggauuuaucagaucugaaacauccugcagauaagcugguugaca

SEQ ID NO: 4231142 - RNA, 67 nt, Human
guguucgauacugugggcacucauaauauguuauugcuuuguuguagacaguucacucguguagcac

SEQ ID NO: 4231143 - RNA, 68 nt, Human
ccaugucuugcaugauuuaagaauaucugccugacuuucauguaguauuuguaauuaucaaagccugg

SEQ ID NO: 4231144 - RNA, 99 nt, Human
ccucaccagcccugggucagggaggagaggcagggggaggaauucugacacuucucccucuuccuacccucccuuucccauuccuugaagcuguagagg

SEQ ID NO: 4231145 - RNA, 66 nt, Human
gacuccaaccugcaucauuaagguacaguuggcuccaguggauuagugcugaaaugaugggaaguc

SEQ ID NO: 4231146 - RNA, 72 nt, Human
gcgcugacauuuuuacauuuuauucguuuauuucuuggcucaggaaugagaauguaagugaagagagggcgc

SEQ ID NO: 4231147 - RNA, 66 nt, Human
uacaagguugauucuggcaucuggauaaccaagaaagcugcuuuuaggugucuggacaacuuugua

SEQ ID NO: 4231148 - RNA, 94 nt, Human
ggaaugucuuagcuuucuagcuucccagcuaaccaugucugccauuccccaggucuuggcauggugggggaggacuuggagagcuggcagagcc

SEQ ID NO: 4231149 - RNA, 95 nt, Human
gccucccuuuuaaaauaaugaaacaaacauuguuuaaguuaaauuguuacuugguuccuccccacaguguuacuugauaguguauguuacgaggu

SEQ ID NO: 4231150 - RNA, 80 nt, Human
gcgccagccagucccuggggggacggggcacauuggacauguugagaccccucuggccccugugguggauuggugagcgc

SEQ ID NO: 4231151 - RNA, 65 nt, Human
cgagaacgagcugggggggccgggggcgagcucucgguuucccggccgccccccgcucgggcucg

SEQ ID NO: 4231152 - RNA, 61 nt, Human
aggggaggcugggcuggggggcucuuugccccuuagagcucccuucagcuccagcucugcu

SEQ ID NO: 4231153 - RNA, 82 nt, Human
gcaugaaugaauacaaaaaguggugaguguauacucuaaagugguuauauacuaagcucauuacauuuuggcuuaugacugc

SEQ ID NO: 4231154 - RNA, 77 nt, Human
gaguuguccaccacuuggcccugagguccuuggcuacauggcagggugaucucagucuagaugguucuggaucacuc

SEQ ID NO: 4231155 - RNA, 78 nt, Human
gaaauguauuggaauaguaugaaaauuagcgggagguuuggaucccugccuuauuuucauaugcuguggauacaucuc

SEQ ID NO: 4231156 - RNA, 81 nt, Human
ggcaaaugauaaaaaguggcugcuauuggagacccaaaugauggugaacuccagaaagccguugacuuauucacagaugcc

SEQ ID NO: 4231157 - RNA, 55 nt, Human
gcuuuuuaauuugcuucccuggaaaucauccuugggagggaggcaagagaaaugu

SEQ ID NO: 4231158 - RNA, 67 nt, Human
gucaugcugacaacaaagaaggaagcagaaagcaucacuuucucuucucuugugauguuagcggaac

SEQ ID NO: 4231159 - RNA, 57 nt, Human
ggaugucgaggaugggguagcagcucaguccgccccuaccccaggccccucgaugcc

SEQ ID NO: 4231160 - RNA, 74 nt, Human
guggcgaugguguuccugugcuggauggucagugguuguugacauguaguuagaaaauagguagcaaguuccac

SEQ ID NO: 4231161 - RNA, 76 nt, Human
aggaagggagggagagaugcuggaccgggcugagaacagagucagcgccaaccaggcuguccucccacucuuaccu

SEQ ID NO: 4231162 - RNA, 63 nt, Human
uaguggccacugaagugcuagacugagaaaaucuuaggucaugccuagccucagugguuagua

SEQ ID NO: 4231163 - RNA, 56 nt, Human
ucuuccuuacucuggauguuauuuuuuaguaauuucacauccacugagugggauga

SEQ ID NO: 4231164 - RNA, 59 nt, Human
acccaggaggcugagguugcagugagccgagauugcgccacugcacuccagcucugggu

SEQ ID NO: 4231165 - RNA, 79 nt, Human
gcaggugggcucccuggucggcguggugacggcgcgggaccccgacgccgccaaccggcccguccggugagacccccgc

SEQ ID NO: 4231166 - RNA, 69 nt, Human
gggaaaugaacuguaaguggugaaauuaguuuugguauuuaauuuaaaacuacauuuauaguuuuucuc

SEQ ID NO: 4231167 - RNA, 58 nt, Human
gaggcuaugucuacgcucagcguucugccccgugaacguuugaauguuugauagucuc

SEQ ID NO: 4231168 - RNA, 78 nt, Human
ucacugugagugcaagcagggguguaaaucguggggccgaaaaaaaccuuugugcaaagauccuugcucacucacuga

SEQ ID NO: 4231169 - RNA, 91 nt, Human
ucauuuuuuuaaaguaauugaagcuuguggcuuuacaacuuaguguuuuuugcuauccagauaacaaguuucauuguuuagaacccaguga

SEQ ID NO: 4231170 - RNA, 67 nt, Human
guguuuauguuuuugcuagggagaugaaaguaguuuuuguuucuucauuagcguaggauguguacau

SEQ ID NO: 4231171 - RNA, 90 nt, Human
uuguuaggauuccagacuggaaaguuggaagucucaggaaaugcauguuuccaugaguuuuuuaguuucacaguuuuacagauccaacga

SEQ ID NO: 4231172 - RNA, 66 nt, Human
aguuuuuaacgccauguuugaacaugaaauggaagaaagcaaaaagguaaacauggcuuaaaggcu

SEQ ID NO: 4231173 - RNA, 85 nt, Human
aggaauuugucagaaacucuuuccuguuuugguuuggagaguaguucucucuaacuagagacaggaguggccuugaaauuuuccu

SEQ ID NO: 4231174 - RNA, 58 nt, Human
gaggggacugucuggcuccgagaacuaaaguuaaggguuugcggccuaacagccccuu

SEQ ID NO: 4231175 - RNA, 58 nt, Human
gacacuuuuuuaaagcucauuaagauuguuaaacauugauggguuuguuggagagguc

SEQ ID NO: 4231176 - RNA, 77 nt, Human
ggucguugagggucgcaagcaccaggccuggaggcccuccucggccugcuaccagcugugaccuuuggaaagugacu

SEQ ID NO: 4231177 - RNA, 69 nt, Human
ggugaguuggggcugcguauuuccauguuuucugaagguucacauaaacaugcagccugccaauucucu

SEQ ID NO: 4231178 - RNA, 65 nt, Human
ggucagcucaggggaugugggggagggcgguuuuaucuucccccuugucguuugagguuuugauc

SEQ ID NO: 4231179 - RNA, 56 nt, Human
ccccaaccaguuaucuccuaagguuccaugacuuugugaauagaacuggauguggg

SEQ ID NO: 4231180 - RNA, 80 nt, Human
ucccgagccaaaauugagaaaauucgagcaaguuuauuuaacaauaaugacuugauugguuugucaaguuuggaugguga

SEQ ID NO: 4231181 - RNA, 123 nt, Human
ggaucacacagucagagccagcuggcagccuacaucagaauaccaauccaggccauaguccaguaacguugaaccauugguuucuuguggguuauccuugauggcuuuguaacuuucacaucc

SEQ ID NO: 4231182 - RNA, 75 nt, Human
cuccuucuuaccagcgcguuuucaguuucauagggaagccuuuccaugaaacuggagcgccuggaggagaagggg

SEQ ID NO: 4231183 - RNA, 93 nt, Human
guagaaagagcaaugcacuugagcuugaaagguaugcucuccucaccuacccaggagcaugucuaacucuucagggugugcuccuuucuucac

SEQ ID NO: 4231184 - RNA, 71 nt, Human
guuugggucucucuucuuucugugaaauuaacugcugugcguuuucacuguucuuagagaagacccugagc

SEQ ID NO: 4231185 - RNA, 59 nt, Human
cccugcggggcaaggggggcugguggaaucuggcgguccccagcugcccgugucccggg

SEQ ID NO: 4231186 - RNA, 57 nt, Human
ccucccuucccggcauggcucucuggacccaggcaggaagcugcugauugguggagg

SEQ ID NO: 4231187 - RNA, 77 nt, Human
guaauuuggaaguagggugaggaggggagugagaagaaaucaaaagcucaucccuuccugcacuauuagaaauuaac

SEQ ID NO: 4231188 - RNA, 68 nt, Human
cugugcauugccucuauucauuauauauuucuucuagcuuguaaucaugguagaggcaaaguggacag

SEQ ID NO: 4231189 - RNA, 80 nt, Human
auccaacacuuuuuucacacuccuuuccaguuucgagcuguacuggaaauuggagaguugugaaaggaugguuuuuggau

SEQ ID NO: 4231190 - RNA, 55 nt, Human
gggaugaaugccuggcucccccuucuuuccagcccuagcucaggcccaucguccc

SEQ ID NO: 4231191 - RNA, 105 nt, Human
uugcauccucucucucuccaaucccuuuaaugguuuauggucuaagaguagauugaacucuuagacagagaagacuauugauugauagaccgauagcauaagcaa

SEQ ID NO: 4231192 - RNA, 97 nt, Human
uuuccauugugaaguaagauagaaagagaaucagaacuugagagucagacagaccaggguuugaauccucuuucuuacuugcugaguuacuuggggg

SEQ ID NO: 4231193 - RNA, 58 nt, Human
gaggccagcacccagaugcaugaggcaauaaaucucauuauuugcuuaagcuggucuc

SEQ ID NO: 4231194 - RNA, 59 nt, Human
aggccacucagggggccaagauccugucacuccuuuucucuaggcccugcgaauggcuu

SEQ ID NO: 4231195 - RNA, 66 nt, Human
ccuaccugaccagguggcuucccaaggggcacacgaucuuguuggggagaagagcuggucaggagg

SEQ ID NO: 4231196 - RNA, 61 nt, Human
ucaucuauaaguagcaucugggaagaggagaucgaggccacaguuugcuauuuuaguauga

SEQ ID NO: 4231197 - RNA, 61 nt, Human
ggaaucauugcuaguaaggaucuugccuuacuugguagguauguuaacugugcaauuaucu

SEQ ID NO: 4231198 - RNA, 78 nt, Human
ucuugggggaaguuguguaaccucugggcccugcgacgcccuuuccuggagccuggagcuggaacgaagccccuugga

SEQ ID NO: 4231199 - RNA, 68 nt, Human
gggaguggagauuaauuaaaaccuuuauguucuccaauauaagggaaaagcagguugguacuacuucu

SEQ ID NO: 4231200 - RNA, 69 nt, Human
cagacagaccauagugauguuuacguccauugccuaggaguauuuaccacuaaaugguuggauugucug

SEQ ID NO: 4231201 - RNA, 66 nt, Human
guuuaaaauuguuaacuuuggugaagcucuuacgaaagaguauuaucaaaaaauaguacuuugaac

SEQ ID NO: 4231202 - RNA, 56 nt, Human
agggggcaggugggcgggaguggugggcucgcccugaccuggccgcugugcccccu

SEQ ID NO: 4231203 - RNA, 59 nt, Human
auccagcuucugccugcugcugcccuucauggagggcagugcauggaaggggguguggu

SEQ ID NO: 4231204 - RNA, 55 nt, Human
gaaacguuguggaaaauccucuggggaauagcugagaggacuuuuuugauguuuu

SEQ ID NO: 4231205 - RNA, 70 nt, Human
ucuuguaguugcagaauauucuggugacaaugccauuuacagggcaguuauuaagaaaauuuugccagga

SEQ ID NO: 4231206 - RNA, 74 nt, Human
cuucuucuucuuccucauccucauccagcuccagcuccagcacugaugagagugaggaugagaaggaagagaag

SEQ ID NO: 4231207 - RNA, 81 nt, Human
gaggcagaaaaaucgcuugaacccaggaaguggagguugcauugcacuccagacugggcaacaagagcgagacuccgucuc

SEQ ID NO: 4231208 - RNA, 66 nt, Human
cauaccuugguaagagugaucagcaauccucugauggaugugacgaugauuauuccaacaagaaug

SEQ ID NO: 4231209 - RNA, 65 nt, Human
gguggggggcgcguggagggccguggguguggggccgacucgagcgcucccugugcucucgcacc

SEQ ID NO: 4231210 - RNA, 59 nt, Human
uuacuuacagggggucaggcuggacccacacagggaagaagucacagacccucagguag

SEQ ID NO: 4231211 - RNA, 128 nt, Human
guucuacuucuuuaaaccucuguuuauuuaucuauaagauggauuugaugagacuaucuacuucauaaaagcauauacaguaggagcucaauuaaauguucucuaagaaaugggcagaugaaaagaau

SEQ ID NO: 4231212 - RNA, 103 nt, Human
cuuggugcuacagguagggcuuuuuggcaagcagaugaagguagccuaaauaggugauugguauguauguuugucauugcccugaccuuccuuaguuguuaag

SEQ ID NO: 4231213 - RNA, 80 nt, Human
ccugugauguaaaauaggaaguucuacuuggaauaauauaaaggaaccacuagaauuuacaauuauuuugaaguuacagg

SEQ ID NO: 4231214 - RNA, 70 nt, Human
uuggaagugauagauccauauuuugguaaaaaacuauggugccaucuaugucuaguuaaaaaacuuccaa

SEQ ID NO: 4231215 - RNA, 57 nt, Human
gaaagcaaguucuaaaguaauucugcuaguagaauacuaauaagggauuugccuuuc

SEQ ID NO: 4231216 - RNA, 66 nt, Human
ggagaucucauugauacugauaaggcuucuuauuuauuuguugauuuaguaugggagaagaucucc

SEQ ID NO: 4231217 - RNA, 82 nt, Human
gcugucauuaugguaacuuuuuccucauuggcuacacuaacuuggugugaagccaugcuaaauguuacagcauaacuauagc

SEQ ID NO: 4231218 - RNA, 66 nt, Human
uguaaauguacugaggcaacaggaguuuaccguuauguauuuucaguuguuggaaguagauguaca

SEQ ID NO: 4231219 - RNA, 67 nt, Human
agggaaagaaggaaaagacgugcuaaguagaucucuguauuuacguggcucguuaauuuccuguccu

SEQ ID NO: 4231220 - RNA, 64 nt, Human
cucugugucugauucugggaagcugguccuugccagugucaacuauccuacaugagacagagag

SEQ ID NO: 4231221 - RNA, 59 nt, Human
ugucagugagggaggcagaauguguggugugaaguggauucugccuccaggagcuggca

SEQ ID NO: 4231222 - RNA, 58 nt, Human
gaaaugucaagauauguuuggacuuugccuuggacaucgccgagcagauugauguuuc

SEQ ID NO: 4231223 - RNA, 121 nt, Human
uggcugugucaugacaggccucaugaugcuaacagagauucuucccuucuuuuuuccaaaagcaccaaaaaaaagggcugaaguagucucuguagcaucuccccaaaguguuaaacagcua

SEQ ID NO: 4231224 - RNA, 85 nt, Human
guggaguaauggguguuuuugaagucuguccuggguacugcacauuaaaaggaauaucauuuucugaaacauugcuauuuuccac

SEQ ID NO: 4231225 - RNA, 78 nt, Human
agcgauacauuaaugcucauuuggcucugcaaaucuuaccguuugcuuaggccaaauggcgcaucaaugacuaucgcu

SEQ ID NO: 4231226 - RNA, 77 nt, Human
uaggcaugugauuucagguuuuucauacugagaacauugagauuucaguuggaagacacccugaaaucuuaugagua

SEQ ID NO: 4231227 - RNA, 77 nt, Human
ggauggaugaauuauucaugucugggcagccccacuguugagugucuggcugcuugauagauaugaguacuccagcc

SEQ ID NO: 4231228 - RNA, 72 nt, Human
ugaaugaguaaguucugauuagauuuuaucuuuaaacaaaaccacaaaauuuaauugguuuuuacuugucca

SEQ ID NO: 4231229 - RNA, 79 nt, Human
uuuggggcugccaccagcucuccacccuccugguuccgcuggccgggccaagagaggauggagggaugggagucccagg

SEQ ID NO: 4231230 - RNA, 88 nt, Human
ggguccucgucccugaagagugugagguugugcuuuuggaugugucccagcagcaccuguccucgcugcuccagggucuggaggaccu

SEQ ID NO: 4231231 - RNA, 80 nt, Human
uuuugcuguacugccuccccuuauuccucaacaugaaguucccaccucggauuggggaugggugggaggggguuucaaga

SEQ ID NO: 4231232 - RNA, 88 nt, Human
ggagaaucgcuugaacccaggaaguggagguugcaauaagccaagaucacaccacugcacuccagucugggugacagagugagacucc

SEQ ID NO: 4231233 - RNA, 76 nt, Human
uccacuuaauagguauggagccuugggcgaguuucuuaacuuuacugagccuucguuuccuuaucuguaaagugga

SEQ ID NO: 4231234 - RNA, 66 nt, Human
uguugaaagauuugaaaguggugcauuuuuacuuuuaagagcagcaaucuuugaaauuagucaaca

SEQ ID NO: 4231235 - RNA, 68 nt, Human
gggaguggcuggcaggggaggguccacagggcuccucuucugggacucucaggcugucggcuucuccu

SEQ ID NO: 4231236 - RNA, 80 nt, Human
ugaggcacugaaagaaaggagacugcacuggagcccaggucccugggcuccccagagcuccuuacucuuccuccuccuca

SEQ ID NO: 4231237 - RNA, 91 nt, Human
uggcauggaaggcagaggcuggguggggugggggcaggcucucggcccccaaugccugcccaucccaccccagcauccaucuucagugcca

SEQ ID NO: 4231238 - RNA, 83 nt, Human
gcacgggugggguccucgggcucacucccaggggcccucacggcugccucugcccacaguccccgaggacucauuggcccggc

SEQ ID NO: 4231239 - RNA, 70 nt, Human
uacacacuuagugcuuuuguguuucuuucuuuauauuccacaaaguagagcauagggcauuaggaaggua

SEQ ID NO: 4231240 - RNA, 72 nt, Human
agggauguuuugcaggcaaagaaguguccaccuuuacuucuccccagcuuucaaaauaauauguuacucccu

SEQ ID NO: 4231241 - RNA, 58 nt, Human
acccaggcuggagugcaguggggccaucuuggcucacugcaagcuccacccuccgggu

SEQ ID NO: 4231242 - RNA, 65 nt, Human
gcuuuaaauuggaagacgcuggaggcacugggaugugauaugccccucucucucccaaucagagc

SEQ ID NO: 4231243 - RNA, 56 nt, Human
cuguguggccuaaguggagacacaggcccugcccucuccacugagcgucacggcag

SEQ ID NO: 4231244 - RNA, 65 nt, Human
ucgugaaaggcaugugcaacuacaaauacuucauagcuguuuggguugcucauucuacaucacga

SEQ ID NO: 4231245 - RNA, 94 nt, Human
augcagggaucuucccauacuuccugcuucccugaucugaaccaagauuggaaagaggcaggcagcagagaagaugcccaagaaacucugacau

SEQ ID NO: 4231246 - RNA, 55 nt, Human
ugcagacuguuucuugacugaaaaguuaauuccuuucauucagaaucaguaugca

SEQ ID NO: 4231247 - RNA, 69 nt, Human
guagcguugacacauggcuucaauugcaacuguaacaauugcaugacugaucuguuugucaacuguggc

SEQ ID NO: 4231248 - RNA, 76 nt, Human
cuaaguucuucguuuauucuuuuauuugugagagccgggggcugcguggauuuaggagugagggcuggggacuuag

SEQ ID NO: 4231249 - RNA, 107 nt, Human
uagcucuguuuaagucacuuuacacucuauuuuuucaucuuucagggcuguccugacuugguuuaggagaugguuuauguaaaugugacucacacaaaaaagggcua

SEQ ID NO: 4231250 - RNA, 70 nt, Human
uauauaaauauauauaauauauauauuuugcugaugcaguauacaguguguauauaugugugugugugug

SEQ ID NO: 4231251 - RNA, 57 nt, Human
ugguggaggcgcugcuggccaggcucaggcugcugcgaggucggcuccccuccauca

SEQ ID NO: 4231252 - RNA, 86 nt, Human
guaaguuauauaugucuacuucuaccuguguuaucauaauaaaggugucaugaugauacagguggagguagaaauauauaacuuau

SEQ ID NO: 4231253 - RNA, 73 nt, Human
augauuauuugaaugaagaggaguaggaaggaaaauggaaucaauauacucuuuguuagucagaauugaucau

SEQ ID NO: 4231254 - RNA, 59 nt, Human
aucagugcacgcgaugggcagaggaggcuagggaauccugagcccaaagcuguauuggu

SEQ ID NO: 4231255 - RNA, 60 nt, Human
uggaagaaaugguugagccaugcuuuccuuucucccuugcagcuuucaccaguacuucca

SEQ ID NO: 4231256 - RNA, 61 nt, Human
ggaucauggagcugguucuggggaagcuggccaccaccaccacugacaccagcucgguucc

SEQ ID NO: 4231257 - RNA, 61 nt, Human
aaccauggauuucaguucaccuuucauuaucuaccgagaaguggucaucuaucccaugguu

SEQ ID NO: 4231258 - RNA, 62 nt, Human
uagcaggaggcaguuccucgcuucagucuacauguagcaucuaaggagacuacuucuugcug

SEQ ID NO: 4231259 - RNA, 65 nt, Human
ccaccagcgucuuccucuuacgaugcgcuccguugaaauuuagcguguugggaggagcugcaggg

SEQ ID NO: 4231260 - RNA, 62 nt, Human
uugggaggcugugggaaugggucugcccccagcuucacagaccucuuccuccagccucugaa

SEQ ID NO: 4231261 - RNA, 65 nt, Human
uuuuaucaucuucugaauuuggaaucaauggaaaaacagauccaggagucagacagauggugaga

SEQ ID NO: 4231262 - RNA, 65 nt, Human
uguaugcacacguguccaugugcacccauguccaagucaccucucugcacggcugugugugugca

SEQ ID NO: 4231263 - RNA, 67 nt, Human
ggggccgggccggcagacugggggcuccccaccuccuugcucuccccagccugccaagcccagcccu

SEQ ID NO: 4231264 - RNA, 101 nt, Human
ggggaaaagugucuauacuguuuauuuguauugucuuaucacuuccggaguuuuaggagauagccagauauaaauagucaucagaauaagcaaauauaccu

SEQ ID NO: 4231265 - RNA, 55 nt, Human
gcaggagggggccuggagcccagucccacaucugggccucuccacccuuuucugu

SEQ ID NO: 4231266 - RNA, 70 nt, Human
gcugcccgggcugggaggcggaggcugagaccugaaaggugcugaccggccuccccccagccugggcagc

SEQ ID NO: 4231267 - RNA, 82 nt, Human
cagcuaauguggcuugacaucaauacuuauuaaugucuucaaccuaauaauacaauuggugucauguaugaaugcuuagcug

SEQ ID NO: 4231268 - RNA, 63 nt, Human
cucgcuucuaccuucagaaugugggguugggguaaaauccaggucucggaugaagguaaggag

SEQ ID NO: 4231269 - RNA, 68 nt, Human
ucagccauuuagagaagauuacaaggacaugaagcucagucacuguaggaaucucuaaauuggguuga

SEQ ID NO: 4231270 - RNA, 79 nt, Human
cugagaugucugagacucagccccugcucucaaggagcucagaguccauugggagaaauaguugauccgcagcauccag

SEQ ID NO: 4231271 - RNA, 63 nt, Human
aacacgggugugauuccuuuugugucaguguuuacaacucagauaccaaaagaacaccuuguu

SEQ ID NO: 4231272 - RNA, 62 nt, Human
gguagggggaggagaagaaaaagcccccagaacgcagagccucuucuuuccccaccccuacc

SEQ ID NO: 4231273 - RNA, 78 nt, Human
gcuucuccuaauuguaagcuccuugagggaggcaauggguuuaaccacugcugaauacccagugugcaugggagaugc

SEQ ID NO: 4231274 - RNA, 71 nt, Human
cugucucugucucuguuuauccgagcagaaccuggaaggggcuggcaaggacuaggcaacagaugggacag

SEQ ID NO: 4231275 - RNA, 68 nt, Human
ucguaaacuuuaggcacauggaucuauucucauuaugaaaauggaugccauuugauuaaggcugauga

SEQ ID NO: 4231276 - RNA, 72 nt, Human
ggagucugccuucaggagcagacucugccuggcaucccagaggagucugugucuugaagcagucagugcucc

SEQ ID NO: 4231277 - RNA, 129 nt, Human
uuaacuuugcugaaagcagauuuuaagugacugagugaagguuggguaagaccuuaaguuauuuuuugcccuagaucacauuacagguaaguagguuuuuguuuuuguuuuugaguauccuaaaaauaa

SEQ ID NO: 4231278 - RNA, 92 nt, Human
agcuugcggcgcagcucacucaaguaccuggggugccgcuacagcgagaucaaacccuacggacuugacugggcggagcucagccgggaccu

SEQ ID NO: 4231279 - RNA, 128 nt, Human
uuuugggauugucagaucuaaacuuauauucuugcuggcuaaugugcugauagccaggucugaaacuugaugugcuauccagacacauaugaucagaaaagaucuagagugcaaagaggugccugagg

SEQ ID NO: 4231280 - RNA, 65 nt, Human
gugacagucaaggaguuuggggaccaaggaguccagggauccugcucucuccauuccuuccucac

SEQ ID NO: 4231281 - RNA, 58 nt, Human
ccaccacugaggcacaggagccaaaggcugggcaacagcuuugugccugagaaggugg

SEQ ID NO: 4231282 - RNA, 81 nt, Human
uugagauuucuucauuuaaaaauauuuuuaauaguaauaaagcagauccuuacuaaauauuuugggacugaggaauuucag

SEQ ID NO: 4231283 - RNA, 101 nt, Human
gccgcgccccgcaguccccagggccuggcuggcuccaccugcugccagggaagacccucggccggagagccaagugcugcugggagguggccgggcguggc

SEQ ID NO: 4231284 - RNA, 59 nt, Human
gaccaggcuagagugcaguggcacgaucuuggcuugcugcacccucugccuccgggguu

SEQ ID NO: 4231285 - RNA, 82 nt, Human
guuuuuagacuguuaauugugaauuuuacauuugggucaucacuguuguguagauuuguucaccuauuaaaauaaugaaaac

SEQ ID NO: 4231286 - RNA, 71 nt, Human
caagagaggcccaaguggcuggcaggagaccaagcuccucaagcaaagcccagcucucuggccugucuuug

SEQ ID NO: 4231287 - RNA, 57 nt, Human
ugauaguaucugauuauuucacaguuaguuuugggaauaauauuacagauacaguca

SEQ ID NO: 4231288 - RNA, 80 nt, Human
gaaauagaggcugacaaagacgagguacuuacccuggucuguagcauagacuagccaaagacuucuguaggcucuguuuu

SEQ ID NO: 4231289 - RNA, 102 nt, Human
ugagacagaguuucgcucuuguugcccaggcuggagugcaguggugucaucucggcucacugcaaccuccaccuuccggguucaagugauucuccugccuca

SEQ ID NO: 4231290 - RNA, 80 nt, Human
uuuaucucugcauagaagugaucucagucucuaagaaaaggaaggauauuaguuagucuaugccugaccagggagguaga

SEQ ID NO: 4231291 - RNA, 91 nt, Human
ggcaggagcucagugcuucuugugcagugccuggacccagguaucuuacuuggggucuuacuuguacccuuacagucucugagaaccagcc

SEQ ID NO: 4231292 - RNA, 81 nt, Human
ggaaugugucuugaguuauuuuuccuguuuuuuagugaugccucagugaaauuuuuuggagauaauuuacagaugaugucu

SEQ ID NO: 4231293 - RNA, 125 nt, Human
acuccugcugguuuuuuuuuauuugucugaaaacugacugaugugaucuuauuuggacaaaggaguguuguuggaaauaucagucacgugaauuaauuaacaauuucuuccuuccuagcgagagu

SEQ ID NO: 4231294 - RNA, 73 nt, Human
aguagaugaccaguaagugguugaaugaaugaaccaucuauucuuuucaccucuuuuuggggacaucuuugcu

SEQ ID NO: 4231295 - RNA, 56 nt, Human
ucgggacgguggcauuugugcccccugggaaggggaugagcacugcugccuccugg

SEQ ID NO: 4231296 - RNA, 86 nt, Human
ucaauggaucaacagauuguguaagcagcaugacgguuggauuuagaaaugugucugcucauguuugguuugugcugaaccauuga

SEQ ID NO: 4231297 - RNA, 76 nt, Human
gggaugagguucgauacagcguauuuauugcuugucauguaaauuaaaaaccuuguauuuaacucuuuucaauccu

SEQ ID NO: 4231298 - RNA, 76 nt, Human
uuggaauuguguucuuuaugguuguaguguugguaaagcacuaauaugcagaaaauaaaggaauuacacagugcag

SEQ ID NO: 4231299 - RNA, 66 nt, Human
cuccuuuacaauugugggaaaauuaucugaccuuuccguguuuguuuccuuaauuguaaaauggag

SEQ ID NO: 4231300 - RNA, 69 nt, Human
ccaauccugcuguugagguuccaggccaaagggaggaagcucuggaaccuggcuucaaagggaggcugg

SEQ ID NO: 4231301 - RNA, 69 nt, Human
cuucuuggguccuggcugaagaucucugcugcccccagacucagaagagccacuccaggacucagggag

SEQ ID NO: 4231302 - RNA, 125 nt, Human
uuugaugcugcuggggcauaauuagcagagccuuucuggagggcacuugguaaucuguaccaagagcuuuagaaaugcucauucauuuuuaccuguugauucuacuuccagaaauugguaucaga

SEQ ID NO: 4231303 - RNA, 61 nt, Human
cauuggaugagggccucaucgaguuuggaacagccauugaugauggcaacuacauccggug

SEQ ID NO: 4231304 - RNA, 57 nt, Human
ggaguuucugucaucccguccccguggcaacgccccccgggaaugauggaagacuuc

SEQ ID NO: 4231305 - RNA, 57 nt, Human
uuuuccuguccuugggucugcaagagaaaauuuugaaaaaacuuaagacaguggaaa

SEQ ID NO: 4231306 - RNA, 63 nt, Human
uguugucaugcagucagugguaugugaauuuuaggguuuuauuagggaacugcaagacuaaca

SEQ ID NO: 4231307 - RNA, 73 nt, Human
gacuuagcagagaaugucagauuuuguuuucaauuauaauuuuagaaaugcaaaaucuuauuuuuucuaaguu

SEQ ID NO: 4231308 - RNA, 76 nt, Human
gccgggccacacaggcgucgccugcucuugccaccagugccucaguggcagcagaacuggcccuguaucaggccgc

SEQ ID NO: 4231309 - RNA, 73 nt, Human
ggcauggcuucugguuuauccuuauauucccuuuugggaaauacugucacagggauaccauggggcccaaacc

SEQ ID NO: 4231310 - RNA, 96 nt, Human
ugagauuuucuacauuuuagguuguuguggggauuaagugaaauacagguaaaguacuugguccacaguaagugcuuaauaaguguuaaaguguua

SEQ ID NO: 4231311 - RNA, 67 nt, Human
cauuaagcuuuuucuuaucuuuuucuauggggaagcuauaggguggguaaggaaaaaauguugaaug

SEQ ID NO: 4231312 - RNA, 56 nt, Human
cagccccaguuuucauaagacugcugugaagauguuugauauaaaggcuugggcug

SEQ ID NO: 4231313 - RNA, 84 nt, Human
ucucucaggacggcuagcagcagaauucauugucggaaggaaauauaaacugcuuuggaagaucugguguagcuccuucggaga

SEQ ID NO: 4231314 - RNA, 59 nt, Human
auucuguaggcuuuuguuaaaaauagagaauuucuugggguuuacuuaggccacagaau

SEQ ID NO: 4231315 - RNA, 89 nt, Human
ccuuacaguggccguggucgcugacucucgugucuccccuguucacaugccagccaucgagggugaguacagcggacccaagcuugagg

SEQ ID NO: 4231316 - RNA, 76 nt, Human
acuggggaggucuggauggaucuguguaggaguucccuguagauaaauuacugaucccccaucuacuauccccagu

SEQ ID NO: 4231317 - RNA, 69 nt, Human
aagacucagcugggagaaaguuuuagguuucugcucuaacaccugaaaugaguucugcucacugcucuu

SEQ ID NO: 4231318 - RNA, 76 nt, Human
acaguagaggcuagugguuaugaccuuccacuccagaaccagacugcccaggucuaaaugcugguuucaccacugu

SEQ ID NO: 4231319 - RNA, 70 nt, Human
gagagacagcuggggagagacauggcagggucggagcgcggccugcgccucugucacucagcauccucuu

SEQ ID NO: 4231320 - RNA, 93 nt, Human
ugguaggcacucaguaaauaucucacgaaugauucccauuaccauggcuaaaacaugagucuuuuaagaugucuuacuguggaucugucucca

SEQ ID NO: 4231321 - RNA, 82 nt, Human
uacucagugauagcagaauagauuagaaagaguauguguuuaaaauaacacacaacuuuauuaauuuauacaacuuugggua

SEQ ID NO: 4231322 - RNA, 67 nt, Human
uucuugagaacaaauuccuggauacuggcauuagugacaaagaagugucaggacaguuugccaagaa

SEQ ID NO: 4231323 - RNA, 105 nt, Human
gcagagguuaaguaacacgcugaggacacaggcuucagagaggggugaagcuggccuuugaagcuagguuguccaucucuagaagccacacccuuaagccucugc

SEQ ID NO: 4231324 - RNA, 80 nt, Human
uugguuagguaguggaaccuucuaaaugacgcacuaugugauuccugugucauauagaauguucuaugauucuuagccag

SEQ ID NO: 4231325 - RNA, 130 nt, Human
uguacaaaaaaaccccaaucuacuguaaauggcaguuuaauuguuagaaaugacuguuuuugcaccacuuguaaaaagguauuuagcgauugcauuugcuguuuguuguuuuauuuugcuuuauauauga

SEQ ID NO: 4231326 - RNA, 73 nt, Human
uggggaagugagcucauuacuuuagguucaaauuaugccaagaauuuuagaugugaucagcuggcuuaagcca

SEQ ID NO: 4231327 - RNA, 96 nt, Human
gcugugugucuguaaaaugacugacagugguacuguaauuaaaaaauauauauuuauguaaauauagugacacuuauagucuggcggauggauugc

SEQ ID NO: 4231328 - RNA, 60 nt, Human
uuggggaaaaagaccuaaugaccuaauaugcaauuucuguccucgugucuuuuucucuaa

SEQ ID NO: 4231329 - RNA, 71 nt, Human
uucaauuguaugcugggaagcgggagguagugauuauaccuucucccaaaucuuucuagcacacuaaugaa

SEQ ID NO: 4231330 - RNA, 56 nt, Human
ggagcucaggaguugauuauuuucccaaagcaggaaaguccaauaccuaaggcucc

SEQ ID NO: 4231331 - RNA, 63 nt, Human
gcauacugagauguuaauagggugugcaauuuggugucaugcuuuauucgacaucugguaggc

SEQ ID NO: 4231332 - RNA, 66 nt, Human
gaggcggcgacgcgggcccggggucgcccgagacaccuggccagcggugccccuagcgcgccgccc

SEQ ID NO: 4231333 - RNA, 123 nt, Human
cuguucacaccuaaugucuugaagaguagguagcagcagugugggcugaaccuaggccagcuugcuuagcgggucacccugcugugaaguccuggcagguguugguaauguguggaaaugcag

SEQ ID NO: 4231334 - RNA, 91 nt, Human
aggccuccacugucagccaugaccauuuggguuugugcgugugacugcugugucucugacacagaccaaguggugcugacccugggagccu

SEQ ID NO: 4231335 - RNA, 62 nt, Human
cagaggcaggcggggcccagguggcguggaccgcccgucaccagcucugccucgccagucug

SEQ ID NO: 4231336 - RNA, 70 nt, Human
aucuuccugaguucuuauuuccagucagggaaacacauuuucuccucauuuaauuuggaacucagaggau

SEQ ID NO: 4231337 - RNA, 90 nt, Human
cccguagugccccucguccccgcuccguagagaaagagcgugcgugccgcgcauuucuggccuggggagcggguggaguaaaccugcggg

SEQ ID NO: 4231338 - RNA, 78 nt, Human
gcucagugggaguguuagacuaaauugggaggaggggucuuccuaaauuuguacuagcauuuucucccugaacugacc

SEQ ID NO: 4231339 - RNA, 57 nt, Human
ccccauuugaagauuggggguacacuuggagcuagagagccacccaucauauggagg

SEQ ID NO: 4231340 - RNA, 84 nt, Human
cugggugccccgcugggccccugagauggguuuucuggucccagcagacucaugaaugccggucucgggggaaaggggcuccag

SEQ ID NO: 4231341 - RNA, 63 nt, Human
uuuuucucuuuuugggguggggugggauaggagccuuguucaccccacccugaggaggaggga

SEQ ID NO: 4231342 - RNA, 84 nt, Human
ucguaagaagggccugaaaugaaccagaggacuccgccaaaguucuaugagccugguuuucuuguucauuuuuuaauuauacga

SEQ ID NO: 4231343 - RNA, 62 nt, Human
guuuucauccucuaguacugaagugcccucaaggugguaggcacuguauagcaggagaaaac

SEQ ID NO: 4231344 - RNA, 74 nt, Human
uugauagaauuaacuuauacccagggcagaaauaauauuugcaugauuccuguggcuggguaaaguacuauuag

SEQ ID NO: 4231345 - RNA, 58 nt, Human
gguacgagcccugccuagugucugucuccugugucacggaccuguucaaccucgugcu

SEQ ID NO: 4231346 - RNA, 65 nt, Human
gcuaguaagugauagagcugaggcucaaacccgugcaaucugacuccacagcccucacuuuuagc

SEQ ID NO: 4231347 - RNA, 99 nt, Human
uuccugguaauucggaugcacauuaaaauuaaaguuuuauuuagagcauugguccccuaaguuagguagaaguuuacuuugaaguuugcaagccaggga

SEQ ID NO: 4231348 - RNA, 67 nt, Human
uguuuucuaacuuugucuugguaauugcaauuuaacuaggugcgguggcuacuaaaguucgaaggca

SEQ ID NO: 4231349 - RNA, 84 nt, Human
aacuggucggugauuuagguaguuuccuguuguugggauccaccuuucucucgacagcacgacacugccuucauuacuucaguu

SEQ ID NO: 4231350 - RNA, 61 nt, Human
ugagcucaagccauccuucugccucagccuugugaggagcuagaacuauggcuaugugcca

SEQ ID NO: 4231351 - RNA, 59 nt, Human
gagaggacaggauccggagggcuucuuacuggaggacuagaccuucaucucugcuucuu

SEQ ID NO: 4231352 - RNA, 76 nt, Human
cggggacaaguccguugaggcugccaggcgagucaggccuuucuggaccucgccugacucggaugggcugugccug

SEQ ID NO: 4231353 - RNA, 69 nt, Human
uuccagguucuguucuucacagguuuguucugggaaucaaacaaggccugagggugacagcaccuggga

SEQ ID NO: 4231354 - RNA, 58 nt, Human
auccuccuuugcccugagaucaucccaaauccuguugcuguccaugguaaagaaggau

SEQ ID NO: 4231355 - RNA, 78 nt, Human
agcccagggggacuggggcauuagaguagcuuucucucaaagagaaguaacuggguggccccaguucccccagaugcu

SEQ ID NO: 4231356 - RNA, 119 nt, Human
ucaggguaaugguuacaguuaggagaggaaagggaauacaaucagauuaugguaguaaacagggauuuuaaccauauugauuauguuuuauuucugaaacuggguaauggauacucugg

SEQ ID NO: 4231357 - RNA, 91 nt, Human
agggauuuuguccaagggaccucagcaaucagggaaggaggcacccccaaaucccugagcuguguuuguugguguauuaaauaaaguuuuu

SEQ ID NO: 4231358 - RNA, 56 nt, Human
guuaguucccaccccuguaagacuugacacguagucuucauuucuggggaauuggc

SEQ ID NO: 4231359 - RNA, 89 nt, Human
cuuugcucucagauacuugaggagaucaccacauaaauucuuagaguucuggguuuagcuguaguguuuagucuagugucgaagcagag

SEQ ID NO: 4231360 - RNA, 71 nt, Human
cagaaaagcgaagagaacugaaguuugauggucguuuagauaaggaacuuucagaauccuaugcauuucug

SEQ ID NO: 4231361 - RNA, 61 nt, Human
uuccaaaugacaaugggcuguaccgggcuuuguggccuuaauaagcccucuguuacuggaa

SEQ ID NO: 4231362 - RNA, 79 nt, Human
ggugcuuaaagaauggcuguccguaguauggucucuauauuuaugaugauuaauaucggacaaccauuguuuuaguauc

SEQ ID NO: 4231363 - RNA, 86 nt, Human
aagggucuuggugaccacuauaucaaggauuuuguuugcugagguaaagacaauuucucaauauagaaacuauucacuaagaacuu

SEQ ID NO: 4231364 - RNA, 121 nt, Human
gcaugagagcagcaucugaaccacucaggaggcuggacgugcauuucuacaguggauuccuaauucuguuuucugggguggagaaauauguucagcuucuucagcaguuugugaaucaugu

SEQ ID NO: 4231365 - RNA, 59 nt, Human
agagggagccugcacagcuuucuggucaccaagccccgcggguugagcguggccccucu

SEQ ID NO: 4231366 - RNA, 58 nt, Human
aggguguacauuuguuggugaaggauugauucaucucccaucaacaccuugucagccu

SEQ ID NO: 4231367 - RNA, 67 nt, Human
uuugauuugcuuguucaccaguacuuuuggagcagaaugucaggaguaugugaggaaguaaagaaga

SEQ ID NO: 4231368 - RNA, 103 nt, Human
guuuaugcaguucaguggaauagaaugggaggggaaucauccauguucacaacacuggguggggcaugcucucuucuguuguuuguuguucugugacuuaaac

SEQ ID NO: 4231369 - RNA, 84 nt, Human
ggcaggggaggcagggagagcgccgccaugcaggugcccgugcccucgacaagccaugguggggccucccugaccccgucuguc

SEQ ID NO: 4231370 - RNA, 70 nt, Human
uaacacuaaccauguucccaacagcuuagggcugucagcuuagggcugucaggaacaugccuugguuuua

SEQ ID NO: 4231371 - RNA, 71 nt, Human
gcagcucccuuaacucaaguggugcucagggcccuuggccagggcuuaaccuggguaugagggagaguugc

SEQ ID NO: 4231372 - RNA, 81 nt, Human
uggcugaaaaucauguuauguacaaauaugacuugauucaauacaauuuauuguuuggguauaauuugaauuagaaagcca

SEQ ID NO: 4231373 - RNA, 60 nt, Human
cagguuguucugggcauggagggggccugguguggcugagggcaugcccagggcucccug

SEQ ID NO: 4231374 - RNA, 63 nt, Human
ggauggaugugaucugccuccuacgggaaugcuauuuaaaggggcagccucacaauccucucc

SEQ ID NO: 4231375 - RNA, 84 nt, Human
ggaauuuagagaaguagcaaggucccaagcaauguugggcuuagaggcaccuugguaaggacuuuggauuuuauucuaaauucc

SEQ ID NO: 4231376 - RNA, 96 nt, Human
gaauuuuuggaguuuccaggcuuugguaugguuuugguguuuacuuacuuacuauuuuuuuaagccaugcuguuuugccugggauuuccuuaauuc

SEQ ID NO: 4231377 - RNA, 65 nt, Human
gaaaagcagguuuuuauuacaacuuugaugugucguggaugaagaauagaggccugcacuuuuuc

SEQ ID NO: 4231378 - RNA, 64 nt, Human
uucacccaaaucaagcuggccuggauucaaaaguacugauugguagucagaaugauuuggugga

SEQ ID NO: 4231379 - RNA, 79 nt, Human
gcugcagggacagcuggggguaaagcauccacccucccccaguuuggcgaggaugcacuccucagcuguucuggaaggc

SEQ ID NO: 4231380 - RNA, 72 nt, Human
ucuugaacaguucaagauuguugcuuucucuccaguaggaagucuagcuguguuuugagcugugugaaagga

SEQ ID NO: 4231381 - RNA, 70 nt, Human
ucagucugguggaugcucauugacaucuugugguuuauaguugcaguucuuugaguacuaaugagauuga

SEQ ID NO: 4231382 - RNA, 95 nt, Human
uggaaaggcuguuacaguugugacuaugguggagaucaguauguuacuuuaauuuguauuggcucagucagaaguuuugcugcaagccucuucca

SEQ ID NO: 4231383 - RNA, 73 nt, Human
cggcggcugcggccgggcaucguauggcgcuagagaacuucggcggcgagcgggaccugcgccugggccgccg

SEQ ID NO: 4231384 - RNA, 78 nt, Human
aucuagcuauuauuuaaguauuuauugaaguagaggggccuucaaacuacuuuauacuagugauaguuugaguuaggu

SEQ ID NO: 4231385 - RNA, 63 nt, Human
gcugucacaccuggcgauaaugggcaucagagagagaugccuugcgaggaugcugugagcugc

SEQ ID NO: 4231386 - RNA, 65 nt, Human
guaaccaaaguugguauuuaauaauauaaugaacaguuugguaguuagaucuccaguuugguuau

SEQ ID NO: 4231387 - RNA, 82 nt, Human
gguccuguaucuuagagagucguguuuuguuucaugcuugauugugucuaacacacaugccuuuccuaaguauaucaagacu

SEQ ID NO: 4231388 - RNA, 76 nt, Human
uuuucagaacaaaguagaugagaauuuuguuguuguuguugugauauuaacagugcuacaguuacuuuccugaaag

SEQ ID NO: 4231389 - RNA, 110 nt, Human
gaauuuuccagauguuuaaguucugcuucccuuuugauuaaaaauuuacucuuuaaauucucucuucuuguauuuuacuaucaagagaagcgaagccacaucuuccauuc

SEQ ID NO: 4231390 - RNA, 60 nt, Human
gguggcgucgaugauggugucaugguccacccggaacauguagcugcucccgaugcccuc

SEQ ID NO: 4231391 - RNA, 65 nt, Human
uuuucuuggaguggcuguccuuuuccucuuagauuauuagaagccagcaguuccucuuaagagaa

SEQ ID NO: 4231392 - RNA, 70 nt, Human
gcagaggugcuagggcaggaggugaggaggaugggaaaauccccagccuuugcuuccugguucccucugc

SEQ ID NO: 4231393 - RNA, 89 nt, Human
gugcaguggcucaaucucagcucugccuccuggguucaagcgauucucuugccuuggccuacuuaguagcugggauuacaagcaugcac

SEQ ID NO: 4231394 - RNA, 58 nt, Human
gcccaggcuggagugcaguggugugaucucagcucacugcaaccuccaccucccgggu

SEQ ID NO: 4231395 - RNA, 74 nt, Human
uuuugggaauuuaugagaaaauauagaaaaccacagaucagggauucauauauguagcucaaaaauucccaaaa

SEQ ID NO: 4231396 - RNA, 83 nt, Human
cuauugcaacuugccuagggacuuugguuuagaucauagguuggccaugaucaaacuaugguccaugggcaaaaucugucuag

SEQ ID NO: 4231397 - RNA, 58 nt, Human
ugcuaguuuuugauacuuuugcuaucuuuggguagaaguguacuuagagaacauagua

SEQ ID NO: 4231398 - RNA, 61 nt, Human
guugcggaucuucauggccucaggagacuuguuucuccaugggcucuucuggacugcacac

SEQ ID NO: 4231399 - RNA, 64 nt, Human
guguuguguuagguuuugggauggcuuucuagggagcaauucugaaauuacuugacagauacac

SEQ ID NO: 4231400 - RNA, 79 nt, Human
aaguuccucauuuuacucucuuccauacaaucugugggaaccaucccauaggaguauaaggcaguaacugaggacucuu

SEQ ID NO: 4231401 - RNA, 85 nt, Human
aagaauaaggaaaguuuaggagugaguuacuuaggguguauucuacucugaggauuucaguuuuacuauagcuguauuuaaucuu

SEQ ID NO: 4231402 - RNA, 86 nt, Human
cagaggagauguagcauuuagaacaccuugagacaugacauuguaaaauagcuuguuuuauguuccugaagcuaucuuguucucug

SEQ ID NO: 4231403 - RNA, 91 nt, Human
cacgggucgggcgcauaaaagcgcgcggggcugcggcagggcacugccaccauguccccgcugcgcccgcugcugcuggcccuggcccuug

SEQ ID NO: 4231404 - RNA, 62 nt, Human
uuuuaaauggcuuuuacuuuucuaagucacugaaacaaggaagggccacaugccauuuaaaa

SEQ ID NO: 4231405 - RNA, 64 nt, Human
augacacaaccuaagaacagcaggcuccucaacgaggggcaaacuuguucuagggugggugcau

SEQ ID NO: 4231406 - RNA, 61 nt, Human
aagucccaucugccuccauguaccagcugaucgcagagcuggacuggggcaggcugggcuu

SEQ ID NO: 4231407 - RNA, 67 nt, Human
ccaguacauauccuuuacguuuuguucaucaacuuugauagacagcauagaggaaauguggaacugg

SEQ ID NO: 4231408 - RNA, 65 nt, Human
gcuggggagccuggaguuucugaugggaggaggcuaccucuacccucgcuccucgguuccccugu

SEQ ID NO: 4231409 - RNA, 113 nt, Human
gccaagaaugagaugggggcugugggacccgcuucaggcgcauggugagcagaugaugcauccguuucucugucucccguguguccgggucaaggcggccucuggucucuggc

SEQ ID NO: 4231410 - RNA, 82 nt, Human
gcccgcacugcccgcaugcaggaaugcuggcguuauuucauuccuacuacagcugcgucccagcauguagggcagugcuugc

SEQ ID NO: 4231411 - RNA, 129 nt, Human
caaaucuuuaaaaucacuuugguggugauuccaaauugguaccaagcaaacuuucuggaugcccaacaugauuuucaguaaccacccuuuagaguauuuguuuacuaaguucaccacauuuugaacaug

SEQ ID NO: 4231412 - RNA, 70 nt, Human
cagaaccauuaauguugacacacuagcacaaucuguuggauuuucuaguagcuacagcaccaugguuuug

SEQ ID NO: 4231413 - RNA, 66 nt, Human
gauagcaacucugcuuccuugccucaggacagguuuguggcaaggaagaaagcagaaguugcuuuc

SEQ ID NO: 4231414 - RNA, 79 nt, Human
uuagguugagccauaggaaauugcuguuauggaguucuaaaaggauugaauuuuggcaauuuucuguggcucagccuaa

SEQ ID NO: 4231415 - RNA, 69 nt, Human
guauuuuguguguguguguguguguguguguauauauauauauauauaugcaccacauguguauaguau

SEQ ID NO: 4231416 - RNA, 93 nt, Human
ggcgggcuccugggacacgugaccggggcggcgagcgggccgggcggacgggcuuccgccugggccgggcgcggcccccucugagcgcccgcc

SEQ ID NO: 4231417 - RNA, 65 nt, Human
ucccgacaagagaaaugcuuuguuuuaccuuuggauuguguaaaauaauaauuucucuguuggga

SEQ ID NO: 4231418 - RNA, 76 nt, Human
ccgagcgcuucccgggcucuggcagaggcggugcguucugcgcugccgcugcggggcgcgggcaccgagcgugagg

SEQ ID NO: 4231419 - RNA, 76 nt, Human
gcacaggaccuagaagaacaugucaaacuauaaacugcuugugauugugaaugacuuuguucuuugcuucuugugu

SEQ ID NO: 4231420 - RNA, 79 nt, Human
gucccccgcauggccaguuuguuuacugaugguuuucauuuggcagaaucaggaagacagccuggcuugaugucaugac

SEQ ID NO: 4231421 - RNA, 89 nt, Human
guuuugcuguugucggguggaucacgaugcaauuuugaugaguaucauaggagaaaaauugcacgguauccaucuguaaaccgcaggac

SEQ ID NO: 4231422 - RNA, 60 nt, Human
auuaguagcacacagagaucagagagacaucaaccucuccucucugcgaaugcugauagu

SEQ ID NO: 4231423 - RNA, 78 nt, Human
ugccuugagcugccaauuaccuauuucugagaauuuggugacucuuauugguaaugauggcauuuacaacauuuggca

SEQ ID NO: 4231424 - RNA, 98 nt, Human
gcacacucacauccagguaguucuccaggggcuguucaucuaccagggugggagccucccacugggggaaguacuuucuggcuggguugagguugugc

SEQ ID NO: 4231425 - RNA, 55 nt, Human
agacuugguaacuagugaagaacaucaaaguuggguauuucaaugugccaaguuu

SEQ ID NO: 4231426 - RNA, 58 nt, Human
ugcaggaacucgaaaacuauagugaaggagguccucucuauaaaaaugguucuuugcg

SEQ ID NO: 4231427 - RNA, 59 nt, Human
gcaguacugguuuucuuacucuggcucuuacugagucaaaguuaacuagcaggugcagc

SEQ ID NO: 4231428 - RNA, 57 nt, Human
gcaaaaacaguguagucuucuguccauuaaggagaugugaagcugcauuauuuuggc

SEQ ID NO: 4231429 - RNA, 61 nt, Human
ucaaaaaacccuaguugauagcuuggguguuucuuaucauuuuuauuagcugggguuauga

SEQ ID NO: 4231430 - RNA, 55 nt, Human
ggguuaaauggauggcauuugcucaggacagagaagauguucaguguccuaaccc

SEQ ID NO: 4231431 - RNA, 65 nt, Human
gucacgcagcccuguugcgcuuccggcgccugcugguggcugagcugcagcguggcuucuuugac

SEQ ID NO: 4231432 - RNA, 63 nt, Human
gaaagugcuggccuacucaaucgagagcaaugcuuucaucgaggagagucgccagcugcuuuc

SEQ ID NO: 4231433 - RNA, 70 nt, Human
gcuagccucuggaauccuuucucuugaccuguggaagagagaacauuuucaggguuucaggggcuauggc

SEQ ID NO: 4231434 - RNA, 73 nt, Human
ugucuccaaauagcuggaugauggugucauauuugcaaugcauagauuaugccaucaugucagauuugggaca

SEQ ID NO: 4231435 - RNA, 58 nt, Human
caggggagguggcagaaaugugcuucuauaaagaggggccagccuccauccucccuug

SEQ ID NO: 4231436 - RNA, 129 nt, Human
uuuuacccccugggagugauggugauaguuaagguguacugaagauggcgucacagaacgcgucauugaaguguacguuugaucuauauaagagacacaggggaaaguuauuuccagguggagguaaaa

SEQ ID NO: 4231437 - RNA, 77 nt, Human
ggacagucaugcuuaaagcauuucucuuuaaccagccagggcucuuggagagggugggcuuugaagaugaugccucc

SEQ ID NO: 4231438 - RNA, 79 nt, Human
gagccagugcucagggaaugccacugacaggaauucccgacagcuccagucauugugugugcuucuugggcauggguuc

SEQ ID NO: 4231439 - RNA, 58 nt, Human
gugggggcuaaauugaggggugacgaugggcgaugucuuuacucaaccaggcuucuac

SEQ ID NO: 4231440 - RNA, 74 nt, Human
gcagagcugucuaagucacuuccuuuuacaccuucagucucccaucugcaaaagugcucaguggacagcauugc

SEQ ID NO: 4231441 - RNA, 59 nt, Human
agugcccuugggcgguucacagagcuccggaucuggcgcugggaacccgaccaaggccu

SEQ ID NO: 4231442 - RNA, 61 nt, Human
guuggcgaaggaccuggaggagucgcagggcggcaaguccucugagguccucucggccacc

SEQ ID NO: 4231443 - RNA, 76 nt, Human
uuuaacugguuucaaguuggacugaacuagaccaacucuuagcuacucuaguucuagccauagaaauuagauugaa

SEQ ID NO: 4231444 - RNA, 93 nt, Human
ggccagccuggccucaaacuccugaccuugugauccaccugcuuuggccucccaaagugcugggauuacaggcuugagccacuacgccuggcc

SEQ ID NO: 4231445 - RNA, 78 nt, Human
ggcggaacaggaaagaaggcgaagggaccagacgguagaggacuacugcuucuucucauuuguuuuucuauuucugcu

SEQ ID NO: 4231446 - RNA, 68 nt, Human
aggcgaguacagacggggccugggagggggcagagauguuccccaggcccugccugugguuccugccu

SEQ ID NO: 4231447 - RNA, 66 nt, Human
cagguuguugagaucaucuggcucuugauuuuauuaaucaucuuagccuucccuuucaacaauuug

SEQ ID NO: 4231448 - RNA, 62 nt, Human
uguggagauauuugugauagggguggugaagaaaaaugaucccaacuuugaaauauuccaca

SEQ ID NO: 4231449 - RNA, 57 nt, Human
uaggcaguagcuuuggaugucaggaauuucucugugaggucuuggaaguucuguuug

SEQ ID NO: 4231450 - RNA, 71 nt, Human
uguacgacuugauuugguauccaggauuuaaauugcucuuaaaauuuacuuucugggauaucaaaugugca

SEQ ID NO: 4231451 - RNA, 63 nt, Human
uuuuacaaggcaguuauuuuccuaaaguguuacauaucaaggaaaguugagcugucuguagga

SEQ ID NO: 4231452 - RNA, 74 nt, Human
cagacugugggaagacagccagguggcacgacuccggcagccacuugccgcccggccaucucggcucccaucug

SEQ ID NO: 4231453 - RNA, 75 nt, Human
gaauaugaacauuuauuuauuuucguguguguguguguguguaucugugcauauaugcaacaagaaagcauauuu

SEQ ID NO: 4231454 - RNA, 67 nt, Human
ggcaggagaugacaucccagcccggcccagcucccacccugggagguuggggugucucuccccaguc

SEQ ID NO: 4231455 - RNA, 62 nt, Human
cugaccgagccgcccuccacgaugucccuccagagcgggcggucagggggcugcucggccag

SEQ ID NO: 4231456 - RNA, 93 nt, Human
ggcuucucagacucucagggguuggcuuguuguguuugcuuuugcaaauaacucaggcuuaaguccugcuacuuucagagccuaggggacgcu

SEQ ID NO: 4231457 - RNA, 85 nt, Human
ugaacuccucuccuuaaaaaucuauguugaacugaugcacuguaucuuguuucugcaacuaguuuuaagcuccuugagguauuua

SEQ ID NO: 4231458 - RNA, 62 nt, Human
ccagcuuuucagaaucugccugaaaguggccuaagaauggcacaggccuucaggauggcugg

SEQ ID NO: 4231459 - RNA, 107 nt, Human
aggcuuaaugucaccauugguaaaaauuagauauguauuuagccucuacuauguaaaauagguuacuuaucugaugugauuuuugaugauggguagauauuauacuu

SEQ ID NO: 4231460 - RNA, 85 nt, Human
gcugaccuggugcuguagccugauugaggggcacagccuuuuccccagucuuggugucuguagcacguauguucuuagucucagc

SEQ ID NO: 4231461 - RNA, 100 nt, Human
agaaaauuguuuuguuaagaggaaggcaguuaauuuggcuagaauccaaaaacucauucagcauggcuguuuucccuuauuucaaaugaaaaacuuuucu

SEQ ID NO: 4231462 - RNA, 56 nt, Human
gcauguagucaguguugagaaccuugguacuaaaggcucuugcaucuuccuacugu

SEQ ID NO: 4231463 - RNA, 90 nt, Human
gggagggcccgcaagcucuagcuggcgcugaccuggggcugacccucuccagcagccugcaggaagcucagcggggccgggcugccuccc

SEQ ID NO: 4231464 - RNA, 58 nt, Human
agugccaucuuuaacugucccagaaauccucacgguagagggacaguuguagaggacu

SEQ ID NO: 4231465 - RNA, 61 nt, Human
auagcagggagacagugcagcauuaaacugguggcauaauguuguaaauauucuuugagau

SEQ ID NO: 4231466 - RNA, 63 nt, Human
guuuucaagguagaagcagcuuauacuccaggccccuggcauuagacagagcuccuugagggc

SEQ ID NO: 4231467 - RNA, 95 nt, Human
cccaaggucaauacugcuuagcucagucauacuuuaugauugaaagaaugccuuccucuuccauugucaauaguauugauuggcaguucuuuggg

SEQ ID NO: 4231468 - RNA, 63 nt, Human
aggguuucucuccaguguggacccucugauggauaaggaggucggagcuguagaugaaacccu

SEQ ID NO: 4231469 - RNA, 63 nt, Human
uggcagugcugcgacagucgggugacuccaguccugugacgccuggccccgcagcgcuuguca

SEQ ID NO: 4231470 - RNA, 102 nt, Human
aaccucuuggcaccagauuggggauuucccaaugcgaagcagcacugcauuuugcauacuugcuuagcggugggggcuccauaaaacuggugcugagaaguu

SEQ ID NO: 4231471 - RNA, 65 nt, Human
ggccggucggagagaaugaccuggaaggcguggggccgauccgugguguuggcucuccggcagcc

SEQ ID NO: 4231472 - RNA, 68 nt, Human
caaaacauucagagagcucacuugacccaaccgaggguuuuacuuggugagccuuucuaguagucuug

SEQ ID NO: 4231473 - RNA, 56 nt, Human
ggaaaagccaagguccauguacuuuuuuugagaaagacagccuguuggcuuucuuc

SEQ ID NO: 4231474 - RNA, 56 nt, Human
agguggucccaauggcugggcaaucagcacuucuggcguucccaccuggacuaccu

SEQ ID NO: 4231475 - RNA, 80 nt, Human
gcagcucaccugagagacggagccccggcucgcccgugugcagagguagcgagcccaacccucccguccucccgggcugc

SEQ ID NO: 4231476 - RNA, 126 nt, Human
ccugcucacguggaaguaaauuauuugaugagcuggggaaauauaagcaguuuguguggauuaaaaggaaauccucacccaaacuauaucuuuaaaaauuaucuagauaauucaggugaaagcagg

SEQ ID NO: 4231477 - RNA, 98 nt, Human
gaggugggaggauugcuuguuccccggagguugaagcuacagugagccuugauugugucacugcacuccagccugggcaacagguaagacucugucuc

SEQ ID NO: 4231478 - RNA, 105 nt, Human
gugguucugaaacuaccuccaguugucuuuugugauuuucugaagcaaaguaacuuuuugagagaauuacuaaagggcuuaaauugagauaaugaaaugaaucac

SEQ ID NO: 4231479 - RNA, 66 nt, Human
gcugagcgccaguggcagcuggaacaggcaucccaaggggguuggcagcagcaaucacuggugagc

SEQ ID NO: 4231480 - RNA, 100 nt, Human
uacaauugcugguaccugguagcauuuauuuucccucaaguaccuaguaaccuuaugaagguagggaggguagaugcucuaccacauuccuucagcugua

SEQ ID NO: 4231481 - RNA, 86 nt, Human
gggggucucucccggagucggccagcccgaggcaggaagcccugcgguuucuggcuucucccaggcggccuccggaucuggccccc

SEQ ID NO: 4231482 - RNA, 83 nt, Human
uuugcaaaacauggcaugaauaauguguacauuacuugcauaauugguuuugugcguacauauggcacaugcuauuuuggaaa

SEQ ID NO: 4231483 - RNA, 59 nt, Human
agccagaauuugaacccacaaaugucugauugcagcauggcaggugcagauucugugcu

SEQ ID NO: 4231484 - RNA, 55 nt, Human
uuacucucugaggcacucaaaaaagcacaugcuuuuaauugagggauggggguga

SEQ ID NO: 4231485 - RNA, 67 nt, Human
uugucaaccagcuuaucugcaggauguuucagaucugauaaauccugauggaaacugguaugaucag

SEQ ID NO: 4231486 - RNA, 100 nt, Human
gggugugugcaguggguucuguggucaggagagugccgucuggaugggagauauuugguugguuuuagcuuggcccauuccugccacugacugauggccc

SEQ ID NO: 4231487 - RNA, 85 nt, Human
guuggccaggccugaugucgugauccacccgccuuggccucccaaagugcugggauuaccggcaugagccacgcgccuggccaau

SEQ ID NO: 4231488 - RNA, 60 nt, Human
ucauuuuaucaggaauggaauccaaugauggauucuaccaucacguuccagaacaaauga

SEQ ID NO: 4231489 - RNA, 64 nt, Human
gggauggggagcuggaaaggggaaggaauaggaagauaaucuuccccuggaguuugacuauucc

SEQ ID NO: 4231490 - RNA, 55 nt, Human
ugccaacaggcuugccugaugugaacaaaaauucagucaagcugccugcuuggca

SEQ ID NO: 4231491 - RNA, 61 nt, Human
gcagguccgagagggucggguauagggggaccccaaucuugccuguguauuuccggccugc

SEQ ID NO: 4231492 - RNA, 63 nt, Human
ugcauugcaugugugaaaugcacagaaggucuuuauguucuguuauaaaucacacugcaugua

SEQ ID NO: 4231493 - RNA, 62 nt, Human
ugugaaacccuguuguguacaugcauaggaacacauucuggcaaacacaauauggguacaca

SEQ ID NO: 4231494 - RNA, 72 nt, Human
ugaccacagguugagauggccuuuuuuauacuugccauaaguaauaaacaacucauuuuggcccugaaguca

SEQ ID NO: 4231495 - RNA, 58 nt, Human
uggaauguucccaaaaucccuguagauacgaaagucaguaucugaaggaaugauucca

SEQ ID NO: 4231496 - RNA, 116 nt, Human
gcguugaccguggagggcaguucaggcgguuuguugggguccaggcccaggcccggugucucgggcccggcucccgacgcccggccaggacaguagggcccauagggaucauaagc

SEQ ID NO: 4231497 - RNA, 74 nt, Human
cuggaaagccaagucucacugagucuguccuguucagcaggacaucuaugucugaggccuuggcacccuuccag

SEQ ID NO: 4231498 - RNA, 98 nt, Human
acagauacuugauugauugauuaauugaugaaccucuccauuucucagggagccucuaaacaguuaucaacaagaguauguuuaauuccagucucugu

SEQ ID NO: 4231499 - RNA, 90 nt, Human
gcuuaaaguucucccuccaggcccagggccaagagcgccucacaaagggcugcugccuugaacuuggccuggggaaaugagacccugagc

SEQ ID NO: 4231500 - RNA, 129 nt, Human
gucuauauuuuacccaugaggaaacuaaggaccugggaaucuagagggcucauuagcuuuugaaccaguacuagcaaugaguucaucugaauucuggucccaaacuccuagcaugagagaaauguggac

SEQ ID NO: 4231501 - RNA, 114 nt, Human
gcuuuguaaauaguaauuuuacccaguggugcauguuugagcaaacaaaaaugaugauuuaagcacacuacuuauugcaucaaauauguaccacaguaaguauaguuugcaagc

SEQ ID NO: 4231502 - RNA, 69 nt, Human
ggcagcagaaccaacuguggcuuggaccagggucacaaucuuacaagccugccacguuggcuaguugcc

SEQ ID NO: 4231503 - RNA, 57 nt, Human
uguuucaugcagcccccugucagcugcucuguggaaaagggguucuguuaugaaaua

SEQ ID NO: 4231504 - RNA, 82 nt, Human
uauugcacuuuuccugucucucagauuguuuccauuuuugauugagaaugcaagguauuuggagggguaggggaagugagua

SEQ ID NO: 4231505 - RNA, 63 nt, Human
ggggucugaucccuucuggcuuucuuuuucuucuuucgggugagccgggacaacguggacccc

SEQ ID NO: 4231506 - RNA, 90 nt, Human
guuaugaagagagacauauuggcuugcuuuaauuuacuuauuuaugaaauuaaagcaugaauaauauguauaauuugaauuuuuugugac

SEQ ID NO: 4231507 - RNA, 69 nt, Human
cuagagaaaaagcuuagguacgcgucuccaaaugaugguuucuuuuucuacaccuuagcuuuuucauag

SEQ ID NO: 4231508 - RNA, 88 nt, Human
cuccguggaccggcagcggcaggaagcgcgcaagcggcuccuggcggccaagcgcgccgcuuccuuccgccacagcucggccaccgag

SEQ ID NO: 4231509 - RNA, 76 nt, Human
agggacaugaguuaaguagcccuucauguauuuauaaucucuuuucuacugaaucaaaugacuuagccaugacccu

SEQ ID NO: 4231510 - RNA, 66 nt, Human
ggacugcucaaagcucuauaggagauacaguaaugugcuuugcugccucugaauggagcagugucc

SEQ ID NO: 4231511 - RNA, 70 nt, Human
gugccugagggauuucuggccuuaacugcugguggaauuagcaggaguuaucuauaaaucccugaggcau

SEQ ID NO: 4231512 - RNA, 72 nt, Human
ggccuuugggagagaaaccuaaugccuaagccucauccuuuaugcucuggucucuucuuuccucuucaggcu

SEQ ID NO: 4231513 - RNA, 67 nt, Human
gaauagggagagaacguaaucuaguauuaaauguguuuuaaugguggaugucuguucugaccuauuu

SEQ ID NO: 4231514 - RNA, 57 nt, Human
cucuuuuuuugucuuaagaaccuuguuucugggagguguccaaagguaggaggaggg

SEQ ID NO: 4231515 - RNA, 73 nt, Human
auucccaaggaaaugucagaaaggcaaaauggccagcaucauccauuugcuuuuuuggguuuacugggugaau

SEQ ID NO: 4231516 - RNA, 78 nt, Human
uguuuauaguugauaauuaauagcuuuugagucagauaaccaucuugaauuauaggugauuaauuuuaaccuggaaca

SEQ ID NO: 4231517 - RNA, 58 nt, Human
augcuuuauuggagacagucauuguaucaacaguacacuugaucuccaguacagacau

SEQ ID NO: 4231518 - RNA, 57 nt, Human
agaagaucccugugguuacgacaguagcuguuacaaguugagccucauggauugucu

SEQ ID NO: 4231519 - RNA, 73 nt, Human
ggccucagcauucuguggucuucuauggagaaaggcuaauuuucugaaggcuuugaauggaaugaaaacugcc

SEQ ID NO: 4231520 - RNA, 78 nt, Human
ccaguuaaaguuaagacacuuucuaaauagaagucuuguauauggggcuuuugagaaaguguuuucccgugaugcugg

SEQ ID NO: 4231521 - RNA, 57 nt, Human
aaaaaggagaaagagagggagagaaagacaguugcuuuuccuuucuuucuuuuuuuu

SEQ ID NO: 4231522 - RNA, 127 nt, Human
gcuaaugaaggaaguaggaccucagcaggugcuuuguuuacuccuggaacaucucaaacauaagcauuccagagugagagaggagguggugaacauuugcaucugcucccugcugaccuauccuagu

SEQ ID NO: 4231523 - RNA, 65 nt, Human
gcuaguguuccacgauguguguggucgucugcugguguaguagcacuguuugaggagcacugugc

SEQ ID NO: 4231524 - RNA, 82 nt, Human
ggccugcaguguccgcuugcucagcacgcucugcaccaccgaguucaaggcacaggcugagcagcgaaggcacaugccggcc

SEQ ID NO: 4231525 - RNA, 58 nt, Human
gccuccaggucggucuuucucuuuccgguuugcugaugaggaaacuuauacuuggagc

SEQ ID NO: 4231526 - RNA, 57 nt, Human
aagcagacugggccauaaggaaacagcaggacuggcucaagugcccaagguuuguuu

SEQ ID NO: 4231527 - RNA, 77 nt, Human
uguagggcccagagcagguuaacaguaaacaucacagaaaaaaugaauggauccugugcucuuuccacggccccaca

SEQ ID NO: 4231528 - RNA, 76 nt, Human
gaucaguagauaauguuggcuuauauguauucccagagauugccagucucuggacggacauuuaaggucacugguc

SEQ ID NO: 4231529 - RNA, 68 nt, Human
gaaauauuuguuauaggaucagugucacuuuauuuaaauguaaguguauuugccuauaaaaauguuuc

SEQ ID NO: 4231530 - RNA, 112 nt, Human
aggcaaacauaguuucacuguucuacugcauuucauaaauuacaauaauuuaugauuuacaaugugcuuaugaaggcagugaucuuuagaagagcuggcuguuauauugccu

SEQ ID NO: 4231531 - RNA, 69 nt, Human
guuauuuuggagaaaugggacuuaaucuauaauaguuacuauguauuuggucuacauuuuccaaauaau

SEQ ID NO: 4231532 - RNA, 55 nt, Human
uguuuccuuuugugguuuuucuaaucagauuuggaaaggcccauaaaaggauaua

SEQ ID NO: 4231533 - RNA, 80 nt, Human
uccuuacuguaggugggugaauuugcuguuucuggauauacucacguuuauuccaacuucuauucagucugcagugagga

SEQ ID NO: 4231534 - RNA, 61 nt, Human
uuggcgcuauuauuaccacauuggucauccucuaaaaacaguguugugagguugguguuag

SEQ ID NO: 4231535 - RNA, 60 nt, Human
ggucugcaaugauuugaaaaacacuaagaacacucuucaauguuuccucauuugcagacu

SEQ ID NO: 4231536 - RNA, 92 nt, Human
gccaggucaggguaaaugugguuucagacagacucgaacucucuuugccagucugaguaucucugagccagauucuuugcggagggcuuggu

SEQ ID NO: 4231537 - RNA, 66 nt, Human
guguauuucuagaagaaaugaaaauggcauaauaucugcaauguugguuuuuuguaggauaaacau

SEQ ID NO: 4231538 - RNA, 62 nt, Human
cugguucggcuguaaguauaucuuuucuuucccauuaaaagauaaggaagcauuugagccag

SEQ ID NO: 4231539 - RNA, 77 nt, Human
aaugccuuugcucaugucaccaaagcacaagcagaaacauuacugcuuagugucuuccaggacaugguaauaguauu

SEQ ID NO: 4231540 - RNA, 80 nt, Human
gacucugcucucacuguucacccagcacuagcaguaccagaugguucuguggaguccuggggaauggagagagcacaguc

SEQ ID NO: 4231541 - RNA, 55 nt, Human
uggaugacaaccauuggaagaguggaaaguguguuuguucuagaggucucaucca

SEQ ID NO: 4231542 - RNA, 61 nt, Human
gauuagagagguuggagugguagagggcgugacccucuuaaucauucuucacuuccuuuuu

SEQ ID NO: 4231543 - RNA, 86 nt, Human
gucauaaaucuauuuggggaagaacuugccauuucaucaaagucuguacauguauagcaggguucuuccuccuagugaccugugac

SEQ ID NO: 4231544 - RNA, 65 nt, Human
agggcgccgacccucccugccggacccucucuagaaggccgcgggucugggucuggcucaucccu

SEQ ID NO: 4231545 - RNA, 91 nt, Human
uuguggauauugaaguuugaagccuguuguucaucuauagaugcacuggaugggauuggaagucuucagauuucaguaggguuuuccacaa

SEQ ID NO: 4231546 - RNA, 56 nt, Human
ccauuuugagguguuugugcaccaucugugacacacacagcaaacacuguaaaugg

SEQ ID NO: 4231547 - RNA, 71 nt, Human
guggucuuuccuucauuguccagucccacgaugaugaccgugugcucuggaagcgucggaggaagggcagc

SEQ ID NO: 4231548 - RNA, 129 nt, Human
gcucccucauguucuuggcacagcagaaguguucugcacauggucucuacggaggaaagcuggucccccuggcccaggcagcacuuccuccgugagccccugcaguuuccuggugugugcuuggggagc

SEQ ID NO: 4231549 - RNA, 71 nt, Human
ccucgcucuccauucggcccucgggguuagacagcaagagucgcagccggauggucaugaaggggcgcagg

SEQ ID NO: 4231550 - RNA, 55 nt, Human
gggagauuuguguaggaaaacucuggcuguagccacagcucuauacaaauguccu

SEQ ID NO: 4231551 - RNA, 119 nt, Human
agugugacaugugcaggugggaggggcagagggacaagaccagcagggagggugcuccuggggacaguauccuccccgcuggccuucacuucuuggccuugcccugggcagccacagcu

SEQ ID NO: 4231552 - RNA, 71 nt, Human
ugauauccuuguuuuaaacuguuguggcuugcugaaucaaagccgcugaauuugaaacaagcucaauguca

SEQ ID NO: 4231553 - RNA, 56 nt, Human
gggcccggguaggggaagagagggccuucuuccuccucauuccccgucccggcccc

SEQ ID NO: 4231554 - RNA, 90 nt, Human
guauuuuucuguuuauaccuuuuauuuucaugcuugcuuaguacauagaacagggggcaugaaauaaaggaaaaccaaaccaagcaauac

SEQ ID NO: 4231555 - RNA, 67 nt, Human
acuagaaguuuggguccauuaagaaaagcauuuuaucauuuguucacugauguaccucaagccuagu

SEQ ID NO: 4231556 - RNA, 89 nt, Human
cccuguccugucuucgaguauuuguuuuuaaugcugggugucgaucgagacaacaagcgcucagagcaaagcaaggaugcauuacgggg

SEQ ID NO: 4231557 - RNA, 58 nt, Human
gggguaggaagagaaaauagugcuugucuccagaauuacuuuuuucacuucuagcccc

SEQ ID NO: 4231558 - RNA, 74 nt, Human
ugguugauggccguggccagggucagggaugagcguuccacagacccaugacucucauucacagucuucagcca

SEQ ID NO: 4231559 - RNA, 129 nt, Human
ugcguaaaauuacucugagcagagcagugagaaccaugcagaaucucuuuccugaggaguacaacuucuacccucgcucauggauucugccugacgaguuccagcucuuuguugcucagguagauggca

SEQ ID NO: 4231560 - RNA, 58 nt, Human
ugacaguuugacugcaaccuuugagaguccuuagccagaggcacccaguuaagcugca

SEQ ID NO: 4231561 - RNA, 55 nt, Human
agcaguuagauccugguuagcggagccuucgcugccaggaagaaugaccucugcu

SEQ ID NO: 4231562 - RNA, 57 nt, Human
ugugcuauuuuugcauauguguguguauauccacgcacauguacacauguaugcaca

SEQ ID NO: 4231563 - RNA, 81 nt, Human
ggauaucacuaguuugguuuacucuggggauaucugaaaaaucucuggaagacuuagaguagcaucaguuguaggucaucu

SEQ ID NO: 4231564 - RNA, 66 nt, Human
aggaacaacagccuuuauauccucacauagaaacaaaacauuggguaauagagggaauguuuuccu

SEQ ID NO: 4231565 - RNA, 66 nt, Human
gggcagagggcaugugaaguaaccuaggaccugcuggucacccugggugaugugcugcccucguuc

SEQ ID NO: 4231566 - RNA, 73 nt, Human
uauuggagccuguacuuagagggauuaagcccacacccuggcuuccauuccauaucagguacaggauuugaug

SEQ ID NO: 4231567 - RNA, 56 nt, Human
uuccucauucuggggcauguugaagcacauguuucuccugcccaccagaagaggga

SEQ ID NO: 4231568 - RNA, 70 nt, Human
acuuuugaguuacauaccugaaguucaaaaaguaagccucuaguugccauucaaguucacacucaaaggu

SEQ ID NO: 4231569 - RNA, 129 nt, Human
gauaauugagaguugacugcagucguuacugcuguugugauggguauuugaagcuaaauucgggcaaguaggagaugugugaauauuuaucucagcugcagaaacuuaaugcaguguggcauuaauuac

SEQ ID NO: 4231570 - RNA, 90 nt, Human
ggccuccaggguccuugcugaggcuggggagagguguggugaguguacagccccuuuguagcccagcaguugcaccuggaagugagggcc

SEQ ID NO: 4231571 - RNA, 75 nt, Human
uagugggaagaggaggcagggggcaggucuugccccuugccaggccucugccccuugccaggccucugcccccug

SEQ ID NO: 4231572 - RNA, 85 nt, Human
gaaagccauaucuccaugauauauaugugcacauauauauacauacaugugcauguauguaucauauuaaggacccaugguacuc

SEQ ID NO: 4231573 - RNA, 95 nt, Human
uccaagacuggcugacuucauuugaaaugguugaaucugcuguguaauaaagugguucaaccaugauuaggaacugaaauuuaguagaagaggga

SEQ ID NO: 4231574 - RNA, 93 nt, Human
ucuuucuguccuucccugcucuuguauccaaaagugaucauggguugccugugucccgaucauuaacagugcagggguaggagugcugaaaga

SEQ ID NO: 4231575 - RNA, 57 nt, Human
ugauggagggcagccccacuaaagcaucgugugcaguggguccugcgucugccagca

SEQ ID NO: 4231576 - RNA, 91 nt, Human
gccaggaaggucuugaucuccugaccucgugauccgccugcuuuggccucccaaagugcugggauuacaggcaugagccaccgcgcccggc

SEQ ID NO: 4231577 - RNA, 64 nt, Human
gagaaggguucugggaggacuaggggaaccaggggggaucugcuuaguuuucuugaacagucuc

SEQ ID NO: 4231578 - RNA, 68 nt, Human
gccugggguuugcggggcugcaaguaccuuguucuccaagcagucgugcauccucguacucuucaggu

SEQ ID NO: 4231579 - RNA, 76 nt, Human
acuuagcuuuguacuuguucuguuuccuugaggcuagacacagugccauccaggacuuauuacaguauaacugggu

SEQ ID NO: 4231580 - RNA, 61 nt, Human
acguuuugaguagauagccauauuugauaagcagguuggaugcuucuguugcuuaggaggu

SEQ ID NO: 4231581 - RNA, 56 nt, Human
gcagaugagagugugaucugggugagugacaacuggaccuccgcauccucaucugu

SEQ ID NO: 4231582 - RNA, 66 nt, Human
gcaaguugaaugucuugcugaaugugucuagggguucaucuucaguaaucgacauuccacuagugc

SEQ ID NO: 4231583 - RNA, 80 nt, Human
caaacggugucaccucuucgcggccgcuccacaugcacagaaucuacuaggauuugucacggccggguggcaccgauuug

SEQ ID NO: 4231584 - RNA, 91 nt, Human
uuauaggaaaaguaaggcaaaggauguguagugcaaccaucugauaaacuagugugauuguauuuauccucuguucuguguauuucuguaa

SEQ ID NO: 4231585 - RNA, 76 nt, Human
ggcagggagagcaugcugauaacgcagcccccugaaaauauaaauauugcaugaauguauuagccucaucccagcc

SEQ ID NO: 4231586 - RNA, 80 nt, Human
caagcacugaguucacugacaguauugaggaggaggcugcacaccauagucaccagcaaguaagucagugucagggucug

SEQ ID NO: 4231587 - RNA, 58 nt, Human
ucaugcagauaagaauaaguaaggagauaacuaaaugauuuggucaaugucugcguga

SEQ ID NO: 4231588 - RNA, 57 nt, Human
uuccugaucuuuucccagaguuucugaaucuguuggucuggggacaagguccaggaa

SEQ ID NO: 4231589 - RNA, 113 nt, Human
uugagucccucaggcaucuuccuguagaugucagguuaaugagaaaagauuuguaucauuugacuuuauugaccugaguaucagcagguaguaaauaaaguguagggguucaa

SEQ ID NO: 4231590 - RNA, 60 nt, Human
gagcaggagagacuggcccaaaaguuguuuauacuccuguuggcucccagucucccccuc

SEQ ID NO: 4231591 - RNA, 91 nt, Human
aguucucacuugcauuuugaaggaaaaaaauguguaucuuccauuuuagacugaagcauuuugguccucauguguagcuggcugaugaacu

SEQ ID NO: 4231592 - RNA, 78 nt, Human
gcuagaagugacuaagguuggcaguggaauugggagcuuaguaggcccaaucaacuguguggcuuucuucacuuaggc

SEQ ID NO: 4231593 - RNA, 57 nt, Human
cagagaugaggcuggcgugguugauggagcgcacgggccacugcugcucauucucug

SEQ ID NO: 4231594 - RNA, 66 nt, Human
gcuuuccacaugugugugccuacaugcaaacacacgugugcuugugcacacacauguuaucauagc

SEQ ID NO: 4231595 - RNA, 55 nt, Human
ggaagaagagggagcugugggagugccucaccuacccccagcauccuuuucaucu

SEQ ID NO: 4231596 - RNA, 94 nt, Human
gauuuuagcuauuucaccuugauggagugaugaaugauucacauuagaacagaugauucacagacuucacaaggcagaaauuuuagcgccuguc

SEQ ID NO: 4231597 - RNA, 100 nt, Human
ggcaguucucgggagugcuucugcgugugugauaugccucugcacacaugucuugugcaugugggagugucacaugcugcacgaggcucaccugucugcc

SEQ ID NO: 4231598 - RNA, 81 nt, Human
uaguuuuguucaguuuguugugggugacgaguuuaaaaauguuuuucauagccagaaacugaaaucaaaucaacaugacua

SEQ ID NO: 4231599 - RNA, 74 nt, Human
gcaggcccccaaauuugugcuuucauagucaucguuaaucaaauaggcagaaacacuguauuuagggaaccugu

SEQ ID NO: 4231600 - RNA, 75 nt, Human
ggcaggucagggugucccagaggacagggucacaugggccaaaucaugugaaccuggguccugggcccuuuugcc

SEQ ID NO: 4231601 - RNA, 91 nt, Human
gggguaauaggaucuucuuuuggggaugaaaauggggaaggcgugaggaccuagacuacuucucccuagaucagaaaaagagaauuacccc

SEQ ID NO: 4231602 - RNA, 66 nt, Human
gugccugugcccuuucuccagugaccauuuggugaccagaugguagauauagaaaggggauggcau

SEQ ID NO: 4231603 - RNA, 59 nt, Human
ggugggccaaauuaaacauauauguauuuucauuuaauguaugugcaguuugguuuauc

SEQ ID NO: 4231604 - RNA, 66 nt, Human
gcagacggaggacaucagcagugucucgaggccuucuuuucaugucuuucguucagccacuccugc

SEQ ID NO: 4231605 - RNA, 60 nt, Human
ucagauaauccaauagagaggaauuguccaaauaguuuuaguaccuuucugaucaucuga

SEQ ID NO: 4231606 - RNA, 57 nt, Human
ucuggauccaaagcucuuucauggggacguccucuuccccucuuggcuugguccaga

SEQ ID NO: 4231607 - RNA, 55 nt, Human
aguugguauuuacugcaguuggauauuagucuguuuugcaaagugaauagcaauu

SEQ ID NO: 4231608 - RNA, 81 nt, Human
cagugcgguggcugccggagagccaacaccacggaucggccccacgccuuccaggucauucucuccgaccggcccugccug

SEQ ID NO: 4231609 - RNA, 69 nt, Human
ggugaguuggggcugcguguuuccauguuuucugaagguucacauaaacaugcagccugccaauucucu

SEQ ID NO: 4231610 - RNA, 95 nt, Human
ggcagcaaaucuauugcuaagacuuuaccaggcucaaaucaucugaggcugauagauauuugacuugguaagacuuaaguaaggcucuggcuccc

SEQ ID NO: 4231611 - RNA, 101 nt, Human
ugaggcaggagaaucauuugaacccaggagguagagguugcagugagcugagauugcaucgcugcaccccagccuggguaacaaaaugagacucugucuca

SEQ ID NO: 4231612 - RNA, 65 nt, Human
cauguguauuauucuuguggaauauuaguucaccagaugauagcccacaauucuaguuacauaug

SEQ ID NO: 4231613 - RNA, 72 nt, Human
gucauuuuaucagcacacgucacuagcuucucaagugagacuacucugaagugaucuguguuugaagaaugc

SEQ ID NO: 4231614 - RNA, 84 nt, Human
ucucaugcagucauucuccaaaagggagcacuuucuguuugaaagaaaacaaagugccuccuuuuagaguguuacuguuugaga

SEQ ID NO: 4231615 - RNA, 70 nt, Human
gcucuccuugaugcccucuguuagggcccaccccaaucccagggcagaaggacaugagggagcaaagagc

SEQ ID NO: 4231616 - RNA, 118 nt, Human
uccuuauggcccagucugcuuccccuucauagaagggaguuuuuccuacugcugcuagguuaugucaugaccagggaccacauccccucuguggagagggucccaggcccagagagga

SEQ ID NO: 4231617 - RNA, 69 nt, Human
uccgagguuuuugucauuuucugguacuucguagcagacaagugguagcaggugcuaaaggccuaaaga

SEQ ID NO: 4231618 - RNA, 93 nt, Human
augaaaaacuauguuaagggggaaaauguggauuaugguaaccagaggaaucccuagccuuguuuuccuuagaagacuuguuuaguguuuuau

SEQ ID NO: 4231619 - RNA, 65 nt, Human
uuucaugguaaucggggccaucugugaccuugaaaggacagguuucuccccugguuauuaugaaa

SEQ ID NO: 4231620 - RNA, 98 nt, Human
aaggucggcggagaaugcgcgggucgagugcuguaguucgauuuuugcgugugugcguugcuugcggccuuugugccuuuuuauucuuugcuuaccuu

SEQ ID NO: 4231621 - RNA, 89 nt, Human
ggggaaagggaagguggggaggguccgaggggaaggggaccccagcuucccugugcccgcucaccccacuccaccaguccccggucgcc

SEQ ID NO: 4231622 - RNA, 66 nt, Human
guggcugccuggggaaugugaggauugucccaaagcacaaucacuggcuccucacggcaaggccau

SEQ ID NO: 4231623 - RNA, 87 nt, Human
caugugauugguuuuagccagaguuuaucacagguacaaaauuaggcgguaugacugugcauguucucuagcugauguugaaacuug

SEQ ID NO: 4231624 - RNA, 61 nt, Human
cauggccaaagaauuauauuuuauuauuaaaaugguauagauguauucauuguuuggccug

SEQ ID NO: 4231625 - RNA, 67 nt, Human
ugguuguaaucuuguucaacauuaucuguaagccucaugcuuauaaaaucugaagcaagaauaacua

SEQ ID NO: 4231626 - RNA, 88 nt, Human
ucccaugcugugacccuccaaagggaagcgcuuucuguuuguuuucucuuaaacaaagugccucccuuuagaguguuaccguuuggga

SEQ ID NO: 4231627 - RNA, 89 nt, Human
gggccccagccagacuacggggaggggagggaagcccagguccaugugaggcugucucuuccuccucuugguacuguacccuguggcuu

SEQ ID NO: 4231628 - RNA, 67 nt, Human
uuggugauugggaauggaugggggacagugaggaggacacaccagcccauuaguuguuaaucaucaa

SEQ ID NO: 4231629 - RNA, 64 nt, Human
ucacagauguuauccugaggauaauccguucaaucaucaaagguuuuauucuuauacucuguga

SEQ ID NO: 4231630 - RNA, 76 nt, Human
agaguguagugaaaagagauuauauucuaucaguuucuaauugggugaucucucugaaacucuuuucuuacauuuu

SEQ ID NO: 4231631 - RNA, 60 nt, Human
gugagagugguuuauguccauguagaaaaucuugacuacugaacauaaauaacucuuuac

SEQ ID NO: 4231632 - RNA, 103 nt, Human
uuuuuguuuuuguuuucaauuuucuucuggugauuugccucuuuagcucuucaaaggaaucuaaagacagcaagacaucaucuaaagaugacaaagguaaaga

SEQ ID NO: 4231633 - RNA, 76 nt, Human
gagcuuggagaucucuguaaaccauaaauugaaggguauggucucuuuguaggguauagcaggagaacccaggcuc

SEQ ID NO: 4231634 - RNA, 93 nt, Human
ccuccacauauguaccccuucuccuuuuuuuaaagauggauuuaaaccaagaugccuccaggaaagaggacgaaaugaguauauucacagagg

SEQ ID NO: 4231635 - RNA, 88 nt, Human
gcaauggugaacuuggggauuuuaaagaccucugacugcauuccucaggaaagccaaggggcuuguggaguugcugguuugccucugc

SEQ ID NO: 4231636 - RNA, 57 nt, Human
ucaaagaucuuugcuuuuggggcaugagcgaauucucacaagagcaaagucuuauga

SEQ ID NO: 4231637 - RNA, 68 nt, Human
cauucuccugccagaaaagagggaguucaagucuucuuuccaggacuccuguguuuuggcugagacug

SEQ ID NO: 4231638 - RNA, 71 nt, Human
ggguaggaaaugaauaagguaccugcuguguauauauuuacauuauaaaguuuacguauucauucuuacuc

SEQ ID NO: 4231639 - RNA, 71 nt, Human
gccguacagaccaguaguucucagcgccuuugcuuacccuggguugcucagaagacuuacugguuacuggu

SEQ ID NO: 4231640 - RNA, 64 nt, Human
gucagacugaguuccuggguacuggaccacgucucaaaacccaguacccgcagcugggucuggc

SEQ ID NO: 4231641 - RNA, 68 nt, Human
ugauguuucugaagggguuacuggacugauaaaauauggaaaugucgggggccucaucagaaauguua

SEQ ID NO: 4231642 - RNA, 60 nt, Human
ugccccucuaggcccuguucuaaagcugagugcuucagauguggagcugggucuggggca

SEQ ID NO: 4231643 - RNA, 67 nt, Human
aacugaggcaggaaguaaggaugcuacauuagacagauguuccacgcguaguuccugcuaucauguu

SEQ ID NO: 4231644 - RNA, 71 nt, Human
guccguguccuuguuggaauauccuuaccuuugucaacagagaguagcaguucauccacaagcucgugagc

SEQ ID NO: 4231645 - RNA, 59 nt, Human
cugaagaaagaaaauggccaucagggcaaacacauaagguggcagaccuccuucuucag

SEQ ID NO: 4231646 - RNA, 55 nt, Human
auugaaauuaauuucugcuuucaagcuuggcagaaagcagcugcagaauuucagu

SEQ ID NO: 4231647 - RNA, 83 nt, Human
gaguaaugucaacaacguggauucuuccaggggccugugacaucagugcuguuggaggaguucagugcuaauagauuuggcuc

SEQ ID NO: 4231648 - RNA, 68 nt, Human
cugacgggacacaggugccaacacugugggccacuugguguggcuguugaagcaccucugucuuucag

SEQ ID NO: 4231649 - RNA, 73 nt, Human
acaugcagcagaauaaugacuauaaaaccuuauaauuauacagcacuuggauagucaggaacuguuggugugu

SEQ ID NO: 4231650 - RNA, 55 nt, Human
uuguuccuucuuuuuguaucaggaaggugacuucucaauaccaggauagggacaa

SEQ ID NO: 4231651 - RNA, 68 nt, Human
gguagcccgugaggaggggcugugcggccucuacaagggcagcucggcccuggucuuacgggacggcc

SEQ ID NO: 4231652 - RNA, 80 nt, Human
cuggaggaacauauuuagcaccuaauauuaauauuuaguaguccauugauaaauuugccagcauauguucuagccucugg

SEQ ID NO: 4231653 - RNA, 64 nt, Human
aggugauaugggcuucucugagccuggaucccacauuugcagggcucugggaggcuugucaccu

SEQ ID NO: 4231654 - RNA, 62 nt, Human
uugugagucuugcaggucgcucacccuucagaccuuuaggcugaggccugccagucucagaa

SEQ ID NO: 4231655 - RNA, 55 nt, Human
ugaaccugagggcaaagggacaguacaaacucuggagcccaccugcccagguuca

SEQ ID NO: 4231656 - RNA, 64 nt, Human
agggauuuuaaauuucugaaucuugaggccuguuucucacguccaagagagauuuuaaauuucu

SEQ ID NO: 4231657 - RNA, 65 nt, Human
cucuccagucauauucucagucaaggcuucccugacagucccacuacuagaaagucacugggggg

SEQ ID NO: 4231658 - RNA, 95 nt, Human
ugauggaaaagcucguguuaguauuggcaaauuuguuuggaagaaaauauauuccagcaaaauuccaaaaugcuaauuuaaguuuuucucaguca

SEQ ID NO: 4231659 - RNA, 75 nt, Human
guguuucugggaugagcuauauagaaaguuuaguugacugcuggaccuuggauauucuuacucgguucaaaauac

SEQ ID NO: 4231660 - RNA, 70 nt, Human
cuccaugagccaggagggcuaccaccagguccccagccuucugccugcccgccagccuggcuucauggag

SEQ ID NO: 4231661 - RNA, 78 nt, Human
cuauguuccaugacuaugcaugaaacaagcugucacuguauuauaaaggcucagcaauucauucauggcauaauauag

SEQ ID NO: 4231662 - RNA, 60 nt, Human
guaugugugcauacauguacgaguauacaugugcacguauauaaauguauauacacauau

SEQ ID NO: 4231663 - RNA, 60 nt, Human
agcacuagcugcuugucucaaguggcauuugaggcacucaugagaaacaagggcuggucu

SEQ ID NO: 4231664 - RNA, 57 nt, Human
guuugggauucuagacaaaaauucuaucacuuuguuuuugcuagaaaucaccaauac

SEQ ID NO: 4231665 - RNA, 78 nt, Human
gacauaccuagggcucccaauaauaacaagcaggucaaacuuacauuuacuggcuuauuguuguggagcugguguguc

SEQ ID NO: 4231666 - RNA, 63 nt, Human
ccgauuauccuaaaggguagugugggaguccagcacuuccaugccccucuuuggguacuacgg

SEQ ID NO: 4231667 - RNA, 95 nt, Human
gccacugggccaggccaagagcuuagaggaccuucgugcccccaaagaccugagggagcagccagggaccuuugacuaucagguauggcaugggc

SEQ ID NO: 4231668 - RNA, 129 nt, Human
uuaaacuuucucuuaauucucuuaaaaugaaauagguauauccaauaggugaugaaauacauuuuuuacaaacauagaugcuuuuuauuuguauguugaauguacagauucauuucaagaaaagcauga

SEQ ID NO: 4231669 - RNA, 63 nt, Human
gagcaaagccucuuugaaaaaaaccacguagcugauuggguuuuacaagagugcauuugucuc

SEQ ID NO: 4231670 - RNA, 65 nt, Human
auagaaauagacaaugcaaagaguucccugaggacaggaaccacaucuguauuguucacuucugu

SEQ ID NO: 4231671 - RNA, 59 nt, Human
ccucuucauguuggugcagaagccagugaaugcacuguuuuugcugcagcugaagaagg

SEQ ID NO: 4231672 - RNA, 76 nt, Human
gggacagacgacgacaggcgcccgaggagggcgggccccacaggccaccuccacgaggggucuucucuuuuguucc

SEQ ID NO: 4231673 - RNA, 60 nt, Human
aaaucaaaagugguuauuuuaucauuaaagauagaacaaaaacuagccagcuugugauuu

SEQ ID NO: 4231674 - RNA, 99 nt, Human
ccagaauggaauagagacuucuccuugagaaugaacaaaggauuuucaggagugccaguaccuuuuuauucuuaaggccgaaacugcaccaucuucugg

SEQ ID NO: 4231675 - RNA, 67 nt, Human
gugguucuaauauuaugauuucuaagccacucaauaagagguagcuuauauaaucauuagaaaccau

SEQ ID NO: 4231676 - RNA, 57 nt, Human
gggcggugccugucuccgaagcgaggagcggauuggcuucacggaggccgcgccccc

SEQ ID NO: 4231677 - RNA, 65 nt, Human
caggggaggcugcgggcugccgugggcggcugagucacugaggcacggaucucgcaccucuccug

SEQ ID NO: 4231678 - RNA, 86 nt, Human
ugagcaaugacaccaagaaguugacagccaggugaauguuauacacaagcucaucggcugucaucuucacgugaccaacagcuaca

SEQ ID NO: 4231679 - RNA, 90 nt, Human
gugaugccagugcuacuuccuucugcccccucugagcaaagaugcccucgagaccagcuagaaggaaguuugcauaccuguggcuguuac

SEQ ID NO: 4231680 - RNA, 71 nt, Human
ccucuucuuugugguugcccaagguuguuuugcguaacugagacuccuugauaugcuucagagaauuuagg

SEQ ID NO: 4231681 - RNA, 61 nt, Human
caugaucauguucuccaaaagcguauuccaaaagaugacacuuuugcgagagcaugcagug

SEQ ID NO: 4231682 - RNA, 58 nt, Human
gacccugaggauucccugcugauccaugucuuccgauggggaggguguccucaguguc

SEQ ID NO: 4231683 - RNA, 61 nt, Human
gcccugucaugucagugucuguguguggccucccagcccaaccagaaauugacagagaggc

SEQ ID NO: 4231684 - RNA, 65 nt, Human
ccugauggaggagagaaauguuuucugugggaccuacaauguucgcauucucucugacacguagg

SEQ ID NO: 4231685 - RNA, 58 nt, Human
agcaccuuguuguagguacaaaagagaacauuucuauuauauuuacacgagaguugcu

SEQ ID NO: 4231686 - RNA, 75 nt, Human
gacuuuauugcuccuuuauuuucucucgugugggggggucuguucagcacggucagggugggggagugguggguc

SEQ ID NO: 4231687 - RNA, 81 nt, Human
ucccuaccacaucuucuauggagguucggaagaccuggccuuguguuccuuuucuuugaggaaggugugugucuuugggga

SEQ ID NO: 4231688 - RNA, 62 nt, Human
ucccuuuuuccugaucugugaaugcuggugcuagacacugcugaauagacaggaaaaaugga

SEQ ID NO: 4231689 - RNA, 56 nt, Human
auagcuuucuauauaugaguugcuggggaccuucacauucucuuuuagaaagcugu

SEQ ID NO: 4231690 - RNA, 56 nt, Human
cccaggcuggagugcaguggcauggucucgguucacugcaaccuccaccucccggg

SEQ ID NO: 4231691 - RNA, 61 nt, Human
aggcugcucucgccggcgguguuggaacguggacacgugcgcuuugguaauagggcagccu

SEQ ID NO: 4231692 - RNA, 62 nt, Human
aguuaccgagaacaugacuggaauucaggaaaugcuaaagguccugucuuaucucuguaacu

SEQ ID NO: 4231693 - RNA, 64 nt, Human
gcgggaggggaacaggcauucuuaagagaucgguuuaccuuaggaaauccuguacucccccugc

SEQ ID NO: 4231694 - RNA, 66 nt, Human
cucuucccugucuuuucugaucauacuagcugcagcacaguagaggguccaggagggcaagaauag

SEQ ID NO: 4231695 - RNA, 69 nt, Human
aauaggcugaccuccuuucucgacuaauugcauuacaucgccagcuggcuccagaaggagucgucuguu

SEQ ID NO: 4231696 - RNA, 64 nt, Human
aggccaguuuuuggagggaaacaucaauacuguugccauucaguucucuaugccaugcuggccu

SEQ ID NO: 4231697 - RNA, 62 nt, Human
cagcaguuuucucaguuuuuuucaaaaggucaucagcuugaaaaaaucugaggaggaccaug

SEQ ID NO: 4231698 - RNA, 83 nt, Human
cgggguccagggccaggccucaggggcgccgccucuuccacguggcuuugcagccuccggccuggcccccucugcgggcuccg

SEQ ID NO: 4231699 - RNA, 65 nt, Human
ucccggcgcgcaggccgcggcuccucggaguugaggugcuggggcuuggccugcuugcgccgcga

SEQ ID NO: 4231700 - RNA, 61 nt, Human
uauauaauacacaaauauguacuuguagaaguacacuauacaguauuugugugugugugug

SEQ ID NO: 4231701 - RNA, 79 nt, Human
guggccaagcuuguuucuccugggggugcucuuccgaggauaucugggcugccuccggagucgcagugucuugggccgc

SEQ ID NO: 4231702 - RNA, 55 nt, Human
cauugguacaaaauguacuuugaggcucuaaugcacugguacguuuugaucaaug

SEQ ID NO: 4231703 - RNA, 59 nt, Human
aauuuugagacaaaguuguuggauguucaucuguaugaacacugaaaugucuuaagauu

SEQ ID NO: 4231704 - RNA, 123 nt, Human
gggaaggcuuucaggucuggcuugcucaagggacucagcuccuaccccggccccagcuguugcugagccugagggcagguggugcugccaggugccuuguguuggccucccugcaugcguccu

SEQ ID NO: 4231705 - RNA, 93 nt, Human
gccacagcaccucggcaggcguggcuuuucaccugcuccucugggacagaucugcagggggcagcguagaaaaugagucccugagagcauggc

SEQ ID NO: 4231706 - RNA, 74 nt, Human
ugccuccauuguguguuguuuugccagaauacugaaggcaguguuuguaugauggcacauccaaauaaaaagca

SEQ ID NO: 4231707 - RNA, 78 nt, Human
ugggguucauaugagugccaaguuaccuggggaaaccuaacaacuuacaaauucuccagguuuggcuuuauaacuuca

SEQ ID NO: 4231708 - RNA, 102 nt, Human
cccgugucucccugcagaaagcgggcagcggccugcgccaguggaagcggguguacgccgcgcugcuggcgcgcucgcucucgcugagcaaggagcagcggg

SEQ ID NO: 4231709 - RNA, 63 nt, Human
caugauucccacauugcgaucaucucauagguuuuggcacaaaaucggaaugugggaagcaug

SEQ ID NO: 4231710 - RNA, 100 nt, Human
ggccacgccgauggccacccggguggagccugggcugugggcuucgccugcguccccgcggccuguccacgcguccggcacccggagcuagggcguggcc

SEQ ID NO: 4231711 - RNA, 57 nt, Human
uucaggggcagaggaugauggaagacguaggaucugacguugguucugcccuuugga

SEQ ID NO: 4231712 - RNA, 80 nt, Human
uccucuacgucuucguuggcagagauuuccaagaaaaguuuuuccagucuuugacuucugcccuggcgagggcguuugga

SEQ ID NO: 4231713 - RNA, 56 nt, Human
gcuacaaauaaaaugggugacuaauccccaguucuuggacccauuauauuuguagc

SEQ ID NO: 4231714 - RNA, 59 nt, Human
agagauacugcaggccauaaauuauggaguuuaucguaaggacuggcuuccaguucucu

SEQ ID NO: 4231715 - RNA, 129 nt, Human
uaaaaacaaagcacgaaaaagugcuuugucccuugacugaggaagguggggugggaauuggugacaaaaauaacccagcccaucauuccugcaaaggcuuuaaagcccuucuuuccuguuuccuuucua

SEQ ID NO: 4231716 - RNA, 72 nt, Human
uucugguucccaugauguugccuacacugcuagacuacaguuuaguaucgcuuuguaucaugaggccaagaa

SEQ ID NO: 4231717 - RNA, 56 nt, Human
gagagccaugcuugugcauauaugggugucuacaugugaggcaaaggcaggcacuc

SEQ ID NO: 4231718 - RNA, 84 nt, Human
acauaaauuggugugcaugcgugcgugcgugcauguguguaugugugugugcgugcauguguguaugcgugugugcauaugugu

SEQ ID NO: 4231719 - RNA, 63 nt, Human
ggcugucccccaaagaugcuccugagugcaagagcaggcaaggcagaguccuggggcacagcc

SEQ ID NO: 4231720 - RNA, 89 nt, Human
uguucuauggccuguuuccucugaaagaaucugacuguccuggaaucuuggcacaugaaggguccuucagaggacggcagccaggaaca

SEQ ID NO: 4231721 - RNA, 103 nt, Human
ggggcaggggacgcuccagcuggucugggguuggccagggcccuaguggcccgcccuggggccccagcucggccccucgccucgcugagcucuagugugcccc

SEQ ID NO: 4231722 - RNA, 65 nt, Human
cugaggcugguucccuugaucuuuccugaccccaguuuugggaggagacaguggagccgcuacag

SEQ ID NO: 4231723 - RNA, 86 nt, Human
ugcacacacgcucgagucuauuuauagacagauccuaaugauauguauugcauucugaacguaaaugugaaaugugugugugugca

SEQ ID NO: 4231724 - RNA, 56 nt, Human
uucacugugauugggguggauugagaugguuuugagcucuguugcggucacaggag

SEQ ID NO: 4231725 - RNA, 59 nt, Human
guuauaaaagcacaauagaguuauggaaauguuuccaugaugaacugugcuguuaggau

SEQ ID NO: 4231726 - RNA, 69 nt, Human
agcuugaaccuaaaacaauaauuuaaguggacauacuaaugugguuguaaguuuuagguguuucaagcu

SEQ ID NO: 4231727 - RNA, 85 nt, Human
uaagucuucuguagugaaauuaaaccaaagcaacuccaggaaacuggcugucacgcuaagucaaaaaauucaaaaugaagauuua

SEQ ID NO: 4231728 - RNA, 83 nt, Human
ucuggguacacaauggcuagcauguaaaauaucacaguaaauuuauuacuagauaauuauaggcuaagccacuugaccucaga

SEQ ID NO: 4231729 - RNA, 89 nt, Human
guggaggagccuucuuggggcagccuaagcugagccucuaccccuaugagcugcuccuggccgggcugcuccuggaugagguacuccac

SEQ ID NO: 4231730 - RNA, 75 nt, Human
gggucugcguucgcggccaggcggggaggccagagcgggccgccgagggcgcuccccgccugcgucgcgcgcccc

SEQ ID NO: 4231731 - RNA, 69 nt, Human
gaaugaagccuguugacagcugucagucacuuuaugaaguaggaggaggcagcaugcaacaggccauuu

SEQ ID NO: 4231732 - RNA, 63 nt, Human
gaauuagguaauagaacuaguaauuaagaugguucaccucuaacacaguucuguggccuguuc

SEQ ID NO: 4231733 - RNA, 58 nt, Human
gccccccagugcagacgcggaacuggcgcccgcucggagcggcgccgcgcuggggagc

SEQ ID NO: 4231734 - RNA, 63 nt, Human
gaguuggggcugcguguuuccauguuuucugaagguucacauaaacaugcagccugccaauuc

SEQ ID NO: 4231735 - RNA, 71 nt, Human
gcugccugccuggcccaggaaccaguaggccucaaagaucuuggucaggucucgagccaggcagcugcagu

SEQ ID NO: 4231736 - RNA, 59 nt, Human
gggaggcugagguguggggaacuauagcucuugggcuguuccugaugccucguccuguc

SEQ ID NO: 4231737 - RNA, 73 nt, Human
uggcagggguuugggaaggguuaggggaggauggaggaugaagucuccuacccccuucuccagcuccaggcca

SEQ ID NO: 4231738 - RNA, 64 nt, Human
uguacuaaauguuuuaucuuccuggcauuggaaaaaaauggggaagaaauagaacauuuugaua

SEQ ID NO: 4231739 - RNA, 62 nt, Human
ggccuggccauuuacucuguaagaguggucaacuucacuuccuuccagcaaauggcaucacc

SEQ ID NO: 4231740 - RNA, 63 nt, Human
gcuacauccuucaaaaggaauagcagguggugucccccagccuggcugaccugaagguguagu

SEQ ID NO: 4231741 - RNA, 60 nt, Human
gugacucagcaacccacacacggucucagcagcugagaccguguguggguugcggugcac

SEQ ID NO: 4231742 - RNA, 84 nt, Human
ggaauuuuggguuugcuuguucagguucuggaagguuuuuauacuacugcuaaggaugagugaagagguaaauuuaaauaaucc

SEQ ID NO: 4231743 - RNA, 117 nt, Human
ccagaaggcuaacuacugcagggaagguaaugcaucaggcagggacacauaugcucuauuaacuaacacugcaaucuaagcuugaucacuugcuuuuaacacaucuuggcucacugg

SEQ ID NO: 4231744 - RNA, 73 nt, Human
gagccgcagcugcguaggguccagcugcuucuuguugcaagcccgaaaauuguuguacugcagcuggagguuc

SEQ ID NO: 4231745 - RNA, 66 nt, Human
cguggugguggagcgggcccaggccgagccguucugcuugcccuggugcagguuccacaggcugcg

SEQ ID NO: 4231746 - RNA, 70 nt, Human
ggacacuguugagcaauguacaguguauggugugcuuaccuguccacucuagagcauugcuuacagguuu

SEQ ID NO: 4231747 - RNA, 87 nt, Human
auacauguuugaggugacucuggaauggauuaugaggucauaucucaaaaugucagaaaacguuauagagcacucgaacuuuuguau

SEQ ID NO: 4231748 - RNA, 66 nt, Human
uguguguguguuuguauccuccauauaacucauaaaugaguuuuauguuuuauagacacaaacaca

SEQ ID NO: 4231749 - RNA, 56 nt, Human
gggaaaaaggaaccuuauuacuuuuaaaauacuugauagugggauggcuuuuuccc

SEQ ID NO: 4231750 - RNA, 64 nt, Human
cugggaccugugugccugggccagucccaugccugccccaagcccugaggcccacaagucccag

SEQ ID NO: 4231751 - RNA, 56 nt, Human
gacauugacuuucccuucuccucauuucacagaugaggagucaaggagucggaguc

SEQ ID NO: 4231752 - RNA, 66 nt, Human
cgcagaacguggugcagcgugugguggcucugccccuggucagggccacgugcaccgcggucugcg

SEQ ID NO: 4231753 - RNA, 75 nt, Human
ggacuuacucauuuggauuuuggaguuuuaccugacuuggucaagccucaugccagauccaggugaguagcugcc

SEQ ID NO: 4231754 - RNA, 80 nt, Human
uccuggaaaauugacuaguauuaagugugaguaaaagguguccacuuuuuuuuaaguuuugauuuuaguuuugucuugga

SEQ ID NO: 4231755 - RNA, 72 nt, Human
agugggagugaggggagaaugagguggagggaagcugauacucucuauuguuauccuuuccauuuaucuacu

SEQ ID NO: 4231756 - RNA, 57 nt, Human
ugccucuccaagcuuccuaagggaugcugcccuguguggggaugcauugcagaggca

SEQ ID NO: 4231757 - RNA, 81 nt, Human
ggguugggguccugggcaugggaacuucaaggccacuuaccuggagguggccuugagcucaugucccagcucugcacaccu

SEQ ID NO: 4231758 - RNA, 69 nt, Human
gaguucaugagccauguucaugagguucaugaggcaugucaugagccauguucaugaguucaugaauuc

SEQ ID NO: 4231759 - RNA, 81 nt, Human
uccuauauuuagauuuugacaucccucagugccuggccuggcuggaucuggugcagguugcuggucugaucucguauagga

SEQ ID NO: 4231760 - RNA, 63 nt, Human
gugucauuggcuucccaaguccuugguccccagaagaugaaagauuuuagggcagccaaacac

SEQ ID NO: 4231761 - RNA, 99 nt, Human
uagugacaagggcaucccaaggcacuugcccagagcugcagaguugugugugccauaccugcggcucaaagggaaggccuucuauccccugaguuucua

SEQ ID NO: 4231762 - RNA, 62 nt, Human
cguggggcgggucccccgccuggggccucugcgcagcuccgagcagggcgcccugccccacg

SEQ ID NO: 4231763 - RNA, 56 nt, Human
uggagccugauggauaggaacggguagucuguccucuuccccauaaaaauguucca

SEQ ID NO: 4231764 - RNA, 63 nt, Human
cuugaggacuucaggccuggccaggggggcaccucuggcucaggagcuguguucagagucaag

SEQ ID NO: 4231765 - RNA, 88 nt, Human
agggcgcgcgcuuugcggugcaaggguagcggcaggcgggcguaccaggcgggcggcuucaucuugcccuuccacagcgugacgcccu

SEQ ID NO: 4231766 - RNA, 75 nt, Human
gaggaaagcugguuuaaaguaucugagugaaauaagaggaaaaccccaaauacuucaccuaacccaguuucccuu

SEQ ID NO: 4231767 - RNA, 56 nt, Human
gcaguugugguuucguuuccuuuuggaaucuucaaaggcagcgauuuucauauugc

SEQ ID NO: 4231768 - RNA, 124 nt, Human
ugggcuggacuuuuagccucuauucugcugaccagccccagcacugcaaacaucuuuuaaacucucuuuggaaacaaggggaggcagaugggagcuggaaguugcaggacaagaauccagccca

SEQ ID NO: 4231769 - RNA, 74 nt, Human
uacacuguguuacaauaauggcaaguaacauguuaagaagguuuacuuaugcuagccacuauuguaaguaugua

SEQ ID NO: 4231770 - RNA, 59 nt, Human
gagccuuucuugguuugucaggcagauacaccucuggccugauuuugcuaagagaauuc

SEQ ID NO: 4231771 - RNA, 70 nt, Human
ugaguuaggaaugcagaugcauaauaaauugguugggauuuauuaauacaugcaccugcauuucugcuua

SEQ ID NO: 4231772 - RNA, 73 nt, Human
ucucaaauggguuaaaaguugaaugaauugacacccugauguuaugauguuggaauuuuaacuuaaacuggga

SEQ ID NO: 4231773 - RNA, 82 nt, Human
aaaaccuugugucagagaagcaauuggaaaguacagggcguuuuccccucuuuugaaccaguucuucaagaaacuugguuuu

SEQ ID NO: 4231774 - RNA, 68 nt, Human
uuccauuacuaaugccugcaauugcugauaauagacgugccccaggaaucgcugcaagggaaauggag

SEQ ID NO: 4231775 - RNA, 56 nt, Human
uaguuuuaagcugacauuguuccauaugugauaggaacaacuuaguugagagacua

SEQ ID NO: 4231776 - RNA, 76 nt, Human
gcuggguggcuucuguuugcaagaggucuauuuuuaauuaacuuuugugcuuuuugccuugaagugaccucauagc

SEQ ID NO: 4231777 - RNA, 55 nt, Human
gaggggaaggagcgaaggcgggcggcggccucccaccucagagcuccuucuucuc

SEQ ID NO: 4231778 - RNA, 65 nt, Human
cuuucucaugcugcaaauggcuguuucucugguucacucaaagcagcauaugacagcauccaaag

SEQ ID NO: 4231779 - RNA, 129 nt, Human
uacauugauagaauuaaacaggcuuuggaaaugcauuuguuauuaucuggcuacuuuuguuaguuccucagaugcuaaucaaacuuucugcagguauuuucaauuacuauuuaauuauuuuacagugua

SEQ ID NO: 4231780 - RNA, 101 nt, Human
auuuuuuggucacuuuagaaauauuuuugcagaauuuuucguuguuaauuuuauaaccuccacaaaaauauuguagaagugcugagguuaguccaggaagu

SEQ ID NO: 4231781 - RNA, 79 nt, Human
ccuuuucaagcucaguaucucuaaaauuacucuuucaaaguuacacuuuaagggguacuagaggauugagauuaagagg

SEQ ID NO: 4231782 - RNA, 80 nt, Human
ugauuggcccaugguucugcaggccgaccggaagcauggcagcaucugcuucuagggaggccgcaggaagcucccaauca

SEQ ID NO: 4231783 - RNA, 77 nt, Human
cuagcuuuuaccuuaauuucgacacacuucuguugaaucucaccagaccaugugggaggauuuaggugaaucccuag

SEQ ID NO: 4231784 - RNA, 75 nt, Human
guuagaagaaacucuaagacuaaaauugaagaucuagaauugaauauuucaauggaauucuuagguuucaauaac

SEQ ID NO: 4231785 - RNA, 58 nt, Human
ugagauggagucucacucuguugcccaggcuagagggcagcagagcagucuccgcuca

SEQ ID NO: 4231786 - RNA, 64 nt, Human
caaauuuuuauuuaccaucugcuauucccacgguggcaaaugcagagguagaaguagauguuug

SEQ ID NO: 4231787 - RNA, 130 nt, Human
auaaaaaucaaauauucugggcaaaugaacuauacuaagguaccacuucuguguggauacagucccugugugaacacaaacugugcagucacauaaggaggcccugguccugccccagagcacaauuugu

SEQ ID NO: 4231788 - RNA, 55 nt, Human
ucagguuuaagugacuggaaucauuucuacaugauuccuggaggcagaaacguga

SEQ ID NO: 4231789 - RNA, 89 nt, Human
ucacuuagcuucucuuccuucucauccucacucucaucagugcuggagcuggagcuggaugaggaugaggaagaagaagaagaugguga

SEQ ID NO: 4231790 - RNA, 56 nt, Human
ugagagggagacagcucuagcaaaggggaaaauucuggagcaguugucucucucca

SEQ ID NO: 4231791 - RNA, 58 nt, Human
cuguguuguuugaguagcuugaaacagcuuaauuuuaaauuuuauucugauaacacag

SEQ ID NO: 4231792 - RNA, 59 nt, Human
cagcauugagcacagaaggaaaacauuagcccuguaguugcuuuuguugucagcugcug

SEQ ID NO: 4231793 - RNA, 67 nt, Human
caguggagaagggaccgggaaggaaguaauuggaaaucucucuuccucccagguucuaucuccucug

SEQ ID NO: 4231794 - RNA, 110 nt, Human
cucuguuuuaaaugaaacuccugaaaacuucuguggaucuaggguuuagggaccauuuccuugagaucugucaccauccuggagccuuugaguccaagagugaagcagag

SEQ ID NO: 4231795 - RNA, 81 nt, Human
aguacugccucuuuuuaaaauauuagguuugaguccaucuaaaggcaaagucauuauguguuuugagaggaugguuuuauu

SEQ ID NO: 4231796 - RNA, 75 nt, Human
auuugcagucuacuuaagaaucucaggaaugcaucgaucagccuuacauccuugaggucuguguaggcagcaagu

SEQ ID NO: 4231797 - RNA, 63 nt, Human
aggagggaagaagaaaagaggugggauccagaaauggcauccgaccuuuacuucuugucucuu

SEQ ID NO: 4231798 - RNA, 73 nt, Human
gugaagaccaguccacgucaagaagagguuaagacuaugaucucacuucugucauguggcacaagcuuuucau

SEQ ID NO: 4231799 - RNA, 80 nt, Human
gccagugggugaaugcaggaacagcaccaggagcuagagcccaacucuggccugugggcugucuccggguccucagaggc

SEQ ID NO: 4231800 - RNA, 85 nt, Human
gauggcaucuucgguuggacugcuuccuacccagcuucugaauucuuacuuggguaccacccugcggacaauggaagaugucauu

SEQ ID NO: 4231801 - RNA, 57 nt, Human
gggaaagaggacaucuuacuucuguuuaugaaaaacgggaggagcuucccuuugccc

SEQ ID NO: 4231802 - RNA, 73 nt, Human
cgguguccuggagugucagaaacaguguccuggcugggugcaggaccuguaaucccagcacuuugggaggcug

SEQ ID NO: 4231803 - RNA, 55 nt, Human
ggggcaucguugauugcauggucaagauuuaccgccaugaguccgugaguggccc

SEQ ID NO: 4231804 - RNA, 99 nt, Human
ugaaagcaaacuugucauggucuucuuacauuaaguugaaacuagcuuauaauaacugguuuuuacuuccaaugcuaugaagucucugcagggcuuuua

SEQ ID NO: 4231805 - RNA, 121 nt, Human
gccaacauguaucaaauaauuaugagaugaaaaguauaagugucuccugauuuauucuaauagaacuugggauuuaucacauggauuuuaucuuuugccuuuaaauaaaauacuaguaggu

SEQ ID NO: 4231806 - RNA, 89 nt, Human
guucauguuuucagcuugugcuaaugaauggaggaucugagcauacaugcuggacagguacuucacauuauucuagguagauuacaaac

SEQ ID NO: 4231807 - RNA, 110 nt, Human
gcugcaggagucgggcccaggacuggugaagccuucggagacccugucccucaccugcacugucucugguggcuccaucaguaguuacuacuggagcuggauccggcagc

SEQ ID NO: 4231808 - RNA, 57 nt, Human
gcuguugugaggaucagcauaugaaauugacaucaugguuagucaugguacugcagc

SEQ ID NO: 4231809 - RNA, 78 nt, Human
ccuuucugacuucaagaugaaucuuugggacgauguuucuggugcuugguccacagugauucacuuuugaaggagagg

SEQ ID NO: 4231810 - RNA, 71 nt, Human
ccuucucugcuucaggguacuuguggccaaaguuagauguuuaacuaaccacuuuacaccuggugagaagg

SEQ ID NO: 4231811 - RNA, 70 nt, Human
uuccuuucuuuuugguuuccccccagaacacagagcuggacuuugguugggguaacaaaaaggaaaugaa

SEQ ID NO: 4231812 - RNA, 71 nt, Human
auucuuuagaguccuucaaauauuuauagucaguuuuucaguuacuaaauaugagguggcuacuaaagagu

SEQ ID NO: 4231813 - RNA, 62 nt, Human
uagucuaguggaaccaucacugcacuaggaguccagagauguguguugugggccacuaacua

SEQ ID NO: 4231814 - RNA, 63 nt, Human
gcucacuuguaaccccuuccucagguccaagagaaugggaggagggucauguugaaguguagc

SEQ ID NO: 4231815 - RNA, 85 nt, Human
aguaaaugucuucuauuuggcaugacagacaugguuucucgauuugagccacacucuguuuacaugucagcagcaagcauucucu

SEQ ID NO: 4231816 - RNA, 56 nt, Human
aggaaaggcucugugguuccuaaaggcucagacucuuaacuacagcgcacuguccu

SEQ ID NO: 4231817 - RNA, 63 nt, Human
caugcuucccacauuccgauuuugugccaaaaccuaugagaugaucgcaaugugggaaucaug

SEQ ID NO: 4231818 - RNA, 57 nt, Human
aaugcugugggauagggcuccuguugccuuucagaggaagucugacacuacagcguu

SEQ ID NO: 4231819 - RNA, 58 nt, Human
ugcaucugagcacuacgguggagccguggacaagcugcuucacagaggacucagguca

SEQ ID NO: 4231820 - RNA, 63 nt, Human
augccagcuugcccuuguaccagccagcuguugggcugugccagucagggggcaaguggggau

SEQ ID NO: 4231821 - RNA, 90 nt, Human
cugaccuuccugaaaugcuagaucuggcaggcacaaggucaagauuggcuucugugagugcagaugcugagguugccaggaggaaaucag

SEQ ID NO: 4231822 - RNA, 76 nt, Human
ucgcuugaacccaggagauggagauugcaguaggccaagaugaugccacugcacuccagccugggcuacagagcga

SEQ ID NO: 4231823 - RNA, 103 nt, Human
uccucuuucccugggaugcucugagguccucagagggaaagguucgggaucccccgugccucucccugcagggcccagggcagcugaucccacucaucgagga

SEQ ID NO: 4231824 - RNA, 59 nt, Human
uucugacuuuucuccucugaaguuugcaccaguggaaacuuuugaaggaggaaaaagaa

SEQ ID NO: 4231825 - RNA, 57 nt, Human
gcgcgccugccucccgcggugcgccagaccuggacgccgggagugcagcgggcgcgc

SEQ ID NO: 4231826 - RNA, 66 nt, Human
gcuaucuguagucucaugguuccugcggugacuucacccacuccagugccauggcugcuagauggc

SEQ ID NO: 4231827 - RNA, 56 nt, Human
ggcagagucucccuguguugcccugguuucaaacuugggccaagugauucucugcc

SEQ ID NO: 4231828 - RNA, 61 nt, Human
uccucuucaaaauagcucugaaaaauaugauuggaauuucuggagucuauuuugaaaagga

SEQ ID NO: 4231829 - RNA, 68 nt, Human
gaaaugggggcaugcguuacauggcugugcuccacucaaaaaaguuacaugaaugcuccccacguuuc

SEQ ID NO: 4231830 - RNA, 72 nt, Human
uuaaaauauggcuaguguguuuguaacacuucuauccacauaguguuacaucucugcccagccuaguuuuaa

SEQ ID NO: 4231831 - RNA, 89 nt, Human
auggaacuacaugcuuguauguguauauauacauugcuugugcauaugcauaucuguauguauauauacauguauuguaccauguccau

SEQ ID NO: 4231832 - RNA, 85 nt, Human
ggucucagcuugagccugugcuguguuugcuccaugauucagccuuggcacgucuggaggaugacagagaugggcuguugggacu

SEQ ID NO: 4231833 - RNA, 60 nt, Human
gacuuuaaugaugucuaugccuguuuccccuggggaagcugcauguauauucuuaacauc

SEQ ID NO: 4231834 - RNA, 58 nt, Human
ccagguuuagagauaaaugcucucccacucagcugccugagugaggcugucucccugg

SEQ ID NO: 4231835 - RNA, 70 nt, Human
gcgggggaggcucggcgccgcggucuauaaauaggcgcugcuccgccaccgccgcugccgccgcccccgc

SEQ ID NO: 4231836 - RNA, 60 nt, Human
ggcagagcugugcgcccacccagcuauugaaaaggacuuucugugggcacacacucuguu

SEQ ID NO: 4231837 - RNA, 82 nt, Human
guucuuagcacuucugcccauucuucaauagaccagaaagaagaaaggaagcagcaggaaaugggcggaaguguuaaguugc

SEQ ID NO: 4231838 - RNA, 127 nt, Human
ccuccucagaauucaggaccaacaaaauccucuuuagcaaggagaaauaauccugcugauccacgaaaugccacaauuagcaauuuauccuuuugcuaaagcacuugcgaguccccauaggaggagg

SEQ ID NO: 4231839 - RNA, 92 nt, Human
uaaucacauuuugaagaggcaauuauacuagguuuuggaauuuuggcuaccccagggacucacaucugugugauugucauuuucugugauua

SEQ ID NO: 4231840 - RNA, 76 nt, Human
gcaugaggacggggagcgucggccucucccacucugcgguggagucgggggcgccgccgcucaucucaccuccugc

SEQ ID NO: 4231841 - RNA, 93 nt, Human
cauugugaccuuuggggaauguuaaugcacuucuagcucauggaaaccccggaagccagugucgugugacaugagcccagccggauuagaaug

SEQ ID NO: 4231842 - RNA, 59 nt, Human
gagggauuuuagugcagcaacugaauguccuucaccguucugcagcacuaaaaacuuuc

SEQ ID NO: 4231843 - RNA, 75 nt, Human
ggacaagaugauacagccuaguuugagucccaucugagacacgguagugggauucaccaugggcuucagaagucc

SEQ ID NO: 4231844 - RNA, 75 nt, Human
uugcuuuucuagucaguccugugccuuuccggaggaaaaaaaauucggcuccuaagaaacagacugaaaaggcaa

SEQ ID NO: 4231845 - RNA, 94 nt, Human
guaggucucaggcacuucggcagcgugguagaggugacaauuccaaaggaggcagccacaguggugcuagcugcccgaaggucucagagaaagc

SEQ ID NO: 4231846 - RNA, 78 nt, Human
caguggccgucauacagaugaacaaucucaguacugaggacaguggagauuucauuugugaggcucagaaucccgcug

SEQ ID NO: 4231847 - RNA, 81 nt, Human
ccugauaagauccaagggcugcuuuuuguauaugcuucgaggaugagcccauucucuguacagaagguaccguucauuagg

SEQ ID NO: 4231848 - RNA, 59 nt, Human
ggucgagcagcacccguucggcgaggccgccuaccccgccgacggcgcagaugccggcc

SEQ ID NO: 4231849 - RNA, 92 nt, Human
gcuuguuaaaaauugcagauuucuuguccccauuccaggccuacugaauucaaauuuugaguggggcccaagaaucugcauuuuaaguaagc

SEQ ID NO: 4231850 - RNA, 62 nt, Human
gccuguguucguccucaccuugccgccagucgcggaucuggggccaaggaggagaaacaggc

SEQ ID NO: 4231851 - RNA, 61 nt, Human
ccucuccucugugcagacugccccuguuucagccuccaggagagucugugacaaggagugg

SEQ ID NO: 4231852 - RNA, 72 nt, Human
uucaucuggcuguguucauccugcccaggucccggccccuggccacuuggucguggugcagcauggcgugaa

SEQ ID NO: 4231853 - RNA, 122 nt, Human
ucagucuuuuauuaugcuuuuuaaauauaugcuacacgauaaauuuuaguggugcuuugauuccuguuuucagugacuacuguaauuuauuguuacauguauuuugauuuaauauggauaga

SEQ ID NO: 4231854 - RNA, 70 nt, Human
gauacaauagguaauacuuagaccugauuaaaaucaguuaauaggguccuuuguguuauauaaugguauu

SEQ ID NO: 4231855 - RNA, 63 nt, Human
ccuugugacuaacuuacaccauuacacauacuuugcuucugaugguuaaguucugucaaaugg

SEQ ID NO: 4231856 - RNA, 61 nt, Human
gugaugcccagaacccccuggauggaggggagaccccaggcagaggggucuggagcaggac

SEQ ID NO: 4231857 - RNA, 130 nt, Human
cuugcuggcugcuccucccacccgcgcccgccuccucacucgccuuuucguucgccggggcugcuuuccaagcccugcggugcgcccgggcgagugcggggcgaggggcccggggccagcaccgagcagg

SEQ ID NO: 4231858 - RNA, 69 nt, Human
gggagguggagcuggaaguuccaagcuucuaauccuggcuugguccuucuguugaccagcccccauccc

SEQ ID NO: 4231859 - RNA, 130 nt, Human
cucagcuuacacuccauguguuuccaacagagagggauacgcacuugauagaaacagaaaauuauaaucaaauagaauucuucuguuggcagagcauacauauuuauacauucuucuguguuuagcucag

SEQ ID NO: 4231860 - RNA, 55 nt, Human
gcugagucuguugcuagggggaauuagcaugaauuuuuccacacacagacucagu

SEQ ID NO: 4231861 - RNA, 84 nt, Human
cauguugaagcccgguggagaugugggacagggaccucguuuguuccagagccuguuccaacccucccuggcuuuuguggcaug

SEQ ID NO: 4231862 - RNA, 77 nt, Human
uuuccgucucucagccuuagcaggaucaucugagccacugccaguucagagugagcuggggcugcuuuuccaggagg

SEQ ID NO: 4231863 - RNA, 63 nt, Human
gcaacuccuaggcgaggccuucucuucagcaggccccacaaacucgccuuugcaguggguggc

SEQ ID NO: 4231864 - RNA, 58 nt, Human
acccaggcuggagugcaguggugugaucucagcucacugcaaccuccaccacgugggu

SEQ ID NO: 4231865 - RNA, 78 nt, Human
uggaaggggcuggaaggaagcugucuggaugugugcccuuacacauacaucuuaacgcgcucuuggguuuuucuucca

SEQ ID NO: 4231866 - RNA, 57 nt, Human
cccgggccgagucuuccagcgaguuccgacgccgucucguugccagcccggcccggg

SEQ ID NO: 4231867 - RNA, 63 nt, Human
acuugggcaguauguuuauuagaacugcaggaguuuguagucucagggagcugcuucucaggu

SEQ ID NO: 4231868 - RNA, 103 nt, Human
uguauaguugguuaccucugaauaaaaauguuuuugugugguaauuugugaacuguuuuagugcauaccuaacauuuuugcuuauacagguauucuuuuuaca

SEQ ID NO: 4231869 - RNA, 117 nt, Human
gcccuuucuuucaguaucuaugccauguucaauugcuuccuucuguaaguacguuacauguuaaccuacuaccugcaggaacaauuaggagcaaaaauagagacuaaaggacagugc

SEQ ID NO: 4231870 - RNA, 78 nt, Human
gcgugauuuuggggacugcucagcaggccagggggauguggcugguucuucgcugggcggcugcggggagaguggcgu

SEQ ID NO: 4231871 - RNA, 59 nt, Human
gugauaguucuuacuccaaagugccauuucuuagugauccuugaguucagagcugucau

SEQ ID NO: 4231872 - RNA, 62 nt, Human
caucuauauucuggaauguccauuuacuuuaauguaguguaguggaauuuagaguauaauug

SEQ ID NO: 4231873 - RNA, 59 nt, Human
uuugauuaccuggggcccucugcuuccucacaggugucagcccugccccaggaaucaaa

SEQ ID NO: 4231874 - RNA, 90 nt, Human
cccagcagaggagaggaaaguugggauugaaggugccucuaaucauggguugggucacuggccaagcucgacgugccuccccucucuggg

SEQ ID NO: 4231875 - RNA, 61 nt, Human
ugccaguaauuguccuguagcuuugaaauguguuuucugaauuuguggugcaauuguggua

SEQ ID NO: 4231876 - RNA, 67 nt, Human
gccucuguaggugggcuuccaagguccugggugcagccgggugcauggcagcccuucuggcgggggu

SEQ ID NO: 4231877 - RNA, 58 nt, Human
uuccgcuggagagcaagugcgugcaggcauaccaugcccacuuugucuccaugcugag

SEQ ID NO: 4231878 - RNA, 67 nt, Human
cuucaacuucuguuuuaaggaaacacaaauucauccaguguuacaaauucugcagcagguguugaag

SEQ ID NO: 4231879 - RNA, 59 nt, Human
gcuauuuucucugccacacuuccaguggccacaguggaaguggcaggggagacguaugc

SEQ ID NO: 4231880 - RNA, 77 nt, Human
ucucauuuaggacagugucugaauuguaguaugagagacuuaaguuagauaauuuagugcauuuccuaguagugaga

SEQ ID NO: 4231881 - RNA, 70 nt, Human
uugcuugaacccaggagguugcagugagccgagaucguguuauugcacuccagccuggguaacagagcaa

SEQ ID NO: 4231882 - RNA, 55 nt, Human
cucccaucacaauucagggccuucacagagcugggggagugaguaaugauggggg

SEQ ID NO: 4231883 - RNA, 81 nt, Human
cacccggguugcuaggagauuguggcagcagcuguuugcucugaaucagacagaaaaguugucaaucaucaaaggcaggug

SEQ ID NO: 4231884 - RNA, 93 nt, Human
ggccaggcuggucucaaacuccuaaccuugugauccacccaccuuggccucccaaagugcugugauuacaggcaugagccaccacgccuggcc

SEQ ID NO: 4231885 - RNA, 89 nt, Human
ucacaguuauagcuuccguuacugacaaaauguuuaaauguauacacuacaagcaaauguuuuucaaguguggagcaguguaacuguga

SEQ ID NO: 4231886 - RNA, 75 nt, Human
ccaagagcggggcuggcguuagggaggcauccccgcagugaaggaugcuuggagaaucagucccagcugccgugg

SEQ ID NO: 4231887 - RNA, 61 nt, Human
caagguauugaggccaguguccaggcugcauucaguucacagaacuguccucaggacguug

SEQ ID NO: 4231888 - RNA, 70 nt, Human
ugaaagcuuucuuucaaguucugcuuuagcuuccaagaguucaagcuggaaaugaagaaucuugcuuuca

SEQ ID NO: 4231889 - RNA, 62 nt, Human
auauuggagauauucuauauuuuauauauagguuuauguguuguuggggauguuuucauugu

SEQ ID NO: 4231890 - RNA, 126 nt, Human
cauugguggguugauugaucuuaugacguuuauuucuuaucaucacuauuagguaaccagauaaaccuaaugguuagauggaugagaugugaaguuguggcagaugcuaucagugcccuucccaug

SEQ ID NO: 4231891 - RNA, 108 nt, Human
uuuccccccuuuccuuuuuuugucauguuugaaaauuaauagguguacaaauuuuuguauugcuuuugacuuuuuuuagauaugggugaagaaaucuaacuggggaga

SEQ ID NO: 4231892 - RNA, 71 nt, Human
ggcggaugcugugggugaguggggccgccugagccugcucgggccacauccacacauccacagaguccacc

SEQ ID NO: 4231893 - RNA, 77 nt, Human
aaggauugauacaugcacagcaagggugagagaauggacaaggaccaacuccaucccccugugugucaaucagccuu

SEQ ID NO: 4231894 - RNA, 74 nt, Human
cggcugggccgcggcagaggcgggggcgccgaggcugcgccgccgccgccgccgccuuuguugcgggcccgccg

SEQ ID NO: 4231895 - RNA, 55 nt, Human
gucgguacuaguacugguguugcgaggauauggcaccgucaguacuaguauugac

SEQ ID NO: 4231896 - RNA, 64 nt, Human
aggcaggcggcugcuccuugcccucgggccccgcggggcccguccgcuccuccagccgcugccu

SEQ ID NO: 4231897 - RNA, 67 nt, Human
cagccugcuccccauuuucaugggcaggucugggaccugaucugagaaguggaggggccugaggcug

SEQ ID NO: 4231898 - RNA, 71 nt, Human
guggcgggcggugcgaggaugcagggcuuuguuccuuugcaagcccccaaaauguuugccugcauggccac

SEQ ID NO: 4231899 - RNA, 55 nt, Human
aggguaccugauuuauggagcauauuaucagcugcugccagagagcucauacccu

SEQ ID NO: 4231900 - RNA, 57 nt, Human
gccuuuuaaggcagagggagaucccuauggcguuagucuucccaggccuuaaagggc

SEQ ID NO: 4231901 - RNA, 72 nt, Human
agcggggcgaugggggccugggaggcggcuggggggccccgccgcccuccgaggacuccuucagcgcucgcu

SEQ ID NO: 4231902 - RNA, 104 nt, Human
gcuuuugcagcuaggucggcuccucccuggaaaggggcagaggugggggcagucaacagagaccccugcucagggaggagaccguuuccugccguugcccgagc

SEQ ID NO: 4231903 - RNA, 75 nt, Human
ugagcccagaagaguauguguuugcugcgcugaaccuguacacagacaucaucaacaucuuccuguacauccuca

SEQ ID NO: 4231904 - RNA, 94 nt, Human
uuuuggaagcuagggguuucuguugcuuguucuuggggagaauuuuugaaacaggaaaagagagaccauuaaaacaucuagcggaaccccagga

SEQ ID NO: 4231905 - RNA, 60 nt, Human
ucacuuccuugcagcuguagaauucauggggacugugucuuuaaggccagcaggagguga

SEQ ID NO: 4231906 - RNA, 119 nt, Human
aguaguggaugugaauuuggcuugugguguauaaagaugccauacuuacuguacuuacauuuauuagguaguauaaucuuuguuguuuugauaucauacccagguuuccguaggcuucu

SEQ ID NO: 4231907 - RNA, 102 nt, Human
uugagauggagucucgcucuguugccaggcuggaguucagugaugcuaucuuggcucacugcaaccuccaccucccggguucaagcgauucuccugccucag

SEQ ID NO: 4231908 - RNA, 93 nt, Human
cacagggccugccacggagcaaguguggguaagcauuucuugccugaauguaauaagugcuggcuguacaucuccuucuuaggcagccuugug

SEQ ID NO: 4231909 - RNA, 90 nt, Human
acuccuguggagugucucuguguguuugugugugugugacaacugugagcauuagacuaguacacggcagacaugaucuucccguggggu

SEQ ID NO: 4231910 - RNA, 77 nt, Human
uguuucagucuggaagcccuggcauuucuauucauguccacagcauggacaugaggaacucaggagucaccagagca

SEQ ID NO: 4231911 - RNA, 56 nt, Human
aagcuguuauuucacagguucaguugugaagaaaugaucugugaugagaacgguuu

SEQ ID NO: 4231912 - RNA, 62 nt, Human
uucuccucaaaccaucagacaucuacagaucagacuuuagcucuuugguaggcuugagggaa

SEQ ID NO: 4231913 - RNA, 74 nt, Human
uuuccaugagaguggcaaagagaacaaagauaaaugccaggcuacaucuuggauccuuugccagcuuguggaag

SEQ ID NO: 4231914 - RNA, 59 nt, Human
aggggcugugucauuuguccuaucuuuaaauugaggucagagugucacacacaaccccu

SEQ ID NO: 4231915 - RNA, 108 nt, Human
uaaacagaugacaaauggaaaauaguucaucacaaugaucaucggggaaagcauuuugaguagcuuaucauuugaacagaauuuguuuuucuaaccuguuucuguuug

SEQ ID NO: 4231916 - RNA, 59 nt, Human
gucugugguccaaaauugccucucgauacuggaaggagagaagcggucgaaucgcagac

SEQ ID NO: 4231917 - RNA, 61 nt, Human
gcccgggauguggagguugcagugaggugagaucaugccacugcacuccauccagccuggc

SEQ ID NO: 4231918 - RNA, 71 nt, Human
ucugucucucuuagucugcuuuuuuuccaccgauguaacagaccuggagccagcaggacucagaggaaagg

SEQ ID NO: 4231919 - RNA, 86 nt, Human
ccacccucauuuuacaggggcuucuagggugccagaucugcgggggucgauugggaagaacuagaagcuaaaaaggagaagggcgg

SEQ ID NO: 4231920 - RNA, 56 nt, Human
acagccaacgucuuucuuacuuccugaucggacaggaaguagguuucaguugcugu

SEQ ID NO: 4231921 - RNA, 121 nt, Human
auuauucaucuauuuaucugucuaucaucaauauauaugggugcaugucuguguauauuuguguguauguaagugugcauguguauuauauguuuggguagaaagagauacauugaauggu

SEQ ID NO: 4231922 - RNA, 73 nt, Human
aguaauucuucaauccaguguucagagcuguaaaacaucugaaccuaacauuucuggcagugcaggcauuacu

SEQ ID NO: 4231923 - RNA, 75 nt, Human
uugcuucuagcugacauuugagagagauauacaguagguauauauguauaaaauggaaugucagaauugaaguaa

SEQ ID NO: 4231924 - RNA, 76 nt, Human
caaguugcaugugcuugaaauagauuuaauucuuauuccccacaguuuagguauuuuucauuaguacaucaauuug

SEQ ID NO: 4231925 - RNA, 72 nt, Human
uggggccugggguaucuggugucuugguccuugaugagaacagugacuaggagcccgaugccugggucacca

SEQ ID NO: 4231926 - RNA, 69 nt, Human
gcuaaacgcaauuucuugcaugucaaucuauucuuuuucuauguuugacucugaugcaguguguuuagc

SEQ ID NO: 4231927 - RNA, 82 nt, Human
gaaaauggcggcaauagcacuuaauaugaaacaguaguugaguuuaauguuaguauuuaagagcuuguauguugucauauuc

SEQ ID NO: 4231928 - RNA, 73 nt, Human
gggccagcuuugagcugcaggaaggaagacgggagugcaggauucuagaggcguucucugcagcaggcggccc

SEQ ID NO: 4231929 - RNA, 91 nt, Human
cagacacuagaaguuaaagggggcuacagugugggguugggcucagaaagagcaacacacagguaagccucuuucaaaacauuagucuuug

SEQ ID NO: 4231930 - RNA, 65 nt, Human
gagaggaugaggggaaggauuucuucagaacaaugucuuuugaugaccauucuucuuuuucucuc

SEQ ID NO: 4231931 - RNA, 70 nt, Human
ucacuguggcuaggaagcugugggacucaggaggccaggccuggucacaugcucaccuaagccacaggga

SEQ ID NO: 4231932 - RNA, 83 nt, Human
gagauacauuuucaaaccuaucuaagaaauagcccugauauugaaauggcuucuguggaauagguuugacagauguaagucuu

SEQ ID NO: 4231933 - RNA, 77 nt, Human
gcagaagagggcccauagaucgucagcuugcagccucugguuuaaagcaaaaucgcaucuggggccagcucaacugc

SEQ ID NO: 4231934 - RNA, 58 nt, Human
ugggagagauaggcuucuggaccuuacuuugcuaccucuaaugcuuccucucauccca

SEQ ID NO: 4231935 - RNA, 96 nt, Human
ggggacucgcgucaggacugcgauuccuuucgccugccgagcuguagcggcagugucugcgggcagaggagcggcggccguggcagcagcaucccc

SEQ ID NO: 4231936 - RNA, 57 nt, Human
cacuuuuccugcagacaguuuaagcaucaaauguugagaacaucucggggacaagug

SEQ ID NO: 4231937 - RNA, 55 nt, Human
gggggcguugccacggggacgggaugacagaaacuccuccucuccaaacgcccuc

SEQ ID NO: 4231938 - RNA, 89 nt, Human
guuuauagcuucauuaucagggaguuguguguucugacacagcagagccuggaaaagggcauacauuuuccugagauguuaauguaagc

SEQ ID NO: 4231939 - RNA, 56 nt, Human
cacacagcuagugacaggagaaugcuagaaaguugauucaugcagugguugcugug

SEQ ID NO: 4231940 - RNA, 83 nt, Human
uucagcuguuuauggugaugcuacauuuugguuuauaaauauguuugugguauaaaaaaaugaguauaaccauagguuuugaa

SEQ ID NO: 4231941 - RNA, 56 nt, Human
cagacacgucccuguugaccugaugcuaccacucucgucaucucagggacugucug

SEQ ID NO: 4231942 - RNA, 63 nt, Human
aggaauuugugcucaguuguggucuauuuuaguguuaaaauagguaaaugaguaagaaauccu

SEQ ID NO: 4231943 - RNA, 98 nt, Human
caagcccuuggcacuuucuucugccccuugccugacaguguuugccuuucuuuggaugauggagcagugagaucauccaggugccccccaggggcuug

SEQ ID NO: 4231944 - RNA, 56 nt, Human
guaauguaguuuacugugagugcacggcaggugacuaauacagaaacuacaaguac

SEQ ID NO: 4231945 - RNA, 61 nt, Human
gcccaaauuguuguuguuguuguuuugauggcaagaaucauaacaaaagcaauuauaaggc

SEQ ID NO: 4231946 - RNA, 73 nt, Human
caccccuacugaaauuuccugguguguuuauuuaacuucucacuagagguuccagugaagguaacaauuggug

SEQ ID NO: 4231947 - RNA, 61 nt, Human
gucugcccuuggccugggacuuugggcuuugguucuaaguuccuaaagucaggggucaagc

SEQ ID NO: 4231948 - RNA, 125 nt, Human
ucucaucugcaggugguuuaagugugaagguuuacugaagauuuaaagaguguuaucacaguugggaugauuuaaacuaacaguacacguugcauuuuaagaaaauaauuaauccucagaggaga

SEQ ID NO: 4231949 - RNA, 77 nt, Human
ggcuaaucaagaaggcccagugaagggugagaaaucugcaaaucuuccuuuacugguguauuucuucuuauucagcu

SEQ ID NO: 4231950 - RNA, 55 nt, Human
cuggccaggcuucauccuggaaccaucuuuguggcugggagcuggaacugggcag

SEQ ID NO: 4231951 - RNA, 124 nt, Human
ggccugggaccuagguucaaauccuggcaucaccaccuacaucuguguggccuccauaggguacuuugguaauaauaaauauucaaugaggucauauaagcuaguguuggcagaggcccagccc

SEQ ID NO: 4231952 - RNA, 57 nt, Human
cuguccugauggugccacuggugugugauggcaucaccuguagcccaaucauggcag

SEQ ID NO: 4231953 - RNA, 125 nt, Human
ucauuccucuggggccuggguuccgucuccaccugggcacugagaacuuggggacagagguugccagugaccucccaccguaucucaguggcaugggguuagggacauggguucuggaacaguga

SEQ ID NO: 4231954 - RNA, 58 nt, Human
uuuaggugucugcucauugaagccgucccagggaaagcccucagaggagauaccuaaa

SEQ ID NO: 4231955 - RNA, 88 nt, Human
guauauauguuuguauuuauuuuucaacuaccaauguuauacacaaacauguucugguuauauaaggauuaaauacagaaguauaagc

SEQ ID NO: 4231956 - RNA, 56 nt, Human
gcuguguaugaugcaggcaccugggccgucacucagcuggcugucucuuacacggu

SEQ ID NO: 4231957 - RNA, 85 nt, Human
cucagcccugggagcuggaugucugugccaggcacacccguggcaacgggaggugaccagacagagucuagcccuaaggaagggg

SEQ ID NO: 4231958 - RNA, 79 nt, Human
gauggaaaacgcaguuuaauuuuugacauccuguuggcugauuuucccaauaacaaggaauuucacugcguuuuuuauc

SEQ ID NO: 4231959 - RNA, 86 nt, Human
uacaauugugcugcucuguucucauugugaugcuuaguucucguguagaacugagugcuacauugugauuagaaacuggaguugug

SEQ ID NO: 4231960 - RNA, 117 nt, Human
acucuuggcugagucuuugugcuucuguucuguccugaaggacacgugaggagccagaaacaucuggcagccucugguccuuaguucagauacaacauccaugaagcugccaggugu

SEQ ID NO: 4231961 - RNA, 130 nt, Human
auguuagcaacuagcucaauggauucccagauguuagcaucuggcacuauggacucucaaauguuagcuucuggcaccauggaugcucagauguuagcgucugguaccauggaugcccagauguuagcgu

SEQ ID NO: 4231962 - RNA, 78 nt, Human
cucuuuugcuuauauuuuauuuaauuaaauagauauuuuaaggauuuguuggauuuugugaaauaugaagaggaggag

SEQ ID NO: 4231963 - RNA, 83 nt, Human
gucagaggcugggcuagggagacagagggcaugggcacaaguccuggcucugccccucgcucaccagcucugaggccuuagac

SEQ ID NO: 4231964 - RNA, 60 nt, Human
aaagaguuaagagucuuaagcuaaagcagcucuucugccaugugggacucugacuugguu

SEQ ID NO: 4231965 - RNA, 56 nt, Human
gcuguggaaaaugggucuccaauacuaucuuguuuugauuccagcguuccaucagc

SEQ ID NO: 4231966 - RNA, 63 nt, Human
ugcaagauccagucuugagaaggaauguucucacuucucaaagagcuacuggucuauaaugcg

SEQ ID NO: 4231967 - RNA, 64 nt, Human
cuauguuuugcuagugauggguggaugggaacaaacauuacaagaaauagcauaaugaauguag

SEQ ID NO: 4231968 - RNA, 87 nt, Human
ggagguucuuguuucuguuaacuuagcugaccuuaaaguguagacuuuagguccguguugcaguugguauuaggaauuuugacuucc

SEQ ID NO: 4231969 - RNA, 97 nt, Human
gaguaggucgaggaaggggaggccugcgcuuucgggagggaagccgcuggggcuagucuggcugaagcugggcacuuccuuuuuucccucgauacuu

SEQ ID NO: 4231970 - RNA, 71 nt, Human
cagccucaauucgugccucacauugcagucccuggggcagugaaguaauggagggucugagucuggggcug

SEQ ID NO: 4231971 - RNA, 68 nt, Human
ccugggaagcugagccucgauguggagcaggccccgucggcgcagcacucgcaggcccagcucucagg

SEQ ID NO: 4231972 - RNA, 81 nt, Human
ugacuguuuagaauaugguuuucuuaauuagcagucauggggaaaacaugcauuuuuaauuuggaaaaaaccugacaguua

SEQ ID NO: 4231973 - RNA, 63 nt, Human
ucccacgugccaucugcucuguccaccagcaccacacguugauuagcaccccuggauguggga

SEQ ID NO: 4231974 - RNA, 84 nt, Human
gcaugcuuugauuuggaauuuuuagagcuuugaauacaucagauucuuuuuaaaacucugacgcugucaaauacaucagcuugu

SEQ ID NO: 4231975 - RNA, 62 nt, Human
aggccuugggauguggcugcagcugggucagucagccaggcugaagcccacucccugggucu

SEQ ID NO: 4231976 - RNA, 76 nt, Human
ccagggaaggaguacagggagggucccugugugcagcugcucagggaguuccgaucugugcacccucuugaccugg

SEQ ID NO: 4231977 - RNA, 93 nt, Human
cugaucauccagcagugucagcagcuucauugucuccgaguccucucauuuuucaagacuuugaaugaugacagcgugguggaaauuggugag

SEQ ID NO: 4231978 - RNA, 68 nt, Human
guguuagagucuugugcucauuugcugacaugcuuagauuugguaaugagauggaggacucuuaauau

SEQ ID NO: 4231979 - RNA, 55 nt, Human
gggugguggagguuugacagacugccaaaucaggucugucuaguuaccaccgccc

SEQ ID NO: 4231980 - RNA, 69 nt, Human
gccgcgccgcaacggacccugggagucggccaucaugcuggccccggaggccguuagcuuagucauggc

SEQ ID NO: 4231981 - RNA, 63 nt, Human
uguuguucuuuuucuucuuguucucaaaaagaugaaagggagccuaaggaggaaugaauagca

SEQ ID NO: 4231982 - RNA, 72 nt, Human
ggaguaggcuguaugaauauaccacaauuuagggaaccagaacccugauauggugucauuuaaacagcuucc

SEQ ID NO: 4231983 - RNA, 92 nt, Human
ccugacuguaaaugguggcuggguaaggaaacuccuuuguuccuucugauuaugagguuauaaagggccuuauuuuagcaacccauauuagg

SEQ ID NO: 4231984 - RNA, 66 nt, Human
aucaccaaccaguagcugaguucaaaaacuacauauuucuugggcaguccucuacugguaugugau

SEQ ID NO: 4231985 - RNA, 61 nt, Human
uuugguaggggguuuuucuagagauugcuguuguagucggcuaggagggccuucuucuggg

SEQ ID NO: 4231986 - RNA, 130 nt, Human
gugugugugugcgugcgugcguguguguuguaguguguguuucuuuuguuauuuucuccccuaacaccgcagaaaugaaacacacaugcagcucugucgccucauauuuucagauguuuuucacacuauu

SEQ ID NO: 4231987 - RNA, 58 nt, Human
ggauuucagaaugaaaggaaaaauguguggagauuaguccuaguucauucugagggcc

SEQ ID NO: 4231988 - RNA, 58 nt, Human
acagcugacaagaguccuuggaggauuucccgaagaauuccauggacccugucagugu

SEQ ID NO: 4231989 - RNA, 58 nt, Human
ggucuuuggacucucucuccuuccuuugcagauggaaaggcagagaggaccagagacu

SEQ ID NO: 4231990 - RNA, 89 nt, Human
ugugcccuggaagagauccccagugugucucggcuuucuauguucaagucaagccugggauuggggauuuuuugccaguuguggguuca

SEQ ID NO: 4231991 - RNA, 60 nt, Human
agcuaggucagaggacacagcuuaguugagaacuaaauaagccugugccugcuaccugcu

SEQ ID NO: 4231992 - RNA, 73 nt, Human
guuucuaucuugaaacauauaugcauuuugaaguagauuauuuaaugauuacagcaugauguuucaaagaggc

SEQ ID NO: 4231993 - RNA, 82 nt, Human
caugggcauuuugggaggcagaggaugggacuguauaaggauuuauuagauacuagauaccucuucuaccuugugccaggug

SEQ ID NO: 4231994 - RNA, 63 nt, Human
ggauggaugagugaauggauaaauccaucgguggguggguauagacaaauuauauauccuucc

SEQ ID NO: 4231995 - RNA, 76 nt, Human
aguccacaguaguauaagugaugcuaucuucucuaucuuuaucagaggaauugucgucauguauaauaauuggacu

SEQ ID NO: 4231996 - RNA, 78 nt, Human
cuccgccuccucucuguccugauuuacccccugccuggcacaaaaaugaacagagaagucaccaagaggaaggcggag

SEQ ID NO: 4231997 - RNA, 57 nt, Human
auauuuguuagcugcuuuggaggcauaaugauaguauguuucugcggugacagauau

SEQ ID NO: 4231998 - RNA, 77 nt, Human
cccagcgucccguuucacuccuugccagccccuggacaucacccacucggcucaagaccaagggagcggggaauggg

SEQ ID NO: 4231999 - RNA, 61 nt, Human
ggcgaggcgggccgcggggucuccggaauggacugacgcagaccccuccccacuccucgcc

SEQ ID NO: 4232000 - RNA, 77 nt, Human
uagcagcaagaaaaggaagcuuagacuguaaaauaaauuauacauuugauuuuugcuucuuugguuuagaccugcua

SEQ ID NO: 4232001 - RNA, 76 nt, Human
gugacguuaaaugggagucacacagguuuagcuaucuguucuaggaguggaugaacagacuauucucccaugucac

SEQ ID NO: 4232002 - RNA, 81 nt, Human
uaugccccaaccauugggucaugggaucccagcauccagauccuggauccuagacuccuaugccccaaccacugggucaug

SEQ ID NO: 4232003 - RNA, 80 nt, Human
agguuuggguuuuaauuauaucugggcaguuagaaaaugcaauucuuuccuauggcucacaaauaauaaauuucaaaucu

SEQ ID NO: 4232004 - RNA, 126 nt, Human
gggauaggcucugauuaauuaguuacucugacucuggucugccgagauccauuuccaacccaguugcguugggagaggguugggaggcagcagagcaugggugacagugggagcacacgacuuccu

SEQ ID NO: 4232005 - RNA, 64 nt, Human
cugggaguugacgaggcuuguaacaaucuacugggaugaugugagccuuuauuaaccucaucag

SEQ ID NO: 4232006 - RNA, 57 nt, Human
guuccucugugguggaggaagggacacgcgcuuuuuuuuccgaccuuaggaaggaac

SEQ ID NO: 4232007 - RNA, 63 nt, Human
agguuaaacuuccugcagggcuuucucugaagucacagccauuaguucugcagaggcaaaccu

SEQ ID NO: 4232008 - RNA, 65 nt, Human
gcggcccggccucgcggcgcaugcggcugcuccugcggcagguggugcagcgcaggccggguggc

SEQ ID NO: 4232009 - RNA, 93 nt, Human
ggagaaacuccagcaagggucucucauggcuuggacauggcacaguaaggggcagccaacccaguccaugaugacuuuugcuccaacuucuuc

SEQ ID NO: 4232010 - RNA, 108 nt, Human
ggaugacacggaugcgacaguuuggcuuugauccuaggauuccaccugagcggaaacauccgcgagccagggaguccuggagagcccgagcgccucuaccaugucucc

SEQ ID NO: 4232011 - RNA, 110 nt, Human
uucucacacacugucccuucaguccagggggccggggcucaggagccaugaccuggugucuccugcccacccuggucccagguaaaugugaauggagacagguaugagag

SEQ ID NO: 4232012 - RNA, 70 nt, Human
uggucacagauuuacaggaaugugucuaugaaauuacuguacuugacucauccugaaauuacgugauuca

SEQ ID NO: 4232013 - RNA, 56 nt, Human
agucccugauggacuggaugagcugaaguuuccucucccagaaguucucggggacu

SEQ ID NO: 4232014 - RNA, 60 nt, Human
gcaccgggcuuccuuagagcaagaucccaggaggugaagugucucugggaggcccggagc

SEQ ID NO: 4232015 - RNA, 74 nt, Human
gacguccgcugauucuuuggaagccaugucugagggggaugcuccaaccccuuuuuccagaggcagccggacuc

SEQ ID NO: 4232016 - RNA, 87 nt, Human
auacuaaguugaaucauauguaauugacuuuuuuugguagggcaaaaugaucaaguaugggcaguuucaugugguucaaccuaauau

SEQ ID NO: 4232017 - RNA, 76 nt, Human
ugucugguuuaugggugugggguaggguaagaggagguggugaucucucggccuuuucuuauacccacaccuggca

SEQ ID NO: 4232018 - RNA, 61 nt, Human
ccauguaagcuggacuccugggacugcuguuggcuuaucccgggaagugcugcuuaucugg

SEQ ID NO: 4232019 - RNA, 63 nt, Human
ugaaaaaugcuuuaaugcauguauguaccagcagugguuacuugcauuguguaguguuuuuca

SEQ ID NO: 4232020 - RNA, 118 nt, Human
agugaaacuggaucuggguaggaaguuagagauuuuauguuaauguauuggggaggggaauacauuccagaaaguuucuguaguaucuauacaggccgauaacgaaaacuguuucacu

SEQ ID NO: 4232021 - RNA, 102 nt, Human
gcuaagaaaucaagauuuuagaagcauuuaugagauuucuuuagugaugcaccacagagucaguuuuugagaauucuucugaaguuggcaagggauuuuggc

SEQ ID NO: 4232022 - RNA, 75 nt, Human
cuaggaugugagaaaaauuccuaaggguuugaguucagagauccuggagaccagaaggaagcuucgaacagcugg

SEQ ID NO: 4232023 - RNA, 55 nt, Human
agcggaggaggcggagcagggagccgggagcgggcuggcccgcgcuccuccugcu

SEQ ID NO: 4232024 - RNA, 77 nt, Human
gauucuaucauucuguauauuagcugcaaaucauuaauuuaaagcaugccacuaguacuaaauagggugauaaaguc

SEQ ID NO: 4232025 - RNA, 61 nt, Human
caucugggaaggggaaaaugcugaacaccauuguauaguuucuucaacugucccagccaug

SEQ ID NO: 4232026 - RNA, 79 nt, Human
guuuggcugaccucagauuguggcuccgcuguuacucucuguguaaugugggaucguaaauuugggacaaagccgguac

SEQ ID NO: 4232027 - RNA, 72 nt, Human
gccaaaagagacaagggaccucuggagaggcacccgggagcgggcgucugcagggcccuuggcuccuguggc

SEQ ID NO: 4232028 - RNA, 59 nt, Human
cugcagguggcagcggggcaccaggggcucauuccugguggccucaguggcuucugugg

SEQ ID NO: 4232029 - RNA, 71 nt, Human
ucauuuguuucagagaaagcccaaagacuguaaccugcagucauuugucauuuuuuugaggucucaaauga

SEQ ID NO: 4232030 - RNA, 84 nt, Human
guuuggacaauaugccaaauccugucacaucacauuguugcucuaaaauggguggauggauuggguugauggcauacgcuaagc

SEQ ID NO: 4232031 - RNA, 117 nt, Human
uuuuuuacauauaucuuuuuauaacuuuccaggaacuaagcacauuaucugauaauuguuguaaauuuuuuugucagugcuuuaguucaggaugggcaauaaauuauuucuaaagga

SEQ ID NO: 4232032 - RNA, 64 nt, Human
ccuacuuucuucuucagaauugucauaaaacaucaucuuuuacaacauggagaagcgagguagg

SEQ ID NO: 4232033 - RNA, 59 nt, Human
gggcagagggcgagcugggagaagcuccaccccucccucucccuggccagcccuuuccc

SEQ ID NO: 4232034 - RNA, 76 nt, Human
acaaaaagcaaaugguauugguauuauaaaaagugcuccaugagagcaaucaaauaaugauaaugcuauuuuuugu

SEQ ID NO: 4232035 - RNA, 59 nt, Human
ugauagcaugcucucaguaaaacugauccacucacaaauugcuggagcaauguaaauca

SEQ ID NO: 4232036 - RNA, 101 nt, Human
uuccaucccaguaaguucccaugggauaaguuauuuuaguaaaucagaaaauuucucugaaagcaaaguaauucuuaauuuuuggaggcuugaaaauggag

SEQ ID NO: 4232037 - RNA, 73 nt, Human
ugcaagggaagggaguccauccagaaaacaaagcuuugggaguuucaguuaguugggugacacuacccuggua

SEQ ID NO: 4232038 - RNA, 61 nt, Human
ggggaacagaugggacauuugucccuagguacagaaugugccuaugucucaaagguucucc

SEQ ID NO: 4232039 - RNA, 78 nt, Human
gagaaguuauuggauuggucacacaauaguauauauacuuaaauuauaugcacuaugaugagcuagucuuaauuucuu

SEQ ID NO: 4232040 - RNA, 102 nt, Human
guguccgcccccccaggacuuggcagugucaaauuuaaggcuguuuuuucuggugccuuaggacugaaucugagccugcgcaaaguccuguuuugaggaugc

SEQ ID NO: 4232041 - RNA, 70 nt, Human
gcugguucccugccauaccugaaggcacagaacucauuccauugcuugcugugguuggcugguaacuagc

SEQ ID NO: 4232042 - RNA, 74 nt, Human
agccaucuaguuaaugagauaagaaaaccuuugcauuccagguauuuggaauuguucucacagcugaggugguu

SEQ ID NO: 4232043 - RNA, 57 nt, Human
aacaggcggcgggucgggcugugccaguggucuggcggaucuuuccugccucccguu

SEQ ID NO: 4232044 - RNA, 106 nt, Human
cugaauguuugugaagguguugacccauggauacuaagguaugugaaaauaacucacacaucucagguguuuaaugaggaucaauaacaauuugugggcccaucag

SEQ ID NO: 4232045 - RNA, 63 nt, Human
gagaggggaauaaacacuuugucacuaauuaaucuugaaggcugaauuauuuguuccuuucuu

SEQ ID NO: 4232046 - RNA, 57 nt, Human
auuauggacuuucuuguuugggugcaagacacuauccacagcauugaaaucuauaau

SEQ ID NO: 4232047 - RNA, 62 nt, Human
uacuuuggugaaauuggaaauacucuugcagaaguguuuucaucucucacccagaaaaagua

SEQ ID NO: 4232048 - RNA, 60 nt, Human
agggaguagggagccauggguggggcagaccccuccucauucccagucccucccaccccu

SEQ ID NO: 4232049 - RNA, 80 nt, Human
cagacggggucagggaggccccaccauggcuugucgagggcacgggcaccugcauggcggcgcucucccugccuccccug

SEQ ID NO: 4232050 - RNA, 89 nt, Human
gugauauggcagcugcaggaagucugaauucugagaguugguuguacauaaccucaggaauuuauucuucugugggcuuacaugauuac

SEQ ID NO: 4232051 - RNA, 65 nt, Human
uggaggcagagaggucuuccuggaaagcucucugugcuuuccacauucggaauuuucugaaucua

SEQ ID NO: 4232052 - RNA, 65 nt, Human
aucugucccucaguauugacgaaagagauuuaagaaauuucuuuagagguacugaucugacugau

SEQ ID NO: 4232053 - RNA, 65 nt, Human
gcagcagcaggcgcacggccgucuggaucucccuggaggugauggucgagcgcuuguuguaaugc

SEQ ID NO: 4232054 - RNA, 63 nt, Human
gggcaagagaggaagagauggcagcuuuuuaagugaaauuuuaaucuuaucuaucuuuuguuc

SEQ ID NO: 4232055 - RNA, 93 nt, Human
aaauacuagaaaacauauuuuauuuugggaucuuuuuauugagugucucacuuuggaaagauuuaaaauaacgaguuucagaucuggauguuu

SEQ ID NO: 4232056 - RNA, 101 nt, Human
gggccccguuguguguccauuugggcuuugcuggggucccuggucuuuuuacccaggaggcccagaaggaagcccagacucucagggccugcccggggucc

SEQ ID NO: 4232057 - RNA, 87 nt, Human
cauggaaacucaacauuagaaaugacaugugggaauagaucaccuucucucuagacuaauaucccauuucugacaguggucuccaug

SEQ ID NO: 4232058 - RNA, 73 nt, Human
acuucaggguugauuuuuaugaagccauggaugacuacacaucugccauagaaguccaacccaauuuugaagu

SEQ ID NO: 4232059 - RNA, 81 nt, Human
gcuuagcuggguaguucuuguuugggaucucucaugagguugcagucaagaugucagacagggcugcagucagcugaaggc

SEQ ID NO: 4232060 - RNA, 81 nt, Human
ugugacagcaguggccucauggccuuaucugggggaaagcacuuccuuccaagcaccaugaaggccucacgugcugagaca

SEQ ID NO: 4232061 - RNA, 64 nt, Human
gccaauguuuuuccuuccuuaauaaaguguuccaaaacaguaugcuagauggaaaaauauuggc

SEQ ID NO: 4232062 - RNA, 62 nt, Human
guggggccaggcuguuggcuuccauguuucaugugacagggaggcccagaggucggccccac

SEQ ID NO: 4232063 - RNA, 64 nt, Human
gccuuauguugauaggaaucugauucccauuccuuuuugggaaugaguugggcagcauacaggc

SEQ ID NO: 4232064 - RNA, 59 nt, Human
acuauugcuuuagggggaaaccuuagauauuuuaauuuaccuucucucuggauaguagu

SEQ ID NO: 4232065 - RNA, 69 nt, Human
ucuuguguugaagugguuagggcguuuguuuuaagauaggcauuuugcccugaagcugucaauuuugga

SEQ ID NO: 4232066 - RNA, 99 nt, Human
uuggccaggcuggucucggacuccugaucucaggugaucugccugccuuggccucccaaagcgcugggauuacaggugugagccacugugccuggccaa

SEQ ID NO: 4232067 - RNA, 72 nt, Human
uagaaucuacuagaggaauugcuauaacuuccuugaaauuggcaaguagcaguuccauuugaugugauucua

SEQ ID NO: 4232068 - RNA, 59 nt, Human
guccccugcuguggaucuguggcuaguaacagccugggagcagcagacagacaggggac

SEQ ID NO: 4232069 - RNA, 105 nt, Human
caggaagaugacucagggccuuauccauaccuucaaguuugcucuuagcaaguaauuguuucaguaucuauaucaaaaauggcuuaagccugcaacauguuucug

SEQ ID NO: 4232070 - RNA, 77 nt, Human
gcucuucaucagacucugcuuguaucacauuugcuaggauacuacaggguauauaggcaaagcuaaaugugaggggc

SEQ ID NO: 4232071 - RNA, 89 nt, Human
cuugcagguugguauagaaauuaaagcuaguugagauuuaagaauguuuuauuagaguucaagcuuuaggaaaggccaagauugccaag

SEQ ID NO: 4232072 - RNA, 57 nt, Human
gguuuucagaaugcaguccugucuuuguguggauucagagcucacaaacugaaaacc

SEQ ID NO: 4232073 - RNA, 87 nt, Human
auguuuguuuaccaguaguaacagguguacagacuaucaggugucauuaugacagauagcacacuuguugcuucugcugucaagcau

SEQ ID NO: 4232074 - RNA, 68 nt, Human
gagaaugagucagagcuggcugaggucuucgccuugauucaugaacucaacagcucucgacuuaucuu

SEQ ID NO: 4232075 - RNA, 77 nt, Human
uuuguguuuugaggucuugcaauguuuuuguguuucugaugcuaauaacuaaaguuuguaagacuguagaaugcaaa

SEQ ID NO: 4232076 - RNA, 99 nt, Human
gggcuauaagauauuugaaagaaacccuagcguuguuuauugaauccaggguugacucaagaagauaaugucuaggguuagauguucaaaaauauaccc

SEQ ID NO: 4232077 - RNA, 90 nt, Human
gucagaccagcaacuuuuaccaauuaaauagccaaucuauucaccacuaaguagaucccauugguugguugguugaugauugcugcugau

SEQ ID NO: 4232078 - RNA, 84 nt, Human
caggaaauggaauguuugcauagaaauaaacacugcuaccuuuacuauuauaaguaauaagcuucucugcaguucaguuuucug

SEQ ID NO: 4232079 - RNA, 62 nt, Human
gaccuuggcacauuuuguucuucuguauguccccuuacggaggcugcuuucuguugcuaguc

SEQ ID NO: 4232080 - RNA, 68 nt, Human
guguaacauuuaguuuuaagaugguaucuuuaaauagauaccuuagcuguuaaaacuaagugauauau

SEQ ID NO: 4232081 - RNA, 69 nt, Human
guggugcccgugggugggguacgggcuggccucuguggccaggcccugcuccucacaccacaggacugc

SEQ ID NO: 4232082 - RNA, 78 nt, Human
ucacauucuuggcuuuucaguuuuaaguuacauguuaaauguguauuugaagaaagagcuucuaguuaaagacuguga

SEQ ID NO: 4232083 - RNA, 69 nt, Human
cugccucaucugugguacaugacggcugccuaaucugcuuaggcagcucagcacgcacagguaaguuag

SEQ ID NO: 4232084 - RNA, 57 nt, Human
ugauguaggacauuauuauuucaaaugugcaucacuuuuaugauaauguuugcauca

SEQ ID NO: 4232085 - RNA, 68 nt, Human
gcauagacaccuuagagcaauagaaaguauaagcuucacaaguuucauuugcucucuuguguugaugu

SEQ ID NO: 4232086 - RNA, 61 nt, Human
uucuaguuacucuuaaaugcugccuucacaagguuaauuuggcuguuaauagugauuagaa

SEQ ID NO: 4232087 - RNA, 56 nt, Human
aguuauucuuagccucgguauuucuaucuuauggcaucgcaggucuaagauuagcu

SEQ ID NO: 4232088 - RNA, 56 nt, Human
gaaugcauuuuuuaaaagcauauugcuauaaaaagccaugcacgugaaaugcauuu

SEQ ID NO: 4232089 - RNA, 71 nt, Human
ccugcccccacugcuggugcugcccacacggugguccccgaccuugggcccagaccggcacggggcuccgg

SEQ ID NO: 4232090 - RNA, 96 nt, Human
gucauaguaaaauuagucacaauuagauaaaucagcccugaguauaauagcaucuguauuauggguuuuuguguaaauuauuaauuugacugaaac

SEQ ID NO: 4232091 - RNA, 70 nt, Human
uuucauuuuacuugauauaaaagauucuuauugaguccauaaggaaaucagggaucgucagaaaaugaaa

SEQ ID NO: 4232092 - RNA, 60 nt, Human
gcgucguucucugccagggcguugguguagaacagcaaagccuggggagaguaaggaggc

SEQ ID NO: 4232093 - RNA, 65 nt, Human
uccucuucucuagagccggaauccccuaggagcauuuccuuguuuuccuccucuggagaagaaga

SEQ ID NO: 4232094 - RNA, 104 nt, Human
ggaagugaagguuugugcggaggagggagcuggaagcucuuccuuucaccgacacagaggaaagugcccucccgcccccucccaagcacaccccucugcgcucc

SEQ ID NO: 4232095 - RNA, 55 nt, Human
ucuuguuuggccauaggugcuggggccccggcuucagucacugucucagacagga

SEQ ID NO: 4232096 - RNA, 71 nt, Human
acugcuuucagugcuggaggggugcuugcaggagcauuguguaauucuaauccagagcuggugagagcggu

SEQ ID NO: 4232097 - RNA, 109 nt, Human
gcugagugacauuagugucaucaaugaccuugcagagcccauggaugucacucuccacagacugacgcauggccagcucugucucauacuugacucuaaggucaucagc

SEQ ID NO: 4232098 - RNA, 114 nt, Human
aggagggcacuucacagguggggaaguggcaggagcacugggcaugucacccaucgaaguggggacugccgacagucucaaauauuccucuaacugggacaaacugucuuuccu

SEQ ID NO: 4232099 - RNA, 59 nt, Human
gucuuuguaguuuuaauuugaggccaauaucugaggccuagaauugcacgagcagaggc

SEQ ID NO: 4232100 - RNA, 64 nt, Human
aguuuucuaguauauaacuagaucuuccuacaacuaggaagauuuuacggaguauuaggguauu

SEQ ID NO: 4232101 - RNA, 58 nt, Human
gucucacuucauuuucuuagcccaagcuauagaaaggguugagauuguaugaggagau

SEQ ID NO: 4232102 - RNA, 102 nt, Human
ugaggcagaguuucacucuuguugcccaggcuggagugcaauagcgagaucucggcucacugcaaccuccaccucccagguucaagugauucuccugccuca

SEQ ID NO: 4232103 - RNA, 59 nt, Human
ggcacagcgacuaccaucgaaaguugauagggcagacguucgaaugggucguugcugcc

SEQ ID NO: 4232104 - RNA, 108 nt, Human
gugaauggggaguguccuaugggguuguauaaauagucagaaaucaacgugcugcacuucugugggguugucuggcucugaccauucugaucagccuuuucuguucac

SEQ ID NO: 4232105 - RNA, 59 nt, Human
ucugacugauuuugcuuuuuaauucuguaaucaguauuaaaaaaagauaaugaguuaga

SEQ ID NO: 4232106 - RNA, 66 nt, Human
agacuugccgacuggccaaggaguaaguccuuuuggagcuagagcccucuggccacguugcugucu

SEQ ID NO: 4232107 - RNA, 67 nt, Human
ugcucacuagaagauucagcaguagggugggaugcucuucuucuccugcccuuggacuuccagagca

SEQ ID NO: 4232108 - RNA, 87 nt, Human
gguugccgugauugaggaggugcuaccagcgucugcugggcagagaccagggaugcugcuccacaucccacaaugcacaggacaauc

SEQ ID NO: 4232109 - RNA, 128 nt, Human
agagacgggauuucaccauauuggccaggcuggucucaaacucccgaccuugugauccucccgccuuggccucccaaagugcugggauuacaggugugagccaccaugcccggccuguucccauuucu

SEQ ID NO: 4232110 - RNA, 73 nt, Human
guucaaacacugugcaauuggguacacccauccauaauuuuaaggggcugaauucaaugcacauguuuuggau

SEQ ID NO: 4232111 - RNA, 61 nt, Human
aggugccaaaauauuagugcuuaaguacacugauggugugcuaaaggcagaauauucaccu

SEQ ID NO: 4232112 - RNA, 59 nt, Human
cuguuccuccaccucaacaaaccuuuacauccucacugguuugugaggccagagaacag

SEQ ID NO: 4232113 - RNA, 108 nt, Human
gggucauuucacugagauaaggaauaugagcagguuauuagaaauggaaguaaucuuaaaagauuuucuagauagucugauauuccuaaaucauuagguaaugaaacc

SEQ ID NO: 4232114 - RNA, 81 nt, Human
uugugcugaaaucuguugucaggaauccacaagaaguucuucauauuuauuuuguguuucggauagcagauucuguuacga

SEQ ID NO: 4232115 - RNA, 73 nt, Human
gauuaguauuuucaccauaugagguaaaacauuuuaaucauuguuaucuuauugugaugaugaagaacuaauu

SEQ ID NO: 4232116 - RNA, 57 nt, Human
gcgggcaggcagcccuggggaugggcagccccgcucuuucuugggccgugugcuggu

SEQ ID NO: 4232117 - RNA, 112 nt, Human
gucaugaagccugagcuguccugggaacaggcacuaccucucucugagggagagcagcuugaccuaguuccucuucucagggccaugcuguaguuuucccugcuuuugugac

SEQ ID NO: 4232118 - RNA, 74 nt, Human
gcccccuuugcuggugauuaaauccugaagguacacgaaguauuucagugaaugaauggcuaacagaaaagggc

SEQ ID NO: 4232119 - RNA, 66 nt, Human
cuguacuauuuguucacuaugaagagguuggggaaugaucacugaccucuaaguaacagagaaugg

SEQ ID NO: 4232120 - RNA, 65 nt, Human
ugugcccuuugugucuggcugggguggaaagccaugcugccauccacagucagaacgggccuaca

SEQ ID NO: 4232121 - RNA, 121 nt, Human
ggacccagagggccugcuuuggccggggugaauucucuggcuucaguaggguucacuuccuuuccugacaguggcuucucuggggucaagagagagccugggccuaggagaucuagggucu

SEQ ID NO: 4232122 - RNA, 57 nt, Human
uuuauuuuccaugucucuagguugagaaucugucaucuagagaauuuggaaauuaag

SEQ ID NO: 4232123 - RNA, 130 nt, Human
auuuucuuaaugcaguaauuucuuaugauggcacugguuacuucagaucaguaguaugucaauuggugaaaaacagacugcguuucuaaaguagcauaguuuugucauaacauuggggugcuaagacaau

SEQ ID NO: 4232124 - RNA, 71 nt, Human
gguggggguaggggguuuccuggaugauuuucccaucgugaucaaacaccagucgagucccaaccuucacc

SEQ ID NO: 4232125 - RNA, 60 nt, Human
gaggcccugagauugcugcccucccauauuggaaggagggucugcgauggcaagggucuu

SEQ ID NO: 4232126 - RNA, 55 nt, Human
uggcuucuggccaggcacaggagcucuaugggcugucccuggacuccaggagcca

SEQ ID NO: 4232127 - RNA, 88 nt, Human
gacugugugcccuccgagggugacuaccgcuuccgcaucugcacagucagcggacauggccguaguccccacgugguguuccacgguu

SEQ ID NO: 4232128 - RNA, 84 nt, Human
uucuaaagcuccuuccacuaaaaaguugacauuuuuaugugaaaauauaucaaaauucgaacgucuuguggauucaggcuagaa

SEQ ID NO: 4232129 - RNA, 117 nt, Human
guguguuuuuccgacagugguuaauaauuauauuggugauguagcagcaauuguguuggcaggguuuucauauauuauuaguaauuaacacuaacuguuggacugacuuguguacac

SEQ ID NO: 4232130 - RNA, 79 nt, Human
ucagcuacuuaaaaagaugucauacacauuaagagggacagaacuugcuuuagaugcuguauguuauuucuguaaauga

SEQ ID NO: 4232131 - RNA, 85 nt, Human
aaggucagauuuaauaaaaaaugcaucugguguguguaccagaaaaacacaggaguuggauggauuuuuuauuaaaucaggccuu

SEQ ID NO: 4232132 - RNA, 127 nt, Human
uucuaacuggaaaauggaaugauauuugagaacaguuccuuucauuuuugggcaucugagaagaauuucugugcugagaaauagagagguuaauucaguccgaacagauuccaugaagcauuuggga

SEQ ID NO: 4232133 - RNA, 82 nt, Human
cucaggguuugcuguccaauauucaggguucacuauugggguucagggcuuaauaucuagaaugaagacgcaacacuuuggg

SEQ ID NO: 4232134 - RNA, 81 nt, Human
aaaauagaucauaguugggcuagaaacaacgugggucuuauuguggaucauuuggaaauuuggccuaaggagguuuauuuu

SEQ ID NO: 4232135 - RNA, 84 nt, Human
ggguuggaagggagagggagaaggugggaccucagcugggcugguuucuggccuaggucuuuuucccugguuccuuuuuggcuc

SEQ ID NO: 4232136 - RNA, 77 nt, Human
gccagcuuuugauuuuguuuauagugccguggggauccacugcagccuguggcaucacagacaaggcagcaucuggc

SEQ ID NO: 4232137 - RNA, 66 nt, Human
gccaggcacaaugagcgccaucuuuuccugcugcaagaaugagguuuggguucauugcuggcuggu

SEQ ID NO: 4232138 - RNA, 55 nt, Human
uucuguuuaaccuggaaagugugauuauauucguuaccuucuuugguagacggaa

SEQ ID NO: 4232139 - RNA, 56 nt, Human
uucauagggagcaucuaccuauuuauuauuaccacauaggugaugugacucuagaa

SEQ ID NO: 4232140 - RNA, 79 nt, Human
guguaccuauuuuucugcauuuguauuggaaaagguuucuuuuaagacauuuuccaaaaguggagaggaauaugugugu

SEQ ID NO: 4232141 - RNA, 57 nt, Human
ggcugaugacgccugagucugaaccauuaggaaggacgggcucugcauccaucagcc

SEQ ID NO: 4232142 - RNA, 65 nt, Human
cugaauguggucaggaaauuguucagguguaaacaccauagacaccuucuacugacuauggaaag

SEQ ID NO: 4232143 - RNA, 88 nt, Human
aggcaacacagugaguugugugaguaagcagacuaacuggauucgaauucagauccauucuguucacaauuacacacacugcaugucu

SEQ ID NO: 4232144 - RNA, 55 nt, Human
cagagagcguccauccggugccuggugagggcccugcauggcuggcugcugucug

SEQ ID NO: 4232145 - RNA, 81 nt, Human
uuucccuugcagccauuugcaucuaauuaauacagucuuuuuaaaauccauugcuuuggugaugaaagugcugcgcugaaa

SEQ ID NO: 4232146 - RNA, 63 nt, Human
ugcugaaaauuaugaauuguguuacgaagauaagucugaguagaaucauucauaaacacagua

SEQ ID NO: 4232147 - RNA, 76 nt, Human
ccaugugacaguucgguuuccuguucaaacuauugaggcagcuccagcccagaccagaaggaagccgacaacaugg

SEQ ID NO: 4232148 - RNA, 69 nt, Human
gggggguuagggcaagggguuccucuggauugcagaccacaucgcacagaccccuggcucugacccccu

SEQ ID NO: 4232149 - RNA, 86 nt, Human
uuauuguuguuacuaguuacuauuacuuauuauuauuauauuaauacuuaugauggugaugaugaugaugauaaugacacugauga

SEQ ID NO: 4232150 - RNA, 63 nt, Human
cuuauaagugcaaugaguguggcaaagccuuuagugggcagucaucacuuauucaucaucaag

SEQ ID NO: 4232151 - RNA, 82 nt, Human
aguagcuauuuuagcauaauaaggaaaugcaaauuuaagaaagaaaauuuucauuagcacauuuccuuggugaauagguacu

SEQ ID NO: 4232152 - RNA, 79 nt, Human
gagucuguguuccuggcaccaaacuuagaauuggcuggauauuugagaggccagguuugccagugcuggaaugcagcuu

SEQ ID NO: 4232153 - RNA, 55 nt, Human
uggggagcucagcaccaucagugucacugucagaacugccaugcaggagccucca

SEQ ID NO: 4232154 - RNA, 83 nt, Human
ggauucugauguucuaaugaaaugauggcuccuacgaauuccacuuuugaguggucacuaauuuccuuaaugcacaagagacc

SEQ ID NO: 4232155 - RNA, 75 nt, Human
gggcagccucaaaaucauguuaaagagggaguuuuguuagaggcaucuuuaaugaacaugaaugugagugcucuc

SEQ ID NO: 4232156 - RNA, 103 nt, Human
gauggucagugugugaauuagguaaugacugugguuucuaugggccuugagcuagcucagagccagacacacagcagagcagggagaauauaugcugagaguu

SEQ ID NO: 4232157 - RNA, 118 nt, Human
guuuguuuuuguuucuggcagguagguagaauagagacaguuuaacaauauagucagagauugagaugauauauaguuggguuucauucuacagauacacuucugguuuauugcaagc

SEQ ID NO: 4232158 - RNA, 69 nt, Human
aaggaaggggccuggggcaaggcuagcuaggcuucagcuuucccuugcccuaccccaggccuuuuucuu

SEQ ID NO: 4232159 - RNA, 103 nt, Human
acagugucauuuguuuaggagaaucuacaaugaaaaaauguuuaaauuaaauguuuaggcauuuaaagauguaagacucgcuuaucuggcacauagacauugu

SEQ ID NO: 4232160 - RNA, 98 nt, Human
gugauugauaaucaaguauuuuaaauggauaaucaagauaaucaaguauuuuacauggauauuuuguaugugcguuugggacaggaaauuauuaucac

SEQ ID NO: 4232161 - RNA, 64 nt, Human
ggcagagaggaggccagcgcagcugcgcugcccgucagcuucugcugcucugguuuccucuguc

SEQ ID NO: 4232162 - RNA, 87 nt, Human
cagcacucagaccgcaggcuggcucccugaagguucaccucacagcggcucuccuggaucuucagccagcaggugcccuuggugcug

SEQ ID NO: 4232163 - RNA, 74 nt, Human
guucuguaagaugggaggaugaauuggaccuuccuccuagggugaggcuuagaugaguucccacaucucaggac

SEQ ID NO: 4232164 - RNA, 77 nt, Human
ggaacagaugcugcuuguguugcucagagucacggaaucuguacugaagaugccaucacaagcuuuucuacaguucc

SEQ ID NO: 4232165 - RNA, 67 nt, Human
cccagaccagagugccuggacgccccccacucccacucaacaugguucccacacacuggucucuggg

SEQ ID NO: 4232166 - RNA, 104 nt, Human
caccuguguugaauuuaacuugaaggugggaggauuuauauuucugcuuguuuuccugagcuaauauuuaaguuacuucucuuuccuugagucccuaccaggug

SEQ ID NO: 4232167 - RNA, 59 nt, Human
ucuggguauuauauaaccauugguucuguuuggcauaacccuauuaaauggugcgcaga

SEQ ID NO: 4232168 - RNA, 67 nt, Human
uccugcugaagcuagguucaugaggucggaaauccccaccacauuugccuagacuuugggcacagga

SEQ ID NO: 4232169 - RNA, 89 nt, Human
ucugaaucuguggaaugcaguugcgagcauucacaauguccccauuagguauugcaguugcguuugcauuccauuauaacagagacgga

SEQ ID NO: 4232170 - RNA, 74 nt, Human
gggcaucuucucugcugccugccucuuuccaaucuugguucagaucagggaagcaggaaguaugggaagauccc

SEQ ID NO: 4232171 - RNA, 67 nt, Human
cugaauuugccuuauuucauguaaaauuuaugucauucaguuuuugacaaugaguuugaggcaucag

SEQ ID NO: 4232172 - RNA, 62 nt, Human
gccggagccugcuuguugcagcugugggugaggacggcucuagcuaggugagcggcuccggc

SEQ ID NO: 4232173 - RNA, 65 nt, Human
caauuuauuugaagagccauugcacuagccugauguauacugcaaugagcuucuuugauaaaaug

SEQ ID NO: 4232174 - RNA, 82 nt, Human
cuuguuacguggcucaggcugaucuauuaauagaauuccugaccucaagcaguucucuugcuucagccucccacauugcagg

SEQ ID NO: 4232175 - RNA, 56 nt, Human
cucuccaguuauagcugauuugaaacuucccaaugaaucaggagucgcggggagag

SEQ ID NO: 4232176 - RNA, 60 nt, Human
cagccauucuaacacugccagugcagaggggccucagacgcuggaguguagcaguggcug

SEQ ID NO: 4232177 - RNA, 55 nt, Human
guguccaugugggugcucuccugccuuugauucacaggauuauguacauggaugc

SEQ ID NO: 4232178 - RNA, 75 nt, Human
gggcagaaccugggccuaaacaaacaagagccagggcagccagggucucugcguggcugggcccagggcuugccc

SEQ ID NO: 4232179 - RNA, 63 nt, Human
auccaucuacuuugggaguuucucuuccuauuggugagagguuaucugcuaagguagguggau

SEQ ID NO: 4232180 - RNA, 61 nt, Human
uggugguggaggugggggguauuuuaauuucauaauuaaaagcucucuucuucggcuuuca

SEQ ID NO: 4232181 - RNA, 79 nt, Human
cucuuaaguauauccauuugacuggaucauaaaucaguacacugccagugagauagugguauaugcuuauuuguaagag

SEQ ID NO: 4232182 - RNA, 62 nt, Human
aggcagagguagcuggaaccaggaacaaaggacugagucugggguuggguuaacuacugcuu

SEQ ID NO: 4232183 - RNA, 67 nt, Human
gauauacuuagaugaaaaucggaacauguuuuuaaaauagugugugucuacuuucaucucuguuauc

SEQ ID NO: 4232184 - RNA, 64 nt, Human
ugucuauguuucagauauauauauauguguguguguguguguguguauauauggaauauugaua

SEQ ID NO: 4232185 - RNA, 68 nt, Human
cuuggggaugccccuacgggcuaccaggguugaacgcacaggcauggucacgucgggguauugccaag

SEQ ID NO: 4232186 - RNA, 105 nt, Human
ucuguuucacucuugcgucacacccagcuacuaccuguagacaaagccuucuaugaagcaggcauugcugccaaggugagcugggacaaggaaggguggggcaga

SEQ ID NO: 4232187 - RNA, 90 nt, Human
agcuuuauucagucaauacagauggcaugugaagauguaauaugcuuuuuuacauuuucauauggguuauuuguaaauaacuauauugcu

SEQ ID NO: 4232188 - RNA, 106 nt, Human
ugucuacauagcaggaaugaaauagaaguuaauuaaauuauuacugaaugaucaagugagaguauuaaugugaacuuccaauuucuuuacccuauucuagcagaua

SEQ ID NO: 4232189 - RNA, 57 nt, Human
cccugccuuccagcucuggggaggguuggagcccucuugggggcaggagggacaggg

SEQ ID NO: 4232190 - RNA, 82 nt, Human
gggucauggugcuaguuaaaucuucaggggggcaucucaguauauagcuaccuguucaagguauuaauuaucaucaugacuu

SEQ ID NO: 4232191 - RNA, 63 nt, Human
agagaaccauggcauccagguaaccaguuccaacuuuuccuaccauugauuuuaugguuuucu

SEQ ID NO: 4232192 - RNA, 75 nt, Human
aagggggguggccaaggcagagaaagagcccgacaggccaggagccggcuuuucucccugcuuucuuccucccuu

SEQ ID NO: 4232193 - RNA, 67 nt, Human
cagccugugacucugugaaaccauguucagacuccauccucucaugucacuuguggucacuaggcug

SEQ ID NO: 4232194 - RNA, 75 nt, Human
auuacuguccguccugggcuugcucuuuccauucugagaugggaauggaaaaauccacagggaacaauugguaau

SEQ ID NO: 4232195 - RNA, 80 nt, Human
ucuccagagaggggucccggcucagcgagggaaagaggccgccgcuggggggacggcuggccggggccccucccuggaga

SEQ ID NO: 4232196 - RNA, 56 nt, Human
gugaccuggccgccuaaacccagggcagugccugauuauaaguggacacaggucac

SEQ ID NO: 4232197 - RNA, 74 nt, Human
uacuaacaguauuuggacugccuguucauuccuggagacaaaaaugaaaaucugucaguucaaguucuugggua

SEQ ID NO: 4232198 - RNA, 76 nt, Human
uugcucugucacccaggcuggagugcaauggcacgaucucagcucagugcaaccuccgccuacugggcucaagcaa

SEQ ID NO: 4232199 - RNA, 85 nt, Human
ggaagaggaagaggagccagagcaaaagccuugucugaaaccuacucugaggcccaucagcucugcuccaucuguuuccucugcc

SEQ ID NO: 4232200 - RNA, 76 nt, Human
ggagaagccgaagcgcaaggugucagcagguuucgucucuucugaggccucucuccuuggcuugcagauggccucc

SEQ ID NO: 4232201 - RNA, 57 nt, Human
gacauuuauuggauuuuacgagcuaguggaucugacucagaaagccgaucagauguu

SEQ ID NO: 4232202 - RNA, 88 nt, Human
aggguauuggaaucucaggaccauuuaucagaagagacaccucguggcagccauggugcuucgauagguguccauagccccaagcccu

SEQ ID NO: 4232203 - RNA, 77 nt, Human
ccuggcccaucuuccagagaugcagugggugcaguauguaaaacucaaccaucugcauuuuugaaaagugccccagg

SEQ ID NO: 4232204 - RNA, 81 nt, Human
guuuuaaaaugaugagccagcauauauauaguugaauacauguaaaaaugagaguucagcauaggcugcucuucaaugaac

SEQ ID NO: 4232205 - RNA, 57 nt, Human
auugaguacuugcugggcucucaagauucaugcuuugagcacaggcagucauucagu

SEQ ID NO: 4232206 - RNA, 67 nt, Human
acugacuucugguauuuuuaguacuaaagauguuauuauuuaguacuuugaggagaagaaugucagu

SEQ ID NO: 4232207 - RNA, 59 nt, Human
cuccaacugccacuguacuggacuguaauuuauaaauccaguagcuacgcaggguggag

SEQ ID NO: 4232208 - RNA, 85 nt, Human
cauccagaggguguccagcacacagguggcucucacaacagcuguggacuguaauguguguggaccguaagcugcugacuggaug

SEQ ID NO: 4232209 - RNA, 65 nt, Human
gugcaggggaaggaaggggagggcacgggcccuucgcgccucugaccccccuugccuccacucgc

SEQ ID NO: 4232210 - RNA, 83 nt, Human
caagugcuucauguuaucugaugcaggcucccaggaucccauucccgguuccugguaaagaguaucagauuggcccagccuug

SEQ ID NO: 4232211 - RNA, 96 nt, Human
ucuaaaauguucuauaaaaggucagacagggugucuuucucugauuccaucaggccucugggaagaaccucugcuaccaauuaugugcuacuugga

SEQ ID NO: 4232212 - RNA, 55 nt, Human
guaaauuaugucugggucaguucagauaacucucaauuauccggacuuaauuuau

SEQ ID NO: 4232213 - RNA, 61 nt, Human
ccuaagaaggaggaaaagugccaaauuagugucucuaugacuggcaugcucucuuuuuagg

SEQ ID NO: 4232214 - RNA, 92 nt, Human
ccuggcacguuuucuggguauagcaagagaaccauuaccauuacuaaacucaguaaugguaacgguuuccuugccauucccaagugcccugg

SEQ ID NO: 4232215 - RNA, 68 nt, Human
aaagcagagaggagcacaaagugaaguuaauuugguuggcuugcuuuaucugguuucucauuuucuuu

SEQ ID NO: 4232216 - RNA, 60 nt, Human
uucagaagguaggaaugucccucuugauagggcugaaucaagggauuccuggcuuuagaa

SEQ ID NO: 4232217 - RNA, 90 nt, Human
acaauaaaagauuuuguuaagugguauaaaaauuugugaauguugaaauucaacaugcuucauauuauaaccaaccugcaagaauauugu

SEQ ID NO: 4232218 - RNA, 57 nt, Human
ggguaugugguaccaugcaacggggggaaugccuccccugcauggcaccacauuccc

SEQ ID NO: 4232219 - RNA, 85 nt, Human
cgagaaugagacgagagaacccauuuccacaaccauuuuaaucugcgcaucggucccagacguagggauuccucgucucaucuug

SEQ ID NO: 4232220 - RNA, 73 nt, Human
ggggcacaggaagccgagggaggugauggagacggcgaagggugcucugguccucccucggcgccugcguccc

SEQ ID NO: 4232221 - RNA, 55 nt, Human
caggauauguucaagguuuucugcacuguaggcacagucucucaagcauauccug

SEQ ID NO: 4232222 - RNA, 58 nt, Human
agcccuucccuuucacuggugcccggcacuucagcugcaucaagaucaauggagggcu

SEQ ID NO: 4232223 - RNA, 64 nt, Human
guagugauuguuccucagggguuaugcuuuacacagcucggauuuccuaaaagauaaucauuac

SEQ ID NO: 4232224 - RNA, 90 nt, Human
ccaaguuugcuggagccauguuuucucuaauguccccacagaacagugguugguaggauggcggagacauggacuucagagaguucuugg

SEQ ID NO: 4232225 - RNA, 56 nt, Human
cugcuacgguguccgguggggcagggcgaggucgaugcccgauggagacuuagcag

SEQ ID NO: 4232226 - RNA, 70 nt, Human
ggggcuuccagcgcccgccgguggccgggacccacuaaagcccccgcagccgaggagugcggggagcccc

SEQ ID NO: 4232227 - RNA, 72 nt, Human
uuugaagaagaaugguuugaaagauuuuuuguguguuuaacaucuuaaguccaaaacauuucucugcucaaa

SEQ ID NO: 4232228 - RNA, 83 nt, Human
auguuaacuuuccaacuuaauugggaagauuaguuuucuaggacuaguuuucaagugaguuggaaggugaccuaauauagcgu

SEQ ID NO: 4232229 - RNA, 83 nt, Human
uuuguuccuaugccaccagucuggaacucucuguacuuauccucaaggagagugagauaugugguugguacuugggggacaga

SEQ ID NO: 4232230 - RNA, 55 nt, Human
gaugguggggggcagcugggaggggaauugcucuucucuuuaugagaccacuguc

SEQ ID NO: 4232231 - RNA, 74 nt, Human
ggagaggcugagcaguccggguucgcuguccgccacuucggcgcggaaucagagcaggacuugcugagcccucc

SEQ ID NO: 4232232 - RNA, 62 nt, Human
uggaacugguuugcuucagacuucaaaaccacuugugacaucuguggcaaacacagugacca

SEQ ID NO: 4232233 - RNA, 78 nt, Human
uuguugcuuuacaugugugucugugugugugucugcaugugugcacgcauguacuuguaugcaauguaaaaguaacag

SEQ ID NO: 4232234 - RNA, 76 nt, Human
gggcaucugggagcuagauucaauaaagcuguucugaccaugaacuuggaacuggccccuuucauucuggaagccc

SEQ ID NO: 4232235 - RNA, 73 nt, Human
augaaaccauucauucugaccucaagagaaccuucugaguguuuuuguggggggcggugugaaacagguucau

SEQ ID NO: 4232236 - RNA, 82 nt, Human
guggcugauggagagugugauuugggcguaggucuuauuugcaaaccugcucauguucuaagcuuucuucagguaguaccac

SEQ ID NO: 4232237 - RNA, 62 nt, Human
ccauauuuggcgucucucaggagcucaggaaguacuuggcugagugaacauguccauugugg

SEQ ID NO: 4232238 - RNA, 58 nt, Human
uaauuuugucacagugacaugcccugucacagggcguauguguucuguuauacaguug

SEQ ID NO: 4232239 - RNA, 88 nt, Human
cuuucagauacccccuaguuaugccagaagugcagagugcauuuauguuucugaauccuccuugcuggucugguguaauuccugaaag

SEQ ID NO: 4232240 - RNA, 85 nt, Human
ccuaguguccccugcugugcuugcauggcucacuguuguaccuucagcaucuagcacagugcugggcacacaguaggugcucagg

SEQ ID NO: 4232241 - RNA, 82 nt, Human
gcucgugaguauagcaauucagagcauggacuuuggagccaaacucaacggaguucaaaucuggaccuugcuacuuacuagc

SEQ ID NO: 4232242 - RNA, 86 nt, Human
agacagugugaccucucccucauaugguugcuuaucuccucuugugaguggaaaaguauuaugugaggguucccuuggcacugucu

SEQ ID NO: 4232243 - RNA, 88 nt, Human
gcugaguguugggagagaagcugaggcagggcuugcauguuugcuagacuugcugcuccuugcuucuagcauucccauguucucaagu

SEQ ID NO: 4232244 - RNA, 82 nt, Human
gggguauguguggcaggaacagaauugggguucuuggggagguuuuuuuccacuuaaaacucuuuuugucgccuacgucucc

SEQ ID NO: 4232245 - RNA, 76 nt, Human
agaauugccagccuauucaucugaucuugaaaguguacaaacuuaccuucaaacaguguagaauauaugcaauucu

SEQ ID NO: 4232246 - RNA, 83 nt, Human
ggucuggggacagacagagucuucccaucagucuuccagaacagggaggagauggcugggagcucuguuugguaccaacaacc

SEQ ID NO: 4232247 - RNA, 120 nt, Human
ggcuaucacucaccuucaacuuugacaaaauacucccuuuucuaauuuagccuguucuuucccagcaacagguucaucuuggaagcaggcaggauacagaguaauagaggggguuucgcc

SEQ ID NO: 4232248 - RNA, 64 nt, Human
cucagguuuuggucuggaaucuucaggguccuggggcuccggggguuccagaucauccacugag

SEQ ID NO: 4232249 - RNA, 93 nt, Human
uuuccauucuaauugcagaugaagugcccugggggccagaguccagacaaguauuuuggcaccuccaaggacucgcagaacacagagaggaaa

SEQ ID NO: 4232250 - RNA, 62 nt, Human
aucuucaaagcacaucguuuguacaagagauagacuaagaacaaaaauguguuuauggagau

SEQ ID NO: 4232251 - RNA, 60 nt, Human
guucccucugccugcaguccugcuuuguuuuggacaaguaggagugacaagcaggucagc

SEQ ID NO: 4232252 - RNA, 65 nt, Human
uuugugagcauauaugcaugagugugcacuguguuaggguguguguguguguaugugcgugugag

SEQ ID NO: 4232253 - RNA, 88 nt, Human
ucacccgggguucguguuaaaugcagauucugacucagcaggucugaguggguccaggauucuguguuucucauauguuccuggguga

SEQ ID NO: 4232254 - RNA, 72 nt, Human
gcugcugcuggcuuccugcuguuuugaggccucugaugcuggaagaacaggaggaagccagcuccccacagc

SEQ ID NO: 4232255 - RNA, 68 nt, Human
uagagaagggggacaagcauuggcuuagggguccugagugccagugcuugcucuacccugaacuucug

SEQ ID NO: 4232256 - RNA, 77 nt, Human
cuuaaguguguuuugugugugugcccacacguagacaaauguguacggugcacacacacagugcaucauuuuuuaag

SEQ ID NO: 4232257 - RNA, 90 nt, Human
cuuugguggugagggugugaaaugagggggugcacguggagggaaaaaagggacuccccucccucuuggcuucuaucccaccaacccggg

SEQ ID NO: 4232258 - RNA, 74 nt, Human
uggggggacaugguguggcacuaggggcucgaagacugguuucuagcacuaccggucacggccaugucguccua

SEQ ID NO: 4232259 - RNA, 72 nt, Human
uccuaacugaucauugaacaucgaguuaaaguguuuagaauuuugauuggguauaaugacaggaauucagga

SEQ ID NO: 4232260 - RNA, 65 nt, Human
gugucuuauugauguuggcacucccuaacauguacauaggauaguguucagcauguaguaaauac

SEQ ID NO: 4232261 - RNA, 112 nt, Human
auagcauauggugaacuuugagacacgauguuuuaagccccuaauuugguucauuggccagaaauauucaggugguuuaagaauuggaucuugaaaggaaugcuaauguuau

SEQ ID NO: 4232262 - RNA, 74 nt, Human
ucgccucuuugaagaccuuaucucuaaauagcacuacagucugugcuacuggggauugguucuucaacauguga

SEQ ID NO: 4232263 - RNA, 78 nt, Human
ggaccugcucgcuguccgcucgggugcagagggcagaccccggucucuccuccacaccgggugcuggcgggcgggucc

SEQ ID NO: 4232264 - RNA, 60 nt, Human
cccaucccugagucacaggagggcucugugucaguguccagcugugcuccaggagguggg

SEQ ID NO: 4232265 - RNA, 65 nt, Human
acuuaacaguggucugugguaucugaggaaacuuuagaugaacagaaagccacuguuuuaugagu

SEQ ID NO: 4232266 - RNA, 117 nt, Human
auaguuuacuucuagguauuuuuauucguuucucuugcuauugcgaacagguuuuuuauuauuaaaauuucaaaaugcuuauugcuuauagauaggaaaacugccuauauaaacuau

SEQ ID NO: 4232267 - RNA, 109 nt, Human
ucuggaaaaagguguuacugcauccauacauguuagcaguagccuucaagguuucaccuaggguuccugaaaaguaugucacccuugguauguuacgccuuuuuccagg

SEQ ID NO: 4232268 - RNA, 62 nt, Human
ugaagguggcuugcagcuagucccaaaauaaauacguugaaugauagcagaagucauuuuca

SEQ ID NO: 4232269 - RNA, 59 nt, Human
caaggcuaagcuuuggcuuucuuugggauguaccuuaacgagguaaucaauuggucuug

SEQ ID NO: 4232270 - RNA, 70 nt, Human
gggagaaaaggcgaggggcacagcugagauccauuuucaauaucugaguaauacucuugccuuggcuccu

SEQ ID NO: 4232271 - RNA, 110 nt, Human
uucucaugcacugucccuucaguccagggggccggggcucaggagccaugaccuggugucuccugcccacccuggucccagguaaaugugaauggagacaggcaugagag

SEQ ID NO: 4232272 - RNA, 94 nt, Human
cucuuuugcaaaacaaaagaugucuucuuuucccuuagcccuugguuuuguuuggcagaugguguaggugaagagaacauuaguuguggaagag

SEQ ID NO: 4232273 - RNA, 74 nt, Human
uccacugugcauuauaacaauaaggcuuacuuuuaauacaaagacuaagcguuugggaguuaugaaccacugga

SEQ ID NO: 4232274 - RNA, 60 nt, Human
gccaaccagucgguccaggaagacccccggaugauggccuucuuugacucacugguacgc

SEQ ID NO: 4232275 - RNA, 84 nt, Human
ucugggcugaugaauacauuuaccuaagaaacucauuucguuuuacuuaagaggggaagugcaguuuucuuuuggcaguucaga

SEQ ID NO: 4232276 - RNA, 74 nt, Human
uuguaguguaaugcuuuuauuucggggaaauaaguuccuugaguuuccuuuaaccaagagcaguacuuaagcaa

SEQ ID NO: 4232277 - RNA, 64 nt, Human
uguuucagauuuguuuuuguuucuguucuaacucuaagcagacagagcucacaagucuuuggca

SEQ ID NO: 4232278 - RNA, 60 nt, Human
gcagguggccggguaggagguggagccacugcggugaccacuccucccaggccacccugc

SEQ ID NO: 4232279 - RNA, 129 nt, Human
gcguggacaaggugguaugugcagcaggggaauagacugcuuggauuuccaaaugguuucuggggaagaugaccauccagaaguccagcuuagugcagucugcucuggaauucacacccacccccucgc

SEQ ID NO: 4232280 - RNA, 61 nt, Human
aguguuaggaauuaauguagggcacccucuuauugggaaugucacuguaauugccuacauu

SEQ ID NO: 4232281 - RNA, 75 nt, Human
ggcgucaaaguauuuagcugacucgcuacacuccacggaagcaauaugaagugaucugcugcagugcucugagcc

SEQ ID NO: 4232282 - RNA, 69 nt, Human
gagagagcaggcuggcagggccagggacagucuucagaggccccuggcucaggcagcuuuguuucuguc

SEQ ID NO: 4232283 - RNA, 57 nt, Human
ucagagcuuuggaguaaguuuugauaugaaaucgaaugccaacaccgaaguuuuaga

SEQ ID NO: 4232284 - RNA, 68 nt, Human
uugagaacagccacuaugacagauuuagagcccuuuugcccuaaacuucauauguugcuuuaauucaa

SEQ ID NO: 4232285 - RNA, 101 nt, Human
ggauuccgaggcccaagcccacgccuuuauauuacauuuggaagcugaauuuguuuaccuuauguaaauaagaguaacuguugggauuggaagcuuuuucc

SEQ ID NO: 4232286 - RNA, 64 nt, Human
aucuuuggucaauuuggucaaucguuuaagaaacauucuggaugcuccaaguagaccuuaagau

SEQ ID NO: 4232287 - RNA, 63 nt, Human
gaacaggguaagggagggugagugcgacucugaguuuauugcuuaaccagccccuucccuuuc

SEQ ID NO: 4232288 - RNA, 77 nt, Human
gccuggacgggugcuuguucccgcugcuuccggcuauggcugagagccuggccugggcaggcacaugccacaaaggc

SEQ ID NO: 4232289 - RNA, 128 nt, Human
acggauuguggcucaccuaagcagggaagccgauuuggaacuuaaacaagcucccaaguugugaucagucgagcuuggcaagcacuguuugagagaguagguguccugcaagcaggagccgguuuugu

SEQ ID NO: 4232290 - RNA, 66 nt, Human
ccggcgcagcuucagggccaggagggcggccccgugcacguccccaugaacuuguggcugcuccgg

SEQ ID NO: 4232291 - RNA, 61 nt, Human
gugucagugguucagggccgggggucuccccaaccacggccccggcaccuccgcugcacac

SEQ ID NO: 4232292 - RNA, 66 nt, Human
uaaagaagaaaaggcuucaggcgguaguacaacauuuaacauguccucauagccuuuccuacuuua

SEQ ID NO: 4232293 - RNA, 87 nt, Human
cuuuccuuccccccaucuccaagucuguaagcaguuggacaaggcuauuuagaaaggcuuggagagacacccuagggggauugaagg

SEQ ID NO: 4232294 - RNA, 57 nt, Human
cuguccccauugcugucccuggaguacgggcagcacaggugaaggcgagggggacag

SEQ ID NO: 4232295 - RNA, 99 nt, Human
augaccuucagucacugccucuuugcucuuugguuguugacuuugucggcagggaauucagagggaaggagagucagcgacgugcucucguaaggucau

SEQ ID NO: 4232296 - RNA, 58 nt, Human
guagaucucugccuuguucagaguucuguggaauucuggccagggaagaggggucaac

SEQ ID NO: 4232297 - RNA, 84 nt, Human
ucagaguggggcccugcaggccaggcaagggcuucaaaguuugugcugagagagcccaggagcaggggcaggguuuugugcugg

SEQ ID NO: 4232298 - RNA, 92 nt, Human
gcauuauuucagauuugguacacaaagugagacuugauaaucuuagguugcagguuuucagauguguguugcuccaaauuugcaugaaaugc

SEQ ID NO: 4232299 - RNA, 68 nt, Human
ucacauggacacugguggauauggaauggcuuuuuucugcgcaauucacauccgaccaggucaaguga

SEQ ID NO: 4232300 - RNA, 82 nt, Human
ucugagcaaagcgcaugaggccuaauacccauuccugguugugauacaaaagcuaggagguaucuggucuccuuuuuuaaga

SEQ ID NO: 4232301 - RNA, 70 nt, Human
ggaagauagaaguucaaaaguuaucggugcaaaaggagugauacacaaaagacuucaauuucuaucuuuu

SEQ ID NO: 4232302 - RNA, 129 nt, Human
ggauauuuuggcuguaccuacuacuaaagucauuagucuuuaauacauaauacauauuugaaaaguaaacauauuauauagauuaugugagggacuuaaucaugaaaccaguuucacaguccaaguacc

SEQ ID NO: 4232303 - RNA, 63 nt, Human
cuuucagaagguacugaagacauggaauuucugagggccaguuuuuccagugcuuucugugag

SEQ ID NO: 4232304 - RNA, 65 nt, Human
ucggccggagggggcgggcgcaacgacgcgcgcugcgucccggcgcucggcuuucccuccgccgg

SEQ ID NO: 4232305 - RNA, 60 nt, Human
auuguauuguuugcgucuguguucccagugccugugagcacagugccugacauauauggu

SEQ ID NO: 4232306 - RNA, 64 nt, Human
uccugaagcuccaggaugccugcacuuccacugagaagcugcuggcggauguuggacuagagga

SEQ ID NO: 4232307 - RNA, 114 nt, Human
guguguuguguucuaaaacuugaugaggugguaauuggcauuccagaugcuuuucucagauacuaaucuaugcuagaugaguaaauggagucuucccucuaggacagaauaugc

SEQ ID NO: 4232308 - RNA, 92 nt, Human
uguaacaucucaugaccugcagguguuuccacacuuccuuccccuugcucaggagguguaauuacucuugcaguuugccugugaauuguaca

SEQ ID NO: 4232309 - RNA, 70 nt, Human
auuuuuauugauuucgcucuucacacagugcugacgguguaggccugcugaagagcaagcugaugaaaau

SEQ ID NO: 4232310 - RNA, 74 nt, Human
aaagguggaagauauuucugguccagucgcuagcuuuaauuaguuauuucuaaaccaauauauuuucuuccuuu

SEQ ID NO: 4232311 - RNA, 75 nt, Human
acacaggacacaaaagucaccauuuaaacuauuuuaaaguguccaauuugguggcuuuucguagguucacagugu

SEQ ID NO: 4232312 - RNA, 94 nt, Human
ggccgccggcagugaggcuuugggaggaugaggcgguaccggcacgacccccguaccugcucucccucucgcagucuagcaaccgccuuuggcc

SEQ ID NO: 4232313 - RNA, 87 nt, Human
guaaaauuaauaugaagaacuagauagugguguaaacaaaugugauaauguuuauuuacuuucgguucugcucauacuuuuuuguac

SEQ ID NO: 4232314 - RNA, 67 nt, Human
ucuggcugcuggaguugggucucuccucauguuugggcgacugagggcucaacuacuacuaggcaga

SEQ ID NO: 4232315 - RNA, 75 nt, Human
ugaugaggaagucaggggaucuagacuugaauaaacuccauuaauucaagucucucuucaaacgucaccucuuca

SEQ ID NO: 4232316 - RNA, 76 nt, Human
ucaggaggaaaguuccacucaacuugcuauuucucaucuagcucggcaguguugagaggccuggcucuuuuccuga

SEQ ID NO: 4232317 - RNA, 81 nt, Human
agugucgccggaggcccuggggcgcaggcccagcgggcugucgcacagcucggcuguccugugccccuuccugacgaggcu

SEQ ID NO: 4232318 - RNA, 71 nt, Human
uggggucccaaguguuuggcgaggagagguuuuggggacaccucucuucggagagaccuuuggaggcccca

SEQ ID NO: 4232319 - RNA, 71 nt, Human
agaggccauguggcccgggcugcaggaaagcaucucacccucaguccugcacuccgagggcacgugucucu

SEQ ID NO: 4232320 - RNA, 120 nt, Human
uuuuuuuguagagggagguggacgggggaggagacagcggugcaauaaauggucggagaacugacugaccaauguucaaccuugacugccccucauucggcuuccagaggcacagagaga

SEQ ID NO: 4232321 - RNA, 56 nt, Human
gcuugggcugaaggccugggucucuguguugcuggcacaggcuuacagcagcaggc

SEQ ID NO: 4232322 - RNA, 73 nt, Human
agacccuccucagggauuaaggucaaaggugggaggaagaaggcuuccauuggccuuuuauccuagagguucu

SEQ ID NO: 4232323 - RNA, 62 nt, Human
agcagucagaucguggggaaaagccuugucuaauggcuagccuuccucaaaagucugaugcu

SEQ ID NO: 4232324 - RNA, 74 nt, Human
cagcuggauaaggaucaguuucuuucacuuugggucaugggcccuccaagaaugaaaugauacuuuauucacug

SEQ ID NO: 4232325 - RNA, 63 nt, Human
ggcuuaguagggacagaugcacacccaaggcugccuggccucaaagucuguuccuuuaauguc

SEQ ID NO: 4232326 - RNA, 66 nt, Human
ccaaagaauuuggaaaaucugauggugugagcagcagccguuaguaucaggguuucccauucuugg

SEQ ID NO: 4232327 - RNA, 59 nt, Human
aaaagguuauagcuuugccuugagauugacucauuaaaaucagagacuguaacacuuuu

SEQ ID NO: 4232328 - RNA, 58 nt, Human
ccagagcaccgaaacgagcuuuacgccucucuucugagcuuugucccaagugcucugg

SEQ ID NO: 4232329 - RNA, 76 nt, Human
ugaaaccaugcacuuuguaaucaauaagucuuuuguuuaacauuucaaaaggauauuuggugcaaagcaauuuuca

SEQ ID NO: 4232330 - RNA, 114 nt, Human
ugugaacgguacauuuauuguuggggagaguggauuguuuacaucaugucuggacuuuugucuaguuggguagacaguucuacaccagcagcccccuuaauaaagaagucuaca

SEQ ID NO: 4232331 - RNA, 62 nt, Human
caguggagaccugccugcuggaugccacguugaacuggaccccagcagucagcucuccaaug

SEQ ID NO: 4232332 - RNA, 55 nt, Human
ccuuuuaucgcgaagaacuccaguuguaacuuuugagaguuuuuuuggcaaaagg

SEQ ID NO: 4232333 - RNA, 57 nt, Human
ggcggcccaggugcuccaggcgacaccguccgugagcgccggggcauaggggccguc

SEQ ID NO: 4232334 - RNA, 58 nt, Human
uuguagccaugucacaagcacagaugagcuggaucugucacugcggaguggccugcag

SEQ ID NO: 4232335 - RNA, 59 nt, Human
aggcguggcuucugcuggguuggagccauucuuauuugacccagaauggagccaagccu

SEQ ID NO: 4232336 - RNA, 77 nt, Human
guguaucagaggcuguguuauaaucuugcaacgcuuguucaauuguauuuugcuugaauuggcaugcuuugauacau

SEQ ID NO: 4232337 - RNA, 66 nt, Human
cauuugggguuuuuuggugaaaucagagauagcucaggauuucauaaaacgagaaacuccaaacug

SEQ ID NO: 4232338 - RNA, 84 nt, Human
uguguaguauguauucuuuucucuaaaugaugaaaugcuaaagaaucauuucacguuguugaagaaaauaccguugcuacaaca

SEQ ID NO: 4232339 - RNA, 55 nt, Human
acagacuugaccuuggagaggccagagaagccuucucugaggacagaaaguuugu

SEQ ID NO: 4232340 - RNA, 66 nt, Human
ugcaucaaugggucaaagagaagguaugcagaauuaaugaaaucaucuaaaauuggcucagaugca

SEQ ID NO: 4232341 - RNA, 130 nt, Human
ccuucaaggucuaacuuccaagauucugugaguacgauucuagggagccucugccucagacuucuaaguaguucuucaggcugugcucuagaaguuacuggaaugaaagaaaaauuguaguguuugaagg

SEQ ID NO: 4232342 - RNA, 78 nt, Human
uucagugggaaggggagcuggaaaggagauguggcugguaaguaauccuccucugaaguucacccaucuccagcugga

SEQ ID NO: 4232343 - RNA, 70 nt, Human
guacuuuggguuaguuuuccaaucuuuggucuucuuuaaaggggagagagugggagauuuccagcagugc

SEQ ID NO: 4232344 - RNA, 67 nt, Human
cuaucgacauucucugauuggugccucccugaacucacggacaaaaaucaggguaaugaugagguag

SEQ ID NO: 4232345 - RNA, 81 nt, Human
cuucuggcaccaggacucagcgucugucucccgcccagccacguuggccgggagcagcucuggggcuggggcgcgcagaag

SEQ ID NO: 4232346 - RNA, 66 nt, Human
acucaaacuuuuuguggacauucuuuucaaaauuuuuuaagaacccuguacuauaaaagguugagu

SEQ ID NO: 4232347 - RNA, 70 nt, Human
gccuguccucuuccgccugucuguccuuuguguccaggaauuccccagacaguggggaaggaggagaggc

SEQ ID NO: 4232348 - RNA, 55 nt, Human
aacaggcuaaauuguccauuucuccagcaguuuugaggcagacaaggagucuguu

SEQ ID NO: 4232349 - RNA, 73 nt, Human
gggagagaaagggagaaaaagaucuucuugguacuauuaagcuuuuaaaggacauuugcuuuuuuucuuuucc

SEQ ID NO: 4232350 - RNA, 69 nt, Human
aaagcagucuguuuuaaccugaaauaauucuguugauauuugaaucacuuucagugggacauuugcuuu

SEQ ID NO: 4232351 - RNA, 67 nt, Human
guuccuuggaagacagccgucuuuauuucuuagugcugggaaauucaggacaaauguuuucaagaau

SEQ ID NO: 4232352 - RNA, 78 nt, Human
cccagguuuagguggacgugcaggcuagcuggcucccaggugccauggccaguccuguggucccugucugugccuggg

SEQ ID NO: 4232353 - RNA, 103 nt, Human
cugcagcuggcgaaccugggagcuggcgcgcagccugcuggugcugcgcuucugcgccuggcccgcgcugcuggcgcgccacgagcaggugcgcggggugcag

SEQ ID NO: 4232354 - RNA, 76 nt, Human
uuggggggugcugcaggaggugguagggucuccuugcugggagacccugauucugcuggcgguguaaacuugcuga

SEQ ID NO: 4232355 - RNA, 56 nt, Human
auauguuuuaguagaaucccaaugcuuaggcauccuggcauacugcuaaaaagugu

SEQ ID NO: 4232356 - RNA, 73 nt, Human
ggaaucuucaggggcaauggagauaugacccagagagacuuuguuuaaugucuucauuccccaugaagucuuc

SEQ ID NO: 4232357 - RNA, 63 nt, Human
gagguagcgugcagggcccgaagugcgcuguuucguaagguacccucccugcacccuacucuc

SEQ ID NO: 4232358 - RNA, 71 nt, Human
acugcuuauaugggcauacaaaugcuacccuauuuuaaauguagguggcguauguguucguguuuuaaugu

SEQ ID NO: 4232359 - RNA, 90 nt, Human
ggacaaaggaaauaucuuguuuuugauuucuuggaagaggaagcacucugggcaagagguaugagccgggaugaaguggacuccuugucu

SEQ ID NO: 4232360 - RNA, 72 nt, Human
gcaguuugugauguggcagucacucuuuccaacaauacuaagaauuagucuuuguccacacacaccaacugc

SEQ ID NO: 4232361 - RNA, 80 nt, Human
cucacugucagcugcagggcuuggggcucugccuagaaucagaaauuugagccaaacugggacccucagauggcagugag

SEQ ID NO: 4232362 - RNA, 130 nt, Human
cacaaagcugaaguagggauugcucugccuaaauuaugcagcugccuccaagguuuccaauagagcauugauguagccuggcagggagauuguaagaaggcaagaacaacuguucugguuagaacuaaug

SEQ ID NO: 4232363 - RNA, 79 nt, Human
gccgccgccgccgugucuggucuguacgucuuuagagggucgaggaagucacgucgggacagacuggggcgaguaaggu

SEQ ID NO: 4232364 - RNA, 99 nt, Human
agguuguggcauacugaaggggcuuggccaugagaaucuuugcugugucauaggggcacugccuugcaccauggcuuuugcucaaaucaagccaaaccu

SEQ ID NO: 4232365 - RNA, 71 nt, Human
acaugggggugggacggcagagagggaccccaugucucuucuaaucacccgccgccccccgcgcccugugu

SEQ ID NO: 4232366 - RNA, 55 nt, Human
auuccagggaaauggggauggaggugccccaggcaugauccccagucccuggaau

SEQ ID NO: 4232367 - RNA, 72 nt, Human
uauaaucauaaguuauuuugucuuguucaugaaguccuuuuuuuaugucaaaaguaaaaugaagggauugug

SEQ ID NO: 4232368 - RNA, 77 nt, Human
gaauucucacaaugaacuuugaagauggugaauucugaauaccaucagcauucugcuuuaaagcucauguuuuauuc

SEQ ID NO: 4232369 - RNA, 56 nt, Human
auaaaacagaucaggagaaugaagagggaaugcuuugguuuuuuguucuguuuugu

SEQ ID NO: 4232370 - RNA, 55 nt, Human
ggcuccuuguaugauauuuugugaucuguacauggcagaguauagauuaggagcc

SEQ ID NO: 4232371 - RNA, 129 nt, Human
gaguuaauucuuauguuugaugauaaaucaucuuugaguuauuaaauauuuuggugauugcuuagauacaagaauugccaagaauuagugauacauuuuugauguuuauuuucagaugauuuaaccuuc

SEQ ID NO: 4232372 - RNA, 85 nt, Human
ccuucuuuucuucccuguuuauuacacccuaagcuuugucuaucagaaagucaucuuauuggagagcaggugaaggaaagaaugg

SEQ ID NO: 4232373 - RNA, 96 nt, Human
acugaaauuugaucagggaucucaaagauaugcugguaaauuguauagcaauguaauuauuuuaaucagguauuugaguauuucuuaagauacagu

SEQ ID NO: 4232374 - RNA, 127 nt, Human
ugaauuacgaucucuguuugcuuuguagcuugagcuuguuccuaguuguccaucacagaaagcauuagcagaggaugcuguggugcagcgggaacagcuuggguuagagggagagagccuggauuca

SEQ ID NO: 4232375 - RNA, 81 nt, Human
augggccagaaaugugaaagagguguucaguggggaguauacuucuaacuugaauacauucuuuucagcauuucuacuuau

SEQ ID NO: 4232376 - RNA, 63 nt, Human
gugggugucaguaucuuuaacggccuucauucuugguugugagauuuuauuugauaugcccac

SEQ ID NO: 4232377 - RNA, 65 nt, Human
ggguauuucaugagugaauaucuagauguugaaguuggugacugauguuuaucucaagaguuccc

SEQ ID NO: 4232378 - RNA, 74 nt, Human
gaaggaagaagagauaauggggagcaaguacaaggggaaacgagaugaugucuugccccucuuuucuuuccuuc

SEQ ID NO: 4232379 - RNA, 95 nt, Human
gggcuagugucuccuuacugaagggccaggggcaggcuggaaggcaggguccccaguccaguggcaccuuggcccucagcaguaagcaccaguuu

SEQ ID NO: 4232380 - RNA, 61 nt, Human
cucugucuggggaggggagagggugagugcuguaaugccaaaaccccucuuccagacagag

SEQ ID NO: 4232381 - RNA, 95 nt, Human
ucagaauauguuuagauauaaugucuuuguugaaaucugguaaaauguucagaugacuaacauaguauugcugucuucaaggaaauaauguuugg

SEQ ID NO: 4232382 - RNA, 97 nt, Human
gcugaguguuuguguuuaugcaaaggggccucuuccugcauauuuaaucuagaguaaggcaguggcuuuuguuguguuuagcccacauaccuucagu

SEQ ID NO: 4232383 - RNA, 64 nt, Human
gcucuaaaaguuaauucuuguuuuuuauugggaaacucugagagaaacauuaauugaugagggu

SEQ ID NO: 4232384 - RNA, 70 nt, Human
uauuguuguuuacuugagcugcacucuuggugcauaaacccuggagauggucacagguaaacauucagug

SEQ ID NO: 4232385 - RNA, 73 nt, Human
ggucccacagaggaugcccaagcgaucuccaagcccagacuuuguuucgguugccuguggcucccuguuaacc

SEQ ID NO: 4232386 - RNA, 100 nt, Human
uccccauggacuagcuaugagcaggagacacaaccucuucucuuguguguuucagcuucuuuuccugcucuucccaucccuuaaauucuauuccugggga

SEQ ID NO: 4232387 - RNA, 74 nt, Human
gagaagugguagcuccaggcugucugaacccagaacacugaaguucagaauauggcuaggagugcuaugcacuc

SEQ ID NO: 4232388 - RNA, 56 nt, Human
uucguucagcgcuugcgcaugcgaggagguuccgcaugcgcgguggagugagcgaa

SEQ ID NO: 4232389 - RNA, 57 nt, Human
auguguguauguagguauauauguauauuuuauauguaaauauuuauauaugcauau

SEQ ID NO: 4232390 - RNA, 119 nt, Human
acacgugaacacauuuauacauuauacauauaugugcauacaacuauauacaaauuuaggaaaagcaugugcauggugugugugugugugugugugugugugugugugugugugugugu

SEQ ID NO: 4232391 - RNA, 76 nt, Human
gggaaggggaggggaguaucaggauucaggaugaacuuauaugugauucccagguuuucacgauccucccuuuuuu

SEQ ID NO: 4232392 - RNA, 59 nt, Human
uuuguuaggguuucagcuagccaaaaaugguauuuucauuugcugaaauucuaaacaaa

SEQ ID NO: 4232393 - RNA, 61 nt, Human
aggauggauagcaaggaagccgcucccaccugacccucacggccuccguguuaccuguccu

SEQ ID NO: 4232394 - RNA, 81 nt, Human
ggcaucauagagccuccagaggggacaaaaauuuacaaggauuccugggauuuugaaccuuauuuggaaaucuugaaugcu

SEQ ID NO: 4232395 - RNA, 69 nt, Human
gacuaagugaaagaaaacuguuagaacuuaguggucccaaacuuguucacaguauaucuuuuaacuguc

SEQ ID NO: 4232396 - RNA, 76 nt, Human
gcccacccaaaauacagcacucacaccucccuccaccgucagcuaugggaaugauggaaagggaaguagggugggc

SEQ ID NO: 4232397 - RNA, 91 nt, Human
ugagaagauggaaauucauuuacauaacaguaacgcugaaucaauauauuuucagcuugcccugauguggaagaaauauaccaucucauua

SEQ ID NO: 4232398 - RNA, 68 nt, Human
aacugcauaagcuucgggaccucuugauucacugauauuuucugguggacccagggcuuauucauguu

SEQ ID NO: 4232399 - RNA, 68 nt, Human
cccgcugugugugcacacguguaugggcgugacggccuccaccccgcaccgucugccauacacgcggg

SEQ ID NO: 4232400 - RNA, 84 nt, Human
uugcucugauacaguagacuuuuuauuuguuuuggaaagugauucuaagauuuuuacaaauagagugucuagucuacagagcaa

SEQ ID NO: 4232401 - RNA, 64 nt, Human
gagguuuggggaggaagauagggugaaggguuucagccuuuuacuuguuuugcucuuuucccuc

SEQ ID NO: 4232402 - RNA, 61 nt, Human
cugguuauuucugauuauaugauaggcauuguguuugaaaaauauuuuuagaaauaauugg

SEQ ID NO: 4232403 - RNA, 78 nt, Human
guucuacugcaguuccugcugucuccauaugguucaucagugugugggagaugaaugugguaaaacugaaguagcugc

SEQ ID NO: 4232404 - RNA, 63 nt, Human
guuuugaagagaagcaagucuguguaaaacauucagaaacaacaacuugcuuucauuuaagau

SEQ ID NO: 4232405 - RNA, 96 nt, Human
cuccggccaaagcacuucccacacucaacacacauguagggccucucuccacuaggcacugccuggugcggagugaguggcaugcuuuggcuuaag

SEQ ID NO: 4232406 - RNA, 71 nt, Human
gggccaaggucagacagccaggacagagugcagcuggacuuuccucuugaaucugucugacuccaaagccc

SEQ ID NO: 4232407 - RNA, 60 nt, Human
gaaagacagaaaagcagagagagggacacacagguccccugcuuccucuucuguuuguuc

SEQ ID NO: 4232408 - RNA, 70 nt, Human
ggaguaguggcugugaaauacaugggaaagaguuugaaaaguauguaucccacauuucacagcacuuucc

SEQ ID NO: 4232409 - RNA, 64 nt, Human
gggcggaggucacgcacccgccagucccgggcccugccccccuggagguagcugacuccagccc

SEQ ID NO: 4232410 - RNA, 76 nt, Human
aggccccuuguuuuauucaaauuggucucggcaggaaaauguucucgacaugaugagaguaauaacacaggacccu

SEQ ID NO: 4232411 - RNA, 56 nt, Human
ugcaaggcacccacucugcuuuuuuugugaugagauggagcaugacuggccuugca

SEQ ID NO: 4232412 - RNA, 74 nt, Human
agcucauccuuggguacaguaaagggaggucucuugcacaagucaccugguuucuuacccaagagaagugggcu

SEQ ID NO: 4232413 - RNA, 67 nt, Human
ggccaaagagcacaaugaauagaguuaugacaagcagaauuugucugagauucauuugcguuuggcu

SEQ ID NO: 4232414 - RNA, 112 nt, Human
agagauuccaaggucagguugauauggaaacucuagguuaaauaaaguuaagcauuucuuuaugaaagaacuucuggaaacuuccaugugauaaugugcauugcggaucucu

SEQ ID NO: 4232415 - RNA, 72 nt, Human
gcacagucaaggcgggggagccaggaacccaggcugggaaaguggccugggcucccucucccgccucggugc

SEQ ID NO: 4232416 - RNA, 58 nt, Human
caucugcagccucugcauucccauagcggucaggcuggggagugucuguugcaaggug

SEQ ID NO: 4232417 - RNA, 75 nt, Human
gauuuguugagugguccuaggugcucaagucacuguaccugcaggguggcuugagcugggcccaccugacugauu

SEQ ID NO: 4232418 - RNA, 94 nt, Human
ccacuggcagaggaaacagauggagcagagcugaugggccucagaguagguuucagacaaggcuuuugcucuggcuccucuuccucuuccaugg

SEQ ID NO: 4232419 - RNA, 60 nt, Human
acuugauggaguuucacuguauuauguucaugaugggccccagugaacuccauaucaggu

SEQ ID NO: 4232420 - RNA, 65 nt, Human
ggagcagcaggccagguugcagguugaggaagucagaaguuaacuugagcugaguuugcagcucu

SEQ ID NO: 4232421 - RNA, 75 nt, Human
ggugauuucaaauauagagugagauuugauaacuugugaugaaggacuuuuuauugcuaugucuugauugucacc

SEQ ID NO: 4232422 - RNA, 77 nt, Human
gguccuucucgggguagacgccagcucggaggaacgaggccuuccagcuguccacgucuuccugggagucacaggcc

SEQ ID NO: 4232423 - RNA, 82 nt, Human
ggccgcagccgcccacccccgcccacguggauguuaaccgucguggcauagcugagccgccuggcugggggaggugguggcu

SEQ ID NO: 4232424 - RNA, 130 nt, Human
agagugccagccaggccgacuguugugcaaguucugggcuggccugcgagggcaggcuggcagaggagucaugccugaucagcggccagcauggugucugcccagcccucuuggccuguccuaugagacu

SEQ ID NO: 4232425 - RNA, 61 nt, Human
gcauagauauguaaugcaucaugauugaaacgacaaauauauuguauuuauauuucugugc

SEQ ID NO: 4232426 - RNA, 63 nt, Human
ggcuggagucagcaaggacgaggccuaggacagggagcccagccuccgccuuccugucucccc

SEQ ID NO: 4232427 - RNA, 75 nt, Human
ggggacaggugugggcagaugcccuacuuaauaaggguuuuuaaggagugggugaaugugcucauaacagucgcc

SEQ ID NO: 4232428 - RNA, 93 nt, Human
uguaaacaacauugaagcauggagaugaggcaaggaauaguacucacugaaguugaaaugacugcccacuucaaaaucuucauuguguuuaca

SEQ ID NO: 4232429 - RNA, 83 nt, Human
ccagcucauugcucuaaggcaagcacugggugucuuagccuuggccuucagggcugggacacacagucuucuuuggggccugg

SEQ ID NO: 4232430 - RNA, 55 nt, Human
ucccugagagacuucuuuggcucaacaucucaggagccugggagaagaucaggga

SEQ ID NO: 4232431 - RNA, 87 nt, Human
ucucaugcugugacucucuggagggaagcacuuucuguugucugaaagaaaacaaagcgcuucucuuuagaguguuacgguuugaga

SEQ ID NO: 4232432 - RNA, 70 nt, Human
agucgauuccugauaagugaauaagcugauuguuuggucacaauguuuuauucacuuaucaggaacgauu

SEQ ID NO: 4232433 - RNA, 66 nt, Human
gaggugggaggcgggccugcaucugaagaauacgcucggaggcuggcagguugcugcccccgccuc

SEQ ID NO: 4232434 - RNA, 56 nt, Human
gggagaaccagccagugcaagggccccucauguccugccuggccuuugcuuuuccu

SEQ ID NO: 4232435 - RNA, 104 nt, Human
uugagacagaguuucacucuuguugcccaggcuggagugcaauggcgugaucuugguucacugcaaccuccaccuccuggguucaagcgauucuccugccucag

SEQ ID NO: 4232436 - RNA, 60 nt, Human
agaguuaguggccucagcagggccagucaagccagauauguugaaacagcuauugacuuu

SEQ ID NO: 4232437 - RNA, 81 nt, Human
aaaucauugagaagugaauaacgaagcaggcugcaaaugguaaguuuuuuuccaguuauucauuuuaggagacagugguuu

SEQ ID NO: 4232438 - RNA, 63 nt, Human
gacccuagagaaauguacuagucuaacuccuuugcaggauuuggaaggcguuucucuguaguc

SEQ ID NO: 4232439 - RNA, 124 nt, Human
augccccuucgagugucugggguaguuggugagugggaggugggaaggguaggccagagcccaccugccuccucccuccuccuaggucugacgcugcacccucccuacguucccugaggugcgu

SEQ ID NO: 4232440 - RNA, 129 nt, Human
accuggggugccgguguguuuuacaaggcuggcuuucauggcgcaguugaguucccacuugcagaacauacucacccuguggcuauaaggcaaagcgcuggggcuuguaggcacuggaccccaagcagu

SEQ ID NO: 4232441 - RNA, 84 nt, Human
cuucuggucaaaacuuucaugguaccuagccucauggaugcacaguggaucugcuguaguuggugccaguaggucaccaagaag

SEQ ID NO: 4232442 - RNA, 80 nt, Human
uucuguuggagauaguuucuaauguugaaauuaucagugaauguucauuaauucuucauguugaagcugucaccauggaa

SEQ ID NO: 4232443 - RNA, 67 nt, Human
guacaagcaaaagguuacacuucuggaauagcagacuaucuaauucagaccaaccucuugcuggaac

SEQ ID NO: 4232444 - RNA, 91 nt, Human
gccccugccugccucuuucuugcuuccggugcuccaggggucuuccugcuccccuggcccagcuggaagcgggaagggauuggaggugggc

SEQ ID NO: 4232445 - RNA, 56 nt, Human
gaggccuucauuucuccgucuggcaaguggacaugcuaguggaccuugaaggccuc

SEQ ID NO: 4232446 - RNA, 68 nt, Human
gccaugcagcccuuuuuuuuacuccggacagcucauguacugaagcgucaugaaagaaaggcuguggu

SEQ ID NO: 4232447 - RNA, 79 nt, Human
ggcucuuuguauucuagaagcucuuuaucucuugacucacugaugcuagauuuggggcuuggguaagaaugcaaagguc

SEQ ID NO: 4232448 - RNA, 83 nt, Human
cauagcuagaagguagaaggaccagaauuuaucuuugauguuauaauuuaagcaauagauggaaggucauguuuucuacugug

SEQ ID NO: 4232449 - RNA, 75 nt, Human
ggucaaaacugggugugugugaacagagauacacccauauucguguauauacacauccaccuacauguuuugguc

SEQ ID NO: 4232450 - RNA, 59 nt, Human
ucugaucuuugcuuuuggcuuagugagaugucacauuaaaaaugagaguagggauugga

SEQ ID NO: 4232451 - RNA, 64 nt, Human
gugguaaagugugccuguggucaugcaaauacuaguuuuugcuucacagggucacucuuaccac

SEQ ID NO: 4232452 - RNA, 79 nt, Human
gagagagagagauuggaagagagauggggagagacugacucagaucccucuccugucugcuucuuuuucugguucucuc

SEQ ID NO: 4232453 - RNA, 56 nt, Human
uuaggagugccaucuuguggacacauccaccacuuccacaucaugucaccuccuag

SEQ ID NO: 4232454 - RNA, 95 nt, Human
ggucagcccuuguaccucccugccuucccuguuggucugugauugggaccucugccugcucccagacagaaggcuccuugagguagcagcugguc

SEQ ID NO: 4232455 - RNA, 76 nt, Human
aaagggaggagggacagaaagaggggaaauaugcccuugacauaugauguaucuucuuucuuuucuucuucucuuu

SEQ ID NO: 4232456 - RNA, 85 nt, Human
gagugcaauugagcugguuucucucauugucaguuagggaccuagcccacugcagauccucugagaaaccuucucaaguguacuu

SEQ ID NO: 4232457 - RNA, 57 nt, Human
cugcuucacccugccugagaaccagggagcacugcauuucuccacaggguggaggag

SEQ ID NO: 4232458 - RNA, 56 nt, Human
cuuggccguuucacugggcaguuaauaaucaaguuaauucccagaaacagcacaag

SEQ ID NO: 4232459 - RNA, 125 nt, Human
gucaauauguccagcccccugucucugaccagccguuccuacucucucugugugacggcuuagccuggccagccagccggugaguggaagcggcggcuccugacuccugguggcggcacugugac

SEQ ID NO: 4232460 - RNA, 66 nt, Human
uuuauggcuggcuacauuuauacucucauuaguuuucugaugauugaauaaauauggucacauaga

SEQ ID NO: 4232461 - RNA, 62 nt, Human
ucugguuaggcuugugagguccccguagcuguggcugcugcagaggccucagccuggccgga

SEQ ID NO: 4232462 - RNA, 69 nt, Human
ugugaagucgccuaaacaaaguaucuuaaaaugggaauaauuuuaauauaaugcaguaggugauuaaca

SEQ ID NO: 4232463 - RNA, 85 nt, Human
ggguggggcucuaucugcuggagguaauuacucuaaugagcuucccucaagaguggccugccccagccaggccucagcuccuccc

SEQ ID NO: 4232464 - RNA, 63 nt, Human
gccacugucucugauaagcucgaggguagcaaccugcucuugugucaccauggauaaaguggc

SEQ ID NO: 4232465 - RNA, 71 nt, Human
gcagauaguaggagcuaaucuuuucugugguuugguuuggucgccugccuuagguugguuuacuagucugu

SEQ ID NO: 4232466 - RNA, 56 nt, Human
uccauuucacaucccugacauguagcacacacugcagugacugggauggaaguaga

SEQ ID NO: 4232467 - RNA, 56 nt, Human
gguggagacucagauuuguugcugaaaguucaguaacacaguccuggucuuuggcc

SEQ ID NO: 4232468 - RNA, 94 nt, Human
gagucuccacauggcuguuuuaaucuccuuauuccuaagacuauauaugaugggauugaggaagggaggcaaaacuguguaugucagagcaauc

SEQ ID NO: 4232469 - RNA, 63 nt, Human
aucgcagaguggaaauugaugagcucuugucucuugaggcaugcaaauucuuuacucugugau

SEQ ID NO: 4232470 - RNA, 61 nt, Human
ugcauuccagcucccuucuggcccgaggaggcggugggcugcgggaaggugcuggagugca

SEQ ID NO: 4232471 - RNA, 116 nt, Human
gccucgcaacgucugcaccugcucgcccagggagcugcucugcuuccgugccucagauaaugccugccgggcggcauccagccguuccugggggacaggggcugauggugccuggc

SEQ ID NO: 4232472 - RNA, 77 nt, Human
ugauuacuuaagacaauaaucuuugaguagaguugagcuauagcuuaagacaggcucaaagauuaaugugguuuuca

SEQ ID NO: 4232473 - RNA, 67 nt, Human
agugauuccugugcuuauuccagucugggaaucaccugccgagauggaguguggccaggcaguaacu

SEQ ID NO: 4232474 - RNA, 83 nt, Human
cccgcauggagauagacuuggguauauauguugcuacagaccuguacagacacuucugaauauguuuaucaucucuauauggg

SEQ ID NO: 4232475 - RNA, 59 nt, Human
ucuaugcuacguuccucugaaaggcaaacuuaugacugcauagaggagaauggcaaaga

SEQ ID NO: 4232476 - RNA, 60 nt, Human
ccugcccccauuccugcggccuucauugcugcauccgguggaggcccagcugggggccgg

SEQ ID NO: 4232477 - RNA, 76 nt, Human
gcuguuguugcacggaaggugggaggcaggaggguaagggaagaaggcagagaccccaggccguguaaucagcagc

SEQ ID NO: 4232478 - RNA, 97 nt, Human
cagggccuggugcucucugaagcaccuggacggugccuggggacuuacggagcccagggcuggaccagugcuugggaggccagagcaugggguccug

SEQ ID NO: 4232479 - RNA, 78 nt, Human
ugacuuuugaggagggcuagagucuccuggucuggcacuggcaccuggucaggaacucggagcccaucucugggguca

SEQ ID NO: 4232480 - RNA, 57 nt, Human
uacaugggcguguucaguuagugaaaguuuacugaucuguguaauauguuacaugug

SEQ ID NO: 4232481 - RNA, 88 nt, Human
gcugaaaucuggcuuuucaaagggagaguauccagaaacagaagaugcugcucugagaggcucuuccuaauagaacugcugcuucagu

SEQ ID NO: 4232482 - RNA, 70 nt, Human
gcaagagaagaaagaauaguuugaaauuaaacauuagaucaguuuucauaauuauuugcauuuuucuugu

SEQ ID NO: 4232483 - RNA, 79 nt, Human
cagcccauggcuuguuuuuguaaaugaaguuuuauuggaaugccaccgugcccauucauuuacaaagucucuauggcug

SEQ ID NO: 4232484 - RNA, 65 nt, Human
gggccucugaaagacgaggggaagucggcauuuucucaagagaacaaccuccccuguggaggucc

SEQ ID NO: 4232485 - RNA, 86 nt, Human
caccucuucugcccauuucagcagcccauguuuggauuuuuaggcccuacuggauuccaaacagucaccaugggaagaguggggug

SEQ ID NO: 4232486 - RNA, 56 nt, Human
ucugugugugugcauaugcaugcauguguguguguguguguguccucauuugcaga

SEQ ID NO: 4232487 - RNA, 79 nt, Human
ggaaggggagcuggaaaggguaugguacgggaaggugaucuuucccugaagccuggcccucuacagcuggacuccuuuc

SEQ ID NO: 4232488 - RNA, 111 nt, Human
gccuaaacccugugccuugagugugcaagcugacuuauuagaaaaggacagggcuggcugaccugucccuaucagucccaagucaugcacccugugccccgggaagugggc

SEQ ID NO: 4232489 - RNA, 102 nt, Human
cugagauuuccccgggcaacacaugaaaagagcucgauugucaguguuagggagacagacguuuucagcacuggacagcgagucucaggccugaggguucag

SEQ ID NO: 4232490 - RNA, 66 nt, Human
acagacuuaguauccugcugcuuguuucaaucuugaugcaguaagugaugcaguaucugggucugu

SEQ ID NO: 4232491 - RNA, 59 nt, Human
ugucuucacugaagcuuugcaucucucuguaaaaaugacgauuugguucagugaagaca

SEQ ID NO: 4232492 - RNA, 89 nt, Human
cuuaaaaguaauagucaacauuugagaugcaauggucagaggauauugugcuguugccaucuaaaauguuacuguuucuuacuuuuaag

SEQ ID NO: 4232493 - RNA, 55 nt, Human
ggaggaugaggguggugguguugggcacacuuugcagggccucacccacaccucc

SEQ ID NO: 4232494 - RNA, 111 nt, Human
uaaggaauuuucaaagacaaggauguauucagaauguacugauagaacaguaauaacuaauauguauaguguucuuacuaaguaccugaaauauuuuuguaaaacuucuua

SEQ ID NO: 4232495 - RNA, 74 nt, Human
gauuucuuuggguagggagcuggaauccuaaaggcaugccagacuuuccagaacacucucuuacccuagauauc

SEQ ID NO: 4232496 - RNA, 62 nt, Human
gcuuacuguuccuguuggugcugaaagaaugcucguaauuguuaccaaacaguggacggagc

SEQ ID NO: 4232497 - RNA, 96 nt, Human
ccagaauaugcaguagagacauauuuugaugagaaaugacuuaaguuauguuguaacugguagcugauuaaguauaguucccugcaccccuucugg

SEQ ID NO: 4232498 - RNA, 89 nt, Human
uaucugaugauugauucauuuguucccauuuuaaaacuauugcaaauuaacauugggaagaggauggaaguaacuggauaaucaagaua

SEQ ID NO: 4232499 - RNA, 84 nt, Human
cuaagguacugggcagaaggccaaagauagcacagcugcucugugcucuguuggcuucuuuugucaauugcuaugugaccuuag

SEQ ID NO: 4232500 - RNA, 91 nt, Human
ugugauucccgagcaaauauuugucuguuuuaguggcacagucgagcugacugcuguucggaaaagggcaagcuaucuugggaacuaaaca

SEQ ID NO: 4232501 - RNA, 65 nt, Human
gugugguuggggucagauagggaggaccguacacaaggcaucaucucuagcuuccuuaggaacac

SEQ ID NO: 4232502 - RNA, 74 nt, Human
uucauugcagaauuuggccucaccaugcgugagucagaacaagcgccuugaaggccagggauuugcagccugag

SEQ ID NO: 4232503 - RNA, 60 nt, Human
uugcauauuuuaaaguguaaccugagccuucgcgguuucagcuucacuuaaaacaugcaa

SEQ ID NO: 4232504 - RNA, 69 nt, Human
cauguucuguuguugaucuuuggaggguacaucauccaguuccuauccaaaggaacaaucacagccaug

SEQ ID NO: 4232505 - RNA, 60 nt, Human
uggcacguaggagcuaugucagggcuccagcaugccuugacaugccuccuacaugaucca

SEQ ID NO: 4232506 - RNA, 68 nt, Human
ccuggaugucugggaggcuucccugcuugggugaaguugggagggcuuggacccagaugucugugagg

SEQ ID NO: 4232507 - RNA, 79 nt, Human
cauuccaaguauauacaugauaugaguguauuuccugacucccuuuuugaugguaucaugugacuagguuuggccaaug

SEQ ID NO: 4232508 - RNA, 61 nt, Human
uuguagaucagauggccaguagugguggacuugcccgaaucuacguguccgaugaucacag

SEQ ID NO: 4232509 - RNA, 93 nt, Human
uacugguuuauuaagauaugugguuugucauuuaauauuugaauaaauauuucauauaauugaauaagagcugcagguauugggagacccuua

SEQ ID NO: 4232510 - RNA, 73 nt, Human
cgcagguggcagagccuugcggcuuuggagagagguggagccuuggugagguugggaggacugccuaacugcg

SEQ ID NO: 4232511 - RNA, 84 nt, Human
uccauggccuccuucuuccccaccagagacagagcugcuguuccuacggcgguugcaggaugugcgggcagaggaaggccagga

SEQ ID NO: 4232512 - RNA, 93 nt, Human
ugccaguuagagugguuugacccuucagguaaaaagauauguuacuguuauuuuucuacgugacagaacagacugaauuuagcuagggaggca

SEQ ID NO: 4232513 - RNA, 67 nt, Human
cagccagucgucuuuauuacagcuucugcagaacacuugcuuagacugugagaagauggcugcguug

SEQ ID NO: 4232514 - RNA, 129 nt, Human
ccggugagggccaaggggagcuggaagggucucucuuguuagcccaggaagcccagggaccaguggguccccccgaaagccccugugcuugcagcaguguccaccccagugucuaacaguccucccggg

SEQ ID NO: 4232515 - RNA, 80 nt, Human
uugcuuggaaaagaugcuaauuaaugaagaggagcaacuacuauugguguauuuuucacagauuggugcuuucuaaauaa

SEQ ID NO: 4232516 - RNA, 57 nt, Human
ggugccugggcacggaaagcaugugcagcggcuggccugccuuccgccccgggcacc

SEQ ID NO: 4232517 - RNA, 69 nt, Human
uuguucuuaacuuuuguguauaugggagaguugacuaucucuuguaaaugcacaauaaaguaaaggcaa

SEQ ID NO: 4232518 - RNA, 130 nt, Human
uaccagaguagugcuacagggucauaggaaauugugcagugcguggguguugaaaaagauuccuucuuuuagcaaaaaagcucugcguaauuaucaugucuuugcuugauaauuagcacuacuccaacaa

SEQ ID NO: 4232519 - RNA, 63 nt, Human
cuucucuauuugcugcaccucucuaccugcaacacaggcuuggggagaguagcgguagggagg

SEQ ID NO: 4232520 - RNA, 57 nt, Human
uaagcacuuuauaugcuuuaucuaauuagcuauucuugaagcccugugaggugcuua

SEQ ID NO: 4232521 - RNA, 80 nt, Human
gaugcucaaaugcugcuuguccauuuauuugccuucuguaugcauuaggaaacagauaagcuauaaguaguaccagcauu

SEQ ID NO: 4232522 - RNA, 79 nt, Human
ucaugacuguuuuucuuugauuuagaaccagcacuaugcuaaucauguguggucucaaagcaaggaaggaagaauaugg

SEQ ID NO: 4232523 - RNA, 78 nt, Human
ggacccagcgaagaaccuagcggccgaaaagagucccaggaaaugugccccccgggauuacugguauuugcuggcucc

SEQ ID NO: 4232524 - RNA, 73 nt, Human
agcggacuaggagccauaccuuucccagccucucgcacagcugggcagagagcuggaacuccuuggcauagcu

SEQ ID NO: 4232525 - RNA, 68 nt, Human
ucagauaaaucauuuauuaagcggucaagucaaaacagaacuuuuguuugguugacugauuuaccuga

SEQ ID NO: 4232526 - RNA, 86 nt, Human
gguuaaauuagaaaaacuuaccccagggcaaggaauuuucugucaccaguccuuuccuggaaaugguaaguuucauccuuuugacc

SEQ ID NO: 4232527 - RNA, 86 nt, Human
ggguaccaggcuggggggcggggggagcuggaaugaauuaacgccauuaaugucuggaaaccaccccguuucuccagaaacugccc

SEQ ID NO: 4232528 - RNA, 73 nt, Human
aaaggccaauuuccuagacauuagugguugauuacuaacucauuucauuaaacuaaauuaugaauuggcuuuu

SEQ ID NO: 4232529 - RNA, 79 nt, Human
cucuucaguggcuuuguuuccaaaugaaaaccagaaaaaugaugcuggaauuucauagaggcagcggcggauggaagag

SEQ ID NO: 4232530 - RNA, 130 nt, Human
ggagcucagaugucagacagcaggaggaauaaaaaugcuacuugugaaaacccaggcuguagguaaaacuuacucuuuuguugguugcacugguggguugggacuuucuccugaacuggccuugaaaucc

SEQ ID NO: 4232531 - RNA, 82 nt, Human
uaugcuauagguuuuuuccuuuguuuugguauauguaaccauaccuauauuauuaaaauagauggauauagaagccagcaua

SEQ ID NO: 4232532 - RNA, 87 nt, Human
ggucuuggggagaaggauggggaggcggauggagugcuggucggaagcgggcauuccgggguccccuucucagaguucccuaaagcc

SEQ ID NO: 4232533 - RNA, 128 nt, Human
aacaugcaggaggcaaugggaacaaacuacggggaaauagagcuggaaccuugaucaggcugcaccugaagacugauuuuccacuaggcuuuuccauauacaguuguuccuuauuauuccuuuuuguu

SEQ ID NO: 4232534 - RNA, 59 nt, Human
aggccaggcgccggcgcgagacuccccuugucguccaauaaccugccagcgccuggccu

SEQ ID NO: 4232535 - RNA, 58 nt, Human
acuaauuuacagaaauuucuuagaaauuccuguuggaguagagauuuucuguuuuagu

SEQ ID NO: 4232536 - RNA, 65 nt, Human
ccuggggcuccuccuggcaggaggccuggccagccccgagcccuugagccuggaggagcucucgg

SEQ ID NO: 4232537 - RNA, 68 nt, Human
caccgugugcuugucguggagccaggcucggugccuaccaggccugagucaagauguggcaccuggug

SEQ ID NO: 4232538 - RNA, 78 nt, Human
gggcugguugauuaauuuugccaagcuguccucuucuaaacucaaaccuggacuguuuaaguuaaaauuuaccugccu

SEQ ID NO: 4232539 - RNA, 67 nt, Human
ggaugucagucuucaggacuaugaaaacuuccugccaguuuagcauggacacugagggcuggcauuu

SEQ ID NO: 4232540 - RNA, 58 nt, Human
uugggaccaaaugcuaccauucuaggaaacaacuggagaaauaacauuuggauucuaa

SEQ ID NO: 4232541 - RNA, 88 nt, Human
ggggcaggugcuugacacugccaagugccccgagaugacucuacugcucacccauuucuuugggcccuggcagucuccuacuuguccc

SEQ ID NO: 4232542 - RNA, 76 nt, Human
aguuucuugguuuuauucguauuuguauggccaguaacuagggcagugccuggugcaggauaaucacucagaaauu

SEQ ID NO: 4232543 - RNA, 62 nt, Human
auagcaucaugcuaucccccuuguaaaaggaggaaugcuuggcaugagaaccuuacugcugu

SEQ ID NO: 4232544 - RNA, 86 nt, Human
gaaaaccauagagagugagaaauacaggcaguaagauucucagagccauguuugcguaucuacauugccuguacuuuauggaauuc

SEQ ID NO: 4232545 - RNA, 122 nt, Human
acauguuucagaagcggugacauggagagaauuuucugaucuuucauccuaaaugggucugugggcaccauggaaaagacgggcaggccgcucuccaccugugugcaccaucgcuggcaugu

SEQ ID NO: 4232546 - RNA, 64 nt, Human
guguuggugagcucauuuccaccagaacucagcccaggcugcugugggauggaaucaccugcac

SEQ ID NO: 4232547 - RNA, 55 nt, Human
gcugggagaggaaccucgagggucgggugaagcccacccagaguccuccccgcgc

SEQ ID NO: 4232548 - RNA, 66 nt, Human
gcuggugggucacguguggguggcuggaguccuagggaaaccccacccacuucucugcccuccagc

SEQ ID NO: 4232549 - RNA, 61 nt, Human
ggugaguaguggaaaugaaugagguuaggaagaauuauugcauuaauuuuuagggcucacc

SEQ ID NO: 4232550 - RNA, 55 nt, Human
ugcgaccccugaaaauggcagccaccguuagguagcggccaugacgggggucaca

SEQ ID NO: 4232551 - RNA, 67 nt, Human
ggccuugauuccggucauugaacacacuuuauucauuucugugucuggcacuguccuagucgaggcc

SEQ ID NO: 4232552 - RNA, 117 nt, Human
gauucuaauuuaaaaugcuuaacagacuuuuagacuuaugaguuucaguugaaagguauuuuaaaauguuacuaagucugcaaaaguacugaaauguuucagagaacuuggaaaguc

SEQ ID NO: 4232553 - RNA, 89 nt, Human
ucuuccguauuuucuuacauuauuguguagugugggcaucuagagugaugccuggacgacaucacagugaaagauuagugcaacgaaga

SEQ ID NO: 4232554 - RNA, 56 nt, Human
agaguguggaaauguucagaguacuucggaaggggugaaagacuuucuacgacucu

SEQ ID NO: 4232555 - RNA, 130 nt, Human
aguccaggacuguuuuccuacagcgugccucaaaaguguuguagagggcaggauucuacauucacagccuguuccaucuacgagauuuuccagaugcuacuugugguagacauuccuaacucaugguacu

SEQ ID NO: 4232556 - RNA, 68 nt, Human
cgcacaucacuggcaugauagaccauaacagcuucuucugagcuguuccggucuaucgugucaaugcg

SEQ ID NO: 4232557 - RNA, 65 nt, Human
ccuggcgccuuguggaaugagagcuuaauuaauuauuaaacugaguucccgcgggagggcgcagg

SEQ ID NO: 4232558 - RNA, 55 nt, Human
ugguauauuugaccauauguguuauucauagaagacaguaugaucaaaugugcca

SEQ ID NO: 4232559 - RNA, 80 nt, Human
ucccauccuucacuuuacaucuguaaaaggaggguaauaaauaauaccuaaucuaauagauuuggaguggaaaguaggga

SEQ ID NO: 4232560 - RNA, 58 nt, Human
uuggucagaugugucuccuccuccucaaccccagagggaggaaggagaaucugagcaa

SEQ ID NO: 4232561 - RNA, 130 nt, Human
ggugcccggcgaccccuacucuguggugguucugcugcagggcuacgcggagccagagggugugggcgaugccgugcgcgccgacggcuccgugacccugguccuaccccagacccggggcccggccucc

SEQ ID NO: 4232562 - RNA, 71 nt, Human
ccgugaccucaguacugcaguuugguuggugucuuaaccaagcucaauggucugaguauucaggguuacgg

SEQ ID NO: 4232563 - RNA, 56 nt, Human
uuuguccuguuggcaugaaaauguaguuacaccuccaaguucugcucaggaacaga

SEQ ID NO: 4232564 - RNA, 124 nt, Human
gauuauaguuuguaacauguuugaaacagaagcuucgaaagagugauuucucaacuuaguguuaaaugauuuugucugaagucugacucuuuguaagcuuguuuguuucaucaaauuuuaaguc

SEQ ID NO: 4232565 - RNA, 77 nt, Human
uucuaaugauuagccguccuuuuauuaauuaguuuauuuuugaagcccuuuguauaaagauggcuagaucccuggaa

SEQ ID NO: 4232566 - RNA, 61 nt, Human
guugaaagccuacagcucacuguuuuuggugcucuggaaauguugaggguggguuuuuaac

SEQ ID NO: 4232567 - RNA, 59 nt, Human
cugcccagcagggagcuaccuggaguuggucuggcccagcagaagcucccgcugggugg

SEQ ID NO: 4232568 - RNA, 60 nt, Human
ucuuacauuuguuuaguguuucccaauuuuugggagaaggggugcacagcaaauuugaga

SEQ ID NO: 4232569 - RNA, 72 nt, Human
uguggauguuugaauguguauguguauauauauguuuauaggcauauacauauacaugcauacauauuugca

SEQ ID NO: 4232570 - RNA, 130 nt, Human
ucccuagagcuuuuaaguuauuaauuuuuaaauaacaauuuaaguuauugcuaaugugucuaaagguaaaagcuacagcgaaaauuuagcuugauugcaguugaauaaauggcuugauuacuuuuaggga

SEQ ID NO: 4232571 - RNA, 61 nt, Human
uguggugcucagggaggaugggugacacucgcuguugcuucagcuucaucuugagcccaca

SEQ ID NO: 4232572 - RNA, 64 nt, Human
ucggcgaccugucauggaccaagaguauauauauaagcagcgauucauccuacaggugugcuga

SEQ ID NO: 4232573 - RNA, 58 nt, Human
uagcauuuauugggcuagcaaagaaaaccagcucuuugcuuuugccccaaaagaguua

SEQ ID NO: 4232574 - RNA, 82 nt, Human
ucacuuauaauccaaaccaggaauucccuggaaauaagaucacaaaucuagggggaauccugcuuauggauauucuggguga

SEQ ID NO: 4232575 - RNA, 72 nt, Human
gcaguuuaaucaguugguaauauugaaucauauguauuuuuauguuuagaguacaggauuguuuuaaauugu

SEQ ID NO: 4232576 - RNA, 64 nt, Human
gaaaaucaugaaaguguguuguuuuuuacucuuuuucauagggcaguacauauuugugauuuuu

SEQ ID NO: 4232577 - RNA, 89 nt, Human
uguaguucauuucugauacagucccaacacaaauggcuguccuauuuagauggcauuggucaagacugauaucaagauagguaacuaua

SEQ ID NO: 4232578 - RNA, 127 nt, Human
ugguauguuguuaacagucagguagugguuaaguucugugccgugaucugcaucaacccuaaccucaaguagcgagaacggcaaugaaaauaauguauuuccuucuacaguacuuaauugugugcca

SEQ ID NO: 4232579 - RNA, 59 nt, Human
agccacucauucauucguucaacaguguuuauugagcagcugagcuggaaugagaggcu

SEQ ID NO: 4232580 - RNA, 95 nt, Human
cgggggucggggcgcauuugccaggggacaucuggagcccggcccugcuucugucgggcuccaggguaccccuggauggcugcgcugugcccucg

SEQ ID NO: 4232581 - RNA, 82 nt, Human
ccgcugggaaguggagucagaaugcgacaggccucauaauucuccagugggccuccaucuuaucuuacucuguauucccugg

SEQ ID NO: 4232582 - RNA, 106 nt, Human
gagcaaauucuacccuaaaaauguucuaguaguucacaggaagaagaugagguuuaauaacuuucaagguaauucuagauugacauuuugaggggaaaaugggcuc

SEQ ID NO: 4232583 - RNA, 76 nt, Human
ggcaguguuugggagagggugugagugaaaguggaaacuccaagacuccccacucaacucccagaccacgguagcc

SEQ ID NO: 4232584 - RNA, 94 nt, Human
uuucuucugucagauaccuccauggcccacaucuagucauccauuacccaggaugacugauuccaagcuuguggagguuguuuggugggaggaa

SEQ ID NO: 4232585 - RNA, 81 nt, Human
gcucagcaagaugagguaagguugggugucagaggggaccuccagcuucucugaagagccagcccuuaaggcacuuggagc

SEQ ID NO: 4232586 - RNA, 95 nt, Human
gggagauuaucaagggauuggcauuugagcuggaaggaugaguauuaauagcaauagcuaacauguauugagcucuuaugugaacagaccuuccc

SEQ ID NO: 4232587 - RNA, 70 nt, Human
cuuagugcagggcuuacaucccacaguuagcaauagcaaguuaugugcuuuuugagcucuaaacacugag

SEQ ID NO: 4232588 - RNA, 69 nt, Human
gaggagacgcuucacaggugcgcauugucgugauugcagacgccugccuguacuugugggguuuuucuc

SEQ ID NO: 4232589 - RNA, 81 nt, Human
uucuuuuuccaggugauuuuguuuucaaaugcuccuugugaaaacaccuaguguuguagaaaggaaaguggccagaaagaa

SEQ ID NO: 4232590 - RNA, 67 nt, Human
guugaagguggggacuccaccgaugcucuucauaugaagauccacggucaauuccccauccugcagc

SEQ ID NO: 4232591 - RNA, 57 nt, Human
gaaggacaaggaagguugguugaagguaguugugucccugccccuucuucauccauc

SEQ ID NO: 4232592 - RNA, 75 nt, Human
cuguagaggccguagguggcugguuaaaggcuggggauuugggauuaucaccaaauggccuccuugaagauacag

SEQ ID NO: 4232593 - RNA, 68 nt, Human
gugaagcuuuugaauacuacaggaguuagauuguuauauuuggacuuguguagcuucagaauuuugac

SEQ ID NO: 4232594 - RNA, 72 nt, Human
agcugccuuaaacaaaugcuuuaauugaguucaugaugguguuauacucaauaaauauuuggaggaggugcu

SEQ ID NO: 4232595 - RNA, 58 nt, Human
cauccuauuacugaggcucccccaaaccaagcuugggcugccucacuagauagguaug

SEQ ID NO: 4232596 - RNA, 91 nt, Human
cgcggagccucauggggguuggaguccccaagguuuccuuugugcgcaguauuggcggggccuuggacuaccacucccacaaggcaccgcg

SEQ ID NO: 4232597 - RNA, 94 nt, Human
uguacucagugcauuuaagaaaugguagaguauuuuaauccuauuacuugacuaagagugugaagguaguacuuuuuagagugcacugagugca

SEQ ID NO: 4232598 - RNA, 67 nt, Human
cggaagcacuagacacugacacucauugguagacccucccuccccgccguuguguuugguucuuuug

SEQ ID NO: 4232599 - RNA, 80 nt, Human
ccuggaggaggagguuggagggcuggccugcagggucacugcaccucugcccagagccucuuaccuccagauccuucagg

SEQ ID NO: 4232600 - RNA, 78 nt, Human
uguaauguuaccguuugugaggaugugcuuuuuaguuuacaacugaggaagccugucaucaucauuaguacucauuca

SEQ ID NO: 4232601 - RNA, 101 nt, Human
gcaggauggcuggggucguacaucuguggguaaggauaagcaugcaaguacuguauguaugacugaugcugacucaugggugaggagacagccacucuugu

SEQ ID NO: 4232602 - RNA, 65 nt, Human
ggauuagaaacccguagaucaguucuagguuagcccugauuaacugcccuggguguuucugggcc

SEQ ID NO: 4232603 - RNA, 69 nt, Human
ggaguguaggcagugguaggagcccaggaguugaaugaacguuucuuugcucaccugccgcuccucucc

SEQ ID NO: 4232604 - RNA, 89 nt, Human
cucuguuccagcaacccugguuggggggucagacuugauacacuuucagguugggaguggacccaccccagggccugcugaggacagag

SEQ ID NO: 4232605 - RNA, 58 nt, Human
uuaacggugagacgccccaaauggaaccaguauccgauggaggcguaaucacuguuga

SEQ ID NO: 4232606 - RNA, 71 nt, Human
ggcccugagcagcugagccccagcugugaucauccagcaugaugcagcgugaggacagcugagcagggacc

SEQ ID NO: 4232607 - RNA, 79 nt, Human
caagaagguaccaguuaauuauagugcuuaauauugggaauaagauuaagcauuauaauuauaauguaugggccuguug

SEQ ID NO: 4232608 - RNA, 91 nt, Human
ggcggcugggagcucucgggcuggggcguuguauuuauuaauuuauauuccgcggcgccccgcgcgggcggcuccuuuguguccagccgcc

SEQ ID NO: 4232609 - RNA, 98 nt, Human
agggaacaagaugugaaggaacaguaugugagauuuacacaucaucacugcaugccauguuuaaauagaacauacugcauaacaucuuaacaugcccu

SEQ ID NO: 4232610 - RNA, 62 nt, Human
uaggagguggugguguuggugacaaguucuacuuggacugggacucaacccaccauugccua

SEQ ID NO: 4232611 - RNA, 74 nt, Human
gcauaaaugaugaaccgcuucauggugccuguagaggccucuugcagagcacccugcagugguaugguuugugu

SEQ ID NO: 4232612 - RNA, 72 nt, Human
ugucuacugaagcaugcuuauaugucuugugucuucugcugcacuugagcauuagguguguuucagaggaua

SEQ ID NO: 4232613 - RNA, 102 nt, Human
aucucuucauaugacaccuagugagcuuuuaaaauuuaccaggaaauuugcagcgguuggaaaauuuagaaagauuuaugguguagaaaauacuuuugagau

SEQ ID NO: 4232614 - RNA, 110 nt, Human
ggcuuugucccaugcuugaaaacugugaccagggcucuuucauuguuaagaaagaccauuucuuguccacagaagagcucauaagucuaguuccuucaucaggcagagcu

SEQ ID NO: 4232615 - RNA, 68 nt, Human
auagccuauauaaaugacauauaggaauauuauuuuccauaugaucuguuguaugguguauaugcuau

SEQ ID NO: 4232616 - RNA, 87 nt, Human
ucccggcauuccgugcuccuugguuccggcguuggagcucuuuggggcccagcuuugcggacccgggagcucgggacgcaggcgggg

SEQ ID NO: 4232617 - RNA, 55 nt, Human
aaaguguaagucccugguugucccuucugccugagacaaccacugcucacaguuu

SEQ ID NO: 4232618 - RNA, 63 nt, Human
ugugauggcaacucaauuucuacaagacugaaacagucuucaugaaauugauugcuuaucaca

SEQ ID NO: 4232619 - RNA, 64 nt, Human
auauucaagucaauagguuaguagguaccaaacacuguaucugacaaccuauugacuugaauau

SEQ ID NO: 4232620 - RNA, 73 nt, Human
ugucuguugaauuuuaacauucugcuggaggauaaauugacuauuuauucaguagagguggaaauaacagaua

SEQ ID NO: 4232621 - RNA, 104 nt, Human
gggguuuuuucuaagaucucuuuggguuaaaaugauuugugauuuauugggcaacauauaggagcaagauuauagcaggaaagagaugugucaggaaagacuuc

SEQ ID NO: 4232622 - RNA, 107 nt, Human
gcuccagggugucccuguuccccacagcauucagacugacucaggcucaguauggaaaugcuucaugcuugcccauguuucugaaguaauaguacuuccacuugagc

SEQ ID NO: 4232623 - RNA, 76 nt, Human
gauuacuguuuucuaaaacacauauaaguuuggguuaguuuuggaauuuauauauuuuguucugguagacuugguu

SEQ ID NO: 4232624 - RNA, 80 nt, Human
ccuuucccuccagagagaaaggaggccgcucccaaguccguccuugccccguggccuuccuguuccuuugaagggggggg

SEQ ID NO: 4232625 - RNA, 63 nt, Human
gaagucugaaccagauggcaagguucuacuaagggcaaagaaccuucugaccucucggacuuc

SEQ ID NO: 4232626 - RNA, 63 nt, Human
cugagaggcacaaggcauuucgguuaaguuauauuggccccaaaguacccuuuugcuacucag

SEQ ID NO: 4232627 - RNA, 77 nt, Human
guaaagucuuucuuuuuagcugguuguaagaagcuuuugauucuuuucagccagcugguaggaauauagaauuuuau

SEQ ID NO: 4232628 - RNA, 95 nt, Human
caaugaacagaguacuugauucauuauugcauuucccagaacauaguauggugccuuuaaaaauggcaauagugcauuauguauuuugugaauug

SEQ ID NO: 4232629 - RNA, 88 nt, Human
cauagacuuacuagaggaacaguuucagguuuugaugcuaaucaguguuguguccuaaaguuguccuuugugccuuuaaaaaguuuug

SEQ ID NO: 4232630 - RNA, 57 nt, Human
aauguugaaccuuuuuggccuggcuuguuugcaaaggcccuggccaacgucaacauu

SEQ ID NO: 4232631 - RNA, 80 nt, Human
gggcugcaggaugcgcaagccacacagccuggggggagucagagacgacucagggcugcacuggcuggucuccugggucc

SEQ ID NO: 4232632 - RNA, 94 nt, Human
ccacccuuugcgccucugcgucagccacagcugccccgggagcgaguucuccugaggcccuggcugugcugacucuagggcagcgugagggugg

SEQ ID NO: 4232633 - RNA, 56 nt, Human
gaacugaauguguaauguuggcuuuauucuagcugguacuacauggcacacaguuu

SEQ ID NO: 4232634 - RNA, 67 nt, Human
caggacaaucaauaaccauagugguuacaauuccaagccauuguacuacaugauuauugaccagcug

SEQ ID NO: 4232635 - RNA, 57 nt, Human
gccucucagcuagaaggcagguugcagucaaaugucaccuggugaugaaugggaggc

SEQ ID NO: 4232636 - RNA, 77 nt, Human
ugacaggcagagaggaagagagaaagggaauuacucuuuccauuuacuauucucauaucgcuuucucguauuuguua

SEQ ID NO: 4232637 - RNA, 77 nt, Human
ggcgggcacggcggguuccgggccagccccggggcggacgguuggccgggcgcgcggagccucgccggggccucgcc

SEQ ID NO: 4232638 - RNA, 84 nt, Human
ugggccaggugauuucaaaguccuuugcaucuucuaauuuuuaaugaguuuaagguuuuguaugaaaucucugauuauagccca

SEQ ID NO: 4232639 - RNA, 87 nt, Human
uuccaucagcaagaccuuauuuuuaccuaauuuaugagagguauuucucuguucagaagaggugaaaguucuggcuucuggggggaa

SEQ ID NO: 4232640 - RNA, 55 nt, Human
ucuugugagcugagauaaagccuugucuuuggucuauugucuuagcugcauaaga

SEQ ID NO: 4232641 - RNA, 77 nt, Human
uggaaaucauuucuuuaagugaaaggggauuaaaugguaccuauguaaauucuauacacuuaaaagauuaauuucca

SEQ ID NO: 4232642 - RNA, 69 nt, Human
auuuaaaggaagugggugauaaaauguuauaauuauguuggcagaauguuaucacauguuccuuuaaau

SEQ ID NO: 4232643 - RNA, 78 nt, Human
cagaaaguagaacuuccauauucuugguauuuucuaggggaagcuggccccuggaagggaauggugguuguaugguug

SEQ ID NO: 4232644 - RNA, 55 nt, Human
uuuuacuuuucccacuuacagcguccuguuuccauuugaagugggcaaagugaga

SEQ ID NO: 4232645 - RNA, 82 nt, Human
gagacacugggagaaauuguaauaaaucuggucauuacugguugugugaacuugagugugcuauuucuuagcucugugucuc

SEQ ID NO: 4232646 - RNA, 73 nt, Human
uuuugccacucauuauauguuugcaguucuaggucuuugacagcugaagaccacaggaaucaaacaggcgaga

SEQ ID NO: 4232647 - RNA, 61 nt, Human
auaggacuuuguaucaggaugaguugaaaucugaguuuaccauucuguguaaauguccugu

SEQ ID NO: 4232648 - RNA, 67 nt, Human
aacauccauguauugcuaacaaauaggggaccacggccccuaugaaucaauuucugcaguugauguu

SEQ ID NO: 4232649 - RNA, 64 nt, Human
gcauugggcggggaccucggcugcagcccuccagcuccccacagucgacugugcccucccgagc

SEQ ID NO: 4232650 - RNA, 120 nt, Human
cuggauguaaauguaaaacuucgcgacuuuauaaaacuggcauuccuaggggaggggcuauuuauccuacaggucccugccuccuggcagugccaugguaugugugcauggauauaccag

SEQ ID NO: 4232651 - RNA, 57 nt, Human
uccaugcaguagaggcgcugggcagagagucaaggcccagcagccaucgaccaugga

SEQ ID NO: 4232652 - RNA, 68 nt, Human
guuauggcuucucagucaugaaaagcucaguuauuuggggucuacauuuucucacugagagccuugau

SEQ ID NO: 4232653 - RNA, 71 nt, Human
cagcuaggaaguggcagagagcaagugucugacuccaaaguccacgcucuuucuacuuuucauaaugguug

SEQ ID NO: 4232654 - RNA, 66 nt, Human
ggggugggcuggguguccaaggccauggccauaacuguguccacaccuugcacucaucccaugccc

SEQ ID NO: 4232655 - RNA, 76 nt, Human
uugagaccucugccagacugugagcuccuugagggcagaauccuuggccuuugcauccacagcacagagauuucaa

SEQ ID NO: 4232656 - RNA, 106 nt, Human
gggaacuguggucaggugagaggaggcagcuuuuacaaucagacuucauugaauagugugggcugcuguuuccuuguaacaaaaccccauaaugauggcaguuucc

SEQ ID NO: 4232657 - RNA, 72 nt, Human
cuugggacauugaagcuggaaagggaauuccaggccaggaagcccaaggucccuuguacagagugacccgag

SEQ ID NO: 4232658 - RNA, 61 nt, Human
cauaacuugguguuggaaacugaccuaagccaauuugcuuauacacagcauccaaguuaug

SEQ ID NO: 4232659 - RNA, 72 nt, Human
agggaaguucuagggagucugggaugaaugagaaacuuauccuaacaacuuuugggcucucugaauuuuuuu

SEQ ID NO: 4232660 - RNA, 68 nt, Human
gcaucuguuagagugugcaugcgggccguggggccucacagcaugugugugcacaaucuggcaugugc

SEQ ID NO: 4232661 - RNA, 56 nt, Human
guaugucuuaggguucaguaacaguaacugacuggcccacugagcccaggacacac

SEQ ID NO: 4232662 - RNA, 79 nt, Human
cacuggaugcguuugaauguguuuguguaguuuguugugaaauuguuacauuuagcaggcagauccagaagcacuagug

SEQ ID NO: 4232663 - RNA, 98 nt, Human
cuucucgcccaacucccugagcgcucccucguuucgaucuuuagaaaaccccgcuuucuuucuggggccgugacgaggggcagggagcggcgagcaag

SEQ ID NO: 4232664 - RNA, 77 nt, Human
ggugcccuuuccuuucuccagagugaagauccuggccuugccacaaagggcuucugcugcagagaccuaauuguacc

SEQ ID NO: 4232665 - RNA, 62 nt, Human
acauaaccuagaggaagaugggucagagaaugcuucucagagcugagucuucaagguugugu

SEQ ID NO: 4232666 - RNA, 62 nt, Human
gaguagcuccgaaaugcaucccagggcacugaaggggagugccggaucuacuuuggguucuc

SEQ ID NO: 4232667 - RNA, 60 nt, Human
cagagacuuuugcuccgauucuguaugucuuuaaauucaagaaugaagaagaggucuuug

SEQ ID NO: 4232668 - RNA, 66 nt, Human
cccgggggcagguuccaggccagcuccuccagcaggcccagcaggccuuucaccucuguccccagg

SEQ ID NO: 4232669 - RNA, 70 nt, Human
gugucaucuggucguagaaccuuuuccaaacagaagcaucugccuuuggcuguucugugaccuuugaagc

SEQ ID NO: 4232670 - RNA, 76 nt, Human
uucaaagcgaauacaagccugccaccuggaggaaggacugcaccccuucagguacuaagugcugauucacuaugaa

SEQ ID NO: 4232671 - RNA, 59 nt, Human
ucacccccacuccgcaguagaacuccagugagcuugaccuccuuguugaguggggguga

SEQ ID NO: 4232672 - RNA, 130 nt, Human
cucuuagucccugauaaaucaaggcaaucacauucaugugagcuggaugaauuuauaaguuauaaagaccuuauccuucauaccuugaggaugauugcacugguuuugaagucaguugcuuaaugaugag

SEQ ID NO: 4232673 - RNA, 101 nt, Human
ccuucagcaugcugaguuuucuuauucuuuuaaacaacgcauuucuguuaucaggcaucaugcauuaguaaagagaggagggcugaugucagggcucgggg

SEQ ID NO: 4232674 - RNA, 82 nt, Human
aguacauccuaggaguuugaaaacuuaacuaagguuuaaaauuuaccuuguuuaaagaacuucugacuuuugaggaaaaucu

SEQ ID NO: 4232675 - RNA, 70 nt, Human
gugcauacaugugugugcauacaugugugugcacguguguguacacgugugugugcacguguguaugcac

SEQ ID NO: 4232676 - RNA, 65 nt, Human
gggcgagcgucucagccgggcgggaccgcaaaggccccgggaccacccgacugaggacgccgccc

SEQ ID NO: 4232677 - RNA, 128 nt, Human
ucgcugcuugccaaaaauaagccgugaaacguauuucagaguagaucguuauuuacaugcuggcgaggagccacagaauaccauuuacauuugaaaauagagugcugcgaaguuuuuauaaguaguga

SEQ ID NO: 4232678 - RNA, 58 nt, Human
auagaauggcaccagcaucuacauaaucagucaaguguggaauuggaaaccauucuau

SEQ ID NO: 4232679 - RNA, 59 nt, Human
gcaguuuggaggagaaagugcggguugauuauugacccacgccuucuuucuucaaaugc

SEQ ID NO: 4232680 - RNA, 89 nt, Human
uuugaaagugcacuugaucuagacagauucccuugccuauuaauaugcaaaucagccucaguuuuucuuuguuuauugcaacuuucaga

SEQ ID NO: 4232681 - RNA, 72 nt, Human
gcuugagcccaggaauuggaggcugcagugagcuacgaucgugcuauugcacuccagccugagcaaaagagc

SEQ ID NO: 4232682 - RNA, 67 nt, Human
guuuugauggaguguguuaaauauaaaaguaauccaaugcaauacuauuuagcacauuguacaaaac

SEQ ID NO: 4232683 - RNA, 70 nt, Human
aggucuacuucuguggcucuaagagacuugucucucauggcuucucucggagcuaccggaaguugggccu

SEQ ID NO: 4232684 - RNA, 93 nt, Human
ggacgauucuauguuucuguuaaaguauucaaguagcuuucucugggggaaaaaguaccacuuggacacuuaaaggaauugggauuuuugucu

SEQ ID NO: 4232685 - RNA, 102 nt, Human
gguuagcagagaaacuuggaaaguucuguguuaggaucuugcuggcagaauuaacuuuuugcaaaaguuuuauacacagauauuuguauuaaauuuggagcc

SEQ ID NO: 4232686 - RNA, 75 nt, Human
agcuauucucauguuaccaaauucuaucugcgcauauguuuuuguauaacauuucggugacagugggagucgguu

SEQ ID NO: 4232687 - RNA, 60 nt, Human
ggugccagugugccuuccgcucaccccucggaggggugaugaaggccugcaccugguccc

SEQ ID NO: 4232688 - RNA, 95 nt, Human
gcggcuuuggggugacccugggggacagagagaggcgguggggaaagaggggccaucccgccuucccuccucugcucucagaaucucacaguugc

SEQ ID NO: 4232689 - RNA, 65 nt, Human
caguucuggcccugaaacagggagcugcacaggagccguuuccuuccuuguuucuuccaaaacug

SEQ ID NO: 4232690 - RNA, 60 nt, Human
caagaaggaaggcaagagaugggcgaguuuuaccagcugucuauccuggcuuuccacuug

SEQ ID NO: 4232691 - RNA, 87 nt, Human
gguccacuguugaucucuuuccaaauucucucaccaggaucaccuguuaauauuugagauuuggaauggggguucauacaaacagcc

SEQ ID NO: 4232692 - RNA, 88 nt, Human
acauuuucauaauaauuuacagcccaugauuuguuauuuauauauaauuaauaugugaagaauuaaugugaaucauuauuuuaaaugu

SEQ ID NO: 4232693 - RNA, 88 nt, Human
ccaugcauggagauuuuaauaguauaucuagacacuaauaucucuacccugaaguuguugcuauguuauuguuaucacuauguagugg

SEQ ID NO: 4232694 - RNA, 90 nt, Human
gggaaggaaaaggccccgguugggguuccagggcgccgguaacguuaaccggcgccuugccuguccucuaaccgucgcucccuccucccc

SEQ ID NO: 4232695 - RNA, 104 nt, Human
gcuuacagagcuuucagccauaaaagagaaucuaaaugaauuacagcaucaacaaucaugguuuugucauuugggauuuuuuauaauuagaaagauauguuugc

SEQ ID NO: 4232696 - RNA, 63 nt, Human
ucuggggaugagugaugucguaugguuugcuucucugccagcacugauagauucuuccccaga

SEQ ID NO: 4232697 - RNA, 66 nt, Human
ccugacucugauuucgcugcauaacucccaggggcauccugcucugaugucaggaagggagucagg

SEQ ID NO: 4232698 - RNA, 60 nt, Human
guguuugagagguacaagggaagaaaggacuauguggaucccuuguggcuaugcagauac

SEQ ID NO: 4232699 - RNA, 91 nt, Human
uuaggguugggauuaggggaguuauuagacagggagucagggccuccugccaugggaacuucuugucagugauuucuucccuuggcccuga

SEQ ID NO: 4232700 - RNA, 60 nt, Human
guaaguucaccaguagcugggcuguucuaucaugagcauucagacaucugauggauaugc

SEQ ID NO: 4232701 - RNA, 55 nt, Human
gucaggcuagcccagugcuugggaguuacagcacucaagacacccuggccucuac

SEQ ID NO: 4232702 - RNA, 74 nt, Human
auugcucucaggaaaauauugaagaagugguauuuauauuauacauuucauaaaaacuuuaccugagguguaau

SEQ ID NO: 4232703 - RNA, 99 nt, Human
gaauaucuuuaaaaucuucugauuucuuacuuuuuucccccuuagaugccuggaagugguauuuugaggugaaagaguuuguucauuuugaagauauuu

SEQ ID NO: 4232704 - RNA, 82 nt, Human
cacuguugccugauugauaaugaagacagucacugugaucaacccaacaguaauugaacguucauuuuuaauaaggucagug

SEQ ID NO: 4232705 - RNA, 58 nt, Human
uguucauacucuucccugggcaaagcuaucuuuuguuugccuaaugaagacuauguca

SEQ ID NO: 4232706 - RNA, 72 nt, Human
gcucuggccagggucgucuggguccgugggggcgucggccccuggucucugacuugauccuguguccagagc

SEQ ID NO: 4232707 - RNA, 59 nt, Human
cuggugaagccuucggagacccugucccucaccugcacugucucugguggcuccaucag

SEQ ID NO: 4232708 - RNA, 58 nt, Human
accagguggcuaugaggaugcagucaugauaaauguaauugcucauauggcaccuggu

SEQ ID NO: 4232709 - RNA, 92 nt, Human
ucugagcugucacuggagggcugggaggagacaggggauggggcaauggcagccuacccaccccuccucaucacuguccaggggcauucagg

SEQ ID NO: 4232710 - RNA, 130 nt, Human
auuggggcauguuauugggaggagguuggggggauuuuugguuauguuaaauguuugauguuuaaauuguugcauguugaauucaaacuuuuuaacaaguccuugauguuucaauuugaaagugaccaau

SEQ ID NO: 4232711 - RNA, 68 nt, Human
cauccccaugugcugggauuacaggcaccuuguaaucugccaguuuguccccauggccaugugagaug

SEQ ID NO: 4232712 - RNA, 119 nt, Human
ggagcuugucuguuauaaccgagauuucauguuaguagaaguagaaucauuagggcugucaacuugucaccuccuaccuaacuuuugcuuuccaccugacuugucucagcaguugcuuu

SEQ ID NO: 4232713 - RNA, 83 nt, Human
gaggcaggagaaucacuugaacccaagaaguggaggucacuccacugcauuccagucugggcaacagagugagacuccgccuc

SEQ ID NO: 4232714 - RNA, 82 nt, Human
aaaaaugaaaggaaaaggaggggaggcagaugggaagaugacccuuuuacaaauguuucuucuccuuuuucuuucuguuuuu

SEQ ID NO: 4232715 - RNA, 116 nt, Human
ggggaacagaaggaauggaggcccuucucugcaugccucaggaggccugagccccaggggccuagaccugugggggcagcgggccaggccugagccuccauuccuuccccagcccc

SEQ ID NO: 4232716 - RNA, 59 nt, Human
gguuuuuggcucaauauuuuggaucaauuucacauagcccagaauuggaaccaugaacc

SEQ ID NO: 4232717 - RNA, 58 nt, Human
ugguuuccugauggacacuugguuggguagauacuggugucccaaagauuagaaauca

SEQ ID NO: 4232718 - RNA, 59 nt, Human
accagccacccugccgcguccgacugccagggaucccucacgccgcgaggugagcuggu

SEQ ID NO: 4232719 - RNA, 84 nt, Human
cugcgagggagcuguagagcagggagcaggaagcuguguguguccagcccugaccuguccuguucugcccccagccccucacag

SEQ ID NO: 4232720 - RNA, 87 nt, Human
ugaucaguuuauuuaagguacagcuagcagcauauucaugauuuugguauguuuuauacacauguaucacuugguuuaaacugagca

SEQ ID NO: 4232721 - RNA, 68 nt, Human
agaggacaaagagaugcaccauauuucuuaaaguccuggauaggaaguuugagcaucuguuucccucu

SEQ ID NO: 4232722 - RNA, 56 nt, Human
gaggauuugagggucacuccacugagucugucuguguuguugauuuucgaaucuuu

SEQ ID NO: 4232723 - RNA, 61 nt, Human
cagucucuggugaguugacaguagcuaauagaaucuagucucuguuugcuaucaugagcug

SEQ ID NO: 4232724 - RNA, 57 nt, Human
gcucucucuucugcaggccuuagaccaccuggguccuaggguacacuggcagagagc

SEQ ID NO: 4232725 - RNA, 129 nt, Human
gauuuguucaucaguugaaaguuacucgggucacaucugaaggcggcucuaggucacccuagaggccuaggcuggcugucuucaggucagggggcugaguugccauucaaagacucaaaggagugaauc

SEQ ID NO: 4232726 - RNA, 69 nt, Human
gcucugagcgcccguugagucgcgcggugcuuccccuccugggggccgccgcucaccugggcgccgagu

SEQ ID NO: 4232727 - RNA, 65 nt, Human
uacucaaauucucuacuguaugaauuaugcuuuaaguagaauucagugccaaggagaacuuggug

SEQ ID NO: 4232728 - RNA, 107 nt, Human
caugcggagcucugguuucagaugccagcagccuccccggccgaccuagugucucuuuucaaggucugcccaggaugcugcuucccggcaugcaccuuguuuccaug

SEQ ID NO: 4232729 - RNA, 67 nt, Human
gguagaccaaugcauacguguuuguggcaagugugcuuguuuggcaaaugugugugugguguaggcc

SEQ ID NO: 4232730 - RNA, 81 nt, Human
uaucuugggagaucgaaguauuucugaguugcccagugggcaaaauccuuacagggcaucucugaaucuucacccaaggug

SEQ ID NO: 4232731 - RNA, 78 nt, Human
gguuucucagcucucucuuggugaucucucucuuuagcuguugaaugaguucaaagaucuaggaagagcuuugaaacc

SEQ ID NO: 4232732 - RNA, 99 nt, Human
ugaagauauaccaaauguagcaguuuauccucauaauggaauuauagacuuaaaauauuucccauauuauggggaaaaacugcaugugggguaucuaca

SEQ ID NO: 4232733 - RNA, 81 nt, Human
agcuguauauuuaugagcauuagccuuucaugcacuaauuuccuugacccuuugcuugggcugaugcuuauacauacuguu

SEQ ID NO: 4232734 - RNA, 75 nt, Human
uuguagccacucacgguuugcaucaagaguguuuuuuguaacugccucuggacuugggacagugaguaggaucaa

SEQ ID NO: 4232735 - RNA, 56 nt, Human
ggugucaucugggcuggagauagaacuuauguucaaauaaccacccagagaauauu

SEQ ID NO: 4232736 - RNA, 76 nt, Human
gagugaucuguaggcagcauggaaaggaaggcccggaaucugucagaaccugccaaagauguuccugcaguuauuu

SEQ ID NO: 4232737 - RNA, 71 nt, Human
guuuggcaugggauuugaaaaguggaaauuguggaaaaauugagcuguugaagucccacauauaaccagau

SEQ ID NO: 4232738 - RNA, 58 nt, Human
caacguugaaaugggcauuuuccgcuguuggaacagcaaaucuguuaauuucaaguug

SEQ ID NO: 4232739 - RNA, 59 nt, Human
guggaguggguuguacucagggaguguaguuggaagcacuugccuggcaccagcuccac

SEQ ID NO: 4232740 - RNA, 110 nt, Human
gauagcuuuugcaaaauuuacauacccagcagccuccccaucagcugaauaagaauugcaauguggauguggcagaggcaaucagguaugugggguuagaagaagcuguc

SEQ ID NO: 4232741 - RNA, 130 nt, Human
agaaucaccuggcagcuuucaaaaaacucugaugucugccccucaccuccucuugccgagguccacagaaucuccaagguggggcccuggaaucagcauuguuagagguuccagugugaugccgaagucu

SEQ ID NO: 4232742 - RNA, 122 nt, Human
aauagcauuagaauuauuuguuuguuaaaaguuagcuaggacaaaguguaaaacaaucuaauccugaugacacuuuuaauaguagauuuuuaaucagcuuugugauuucuuuaauaguuauu

SEQ ID NO: 4232743 - RNA, 61 nt, Human
aauuauucucucaacugagaugagaucccucaacccaaacaucucaguccugggaaugauu

SEQ ID NO: 4232744 - RNA, 58 nt, Human
cucuguggucugaagccugugaaaucugacugccaguuucaggcuggggaucacaggg

SEQ ID NO: 4232745 - RNA, 59 nt, Human
gagagaguaucugcugguucaccacacuucagauguugugucagcaacaauacuuucuc

SEQ ID NO: 4232746 - RNA, 69 nt, Human
gucugcuuuuuagggauuaguguuugaggagguuugcagcugcucagcacauuccuaagggaugcagac

SEQ ID NO: 4232747 - RNA, 65 nt, Human
uugcagugucaucuagacgugguagaaaaauagauauacccaugccauguucugaauuacuguaa

SEQ ID NO: 4232748 - RNA, 112 nt, Human
gagcugauauuuugaucaaauauuuacugucggguguguguguuggguaugcaguguuugcauagacugucuccuaauuacauacuugauuagcuugaagaaacuuuggcuu

SEQ ID NO: 4232749 - RNA, 76 nt, Human
acaaagaaaagugauauaaaucgagagggaaaaugauccugcuuucucuacuuggcuuguguucaccaaacucugu

SEQ ID NO: 4232750 - RNA, 89 nt, Human
gcugaauucgcgcgcugucuggagccacugcugcugcuggggccacgucggguggcagcugcugcaaguggugcuaacacgugagcagc

SEQ ID NO: 4232751 - RNA, 62 nt, Human
acaggaaaugaaaugguaucuaaaauaaacaagcugugguaugaugauuauucauuuucugu

SEQ ID NO: 4232752 - RNA, 61 nt, Human
ggacccgcgguuggacguucgccucggggggggcaauguccccucuccgaccccgcggucc

SEQ ID NO: 4232753 - RNA, 60 nt, Human
gagaagcagaaggaagcagggccuuucccacuuggcccuucuuuuaauagccaguuucuu

SEQ ID NO: 4232754 - RNA, 112 nt, Human
gggucuagugaugggaggaaggccugauuugggaagcagguucuucaggaugaaaagcuuaacccuuuccauucccugacagccucuuucaaaacagucuuuccucagaccc

SEQ ID NO: 4232755 - RNA, 85 nt, Human
ggaggauuuucuaggcauguaaaagugaguucgaacauucagacuucacuguuugauuugauuuguuuaugccugggaauccuuu

SEQ ID NO: 4232756 - RNA, 72 nt, Human
uguauagacacagcuaugauuugagcagugccauuagugucuuaguaccacucggaggaccuguuuuaugca

SEQ ID NO: 4232757 - RNA, 68 nt, Human
acacaagaaugugcacucagccaagauuaaaucaacaaauuuguugcugcagugaauguuguuguugu

SEQ ID NO: 4232758 - RNA, 61 nt, Human
ccacuauucaccaucuugauccccucuaauuaucugagacuaguuagagagaugguggugg

SEQ ID NO: 4232759 - RNA, 80 nt, Human
gaagacucgugaagaaauguggacuucaggcguauccuaaaaaaucaaaucugguguccccugaguuucuaucauucuuu

SEQ ID NO: 4232760 - RNA, 62 nt, Human
ugaacagugugagggugugaccaaggccuucagaagcaaggcucuccauccucugcucuuca

SEQ ID NO: 4232761 - RNA, 80 nt, Human
cuguauaggaaaguugcuuguagugcugaccaaguuucuucuugcuggguuucagguuauugaagagcuuuccccugcag

SEQ ID NO: 4232762 - RNA, 68 nt, Human
ucucuggaaauggaaguaacuauguaacuaaauuguuacuauacuuagaacuccauuuucugcagaga

SEQ ID NO: 4232763 - RNA, 70 nt, Human
auguacacacacagaguauuuagaaggggugggaagaucuacuguccucgaaguaccugugcaggaacau

SEQ ID NO: 4232764 - RNA, 63 nt, Human
gagaaagauuguccuucaggggacaugacaucaauagguuucuggaaugagggacucuuucuc

SEQ ID NO: 4232765 - RNA, 62 nt, Human
ccaccuggcagcaggcucggcacagcuuucaucuucugcaccugagucagcugcaugggugg

SEQ ID NO: 4232766 - RNA, 55 nt, Human
gagcggcucaguggccaugugaggcuauuacuuguugguggccauugaccagcuu

SEQ ID NO: 4232767 - RNA, 73 nt, Human
aaagcccuggccagacaccaguucauuaguggaaauaaaagcuuccuaaauugcagggaacuggcugggcuuu

SEQ ID NO: 4232768 - RNA, 85 nt, Human
cagguaaaauauuggguagguccuuuggaguucuagacucaguuugagauuacagaagauaugcucaacauccuccuuugaccug

SEQ ID NO: 4232769 - RNA, 58 nt, Human
gcagggacugcaggaggacagguggcuggaaagcaaucauuucuuagugagucccugc

SEQ ID NO: 4232770 - RNA, 69 nt, Human
guucuuccagucuuuguuccugggaccugauguuuugagcaacucaggucacugauaaaguggaaggac

SEQ ID NO: 4232771 - RNA, 69 nt, Human
ucauuuaucgcugccuuuuaaaagcuaaagagggaacuuuacagcauaugaagggugagauauaaguga

SEQ ID NO: 4232772 - RNA, 95 nt, Human
ggcccuaagaaaggcagcaggucguauaguuaccuccuugugggcaaaaucccugcccuaaaacuaugcaaccuacuaccucuuccuaggaaccc

SEQ ID NO: 4232773 - RNA, 61 nt, Human
ggacuuuggugcgaagucacuuuagaaaacugggaucuggaaggggccaggcgcggagucc

SEQ ID NO: 4232774 - RNA, 66 nt, Human
ccccauuccuucucagguacuggcacagcacggccaccuaugccauagccacugaggugagugggg

SEQ ID NO: 4232775 - RNA, 91 nt, Human
gacuggguugacccaucauuugaugauuuucuagaguguaguggcgucucuacuauuacugccacaucauuaggugugaauaacucaaguc

SEQ ID NO: 4232776 - RNA, 83 nt, Human
gggccaagagcagagcuuuuucuugugguuaauaucuguuuaauccagaagaagacccuaaggaaaggucaguauuuaggucc

SEQ ID NO: 4232777 - RNA, 59 nt, Human
auuuacuuuugguaaggucauuucagaacuggguuuugaggugguuccaauaaguaggu

SEQ ID NO: 4232778 - RNA, 59 nt, Human
ucccuuuggagguguccagcacugagaaagaugugaaauuggcuacugcuucagaggga

SEQ ID NO: 4232779 - RNA, 78 nt, Human
aagugggucauguggauuguaccacgaaaagugcucacggaaagugcagccuuuuagagaagugcauccagcuuccuu

SEQ ID NO: 4232780 - RNA, 56 nt, Human
caguguugcuaaugaauucauuaugcugcaaaugcaagugauuuguuaguacauug

SEQ ID NO: 4232781 - RNA, 74 nt, Human
cuugauuuugggugcaaauuguuuguuuuuaggaguauagauuugauaggaaauaagggcacuucagauucaag

SEQ ID NO: 4232782 - RNA, 83 nt, Human
gaaacaggccauaagcagugacaagucugguaaugccagaguaguuuuucugcaguaaagauuucccuuccugcuugccuuuc

SEQ ID NO: 4232783 - RNA, 58 nt, Human
ucaugacaacuugcacaguuuugagguugagacuuuugauauguguaaguugcauaga

SEQ ID NO: 4232784 - RNA, 87 nt, Human
cagguguuuucuuuucagccuguuacuguccugugccauuuuuaaaaauagccaucaugaguaagggcuucuuuaaaauaaucccug

SEQ ID NO: 4232785 - RNA, 93 nt, Human
gggagcugcuagaggccggcugcgguucaccuagggcagcccgguccaucuccugucuuaggcuccgccggcccaguggccugggcuucuccc

SEQ ID NO: 4232786 - RNA, 83 nt, Human
caguacacucauccauaaaguaggaaacacuacacccuccagugcuguuaguagugcuuucuacuuuaugggugacugcacug

SEQ ID NO: 4232787 - RNA, 63 nt, Human
uauaaucuugcccauaguauuuaccucauuuuugugucuguuuugcuguggguaagcuuuaua

SEQ ID NO: 4232788 - RNA, 85 nt, Human
uugacucuugcaccagcuacauuagcuucaauggcuaggguaaccauggcauuuuguagcuguguaucuguuugucaggaguuaa

SEQ ID NO: 4232789 - RNA, 75 nt, Human
guagguguagacuucccacugcagugacugagccuaggggacuuugccagugacaaagucggaaguccugucuac

SEQ ID NO: 4232790 - RNA, 65 nt, Human
ggcagcaugcaaguccagaugugggucugcucaugcacuuccauggccaauugcaccuugcugcu

SEQ ID NO: 4232791 - RNA, 56 nt, Human
uuccuaagugcugguaugaggcaauuaaaucaugcacuuaugcaaaauguuaggga

SEQ ID NO: 4232792 - RNA, 82 nt, Human
uagauuuaacaucauauugguagagauguguaacuucuuacauggauuagacaucaagaagccaauguguacauauaaacua

SEQ ID NO: 4232793 - RNA, 84 nt, Human
ucccugcggucuaggaccucagugugucaggaagaaaauacacagaccugcaaugcccugggagugcuguaccacagauaugga

SEQ ID NO: 4232794 - RNA, 68 nt, Human
ggaauaucaugcugacacaguuuaucuauguugaaaaaagauaggaauuugggguuacaugauguuuu

SEQ ID NO: 4232795 - RNA, 98 nt, Human
gauugguccuuaaugcauuuuuaaaaagcaacguauauggguaaggauaucaauaucuuaguaugcuguauucuguauguuagcucauuuuggcuuuc

SEQ ID NO: 4232796 - RNA, 68 nt, Human
guugggaauucggagagaaauaugaugcuuauuuuaggccuuuuuguauauuuguccuagcuccuagc

SEQ ID NO: 4232797 - RNA, 66 nt, Human
guccagcugcgcagcgccgggccugcgcccucuggugggcacaggccgccacugcagcagcugggc

SEQ ID NO: 4232798 - RNA, 81 nt, Human
agaauggguggaugcugccaggagaggccagggccccugaggauucgggggucggcacucuggcagcaccaucucacuucu

SEQ ID NO: 4232799 - RNA, 64 nt, Human
ggugucguaaaagggccgcaguggcagcguccuggccgacggcuaguagcccauuuuggauacc

SEQ ID NO: 4232800 - RNA, 66 nt, Human
agcugggagguaaugggggugcaggggcugagcaacucccuccugcccuguccuugccucugugcu

SEQ ID NO: 4232801 - RNA, 78 nt, Human
cuaauaaacucugcaaugaaaucauguugacugcaucagucuguaccaugaccugaccucauuagcaaguuuauucag

SEQ ID NO: 4232802 - RNA, 63 nt, Human
uuaaccuguuaugcccccagagcccucaguggagcgcccguacuuugccggcaugacguuuga

SEQ ID NO: 4232803 - RNA, 62 nt, Human
gcugucauggacaugucuguuuuucagagagagaagaggaaagaggugaauccaggacaagc

SEQ ID NO: 4232804 - RNA, 77 nt, Human
cuguguuuuaaucacuucuuugucuucuucaguugcuuguuaugcuugaaggagucgaggugggugagaacucccag

SEQ ID NO: 4232805 - RNA, 69 nt, Human
ggagauggggucuggcauaugguagauaaucaauguugguugacuaaauaaaagccaaacuucaucucc

SEQ ID NO: 4232806 - RNA, 76 nt, Human
gcaagccuuucccuuguguaggacaccccagggccucacauucucugaauccacacaaggugauggauggcuuugc

SEQ ID NO: 4232807 - RNA, 88 nt, Human
guuccucaguuugcagcugcugagcugcucccgcugcagcgacaggcucugcgugcugcggcgcaggcacuccaggcucugcaggaac

SEQ ID NO: 4232808 - RNA, 59 nt, Human
ugguuuguauauguuugugagaucuagcuucugaggaaucucauacauaguaggaacca

SEQ ID NO: 4232809 - RNA, 91 nt, Human
gccaguuacucuuccccugccccccauccucuggguuucauuagaaagaaaccauuccccaacucaacagggcuugauuucugaacugugc

SEQ ID NO: 4232810 - RNA, 87 nt, Human
ucuuucaggcuacuuggacaguauuuaguauucuauauuaguacuacacuaauaauuuacugagugcuaccuaagugaccugauuga

SEQ ID NO: 4232811 - RNA, 58 nt, Human
ucacugcagccucgacuucccuggcuuccgucagccucgacuucccuggcuugcguga

SEQ ID NO: 4232812 - RNA, 71 nt, Human
uuuggaugcugucauaugcugcuuugagugaaccagagaaacagccauuugcagcaugagaaagccccaaa

SEQ ID NO: 4232813 - RNA, 69 nt, Human
aggcuuaagugaggagaccucuucuucaaauuauaccaauguggaaaggaguucuguuuauuugaggcu

SEQ ID NO: 4232814 - RNA, 71 nt, Human
ggaauggggggacagugugccuggugugaggaagacguaagauccccaauuuggaaagcaugccccccucc

SEQ ID NO: 4232815 - RNA, 94 nt, Human
gcuuaauggcucuguuuuuauguguaauuaaauacuauagcauggcaaaaauauguuguuugcacuuuagagacuguguaagggccuaggaagc

SEQ ID NO: 4232816 - RNA, 68 nt, Human
cuccugaaggccugaguuccaccaggaaagugagcuggcacuggggugggaauccaggccuucaucag

SEQ ID NO: 4232817 - RNA, 69 nt, Human
ggaugaaggaguggugaagucagauguacauaaaguacuguacaugaguuacuuccgauucccuugucc

SEQ ID NO: 4232818 - RNA, 63 nt, Human
gccggcgauuggccgggaggaggcagucauucaaacugccuuuuguguuuggcuaaucagggc

SEQ ID NO: 4232819 - RNA, 56 nt, Human
uuuccuucccuccugggccuucagccaggccugcugaggaacuggaagggaggaaa

SEQ ID NO: 4232820 - RNA, 66 nt, Human
gccggguccuucugucuucucuggccaagaccaaaaggcccagggagggccacagggccauucagc

SEQ ID NO: 4232821 - RNA, 84 nt, Human
ggguuugggaauaacacauagauauuuuaacuuuucgagagaggaaaaggaaaaaauggcuugugauagacauuuuuuggaccc

SEQ ID NO: 4232822 - RNA, 67 nt, Human
uuugguaucauugauugcucagcuagccucuuuuuaaaagaacguuucugggaaucagaugucuagg

SEQ ID NO: 4232823 - RNA, 67 nt, Human
ucuucuauaucuacauaugcaaagcuuuccuuaacaguaaaggguacauaugcauagugggaggaga

SEQ ID NO: 4232824 - RNA, 89 nt, Human
auucuuuucaguaauuucauccucuuuaucuaccuguucuauuuugcauuuuuuagaacagguuggagguguggagucaccagaagaau

SEQ ID NO: 4232825 - RNA, 80 nt, Human
ggggaguccagaugggggcugugggagggacagacagacagcagacugggucacccccaggcuccccuucugggcccccc

SEQ ID NO: 4232826 - RNA, 64 nt, Human
aggucccauauacuuuuucugguccaugugcagaguaaugguccaaaccagugcuguggucccu

SEQ ID NO: 4232827 - RNA, 75 nt, Human
cuagaaucaguaggccaagcagcuggcacugaccaaaagaagggccuaggcuaggcugcuggccacugaggcugg

SEQ ID NO: 4232828 - RNA, 106 nt, Human
gccuagggaacccuguagauggcuuucugggccacccgccuccagggggacuugcuugucuucacccauggaaggguuggcccagacgggccaggggaauccuggc

SEQ ID NO: 4232829 - RNA, 65 nt, Human
aggauaaaggucauuauucccauuuuacagcugaagaaauuuauaagggagaaaaucuuuauccu

SEQ ID NO: 4232830 - RNA, 64 nt, Human
cuaguacuacccugaccaaguauuuuacagagcugugaaucagaccuucauuggguagugcuag

SEQ ID NO: 4232831 - RNA, 76 nt, Human
ccucagaacgugaccuuauuugaaaaaugggucuugcagauguauuucaguuaagaugaggucauacugcauuagg

SEQ ID NO: 4232832 - RNA, 58 nt, Human
guugguggaggcgagagaagaauauuuauccaguuucugccuuucugcccccauuagc

SEQ ID NO: 4232833 - RNA, 78 nt, Human
ggaagauauuuugugaaaaaacaacuugcacagaaauguaaguucauaucuacuuuuccauccagcgagguauuuuuc

SEQ ID NO: 4232834 - RNA, 61 nt, Human
gcagcguguggcuaauggcucuuauaaugagagauuuacaacuugggcuuucacaugcugc

SEQ ID NO: 4232835 - RNA, 108 nt, Human
cagaauaccuucuuccuugcgauuuauguggacagacauaauccuaauuucucaggcaaguaaauugauauuagauuugucucagugauaccaagaugauaauuucug

SEQ ID NO: 4232836 - RNA, 56 nt, Human
agggcaggguuggugcuggugcugaagauuagaccucagaccaacucuuguauccu

SEQ ID NO: 4232837 - RNA, 64 nt, Human
augcuuagcaggagagaaguuuuaaguuugcaaauaguagacauuucuccuacuuguuauuuau

SEQ ID NO: 4232838 - RNA, 78 nt, Human
aucuaagaauucacaauuuuaaaaaguggaaccuaaauaggguuuccuaauugccaugaaguuauuuguaucuuagau

SEQ ID NO: 4232839 - RNA, 87 nt, Human
gaguugggagaccguugguuaccuucagaaaugaguugcgacaguuagugccgcuugcugaacaggaaccuggcagucuccagauuu

SEQ ID NO: 4232840 - RNA, 65 nt, Human
ggggaagugguggggcuccgaguggaggaaaacgucucugcuucgucgucagccacuaccucccc

SEQ ID NO: 4232841 - RNA, 78 nt, Human
ucuugaucuuguuugaaaggagcuuuauccagaauacaauuucuuuauucagaaugaaauuucuuucagauauuagga

SEQ ID NO: 4232842 - RNA, 82 nt, Human
cgcauaacuggacggcuugaacgcgccuguggguccgugguugaacuuugucuccacgggagcgucggucucggugagugug

SEQ ID NO: 4232843 - RNA, 59 nt, Human
aggggcccaacuguuggcagccucacagcuugggcugggggccuuugaguugggucccu

SEQ ID NO: 4232844 - RNA, 64 nt, Human
gaguagggguggggagguggucugccggugcccugccccccagcacugcccuaccccuccacuc

SEQ ID NO: 4232845 - RNA, 89 nt, Human
uuugcauaugagcacagucuauacuucccaguugacaauuguugcagaaaucuugcugucucuagggcagauagagugagcauggcaaa

SEQ ID NO: 4232846 - RNA, 61 nt, Human
uacuuaucuuagggaugcuugccccagggacuuggguggggaaguagcucugagaaaagug

SEQ ID NO: 4232847 - RNA, 60 nt, Human
gagcagucuuugaaaggcaccaacccuuccuaacugaugguggucucuugaaagaggcuc

SEQ ID NO: 4232848 - RNA, 79 nt, Human
ucuccuuccauccugaaugguguaauagguuuaagauaacuaccucuaaaauuaacuaucacuuuugugaggaagguga

SEQ ID NO: 4232849 - RNA, 61 nt, Human
uuguaugaguggauagauguaucuguggaugaauagauucgucuuuaauucaccaucucaa

SEQ ID NO: 4232850 - RNA, 55 nt, Human
gcaugaauggaacccccugaguaaugugacugacucaggaagagccaguucaugc

SEQ ID NO: 4232851 - RNA, 64 nt, Human
cauugaauaguuacuuuugcucuucauuaagucuuagugauuuaagaaaggugacuguaagaug

SEQ ID NO: 4232852 - RNA, 58 nt, Human
ugguccaccgccucauucucugggaaaguuguugaccaagacguaguuggguggacca

SEQ ID NO: 4232853 - RNA, 72 nt, Human
gcauuuuauaacccauaucuuaaacaucaucucuggaaguugagagccuccaauggguuuucuauagagugc

SEQ ID NO: 4232854 - RNA, 71 nt, Human
uccggacuguccaagggccuccuggggagccugggaggccaggcucaccuggagccccuggugaacaagga

SEQ ID NO: 4232855 - RNA, 62 nt, Human
cuggagaagagguaguauguaguuugcuuuugauuucaaaaugccaccucuucugauuccag

SEQ ID NO: 4232856 - RNA, 63 nt, Human
ugcuuugguacaaaaaagauuuuggacauuuagaaauguuucuguguugauugugcccuugua

SEQ ID NO: 4232857 - RNA, 60 nt, Human
aaugauuuucugcaaacagugagccagaccaugcuggucucaagcggcagagcaguuauu

SEQ ID NO: 4232858 - RNA, 88 nt, Human
ggagucuugcucugucgcccagguuggagugcaguggcgcgaucucggcucacugcaaccuccaccucccggguucaagcgauucucc

SEQ ID NO: 4232859 - RNA, 71 nt, Human
gcaugagaccagugaguaggccuuagauuggauguguccacauauccucugagucgcucccuggauccagc

SEQ ID NO: 4232860 - RNA, 71 nt, Human
uugucugaaguuggaguucuucaugcucuguagaaacuguaguguauagaauuccagcauuuuccugacaa

SEQ ID NO: 4232861 - RNA, 73 nt, Human
ccaucugcuuggcagaaaaggucggggguuugcaaagggaguagccucugguccuuuuuucccuuaggcgugg

SEQ ID NO: 4232862 - RNA, 129 nt, Human
cugacggacaaguuacuguggagaccagucagcagguucaagggcaaagcugggggcgugguuacccacagcuuguucugaccugugauuuggcugcuucuucucacucuuugcuuggccuuucuuugg

SEQ ID NO: 4232863 - RNA, 70 nt, Human
caagaugcaagaccagucaggcaaauacacuucccuuauuuuuuaugggucugaaauaucuuuugucuug

SEQ ID NO: 4232864 - RNA, 90 nt, Human
agugaucaaacacaugcuaacacguugcucaccggguucuuguggaguguucuccgugugcguauguguuuguaugagugcugcaucacu

SEQ ID NO: 4232865 - RNA, 57 nt, Human
ccuuugcugggccucuccaucugcccaguuacugggagguagauagccccaggaagg

SEQ ID NO: 4232866 - RNA, 73 nt, Human
cuucucuguuuuccaggaaucucauagagcacugcacccuaaaaauucuucuaugaccuuaggaagcaagaag

SEQ ID NO: 4232867 - RNA, 81 nt, Human
ggcaaaagcuggaggguggaggagggaauugagaagaaauaacaagucucagugugacccuucuauuuuuccucuuaugcc

SEQ ID NO: 4232868 - RNA, 90 nt, Human
gacugauagacuugcugaugugcauguggggggaugagguguguauaugccuuucuccugacuggccauucaguguucaggcugucauuc

SEQ ID NO: 4232869 - RNA, 57 nt, Human
ucuguuuugugcuuuguuuucuuuugcuucuuugugccugacaaaaguacagacaga

SEQ ID NO: 4232870 - RNA, 76 nt, Human
aauguaauauaacugccaguuaagguagacaguaguuguggucuuaguuacauuugauauggaguuguguaauauu

SEQ ID NO: 4232871 - RNA, 72 nt, Human
ugucccaugguacugccacagaagagucucagcucucuccaggauucaguucuaaggucagugccuaagaua

SEQ ID NO: 4232872 - RNA, 56 nt, Human
guucuucagauuccauuucagugccuuuccaacacugaggaguaguucuggaggac

SEQ ID NO: 4232873 - RNA, 72 nt, Human
uguggcagaaggggcccaaggaugucagaccugagacucggguaccuggcagcucugagucccuucuucaug

SEQ ID NO: 4232874 - RNA, 55 nt, Human
gccugagauuggacauuauuuaaaagcaauuuggagaguuuucuccauuucaggc

SEQ ID NO: 4232875 - RNA, 60 nt, Human
gcgggguguggggcgguagugugggcccuguuccugcccgcgcgguguuccgcauucugc

SEQ ID NO: 4232876 - RNA, 56 nt, Human
agguauaguuauuucugcucccagaaauucuucccaaggagcagauaaacauacuu

SEQ ID NO: 4232877 - RNA, 55 nt, Human
aggaucuugcuauguuggccaggcuagucucagauuccuggccucaagcaguccu

SEQ ID NO: 4232878 - RNA, 93 nt, Human
uucuuuuggcacugucucaauaugcaaagcguguuaucugcaaaauaccugugcagaaaacauuguguguauaagaucuaaagccuaaaagga

SEQ ID NO: 4232879 - RNA, 120 nt, Human
aaugggaauucagugguuaagacaaggauuaaauagcagaagaaagauguguacauauguacagauguauguguccuuuauauguuuuuuaguacucuugucuccuuucugguccucauu

SEQ ID NO: 4232880 - RNA, 73 nt, Human
caggcgucccacugacccaggcuggguggcggcagagaguggcauucccacugagguagcuggugacugccug

SEQ ID NO: 4232881 - RNA, 96 nt, Human
ugaggcaggagagucgcuugaacccaggaaguggagguugcagugagcgagcaccacuucacuccagcuugggcaacagagugagacuucgucuca

SEQ ID NO: 4232882 - RNA, 87 nt, Human
ucccugaguccuguguagcuagguauuuuaugucgugugauguccuauaaagagcauuauacaugaagacucacccaacaggaggga

SEQ ID NO: 4232883 - RNA, 119 nt, Human
agugaagaagacagcacugaugaccaaagagaagacacucauauuaagccuauuuauaugcaauuucaguaagugguuuauuguaugguuuucggagaguggucuguguuuuguucacu

SEQ ID NO: 4232884 - RNA, 84 nt, Human
uccuugauacuuuaucauugaaaauuuaugcauuuauuuacugauuguguugugaacaugaguuuuaugguauuuugugaggga

SEQ ID NO: 4232885 - RNA, 60 nt, Human
aagucaggacagauuuucuggggguauccucugguugcucuuccagauacuuccugacuu

SEQ ID NO: 4232886 - RNA, 66 nt, Human
gucugcacgugccagggaggggucacaggaugaaugcuauaucccuccuuuuugggaccgugcagc

SEQ ID NO: 4232887 - RNA, 89 nt, Human
ccuuuggugagcauccagaucuacugaauuacugcugguaaaugaacgagaacauaaccaaaaauaguuuaguacuagguuaccuuagg

SEQ ID NO: 4232888 - RNA, 75 nt, Human
cugccugccucugaguccugcacucacccguccaccaggacagggauggcugucaggauguaguguugcugggag

SEQ ID NO: 4232889 - RNA, 129 nt, Human
uggaggaugguagcucucuucucacaacuccacuaggcagugccccaguagggacucgguguggcagcuccaacccauuucccuuccgcauugcccuagcagaagcuccuugagggucccacuccugca

SEQ ID NO: 4232890 - RNA, 70 nt, Human
gugggaacaacucugagaaacuugcaguugagggugucauaagaacuccuuuuaacugguuucuucccau

SEQ ID NO: 4232891 - RNA, 77 nt, Human
uacagucagcuugucucuaggguuguuaaaucuuuauuguucggacauaauuaaccuugaagacugagcugaccgug

SEQ ID NO: 4232892 - RNA, 60 nt, Human
ucagcccugugugcuuguguuccuuagagcucuccuucaaagagcgccgggcagggcuga

SEQ ID NO: 4232893 - RNA, 59 nt, Human
aggugcauuuacuuggggcccugacgcuaguacagacagggucagccaagaaguuaccu

SEQ ID NO: 4232894 - RNA, 63 nt, Human
gcauuuuuuuuccccuccugguagaagugcgcuuuccaccuaccagacccugaaagaaagugu

SEQ ID NO: 4232895 - RNA, 76 nt, Human
gguuacuuucuguguuacugaaugucucugcuuuccucaguugaacaaagcaaagaucuguagcccaagaaaggcc

SEQ ID NO: 4232896 - RNA, 73 nt, Human
aggacauaaaccccccuuccccaggacuuuugucuucccaucaagcuggaggaugagcuggguuuguugucuu

SEQ ID NO: 4232897 - RNA, 64 nt, Human
ggggguggagucaauucaccuuggugcuuggacuaagcaugagguggugagugacaacguuccu

SEQ ID NO: 4232898 - RNA, 93 nt, Human
ggaagggagcgggcgcaaggcggcggcggcggcugcgggugaggaacuuguugcgcccgcggcugcgcggugccccucccuccgcuccaguuc

SEQ ID NO: 4232899 - RNA, 66 nt, Human
ggcucugccugccccagcugagauaucacuuaacagugcgggcucuucaggggcagggccagggcc

SEQ ID NO: 4232900 - RNA, 97 nt, Human
cacaggugcuaaccuuucacuguuuggaugccauggucaaggaggcaaucaauucuuugaauauacuucaaacaaagaaauaagguuuaauucugug

SEQ ID NO: 4232901 - RNA, 91 nt, Human
gccgggauggucucgaucuccugaccucgugauccgccugcuuuggccucccaaagugcugggauuacaggcgugagucaccgcacccggu

SEQ ID NO: 4232902 - RNA, 95 nt, Human
cauagugcucacucauuggagcauaugaugguuaauugcauagcuuuuaguugaccuuaguuuuuucaaugagauuguuaaucuuauaaacugug

SEQ ID NO: 4232903 - RNA, 67 nt, Human
ugcugcucaagcugcagcaaaagaggaagcagacacugcucucaagaguguugcagcuugaucggua

SEQ ID NO: 4232904 - RNA, 62 nt, Human
uccuugauuuugucucuggcccuguaccauuucuucugguuugaggcccagcagagucggga

SEQ ID NO: 4232905 - RNA, 59 nt, Human
acugaugacaaugugaguguucuugggauccggaagcauucccuuugcagugucauagu

SEQ ID NO: 4232906 - RNA, 57 nt, Human
cuuuggacaacugagugacguugcugaaaagcucuacauccagcagauuguccagag

SEQ ID NO: 4232907 - RNA, 56 nt, Human
aagaagcuacugucacuaucagguagauuccuugaugguguaagacuguauuucuu

SEQ ID NO: 4232908 - RNA, 82 nt, Human
uucaagaggauuuuaguuugccagaaauguugcaaaugcacuaauuugaguaagauguugauacugaauauauccucuugag

SEQ ID NO: 4232909 - RNA, 76 nt, Human
gaucuuaauauuuguacagcuugugaguuaggugaauuauuuccaccaaacaaaacauuuuacgaauauaagcauc

SEQ ID NO: 4232910 - RNA, 73 nt, Human
uuguggacgcaauucaaggauaacauucugcagcucuuuggauauugaaugauguccucggaucaguccacaa

SEQ ID NO: 4232911 - RNA, 78 nt, Human
acaauaguguucuagaggauucuaaaggaagcugccccagcagcccugagagaaccaucuauacuuuggauauguugu

SEQ ID NO: 4232912 - RNA, 69 nt, Human
uuauccaucuucuuugagaauggaagagcuuuugugaagcaguacaucauugcucaagauaaugguuga

SEQ ID NO: 4232913 - RNA, 69 nt, Human
ucccuucuagguugcugagggaccggcuccugucacauuaugagcuguuucuuuggcaaacugauugga

SEQ ID NO: 4232914 - RNA, 64 nt, Human
aagaugcuucaugagaguugggggcaugggaugggagguccccuagcuuacugucaggugucuu

SEQ ID NO: 4232915 - RNA, 60 nt, Human
uugggauucugucaguguguguuucugagagugaucggcucacagcugacgaguauccaa

SEQ ID NO: 4232916 - RNA, 71 nt, Human
ucuuggcuuugguaguucuuucucaauguucaaggccgccuugagauuuggagguaauucccucgucaaga

SEQ ID NO: 4232917 - RNA, 95 nt, Human
ucuguaacauuguuuuugaccucuaauuucauuuugcaaugaucucagcacuggguuuaucuuuacaaaugaaauggugagaaacgcuuugcuga

SEQ ID NO: 4232918 - RNA, 58 nt, Human
ccccuuucucccgcgucuggcccgccccgcugugugaggcuugcgugggaggaggggg

SEQ ID NO: 4232919 - RNA, 98 nt, Human
ucgcuacucuuuuacuucuuuuguaaaguauugacucuuggaaggcuacaguauacaaagucucaacauguuuuuuaaaagaaauaaggagcaagcga

SEQ ID NO: 4232920 - RNA, 104 nt, Human
uugagacagggucucacucugucgcucaggcuggagugcaguggugugaucucagcucacugcaaccuccaccucccgggcuuaagugauucuccuugccucag

SEQ ID NO: 4232921 - RNA, 95 nt, Human
gugcggcgguccgagagguguacgaagaggcgggagucaaggggaaguuaggccggcuccugggcgucuucgaacagaaccaggaccccaagcac

SEQ ID NO: 4232922 - RNA, 128 nt, Human
gacuucaagcugugugugacccuggcguccgguuccucucacaggcuggagcuuuucggaaguggcaugcaaagaguccagguuuggccuuggggggaguugggguuaggaucccuaagcuggagguu

SEQ ID NO: 4232923 - RNA, 72 nt, Human
ggaaaggcagaggugauuccucccauguaaucaaaggucuugaauauuuaaauagaauuacaucuccuuucu

SEQ ID NO: 4232924 - RNA, 75 nt, Human
ugcaagagggucagguauaugugugucuaauacaguggucuguacuuccauccacauauauguggcuuuguugua

SEQ ID NO: 4232925 - RNA, 82 nt, Human
cgcaggccugcagggcgugguggugcuggagcaguaccgcacugaggagcuggcucaggccuacgacgccuucacgcuggug

SEQ ID NO: 4232926 - RNA, 64 nt, Human
aguaauuagucaguggugcuuaaaguuucaggacuuuguaaacuuuugcauacugcuuguuacu

SEQ ID NO: 4232927 - RNA, 129 nt, Human
caaaguuucauuuaaaauacauuuaggcaccuuuggagcuuggauuuuggaauguuucaguaguggacagaaaucugcuguuggaaucuucuagucuuccagguuuaauuugaaauguuuuuaguuuug

SEQ ID NO: 4232928 - RNA, 64 nt, Human
uuugggagccacugguugccucuuucuguucccucuugcccagggacaagccacagcucccaga

SEQ ID NO: 4232929 - RNA, 59 nt, Human
aggggcaggauggagcagggcuaaaagaugucucuuugggccugucugccugcuuuccu

SEQ ID NO: 4232930 - RNA, 64 nt, Human
uugguuuuggagauguccauuuuccugcuacucagagcuggaagucuacucuuccgaaaaccaa

SEQ ID NO: 4232931 - RNA, 72 nt, Human
aaaguucuguguauggaagaauguccacacuccuguaggaugagagggcucaaccauagcacaaagaagguu

SEQ ID NO: 4232932 - RNA, 72 nt, Human
aaauauauccuucuguccugcccugcccaccauuaucuagaggggaaaacucagcugggauaggauguauuu

SEQ ID NO: 4232933 - RNA, 129 nt, Human
gaaaugcgcgaaguaggagucuuuugugucugugcagaaggagguucuccggccgccggcccuuguugcacgucuggauagaccccuuauugcauuggugguagacuccccauuugcccccuagauuuc

SEQ ID NO: 4232934 - RNA, 74 nt, Human
gcgcagccauccagggguacccuggagcccgacagaagcagggccgggcuccagauguccccuggcaaaugcgc

SEQ ID NO: 4232935 - RNA, 71 nt, Human
gugauauaggaguuauggaaugagcccuggacaggauccuaagauccggguuuguuccuacuucuacucau

SEQ ID NO: 4232936 - RNA, 85 nt, Human
acuuguaaacaaaucucguuaugaagaugguuggcugaucaagaugacacugaguaacccuucauaacuagaugaacuuaugagu

SEQ ID NO: 4232937 - RNA, 63 nt, Human
gguggcagaggaggcgggagagaaggggcccacaccuccacucccaagugcuccucuggcccc

SEQ ID NO: 4232938 - RNA, 60 nt, Human
ggcacgagccaguguguguguuuccaaaguagguuuggagcagcaggugaccucgaugcc

SEQ ID NO: 4232939 - RNA, 83 nt, Human
uuugggguguuacacaacauugagcaacauuccucauccaaucagaugacugcauuuaauuuagcugugugugucgcuccaag

SEQ ID NO: 4232940 - RNA, 59 nt, Human
gagucuacaugcaggcaauuguaucccacacucuggccucacccaugcucuguggacuu

SEQ ID NO: 4232941 - RNA, 76 nt, Human
cucccccuccaaauuauaguauugucuuuggaguguuugauccacauuggcagggacugggauauggagaaaggag

SEQ ID NO: 4232942 - RNA, 88 nt, Human
auaugcuugaauguauuaugugugaguauauaugcacauauauauauguguguguauauauuuuuauauguacacuuuauaugcauau

SEQ ID NO: 4232943 - RNA, 79 nt, Human
guuucagcccagguggaguguguggggauuggggguuagaagcaguccccauggaaaacccaccuagggaacaggaagc

SEQ ID NO: 4232944 - RNA, 64 nt, Human
uuggucaggcauguggcgcaugcuauuccugagcaggucgggcagcuggugcuugccuggcuaa

SEQ ID NO: 4232945 - RNA, 69 nt, Human
accggccagagcacaccguuugccuucaacgugggcagcacaacugagagcaaaccuguguuuggaggu

SEQ ID NO: 4232946 - RNA, 58 nt, Human
gagacaggaagagaacugcucagccuggcucugcauagcgcucauuuuccuccugcuc

SEQ ID NO: 4232947 - RNA, 70 nt, Human
ggguggcauggggagcagcuagaacaaugcagauuuauccacaaucccuuucugcuguucaccaccaccc

SEQ ID NO: 4232948 - RNA, 57 nt, Human
cucaccuugugauccacccgccuuggccucccaaagugccgggauuacaggcgugag

SEQ ID NO: 4232949 - RNA, 130 nt, Human
gaaagcggccugccuacccaccccaucgcugccguuuugcagucgucgcucccaccuuccgcugccgccuggagggaagccggagcgacgggggucacggcggcggucagaggguaaaggucuugcuccc

SEQ ID NO: 4232950 - RNA, 63 nt, Human
ggcuagaaggaagccccugcugaagcagccaucagagcgccucagcaguuaagcuucccugcc

SEQ ID NO: 4232951 - RNA, 76 nt, Human
uaguguacuaguccaguaguguuugcauguggaugucuguggaugacaguuauuguagcacuuuggcagugcacua

SEQ ID NO: 4232952 - RNA, 73 nt, Human
ucuguuucaggggucuggaauggggcacaccucccauuucuaacacccuccuuccagaugcuccugaagcaga

SEQ ID NO: 4232953 - RNA, 102 nt, Human
ugcugcagccacccagaucauuguguaguagagguggcaccauuuuacuauguguccucccugcacucagugaagucugugaagggaggggucagugcagca

SEQ ID NO: 4232954 - RNA, 76 nt, Human
aauaugcuuguuuguaaggcucuuagaauaacugucuuugacugcucauuuuuagucuugcugcaaucaguauguu

SEQ ID NO: 4232955 - RNA, 56 nt, Human
ccaugaagugaaaagguuaauuuugcugaauguuuuaaguugaaguuacuucaugg

SEQ ID NO: 4232956 - RNA, 85 nt, Human
gucuugucuuggccuggaucauauccagucaccacuaugcaacaaaugaugugcacugggcaaggauaugauggguuaugaaagc

SEQ ID NO: 4232957 - RNA, 75 nt, Human
cucagaugaugucuucagggaauuuuuggugggagggacccauuuucauucaacuucuuugaagacccauuugag

SEQ ID NO: 4232958 - RNA, 84 nt, Human
uucagcagucaagcucagugugucuaugagguaaugaauaaacuuuuauauacauguggagauaacugaagcacguacucugaa

SEQ ID NO: 4232959 - RNA, 65 nt, Human
gcuguugagucagacaaguuuucuaaugagcugcaauauucucauaaacucucugaucuuacagu

SEQ ID NO: 4232960 - RNA, 129 nt, Human
uaucuuuucuaaaagugauaugugcucuuuaugaaccuucacauucauuucuuauguuuggguugugaguaaagagaggaaagggugugagguuugguucauuuucaggggaugaaagaaggaaaagaa

SEQ ID NO: 4232961 - RNA, 83 nt, Human
ccuccucgggcagcagcaggcgcucggccgucuggaucucccuggaggugauggucgagcgcuuguuguaaugcgccaggcgg

SEQ ID NO: 4232962 - RNA, 60 nt, Human
uuuuacaaugcaaauucuugcuguuucacuuucuggauucagcugaauaguuuugugaaa

SEQ ID NO: 4232963 - RNA, 83 nt, Human
gcuacggcugaucugacaggaggcagagcucagguggccaugcuugcuugccccuggcucacuuucuguugugcagccagugc

SEQ ID NO: 4232964 - RNA, 63 nt, Human
ucaugccccuuuauauguuaagucuuauguuuuaggauuuugcuuuagugaaggaaggcauga

SEQ ID NO: 4232965 - RNA, 78 nt, Human
auuggcuuauuacccagggacuauuaguuguguauuaacaucaaguuaaacacuguaucagucuucaauaagcucaau

SEQ ID NO: 4232966 - RNA, 60 nt, Human
agggagguagaggaaaagauuaucaaguuccauauuuguggucuccucucugucuucccu

SEQ ID NO: 4232967 - RNA, 57 nt, Human
ucuugauggugauguugugucauugcuucauuuuuggcacucagucacuacucaaga

SEQ ID NO: 4232968 - RNA, 64 nt, Human
ggguugugguagagcuuaaaugagguaaugcaugcacggaccccagcucugagccacaccacuc

SEQ ID NO: 4232969 - RNA, 123 nt, Human
gaugauacauuguaauguuuugggugugauuccuuugcuuuucacacugguuaaaaggauuuuuuuuccgugaucaccaaggacagagggaccagagcccagucuuucaggaaaugauacauu

SEQ ID NO: 4232970 - RNA, 67 nt, Human
uccaugaugcugugagaccauuuguugaggaagguguccuucuuaaaguugucacagcugcuaagga

SEQ ID NO: 4232971 - RNA, 114 nt, Human
gguucucuuuggcugcuccucaggccucuuggcgucucugggcugacccaggucuccggugguaaagggacuggagcccguggaggcgcaggcuccagaguagcuagcuuugcc

SEQ ID NO: 4232972 - RNA, 122 nt, Human
ccuuaccaucguggaauuuacaaucuaaauagggcaagaggguuugacaugagcuauccauaugaaguagugacucaugaauggcucuuugugcuggggauggcaaguguugcauggugugg

SEQ ID NO: 4232973 - RNA, 75 nt, Human
gucccaggucaucacugagagcagaucccacgcgcccgagcugccgcggugaagaugccucaggugacccgagac

SEQ ID NO: 4232974 - RNA, 60 nt, Human
acauuuuaaaaacaguaccuggaggugacuaagugacuacugcacugugauuuaaaaugu

SEQ ID NO: 4232975 - RNA, 71 nt, Human
uguacuuuaaagcuuugcccaaugaguuauguggcuccuaugguauauaacccaaggcaggcuguggugca

SEQ ID NO: 4232976 - RNA, 129 nt, Human
gaggucuguccuuugacucugugaguugggcagccuaacaugguuauuguuaauugacgguaaaguaucucgagguccguuagucuauguuuuuguucuuauuuaucacuguguaugucuuugggcuuc

SEQ ID NO: 4232977 - RNA, 58 nt, Human
cugcugcuugauugcaggaaguucuccccaaugucacuccugccuuaguccagagcag

SEQ ID NO: 4232978 - RNA, 130 nt, Human
acauuuuuaugguugcuuuauguugaagagugcuuuggcaauggcuuuuuucuccccuuggauuuauuauuugugaacuugaagcaugaaaauaagccuuggcaaaggauuaauuuaaaauauucagcuu

SEQ ID NO: 4232979 - RNA, 72 nt, Human
acaucaaaauguguagucuugaucuaaugacuuagaucuaaugauuuugauuaagauuacauauuuaagugu

SEQ ID NO: 4232980 - RNA, 58 nt, Human
caggcacaagaucggcuagauaucauaucuagguguuuagcucugacuaugugaucug

SEQ ID NO: 4232981 - RNA, 71 nt, Human
aaacuuguagggaucugccucuuccucuuuaagaaauuccuuccagggauacuuuguuucccugccaguuu

SEQ ID NO: 4232982 - RNA, 87 nt, Human
ucccuggcaggccaggcgucgggugcuggugcucgcuccucuggggccagccuggggaggcagcauggcagcagugccugucaggga

SEQ ID NO: 4232983 - RNA, 89 nt, Human
ggaaauaaaaacucagaguauaaauaucuauauuguuaccauuaucugggauaauugaugauuuauaagaagcugagguuucgucuucc

SEQ ID NO: 4232984 - RNA, 65 nt, Human
gcuuaaaaacgcagagaguaaugcugaacuuaaggguuuagauguagauucucuggucauugagc

SEQ ID NO: 4232985 - RNA, 67 nt, Human
aagcagagggagcuccaagaucaaggcugaguuucccuaagucauggucucccagcccccucuguuu

SEQ ID NO: 4232986 - RNA, 65 nt, Human
aggaaagggggcuuggacacuggccaaggagaccccuucgugcuguggacacagcucucuucacu

SEQ ID NO: 4232987 - RNA, 82 nt, Human
uauuauagccaaguuuucuuugaaaguauuggaaaacuaaaauuaaaugacaaggacuuugaauuagaauuuugcuguaaua

SEQ ID NO: 4232988 - RNA, 79 nt, Human
gaaggagcuuagaugcugucauucaccaaaauaccacaugauaaguuccguuugggacaugaugcauuugaaagccuuc

SEQ ID NO: 4232989 - RNA, 86 nt, Human
ugcaugaaaaguagagucaaaucaagucagcugaauuccagcagcugcaguggaagugucagcaggcugguuucugaguuccugca

SEQ ID NO: 4232990 - RNA, 65 nt, Human
cacugcuucuuuccuuggugacuucacuuucacuguugcaguccuuaggagaggaaguaucugug

SEQ ID NO: 4232991 - RNA, 67 nt, Human
auuugguauucaguuggauuuggauauauuaggauuaccugucagucacaguucaacuaguucagau

SEQ ID NO: 4232992 - RNA, 61 nt, Human
cagggcuuuuuccuccucuuugcagccacaggaauggaggucauuaaagaaaagaguccug

SEQ ID NO: 4232993 - RNA, 99 nt, Human
gggggcccuccaggucgggccgggcuguggagaagggguguaagcggucacgaccccgcuccuugcagccucuggccuccuuaugucuggagggcuccc

SEQ ID NO: 4232994 - RNA, 92 nt, Human
gauagggccucaauucauaauggaugauuaaauggaugaagagacaaauauuauccaagcuuucuguuuauccacucauccaugccucuauc

SEQ ID NO: 4232995 - RNA, 86 nt, Human
ggucccagcccgaccagcagaggagguggcagcaccagggccccaaccugguguuccgguucugcucuggggucaggcuggaggcu

SEQ ID NO: 4232996 - RNA, 60 nt, Human
acauugcagcuccuaccuugucucucagaucacuaguucaggggaagccagcugccaugu

SEQ ID NO: 4232997 - RNA, 65 nt, Human
uucuagaagggccuaggcauaagguaugguuugggaaauugccuuggccaaggaccuuuuuggag

SEQ ID NO: 4232998 - RNA, 75 nt, Human
aaggcagcuggucaauaaucauguaguacaauggcuuggaauuguaaccacuaugguuauugauuguccuguguu

SEQ ID NO: 4232999 - RNA, 75 nt, Human
ucuaacagccaggggacacuccugcuugggcugagacuugugcagcucuaguaggaaugucccucugugcuuaga

SEQ ID NO: 4233000 - RNA, 62 nt, Human
aguuaucagagcuaguacuugcaggugagucucucuuuacuucaggagcagucucuggaacu

SEQ ID NO: 4233001 - RNA, 60 nt, Human
aggucgugggugagagagagacaucuggcuccuuggccucuuucucuccagccuggaccu

SEQ ID NO: 4233002 - RNA, 59 nt, Human
auguccugguccacagaagggacucaaugucuguguucccuuuguucuugcuaggaugu

SEQ ID NO: 4233003 - RNA, 57 nt, Human
ggagguguguucuguuuuaguguuuuccagucacccacuagagcagcuucagauucc

SEQ ID NO: 4233004 - RNA, 87 nt, Human
gaaagcagagacuugaaccugcuggagucuaguuggucugcguuuuuauguuggagaaccauccugguuccagcuuauuuugcuuuc

SEQ ID NO: 4233005 - RNA, 99 nt, Human
ccuccuuccuguaccuaguguggaggaggagaacuuggcacugagcugagcuggugggcgccugguauucuuccucuccauuuuuggaacagaaggggg

SEQ ID NO: 4233006 - RNA, 57 nt, Human
ggucccaggggagcucucugauuggcugugcuugggccagucauuaucuccuggacc

SEQ ID NO: 4233007 - RNA, 83 nt, Human
gauuuacaggggcccuggagauggaaguucugaaaaaauguugccuuuauucaguauuagugcauuaucagggacuccagauc

SEQ ID NO: 4233008 - RNA, 73 nt, Human
ggauccauauuggcugucagcccggauggggcuguaauuaaacacagccccguggugggaugacaccaugacc

SEQ ID NO: 4233009 - RNA, 89 nt, Human
uuauuuaaaaaauaauaauaguaaaugaaagcaauuuuagagguggaaaauaccuuagaauggaaucauuugcauuauuugacaaauga

SEQ ID NO: 4233010 - RNA, 67 nt, Human
ggaugauuuucaguuguguggguguuaagucuauggauugggaauuuaccacugaaauugaucguuc

SEQ ID NO: 4233011 - RNA, 83 nt, Human
gcugcgcacaguguuggcucggcuggcugcccucuccaaccgguggucuggggcgggugagcccggcugaccugagugccugc

SEQ ID NO: 4233012 - RNA, 63 nt, Human
ccgugugcauauguguguauacaaacacgcaugcaugccuggauggacauacguaugcacagg

SEQ ID NO: 4233013 - RNA, 79 nt, Human
ucuccaagcagcagauaaagguugcauuucuuucaaaaauacauucaaagaccauguuauccuucauuuugguuugaga

SEQ ID NO: 4233014 - RNA, 70 nt, Human
ugugcccugauaaaucagcaccucaguggacuugccaggaaguuuccugaugucaaauuuaucaaagcca

SEQ ID NO: 4233015 - RNA, 89 nt, Human
uucauauuuugaggguuuuuuugggccaaauauauuuacuuuuaauaagaaaguagagagugucuuccagaaauuauuaagauauagaa

SEQ ID NO: 4233016 - RNA, 55 nt, Human
ucucucgguacagcuggcuggaagauccuuuuccagccugaacuuuguccagaga

SEQ ID NO: 4233017 - RNA, 73 nt, Human
gcuagacaucuguccauggcacuggacaaaaugcacucgggcauacuccaaauucccaugacagaagucuagc

SEQ ID NO: 4233018 - RNA, 103 nt, Human
guaguaaucaaugcauagcuacagcugguugaaggggaccaaauccauugaagaggcgauuugguuccauuuuaccagcucuagcaaagcauuguagugcugc

SEQ ID NO: 4233019 - RNA, 61 nt, Human
gggaagugagcuggaaucaagggcacaauuuggccaccuacauaucuggaccucacuuucc

SEQ ID NO: 4233020 - RNA, 66 nt, Human
gcgcccggcuuccugccucucgccgcccgcccuccgggccgcggcauggcgagcaggacugggcgc

SEQ ID NO: 4233021 - RNA, 105 nt, Human
aguucugacuaugggcuucuacugagcauaaaacccauacuuucauuuuucuguuuggauuuugcugguguggguguuaguuugcuuauuugguccuaaagaacu

SEQ ID NO: 4233022 - RNA, 70 nt, Human
ugcccgcuggcugggcuccagcuuccacuucuugaccuugaaauaggggcuggccccauccaggcuggca

SEQ ID NO: 4233023 - RNA, 67 nt, Human
gguggccuaacaaugguggcaaacucuggguuaaacguagauaaauugcuuucuuuguagguuuucc

SEQ ID NO: 4233024 - RNA, 87 nt, Human
ucucaucguguugagacucgagucucucagaccuuggauucauucccuggugucuuugagccucaguuuccucauugguaaaagaga

SEQ ID NO: 4233025 - RNA, 62 nt, Human
gaguaagggagcagaagcugugaaaugcuguauugcccuuucacagcgucuuucucuugcuu

SEQ ID NO: 4233026 - RNA, 91 nt, Human
gggcuggcucuggagggcugggcuuggcaggcuggggagagcaaggagguggggagcccccagucugccggcccggccccuggucagcacc

SEQ ID NO: 4233027 - RNA, 61 nt, Human
guaggaguguucgggaacuggggagcagugcaguuuguuagauccuuccaacuacucuuac

SEQ ID NO: 4233028 - RNA, 75 nt, Human
auuuuuggguagcucaauagagccacaaagugaagaaagcaauaauuauguggccaccagagcugcuauuagagu

SEQ ID NO: 4233029 - RNA, 68 nt, Human
aucucccaaauuagccucuugauucugucacaaacuuucagaacucaaaggcuugugguucugggaau

SEQ ID NO: 4233030 - RNA, 73 nt, Human
ggcucuagucaagaaugaauuagagugaaggaaagcugugugacaccuggcauuccucucuguucauggagcu

SEQ ID NO: 4233031 - RNA, 97 nt, Human
cuuuaauuucaagguguugucucuuguggauguugggaaguauuguacuugaauauuugaagauaaauauggagaaaagcaguggugagaacuaaag

SEQ ID NO: 4233032 - RNA, 69 nt, Human
ccccagcuucaaaggcccugauggugccccuucccuuuuggcagcacugucaggauugagucucugggg

SEQ ID NO: 4233033 - RNA, 58 nt, Human
cugggaaggaagggaaaaacagguuuauccaguuacuacuuuuucccccucuccucag

SEQ ID NO: 4233034 - RNA, 70 nt, Human
ccaggcagcggagugaaaacccgcccugggggccacgccauccccaugcuggcccacacccgcugcgugg

SEQ ID NO: 4233035 - RNA, 68 nt, Human
gggauggagggguuguugcuugaguaauugagauuuauuuuacuuuuuugccaucccuccagcauccc

SEQ ID NO: 4233036 - RNA, 80 nt, Human
gaguuaugagaauuaaauguauuagccuaugugagagcucucagugcaggguucuguaaaugcaaguuuuccuccuauuc

SEQ ID NO: 4233037 - RNA, 77 nt, Human
acauuuggggguuccagacaguuauaugggcucagagauggcccugucagcucucauggacauuaacacccaaaugu

SEQ ID NO: 4233038 - RNA, 83 nt, Human
gacgucacucugccuccagcucgaggcaggggcugcagagcuuuccucuucaaccuucagcuugaguuggcaggugcacaguc

SEQ ID NO: 4233039 - RNA, 88 nt, Human
gcugguggcagccauggcuggccgggcauccacaaugaagaguuggauguugcugauccuguggcugugguuaaauuucugcaccagc

SEQ ID NO: 4233040 - RNA, 78 nt, Human
augugauugugggauaaccugagauaacauuuguugccacugauagaauguuguuuauggguuaucaagauaucauau

SEQ ID NO: 4233041 - RNA, 83 nt, Human
uccccucggcugcuuggcacagagcugcagccugggacucuccguggacccagacuggggauuuugccaggggggcgauggga

SEQ ID NO: 4233042 - RNA, 94 nt, Human
guuggagucucacucugucaccuaggcuggagugcagugacacgaucuugacucacugcaaccuccaccucccagguucaagugauucuccugc

SEQ ID NO: 4233043 - RNA, 61 nt, Human
uuagaguguguguaguagggugaucauuauaguuguguaguaaccuauuguaauauucuaa

SEQ ID NO: 4233044 - RNA, 55 nt, Human
gcggugccuccuccaguguugcugcuguccagcagcucaguggcuggggcgcugc

SEQ ID NO: 4233045 - RNA, 78 nt, Human
acugagcaccuacuaugugucuguaucuggugcccaguuuaggugcugggcacucuguggagacaagauaggcucagu

SEQ ID NO: 4233046 - RNA, 55 nt, Human
cagcuguauuucucugguuagacaggucauggggaacaaaagggaagaacagcug

SEQ ID NO: 4233047 - RNA, 79 nt, Human
aauacaauugcaauggaagaugagaagaauugcuaagaaauguagccucguaugucuauuuuccccuguaauauguauu

SEQ ID NO: 4233048 - RNA, 95 nt, Human
gcggcuggcugccaccgaccuguuguucacuuugcuggugagccaggugaccaucgccauguacaugaagggcggguaaccugggggccagcugc

SEQ ID NO: 4233049 - RNA, 88 nt, Human
ucccugcuguuugcauaaugcuacuccuuucucagaccauguugucauggcuguuggagcuggaagauggcuugguagguugcaggga

SEQ ID NO: 4233050 - RNA, 87 nt, Human
augccaaacucaaacacuauuguccgauuucuuuacuugcaacaagagaguagaagggacaguauuuguuuugugauguuggggcgu

SEQ ID NO: 4233051 - RNA, 101 nt, Human
cauuccaguuuuauucucagacacacaacuucugcuuagauaguucagaguucccauaauccugucuuagaaaaaggcuguggucuuagggaaguggaaug

SEQ ID NO: 4233052 - RNA, 64 nt, Human
uguauauuuucuguauaaaauauguguuguguauuaaccuuuaucccauacagagagugguaca

SEQ ID NO: 4233053 - RNA, 85 nt, Human
auggcaaaggagcaagagugagcaagcagaaaauaugaaaaugcuuuucaggccucugcuggugucauuuuugcuaauaugccau

SEQ ID NO: 4233054 - RNA, 80 nt, Human
guggcccccgcucccgccacggggcaugggaggcagguagcccagccugcgccaggacacccguggcgggcggaacccgc

SEQ ID NO: 4233055 - RNA, 129 nt, Human
agucaucuucucuguaggcucugagucugugugcuugugggaucauggaucagggccacuucugugacaugaaaggcuuaugaucugacccaucgagccagcuaccaagcaccugcagagaagccugcu

SEQ ID NO: 4233056 - RNA, 129 nt, Human
accuucccuccuacucuggucacacugcauaacacgcauucucuuuccagguuuccaccucacuccucgugccugucuaucuuugucaucucuguugccgugugucuaaauccuauuagcucagaaggu

SEQ ID NO: 4233057 - RNA, 80 nt, Human
aaagaccaucacaagaacaacugcuuuaaaagcaccgccuuuggugcuguugacuuuguuguucuuaucaagauguuuuu

SEQ ID NO: 4233058 - RNA, 59 nt, Human
gagcccguguguguguguguguguguauguguguacacgcagacacauguaugggccuc

SEQ ID NO: 4233059 - RNA, 57 nt, Human
ggacagacagcauggaaccauagcucuacacacacuagcauggcuccagugucuucc

SEQ ID NO: 4233060 - RNA, 61 nt, Human
gccugagauuugaguuccuacugaguccccuacaggggcacagcuaugagcugaauugugc

SEQ ID NO: 4233061 - RNA, 78 nt, Human
ccaccccccaggacagagcaacccuacgcagccccagcgcaguuaaauacaguugggagcuaggggacuggagggagg

SEQ ID NO: 4233062 - RNA, 76 nt, Human
uugugagaucgaucuguccuggcaguuaacacgaugugcaacaguguguuagcauggaacagaacgcuuuucacaa

SEQ ID NO: 4233063 - RNA, 61 nt, Human
aagaguuaggagugggcuuugaagucagacucauguggauucaaguccuggcuuugcucuu

SEQ ID NO: 4233064 - RNA, 78 nt, Human
gagaaaauagucaggaugagggaugaggaguacacauaggaaauuuuugugauuuucuucauuuugauuguauugcuu

SEQ ID NO: 4233065 - RNA, 124 nt, Human
ccaaguuuuugucuucuucuugucuugaacucuuuaacugaaauacaggcauagacaauccguguccgcccuuuaaagaugccuguuaucugcagaccuucagggcagagaagcuggaaguugg

SEQ ID NO: 4233066 - RNA, 84 nt, Human
ugacaaguuaccuuuucuuguuuacaaguuauuuggccucuuugaauuacuuguaaaauagagauagggauucuuucuugauca

SEQ ID NO: 4233067 - RNA, 69 nt, Human
ggggcugcuuacuauaggguuaacuauguauauucauuguuaagaguuaacuugugguuuggcuguuuc

SEQ ID NO: 4233068 - RNA, 80 nt, Human
uccaccacuuuaaacauuuugggagaaaguuguuacuuuggcuugauggcagcucauuuggaaauggaguacuguuugga

SEQ ID NO: 4233069 - RNA, 83 nt, Human
gcaggagaugggauggacguuuguguauuauguaccaggcuuugcuagguuacauaauucauuagcuccucuggauggccugu

SEQ ID NO: 4233070 - RNA, 58 nt, Human
uuuuaacuuuggguucucuuuagcugggaucuggccagaaggaggcuuaaaguuagaa

SEQ ID NO: 4233071 - RNA, 57 nt, Human
agcccuauacuuagauuuauucauaacauucaguuaaguagauuagagcauaggguu

SEQ ID NO: 4233072 - RNA, 82 nt, Human
uccugaagugggaggaguguugaguaaguuggucuuucccggugcuauacuugccuccucuccacggaagaauuguucagga

SEQ ID NO: 4233073 - RNA, 78 nt, Human
gauggggcugggagugggcagggaaaagaugcaucauucacuuucaucgaggucaccaugcccuucucugcucuuuuc

SEQ ID NO: 4233074 - RNA, 58 nt, Human
ggcuuuuucccuaggguaagaggaaguaguauuuuuuaaauuagccuaggagggagcc

SEQ ID NO: 4233075 - RNA, 55 nt, Human
ccaagagcuucccauagcuucuuguggccauuuccagaacuaaggggagcucugg

SEQ ID NO: 4233076 - RNA, 55 nt, Human
gcuggcgauggccgagucuccggaagaauuggcaggacucguucgccgugccagc

SEQ ID NO: 4233077 - RNA, 109 nt, Human
gguaauacaaauauaaagcagguugucaucuuucuaaagcuggucagggacuaagucauguuuuggcuauuguuuuaaaaaaugagaauuguuugacaacuuuauggcc

SEQ ID NO: 4233078 - RNA, 89 nt, Human
gugagguuguaugacugcucagugaauggaaauugucuuuucauguaguauaaaaggaauuugauuuuuugagcaguguaucaacucau

SEQ ID NO: 4233079 - RNA, 57 nt, Human
gcccaggcuggagugcaguggcacauaucuguucacugcaaccuccaccucccgggc

SEQ ID NO: 4233080 - RNA, 88 nt, Human
gcuggaaggggccgcuuucuggggagugaggugagacauagcggcccgggcgcugccuucacuccuggagugaguuuccauuuccagc

SEQ ID NO: 4233081 - RNA, 56 nt, Human
ccauaguuuguucuuuuuuauugcugaguagcacucacgguaugaauguacuaugg

SEQ ID NO: 4233082 - RNA, 64 nt, Human
ucaguagcauuuaauguucagugcucuugucauaaacauagaauggauauugaguaguuucuga

SEQ ID NO: 4233083 - RNA, 68 nt, Human
gagacagggucuugcuacauugcccagguugaucucaagcuccuggcuucaagcaauccuccugccuc

SEQ ID NO: 4233084 - RNA, 55 nt, Human
aguagagacgggguuuuaguagagacuuggccucccagaacccccuuccucugcu

SEQ ID NO: 4233085 - RNA, 103 nt, Human
ggaagccagaauugaucguuguugaagguuuuguuuucgguuuuuuuuaaaucuaaaaacaaauccaauaauaaaauuuuuaacuguacgaauuacggccccc

SEQ ID NO: 4233086 - RNA, 58 nt, Human
uugucuuaugcugcauagacuauucaccuccuaacuugaaggucuaaucauaagacaa

SEQ ID NO: 4233087 - RNA, 83 nt, Human
uacuuauuuuuuauagacaaguaugagaaagcuauuaccuccugaggagcaauagccuacaugcgucagagacagagugagug

SEQ ID NO: 4233088 - RNA, 124 nt, Human
gcucagauagggauagagggcugggggccgggggagcgcacagaaggaagcagccaccucccucucguggccuagucaaucuuaucgcaacgccccaagcgccccugaaccccccgcucugagc

SEQ ID NO: 4233089 - RNA, 78 nt, Human
gcagagguucaagugaaaugcuuuuugcgaaaugugcaaguuccuuuuguacauuuacaaaagcuuuauuuacucugu

SEQ ID NO: 4233090 - RNA, 68 nt, Human
ccuagacucaggucuugguaggccagagucuagguuuuggcugagacuccuucuaagaccucauuagg

SEQ ID NO: 4233091 - RNA, 59 nt, Human
accgcggcuguaguggagguggaaguagagcuuuuccaccacgaaacugcagcugccgu

SEQ ID NO: 4233092 - RNA, 98 nt, Human
agguguccaaugugaggugcagcugguggagucugggggaggcuugguacagccagggcggucccugagacucuccuguacagcuucuggauucaccu

SEQ ID NO: 4233093 - RNA, 94 nt, Human
ggaccccaacaaaaagcugauugucuuuuuaaaaguuauuauuuugcccugagcaaauugcauuuuaauuggggcaguuagaauguugauuucc

SEQ ID NO: 4233094 - RNA, 96 nt, Human
ccacuguuaaauuugccucuguuguauuuauuucccuuuccaagauucuacuuugggagaggugaagcuaauuaauuugauaaauugugucagugg

SEQ ID NO: 4233095 - RNA, 74 nt, Human
auagauacacauguacauacauagauauacacacauguauguguguauauguguguguguguguguguauauau

SEQ ID NO: 4233096 - RNA, 105 nt, Human
caguugacaaacuccuuuucucauuccauccuggcuuuuuccugccucuuccaaccugguaggggcccgugggauggacagagggcugcaaaggaaauucagcug

SEQ ID NO: 4233097 - RNA, 72 nt, Human
cugucacuccuucccagagggagccaaccagucuucagacaugugccagccucucuggcaaagcggugaugg

SEQ ID NO: 4233098 - RNA, 116 nt, Human
aaagugaaguguuacaacccacagcaucauaugugauaccauaaugacugucuacacauagccgaucgucgugagugcugucaccugcugguuuggggguaguaaugugucgcuuu

SEQ ID NO: 4233099 - RNA, 61 nt, Human
ucugggccaacccuuccaugggugaagacaagcaagucccccuggaggcggguggcccaga

SEQ ID NO: 4233100 - RNA, 66 nt, Human
aacgggguugauuauuggaagaauacuccgugcaugaggaggcuuuuccaaaucgacucucuaguu

SEQ ID NO: 4233101 - RNA, 69 nt, Human
caugauacgcaucggguagaggagcuggagaggagcuuguccagacucaaaaaccagauggguaagaug

SEQ ID NO: 4233102 - RNA, 69 nt, Human
gcugaguggccugacagaucggaacagugugauucagaaaucuugugcauuugcuaugggccauuuagu

SEQ ID NO: 4233103 - RNA, 56 nt, Human
cuaggcuuucugugugacuagacugagauguugaguuugauucacaaaaagcuuag

SEQ ID NO: 4233104 - RNA, 61 nt, Human
ugcuucuuuaggauguaguuauaacuaaaccuguuauacuugaacaucacuaagagaagua

SEQ ID NO: 4233105 - RNA, 83 nt, Human
gcuacaaguaucaaagaagcaaagucaucuagaguagucuacauaggagcucuuuggacuuuguuuuauuaugguaaaauagu

SEQ ID NO: 4233106 - RNA, 57 nt, Human
caugugcagcuucuucagcgagaucucacacuccaucacacuggaggagcugccaug

SEQ ID NO: 4233107 - RNA, 71 nt, Human
uagugguaugcugaagccagcucgcauagaacagugauagcugauugcagccucuuguuucagccccacua

SEQ ID NO: 4233108 - RNA, 68 nt, Human
ggcugcugguuucuuguuuuagaagauuggguuuagacuugcccuuaaaaccuagagaucagacaguc

SEQ ID NO: 4233109 - RNA, 101 nt, Human
gcaauuguguaaaacaacucagcacaauaccuggcacuuaauaauuacugcauguaauuauaauguauagcugugccugagaagugaauguacaugaaagc

SEQ ID NO: 4233110 - RNA, 130 nt, Human
ggauuaaugaacauuuuuaggacugguagcuuuuagaaauggcuuuaugagguuaucuaugucguauccaaaaaguagagaugcuagaaaauuucauauuauuuugugcucuggccuuuguucauaaucc

SEQ ID NO: 4233111 - RNA, 63 nt, Human
uuaagaaacauuuuuaugacaguuuagcuuuuucagcugcuuucauuauguuguguuuuuuag

SEQ ID NO: 4233112 - RNA, 60 nt, Human
guugagacguguauuggaaucucugacuagucagaauacguucuuaguuauauucucaau

SEQ ID NO: 4233113 - RNA, 83 nt, Human
guguacaccccucugugauaugguuuguaauauccaggggguuagagggugauauugcuccccauaucgcaguggggguacac

SEQ ID NO: 4233114 - RNA, 57 nt, Human
uuagaggagaaacagccgugauagucaggaaucuugaaauccagugaucuccucuaa

SEQ ID NO: 4233115 - RNA, 58 nt, Human
ucccugcaggcauguacucugagccccugaggcaguuuagggacagcucuguagguga

SEQ ID NO: 4233116 - RNA, 58 nt, Human
ggguggcaagucuuucugcaacauuuuuggaauacaagcagaaagugauuugcuauuc

SEQ ID NO: 4233117 - RNA, 75 nt, Human
ugcuaucauauaccuagaagagacuuuucuggaggaauuucuccacuagaaaguaugcuuuuauaauugauugua

SEQ ID NO: 4233118 - RNA, 91 nt, Human
acgguguagacauuucccccaguaugagcacagugccuggaccugaaugaucaucuuggcaguucuugugcuuuuacuuuguaaacauugu

SEQ ID NO: 4233119 - RNA, 129 nt, Human
ucaguuauggggacuuuuucucugcccuucgucauuaugcagccugugaacagcgucugggaaagugguggucauugguugcauaauuugaucugaggcuuauggaggaaaggacccaagugacucuga

SEQ ID NO: 4233120 - RNA, 70 nt, Human
ggagccgauuaccaagcguguuuaggaaaugcugccucuguaagggcacauuacacgcaguaauugcccc

SEQ ID NO: 4233121 - RNA, 70 nt, Human
gucaggugcaccuccaccaacaauucacugaggauaaaaugcacgugggguuuggugaagguucacugac

SEQ ID NO: 4233122 - RNA, 61 nt, Human
uggcaugguuuccugcaacguucugccucuggggcagagcagcuuuucggaaccacugcua

SEQ ID NO: 4233123 - RNA, 121 nt, Human
uuagggcuuuucgggggguaugacugcagggauuuuagagguuuuuuuccucauucucuuuuuaagaggugauaaaaagcauuuaaauuagcggcagggcgguuaacacccgcagcccuag

SEQ ID NO: 4233124 - RNA, 64 nt, Human
ggaggcauugcaggguuucaauacacaggacauguucuaguuacagaagccuugcucugcuguc

SEQ ID NO: 4233125 - RNA, 90 nt, Human
guggccucaccaguaggacacagaguauggaaguguccccagccucggccugagccacaucccccuacuuguguccugcucugcggucac

SEQ ID NO: 4233126 - RNA, 55 nt, Human
cuuuggggcugaggaggagguuaaaggccaaaugcuguuucccaacaccccaaag

SEQ ID NO: 4233127 - RNA, 90 nt, Human
gaauucucugaugcugaaugagaaauaauuguguacugaaggcuuugccacacuccuuacagucauaagguuucucuccagaaugaauuc

SEQ ID NO: 4233128 - RNA, 60 nt, Human
gggcacaggcugcacgaccccagccuggccucgggcuugcugggagucgcgucuguggcc

SEQ ID NO: 4233129 - RNA, 70 nt, Human
acguuauagaugcuucaugaaagauuuaaaaguugcacuuuucuuuugagcaugaugcaaacaguaacgu

SEQ ID NO: 4233130 - RNA, 59 nt, Human
gcuacuaguacagcaaggacuacaguggacauggcuauggccuuggugguuuugguagu

SEQ ID NO: 4233131 - RNA, 58 nt, Human
uguaccugguuucuuaaacccaaaugccuccaauucuggaguuugaagaucagguuua

SEQ ID NO: 4233132 - RNA, 63 nt, Human
gggaguugugguuggcuucuggaaggugcuccaggacggcauagauggcagccagcugcuccu

SEQ ID NO: 4233133 - RNA, 73 nt, Human
ucugaggaauacggguuuauuuagucuuagcuccuccauucccugggacaauuguacucgauuucaagucaga

SEQ ID NO: 4233134 - RNA, 63 nt, Human
agaaccagacugagaaagugccacagggcgggggccgcauccgccccucggcuucugguuacu

SEQ ID NO: 4233135 - RNA, 77 nt, Human
uuggauaggagcauuuugguggguuuugcacagacuugcaucuugugucagaaugugacaucaaaggcucaguuuga

SEQ ID NO: 4233136 - RNA, 61 nt, Human
gugaaacuggaugugaaaacaaagucuugcaguggcguggaauuuucaacguccgguucau

SEQ ID NO: 4233137 - RNA, 79 nt, Human
gaggcaggggaucuugacguccucgauggggaacuuauagucauagguaaucuccucauugacguuaaugugcugcuuc

SEQ ID NO: 4233138 - RNA, 74 nt, Human
ccagcuucguguuggaacugcuuuguaaaaguuuuuuacaucucuuaccugccucaaacacgaaugcaggcugg

SEQ ID NO: 4233139 - RNA, 80 nt, Human
cagcgcguuuggcucuugcaagcccugaagggcuggaggcuugugccugccagcuccgaggagcugcagcccaacuucug

SEQ ID NO: 4233140 - RNA, 111 nt, Human
ugaauaacuguuuaauaaaaggaaaaucucugauaauaaccauuuuaaaaugauaccaaauuacucauuuugcaguuuauugccaaucauuccguguuuaaauguuauuua

SEQ ID NO: 4233141 - RNA, 129 nt, Human
uggugcuggucuccuacucacacauccuggcggccauccugaggauccagucuggggagggccgcagaaaggccuucuccaccugcuccucccaccucugcguagugggacucuucuuuggcagcgcca

SEQ ID NO: 4233142 - RNA, 73 nt, Human
agggagaggcucuucuguguguagugguugugcagagccucaugcaucacggagcaugagaagacauuccccu

SEQ ID NO: 4233143 - RNA, 78 nt, Human
ugggcuuccagugguggcucccggaccugccuugggggcagcaggagagguugggagaggucacccugaugaagaaca

SEQ ID NO: 4233144 - RNA, 105 nt, Human
gcaaaacaaaaauaaaauuccacuggcucuccacuauggaugagaaguugcacaaaggccuagcuguuucguugguggagagcuacauggcugcccaaguuuugc

SEQ ID NO: 4233145 - RNA, 79 nt, Human
guuuauuuugagaguguuugcuguauaauuggacuuaauaaaauguuuagagguacaguaggcaugacuuuggguagau

SEQ ID NO: 4233146 - RNA, 95 nt, Human
augcuuugucuuuuuucaguugagguggucuauugcguuaccgagcuguggggaugcacccacuuagcugaaguucucaucuaaaaacaaaguau

SEQ ID NO: 4233147 - RNA, 72 nt, Human
gcauagcuuucaagaaauugucacaaaagguuuuauucucuuugcuugugacuauuuuucauugaagcaugc

SEQ ID NO: 4233148 - RNA, 56 nt, Human
ggucgacuaauguuucauuucaugugcaugcuaagugaagcugguuagugaugacc

SEQ ID NO: 4233149 - RNA, 76 nt, Human
agaaauggaagagacaaugcuaucuguauuaaggccaucccagaagacaucagacagaguuguuucuucucccucu

SEQ ID NO: 4233150 - RNA, 82 nt, Human
ucugaccaccccagaaagggaaggccaggucaggccaacaguauguguaacccccugguggccuucagcucuggggugcaga

SEQ ID NO: 4233151 - RNA, 71 nt, Human
ccuugaaccugggaggcggagguuguagugagccaagauggcaccauugcacuccagccucccauaauagg

SEQ ID NO: 4233152 - RNA, 58 nt, Human
ugauucaguacuuucucuaacuuuauugcacaauaguagugaguagagcacugaguca

SEQ ID NO: 4233153 - RNA, 55 nt, Human
gacccgacaaguaaucaggugagauuuauuucucugccuccuaauuguugguguc

SEQ ID NO: 4233154 - RNA, 72 nt, Human
gaccuuaauauauuuuuuaagggaugugccuaugcauugaugccugaaaaauauguauaaagaaaugagguu

SEQ ID NO: 4233155 - RNA, 70 nt, Human
cuauuuuuauaagauuuaaaauguauguuuuagcacucugugggguacguuuuauaucuuuuggaauuag

SEQ ID NO: 4233156 - RNA, 101 nt, Human
guggucuuggauucauucagcaaacaucugagagcccuugugcaccagguacccaggcugcauucugggucgcagaguggguuggaguccacaagggccgc

SEQ ID NO: 4233157 - RNA, 60 nt, Human
ggcccagguuggagugcagugacaucaucucaguucacugcagccuuugccuccuggguu

SEQ ID NO: 4233158 - RNA, 95 nt, Human
acucacggcgugucccucugaccagguggacggcgaguacagguaccgcugcggcacuugugagaagaccuuccgcaucgagagcgcgcuggagu

SEQ ID NO: 4233159 - RNA, 80 nt, Human
ggucuucagccugggcccccagcuggcuugaggauuugaucauaccaaaucccaguccuccugggggaugggcugagacc

SEQ ID NO: 4233160 - RNA, 56 nt, Human
uuugaaugcugugauuuauuaaguaucaaaaaugcuugaaaguuauuucauuugaa

SEQ ID NO: 4233161 - RNA, 55 nt, Human
accaggguacuucuagguggggcuugcagcugccccuguccugcuaggcccuggu

SEQ ID NO: 4233162 - RNA, 59 nt, Human
cagcgguggcaaggugacugugcugacccacuguaacacuggugcucuggccaccgcug

SEQ ID NO: 4233163 - RNA, 78 nt, Human
gaaguagucuuuguggucuuuagcuaguguuucagaaucccaacaagauuagcugucauuggaucagaaggaauuuuc

SEQ ID NO: 4233164 - RNA, 66 nt, Human
cugacccugccuguccuggucccguuuagcaaaugcucuaauccucuuaggccaggccagccucag

SEQ ID NO: 4233165 - RNA, 65 nt, Human
uuuuguuaugcaggcuaagaguaaagacgaagaauccucucuuucauucuuagguugccgcaaga

SEQ ID NO: 4233166 - RNA, 63 nt, Human
guauuaugaaugccgaggcggcaacaaaaauuuugacagaauugcgccgccuugcucgugaac

SEQ ID NO: 4233167 - RNA, 58 nt, Human
gaugcucuugauuggaccagggguaggucccgacccaagcugggacaaugaaagcauc

SEQ ID NO: 4233168 - RNA, 60 nt, Human
gcuuccgacagagaucacauugaaagggucugucuccugugugugaccuccuguggaugc

SEQ ID NO: 4233169 - RNA, 59 nt, Human
gggagcccuggacgggcgguaugggccccaguccaaaccgugccggccgcgggguuccu

SEQ ID NO: 4233170 - RNA, 81 nt, Human
cgagggauggagguuugucugguuuuguuauuacccugggcaggggucugagacagaugccagcuacaccaccgugccccg

SEQ ID NO: 4233171 - RNA, 60 nt, Human
gugacagugaaucuagacagacagccuggaaaggaaguugcuuuauugauuuauuuucau

SEQ ID NO: 4233172 - RNA, 68 nt, Human
uuggugcgaaagaagcgacuccagucucucguccucgaagcuccgacuggauuguucuugggcgcuga

SEQ ID NO: 4233173 - RNA, 76 nt, Human
cauauguaugggauuuauauauauguaggagcacaugcguaugugcaguauugaaauauaugugcccguauauaug

SEQ ID NO: 4233174 - RNA, 57 nt, Human
auccuccauguugugcacuugaaacauuacuauguugcauugccauagcagggggau

SEQ ID NO: 4233175 - RNA, 74 nt, Human
uuaucagaauggaaaaagaacuguuuaaaaguuugauacuuuuaaauaguugguuuuuuugcuuacucugguaa

SEQ ID NO: 4233176 - RNA, 67 nt, Human
ccuuagcgggucgcacaggagaaaggcggugggaaugccggugucagccacggugugaccggcucgg

SEQ ID NO: 4233177 - RNA, 62 nt, Human
guuugaucauuuucauuaauguugcagagaauccgacugcuauuaagagaaagugaacaaau

SEQ ID NO: 4233178 - RNA, 63 nt, Human
acagagguuaggauggguuguaaacacuuuauuauuauacagagccuaauaucuaaucuuugu

SEQ ID NO: 4233179 - RNA, 57 nt, Human
cuuuuccuccaggaagccaagccgcugcggugcgcuuuggcuaccugggagggaaag

SEQ ID NO: 4233180 - RNA, 59 nt, Human
uuggagaugguucagaauuauaaagauuaucugaaucuuuaucugugagcagucuccaa

SEQ ID NO: 4233181 - RNA, 129 nt, Human
auuguggaugcgugcaccugcgcuuccugucgagaacauucauuaugcaaaagucaggaaaggagaaacagaacugucauuuggauugugaaaguauucucuggggagcugcccuacuguaucuauaau

SEQ ID NO: 4233182 - RNA, 66 nt, Human
ccuaacgugcuuuacaaaugaccuuccccuugaaaacugaggaaaaggcgauuuaaagauguuagg

SEQ ID NO: 4233183 - RNA, 69 nt, Human
gauggacgguuuuaccagacaguauuagacagagggccaggucuaaccaugucugguaagacgcccauc

SEQ ID NO: 4233184 - RNA, 57 nt, Human
ugucuucaaauacagucauauugagaguugagcuuucaguauaugaauuugggggua

SEQ ID NO: 4233185 - RNA, 85 nt, Human
ggacucugacucagccaaggcccagccccucuuagcuuccucaucugcuaaaaggaagagcuggaccagaggacugguuuggucc

SEQ ID NO: 4233186 - RNA, 81 nt, Human
cucauaagaugcauugaguauuguaaauaaaacaaaccauuuuugauuuguuuaaauugcucguuacaguucucuuguggg

SEQ ID NO: 4233187 - RNA, 96 nt, Human
aaaauaguacagaagaacuuguaaugaaaggcaauaguccuauuauucucuguauccauugaagccaccacuguaagucacuuuuguuauuauuuu

SEQ ID NO: 4233188 - RNA, 62 nt, Human
cagauggaggauaacacaagaagugauacagaucaggguucacuucucuuacccucucucug

SEQ ID NO: 4233189 - RNA, 58 nt, Human
ggagcaucuaccauuucuagauuauucagaguaaugaggggaauggauggauugcucc

SEQ ID NO: 4233190 - RNA, 88 nt, Human
cuuagauuuggugaugcuaggaauguaguguuuuagauauuaauucuauuuuuauuuauucauuuuuacaucaccaauaggaucugag

SEQ ID NO: 4233191 - RNA, 108 nt, Human
guggugauaguuugugggcaguuaacagugguggagggcuguccugugcauuguagcaaguuuagcaggaucccuggccuccgcccacuuagaugccauuagcaccac

SEQ ID NO: 4233192 - RNA, 86 nt, Human
uaaugagcaaaauauuaaugaugaagguaguaaagcaaaucagcuuaaccaugacugucacauuauuauuucuaauugguuuauua

SEQ ID NO: 4233193 - RNA, 74 nt, Human
ggaugggguaauucugugugaaucuauuaaggaaaagauaacuucaguggaacacacagagugggucaaaagcc

SEQ ID NO: 4233194 - RNA, 56 nt, Human
ggaauuacagaguuguuaagucagcaaggugcugagaaaacaguuuguaauaaucc

SEQ ID NO: 4233195 - RNA, 57 nt, Human
ucgcuuuaauggucuucacagcacgucguguuuaugagucagaggacccuagagcga

SEQ ID NO: 4233196 - RNA, 90 nt, Human
cuccggcgccccggcuccccgcgcccccgaucggggccgccgcuaguaguggcggcggcggaggcgggggcagcggcggcggcggcggag

SEQ ID NO: 4233197 - RNA, 74 nt, Human
guagagacgggguuacucuguguuggucaggcuggucucgaaguccugaccucaggugauccaaccaccucugc

SEQ ID NO: 4233198 - RNA, 69 nt, Human
cuuccuuucagaggaaggccuguccugcuggaacuggagccaaggggaggcugccuaugaaggcagaag

SEQ ID NO: 4233199 - RNA, 74 nt, Human
ccucuuuuucucuuuucuguggcuuucccaacuugccauggaugcagaggagaaggccaagaaggaagcagagg

SEQ ID NO: 4233200 - RNA, 96 nt, Human
caaguuuggucaaggggugaguguguccgacuccaaggagcaucuccguuucugagugggaacucucaugacacugugucccuugccucaggcuug

SEQ ID NO: 4233201 - RNA, 66 nt, Human
cagccccgcuggccucgccuccagcccguagccaagaggcgagcgcggccggugcccccggggcug

SEQ ID NO: 4233202 - RNA, 66 nt, Human
uagauagagaggaacagcaagaacugggccuugaauuucagucucuagagucugucccucuaccua

SEQ ID NO: 4233203 - RNA, 57 nt, Human
cuguuacggaggcuuucuaguuugcuacaggucaccaaaagagaaggcuaguaacag

SEQ ID NO: 4233204 - RNA, 61 nt, Human
gaaguuacacaugaagguccaauguuacuucaagcaucuaucuucaauguguguuuauuuu

SEQ ID NO: 4233205 - RNA, 81 nt, Human
ugguuuuacgguuugauauguuugugauucuacaguaagauagcaaaagaguacagaagcauuucagauuucguaugucca

SEQ ID NO: 4233206 - RNA, 100 nt, Human
uggaaggaagguagauacaaaaagauugugguaaaaacuggggucagugcucuuggugccuuuucuauaauuguacuuguuuuuuaauuacuuccuuuca

SEQ ID NO: 4233207 - RNA, 67 nt, Human
cuuuucacugugauguuuaagagaauguaugaacaguuuacauuuuccuuagaaauacauugauggg

SEQ ID NO: 4233208 - RNA, 56 nt, Human
ugcaggagaaaguacggagcguuuagcuuuagcuggcauuuuguguuuauucugca

SEQ ID NO: 4233209 - RNA, 97 nt, Human
uggauauuguuuucuuaaggaauggauaugaaacaaaacaagagcagaguaguucugccuguuuguucauguacugugauuugaauaucuuuaucca

SEQ ID NO: 4233210 - RNA, 112 nt, Human
gacuguggcaaaacauuccuauaaaagccagugcagcuggaaauucaccuaucagaggguagaacaaccaaaauguauguguacuauaguguuguguauuuuuguuugaguc

SEQ ID NO: 4233211 - RNA, 59 nt, Human
uauguugucuuguucagccauagccccuuccagcaucuggcaggcugccaggcaacaua

SEQ ID NO: 4233212 - RNA, 64 nt, Human
cugcccauggcuccuggcugugguucuucuuggucugggucccacaucucagggcuacaggcag

SEQ ID NO: 4233213 - RNA, 102 nt, Human
uuuuaaugcugaccguacccauuuugguucuugaugccagcuguucaccucaucuguaacguaucaggacuaaauuauggauaccaugcacagcuagugaga

SEQ ID NO: 4233214 - RNA, 57 nt, Human
ucauguauucugggcaggagaugacuuugccgauuacuaccuccccagcagucauga

SEQ ID NO: 4233215 - RNA, 63 nt, Human
agauacaaaagauaagauuuagcaguuuauucuuugguagguuguaagaggucuuuuguuucu

SEQ ID NO: 4233216 - RNA, 58 nt, Human
uuuccucaucuuaucaucccaagaagccuggaauucucccauuuuacaggugaggaga

SEQ ID NO: 4233217 - RNA, 119 nt, Human
uuuagugaaagacuuuugaaaagugcccuuuccccuuaagagacaguuggaauaccaguugacuaauauuacaagcucuuguagggggaaaaaggagcuuauuaaaguuguuuacuaaa

SEQ ID NO: 4233218 - RNA, 66 nt, Human
cucagacucugcccuccccucccuuuaacccccuuccagccggacgggaggcggggcagggcugag

SEQ ID NO: 4233219 - RNA, 58 nt, Human
aucuucuuucaucagccccucagcugguugacccuggaggguccugaggaagugagau

SEQ ID NO: 4233220 - RNA, 57 nt, Human
uuaaaagaauccuguuauccucaggccucugccuuguaggaagauccuuucuuuuaa

SEQ ID NO: 4233221 - RNA, 69 nt, Human
gcuaaauugauguggaucuauaacuguaaggaagcuuauuacuuuaugguuuaauauccagcacaaagc

SEQ ID NO: 4233222 - RNA, 67 nt, Human
ccacucucucccucuguaggggccucucucugagaucggguccuccuccugcagggcagcagagugg

SEQ ID NO: 4233223 - RNA, 84 nt, Human
cuggauuucggacccacagaaucuuuuuagauaauauauauuuaugugucaaguuguuaaguucugggguaauucguuaugcag

SEQ ID NO: 4233224 - RNA, 77 nt, Human
cacagauaaggcuuuguccccagcucaguucgcucccaucccccaccugugcauuccgggacugagccuuguuugug

SEQ ID NO: 4233225 - RNA, 60 nt, Human
ggagagcguggaugggcuuccacugcggggagugucccgccgguccguuacaggcuuucc

SEQ ID NO: 4233226 - RNA, 113 nt, Human
guuugaaguguauuuuuaggaauguagauuauuuuuaggaauguagagguaaggaggcagcauccacauuucauccauuaagaguacucuccauuuuuaaagauguuucaagc

SEQ ID NO: 4233227 - RNA, 71 nt, Human
ggaggaggagaaagaccagccugccgagauggaguaccuuaacucucgcuguguccuuuucacuuauuucc

SEQ ID NO: 4233228 - RNA, 65 nt, Human
aggaaagacgcauuucuguaggaaguaacuguaccuauagcccaaucuggaugcaguucuuuccu

SEQ ID NO: 4233229 - RNA, 56 nt, Human
ggaggcuggccuucagacggguguccuccuccccagccuccugaagcccagcuucc

SEQ ID NO: 4233230 - RNA, 81 nt, Human
guugauugugguaguucaugcuuagaucucauuuccuuuagcaucaaggaaguuaugauuggcguggacaaauguuucagc

SEQ ID NO: 4233231 - RNA, 75 nt, Human
cguucuuaguugguggagcgauuugucugguuaauuccgauaacgaacgagacucuggcaugcuaacuaguuacg

SEQ ID NO: 4233232 - RNA, 85 nt, Human
caguacgucgagcuggaggagcgaauggaauacguacgggcacuccacgaacucauccgcaaccacuuuagccucuuuagugcug

SEQ ID NO: 4233233 - RNA, 89 nt, Human
gcagggaagccgauuuggaacuuaaacaagcucccaaguugugaucagucgagcuuggcaagcacuguuugagagaguagguguccugc

SEQ ID NO: 4233234 - RNA, 117 nt, Human
ggaggguugagcuuccaugugaccagccaggccucaggagcagggaccugcuggaccccagccugccacuggcccggggauccuggcagugggaagcuggaaguccauucagacucc

SEQ ID NO: 4233235 - RNA, 89 nt, Human
gcccucugccucuggaccccugccuuggcccuaguucauggcuccucucuguuggacugggauggccgaggcuauagcccaggcggggc

SEQ ID NO: 4233236 - RNA, 69 nt, Human
uuaccucaauuuuuauugcuuuuuugcuuagaaaaacuauguagaagaugccuuaaaguugaaagguaa

SEQ ID NO: 4233237 - RNA, 71 nt, Human
ucgugccugguggagagcgagggcagccugacggagaacaucugggccuucgcuggcaucuccagguagga

SEQ ID NO: 4233238 - RNA, 63 nt, Human
cccaaggcuggagggcuuauguaugcuggggugcuggggaaugcagggucuccuguacuuggg

SEQ ID NO: 4233239 - RNA, 83 nt, Human
uaccacugauauccagguucaguucaucaucuauuucagaccauguuucuaauuggauucucuguagccugguucauguugua

SEQ ID NO: 4233240 - RNA, 62 nt, Human
agucacuguuuaaucuagcuaaacacagugacuaaaguuuagcuggauuaaucacagugacu

SEQ ID NO: 4233241 - RNA, 107 nt, Human
gcucauuucggucauguugcggugcuuugcuggaaucgaggaaugugcuuaauucgaaggugucuuugucgguuacagcaacgcugcugcugaaugcccugagaagc

SEQ ID NO: 4233242 - RNA, 55 nt, Human
ggggcuggguuugcgcaggcuccggggcgccgcggccgccgcuuagcugagcccc

SEQ ID NO: 4233243 - RNA, 57 nt, Human
gguggcauucaguaaguauauaaauguacucacagcuuuuauuuacuguguguuacc

SEQ ID NO: 4233244 - RNA, 96 nt, Human
gagagggcgagggagaggaggaugcugugccuggaaagcggcucuugaggagagcuggaaucucggcaaagcguccacucccuccccuccccuuuc

SEQ ID NO: 4233245 - RNA, 79 nt, Human
cccaggccuggccuccugcuuuuccauuugauucccugccucuuucuauucggacuggaaugccgggccaggcuccggg

SEQ ID NO: 4233246 - RNA, 68 nt, Human
gguaauugaaaguuuguugaugaauauuuguguaaaacgcauucaagucuauaaccuuuccaauuacc

SEQ ID NO: 4233247 - RNA, 60 nt, Human
cucagaaugcgcagaguggugugugcaugcagcaacguguauacacccugugcaucuggg

SEQ ID NO: 4233248 - RNA, 62 nt, Human
gcccagccucuagcuccccaaagccaggcuccaaggcuggcucacaggaggcagaggugggu

SEQ ID NO: 4233249 - RNA, 68 nt, Human
cugagagaggugaaaugacuuucccgggaacacuugcacaacugggugagaccagagccuauucucag

SEQ ID NO: 4233250 - RNA, 75 nt, Human
uuauuguaaaaucucagaaaaguuuagguugggauuauagcucuuuacuuaagcagaucugugguccaacaauga

SEQ ID NO: 4233251 - RNA, 70 nt, Human
cuuggaugaccuuuuaggauuugaguugcuggacugugaauuccaaggacuaaauucuagauucaacaag

SEQ ID NO: 4233252 - RNA, 58 nt, Human
gacacaacuauccaguaugggacacacaauuuucuccauauggauauuauuuuguguc

SEQ ID NO: 4233253 - RNA, 60 nt, Human
ccuuucuggucucugagagacuuaccucuuccaagaaguccucccgaaugaguagaaggg

SEQ ID NO: 4233254 - RNA, 80 nt, Human
ccacaccuuggggcuugcuguuguagccuguguggucacuaggcaugucugggcuaaggacgggcaagucccacaagugg

SEQ ID NO: 4233255 - RNA, 76 nt, Human
uugucauuggaaucucuuugucccugaguuucagaagcaaauagugaagcuuugggcagaagaggauucaugggaa

SEQ ID NO: 4233256 - RNA, 60 nt, Human
uauaguucuuagcuggcaccagauacauugaagaauggauguugcuugucugagacuaug

SEQ ID NO: 4233257 - RNA, 100 nt, Human
auuuauauuguaagcagcaguucaauuguuuuguaaaaguaauuucaauuuuaaucacugaacuaaagaaaugggcaaggcugacuuccguaauauaggu

SEQ ID NO: 4233258 - RNA, 129 nt, Human
aagaagucucuauuuggcuaauuuagggagcuaagagaauggacaaggucugcuuauguccuucuggcagccuagcauagcuuuugccucccucaaaucaguuauaagucaaaacaaauaaggcacauu

SEQ ID NO: 4233259 - RNA, 59 nt, Human
gcaucuccugagucagauuuuggcaucaacuugaagggcccaaaaaucaaaggaggugc

SEQ ID NO: 4233260 - RNA, 62 nt, Human
ccucgugcgauaguuaugucaggaauucagaaaugccucgugagugacuguugucaagaugg

SEQ ID NO: 4233261 - RNA, 59 nt, Human
cucugugggcauauuuguaaaaguugccaaagaauuauauacaaggauguucaucagag

SEQ ID NO: 4233262 - RNA, 60 nt, Human
auucaucuguacuucaauaucuaguuuccauagcaacugagaugcaguuugcaggugggu

SEQ ID NO: 4233263 - RNA, 107 nt, Human
ucuguuguuggccugugucuuucccucuuucauucuguccuuguuuggggccaccaaacuugaggcaaugaagguguagguugagaaauuacuugggcuaccaaaga

SEQ ID NO: 4233264 - RNA, 57 nt, Human
ucaaugcauaaugguuugugacaaauuuuagcauuuugcucuuaccauuauguguga

SEQ ID NO: 4233265 - RNA, 80 nt, Human
uuacuuugccuuguuuuguucaugaacauuggguuuagugccuggcaacuugaugcauauggaagagcaaugccaaguga

SEQ ID NO: 4233266 - RNA, 120 nt, Human
cugggggucugaggaaagacuguuuugaaagaggcugucagggaauggaaaggguuaagcuuuucauccugaagaaccugcuucccaaaucaggccuuccucccaucacuagacccugag

SEQ ID NO: 4233267 - RNA, 73 nt, Human
acugaaggaaacguaucucaagcucugagggaggccuuugaaggcacccugcauuggcuugaguuuagacagu

SEQ ID NO: 4233268 - RNA, 64 nt, Human
gcugcuuagaaccauauuuaaaguuaucccauuacggaagagaaggagguguguuucuaggagc

SEQ ID NO: 4233269 - RNA, 86 nt, Human
ggcagauauguucaguuaugcaagcaaguaccacuuucuuuuuaucuucagaaagucauuugaggcaugauuaugcagcaccugcc

SEQ ID NO: 4233270 - RNA, 84 nt, Human
ucccagccacuuugccuucuuacuguguuguguguuuuuccuggugcuucaagagcgugugcagggcaagugccgucacuggga

SEQ ID NO: 4233271 - RNA, 126 nt, Human
gacauaaaauucuuucacuuuggcagaagcauuuguuuucuugaugaaauuauuuuuccaucugaggaaaaaaauacuaggaaaauaaaucaaggugaugcugaaaaaaaaaguuguuuuuguguu

SEQ ID NO: 4233272 - RNA, 62 nt, Human
uagagugcugucaaagacuuguguuacucauuccuaagcauaugucaugcaccagcacuuua

SEQ ID NO: 4233273 - RNA, 89 nt, Human
gcaagcugcaaagggaagucgacgaaauaaaauuaaagcccuacaaucguguucgugucaauguagauggggugccccccucgguuugc

SEQ ID NO: 4233274 - RNA, 60 nt, Human
gcgucuuggcggcaguugguggaaccggagcuucgaguccguccccggugcugccugcgc

SEQ ID NO: 4233275 - RNA, 93 nt, Human
aucuguguuaucucuucagcaacauuucaaggucuuuaggaucaaggacuuuuaugccuuccacaaagucuaugagaguugcaaggcacagau

SEQ ID NO: 4233276 - RNA, 56 nt, Human
ggucuuccuugggggacuugaacaucuugguaaaugacaggucuucuuggaggacu

SEQ ID NO: 4233277 - RNA, 58 nt, Human
ggccugccucugacuggggcugacacggaggugcauuagcccaggcuggagguagccc

SEQ ID NO: 4233278 - RNA, 68 nt, Human
agcagucagccucuaugcccccgucacccagccagcucucuggguuucggggcgggaggcugagggcu

SEQ ID NO: 4233279 - RNA, 72 nt, Human
guacugcccaggggagagucugagucguucuccuaaugagagcuucccaggagaucuccgccuagcaagugc

SEQ ID NO: 4233280 - RNA, 79 nt, Human
gggccacauaacaaccucuaucggucaggaagccuuugaucugggccaggcugccgacccacagggguuaauugugccu

SEQ ID NO: 4233281 - RNA, 76 nt, Human
gguuaugacacuuuacuguuuacagcuaaugcauaguuacuugcaugccaugguuguacaguagcagacuaugacc

SEQ ID NO: 4233282 - RNA, 104 nt, Human
guggcucucgguggaaggggagcuggaaaggggaucgagugggaagaaggugaucuuucccugaagcccagccugucuccagccaggcuccccucugaagccgc

SEQ ID NO: 4233283 - RNA, 87 nt, Human
cugccacugccuuggccaccuauccucaccucauagcucgcagcgcgaggcgauaggccagguccgggucaugaggcagcagugcgg

SEQ ID NO: 4233284 - RNA, 97 nt, Human
ccggcaggcucgucugaacuugaagacaccccacauuccaagaugcccgagguuccugggaaugccugggguucuucgauccggaaaauccuaccgg

SEQ ID NO: 4233285 - RNA, 87 nt, Human
gaaaauaccuggguuguuagccucacauuuaggaaaaaauuguaauacucaguuaucuguguguguggcuaaacaagucagcauuuc

SEQ ID NO: 4233286 - RNA, 72 nt, Human
guagaggcaggguuucaccauguuggucaggcuggucuugaacuccugaucucgugaucuacccgccucagc

SEQ ID NO: 4233287 - RNA, 60 nt, Human
ggcgaagggcuucucgccugugugcacgcgcuggugcaaaaagagcgaggagcccuggcu

SEQ ID NO: 4233288 - RNA, 93 nt, Human
gagcaagaagaauacaaauaauaccaagguguugagccaagaaaaccccgaugcuccugaaucauuuugguaauguucguuugcuccuuguuc

SEQ ID NO: 4233289 - RNA, 62 nt, Human
uugcugggauucauugaagggucuccuuuccucuucaauuacaucagaaucuaaagcagcaa

SEQ ID NO: 4233290 - RNA, 61 nt, Human
gcccuuuuaucaacuccuagaauaguuaaagagagacacaucuagaugggaugaaaggugc

SEQ ID NO: 4233291 - RNA, 90 nt, Human
ggcauguauuaguauuuacuguguucaucccucugaacaguuaguucagagauuagagaagaugauaaaucagcagauacuggugugguc

SEQ ID NO: 4233292 - RNA, 59 nt, Human
gaaagcuuggaaacgacuuuaucaugaugcaagaacuugauacuuguuuucaggcuuuu

SEQ ID NO: 4233293 - RNA, 126 nt, Human
gggagaagucacuucuaaaaccggggagauggaggaaagcaguuagaaugucuguuacuaauuuuuguuaacgugcugcuguuuccuacaucucauucaggcauuaguuucaaguuccauuuuccc

SEQ ID NO: 4233294 - RNA, 84 nt, Human
cuauauagugucaagaugcuacauaaugggauaaagaauuauaguuaagugggugaaucucauugugcuuuuuguacuguguag

SEQ ID NO: 4233295 - RNA, 68 nt, Human
ggaggaggcgguuggcuuugucugggugcccaagcccagacccagauauccaggccucugcucccuuc

SEQ ID NO: 4233296 - RNA, 67 nt, Human
aaggacaaaacagcuguucuaaacugccaagaaauuggcuggugcauagaagagggaauuugucuuu

SEQ ID NO: 4233297 - RNA, 59 nt, Human
ccuccuuuccuguuuuccugagugaucccuccccacuggggaagagaagagaaaggagg

SEQ ID NO: 4233298 - RNA, 75 nt, Human
gcuucuguuucucugccugcacacauuuguggguacacacuauacaccuaugugggguaggaggggggaaugggc

SEQ ID NO: 4233299 - RNA, 56 nt, Human
uaucuagguacacaucuccucucaaaagaugagaauauacaggugugugguagaua

SEQ ID NO: 4233300 - RNA, 99 nt, Human
gcucagaggaggaggaggaggagcaggaggagagccuggcgguggcggagcagguagccgacuuugccagcucccugcuggccgcccuccacugcuggc

SEQ ID NO: 4233301 - RNA, 59 nt, Human
aagccuccuggaguuacuuccaaaauuacagguuuucuugagucacuccagugaugcuu

SEQ ID NO: 4233302 - RNA, 63 nt, Human
uucuuuguugucuucauaauacuuuuaacagaacaugaccccagaguugaaggcaguaaagag

SEQ ID NO: 4233303 - RNA, 58 nt, Human
uagaacugcucucauacuugcuguauguuguggaucagcaaguauagucagccuucua

SEQ ID NO: 4233304 - RNA, 65 nt, Human
ugccagggaggcuugccacuguccauggcagagucucugccagggcucgagcaggccagcuggca

SEQ ID NO: 4233305 - RNA, 55 nt, Human
gagacugcguggcucugacacaggcaucaggcgugugcagcucccccgcaguuuc

SEQ ID NO: 4233306 - RNA, 61 nt, Human
cuuggcucacuuccguggagagguggguuggcagccuacuuagacaucuuuagugguuagg

SEQ ID NO: 4233307 - RNA, 84 nt, Human
cccagcaggguggcaagucuuucugcaacauuuuuggaauacaagcagaaagugauuugcuauuccacacaaaacaugauuggg

SEQ ID NO: 4233308 - RNA, 67 nt, Human
aaacauguagugcaugaggaucuuccugugcucuuuauaaucugagauucugauguuucuauuguuu

SEQ ID NO: 4233309 - RNA, 95 nt, Human
ccaguuccugcaggccaccgcccaggaagaagggaucuuuggugagucccaaccagucagcccaggcuccugcaggcagugguguuugcuggugg

SEQ ID NO: 4233310 - RNA, 55 nt, Human
ggcaguagucagaggguuuuacaugcagaucauguuuauccuuugaucaucuguc

SEQ ID NO: 4233311 - RNA, 64 nt, Human
uagaugucauguuggcagacaguuuuguucacugucaaaacuggguuuaucuaauguguauuug

SEQ ID NO: 4233312 - RNA, 62 nt, Human
gggugaaggaucccucuuggccuggaggcgacuggccugaggcaagaacggguuguucaccc

SEQ ID NO: 4233313 - RNA, 78 nt, Human
ugguuuuccugcuugaugaggaaaggauugcugcacgucauugugccucggugcuuuccauaucagcagcuguuacca

SEQ ID NO: 4233314 - RNA, 56 nt, Human
ugccagauuaugucuccagggcuggaguuuauagcucuccaucacaugguguggca

SEQ ID NO: 4233315 - RNA, 109 nt, Human
ugggagggagggagaggaguagagacauacaguauuuuuuaagaaaaaacauauuuuuuaggauuuuuucuggaguuugggguuuuaguuuuucugcuuuuguuuucca

SEQ ID NO: 4233316 - RNA, 58 nt, Human
uuuugcuuucaaugaauuguauacugggaaaccaguuuacccacuguugaaauuaaag

SEQ ID NO: 4233317 - RNA, 65 nt, Human
ugacucacaauuauucuuugggaaaguugaauuuuuuuaacauaugaaagaauauuugugccuca

SEQ ID NO: 4233318 - RNA, 85 nt, Human
ugaaaaaugcauuugccauacuugaaaggagaaaaaugaagaaaaguagguucauuuucuuaguuaaguagguaggcauuuuuua

SEQ ID NO: 4233319 - RNA, 112 nt, Human
gucugacucauaguagauuuacuaaauguuugguggauaaaaggaugaaugaauuuuucuuaaauauuuuuguuuaccaguuaacauaacgaucugaaagaggucauuugau

SEQ ID NO: 4233320 - RNA, 83 nt, Human
cacaugugacccugauuuugguauggcuugauagaguucccugaaaacuccuuuuaugugugcuaaaaccagggaagcaugug

SEQ ID NO: 4233321 - RNA, 60 nt, Human
guguauaguggugucgguagaaugcucugucaugugaucucaccaggauaugacugucac

SEQ ID NO: 4233322 - RNA, 59 nt, Human
gccauauucaugcaggugcuaaccgccuuuucuacuggugcaacugaaaggaauauggu

SEQ ID NO: 4233323 - RNA, 60 nt, Human
uaggucaaugccaaguguggcuuauggucagccgcugagccugaguguguauugaaccua

SEQ ID NO: 4233324 - RNA, 84 nt, Human
ggccaggaagaggaggaagcccuggaggggcuggaggugauggauguuuuccuccgguucucagggcuccaccucuuucgggcc

SEQ ID NO: 4233325 - RNA, 78 nt, Human
gccuccugcggggccuggacagggagggggccagaccacagcggccccuccuccggucauugugcgggccucugaggc

SEQ ID NO: 4233326 - RNA, 62 nt, Human
gaggucagcaagccaugcuuguuauaauuggcacugccauagucaggggcuuaugcgaccuc

SEQ ID NO: 4233327 - RNA, 66 nt, Human
gucauggguauaauuuuagauguuuucuggcucugaagccuugcauuuaaauuugaacuucagaac

SEQ ID NO: 4233328 - RNA, 60 nt, Human
augcacaagguagauuauuauucugaugucaugcaaaugaguaccugugugccugugugu

SEQ ID NO: 4233329 - RNA, 78 nt, Human
ggaaaggaagaagcauucuuucauugguugguguguauugccuugucaaccaauaagaggaugccauuuauccuuuuc

SEQ ID NO: 4233330 - RNA, 58 nt, Human
gcccaggccggagagcagugcugccaucucggcucacugcagccuccacuuucugggc

SEQ ID NO: 4233331 - RNA, 67 nt, Human
gugggaauggagugguucuugcccucugagcuuacagacuaagaaggcagaaaagcuuuacaacuac

SEQ ID NO: 4233332 - RNA, 74 nt, Human
aaugagaggauaaugaaucugaaucauagcaggaauuugcaauauuaauuaugguuagcuauuuuucucucauu

SEQ ID NO: 4233333 - RNA, 78 nt, Human
gaguauggggugacaaaaauuaguuccuggugcuuaaugaaacuuucugccacugauuuuauauauuaccccgugcuu

SEQ ID NO: 4233334 - RNA, 59 nt, Human
gcgcgcucugcgaggacacgcucugcugcggagguaaggccgugcgccuccaggcgcgc

SEQ ID NO: 4233335 - RNA, 67 nt, Human
gacgaagaugaucagagggcaagagggcaagaggacugagcucuggugcacucugauauuugaaguu

SEQ ID NO: 4233336 - RNA, 69 nt, Human
gaaggcuguggcuggucucaguuugguuacucaaugcccaggaggggcugagcaccagccauaucuuuu

SEQ ID NO: 4233337 - RNA, 129 nt, Human
aacucacuuggcaagcucucugcugucuggccugugcuugcugugcuggggccacagauaagaaucugacacggccugagaagcaaggacacaaggcauuacaaaaaagugggaagaugccgugggaau

SEQ ID NO: 4233338 - RNA, 82 nt, Human
gugagaucccagccaagcacaauuucuacauguuagucaauugcaagaaacacugagauguaauguaguacuuuggacucau

SEQ ID NO: 4233339 - RNA, 63 nt, Human
gucccuggucuaccguggcuucaucuacccaaugcugccuggagggccagguggaccaggggc

SEQ ID NO: 4233340 - RNA, 88 nt, Human
gugcagcaaagcccaaaagguguagacucaguuaugcaauuauaagguuaaggcguagaagaaagcugcugcuagguuuuuguugcau

SEQ ID NO: 4233341 - RNA, 63 nt, Human
gccaggguuuuaguugcagguuauucagaacggauuuauguagcaugauuuuaaaauccuggu

SEQ ID NO: 4233342 - RNA, 79 nt, Human
caguuacuugucuuggcauaccguuauauuuguguuucuaugcauuagcaaaaauaugguaucugccaaacuauaauug

SEQ ID NO: 4233343 - RNA, 57 nt, Human
gaggaggacauuggaaagaacuugacaaaggauuugagucuuccaucuauccuccuc

SEQ ID NO: 4233344 - RNA, 94 nt, Human
gaaugagcuuugagacucacugccuuagaaaaucauggaauauuaaaaguuuaguauuggauauaaucuaggaagagugcucuuaaucuuguuu

SEQ ID NO: 4233345 - RNA, 58 nt, Human
auaucggucuccuauaauucaaacuagggaaacauuuggugaacuggagaacugaugu

SEQ ID NO: 4233346 - RNA, 73 nt, Human
augaaaucuccagauuugggggauauacucuaccaaauuagacauggaccucagauccuggccagaagcucau

SEQ ID NO: 4233347 - RNA, 58 nt, Human
agggagucuggccgucggcuggcucagggcgggccgguuggcuguacccaggcucccu

SEQ ID NO: 4233348 - RNA, 71 nt, Human
ccuggacucggagggcaaguacuggcugggcuggagccagcggggcagccagaucgccuuccgccuccagg

SEQ ID NO: 4233349 - RNA, 63 nt, Human
gggcuacagaugggagggaugagacuagcucuucaagagggcacauuccaugcaucuuggucc

SEQ ID NO: 4233350 - RNA, 95 nt, Human
uuuuagguuaaauggcuuuguucauuuaguuuuuuucuccuuaacccauuuuggagcaauaagacugucauggaguaaaaccaaauuaccuggaa

SEQ ID NO: 4233351 - RNA, 59 nt, Human
aagauauauaacccuuucacuuacuagagcuauguauguuggaaggaaagguguaucuu

SEQ ID NO: 4233352 - RNA, 93 nt, Human
cucacaaacacacauacacuucugggcagggauuuggggaaacuggccuucaucucuccaguucuuugcucccugcuuuuugugguuugggag

SEQ ID NO: 4233353 - RNA, 58 nt, Human
cuuccuuaagauuucccaagucaucuuugcaagguggcugaggcuuuucuuaaagaag

SEQ ID NO: 4233354 - RNA, 90 nt, Human
uuuuugauuuacugagguaaauaaacugaaacaacauaggauaucuuucaaguuguaaaauauaguugaauuuaucaguagcauuagaaa

SEQ ID NO: 4233355 - RNA, 66 nt, Human
gagaaaggucuuggcucuggccgcacagcagccugugcccaguugaggccaggacucagacuucuc

SEQ ID NO: 4233356 - RNA, 83 nt, Human
uauuuagcugaugguagcuguccacaucaggaaugauuagaccacgugauuuucccauggggccagccgccaucaguuaaaua

SEQ ID NO: 4233357 - RNA, 87 nt, Human
gaaguguacacuuugccccuggccgccuucuucccuccugguguccuggguggacacggaggugugucuggggaagguguguccuuu

SEQ ID NO: 4233358 - RNA, 62 nt, Human
caugccucuguuuuaguuguugacugggguugaacaggaaggcagcuuucaauaggguuaug

SEQ ID NO: 4233359 - RNA, 56 nt, Human
ggggaggugugcaggacaccucaguuuguccugacucaggcugccucacccucccu

SEQ ID NO: 4233360 - RNA, 74 nt, Human
ggacugcugugucucccaaggagggucacugggucaaagaggcccccuggagccuugugagaccacaauagucu

SEQ ID NO: 4233361 - RNA, 55 nt, Human
uuccuuuuuuucuccauauuucuggucaugcaagaccagaagagaagaaaaggaa

SEQ ID NO: 4233362 - RNA, 56 nt, Human
auauugcuuuauucuugaauaugcugcagugagugaauggcagaaugaagcagugu

SEQ ID NO: 4233363 - RNA, 84 nt, Human
cccagguuggauuagggcacuuccucugggucccuggcaauuuccuccagguuagggaucccaaggggucucugccuuccuggg

SEQ ID NO: 4233364 - RNA, 108 nt, Human
cuccuccuuccugccaucuguaaaagcugaaacgaaaugacaaccauuguacccucuugguacugaguugauuuaaccucaccuuugaaaucugguagggaagagggg

SEQ ID NO: 4233365 - RNA, 68 nt, Human
ucuauauucuauguucuucuuuuguaauugaaggcacuacagaaaagaaagaagagcucagagguaga

SEQ ID NO: 4233366 - RNA, 65 nt, Human
uguuucccaggcuggaaugcaguggugugaucuuggcucacugcagccuccaucucugggguuca

SEQ ID NO: 4233367 - RNA, 62 nt, Human
uaguguccagcuauauguguauguguguguguacacgugcauguacacacagcuguacagug

SEQ ID NO: 4233368 - RNA, 66 nt, Human
gggaaagggaggguaggaagagggagaagugucagaauuccucccccugccucuccucccugaccc

SEQ ID NO: 4233369 - RNA, 81 nt, Human
ugcaaacggggucccucucugugucaguuucuaauggagagcgagcugacagugcauggagggacucugccaagauuugca

SEQ ID NO: 4233370 - RNA, 59 nt, Human
agcagggcucacuacaacccugggacuccucagggacuccugggucugugagccauacu

SEQ ID NO: 4233371 - RNA, 57 nt, Human
ggauggaggagcagaggguuuccagucaguucuggaaagcagcccugcuccccaucc

SEQ ID NO: 4233372 - RNA, 83 nt, Human
uuguguucugaaagccuccgugcugcuggaucuuuggggggaaauacaggauccuucagcacugagguguuuaagauuugcaa

SEQ ID NO: 4233373 - RNA, 59 nt, Human
gucacucuuuuucagcuagcucaggcuaaagauaagcccaagugggcaaggaagaugac

SEQ ID NO: 4233374 - RNA, 81 nt, Human
ccgcgcguggggcuuucgcggagcgucggucaugggugccguucuggcgauugcgagagucgccucgggaaauugaugugg

SEQ ID NO: 4233375 - RNA, 89 nt, Human
aggagguuucagaaacccuauauuacaggcuugcucuaggcugcuccuguucuggggcugguaccguaauauauggauugaauccugcu

SEQ ID NO: 4233376 - RNA, 59 nt, Human
acccaggaggcggagguugcagugagccgagaucgcgccacugcacuccagcucugggu

SEQ ID NO: 4233377 - RNA, 57 nt, Human
cucaccuugugauccacccgccuuggccucccaaagugcugggauuacaggugugag

SEQ ID NO: 4233378 - RNA, 62 nt, Human
uuuugcuugcuaucuaaguguuucaaauuaugggaagugugagacacuggaaggcaagaaaa

SEQ ID NO: 4233379 - RNA, 85 nt, Human
ugaccucacuguuggcaucuggugauauggacuaaaaacagccccuuauuguuggucaaauccuagauccuuugaguuagaguca

SEQ ID NO: 4233380 - RNA, 67 nt, Human
uucaauccgcuccucuaagcgcgguccugagcuuuggucccagacgcgcagaaggaagcggccugaa

SEQ ID NO: 4233381 - RNA, 55 nt, Human
gcgguguuuuaacacucccucgguuaucagcugcagagcggagguuguauauugu

SEQ ID NO: 4233382 - RNA, 130 nt, Human
ucugucauuuucuagcugucugaucuuggacaagugaauggacuucucugagccuguuuucucaccuuagaagagagauaacaguacaucaugaggucaucaugaagguuagacaggaucaaccacauga

SEQ ID NO: 4233383 - RNA, 58 nt, Human
ucagagaaguaggcuaaugguggggaagcauuucccugcugauguucgugcuuccugg

SEQ ID NO: 4233384 - RNA, 58 nt, Human
ucuuuucucuguacauagugaagcccguauguauggaguuuuaaucuguacagaaaga

SEQ ID NO: 4233385 - RNA, 58 nt, Human
uggaagcuggcugaucugacuugcuugcagaugucuguaacagcauuagcagcuucca

SEQ ID NO: 4233386 - RNA, 129 nt, Human
caagaauguuguaugcuugggguguucugugugccuguguugaugugucuguauucuaaugagcaauccaguuuuacacuagcauacagauauuuaacucugagguauguguccacaaagcugcuuuug

SEQ ID NO: 4233387 - RNA, 97 nt, Human
ggcugucuagaagagucaguuguugcaccacuagugucuguuuuauuucuacauggguguuaugggcgaugcaaaccugauuuucuucgaaucggcc

SEQ ID NO: 4233388 - RNA, 81 nt, Human
uccagacaugcuccugauuucuaggccuuaucauaccauccccucugugauggguugaguucauggagccuguauucuggg

SEQ ID NO: 4233389 - RNA, 85 nt, Human
cagagaugaaaagcccuggccagacaccaguucauuaguggaaauaaaagcuuccuaaauugcagggaacuggcugggcuuucug

SEQ ID NO: 4233390 - RNA, 60 nt, Human
gguguggcaguggaccugugaagagggagaaucuagccuucagccuguccaguguuaacc

SEQ ID NO: 4233391 - RNA, 66 nt, Human
aucaaucaagcugcuguuuguucuacaugauagcauuguguagaacaaacagcauguuugauugau

SEQ ID NO: 4233392 - RNA, 97 nt, Human
ggugagcaugggcaguuaccuagcacggugagguaggccuuggccaggucuuggucuagcucggugcuggcgacacacguguaacugcccugguccc

SEQ ID NO: 4233393 - RNA, 118 nt, Human
uuauaauaaauuaccuguaaaguaagugaacaucacuugguuaauguggucgugguggugcaauugaccucauggaguaagugagugcaucuguguucuuuaaauuaaaauuuuauaa

SEQ ID NO: 4233394 - RNA, 71 nt, Human
cguaggggcugggaggccggcgcgcagaucuggcggugagcgcugccgccccggggcccccagccaugucg

SEQ ID NO: 4233395 - RNA, 72 nt, Human
ggccuagcugaggcaggcucaaugcccagucugagcuguagaggaguagcugagcucugcacuuugccagcc

SEQ ID NO: 4233396 - RNA, 61 nt, Human
cucggggcguggcaguagcaugcugggagcugcagcugauggcugugccaugacccucgag

SEQ ID NO: 4233397 - RNA, 79 nt, Human
gccccuaaggaucuugugcauuuguucauuggcuucuguuuuccucucugcccaacuagacugcaggcuccuugagggc

SEQ ID NO: 4233398 - RNA, 56 nt, Human
caaacauuuguuggaaccccugaagcauauccuaggguuccuuggaacacuguuug

SEQ ID NO: 4233399 - RNA, 83 nt, Human
gggcagaggccuuggcccagugcaagcucuuucugcccacauucuccugguagcggcucugcagcugggcgcuguuucugccc

SEQ ID NO: 4233400 - RNA, 65 nt, Human
ugaaugaguuucuuacucaggagcuggcugaagauggcuacucuggaguugagaugcgaguuaca

SEQ ID NO: 4233401 - RNA, 58 nt, Human
uccaagggcuuaggcacacugugacugccaggcaguugguggaagcuaagcuucugga

SEQ ID NO: 4233402 - RNA, 98 nt, Human
gcacacucacauccagguaguucuccaggggcuguucaucuaccagggugggagccuuccacugggggaaguacuuucuggcuggguugagguugugc

SEQ ID NO: 4233403 - RNA, 130 nt, Human
ggaguguuuaacgaagguguuuugaugauagagccuaguauggacucuuagguggggaguggaaacuagaagguuuuaggacucuauuuggguaucuagauuagagagcguuauaauguuuaaauguucu

SEQ ID NO: 4233404 - RNA, 82 nt, Human
uguugguguaaagcauuuguuucuccuggaaagugcacaacggggauuuucuaagaaauggaaaacgauugccacacucaca

SEQ ID NO: 4233405 - RNA, 104 nt, Human
ccugccagugucucggggccaugccucguccugguuuaaguguccugugagcacaccggaggagcugccggauggggcaugcggguccuccgaggccaggcagg

SEQ ID NO: 4233406 - RNA, 60 nt, Human
uuauuuggucuguaauuacauggacuuuauuuggaggucagugaaggaacaacuaaauag

SEQ ID NO: 4233407 - RNA, 98 nt, Human
uaaaauuuuagcaagucaauucccaguguuuuaagaaaguaauuuuguacuaguguguaggauuuauuccagaaaugcaaggaugguuugauauuuua

SEQ ID NO: 4233408 - RNA, 81 nt, Human
gguagaucuccccauucccacagugugguauauuucccaaggggaccuugugugugcccaccuguggccacauggaucucc

SEQ ID NO: 4233409 - RNA, 78 nt, Human
ggauggacucgaucucuugaccucgugauccgccugcuuuggccucccaaaguacuuggauuacaggcaugagccacc

SEQ ID NO: 4233410 - RNA, 79 nt, Human
guugggccgggcacagguugagguagaugcucucuggcacuuugaguuugucauuggugaucugaugccugaguuuggc

SEQ ID NO: 4233411 - RNA, 79 nt, Human
cuaagcaaguuguccuguaaagacuaaccaguugucaaaaucucacugagauuuuuaagguuuguuuauauauguuuag

SEQ ID NO: 4233412 - RNA, 119 nt, Human
ccucuccaaggagcagcagaauaccauaugaauauucugaguuaaaauuccagagguaacaaagaaaguguuaccuuuggaggacuagggucauagaagaauucuguucucuugacagg

SEQ ID NO: 4233413 - RNA, 94 nt, Human
caggggggcucugaggcaugggggccagggacccuggcagcagccccagaaggguuggaagaugcaggucuggacccccacuuuguccccacug

SEQ ID NO: 4233414 - RNA, 67 nt, Human
ccuugccucuaauuagcucugugacccugggcaaaacuguccacuugcauuaauguggaggcacagg

SEQ ID NO: 4233415 - RNA, 95 nt, Human
guauuuuuaguagagaugggguuucaccauguuggccaggcuggucucaaauuccugaccucaggugauccaccccucuuggccucccaaagugc

SEQ ID NO: 4233416 - RNA, 85 nt, Human
gaugucuguaauucuuuuuaugucaaaaucgaugagauaugguggagaauucucauuugacaauugggauagaucuaugagcauu

SEQ ID NO: 4233417 - RNA, 66 nt, Human
gccggcgggcgcuguggccccggccugguaugcgcgagccaggccgcuggggcagcgcccgagggc

SEQ ID NO: 4233418 - RNA, 129 nt, Human
ucaguuaugaggacuuuuucucugcccuucgucaauaugcagccugugaacagcgucugggaaaguaguggucauugguugcguaauuugauuugaggcuuguggaggaaaggacccaagugacucuga

SEQ ID NO: 4233419 - RNA, 60 nt, Human
uauaggaugaugucauguugcuuugaauucucuuagaaggaguacugacaauauucugug

SEQ ID NO: 4233420 - RNA, 59 nt, Human
cuggcaaucuggcccuuugucagaguauugaaggagacagcaagaggaccagaugugag

SEQ ID NO: 4233421 - RNA, 117 nt, Human
cccgugccugccccacagccccuccagcucgaauaauggagaacugucaaugcacuccgcgagcgguggcccauuguacgcagcugauggcgaggaggcgacuggggguagcagggg

SEQ ID NO: 4233422 - RNA, 58 nt, Human
ugaugaaguuggaaggaaaguucuaugccagggcauuugccuccuccaaguuucauca

SEQ ID NO: 4233423 - RNA, 100 nt, Human
gguccuggacucacugcugcaggauggggaauugaccguggaucuucauaugaagagcaucgguggaguccccaccuucaacgucauugucaccaugacu

SEQ ID NO: 4233424 - RNA, 57 nt, Human
ucuccuuuacuggcuccuuuuggagacuacagauggaggcaggagcuagaaaggaga

SEQ ID NO: 4233425 - RNA, 80 nt, Human
uagcuacauuaaucuucauuauuaauaauagcagcuguaacagcagcuguaacagguuaauauggagcguugacaggcua

SEQ ID NO: 4233426 - RNA, 88 nt, Human
uuauuuaaaaccuuauuuaugcaucacuuuuuucccauuaaaagaugcuuauggaaaaauggguggugauaugaccagaggaaaauga

SEQ ID NO: 4233427 - RNA, 56 nt, Human
gaagagccauuuaaauaguugucagugacaacuacaacuuacuugaauggcuuuuc

SEQ ID NO: 4233428 - RNA, 60 nt, Human
uccuaaccuuuuuuaaaguuuccuggucuccacuggacacagagcuuuggagacggagga

SEQ ID NO: 4233429 - RNA, 70 nt, Human
gcaguuccugugcccuguucuuuccggggcugcccccugcuuuucgggagccagcagggcauggagcugc

SEQ ID NO: 4233430 - RNA, 56 nt, Human
uguggucauucucugucuucacacccuccugcagaagacaccagagacuggccuca

SEQ ID NO: 4233431 - RNA, 86 nt, Human
cauuugaguuaugauggaaaucuggugauuuucuguugcagucauuuguuguuacaacgcacacagauuucacucaucgccaagug

SEQ ID NO: 4233432 - RNA, 82 nt, Human
cuucuucuucuagaagauggggaagauuaauccuugguucuucuguugaaacugcugcuucuucaucuuuuggaggaacuag

SEQ ID NO: 4233433 - RNA, 114 nt, Human
gaaauguuuuuagugccacuuuagggaauagaguccuguacugaaugauuuuaguuguaugaugaauuauaagugccucuuuauuuucucuaagauugcauuagaaaauauuuu

SEQ ID NO: 4233434 - RNA, 100 nt, Human
guagucaaauauauuuucaaagcacaauuuuauuagacaggcauaauuuacauuuugcuuuucuaguggguuugaaaauguuuauuggagauugggcuau

SEQ ID NO: 4233435 - RNA, 56 nt, Human
agggcaguuaugaaugucuccaaaacuauuucagggguaauucaugaacauguccu

SEQ ID NO: 4233436 - RNA, 65 nt, Human
ccuaaagagcaguucucugucuagcuagaaccuucugaaguagucucuagaggaauuguucuagg

SEQ ID NO: 4233437 - RNA, 73 nt, Human
uagcacagaguaauggucucaauaaauucuggugauacaacauaggauuagucaccauuauuauuaauugcua

SEQ ID NO: 4233438 - RNA, 62 nt, Human
uuaaagguacuccuaagcggggaacaaugcaccaagacacuccugcuccauggcaucuuuag

SEQ ID NO: 4233439 - RNA, 78 nt, Human
guagauauuacaagcagcauuaccaagacauggcaaaaagaguuugucugaauuguaauguugcguuugugaaccuau

SEQ ID NO: 4233440 - RNA, 92 nt, Human
cuuaugcgccuccugcccacaggaagacaccagcggugacuacaagaacgcccugcugagccuggugggcagcgaccccugaggcacagaag

SEQ ID NO: 4233441 - RNA, 56 nt, Human
accgauuucaaauggugcuagacaaaaacagacucugaacaccaggagaaaucggu

SEQ ID NO: 4233442 - RNA, 76 nt, Human
guugucuguaguccuguccuguccuggagacaugaggggcugucuggugugaaggaaaguaggagggacagaaaac

SEQ ID NO: 4233443 - RNA, 76 nt, Human
gccgcggcccccucuguagcccgagcugcuccgcgacgcgacggagccggccucggacagagggagcggucgcggc

SEQ ID NO: 4233444 - RNA, 63 nt, Human
ccucccugagaugcaggagagagaaggggaaggcacccccucucugcugucuuucgggaaagg

SEQ ID NO: 4233445 - RNA, 61 nt, Human
gcagcaaucuucacagugucauuggugcaggaaacaugcaacaccacauggagcuuguugc

SEQ ID NO: 4233446 - RNA, 68 nt, Human
gaauagaggaauuauugaguuagauuugaaaauugguuuaauaaucugacaaaauauuuccaguguuu

SEQ ID NO: 4233447 - RNA, 85 nt, Human
uaaaggcauuuugaauauacuuacagcuuugaucugcaacaaauccuacauggagaaagggaaauuaaugugagcaaugccuuua

SEQ ID NO: 4233448 - RNA, 61 nt, Human
ugccccuggaggagagcaaugggggugccucccacgcuucgauuugcucucucugggggca

SEQ ID NO: 4233449 - RNA, 88 nt, Human
augggccuuugaggguggauugucaggggaugauagaaaggauuuuaauaagucauccugaggaaauuucaccuagugagagccacau

SEQ ID NO: 4233450 - RNA, 81 nt, Human
guccuaaagaaggguggcagguguacagcucagcucaggauccugaugggcggugcauuugcacaguuguugcuccagaac

SEQ ID NO: 4233451 - RNA, 85 nt, Human
cuggaggucgcucggugagccaguggcggagccuggacuuguacccagacguucuguaccuuauguucagagugaccuguaccag

SEQ ID NO: 4233452 - RNA, 77 nt, Human
cugguuuugguugagguugacucuauauagaaagggcauuaauuauuauaggugagugaagcucaggaagagauugg

SEQ ID NO: 4233453 - RNA, 88 nt, Human
auucuuaggagcuaauagacagcaacaucagcaacguagugagauucgcucaguagugaguugcagucaauauugcaaucuugagaau

SEQ ID NO: 4233454 - RNA, 58 nt, Human
gggcaggacccguuagaguggcgaguaaggaagcguuggcucuucuccgggucugccu

SEQ ID NO: 4233455 - RNA, 108 nt, Human
gggcugcugggugugugcaguggguucuguggucaggagagugccgucuggaugggagauauuugguugguuuuagcuuggcccauuccugccacugacugauggccc

SEQ ID NO: 4233456 - RNA, 71 nt, Human
gauagauagaagggacguggugccaauuugggucugucuguugccaaagcucauguugcuucuguucuguc

SEQ ID NO: 4233457 - RNA, 60 nt, Human
ggugaggggauccuguuaccauccugaguauucuuucucugguaaggggauccuguuacu

SEQ ID NO: 4233458 - RNA, 67 nt, Human
ccauacuuuccuuucugcuuucuaguugguguuuuguugagcacucacuagaguuagaaccacaugg

SEQ ID NO: 4233459 - RNA, 70 nt, Human
gcccaagcugagccagacagguaagcagagacuuucacugcagugaugcuucuggcucagccccaggagc

SEQ ID NO: 4233460 - RNA, 57 nt, Human
gaccuuguucuggcauucucaggccugguggcuaggagugagugacagaagaagguu

SEQ ID NO: 4233461 - RNA, 64 nt, Human
ccuuagagauagccaaguccuucaacauaaagagaaucuugaauggaauuggaaucuuauaggg

SEQ ID NO: 4233462 - RNA, 79 nt, Human
ggcacuguagcucaaagacuggaaucucugcuuguuaaccauuguuaacuaguauuuuuaguccugguugcuuuuagcc

SEQ ID NO: 4233463 - RNA, 92 nt, Human
uauguggucaugaguguguuccugucuuauucuuauuuuauguggugcauuuuuaaauaggacuguacagaauacaagcaucuauuuguaua

SEQ ID NO: 4233464 - RNA, 67 nt, Human
cuccagcucgcgagcucugcucccuuauucugggaaaugucccacugcaggggugugugagcugggg

SEQ ID NO: 4233465 - RNA, 80 nt, Human
guuucagaguuugagggaacccaaauaggaaaauugauggagucauuuuccucugcugguguucaagucagauuugaaac

SEQ ID NO: 4233466 - RNA, 62 nt, Human
cccuccgccuguccugggcccacgcaggacccccaagcggggcucugcacaggccaggaggg

SEQ ID NO: 4233467 - RNA, 72 nt, Human
cugggagagcccccgccuugcugggccagggguaaaauaaggcuccugucugaaggcagggggaugguugag

SEQ ID NO: 4233468 - RNA, 68 nt, Human
cuccucuggcuguguucagcaucaacggccucaugaucaaacagcugcaguacacggccuauggggag

SEQ ID NO: 4233469 - RNA, 93 nt, Human
agaguuguuuuucuuagauuuuagaaaaaugagaaauagguuauaaauuugaccccccaacaucaaucccugaacuaagcccaaagacacucu

SEQ ID NO: 4233470 - RNA, 59 nt, Human
ugauguaucugagcugcuuagguuuaugaaaggucaccuggauauuuucaguugcauca

SEQ ID NO: 4233471 - RNA, 73 nt, Human
uuccugcccucgaggagcucacagucuaguaugucucauccccuacuagacugaagcuccuugaggacaggga

SEQ ID NO: 4233472 - RNA, 65 nt, Human
cucaucagccacacuuagucacaaagauguuccuccagacagcuugaugaaagugggugcucggg

SEQ ID NO: 4233473 - RNA, 129 nt, Human
aguugcccaccaaggaugaggcuuugaggcagugacagaggccauuucacagguuuuggagaaguguccagguaaggguaaguaggcugcuucucauggcucaaugugaagucuguugggcaaggaauu

SEQ ID NO: 4233474 - RNA, 57 nt, Human
ucuccugcuucaaucugcugcuggauaggaacuaaucagagagagagaggcggaaga

SEQ ID NO: 4233475 - RNA, 91 nt, Human
ugggaaugguguggacauuccaaaaggaccagaaaccuugucucuguucuguguuguuuggggauguccaugaagaaauguauaacccuca

SEQ ID NO: 4233476 - RNA, 74 nt, Human
uccugagaauaagaguuaagaaguauauucauugucaucuuauuucugauauauuucaaauucuuuugcuagga

SEQ ID NO: 4233477 - RNA, 61 nt, Human
cacagcuggggaagcugaggccguguggcucacaguccuggccuugguggcuuugcugaug

SEQ ID NO: 4233478 - RNA, 103 nt, Human
ugccgcccuccuugaugugggccaccagcugguacuucugcacgugcuugucugucuugcagugcagcuggaaguuggccuugagcuggguguuguagcggca

SEQ ID NO: 4233479 - RNA, 116 nt, Human
gcacagcuagaggaugacggucuuauuaggaaaugaauggugcccuagagggauggaugcugggacaucugucugucugccauuuauucuccuagucucccuuuccucuccuuugc

SEQ ID NO: 4233480 - RNA, 56 nt, Human
aagguccuguagccacagagccagacaaggaucaagguucuguggucccaggccuu

SEQ ID NO: 4233481 - RNA, 67 nt, Human
auggagaugucugugccacgucucagcacacugaaugguuauaugauguuuaaaagacaauuuccau

SEQ ID NO: 4233482 - RNA, 63 nt, Human
uuuucucucacuucacauauuuuaggauauagcaaacaaugaaaggagugaaaugagaggaaa

SEQ ID NO: 4233483 - RNA, 65 nt, Human
gggcggcguccucagucggguggucccggggccuuugcggucccgcccggcugagacgcucgccc

SEQ ID NO: 4233484 - RNA, 56 nt, Human
gaaaacccuguauguagcguuugcacugacuaacaagaugguauugcuggguuuuu

SEQ ID NO: 4233485 - RNA, 68 nt, Human
agcagggccagggcuauggugaagugugggaggugcccaguccccuucacugcagucauggcucuguu

SEQ ID NO: 4233486 - RNA, 86 nt, Human
uuuagacuaaggaauagcuaguuguuguguuccgacauuccaaaaugcaaaacaaccuaguaguaucuuucaugaaaagguuuaag

SEQ ID NO: 4233487 - RNA, 58 nt, Human
uguguguucauccccucaacauuaauaaauuaauaaauguugaguggaugaacaaaca

SEQ ID NO: 4233488 - RNA, 121 nt, Human
gcuccaugaaagcgguccuuuuuguuuauuuuguucacugcuauaacacuaacaucuaaagcuggaugcuuaagaauguuuguugaguaaaugaaugaauaccaguauugccuaucagugc

SEQ ID NO: 4233489 - RNA, 77 nt, Human
gcauccgagugugcguugguggguguguggucggagccgacgugcauuccgacacacgugcucgcagcgcggggugu

SEQ ID NO: 4233490 - RNA, 78 nt, Human
gguugucacuguuucaccgucugaagguaggggaaggacuaucccuuuuuuguagauagggaaacagagaagcucacc

SEQ ID NO: 4233491 - RNA, 82 nt, Human
cagaaguccaaggacacuuccugaguggacaaggugggugggugauccaguuguccacuaagaaagugcccuugggcuucug

SEQ ID NO: 4233492 - RNA, 55 nt, Human
uggucaagcaaugaauuuauuuaggaaaaauaccagugaagagugggcuugauca

SEQ ID NO: 4233493 - RNA, 78 nt, Human
caaagaccugagucagaagccugucugacuuguuuggggaauaacaaggaggccagugcagcuggaacagaguaaaug

SEQ ID NO: 4233494 - RNA, 61 nt, Human
aauuauucuugccuagguuuaaagcuacuuaaaauccuuuuuggacuuaggcagacuaauu

SEQ ID NO: 4233495 - RNA, 78 nt, Human
ggcagugggcagagggugaggaaggcgagcacccccaaguauccaugcucgcuuuccaggcacauccucuucucugcc

SEQ ID NO: 4233496 - RNA, 71 nt, Human
ggagcacuggcuucuugggaggggcggagcucagccuugcugggugcucagugccaaggagugagagcucc

SEQ ID NO: 4233497 - RNA, 82 nt, Human
aaaaguaaugugagucugucuaaccauauuuuccuaacucaacaguaggaucaugaugguaaggcaaaugcaaguuauuuuu

SEQ ID NO: 4233498 - RNA, 79 nt, Human
cccaaagugcauugcaucuuuuauggguaagcaugaaauagguuuauuugugguaguguaaucuaacuuaagagguggg

SEQ ID NO: 4233499 - RNA, 58 nt, Human
aauucugaggccauuuauuuccucucuuaaagagaaucugcaaaugguccuagggauu

SEQ ID NO: 4233500 - RNA, 125 nt, Human
gaugugguugggugguggguucugcuuaacuuguuaaaagugacccuaaugagccugaagugguugguuucauugcauuagggucuuuagacagcucagggagaaacugccacucuguaagcauu

SEQ ID NO: 4233501 - RNA, 80 nt, Human
gcuaaugguuuuuggcucuggcgagcuuuaguacaggaacacucauuguauugugggugucagagugcaagaauaacagc

SEQ ID NO: 4233502 - RNA, 56 nt, Human
ccuugagugcaucgugggugucaugcaggcaguagacccggauguuguacucgagg

SEQ ID NO: 4233503 - RNA, 76 nt, Human
caggggcuuucucccucacaaagcauucucuucauggaaggaugaugaaguaaaucuuaugucagggagccaccug

SEQ ID NO: 4233504 - RNA, 81 nt, Human
ucugccugucuuauuauucaaggugaggguaaaauugggagacuuguuuuuucuucucuaucuuaauacaaacacagcaga

SEQ ID NO: 4233505 - RNA, 74 nt, Human
gugugcuuacagugaggcgagauucaccauuguuucuuaugauugugcauuuuguuuuacuuaucuauguauac

SEQ ID NO: 4233506 - RNA, 68 nt, Human
uggggccugcaguagagguugguagggggagcuguaguuucuauauuaaagugcuuugcagugucuca

SEQ ID NO: 4233507 - RNA, 72 nt, Human
gggaguauguccgggcucuagaguacacuauggagaacuauuuccccgagcuggaucgccccgaugugcccc

SEQ ID NO: 4233508 - RNA, 58 nt, Human
cuggccaggugggggguagugggagaucacauauacacagcccccauacccugcccag

SEQ ID NO: 4233509 - RNA, 100 nt, Human
aggcuguuugacuuaggaugaggaaauguacuuauagggagguuuuucugaacaaaaauugcauucauuuguauauuucugauaucucaacaggcagccu

SEQ ID NO: 4233510 - RNA, 64 nt, Human
uccugagcuauauauuaugcauaguaauuuccuuugagauccuaagcuugaguauagcuuagga

SEQ ID NO: 4233511 - RNA, 84 nt, Human
ugugggucaugggugcaaaggagcccuuugccggguugaguucaucuuacacccuugcagacgguuccuuccauuugaccugca

SEQ ID NO: 4233512 - RNA, 67 nt, Human
guggacauaccgugccccaaugcggaaucgggguuccuggaggugcuggaguggcacuguguggcac

SEQ ID NO: 4233513 - RNA, 86 nt, Human
ucacuucacauggauuaacucauuuauuucaauggcuuuguuuuauucaugcccauuuuauagaugaggaaauucaggugcaguga

SEQ ID NO: 4233514 - RNA, 56 nt, Human
agaagggaagcaggagaggcauagggcaacccagaaugcuaucugcucucccuucu

SEQ ID NO: 4233515 - RNA, 90 nt, Human
cugggggccucggggcggggagcaugagcugggcuggcaccacgacugagggcucccggcucggcuucuuccccacagcaggcugcucag

SEQ ID NO: 4233516 - RNA, 69 nt, Human
gccauucuccucaaaacaucugcugucuuuaacaucuggcauaggugguagaauggggagauacuaggc

SEQ ID NO: 4233517 - RNA, 63 nt, Human
ugagguuacauuaggaauaaccugcauuccacuccaugcccuggcugcucgugaugaacuuca

SEQ ID NO: 4233518 - RNA, 55 nt, Human
ugucacaccucguuuagcauucuuuguguauguuggaugcaggggaggggugaua

SEQ ID NO: 4233519 - RNA, 69 nt, Human
uguacagacuauuuugugauaacuaaucuguucucuuugacuauuacugaggcaaaguaguuuugugca

SEQ ID NO: 4233520 - RNA, 81 nt, Human
uagaauuuagaauuucaucugagacugggagccuggacgaaaguggcacugagacuuuagauuggaguuuguuaaauccug

SEQ ID NO: 4233521 - RNA, 103 nt, Human
cgcgcggggggcuggugaggcgugggaggggcggggcgggaggagagccucacuuucugugcuucuccucuuugucacugcuuuuggcguuguuguccgugug

SEQ ID NO: 4233522 - RNA, 60 nt, Human
gaccuccauucugucaugacugacaccaugguagucugucagcuugaccaguggagaguc

SEQ ID NO: 4233523 - RNA, 79 nt, Human
gagguauggauaaaucuuucacauauuuuuuauugcucuuuaguaaagaaaggcacaagaaagaaaauauccagcucuc

SEQ ID NO: 4233524 - RNA, 60 nt, Human
cugaguucugacugagcauggggcaaaguguuugaccugcaugacuuugucagaccuuag

SEQ ID NO: 4233525 - RNA, 58 nt, Human
cagauuuagcacugauaggacugcuugccuuagacagcacuaccaguaauuaaaucug

SEQ ID NO: 4233526 - RNA, 64 nt, Human
gcuuggaggcagagucuugcugaggugcccgugggucugccucagcaauuaccugugucucugc

SEQ ID NO: 4233527 - RNA, 75 nt, Human
cucucugaccuuuuuaaauuauuuuuaauaccaaaagaguucuuuugaaauggaacugauuaaaagggcagaggg

SEQ ID NO: 4233528 - RNA, 70 nt, Human
gcaguaauucuguuuuaccauuuucuuuugaaacacucaacuugggaaaugaaaauacagauucuagugc

SEQ ID NO: 4233529 - RNA, 72 nt, Human
guauuaaugugccugagggcuccuuguggauaggucaguguccacauuucagcacucagggcaugacuguac

SEQ ID NO: 4233530 - RNA, 80 nt, Human
gugcauuccagaguugcuggaaaaaguugcccccaguucccccacauucugccuguuuucuacaaucacucuggaagcau

SEQ ID NO: 4233531 - RNA, 82 nt, Human
guugagggccauuuaggcagauuccauauuuuggcuauugugaauagugcugauuaacaugaauguguagauguccuucaau

SEQ ID NO: 4233532 - RNA, 74 nt, Human
cugcgugcucacagaggaugucuacaccuugaggcugagcuaugaggagaacauuccugaacaggugcaugcag

SEQ ID NO: 4233533 - RNA, 86 nt, Human
aagaggggagacgagaugugucagguccugggggugggaagucacuuccugcgcccgcuggcccugcgaucuccgccuucccucuu

SEQ ID NO: 4233534 - RNA, 76 nt, Human
accuggucaagugguaauguucugaugaauuuguuucucugcaagaacaaggaagaaaacauuacuuugaccaggu

SEQ ID NO: 4233535 - RNA, 60 nt, Human
gaugggaaggugguaaaguuuaugcaaacaauagugugagggaugccucuccuuccgguc

SEQ ID NO: 4233536 - RNA, 117 nt, Human
uaaguuuugauuuuaaagaaauuccuugcacuacagccuuuucuuaaaaugcaagauucucacuuugaagguuuuguguuggaagaaaugcuacugguuuuuaaaaagcaaagcuua

SEQ ID NO: 4233537 - RNA, 62 nt, Human
ugucugggauguuggcagccacuucaaaaucagaccucuguggcagcauuuuuuccagaaca

SEQ ID NO: 4233538 - RNA, 88 nt, Human
agcaccaggaaugugguuuuagguuguguucuggcauguucuguguuuagggacauggggaaaaaggccugcucucgcucuugcugcu

SEQ ID NO: 4233539 - RNA, 66 nt, Human
uugccuagugguagugacuguucauguuuuauaaucuugugcuggaacuauuaauaccauuagcaa

SEQ ID NO: 4233540 - RNA, 58 nt, Human
ccuuucuaacagauuguggaucgcuuugaagagcagcguccuacauucauaggaaagg

SEQ ID NO: 4233541 - RNA, 130 nt, Human
gcaguuucaggaaagucugccaggcaugagcugagaccuuaagagaugucagcuagaauuagccacugucaguauaucugcuucugggucccacucuucauccugcuuuucaagguuuucaaauauacac

SEQ ID NO: 4233542 - RNA, 55 nt, Human
cuucauccguaccacggccacauugguuaggcggaucugguuggugggggugaag

SEQ ID NO: 4233543 - RNA, 95 nt, Human
cgggggucggggcgcauuugccaggagacaucuggagcccggcccugcuucugucgggcuccaggguaccccuggauggcugcgcugugcccucg

SEQ ID NO: 4233544 - RNA, 77 nt, Human
agaguuucacaggaauccucugcucaugagaaaugucucucugacacucagaaaggcagagguucuucuuauauucu

SEQ ID NO: 4233545 - RNA, 57 nt, Human
gugggggcagaagcgagugcagaucaggaaccuggagggcaaguuaucugucuccau

SEQ ID NO: 4233546 - RNA, 60 nt, Human
accucaguucaagggaguuucacagaagaggggcuuggggagagcuagugagcuggaggu

SEQ ID NO: 4233547 - RNA, 82 nt, Human
gugacacgcugcagaggagcuggaaggcuggacagccucggggaggcucagcuaauuccagggcuacaccuugggguguuau

SEQ ID NO: 4233548 - RNA, 63 nt, Human
gggaugaguuguauauaggauuccaaacacggcuccagcgggauccugacauauaccaucacc

SEQ ID NO: 4233549 - RNA, 89 nt, Human
uucugugggcccagcaacagccccucuucucuccucggagccagggccaggcuauuccaggaggacugagggggcuggaucuaucagag

SEQ ID NO: 4233550 - RNA, 65 nt, Human
agcuuggaggauggaaaaaccccaaaggugugaaaucucuggcuuuuuuuccauuuuauuuagcu

SEQ ID NO: 4233551 - RNA, 69 nt, Human
gucaugggaaaauguuucugagacaaaucucuaguuuaugauuuaaaacaguacguuuucuuacgugac

SEQ ID NO: 4233552 - RNA, 57 nt, Human
uguguguaugagcauuuguauguauauauacuuauacagaucuauauuauauauaca

SEQ ID NO: 4233553 - RNA, 56 nt, Human
acccuauuaacuacuacguuggcacugcugugugccacguguugcucagacagggu

SEQ ID NO: 4233554 - RNA, 63 nt, Human
gcaggggguaaggggcagggcucaggaauauuuccaaguugccaaacugcccguucucucugc

SEQ ID NO: 4233555 - RNA, 57 nt, Human
cccagagacuuuguccgacgacuggcccaggcgcuggcgggacacucaagcucuggg

SEQ ID NO: 4233556 - RNA, 59 nt, Human
ccaucuuugcucuuuuauugcaaagcaaaaguguuuauuaauaauugggggcagggugg

SEQ ID NO: 4233557 - RNA, 66 nt, Human
aguguuuagcaguuuauuuaagggggugccaaauauagcauccuucuguuguuuauuuuaaauauu

SEQ ID NO: 4233558 - RNA, 91 nt, Human
caggagacucugcugcuguuuucugggcuucuuaaguguccagucccugcgcugcacaggugggauucucagaaacacagagaguagccug

SEQ ID NO: 4233559 - RNA, 74 nt, Human
ggggugacucccagcuccugggccccacagagaguccauguucucagugcaguggcugagcuggaggacgcccu

SEQ ID NO: 4233560 - RNA, 82 nt, Human
agcaucaguaacuccuauuugguagauggaagagaaguuaaaugcuuuaccuaaagucauacaaggugggagggcuacugcu

SEQ ID NO: 4233561 - RNA, 96 nt, Human
aaauguuuucacggcaucuuuguugauuuggcguuuuccuccuguugaauaaucuccucaggagaaauucacauuagugagaugccuggaucauuu

SEQ ID NO: 4233562 - RNA, 55 nt, Human
cuucucuuugacaguuggguguuugcgcacaagcagccaacccacgugagagaag

SEQ ID NO: 4233563 - RNA, 82 nt, Human
gggcuggugcaguagaagagcuuccaccuggggcugcgagaaagccgccugcagccagggaguucucuccucauugcagucu

SEQ ID NO: 4233564 - RNA, 70 nt, Human
gaaaccacgguuuugugagguaguacuuucaaagggaucuauguaucucagaagcuagucaacagguuuu

SEQ ID NO: 4233565 - RNA, 101 nt, Human
gaaugauuugaagggggcagucagagaaguaggaauaucaggagugguggucugauuacucugagaugugucuugauucuauuuuguuuucuuugaaauuc

SEQ ID NO: 4233566 - RNA, 78 nt, Human
ccuccagcucuggagggggcggccccugugggcacagcccagcguguguuccuggggaccugccuucccugagcgagg

SEQ ID NO: 4233567 - RNA, 74 nt, Human
guuaagcuaaagugaaguucagaauggcuuguuaacuggguuuauuagcuguugaccuucccuuucagcauaau

SEQ ID NO: 4233568 - RNA, 130 nt, Human
ccuacucuguaacccugcuuuucguuuccuguguguccuuucagagcuccuuuugcuuucaaaagcaaauacaaauacgggcagcuucugaauggauggccaagugacucuggagcuuccgcgcugugug

SEQ ID NO: 4233569 - RNA, 66 nt, Human
cugggugccgcaucuugcuguucagcugcagcggaaccggccggaccagagcuaaugcgcgcccag

SEQ ID NO: 4233570 - RNA, 93 nt, Human
caucagcgcuaccugugauguuuucauguauuuauguauguguuauaaauacuugauuuauacauauacaaaugcacauacguaguguguuug

SEQ ID NO: 4233571 - RNA, 105 nt, Human
cucaguccuucuagaagaccuggacugagagaucaugcgguuaaggaguguguaacaggcggaccaccuguugggacugcgagauucucaaggggaaggacuggg

SEQ ID NO: 4233572 - RNA, 129 nt, Human
uugaacaucgaauggagcaaggucuacacucucagccuguagcugugcuaauguuaggauugaauuguucuauuaauucccucaagagacccacagccucaaaagaguugcuuauuaucagauguccga

SEQ ID NO: 4233573 - RNA, 130 nt, Human
cccaucuuggagggcugugcuauagaauaagugaggaagugguuguaugguuuccaucauauauuagcugcuugauggacacuggauaacccuguuggcucucuauacugucccagguacaagaauauag

SEQ ID NO: 4233574 - RNA, 60 nt, Human
aggguuaggaaggagaagagagaguggcgaaguuuguuuuccuucccccuucuuugccuu

SEQ ID NO: 4233575 - RNA, 105 nt, Human
uggaggaagggcggcaagacaugaggggcuggggcucuggggcuaggacucuacccaggaccccgccccaggcccugagccaagcauggacgcugaugucagcca

SEQ ID NO: 4233576 - RNA, 84 nt, Human
guuuuuccuuuuaucaauauaagucacauuaaggagguacaaauacuguaccauuauagaggacauuauguuuaguggaaagac

SEQ ID NO: 4233577 - RNA, 82 nt, Human
aggcuucucugacauagcauguguuuauuuucuuaggugagaccuaaaauccaagaagagaauauauuuacgucuauggccu

SEQ ID NO: 4233578 - RNA, 73 nt, Human
cuugggcacuagcggauucucgacagaaccacaaaguggaguuggcugcagaugagucuguucauggccccag

SEQ ID NO: 4233579 - RNA, 58 nt, Human
gagcaggucucaguucugccucguuccagagaaauacagggugaucugucccuugcuc

SEQ ID NO: 4233580 - RNA, 59 nt, Human
uugugccuuaauauaggcgcuggggcuugcccauggugcucuugauauauaaggcccgg

SEQ ID NO: 4233581 - RNA, 58 nt, Human
guauauauaauguguacaggugaacacagauguguucacaaggcuauguuauauguac

SEQ ID NO: 4233582 - RNA, 130 nt, Human
auauuuguauagugaauuguguacaauuuuugaauaagugcaucaucacuuaaccuuuauguuguuugaauagugaugaugauacauuucuucagacauuuaacugucauuuuuuuccuuugucauuugu

SEQ ID NO: 4233583 - RNA, 66 nt, Human
gcuggcggguuggggaggcggagagcucgaugcaggugcuguccuccucgccacgacucugcuagc

SEQ ID NO: 4233584 - RNA, 62 nt, Human
gccuggggaauguaauucuuuggcugccaggucuucugggagcagagaacauucauucaugu

SEQ ID NO: 4233585 - RNA, 55 nt, Human
cggggaggagccagcggaggaucugggcgcaguuuccucucuaaguuccgccccg

SEQ ID NO: 4233586 - RNA, 84 nt, Human
aaaugcugaguaauuucuuacggagaccuuacagauacaguucuuuuuucuauuguuuccccggaauuauucagaaaagcauuu

SEQ ID NO: 4233587 - RNA, 78 nt, Human
guaccaacaaaacauuuaggguuuuuuuuaaccuucauuaaguagggugaaaggaauuuaaauguuguuuauuaguac

SEQ ID NO: 4233588 - RNA, 77 nt, Human
ugccacagagcuauuucuuaaaagcuguacuuacacucaggauacaguuuuccuugguauagaacucuuccauggca

SEQ ID NO: 4233589 - RNA, 74 nt, Human
gagguagcucuaaggagaaucccucuggguuugagcgcauuccucuuccagggggccuauucuuggacugcuuu

SEQ ID NO: 4233590 - RNA, 74 nt, Human
ggaugccacucaucauuuuacggagcagccgguggaugccaggcuguggcuccaauggugagccuggccagucc

SEQ ID NO: 4233591 - RNA, 63 nt, Human
gaaugcacacgugugugcaugcacugugagcuggugugugcaugugcacuggugugugcguuc

SEQ ID NO: 4233592 - RNA, 68 nt, Human
gagccuaccugcugcucuuucaucccacugguucuggauccuacauaagaggcagcuugguaggcauc

SEQ ID NO: 4233593 - RNA, 106 nt, Human
guuaucuggacagcuucuuugagacuauuuaaaaacugguacaacaggucucuacaacgccaagaucuaacuaagcuuuaaaaggucaagaaguuuuauggcugac

SEQ ID NO: 4233594 - RNA, 78 nt, Human
gggaugcacuuuaccuuguggugacuugagcuuccuaagggccucaccaaguucugagcaccaggcaccacagcuccc

SEQ ID NO: 4233595 - RNA, 68 nt, Human
gacggcuacccaugucauauucguggaaaauucaccugacccaagaaaagaaacauggguaugcuuuc

SEQ ID NO: 4233596 - RNA, 67 nt, Human
gaugguaucugcuggcuuucaggaccaggucgggcacuggacccccacugaauaccacagagccauc

SEQ ID NO: 4233597 - RNA, 82 nt, Human
ucaagaaaagcauuucuguuguguuauuugcagugcagaugaugucuguguaacaacauaaugguuauucaccuuuuuuuga

SEQ ID NO: 4233598 - RNA, 56 nt, Human
gcaaaucugaauuaaaaucugguucuugggaaagaacugaaguuuucagauuuugc

SEQ ID NO: 4233599 - RNA, 60 nt, Human
ugggccucuguuuccucaucugcaaaguacccauuuuccagaugaggauacugaggccua

SEQ ID NO: 4233600 - RNA, 69 nt, Human
gacaaguagguuauuuuuagcaaccaacauuaugaaggugacaaaaugagagaaauagccuuccuuguc

SEQ ID NO: 4233601 - RNA, 127 nt, Human
ggggaaaagaagcuuuauguccagugaucaacagggcuggaaagagcuggcaguuucagaaaagaagaaaccucucuugacagcuuuaguaucauaccguggacuggaaauggcaaaaaucaucccu

SEQ ID NO: 4233602 - RNA, 58 nt, Human
cuuuguguuuucaggcacauggcugaugacucgagcaugcuguuuggaaacgauaaag

SEQ ID NO: 4233603 - RNA, 55 nt, Human
agggcaguguggugggacugacucaacagacauaguuucaucuccacccugcccu

SEQ ID NO: 4233604 - RNA, 67 nt, Human
ccuuccaguucuugguuguaauuggauucaggcuaaaacaaccacguccccaaccaggaaaggaggg

SEQ ID NO: 4233605 - RNA, 106 nt, Human
gcugggguugaucccaggucuggcccaucagggcaccugagaccggcugaguugccuuccaggucgggggugggccggcuguggggaagaggcuguggaccccagc

SEQ ID NO: 4233606 - RNA, 76 nt, Human
ucagucucccaaagugcugggauuauaggcaugagccacugugccuagccaaguccaguauuuauaggagauguga

SEQ ID NO: 4233607 - RNA, 80 nt, Human
gcaccuggaggcugccagcugggaacccccuuuaggcgacgucagcgccguugguucucagccugagccgcccccugugc

SEQ ID NO: 4233608 - RNA, 74 nt, Human
ccuggggcucugcacagagcagcagagcuagagccaugaaacccacagacuuggugccugagcgcagcuccagg

SEQ ID NO: 4233609 - RNA, 62 nt, Human
cugccugugcgccaagugcacgcucaucgcggagcgccagcgugucauggcggcgcaggugg

SEQ ID NO: 4233610 - RNA, 88 nt, Human
agucuuaaagcacugcccacauuuccaaagaugccagucacugaacuccgaguggagcuggcuuguggaaguugggcuugccaggacu

SEQ ID NO: 4233611 - RNA, 82 nt, Human
gaaugcugcuaacugaauuacaaagucuggggccuaaugauuaccagugccagagcuccaggguuuuguagugucagcauuu

SEQ ID NO: 4233612 - RNA, 71 nt, Human
gcuaaacacuauucuggaaauaguauccucuacccaaaucuacuuggcuauaucuguggauaguguauggu

SEQ ID NO: 4233613 - RNA, 89 nt, Human
ggggagaguuggagacagugucagccauugaaaagaccaaacaauuuaaggcccuuuuccccugggaacauugauucuuuaaucucccc

SEQ ID NO: 4233614 - RNA, 62 nt, Human
caggcagggcugccuucugcuuuuucaaauucuugcuggucuuagcaguggagccaugccug

SEQ ID NO: 4233615 - RNA, 61 nt, Human
gcucagcuggagagggacggguugggacgcacuguccuuuugcccuucccccuccgcgagc

SEQ ID NO: 4233616 - RNA, 77 nt, Human
cccccucaaacgcauucuuacaugcuuccaccucuaaacaggagaggggaagcuguugugagugcagcaggaggggg

SEQ ID NO: 4233617 - RNA, 92 nt, Human
gugcucuucuuugcuggugugagauucucgagggccaauguccuucaucugcguaacucuagggacucgcccagaccuuggaagagguucac

SEQ ID NO: 4233618 - RNA, 71 nt, Human
aguccucagauauggagaucugcuuuuuugucccagcuuucuuauacauucagucuucaggugugaggauu

SEQ ID NO: 4233619 - RNA, 124 nt, Human
uuuuucuuuuuucuagggcauuugccucauuuuucugaugaaguagaaagacccuagcaagucugggguuuuccaguagaucagaagagugaagcuuugaugugauggaaauuaccaagaaaga

SEQ ID NO: 4233620 - RNA, 63 nt, Human
aaucgaguggugagaacacaacagaaguccaauuuagauucugaguguuguaaccauaugauu

SEQ ID NO: 4233621 - RNA, 81 nt, Human
cccccuuuccccagaggcugaguugggagcauguuaggaacacuagcuaguugcuccugaacacagcccuaugaaauaggg

SEQ ID NO: 4233622 - RNA, 57 nt, Human
uugauuuccauuguccagcauuuuuaagcaguaauuuguuggacuaugaaaaaucag

SEQ ID NO: 4233623 - RNA, 62 nt, Human
ugggcuagagaggggaaggaugugaugugagcagaugguucucacucauucuccucugucca

SEQ ID NO: 4233624 - RNA, 56 nt, Human
gggggaaaguggagguucgugaaacucuaccuugguuuccccuacuccuuucccuc

SEQ ID NO: 4233625 - RNA, 94 nt, Human
uggcaguuccucucagaguagucuuuacucuuccaauuccauaugaucauauccuuuggaaguggcaaaggcuaaaguaauuggaaggaagcca

SEQ ID NO: 4233626 - RNA, 67 nt, Human
ugacacauuuuccagaagaaucagaguauucuucuagaaggaucugauucauucugguaaaugguca

SEQ ID NO: 4233627 - RNA, 60 nt, Human
gccacucaguuuaggggcaagcucugggcagacaccaggaagcuccugcagcuagagugc

SEQ ID NO: 4233628 - RNA, 129 nt, Human
uacaccuaucugcucauuuuguuguguuagcuuuucugguuuauuucauaguuuguucuugcuauuuauuaagaacagaauaucaaaagauuaugaauagccucagcucuagaaugcuuaccacuguua

SEQ ID NO: 4233629 - RNA, 82 nt, Human
cacucccccacuguccccggagcuggcaaauaaacaaauccacaaacaaauuauccgugugcuccggagaggcggcggcgug

SEQ ID NO: 4233630 - RNA, 71 nt, Human
caggaccccgaggagagguccaggcccuugggcuucugccaggcccugcugaggccucccucucuguccug

SEQ ID NO: 4233631 - RNA, 58 nt, Human
agggcaguuuuacugaaaggugcuuuacuguucaccugcaucuuucagcagcuccccu

SEQ ID NO: 4233632 - RNA, 83 nt, Human
agaugcagagagagccccaggggaggugcccugcagucccgaacucgacugacauccuacaccccugggucuccccagugucu

SEQ ID NO: 4233633 - RNA, 63 nt, Human
gggagccggcugggggcggagggcaguguugcaacacccccucuggcuccagucugacguccc

SEQ ID NO: 4233634 - RNA, 63 nt, Human
guggcuggauuuaggguucccuccuggugcuguaccugggaggcagacgcuggagcccaccgc

SEQ ID NO: 4233635 - RNA, 65 nt, Human
ccugguuugggaagaacuauucccuagugauaagagauuaggaaauaguuuagucccaaaagagg

SEQ ID NO: 4233636 - RNA, 72 nt, Human
gcaucgggagcccggcggaaacauggcggcgcccggaggccggggccgcagccucuccggccugcuccccgc

SEQ ID NO: 4233637 - RNA, 73 nt, Human
gauccacaguccugcauuuacugccuuucacuuaaugauuuuggacagguuuuagagagccaggauguugguc

SEQ ID NO: 4233638 - RNA, 86 nt, Human
uagucuuuccauugcugacuauacauuuagcauuuguugaaaguaacaacaaaucuagagaacuguggggcagccuggagagacug

SEQ ID NO: 4233639 - RNA, 68 nt, Human
ucagaaauggauggaagcagccugaacuuugccccauaugaauucgcugcauuccaucuaggucuuga

SEQ ID NO: 4233640 - RNA, 58 nt, Human
gugugcuuccuguauugauuccaugacucacggagcaugagcuaagcagaaagcacac

SEQ ID NO: 4233641 - RNA, 57 nt, Human
guccuggagcagcuggaagaugcugucauugcacuccaugauccaguguuccuggau

SEQ ID NO: 4233642 - RNA, 128 nt, Human
uuuucaaguguuuaaguucugcuuccucuuugauuaacacuucugucuuuaugucauuucucucucuugcauuuuacaauaggcagucaagagaagcaaagccucaccuucaacacuuugcuugaaaa

SEQ ID NO: 4233643 - RNA, 75 nt, Human
ccacaauggaggccccccaugcagcuccagacuuuaauuuaauucuuuggcggcuggacuggggggccauugugg

SEQ ID NO: 4233644 - RNA, 61 nt, Human
acguaaacagcaaagacaugaugcaaggaaguaugggcauguguggaaaugcuguauaugu

SEQ ID NO: 4233645 - RNA, 67 nt, Human
agaggucagaaggagagacagcguggagaaugauuuccaaggcuggaucuuuucuuuauuugauucu

SEQ ID NO: 4233646 - RNA, 80 nt, Human
cuuugauauuuguuuggcagaguucaggccaaccccaggcuucugcccuugccagacaaguaagcugaugauauucaaag

SEQ ID NO: 4233647 - RNA, 96 nt, Human
uguaacaugcuguuuccuuccucugcagauguagcugcuuuccuaaaucugucugucuuucuuuagguuagcuguaugucuguaaaaguauguuca

SEQ ID NO: 4233648 - RNA, 58 nt, Human
gugcuucaggaaacaaauuugcaguuucugaaugggagcuaaauauuuuuccugacac

SEQ ID NO: 4233649 - RNA, 58 nt, Human
cuugaaugcagaugugucuuuaauuuucuaugaaaaauaaccuucauuugcauugaag

SEQ ID NO: 4233650 - RNA, 69 nt, Human
uucuggacuguucauugauacuggaaauguuaauuuaaagagacuccuuuauuuaugggcaguguagaa

SEQ ID NO: 4233651 - RNA, 70 nt, Human
gcgucaagauggcggcggggagguaggcagagcaggacgccgcugcugccgccgccaccgccgccuccgc

SEQ ID NO: 4233652 - RNA, 55 nt, Human
uccuccuuuccccgcuggagcccuggauagagggcucucuggccugggaggagga

SEQ ID NO: 4233653 - RNA, 62 nt, Human
gaauaaaucacacaccuguuaaauugugugcugcacauaaucaagggguugugauguuguuu

SEQ ID NO: 4233654 - RNA, 86 nt, Human
augauuguuuguucaucuaaauaaauuugacagcucuucaugaagccaugaacucucggguuuggaaugauuucguuagcagucau

SEQ ID NO: 4233655 - RNA, 68 nt, Human
acggagacauguggaggaggcgaggguaacauuuuucugugcacugccuuucuuggcaugaccuuugu

SEQ ID NO: 4233656 - RNA, 63 nt, Human
agaacagccacccuggaacgguugucaaggcccagcacaacccacacguuccggguggguucu

SEQ ID NO: 4233657 - RNA, 57 nt, Human
gucagggugucuggcacaaaccaguagaucuccgacugguagucuuuguccccuggc

SEQ ID NO: 4233658 - RNA, 77 nt, Human
gcaauggauaacaccgguucuguccuaaucaccacuugugaucucaaggccuccuagggcagagcuaugucuguugc

SEQ ID NO: 4233659 - RNA, 113 nt, Human
ucccagggaaugcuuacuggacucugcugaaggugccacuucccucagacuauggugggagcggguaugaggaugaggguggcaugcacagaguugaguuaacagguguggga

SEQ ID NO: 4233660 - RNA, 69 nt, Human
aguucccaggcaauauuauaagggcauuuacauuuugugugaauagcaccuugaguaaugaauugagcu

SEQ ID NO: 4233661 - RNA, 59 nt, Human
gcauaguuuucauagguguuuuguaagaacugauugcucuccugugaguuaagcuaugu

SEQ ID NO: 4233662 - RNA, 73 nt, Human
gcgacaggguuggggccggcgcggaggaggggacuggccagucccuccgccagugcccgccccgagccggagc

SEQ ID NO: 4233663 - RNA, 58 nt, Human
ccuuuggaugucauucuuggcagaguuuguuacuguagcccagaagggcaagcaaagg

SEQ ID NO: 4233664 - RNA, 55 nt, Human
ucuacugagugcugagauuuuggcugaaauugcccggauccuucggccuagugga

SEQ ID NO: 4233665 - RNA, 126 nt, Human
uggcuagaaacgugcuaucuuucagugauaaagacgcucuaguuuccuccuggcauggugccugucagaggcuaucauccuagaaggaagcuaggaucacaggguuauuagcaacaucuuuggcca

SEQ ID NO: 4233666 - RNA, 77 nt, Human
gcacgaacgggaucuucuccgaguccugcagcagcugccagcggcggcccaggcgcuuggagaucucggcguugugc

SEQ ID NO: 4233667 - RNA, 85 nt, Human
cuaaucacaugcauuucuaaagcccuuugaaaaugugugucaugcuuauggguggccacauuccagagggcugaauaugugcuag

SEQ ID NO: 4233668 - RNA, 68 nt, Human
auuaucugacugaguagucugucucuuuuuugauagauuuucuuuuccaucuuuguggucagacuaau

SEQ ID NO: 4233669 - RNA, 66 nt, Human
aagcugcagcuuauggcuucuccaguagguggcagcacacacagagccacucauaaacugcagcuu

SEQ ID NO: 4233670 - RNA, 74 nt, Human
ucauguaguauuuaucuguauuguagaacuguugcucaaugguaauaauuaacagugaugggucuauugcaugg

SEQ ID NO: 4233671 - RNA, 70 nt, Human
uaugaauucucugaugaucaugcagguugguuuuuuuucggaaggcucucccacauucauuacauucaua

SEQ ID NO: 4233672 - RNA, 76 nt, Human
ggagcgggcucagcgggagucuggccgaacugcuugcugccacagugguuccgcggccucgcgcugagcgccaucc

SEQ ID NO: 4233673 - RNA, 78 nt, Human
ggcaaagguaacaugucagaaaauucagaggguugcauaccaauaauccuuuggaaacuggaugucuuacugggugcu

SEQ ID NO: 4233674 - RNA, 60 nt, Human
gucccagcaagauaagaccauguccagaaggaccaguggcaguaaagcuggaaaagugac

SEQ ID NO: 4233675 - RNA, 62 nt, Human
uacagauggacacuguuucaaggugcacuggcaugcacugucuaaaacgguuucaugcugua

SEQ ID NO: 4233676 - RNA, 82 nt, Human
gcguggguuuggugacuguaggaaaggauuugaggacgcuccuucuguucggcuuccuaugucaugagcacaggcuccacgc

SEQ ID NO: 4233677 - RNA, 130 nt, Human
cuaggccuuguguugccuuuuuuuuuuuuuuuuuuuucuuuucuuuucuucucuucccaugcacuauucuggagguuugccagguuuggggagacauggaguaaaagaaagauaggcaacucauggaugg

SEQ ID NO: 4233678 - RNA, 72 nt, Human
cugggagcuagauucaauaaagcuguucugaccaugaacuuggaacuggccccuuucauucuggaagcccag

SEQ ID NO: 4233679 - RNA, 79 nt, Human
agaaacuuacauucacuuuuuccugguccauuuugguuccuaagaauagauaggccauuaagaaggauauuagguuucu

SEQ ID NO: 4233680 - RNA, 109 nt, Human
uauuguccaacauuuggagggacucucagcugcuuuguuuugcuuuacguuuuguucuagagaaagaaggcaggagaguaggaggugguccuccaagggguugaugaua

SEQ ID NO: 4233681 - RNA, 88 nt, Human
aauggaaccccucacacugcugaggcccguguuacuguucauucagccagguggcauguaccucacagacuguugugcaguguccguu

SEQ ID NO: 4233682 - RNA, 56 nt, Human
ucggugcugcugcugaacccagcucugggggaccggcugguggcgggcagcacaga

SEQ ID NO: 4233683 - RNA, 64 nt, Human
ugcaauuggagacauuaagucuaagaguuuuccuucugcucuugcuguagcuguuucuucugca

SEQ ID NO: 4233684 - RNA, 62 nt, Human
gggcgcgccaggagcugcgcgggcgcugggagggagaccagggcgcaguuccgggcgcgucu

SEQ ID NO: 4233685 - RNA, 130 nt, Human
cuguuaggauugcuuggggagcuuucugcaauucugaugccuggguugcuucucagaccaaaaaucagaaucucagguaguggaaccaaggcaucagcuuuaaaaaaaacuccuuugguaguuccagugg

SEQ ID NO: 4233686 - RNA, 68 nt, Human
ucgcuugaaccugggaggcagagguugcaguuagccaaaauugcaccacugcaccccagucuggguga

SEQ ID NO: 4233687 - RNA, 65 nt, Human
guugcuucuuggcuuuuccaacccucugccaugcuugaacaucuuugugaaaguccaggaacaac

SEQ ID NO: 4233688 - RNA, 55 nt, Human
gcagaagugcuccucagaagaguuggaagaguuucagcucuccugaagcaucugu

SEQ ID NO: 4233689 - RNA, 84 nt, Human
agucucaaauagguacuacagguuugguagugggacacccucuguuccacuaucagaccuguagucuagcaucuacacuggacu

SEQ ID NO: 4233690 - RNA, 96 nt, Human
agucagaggaucacuugagcucgggaggucgaggcugcagugaaccaugguggcaccacugcacuccagcccgagcaacagagugagacccugucu

SEQ ID NO: 4233691 - RNA, 86 nt, Human
ugguaucuuucagaguacaaagugauuuuggaauugaaagaauuucuuuggguuaaaguuugucacugacuuguguuccugaacca

SEQ ID NO: 4233692 - RNA, 61 nt, Human
gguccuguccauuuucgugccuccuuuuaucaguaaagaggacagucaaauggccggugcc

SEQ ID NO: 4233693 - RNA, 102 nt, Human
uucugauucauaagcugcuuguuuguacuuucuaauguauuuagugcucuuuuguauugauguauaaaaagagugaaaugaaaaauagcaugugaauuggaa

SEQ ID NO: 4233694 - RNA, 64 nt, Human
agggaagggcacaggcuggcaggaucuggcuucaaauccaggaccuguccccuggcccacuccu

SEQ ID NO: 4233695 - RNA, 81 nt, Human
gucaagaccugcacuggguacauagaaacauuuuggcuugguuagacagucucuguuuccuguaccacagguuuuccugac

SEQ ID NO: 4233696 - RNA, 74 nt, Human
aggauaaucuaaaacuacgaauacuaccugacuccacaaggguacgguguauucuccaguuuuagcaucugccu

SEQ ID NO: 4233697 - RNA, 91 nt, Human
auacaucucuuucuuaaauuaauaucuuuacacauuuucaacuggcuccccaagucugauaaggaaggauuaaaagaaaaaagaaauguau

SEQ ID NO: 4233698 - RNA, 66 nt, Human
cgggcugcagggcuguggucuggagugcggacaguaccagcucccacugcuguccugccaugcuug

SEQ ID NO: 4233699 - RNA, 61 nt, Human
gucuucacuaccuacacugccgcucagcucccggcgcgaguggaggucgggguggggagac

SEQ ID NO: 4233700 - RNA, 89 nt, Human
ggauuuuagcuguaccagaggccuuuaugugcuacacauaauuuguauaaaauuuuauaugugcagauuggguacauaaacaguucucc

SEQ ID NO: 4233701 - RNA, 69 nt, Human
ucgugcacagucaacacuuauucaccaucaggcaauccaugguguagggaaacuugacuaauguaauga

SEQ ID NO: 4233702 - RNA, 84 nt, Human
uugaagaagaggguuagauuuuaagaaagaaagugugcuuauuucacucaugucuuugcagaauuuaacuuugcuuuacuuuaa

SEQ ID NO: 4233703 - RNA, 74 nt, Human
cauauuuuugugauaaguggauucaagggagaggaagaaagucagccuuggaucugcauaucagcuacaauaug

SEQ ID NO: 4233704 - RNA, 65 nt, Human
ggaggggaaggguguucaaugggugucgugcguuuaaacguaaccucuuugcccucuuuccuucc

SEQ ID NO: 4233705 - RNA, 57 nt, Human
cugggagggguagccaauccuagccaagaacuacguuaguguuggugcuuuucccag

SEQ ID NO: 4233706 - RNA, 67 nt, Human
uguccugaggaaaauggaguguaauuaagggugagcacccuuaauucuugagcugucuuuccagaua

SEQ ID NO: 4233707 - RNA, 73 nt, Human
gccugcugucuguauggaggaggugcuagcccgguccaccgggcugcugcccaccccugcaugccccaguugc

SEQ ID NO: 4233708 - RNA, 58 nt, Human
cgaguagagaugugguuucugagagcaaccgcaagcuaaagagucuccacuccacuug

SEQ ID NO: 4233709 - RNA, 58 nt, Human
aagguauaucuuuaaaagugaaugcaauuuuauuugcuuuuuauuugagacaugccuu

SEQ ID NO: 4233710 - RNA, 87 nt, Human
uaauauuccauuguauggguauaccacauuuuguuuaucugaucaucaguugauggccauuuggguguguccauauuuugacuauua

SEQ ID NO: 4233711 - RNA, 79 nt, Human
aaguguucuccugaggacccuuaggucagacagagaagcuuucucuuucugaugggaagggucaaaguggaaaucucuu

SEQ ID NO: 4233712 - RNA, 55 nt, Human
ugagggaagguugauaauguucuuuguuggggacuguuuauacaauuuuuuuuca

SEQ ID NO: 4233713 - RNA, 107 nt, Human
guggaugcagcgccggacgccacagccgaaaaacagaaucuuggaacugguuuaguacaauccaggucgaguuccuuguuuuuuauccgaguggccggcaggcccau

SEQ ID NO: 4233714 - RNA, 103 nt, Human
gaagucugacucuaaaguucauauucuugauauagauaguuaaucccugaauuuauuugggaaacucaucaguuuagaaaccuauggaccauagaaucggcuc

SEQ ID NO: 4233715 - RNA, 61 nt, Human
gauucucuccauguuuucuguccagccauaugugcuugugacaauacagcauggagacguc

SEQ ID NO: 4233716 - RNA, 130 nt, Human
uugagguagagucuugcucuugucgcucaggcaggagugcaguggcgcaaucucagcucaccacaaccucugccuccuggguucaagccacugcacuccagccuggcgacagagcaagacucccucucaa

SEQ ID NO: 4233717 - RNA, 110 nt, Human
uuuggaaggauaaaaugagauuggacagguauuaugaagccuauuuuacagauggaaaagcuacuacucauaaaucuuccugaaauuuguucaaguuagucuuuuccaaa

SEQ ID NO: 4233718 - RNA, 57 nt, Human
gcugcuacagagcuggaggggguaaagcaacaguauuuucucaguugugcgagcagc

SEQ ID NO: 4233719 - RNA, 104 nt, Human
ggcucugggggcugccugaugccuuaggucuuggagguggggcugggaacccaaauguuugaccugcucccccugcaagccuugucacuuaggaauugggagcc

SEQ ID NO: 4233720 - RNA, 71 nt, Human
caaagaaauuucauguauguuaguggcugcuuuaacuaaagcccuccaggguauacauucauuuuucuuug

SEQ ID NO: 4233721 - RNA, 61 nt, Human
gggagaguagcuggaagguucugggagaccaagagcuugauuaaagccuaacaacucuccu

SEQ ID NO: 4233722 - RNA, 100 nt, Human
agaggagaggagagggaagaggagaagagagcgaaucuggagaaggaaacagaacacgucuaguaccguucacucccuugccccucggcauccacccuuu

SEQ ID NO: 4233723 - RNA, 76 nt, Human
gucgacugcacucucuccuuagcugcagaccaugcacagugccuggggcggaaggaggagagguguugcgguuugc

SEQ ID NO: 4233724 - RNA, 58 nt, Human
aggguguuugggagcagaggauggagcaccaacuacuaguucugcucaguaacacccu

SEQ ID NO: 4233725 - RNA, 96 nt, Human
gaccuuugggccgacaggaccgagguggggcgggcagggcacgaggacagcacagagccuuuccccgacuccuccugguaccuaaccacaaguguc

SEQ ID NO: 4233726 - RNA, 58 nt, Human
cauugcuguuaauugucucuagguguguuauuuagauccuuuggagacugcagcaaug

SEQ ID NO: 4233727 - RNA, 98 nt, Human
aauauaugagcaaugugccagcacggugguuaagagagugggcuuuggcgcuucacugccuagggcuacugugccacuuacuauuugcuucacauauu

SEQ ID NO: 4233728 - RNA, 85 nt, Human
guccggucuuuggcaagguuaacaccacagcugggacaaauucgagguuugugccuguugguguagacauagcuacaagagggau

SEQ ID NO: 4233729 - RNA, 56 nt, Human
cagugguaaaugucguuccuguagguuacuccacagacagaacauaauuaguacug

SEQ ID NO: 4233730 - RNA, 101 nt, Human
cauguuggucaggcuggucucgaacuccugaccuugugauccaccuguuuuggccucccaaagugcugggauuacaggcgugagccagccugacccauaug

SEQ ID NO: 4233731 - RNA, 57 nt, Human
ccaaggcugcagccgugacgcgucuguaauuggaugcuucgcuguuccagcucuugg

SEQ ID NO: 4233732 - RNA, 69 nt, Human
gaauucugagaggacaagacaaggaccagagaaagcgcuauggaacuucuuuucuuuucuucucuuuuc

SEQ ID NO: 4233733 - RNA, 56 nt, Human
caguaguucucauaacucaugagguucucuugccucagggccuauauaaacugcug

SEQ ID NO: 4233734 - RNA, 62 nt, Human
aaggaaguuaguucuuggcaaaggcauuucaugcaguguacuuugucauucuaaccuuccuu

SEQ ID NO: 4233735 - RNA, 93 nt, Human
uguccucgccuguaaaguagauuguaugaggacuccaugaggucauccacuucaaguccuuggcauaggauaauuacucaaaaggugaugaca

SEQ ID NO: 4233736 - RNA, 66 nt, Human
uggcagucuuucccuugagcucugcaaaugcagcaaaguacugagcucaaagggaagauucagcca

SEQ ID NO: 4233737 - RNA, 86 nt, Human
agggaugagauggauuuuuuugccagucuaaagcagugaccagcugucaugagugacugucaaauaaaucguuuacaguauucccu

SEQ ID NO: 4233738 - RNA, 74 nt, Human
ggagccugguuugguucucauuguuuuucugggaaagaacggagaaacuaguuagauccaauucuccuugcccc

SEQ ID NO: 4233739 - RNA, 63 nt, Human
augggaggguagagugaacagaacuggguuuagaaccucacucuggcacuugccaguuucuau

SEQ ID NO: 4233740 - RNA, 60 nt, Human
agcaucggacggagcaccugcugcacagcaacaugaccagcggugacauccuucugugcu

SEQ ID NO: 4233741 - RNA, 60 nt, Human
gauuuucauuauagcuaguuucaaagugcuugaauugggauuaguuacuuagugagaguc

SEQ ID NO: 4233742 - RNA, 78 nt, Human
cuggaagcugaguaggaaugguagguuaugacaugucagcaucuaauauguauaccuucguuuaguacucauuuucag

SEQ ID NO: 4233743 - RNA, 126 nt, Human
cugauugcuguaacguuagagcaaauauacuccaguuucuaacuuuucuguucaauuuuccagguuacauuacugugaaaugaagugacuggauauuuugcuuacacagcuuugcucagcaaucag

SEQ ID NO: 4233744 - RNA, 65 nt, Human
gaaggcgguuccgguucgcggcgguucccggguuuugcguuccgcgcccggccggaaaccccuuc

SEQ ID NO: 4233745 - RNA, 59 nt, Human
ggcugugaaguacguugaagguggaucuugucacaugccccuucaguguucaccuggcc

SEQ ID NO: 4233746 - RNA, 73 nt, Human
gcuuccucaucuguucuucaaaauauuacauaaauuaauucauagauguaaagguuuuagagcagagauuggc

SEQ ID NO: 4233747 - RNA, 74 nt, Human
ggggagauaugugaaaaagacagcuuaagaagcuuuuagggcuaggcagucugcuuuuaucacaugucaucuuu

SEQ ID NO: 4233748 - RNA, 62 nt, Human
uuuucaguaugcugaaugauuuuucugaucauggauaaucagaaaaacaguaaugcugaaga

SEQ ID NO: 4233749 - RNA, 55 nt, Human
acucagaguuugcguuccauacgccguuccacggcucgaagcaacaguucugagu

SEQ ID NO: 4233750 - RNA, 57 nt, Human
uuucuuugcugguuggcucuccuccucuucuuuuuugggaguaaaacuagagagaaa

SEQ ID NO: 4233751 - RNA, 70 nt, Human
gggaucuaaagccagaauauauguuaaauugaaauguauccauuccauuauucaggcuuuggaauuuccc

SEQ ID NO: 4233752 - RNA, 60 nt, Human
gugcuggcaaagagaacaucuucacuggagugucuugggagaaaaauuucuuugcugcac

SEQ ID NO: 4233753 - RNA, 55 nt, Human
gugccuuuuucccaguucauuggugcagauaauugaguugacugggaaggaguau

SEQ ID NO: 4233754 - RNA, 57 nt, Human
cucagucugcuauagguauuuguuauucuuggauacuacacaccugcucagacugag

SEQ ID NO: 4233755 - RNA, 68 nt, Human
ugagauuuagaacuggauuucauccauuaaaaauugauugcucuggauaaagaacaguucuaauuuca

SEQ ID NO: 4233756 - RNA, 59 nt, Human
gagucaucucuagaaugaugauauuagauauuaaucauuauuuuauaaagagaagacuu

SEQ ID NO: 4233757 - RNA, 65 nt, Human
auuaauaacuuaaugacuguguacauagcaauguguguguauguauaugucugugagcuauuaau

SEQ ID NO: 4233758 - RNA, 66 nt, Human
aaacauaugccuucuuuuguaacuuauuguuguuucaaguuacaagaucuuugaaggcaaguguuu

SEQ ID NO: 4233759 - RNA, 60 nt, Human
gcagccccgcgaucuccuuguggccgugcucacaggcgcacaugagggccguggagccgu

SEQ ID NO: 4233760 - RNA, 91 nt, Human
aaaguauuagcccugaagagguagagaauuugagcccauuauacaaagacagccuuggcaccaucuucucucucaucaggaucaauauuuu

SEQ ID NO: 4233761 - RNA, 88 nt, Human
ucagccuuuuuacuauuaguauuucauuuuguugguuuguuuaaauaugcugaaaauguaaagaugaguuacaaaggaguaaagcuga

SEQ ID NO: 4233762 - RNA, 82 nt, Human
gcugucuggagucuugcuuugggagugcuacaccugugggagugccccaggcaccacccaaaggcggggcucuggcucaagc

SEQ ID NO: 4233763 - RNA, 58 nt, Human
uauuuuuacuguuugaugauucccugcuuaggaggguuucagugggaaagugagagug

SEQ ID NO: 4233764 - RNA, 99 nt, Human
gugcugguuguuaugagucugguuguuaagugcugguuguuaguuguuaaaguagagaaaaccccuagcacagugcuuggcacacacuaaagccaucau

SEQ ID NO: 4233765 - RNA, 88 nt, Human
cucccccggaacucgcgaauccccugucggaacaguggcucagacggcagccccuccccacuguuggcccgaaggggucuggguggag

SEQ ID NO: 4233766 - RNA, 72 nt, Human
guuuguuuucauuccaagaaguaguucugcauuuaucgagaucugggguucuuaauuuggaagaauacaugc

SEQ ID NO: 4233767 - RNA, 63 nt, Human
ccauuuuuaauucaacauuugcuuuuugaaaauccagaaguagacaguuggauauaauagugg

SEQ ID NO: 4233768 - RNA, 57 nt, Human
ccacuacauugagugcuuucucuggcuccuugcaaagaaagauacuuuuuguaaugg

SEQ ID NO: 4233769 - RNA, 92 nt, Human
uuuuauuuacuuuuuuaagagaggagaauguaaauuugucaguuuauuucugacuagggauauuuucuuuccauuuagaaaagaagaaaaaa

SEQ ID NO: 4233770 - RNA, 70 nt, Human
uugaaagcaacuucugcuuucuuccuugccacaaaccuguccugaggcaaggaagcagaguugcuaucag

SEQ ID NO: 4233771 - RNA, 72 nt, Human
aaguaacuggggagggagggugggaaucaaccuuuaaagauaauuauccuucuuuccuuaucccauuuacuu

SEQ ID NO: 4233772 - RNA, 64 nt, Human
ucaucuuucuuuauggaaauacaugguuuggagccccugguuuuguuucacaaagagagcguga

SEQ ID NO: 4233773 - RNA, 57 nt, Human
ccccccaaauguuacagugaccacaaagcaagguguucauaauaauuacaugggggg

SEQ ID NO: 4233774 - RNA, 66 nt, Human
caccgaacuuugcaaaugcaauuuuaaaaaucccucccccuauugcaaaauuugcagaguucgaug

SEQ ID NO: 4233775 - RNA, 76 nt, Human
agcuaggccuuucuuccagugaaacgugcaucccgagggcuucuaggaugaaguaguccacuggaaggcaccagcu

SEQ ID NO: 4233776 - RNA, 63 nt, Human
gucuccuucauuuacuguuuccuuccuaugauuuaggauuuagaagcugcuaugaagggggac

SEQ ID NO: 4233777 - RNA, 55 nt, Human
guaauugagauuucuggcugcuuuuugggaagaagcaacagacuucaucagauau

SEQ ID NO: 4233778 - RNA, 65 nt, Human
cguggcaguagagcuggaacuugaaucuggaauuaucuggcuagugaucuagcucuucuuccaug

SEQ ID NO: 4233779 - RNA, 73 nt, Human
gggcaccccaggauugaagggaaccucagaaucaugucacugccauucuagaguuucaauccaaggggucccc

SEQ ID NO: 4233780 - RNA, 66 nt, Human
uggcagaaugaagacuggggccucaggguuucccccaucuuuccaccuuucccacuucauuuucca

SEQ ID NO: 4233781 - RNA, 92 nt, Human
uggcuguauuuuggauaugaagucuguucuacagcaccagaaagcaagugggcugucugcuguugaucaugacuagcagucuaaagcaguua

SEQ ID NO: 4233782 - RNA, 65 nt, Human
ucucauaaaggugccacucaguuuuagccaugucuucacugaaauugcaaaaguacuuuuaggga

SEQ ID NO: 4233783 - RNA, 117 nt, Human
gccugugacucuccuccugucaccaacccacuaugauuguccucaugguugaauaggaagcuuaugaggccacaguuauagauuuaguuucugggaaggcuggauagaguuccaggu

SEQ ID NO: 4233784 - RNA, 77 nt, Human
agcagucggccaagaucugaccgugauggcggcccuuggcuugggcuuccucaccucaaauuuccggagacacagcu

SEQ ID NO: 4233785 - RNA, 79 nt, Human
uaguucagacauucuagacuguuccgucagacucaguuucaaaagagaaugugugggagaacagucuuuguccgacuua

SEQ ID NO: 4233786 - RNA, 57 nt, Human
aaggcagagggaaaacgggaaugguuuuuaagacuacccuuucgagauuucugccuu

SEQ ID NO: 4233787 - RNA, 60 nt, Human
cggcgcugguacaguggaagagggcuguccagcccuggaugucuuucauuucuagcucug

SEQ ID NO: 4233788 - RNA, 62 nt, Human
gauaaaucccaguugacagaacuguuuaagagaugaaugugcucccaacugggauuacgguc

SEQ ID NO: 4233789 - RNA, 127 nt, Human
uuguacuacgaacucccuaugcauuucuguuuuuuuaaaugagggauccugaauacuagggagccuuugggaaauuugaaaauaaaaguuacaugaucaguguauuuuagggggacuaauauggcaa

SEQ ID NO: 4233790 - RNA, 73 nt, Human
ucaugaauucuuuguuccucugccaagcgcaacagggauaaguagccuugcucugggaauaugaguuugauga

SEQ ID NO: 4233791 - RNA, 66 nt, Human
ggccauaggggcuuacauaguuauuaaaauugcaucauaaauuuggcucugagcuuccugguggcc

SEQ ID NO: 4233792 - RNA, 114 nt, Human
gcaguucaugcuucccaagggaacccuggugguaggggugguuucugaugggucuagcuagugagagcuccacaccuugcccuuucccuggagaggcaaagaugcacacacugc

SEQ ID NO: 4233793 - RNA, 123 nt, Human
ucucuaucgaugaaacugcuuucucaaauacgucagcaaugggauucaggcuuugcuuacaaugugaaggaaguucuuagucucauuugcacaaagaaggaaggagggcuaaagauaaaaaga

SEQ ID NO: 4233794 - RNA, 70 nt, Human
gguggugagaaguaggaauucaaagagacaaaaucauacuuucucuccucgaaauucuuauaaagcuacc

SEQ ID NO: 4233795 - RNA, 87 nt, Human
gauauguuucuacuagugguugauggccucuuucagcuccaucgcuauggaggcgagguucaucaauaacucagagaaacuuguguc

SEQ ID NO: 4233796 - RNA, 65 nt, Human
gaaaaucaggauggaugugaggcaucuuucugugaagaaaagcaucccagaagauucugauuuuc

SEQ ID NO: 4233797 - RNA, 65 nt, Human
acagacaaauccuuaugagacuguacaucccuagaggcuaggaaucagaucuuauguuuuucugu

SEQ ID NO: 4233798 - RNA, 58 nt, Human
gaaucaggaagggaaaauaguucggggaaugcccccacuguuuucuucauccuagguc

SEQ ID NO: 4233799 - RNA, 80 nt, Human
gaggggcggagguaggggccagaaagacuuagaagaugucccauauguuuaaugucuuuggccuuuaauucugauuucuc

SEQ ID NO: 4233800 - RNA, 64 nt, Human
ggacuggaggagcggugcaugugggggcugaggcacagccugcacucaaacacucucuucuucc

SEQ ID NO: 4233801 - RNA, 68 nt, Human
cuuagcaggguuacgaugauuucauguguuuuucagaagacacugguucucuuaacccuauuguggag

SEQ ID NO: 4233802 - RNA, 67 nt, Human
aaugcucucugcuuuucuuccaacagaguuggcaagugauucugcaggagguacuguagcuggcguu

SEQ ID NO: 4233803 - RNA, 71 nt, Human
uaaaauuagaugcugugauuuuucaaaagauauuuuuuaauggcuuuguugaauggcaggauuuuauuuua

SEQ ID NO: 4233804 - RNA, 80 nt, Human
gaggauacagaagguagaugcaucaggaggaggggcaggugccuuuaaucauuaccucuagaauuaucacuuuuaaccuc

SEQ ID NO: 4233805 - RNA, 79 nt, Human
ucaacacaucaaacuuacuaagauuuccaguaaaugacuauuagaauacacaggaaguucuuauguucugaugugcgga

SEQ ID NO: 4233806 - RNA, 63 nt, Human
caggaccaggagauuugagcuaggcuugggaccuucucuuugcugggucucucccugguccug

SEQ ID NO: 4233807 - RNA, 87 nt, Human
cuggagucauacacaacuugguuugaaacauacucuacgacaaaacuguugugugguguuaagcaaauuaaugucucugaauuccag

SEQ ID NO: 4233808 - RNA, 65 nt, Human
uugcucucugcuuagacaggcuuuaagaccaauuggauuuucauggaggccaggacagagagugg

SEQ ID NO: 4233809 - RNA, 129 nt, Human
uuuuauccuagcuggauugugaacauuuuauuuacuuugaggaaguuguuuaacacuuuuuguagauugcaucaauauuuagaguaauguaaauacauuuucccuuuggcuauuuuacaaggacaugga

SEQ ID NO: 4233810 - RNA, 86 nt, Human
ggcuucuggauggcgccauuuuugccuucggaguguugcuuccaaagcugguccucuggcaacgauggugcuuauucaagggaguc

SEQ ID NO: 4233811 - RNA, 130 nt, Human
gaugcugaugguguacggugagauauugugaacgcaacaacuggagcuguaguuggcgugugugaguguguaccugcgguucuguuuaguggcgagacaagguauguuucaguacugcuuucacggcaac

SEQ ID NO: 4233812 - RNA, 59 nt, Human
cuacauaaauuuaucacagacuacuggcauugagauguacuagucugagugaaauguag

SEQ ID NO: 4233813 - RNA, 129 nt, Human
cuaagacugcacauguguuuugcagacuuucuuccugaccauuugccacaugggucucugauaagauucuguugguuuaauagucaaaauaaucuuugcaguuugugagcacugaguagcagguucugg

SEQ ID NO: 4233814 - RNA, 94 nt, Human
gucuaagaguguggcugaugagcugcuguuauucaucagaacugggaaacagugaauauccauucugugcuaacugcaggccaggcuccgagac

SEQ ID NO: 4233815 - RNA, 73 nt, Human
uugggauuggugggguggguuuagguaauuguuuaguuuaugauugcagauaaacucaugccagagaacuuaa

SEQ ID NO: 4233816 - RNA, 62 nt, Human
uccauguagggagggcuuucaaugcugcaaacauguucucuggaagucuucucucccaugga

SEQ ID NO: 4233817 - RNA, 90 nt, Human
gugguuauguucauaucauuuugaaagcugaguggauagauuuaaauagcaagagcuuuguucggaaugauguguggaacccagaaucac

SEQ ID NO: 4233818 - RNA, 57 nt, Human
cuaaaaggaagaguuuucagagacacaaaaaagugcuuugaaaaugcuuucuuccag

SEQ ID NO: 4233819 - RNA, 64 nt, Human
guagaaaauagauugucucuugcucuuuuaagagaagguaugggagagaaauuuaaguuuuuac

SEQ ID NO: 4233820 - RNA, 70 nt, Human
cuuggcugugcuucuuugggggugaagagauuggggaggaagucuccaccccugggaggcagaagccagg

SEQ ID NO: 4233821 - RNA, 96 nt, Human
cgggucccagacaggaauagaugguguccagaaagagaaugguugggaaaugauucugaaggcaggggcuaucuuucuguuugugguguuggccug

SEQ ID NO: 4233822 - RNA, 130 nt, Human
gucccaugaggcuauugugacuauuagauuuaguaauagcuguaaaguguguuuugucauguuuagcacgcacuuuaugcuuuuaacaaaugcuacuuucacuucuuucccuuugaauaguccguuggau

SEQ ID NO: 4233823 - RNA, 56 nt, Human
ugaugggaggugcugcaggaccaccacugcgguaagguuucugcaaaccuuguaca

SEQ ID NO: 4233824 - RNA, 56 nt, Human
uuaauguuuuagaaugagaguguauguauguauuacucaugugacuaaaacauuaa

SEQ ID NO: 4233825 - RNA, 129 nt, Human
cugauuuuggcgucucacccucccuccucccguaauugacaugccugcugucaggaacucuugaggcccucggagagcaguuagggaccgcaggcugccgcggggcaggggugcaguggguguuaccag

SEQ ID NO: 4233826 - RNA, 69 nt, Human
ugcagcaugguggagcugcucuuuaaauaccgaaaugcacaugcuuaaagacuagaagccguggcugca

SEQ ID NO: 4233827 - RNA, 59 nt, Human
uggaauuaucugaagugauuugaugacuuuucacauuaguuuucauuucaguaaaucca

SEQ ID NO: 4233828 - RNA, 63 nt, Human
cacuauguacauaauagcugcuuuguguucagaauaguagcaguugcuuuguauauuaaagug

SEQ ID NO: 4233829 - RNA, 72 nt, Human
gucugcugcuucugcugcccccuccuccucaaagcagcccgcugcugacacagaggcaucagagcagcaggc

SEQ ID NO: 4233830 - RNA, 81 nt, Human
uuaucuaacagucauucauagaaucaguuugggaaggggaauuuucacugaacucucauagagaaacuguguuuuagauaa

SEQ ID NO: 4233831 - RNA, 123 nt, Human
aaaacauucugcugcauagguuuaugaguuuaauauuaagauauugaguggcaucuaaguaauagauuugagauuauuuaagaucuuaauauauaguaugaauuuacugaguaguaauguuuu

SEQ ID NO: 4233832 - RNA, 69 nt, Human
uccauaggggcacuuuuagccuucccacaacaguuaagcacucuuugacugcugaaggaaccccaugga

SEQ ID NO: 4233833 - RNA, 75 nt, Human
gguugagggggaggaggcuggagaggccaggagagggccagcucuccaccugucccugcuuccugccuguccucu

SEQ ID NO: 4233834 - RNA, 57 nt, Human
uuggcaggcugcauguuuaugugaaccuucagaaaacauggaaacacgcagccccaa

SEQ ID NO: 4233835 - RNA, 97 nt, Human
aguuaccagccgcugacuuuugucucagugagaauaauaauaggcauggugcuaccuggcaccaucugaauauucuccaagagucaguaaugggacu

SEQ ID NO: 4233836 - RNA, 102 nt, Human
ggggauccugauggugcaauaaaguuguagaaccaccucacuaagugcucccaauuccuuuuacaauucucuauuauugcaauuuaauccuuucacuucccc

SEQ ID NO: 4233837 - RNA, 59 nt, Human
ucuguagucuuggagccgcacaggguuggugguacccucgagcacaccagacuugcaga

SEQ ID NO: 4233838 - RNA, 56 nt, Human
ccucggacuugggugggcuccuuucucuuaagcgagggcccaccuuggugcugagg

SEQ ID NO: 4233839 - RNA, 64 nt, Human
guaauaggagggagucugcuuugaguaauccagugccuucugaaaguuucucccuaauuguugc

SEQ ID NO: 4233840 - RNA, 74 nt, Human
uaauaugaugaauggaacauagcaacaucuuaguugauuccggccaaguguucucuguuuuaucuacuauguua

SEQ ID NO: 4233841 - RNA, 65 nt, Human
ggcaguggaaggugcugaaacagaaauuuuaauuaaaaacuuuaucaaguacucuucacagugcu

SEQ ID NO: 4233842 - RNA, 80 nt, Human
uuuuauuucaggcauuuguaaaugcccauuaauaaaguaugguucauaaauuuuaccuuguaagugccuaagaaaugaga

SEQ ID NO: 4233843 - RNA, 86 nt, Human
uuugauaccgaaaaagaagugcaccauguuuguuucgucacauauaaagcgaaaauaacaugggcaacuucuuuucagguaccaga

SEQ ID NO: 4233844 - RNA, 56 nt, Human
aguguucaauuugagcucaaaggcaucugcaaguaauugaggagauauugaauacu

SEQ ID NO: 4233845 - RNA, 84 nt, Human
aggaaccuggaauuguugaaccaggauaaacauagaacaucuuuuaggguuucgucauuguuguugguuuuccauucuaguccu

SEQ ID NO: 4233846 - RNA, 57 nt, Human
cagccuggccucuggauauuugguggaaauauauucuaaauugaacaagccaggcug

SEQ ID NO: 4233847 - RNA, 75 nt, Human
uucauggauuugugaaauuuagaaacagccuaauaaaaauucuaggacaacugaguugucacaacgucacaagag

SEQ ID NO: 4233848 - RNA, 73 nt, Human
gucacgaaugacaugugauuugaaaccacaauuuacuaccguaauaaaguuucuaaaauuacugcagucggac

SEQ ID NO: 4233849 - RNA, 72 nt, Human
agacaacagaacuccugggauuuuucuuuaaccauuuuuuaucauggaaacauuuccggccuuuuguucucu

SEQ ID NO: 4233850 - RNA, 69 nt, Human
guagaguuggccauuacugagccuggagacccaugcuaacuuuccagcaaagguaguguguuacuguac

SEQ ID NO: 4233851 - RNA, 67 nt, Human
uguuguuguuguuguuguuguuguuacaaagaaacaaauuuugagcagcaaugacaauucaaccaua

SEQ ID NO: 4233852 - RNA, 57 nt, Human
uuccagguggcuuuccugggggagugccugguaauuuucccagaggaaugccuggaa

SEQ ID NO: 4233853 - RNA, 60 nt, Human
uggaggaucuuuagcgggacugcuccucgguuaccugaguuaucuaaugaaguucuucca

SEQ ID NO: 4233854 - RNA, 61 nt, Human
ggagacagugacuuagagacugaggcaagagugccguggucaaucaugggucauugucuuc

SEQ ID NO: 4233855 - RNA, 61 nt, Human
aagguguaaguagcugguucauuagcuuaggauaagaacugaacauuuuugcuugcagcuu

SEQ ID NO: 4233856 - RNA, 82 nt, Human
guccguuuucauuguuaguuucuccuuaaacacgauuggcugaacaugcgggaacaaggaaaaccugacugaagaacgaggc

SEQ ID NO: 4233857 - RNA, 64 nt, Human
gcaguaaggaggggaaggguuuucugccacgucuguggucucuucauucuucucuuccugcugu

SEQ ID NO: 4233858 - RNA, 72 nt, Human
gucuuuucugaacaguagcuccauaauaaagagaagucaaucacuauuagagaagcacuguaggugaaaggc

SEQ ID NO: 4233859 - RNA, 66 nt, Human
cagcgcugccuaguuucagagcccccgauggccucacaugggguuuuagagcaggcagagaagcug

SEQ ID NO: 4233860 - RNA, 55 nt, Human
cugcgcagaucugcuguucucuggaaccuaaacugggaacccuagacuugcgcag

SEQ ID NO: 4233861 - RNA, 83 nt, Human
aaucuuagcagugucacuaguaauagucuuacaaaguaggcagguuuuuuuaggcuaagugauuagugacauaguuaaugauu

SEQ ID NO: 4233862 - RNA, 64 nt, Human
ggagaggaaguuuaaagaauugucuauaauagaguuugauuuccuccucuuuuacuuucucucc

SEQ ID NO: 4233863 - RNA, 71 nt, Human
gcaggagagggggcuccugcaggcccccagcccgccaugggguggugcagacaggagccccgcucugcugc

SEQ ID NO: 4233864 - RNA, 91 nt, Human
ccugcucccgccccagcagcacacugugguuuguacggcacuguggccacguccaaaccacacugugguguuagagcgagggugggggagg

SEQ ID NO: 4233865 - RNA, 77 nt, Human
ggaguaggaugugauacuccuucuaguggaaauaccagucaaauguccgugggucuugaagugucacugcauacucc

SEQ ID NO: 4233866 - RNA, 56 nt, Human
cauaagaauauuuaguggcagcugcaggcugaugauuuuccacuagauagguugug

SEQ ID NO: 4233867 - RNA, 76 nt, Human
uagguggaaccauaugaaauuuccaucuccgcaggucacaaagaccaaauaucugaaauuucauauggccaaccua

SEQ ID NO: 4233868 - RNA, 99 nt, Human
gaggcaggagaaucgcuugaacccaggaaguggagguugcaguuagcugagaucgcaccacuauacuccagccugggugacagagcgaaacccugucuc

SEQ ID NO: 4233869 - RNA, 82 nt, Human
uuugacuuuugaugugugaauucuuaaaugugcacaaaccaaagacaauggcauauauacuuugacacauucugaaguuaaa

SEQ ID NO: 4233870 - RNA, 104 nt, Human
ugaacuuaguaauaccuacacuacaguuugugccaggauuuaauaagauaguguuugugaaaagcaccuuguucagaucuuacacacuguaugugcugaguaca

SEQ ID NO: 4233871 - RNA, 78 nt, Human
cugaggccuuggggauugggugcaagggacaggcagcccaccugcacguugcuggggcugaguccccaggaguucuag

SEQ ID NO: 4233872 - RNA, 74 nt, Human
ucauagaguuuacaacaucuuguccuucaauugcagucagucucugucuugaacuggauuugugagcuccuuga

SEQ ID NO: 4233873 - RNA, 63 nt, Human
acaaucuuauuaguaguauagauccaggugccuucuggggacugucaucucuaaaaagauugu

SEQ ID NO: 4233874 - RNA, 60 nt, Human
gccaguggaugucucauagugugaugagccucugucaccuguuggauguauacugucagc

SEQ ID NO: 4233875 - RNA, 75 nt, Human
gcugcgauccucucugugacagggaacggcucgggaaacgcuuggcgcguucccuccugccacgggaggagcagc

SEQ ID NO: 4233876 - RNA, 68 nt, Human
gacccaggucagcacuuggaggugcaagggagguccccgaugcgccuccugcugccugcccugagguc

SEQ ID NO: 4233877 - RNA, 77 nt, Human
auuugcuuacugguaguggagguuacagcuguacaugaagcauguacugacuguacuuuuaaauugguuugucaagu

SEQ ID NO: 4233878 - RNA, 60 nt, Human
uguucaccaggggcuccaggugagccuggccucccaggcuccccaggaggcccuuggaca

SEQ ID NO: 4233879 - RNA, 81 nt, Human
uacuagcuauucuaaagcugaccugauugcuuuucaguguuuugacccugcagagaccuaggucagguuuaguagcuugug

SEQ ID NO: 4233880 - RNA, 57 nt, Human
aguaagucguuugucaauuuugauguguccaaugcauuacuuugauaagcgucuucu

SEQ ID NO: 4233881 - RNA, 78 nt, Human
acuuuggugucucagauuguaaaaugugugcucuaucuagagugucaagaugaacauuuuaccaucuguggaugaagu

SEQ ID NO: 4233882 - RNA, 60 nt, Human
agaaucucuagaaaugggucucagggaucuguauuucaaaggcauuuucuuggagauucu

SEQ ID NO: 4233883 - RNA, 59 nt, Human
cugagcaacacauugaaugaggauucuguucguaauucuuauaaaaaguguugacuugg

SEQ ID NO: 4233884 - RNA, 55 nt, Human
agccauggagauguggguugggcagucagagcccagcgcugcauccaccauggcu

SEQ ID NO: 4233885 - RNA, 59 nt, Human
guaacucgaugcaauucacuuuguggaaccaagccacaaagugaaaagcaucgaauugc

SEQ ID NO: 4233886 - RNA, 55 nt, Human
gagcagccugaggauucugcuccuucuuuucuccaggggcagggcucagcugcuc

SEQ ID NO: 4233887 - RNA, 61 nt, Human
ggaccucgguguugggaacguggucuuccugguagacacuucccuucucugcucauggucc

SEQ ID NO: 4233888 - RNA, 76 nt, Human
acucugcuuuggaucucucucugccucugcugauucuaccaacuuaaagugugguugggauuauccaaggcagagu

SEQ ID NO: 4233889 - RNA, 90 nt, Human
guguguuggggauucuuuguauuguuuauuucauuuugguuuauuuuaaaagauguaaacauauauuaagcuauauuaaaucucacauac

SEQ ID NO: 4233890 - RNA, 66 nt, Human
ggaggggaguuugccucuggggucccuucugggacucccaccugcuaagauguaucccuccucucc

SEQ ID NO: 4233891 - RNA, 71 nt, Human
gauuacguuugaguacagcugccuuuuuguacccaucauauaacccaaaggcaaugucucgauugguaguu

SEQ ID NO: 4233892 - RNA, 65 nt, Human
uuuuggcaaaagauuggguacuuaguuuccuguuacugaguuagcucuauucuuuuggaccaaag

SEQ ID NO: 4233893 - RNA, 75 nt, Human
guucuacauuguauugcguuugcgaaugugcgugaacacacgcacacgugcaggagaauguagugccauaagaac

SEQ ID NO: 4233894 - RNA, 58 nt, Human
cccuaauuuuagacccacuccuaaaaacucacucuugggagcuauguuuggaaugggg

SEQ ID NO: 4233895 - RNA, 83 nt, Human
gucguauaaacgugauaaaugaaugcuacccugcuggcucuccgagagaguguaauuaguauuuauaucaaaauuuaugaaac

SEQ ID NO: 4233896 - RNA, 65 nt, Human
uuggaggaagucuuaucuggaugcaggaggacagaccuuguguuucaguaugauuuucccuccga

SEQ ID NO: 4233897 - RNA, 83 nt, Human
ggcuccgcagcauggguguaaucacaagcuggaauuagcucuuagcaugauuaaaggucuugauuauaagcccauccagagcc

SEQ ID NO: 4233898 - RNA, 75 nt, Human
aaagauuuagauguucccucuacccugggagcuuaugagauaacacuugcaggguugaugaauugucuguacuuu

SEQ ID NO: 4233899 - RNA, 85 nt, Human
gaccugcauggcagaugagcagagcacuugggaacgagcauaggaagugccaucuucccgggcaucucugcucaguguuaagguc

SEQ ID NO: 4233900 - RNA, 67 nt, Human
ggccugguuagguccauuggcugugguuugcugaccccuagcaugugccuaguggauuugaagggcc

SEQ ID NO: 4233901 - RNA, 56 nt, Human
gcucccagcuuuuguccacggccagcaggaugggcugucguguauauagcuggggc

SEQ ID NO: 4233902 - RNA, 70 nt, Human
ugcacuuacuuuuaaggggccuugauuuaggagucugguauuaccuaaaugcucuuuaaaagugcuugca

SEQ ID NO: 4233903 - RNA, 130 nt, Human
ccggagagacgucgcgcuguggccugaaguggcgcaagcuugcuuuguaaauaucuguggucccgauguagugcccagaacguuugugcgaggcagcucugcgcccggguuccagcccgagccucgccgg

SEQ ID NO: 4233904 - RNA, 58 nt, Human
ucccuuuuuaauugugucccugucagccaacauucuuccagagacaagagggaaggga

SEQ ID NO: 4233905 - RNA, 91 nt, Human
uuuagggcgcuguguuaggugcuguauuguacaagaaaaauauaauaaauuagauucccagcgcuauucugacauagugaaugaccuugaa

SEQ ID NO: 4233906 - RNA, 56 nt, Human
gaggcgaggggcugcggcgagucuggcagaggcggugcccggauaccccuggccuc

SEQ ID NO: 4233907 - RNA, 58 nt, Human
gcccugggccccgaacugcugaggcuccaugagguccagcugugccuggcccaggagc

SEQ ID NO: 4233908 - RNA, 67 nt, Human
uggugcagcgguaaggagagccugaagggggcagugucacccccuggcucuggcuuccuguugucca

SEQ ID NO: 4233909 - RNA, 59 nt, Human
ggagguaagaggcccugggccgaggugcagugacccugcaggccagcccuccaaccucc

SEQ ID NO: 4233910 - RNA, 86 nt, Human
gaaucaggauccaaagacucacuucuuucucguauucuacuugcagauguuaaugcuaaagaagaaggaguagaggaagucuguuu

SEQ ID NO: 4233911 - RNA, 79 nt, Human
ggcaggcuccccaccgugaggccaagccuccucugccacugccagcauggcccaagggaggcuuggccuugggcuugcc

SEQ ID NO: 4233912 - RNA, 70 nt, Human
gcggcuuccucagcugcugguguaucggguccuaguucggcuggcggcccggguccccagcagcagccgc

SEQ ID NO: 4233913 - RNA, 68 nt, Human
agcaucucccuuuuagccccgcccuccuccaaaggacggaggaggcguuugcuaaacgggcguuugcu

SEQ ID NO: 4233914 - RNA, 57 nt, Human
gguucuggaaaagaaagcaaaggaucaaucacuguugacuuugugguuuucagaacu

SEQ ID NO: 4233915 - RNA, 65 nt, Human
ucuccuuuggggccucaggguuccccuuuacccucuaugggagagcucugauccuuuaaaggaga

SEQ ID NO: 4233916 - RNA, 77 nt, Human
uuuauuuauaaacucucugcugcugagcuuggggccuggagccccaggaaugagcaggcaggggagacugagaugga

SEQ ID NO: 4233917 - RNA, 58 nt, Human
auugcauucaugcuccccuuagauccaagagugcccaggacuaggagcagaaagcagu

SEQ ID NO: 4233918 - RNA, 55 nt, Human
gacaaauggggaauagaugauggggccugaggccacauaguuuaucuucauuuuc

SEQ ID NO: 4233919 - RNA, 55 nt, Human
gcagggcuugaaucaaggaagucuugauaagggacuucacacucucaaccacugc

SEQ ID NO: 4233920 - RNA, 112 nt, Human
ccuuucuuucuagaaaaggcaguagcuaaaaggggauuuaagguaagaagaaggguuuuguuuuguuuuguuuagguuuguuuuuaaaauacugcuguuuuuguuggagagg

SEQ ID NO: 4233921 - RNA, 93 nt, Human
cccucuauuaaaguaaacgccuugagccuugccugaauuuaucugaaugguggaacagaaaucauuuagggcucuauucuaauggauucuggg

SEQ ID NO: 4233922 - RNA, 96 nt, Human
ugcucauucuggagcaugaaaagaggcagaggaaacagcucauugcuuucuaguaaacugcuuucucugccuuucccacuaugacacagaaagaca

SEQ ID NO: 4233923 - RNA, 65 nt, Human
auagauuuuaucagauuuuaucugugguuaaaauucaugagccaugaaucuggucaaaugucuau

SEQ ID NO: 4233924 - RNA, 68 nt, Human
caaacauagcccuuucuuguuuaacugcauuuuguucaauguuuuaagcucuagaaggggaaucuuug

SEQ ID NO: 4233925 - RNA, 71 nt, Human
guaggauugguguauguagguuuaaaauuauagugaugacuagucgaacuuaauauacaaucaguucuugc

SEQ ID NO: 4233926 - RNA, 63 nt, Human
ggaggggcaagaaguuggccucucgguugacauuccagagaaauggccagacuugccccuacc

SEQ ID NO: 4233927 - RNA, 55 nt, Human
ggcacaggcugguaccaguucacuacagguaauguuggaucaccauccuguugcu

SEQ ID NO: 4233928 - RNA, 82 nt, Human
uccugguacauaguugcugucauuauuugaggguuagucccuccuauugaucaguacuauuugaaaugcgugcuuucaagga

SEQ ID NO: 4233929 - RNA, 56 nt, Human
gcaguuacugucuuuuccuaaauggguacacacuuguguaccaggggcagcacugc

SEQ ID NO: 4233930 - RNA, 58 nt, Human
gcccaggcuggagugcaguggugcgauguccgcucacugcaagcuccacccuccgggu

SEQ ID NO: 4233931 - RNA, 57 nt, Human
uccacuaucugagcuuaguugcagaaacucuaguggccacuaagccccaguaaugga

SEQ ID NO: 4233932 - RNA, 111 nt, Human
ccgaccgcggucagugccugaggcuggggaacgcgcuggcccgcgccgaccgccucccgguggcccugggcgcguucugugucgcccugcggcucgaggcgcugcggccgg

SEQ ID NO: 4233933 - RNA, 116 nt, Human
caaguuuuucagugaugcauguuaacaguuagguccuaaaauucuguggugcuaauucucccauacccaauggugcuuuuguggaugcuaacugcacacaugcugaacaaagcuug

SEQ ID NO: 4233934 - RNA, 66 nt, Human
gugucuggcuucccucuguucugggccggcuccgaaacgcgcucaagagaaaucggaaucagacac

SEQ ID NO: 4233935 - RNA, 89 nt, Human
auucccaccuuaguuugggguguuuugaagagguucagagacuaaaucuuaaaccuuauuugaauaccaacgauagcuauuuugggaau

SEQ ID NO: 4233936 - RNA, 106 nt, Human
ccaacuucagugggccucuucuucgauaggggagcagccagagaagaagcugguguugcuagccagagcucguuucuuuuucuucccuggaggcuuauuuuguugg

SEQ ID NO: 4233937 - RNA, 71 nt, Human
auaaaguaaugcauauaaugugcuuagaacaggaugguauguagguuacagugcauuguacaaugcuuuau

SEQ ID NO: 4233938 - RNA, 64 nt, Human
ggacugggagaauggaggcaagaaaagggcauaguuugacucccucugugucucuucccaguuc

SEQ ID NO: 4233939 - RNA, 56 nt, Human
uuuaucugugcuuuacugacagaagggcaagucuucucucguuuuuugcagauaaa

SEQ ID NO: 4233940 - RNA, 78 nt, Human
uauacauauauauguauauauguguguguauguauggacauagguauguauaugcacauguacauguauauauguaua

SEQ ID NO: 4233941 - RNA, 78 nt, Human
aggagggaaaagaagcaagagggaucaggaucuguguccgauagcagagccggagucuucuuguuugcuuucuuucuu

SEQ ID NO: 4233942 - RNA, 106 nt, Human
uaauagcuuaaacguguacaaaaguucuugguuaauuagggaaauaaacacucaguucuuuauauuuuuuaaucaaguaggaaacacaguucauauaauguuauua

SEQ ID NO: 4233943 - RNA, 70 nt, Human
ccagaaaaaaaugcagacuagcaggaaacagaacuuuccuuauguuguuuguuuuguauuuuuaauuugg

SEQ ID NO: 4233944 - RNA, 70 nt, Human
cauuauaguuuugcccuuaagaaguaaugauuaacuuaugaaaaaauuauuuggggacaggagugugaug

SEQ ID NO: 4233945 - RNA, 83 nt, Human
uggcuaagccuaggaaaagauauauaaggaaguucaguuuauguuacaaugacuggauuuugugguguaucuucuauuagcca

SEQ ID NO: 4233946 - RNA, 105 nt, Human
aggaagaguuuuuuuggccucucuggaaagauuuacacggggaaagaauguucucuuccucauuuuguuaauuuuacaucagcaaccagaaugaaucucuccccu

SEQ ID NO: 4233947 - RNA, 81 nt, Human
auauuuaauggaaucaugagguguuucuuugcagucauccucugacuucaggacacauuauuuaugaauucugucaaaugu

SEQ ID NO: 4233948 - RNA, 71 nt, Human
gcuaucuacuuacacugaagcaaagauacauaaagaaauaugucucuacugcuucugugagugagucuugc

SEQ ID NO: 4233949 - RNA, 71 nt, Human
gggaacguggaggggagagaggaaccugcaggcuccuagagccucaggguuuuguugacacugcgauugcc

SEQ ID NO: 4233950 - RNA, 101 nt, Human
ucuccauaucugauuucagauaacuuagaacagccuaugggaaguagucaugcaucucagguuuguucugagacaccugaugaccuguuagaugaugguga

SEQ ID NO: 4233951 - RNA, 57 nt, Human
uauagaguucucuuuggaggaguggaaaugccugaacccugcacagagggcuuuaua

SEQ ID NO: 4233952 - RNA, 77 nt, Human
ucgcuugaacccaggaaguggagguugcaaugagcugagaucucaccauuacacuccagccugggcaacaagaguga

SEQ ID NO: 4233953 - RNA, 82 nt, Human
cuuggucccagaaugcugaaugcauguuuccauggaaaucuuuuaaaacguguagugugcuguucaguguuacgggagcagg

SEQ ID NO: 4233954 - RNA, 59 nt, Human
gaggucagugugggggcaaggguagcguggagcuaggcauuucucccacaaugacccuc

SEQ ID NO: 4233955 - RNA, 88 nt, Human
uuacuuaccuuuuacuaauuaguuuuggaacagugaaccacaucaaucaaaucuguccacuugaccagaaaaguuaguaauuuaguaa

SEQ ID NO: 4233956 - RNA, 61 nt, Human
ucccagaaccuuuuagcuucacugcuuaaaaaguggacgauggagcagggaggauuugggg

SEQ ID NO: 4233957 - RNA, 56 nt, Human
ggugccccaucgcggguggcuggcucaaggagguggacgccgacuuuggaggcgcu

SEQ ID NO: 4233958 - RNA, 87 nt, Human
cgggcgccggugaggaggaggagaagcggcggcggagagguuuucugcggccggaauucccuucaacagcaucccugucggcgcccg

SEQ ID NO: 4233959 - RNA, 76 nt, Human
cagagaguaaaguuuguacugggaguuacugacaaacaguugcuaauacaaaaagucccaugugaaauuuucuuug

SEQ ID NO: 4233960 - RNA, 65 nt, Human
gcgugugucagccuccuccaccccagagucggcugcagacucaggggcaggggguggcucacugc

SEQ ID NO: 4233961 - RNA, 116 nt, Human
cccacucuccucucccaguccaggagggcuggagcucugggcaucucagggucagcugcggugagccuggccacagggcucugcauuccuucugggcuuugcuugguuugaguggg

SEQ ID NO: 4233962 - RNA, 62 nt, Human
ggugggagugugaggggcguucacucucgugggggucacucccgcgggcucuccaccccauc

SEQ ID NO: 4233963 - RNA, 60 nt, Human
gcaguccagaguagucgaguauucuguaacaaaauaacaggguuacuuauuuuggauagu

SEQ ID NO: 4233964 - RNA, 73 nt, Human
gguagugucccaucacagaggagacuagaugcaauuuuuuccugccccuggucccuagugugggagcuuggcc

SEQ ID NO: 4233965 - RNA, 60 nt, Human
ggacagggagcaaaaacguccccaggcaacgcccucgccucugggacuuucugccugucc

SEQ ID NO: 4233966 - RNA, 58 nt, Human
cugaccgugccgcgguacugcucccccgcgccgugguagcagucugcggccggugcgg

SEQ ID NO: 4233967 - RNA, 64 nt, Human
gccaccacacccggcuaauuuuguuauuuuuuauagagacaggguuuugucguguugugcaggc

SEQ ID NO: 4233968 - RNA, 58 nt, Human
acccaggcuggaaugcaguggugcuaucuuggcucacugcaaccuccaccucccgggu

SEQ ID NO: 4233969 - RNA, 63 nt, Human
ggaacauuguggacaagggcaggucuucauauuucugaucaucccuuucucccagugaaaucc

SEQ ID NO: 4233970 - RNA, 69 nt, Human
uucuucuggagacuaagaaaauagaguccuugaaaucaagcugacucugcuuuuagccuccuaaaugaa

SEQ ID NO: 4233971 - RNA, 115 nt, Human
aaaggccucaaugacauccuauuucaguguuagaauuccaagaaggcuuuuguuaaaauaaacaucaagagauuuuaaauaaacuacacugauuauuaacuggcaugcuuucuuu

SEQ ID NO: 4233972 - RNA, 72 nt, Human
gucaccaguucuauguagauaaugaaaagaccuaacugauauuucauuauuuggaauaugggacuggacggc

SEQ ID NO: 4233973 - RNA, 130 nt, Human
gugggaaaaaacuuuaucagcaagaucauuaauaacuugggacucagcuuuucaaguuacaauuagcugcucaacagcugugaccuucaagagcuacucauuauuguugguccugauuguucacucccac

SEQ ID NO: 4233974 - RNA, 85 nt, Human
gagagccagguggagaaagcuggaaucugagcucuucagggaccuuuuguugaauuucuguucugcuuucuccauccuccaucuu

SEQ ID NO: 4233975 - RNA, 76 nt, Human
ugaaguuaucugagaaauagauucaugguagauucuaagauaguauuguucuagaauuuuuuuuccuguggcuuua

SEQ ID NO: 4233976 - RNA, 108 nt, Human
cucuucaaggcuauaagaagacuugggagaagagaaaugucugagacuucugaacuuuggcagauaaaguugguguuagaguuuuucagcucccgaagccaucaggag

SEQ ID NO: 4233977 - RNA, 65 nt, Human
ccacagucugagcccagccuuguuuuaaaaggggagacgaggauuuccuuagaugaaaauugugg

SEQ ID NO: 4233978 - RNA, 55 nt, Human
gcccgccaacuugccagcggugcuucugcagccccgcuggaagcgaguggugggc

SEQ ID NO: 4233979 - RNA, 102 nt, Human
uacacuuuagcuugaugggauuuuuuuuccugucucuuucauuuaguguaaauaauguccugugagaggaagggaaagaugauuccauguuuuuuaagugug

SEQ ID NO: 4233980 - RNA, 101 nt, Human
ucaagaauaauagaaaaugacuauaaauaggagauuguauaauauaguauaauagucuuuugagcaguuaccuauuuuguagaaauuuuuuaaggucuugg

SEQ ID NO: 4233981 - RNA, 60 nt, Human
caagacgggacagacuuuugagugugggggcaucuuugguccgagaacuguccugguuug

SEQ ID NO: 4233982 - RNA, 110 nt, Human
ggguauuggaauagccuuuucucucaguuaaacuuugugaauguuaucuguguuuaacuccaaguuugagacugagaguggggcaaaugaagccuuuuuccacuaauucc

SEQ ID NO: 4233983 - RNA, 85 nt, Human
uaaguguauuggaaaagaaaggaugguauguguaugaaauguuaagauccuacgcaacacugcuauuuuuuuccuuuaauauuug

SEQ ID NO: 4233984 - RNA, 67 nt, Human
cucccccaggcagcccuccaggagccugugcgaagcuggggcuguggagaagcugccuauggcugag

SEQ ID NO: 4233985 - RNA, 78 nt, Human
uauuuguauuuuacuaugauaguugagaaauuuagccucuuagucauuuuuagcuguuauuguggaagaccucaaaua

SEQ ID NO: 4233986 - RNA, 68 nt, Human
gaggcauaaguagaagagauuguuaagaaggguauucaugugucuuugcucuuucugcuuuaugccuc

SEQ ID NO: 4233987 - RNA, 83 nt, Human
gggacaagcuagguccuccugaacugcagaggcugccaauaaacuggcaacacagguguugcaggaagauauagcuggguccu

SEQ ID NO: 4233988 - RNA, 59 nt, Human
acuucaggacggcaguggaggggccaacuccagaugccccugcacuucccuccucaagu

SEQ ID NO: 4233989 - RNA, 56 nt, Human
gggagcugagcuggaagagaauuaagaauuugucucucuaauccccagcucuuccc

SEQ ID NO: 4233990 - RNA, 93 nt, Human
uagagaagaggacauagaucuagacuuuaaaaaacugaacaagaaauauuuggaaggauuuuuaagccaagagguuguaacugucccuuccua

SEQ ID NO: 4233991 - RNA, 124 nt, Human
gugcuacuuaaucuuaaaagcaaaauuaaacauuggacugguuuacauuucaagcuacaauauggaaccauuguauuuggaggaaugaguuuaauaugcauuguaaaauaaaauuaggggguac

SEQ ID NO: 4233992 - RNA, 120 nt, Human
gggauuauuugguauucaugugagcaguuagguuuugugucagaguagaaugaccacucuaucaaaagcuccauacuauuuugacaugaaauugaucugcaaacaccuauccagaauccc

SEQ ID NO: 4233993 - RNA, 59 nt, Human
aacaaagaugccaaaaggaagacagauuuucaucugugauuucaaagggugucuuuguu

SEQ ID NO: 4233994 - RNA, 90 nt, Human
gacuaauuuucugaaugaauaaauuuuaaagacagaaaaacaacgacuucugugcuguuaagaaauuuagucagucagaggccacaaguc

SEQ ID NO: 4233995 - RNA, 60 nt, Human
ggaauauaaaucagaugcuccguccuaagcccuuggaccuggagcgggcauuuguguucc

SEQ ID NO: 4233996 - RNA, 60 nt, Human
agcccagcuuuuugaggcaggcaggcggggccccacuugcucgccuucaggacuugggcu

SEQ ID NO: 4233997 - RNA, 56 nt, Human
guuacagagcugcuaugugugcgugcccacggccccaacacaccagugccugugac

SEQ ID NO: 4233998 - RNA, 127 nt, Human
auugcaguuauuugggcuuacuggcuuggaucuaagguacuugaugcacauaucccaacacuccauccuggaauucugcaauaaucaguccuuaccucuagccuauuaggggaugaaugacuacaau

SEQ ID NO: 4233999 - RNA, 130 nt, Human
ggucccgcccuugacauguggggauuauuacaauucaaggugagauuugaguggggauacagagccaaaccauaucauucugccucuagcuccucccagaucucaucuccucacauuucaagacacaauc

SEQ ID NO: 4234000 - RNA, 66 nt, Human
gugaaggcaugugugcugugcucugcuuaacuaauuucccucagauauucgcauuucugucuuuac

SEQ ID NO: 4234001 - RNA, 78 nt, Human
gccagguacagcagggcacaguuauggaggugggguaccauggcagggcaccacccugguuacugugccaggccuggc

SEQ ID NO: 4234002 - RNA, 103 nt, Human
guguuuacugacuaauaaggcaagaaaaaacaugaugaguguacuuuacaucuuacuuuugugggcucuuaauuuuuuucucuaguuuguuuucaguaaagac

SEQ ID NO: 4234003 - RNA, 97 nt, Human
cccaggaugaggacccagcuauaucuuccugcaacaccuguguugccaguuuauuggcagccucugcaguucaggaggaccuagcuugucccuuggg

SEQ ID NO: 4234004 - RNA, 59 nt, Human
accucauucugcauagaacuuuuucaaagucggagggaggagguugcucagaguggggu

SEQ ID NO: 4234005 - RNA, 113 nt, Human
guugcauggagcccccgagggugcuccacagcgcggccuuacacccagggggcgacccccugggcccugagccgcgauccauguagcacuccuccccgccccuccaccccagc

SEQ ID NO: 4234006 - RNA, 95 nt, Human
acccagugauauaggaagcccagaaugauucagcgacaguucagcuucaggggaacugugacugugucuucugggcaaguguucuuuccuugggu

SEQ ID NO: 4234007 - RNA, 81 nt, Human
agugaaugugaggguggggaauagacugcuaugggagggauggaccugguggcagugagauuucucuucugggcagacacu

SEQ ID NO: 4234008 - RNA, 60 nt, Human
ggaggagauggaugggggacguuuagcgaagaaaggcaucucccagauccuuuagccucc

SEQ ID NO: 4234009 - RNA, 59 nt, Human
gaugcuguacugucugccaagccagccccaggggcugagcggugagggcauacagcguc

SEQ ID NO: 4234010 - RNA, 68 nt, Human
ggacacugauugggagugugacauuguaucagaaaugaccgaauucuauucccaauaccaguuuuucc

SEQ ID NO: 4234011 - RNA, 83 nt, Human
agucagagaggcguguggcgacucagagcugccugggcccuggccucagguuaggaggggagugccacagccuuuauuugacu

SEQ ID NO: 4234012 - RNA, 61 nt, Human
guuguuguuuuuguuaaaacagugagagcaaaauaacuuacuggaauauaaagauaagagc

SEQ ID NO: 4234013 - RNA, 89 nt, Human
auauaauauguauauacacacacaugcauguacguguguauguauauauguauguauguauauaaauguguguguguauauauauauau

SEQ ID NO: 4234014 - RNA, 59 nt, Human
ggugucacuuucaggagcucuaagaauacgucaacucucgcuucugaguuggugacccc

SEQ ID NO: 4234015 - RNA, 58 nt, Human
ugcuccguucuucugcuucuuguagcuauagagccccacagcaggcagaacgugggca

SEQ ID NO: 4234016 - RNA, 66 nt, Human
cuguuugaaugugcugguaacugcuuugcuucuugaguagagccaccaccaccauagcccagccag

SEQ ID NO: 4234017 - RNA, 76 nt, Human
uacccaagaguuguuuuaaaaagaauaacuacauauucaguguaguuuucaugguuagaaauaggacucuuaggug

SEQ ID NO: 4234018 - RNA, 78 nt, Human
caguguuuucaacaacuugguucaaauggguuuccccuaagauccacccacccauuuggccauucaguuguuccacug

SEQ ID NO: 4234019 - RNA, 72 nt, Human
guuccucuggguuuuguuuguacaguguaauuugagggugauuaaaguuaaaaagaugaaucuaagagggac

SEQ ID NO: 4234020 - RNA, 66 nt, Human
ugcagaacacaguagacagaacugccaccuucaauugguacuuuauucuuugcugcuguuuuugua

SEQ ID NO: 4234021 - RNA, 67 nt, Human
ucuagaucuuuaaaaaucuggaauccugaccacaugugguccuuuugggcauuuuuaaggaucuuga

SEQ ID NO: 4234022 - RNA, 59 nt, Human
gcuggucuggcaauccucauggcacguaaagaggcggucauccgugaggaccaggcagc

SEQ ID NO: 4234023 - RNA, 65 nt, Human
ggcacacugaaguuugagaaccacugaaucagugauuucaguauuuccuaaaaugcuuuugugcc

SEQ ID NO: 4234024 - RNA, 58 nt, Human
gcccucugccacaggacgccagccucggccucagagcugccggcugcugcagagaggu

SEQ ID NO: 4234025 - RNA, 61 nt, Human
uuggauagaauuuaaauugucuacauaaauauuuguuuuaggacccuuagauuuuaucuga

SEQ ID NO: 4234026 - RNA, 55 nt, Human
gcugguuacuucauuagguccucucauugauugaacccugcugaagugaugcagc

SEQ ID NO: 4234027 - RNA, 63 nt, Human
gagucaaugugcagugcagcccacacuugagaggaugaauguaugugcacugucacuuugcuc

SEQ ID NO: 4234028 - RNA, 83 nt, Human
gagucuuacucuaucacccaggcuggagugcaauggcgcuaucucagcucauugcaaccuccuccuggguucaugugauucuc

SEQ ID NO: 4234029 - RNA, 60 nt, Human
gaggaggucggaagugaggguaacucaaguccuugagauaaucacaaucuagacuuuguc

SEQ ID NO: 4234030 - RNA, 69 nt, Human
ugaagagcuuguuaugcugcucuugcuaugcugcugaaagcaaccuaaagggaaguuugacacuuuuua

SEQ ID NO: 4234031 - RNA, 63 nt, Human
gguaggggcaagucuggccauuucucuggaaugucaaccgagaggccaacuucuugccccucc

SEQ ID NO: 4234032 - RNA, 81 nt, Human
gacaaguuguuaauaugcaaaacggaugcgugauauuucuugcuucucaugaugcauguuucuguauguuaaugacuuguu

SEQ ID NO: 4234033 - RNA, 74 nt, Human
ccaggggacuuuauaugagaggaggagcaucagugccucucugggcaucugcugcuccuucuucuugcccuugg

SEQ ID NO: 4234034 - RNA, 80 nt, Human
ugauuggcccaugguucugcaggccaaccggaagcauggcagcaucugcuucuagggaggccgcaggaagcucccaauca

SEQ ID NO: 4234035 - RNA, 59 nt, Human
uuuggucaucaaagacaaguaaugugucucagaugagaggcuugaauuugauggccaga

SEQ ID NO: 4234036 - RNA, 70 nt, Human
ucccaggcaggagcugugguggugaggagggccacuccucauugacagagcagcucuacugugugaagga

SEQ ID NO: 4234037 - RNA, 113 nt, Human
gaaaacagucaaauuuaaccauuuggaguuuauuugaauucuuggaaagagcaauauucaaaaccuuuucaaaaauaagauauucuggacuacuggauggauguuuuguuuuc

SEQ ID NO: 4234038 - RNA, 66 nt, Human
auagaugacaguuaggaagcugguggagcuuuaaugcuugcuuugcuuuguugauggugagucugu

SEQ ID NO: 4234039 - RNA, 55 nt, Human
guuuguuugccagcuuaguaaacaguaagaauguuuacuaagagagcagagggac

SEQ ID NO: 4234040 - RNA, 60 nt, Human
ggacuugaaguaguuauggccugaggucucacuuaccugggcuggcaguuuucugaguuc

SEQ ID NO: 4234041 - RNA, 68 nt, Human
agguugaucucagaauugucaccucaaaaaggcccugccuuccacuguucaguucuggucaucugccu

SEQ ID NO: 4234042 - RNA, 83 nt, Human
cucaguuauuuuucucaagcacugugcaaugagcuugcgggguuuucuaggugcuugcauacugcuugacuguugaacuuggg

SEQ ID NO: 4234043 - RNA, 67 nt, Human
ggguuguuuguauuucucugaaccugucacuguaaugauuugucaggacacuuaauaggaacaggcc

SEQ ID NO: 4234044 - RNA, 70 nt, Human
ggagugguggaagggguuacgcagcaggauggacaccacuuccaugcgcgauggccuggcuucccgcucc

SEQ ID NO: 4234045 - RNA, 78 nt, Human
gggaacacaggcaguguguagcuggaagagaagcgagaagcguacuuugcagguggaacacaugugacuuagugaccu

SEQ ID NO: 4234046 - RNA, 57 nt, Human
ccggaggaaauugcauugguugcaucauucucggcagccgauaaauuguuuucuugg

SEQ ID NO: 4234047 - RNA, 104 nt, Human
gggggcucccugcaggggugaggcagggcaggggucauagcagucacugugaaccaggaucccaguccuacccucauaacuggcacaaguaaccuggaggcccc

SEQ ID NO: 4234048 - RNA, 84 nt, Human
gcuucuccuucaugcgcuuuucaggaguguuuuagggcuauauuugcugaggauacauuccugaagguaaugagaaauggaagc

SEQ ID NO: 4234049 - RNA, 76 nt, Human
gggccuuuauuugguuuuggcuuuagcugauaauguuuuagugaugucagcuagugcaguucucaaauggcugccu

SEQ ID NO: 4234050 - RNA, 61 nt, Human
uuuaaugcagguacuguuacaauacaacugauguguuuuguugucguucccccugcuuaaa

SEQ ID NO: 4234051 - RNA, 91 nt, Human
uugcccuguuagaguguaagcuccuugagggugggauugugccacauucaccuuuucccaccuauacuaagcacuacuuguuacacugcag

SEQ ID NO: 4234052 - RNA, 59 nt, Human
acuuggguagguccuucacggauacuuuccugaguauuugauggaacucuugcuuuggu

SEQ ID NO: 4234053 - RNA, 70 nt, Human
ggggaggagggugacuggcgucugucuccccugcccagacaguucugggacgugaggcgcccuuuuuccc

SEQ ID NO: 4234054 - RNA, 66 nt, Human
cuuuucugauauucauaggcagguauuuaauuuuacuaauuagcauccugugugaauguauuaaag

SEQ ID NO: 4234055 - RNA, 85 nt, Human
auuuuggauaaguuugucauuuagcccaugguggggguaagagucccacuuucuaaauuggcgauuucugucacaugucuaaggu

SEQ ID NO: 4234056 - RNA, 56 nt, Human
aauugaggaaccuuagggcaaaucaaugaacuucugaacugccuucgucuucaguu

SEQ ID NO: 4234057 - RNA, 61 nt, Human
uucauugauuuccuuggaauaagauuuuuauaacuuucuuuauuccauagaagucaaggaa

SEQ ID NO: 4234058 - RNA, 72 nt, Human
ccuuccaggccgggcaggaaacaccauaaagccaccaugcuuccuugggguguugucgcuggguuuugaggg

SEQ ID NO: 4234059 - RNA, 121 nt, Human
gguacaaguugugagauugcaggugacaaaugaccuucuuuccuuaaauuuagaaaaguuguuuuggggcuauaaauuugggagaaaugggucaucuaaaucaucugugggaauuugugcu

SEQ ID NO: 4234060 - RNA, 68 nt, Human
cagcuucuuauuuuucguaaauccugauguguuagacaagauggggcauacgugaaauaauuuagcug

SEQ ID NO: 4234061 - RNA, 122 nt, Human
cuccuggcaggguuaaagggagaguacuuuaaacccauauaccagcugugcuucaguuucucucacuuugcccuggguaagcugcuguagggucagaaguaacccuuucugugccaguugag

SEQ ID NO: 4234062 - RNA, 122 nt, Human
caaugugcuggccauggagaccucaguuaauucuacagggaacucuggagcugggauggcccuccagagcuguccuacugugagagagcugggccuuugcaucccccaucagccagucauug

SEQ ID NO: 4234063 - RNA, 71 nt, Human
agcccuuucagcgucaugugaccagcgcgccccauucagcuuggcuggugucguuucacaugacccaggcu

SEQ ID NO: 4234064 - RNA, 69 nt, Human
gggagggugugguauggauguguugaccccugaagugguucugaugaccuuucccuaucucacucuccu

SEQ ID NO: 4234065 - RNA, 99 nt, Human
gagacugaggcaggacaaucacuuagaacccaggaaguggagugagcagagaucacgcuacugugcuccagccuaggugauagagcgagucucggucuc

SEQ ID NO: 4234066 - RNA, 80 nt, Human
auaggggagaaaaaggcaagauuaggaccagaagaauaaugacuuuuuguaaagaauucauaaaccuuuuuuucuacuau

SEQ ID NO: 4234067 - RNA, 74 nt, Human
ccauacaauuuuaauaaggacaugaaggguccuggggugagcacuuuccagaccucucaggcuguucuugaugg

SEQ ID NO: 4234068 - RNA, 106 nt, Human
agaaagugggguaagaaagggcacauggcacaguuaaaguuguagaaaucaaauuacuaucauuuuuuguugccaaaacaaagucuuacauuuaaccccccuuucu

SEQ ID NO: 4234069 - RNA, 60 nt, Human
agcagccucuugucacagcuugacuccuagguagugugccuagugaccaagagggcugcu

SEQ ID NO: 4234070 - RNA, 58 nt, Human
cccugcccacugcuggccaccacccccggcuccccucaggguggggcccagugggggg

SEQ ID NO: 4234071 - RNA, 81 nt, Human
ugucuagcagggucaucugagggacgagauuucagagugaacaccuugaacucuugguggucauuagaugguccugugaua

SEQ ID NO: 4234072 - RNA, 94 nt, Human
aagcaauggagguuugccuacaaacgaaucuaucugaaaauguccccgucuacuauuuagagauuccuuuggggaaagcacuacccaguggcuu

SEQ ID NO: 4234073 - RNA, 81 nt, Human
ucuguguggugccaaauagcuugauuaagaagcacauaacccagccugcacucagugauccagauauuugagcugcauaga

SEQ ID NO: 4234074 - RNA, 60 nt, Human
uuuuggaggaggaugcauuuguuguuugauggagucuacgaccuugcccucauuccaaag

SEQ ID NO: 4234075 - RNA, 76 nt, Human
aggugggggcacccagccgaugaggcagaggaaggagggcugggcugcggucucagcuggcugggagcccuggccu

SEQ ID NO: 4234076 - RNA, 91 nt, Human
uuucuguacauguuguuuguguauauguguauuuuuuaaaaauuaaaaaguguggaaaaugcacacauacacacccagcauuuagcaaaaa

SEQ ID NO: 4234077 - RNA, 117 nt, Human
ccagcuagagcucgucauggucgucuucggugggugcuucaggcgguggcuccgggcaggcggcuggcgucaucagcuccaugagguacucgcagcgacugggcucuguggugcugg

SEQ ID NO: 4234078 - RNA, 66 nt, Human
uauuaauugugguuauuguauuuccaagcagaugccuggccuuaaauuauagugacuaaauugaua

SEQ ID NO: 4234079 - RNA, 100 nt, Human
cuuuccuugagauaaauuccuagucacaaacuuccuggaaagaaaguauguuuagauuuucagcauuuugagguguguuacuaaauuuaucuagagaaag

SEQ ID NO: 4234080 - RNA, 97 nt, Human
agucagcuccuuugccuucaguguuacuagaaagcggccuguguccaugagugugcuuugcuguuggugcacugaaaggcaggaaggagacaagauu

SEQ ID NO: 4234081 - RNA, 113 nt, Human
ggaccuagagaagugccuggaacucgguucagcacaggugugaggccugauuuccucuugugaucaacucacagugugcuggcaagaccugccaauccacuccucugggagcc

SEQ ID NO: 4234082 - RNA, 74 nt, Human
uaucagcagagaaauagaugcaaagagacaagccuuuauuuggcuacuuauuugcccauguuucuuuauuauua

SEQ ID NO: 4234083 - RNA, 66 nt, Human
uucuauaagguuuucuuuuguucccuuagaauucauuggagggaugcaguaaaaacuguaguagaa

SEQ ID NO: 4234084 - RNA, 67 nt, Human
gugcggccuggccuucaaguggucgucccacuaccaguaccacuuaaggcagcacacaggcgagcgc

SEQ ID NO: 4234085 - RNA, 57 nt, Human
guggaggguuugcaaugugcaggguaauccuaucuccuagcacuguauccucuucau

SEQ ID NO: 4234086 - RNA, 68 nt, Human
ugcugagcuuauuagguuauuucaaggaugaaaucagacagcuccugagaagcacuuaauacacagca

SEQ ID NO: 4234087 - RNA, 70 nt, Human
gguuagcccaggacuuuuuauagcauagaguuuuaaagcaagggcuuagaaucagaccugggucaaaauc

SEQ ID NO: 4234088 - RNA, 76 nt, Human
aaaccaauaaaagcaauucacaguucugaaggcagucugaaguuugcuuguuuuacugugauuuguuuuuguguuu

SEQ ID NO: 4234089 - RNA, 68 nt, Human
ugaaagcuggcucugcagagugccuuaaaaaugacuuuaauuaggaaauucugaguugucagucuuca

SEQ ID NO: 4234090 - RNA, 85 nt, Human
cacuuucaauuuguuuccuuacuuauaaaauggggauaauaauagguucuucauaagauuguugugaggauuaaacaagauagug

SEQ ID NO: 4234091 - RNA, 56 nt, Human
auauucucuauugguaaauuugacuuuauaaaggacauaguugcuauggagagugu

SEQ ID NO: 4234092 - RNA, 72 nt, Human
agguaaugacugccuucaaaguaauauuuuaguugauuuuaauauucucuuugaaggaaguucucauugacu

SEQ ID NO: 4234093 - RNA, 60 nt, Human
gggggcugugugcccgcuccccacagaagcaaaggcuccggggcccccacacaugccucc

SEQ ID NO: 4234094 - RNA, 80 nt, Human
uuuuguuuacaagauugauuuaauaugagaggauacaaaaugucaucguuauccucucuuaugaacaacuguagucaaaa

SEQ ID NO: 4234095 - RNA, 59 nt, Human
uugagacugaguuugguuuuguuauuauugcucuaacaaagaaaagcuugagguuuuga

SEQ ID NO: 4234096 - RNA, 88 nt, Human
ggagaaucgcuugaacuugggaggcggagguugcagugagcugagaucacgccacugcacuccagcccgagcaacacagugagacucc

SEQ ID NO: 4234097 - RNA, 60 nt, Human
ugcuuuggcccaacauugaugccugucccagaaauacaggaucaagugucuugccaggca

SEQ ID NO: 4234098 - RNA, 61 nt, Human
gauuucaggucauuuuuagcccuagacuggaaaggggucaggggacaggugaccugggcuc

SEQ ID NO: 4234099 - RNA, 85 nt, Human
gggcacgggcagggcucagccgcucccaccuccccacagaagcccaggaguguguggacgucugagcccagcuuucugcgugccc

SEQ ID NO: 4234100 - RNA, 59 nt, Human
uucuacauugugaaguucuuuauccuaccuguguaucccuagggcuuuacagaguggag

SEQ ID NO: 4234101 - RNA, 60 nt, Human
cggggucuggaguugugguguggugguggcuugugcuccauccagagcugccugaccccg

SEQ ID NO: 4234102 - RNA, 83 nt, Human
ugacuaaaguugaaagucgugucagaaguugggaaaaccagaagguuuguuccgcuuucaauggcuuggcuccucaccucuca

SEQ ID NO: 4234103 - RNA, 55 nt, Human
ggagugaguauguucugaugcacagggcagcaguguuuaaggauauauucucuuc

SEQ ID NO: 4234104 - RNA, 70 nt, Human
uuuuugaaagcagguugcaauuacagugcuucauuuuguggaaguacugccauuauccugcugaaagaaa

SEQ ID NO: 4234105 - RNA, 61 nt, Human
auucugcuagugguauauguugaucugaacuuacaaugaugggauauagaauuggcagagu

SEQ ID NO: 4234106 - RNA, 81 nt, Human
cagcccucucauacuuguuaacaauugguaucuuugaguauuuaccaaagagcugccaagguuacagugaacagaguuuug

SEQ ID NO: 4234107 - RNA, 73 nt, Human
gccuuuguaucuucaauagcccagaugugcuuaaagcaaugaacacauaaggacauuauugaaaggcacgggc

SEQ ID NO: 4234108 - RNA, 67 nt, Human
agaaaauauuugaaugguguaagaugguggaaggaaagccaucccacaccccuacaacauauguucu

SEQ ID NO: 4234109 - RNA, 88 nt, Human
ggagucucacuuugucacccaggcuggagugcaguggugugauaucggcucacugcaaccuccaccucccggguucaagugauucucc

SEQ ID NO: 4234110 - RNA, 108 nt, Human
uuuuauuuuuuacaaguugcuaugaaauuaaaauuuauauauauaucuuaaguguuuauaaagcacucaaaauuguagcuuacauguauaugacuucugaaaauaaaa

SEQ ID NO: 4234111 - RNA, 102 nt, Human
cuacagaugauuuuuaaugaguauuuugcauuaguuuagauuucaagugauuuauuuugaacauuagaauaaguaauugucauugguaaugucacacuguag

SEQ ID NO: 4234112 - RNA, 59 nt, Human
gggggacaggaugaauaucugucugauaagcucacugagauauguuaggcuuguucccu

SEQ ID NO: 4234113 - RNA, 80 nt, Human
ggagccuucgagaaggcaguaaauggcuguuuuuauugacaaaaggaaaacauuuuacugccaucucacugauggcaucu

SEQ ID NO: 4234114 - RNA, 69 nt, Human
caugugauuucagguuuuucauacugaaaacauugagauuucaguuggaagacacccugaaaucuuaug

SEQ ID NO: 4234115 - RNA, 66 nt, Human
uaguaagugcuagaauuccagguuugaacuaaggugugucaaaaccagaguucauaguauucauua

SEQ ID NO: 4234116 - RNA, 120 nt, Human
aauuguuuuccugaaucuaaguauaugcuugggcauuucuuauguauuuuuuaaacuuuauacagguagagaaaguagaauaauaaacccuuguguacuuaucacccagcuucaacaauu

SEQ ID NO: 4234117 - RNA, 69 nt, Human
ggcugacuauaaggcugcucugugucgucauaaacaguacaugggcaaucgcuuuauucaaguucaucc

SEQ ID NO: 4234118 - RNA, 75 nt, Human
gagggaggagcaggcaggaucuggucaguucacauuuccuccagcugaagauucugacccugacucagagcccuc

SEQ ID NO: 4234119 - RNA, 84 nt, Human
ggggaaugacuuagaucacugucuuccuuuggcuccucaccauguuguguggaggaaacgaaaagcagcucaaguucacuccuc

SEQ ID NO: 4234120 - RNA, 56 nt, Human
uccaggcagcugcuugaugauacaaaugagguggaccaucagcaguuuugccugga

SEQ ID NO: 4234121 - RNA, 63 nt, Human
cugacugaggaucaguucaucaggacccccaccggggacgaguuugugaagaccucagugcgg

SEQ ID NO: 4234122 - RNA, 75 nt, Human
cagccucccaaagugcugggauuacaggugugaaccaccgcgccuggccuaauuccagcauuuaaaaacaaucug

SEQ ID NO: 4234123 - RNA, 69 nt, Human
gggaguacugggaauggagccugggccucggcaccaugcccagggccgccacuuuccagugcugcagcc

SEQ ID NO: 4234124 - RNA, 59 nt, Human
guuuuuagugaagcuuugcauuucacauaagguaugugaagugaaauuucacaagggac

SEQ ID NO: 4234125 - RNA, 66 nt, Human
gaacauuucugcagaugucugaauaucaagaaccuaucucuaaaaggcauuuaucaggaaauguuc

SEQ ID NO: 4234126 - RNA, 65 nt, Human
gucuuuaagugugugccuccaggcaugcuuauuuauuuuuauugucucaagguaacauuuaagau

SEQ ID NO: 4234127 - RNA, 86 nt, Human
uuuuuuuaacgguguguggguucugaucccaggacugcuacuguggcagucauggguagaacucaagaaaaugcauccgaaagaaa

SEQ ID NO: 4234128 - RNA, 62 nt, Human
gaugguuuuacauuuuaauguuugaaaacauaauuuugguucaauugcaguguaaaacuauu

SEQ ID NO: 4234129 - RNA, 65 nt, Human
gccgagcggcggugagaagugugggaaccggcgcugccaggcucaccugccuccccgcccuccgc

SEQ ID NO: 4234130 - RNA, 83 nt, Human
agggcaggaugcaacgccggguaaggucauucugcacauguuaauuguugauguagaacucuuuccugcguggguagggcccu

SEQ ID NO: 4234131 - RNA, 78 nt, Human
ccagucacuuggccgaugagcaugcgcugauagccuccuauguggcccgucugcagcacugugcacggucaguggugg

SEQ ID NO: 4234132 - RNA, 62 nt, Human
guacuccggcgaccuccagauguucccgacagugcggccaucugcuuagauugcuggggcgc

SEQ ID NO: 4234133 - RNA, 61 nt, Human
gauuaagaaagauagauguggauacccagccacucguuccauauugguaucuuuuuaaauc

SEQ ID NO: 4234134 - RNA, 57 nt, Human
gucuugugguggaucccucauuuuguaauaggcaggagaaggaugucaucaaaagac

SEQ ID NO: 4234135 - RNA, 59 nt, Human
gcuucucucacucuuagaucccgcaccagaggaagcggaucuccuugagugggcaaagc

SEQ ID NO: 4234136 - RNA, 60 nt, Human
ccccuaggggucuggauuugcugguuaacaagauaaccugagggcaggaccccauagggg

SEQ ID NO: 4234137 - RNA, 56 nt, Human
agggccaagaaagaguggcuuuaagguuagguaagugucaauguuuucuuggcccu

SEQ ID NO: 4234138 - RNA, 73 nt, Human
ggccagugcaguacaaaccuuagucaugaacauaacaguaugugguuuacuggguuguuugucucaugaggcc

SEQ ID NO: 4234139 - RNA, 76 nt, Human
ccagucugucacuugcagccuggagcucagccucaccaguuaggugaggcagagauggcugcagggccaacacugg

SEQ ID NO: 4234140 - RNA, 61 nt, Human
guaugugucuuagaacuugggacuuagaacucuccccuucucccuggaaugagaugcauau

SEQ ID NO: 4234141 - RNA, 55 nt, Human
ggucgucuguccugucgccgcugccgccgccgccacagcggccgccgcgggcgcc

SEQ ID NO: 4234142 - RNA, 105 nt, Human
ggggagaccauugaaguagaagccucaaagcagacuuuucccuuuacuguguguacuccaggacgaagaaggaagaucaugcuugauacuuagauugguuuuccc

SEQ ID NO: 4234143 - RNA, 56 nt, Human
aaggucaggggcuuuugaaacacccaaccccugggugucagaaagccugugacuuu

SEQ ID NO: 4234144 - RNA, 77 nt, Human
cuaaagaaaagcaaggggaauaguaggaccugggacagcaguccuaggcccauuaauuccccuugccccucugacag

SEQ ID NO: 4234145 - RNA, 81 nt, Human
cuuuccgcgcccuguccuucccuccaucugaacccugcuaccgccucucucagaacugcggggaagguggggcgcacgaag

SEQ ID NO: 4234146 - RNA, 61 nt, Human
cagguguugcaguugaagacugguaaguuugccaaucagaucuuccaacacugacaccaug

SEQ ID NO: 4234147 - RNA, 71 nt, Human
uuagucuuuuaacccagccauuuucaauuuuuuaaaaauuagguaaguuaaaaaagcuggguaaaagcuga

SEQ ID NO: 4234148 - RNA, 60 nt, Human
uaaggucuucgaaccuuauguuagggguuggaggucuuggugugaggaaggaagacuuua

SEQ ID NO: 4234149 - RNA, 79 nt, Human
ugcuaugggauuuaaugggaaaaauauguaaaaacugucacuagucagcuggcucuuuuuccuaugaaaucuaucagua

SEQ ID NO: 4234150 - RNA, 57 nt, Human
guuuaaaagcaaccaacaggcuugaagguuucaacugccuuuuguugcuguuuggau

SEQ ID NO: 4234151 - RNA, 67 nt, Human
uucccugccacauguguaccugccucucuggggacacccaggacccaacggugcaaugucaggagga

SEQ ID NO: 4234152 - RNA, 59 nt, Human
uucugagccacaguaaggaucuaguccagcccuaaaugaguccuugacuguauucagag

SEQ ID NO: 4234153 - RNA, 69 nt, Human
aguuauggguauguauuauaauuucuaaaaugcaaauaaauauaaagaaaauaaauauaacccauaauu

SEQ ID NO: 4234154 - RNA, 63 nt, Human
gccccagggcugcugccugggcuggacagcacugccccagccacagcuuccagcuccugucgc

SEQ ID NO: 4234155 - RNA, 97 nt, Human
uguacgugaauagauguuuuguagauuggaaaaucuggguagauuugauaaugcaaaccucagaacuaacuuugcugaaccucugcugucaguuaca

SEQ ID NO: 4234156 - RNA, 70 nt, Human
ggaggcagugccuggaccccagcugcccaggagaggugaggggcuagauggggccugaggacacugugcc

SEQ ID NO: 4234157 - RNA, 130 nt, Human
gcuacauuugggaauuccagcuggggcugggaggaagugaaagaggaggacgguucccagaaggcgcauaacaggcauuuucagugggggcuuuccuucugccacuccgauaagccccucgaguuccugc

SEQ ID NO: 4234158 - RNA, 86 nt, Human
gcaguccagacgaagggggcauggugagagugcauguucaccuugggcucuucuaaguuuacccuucccaucaaagugcugacugc

SEQ ID NO: 4234159 - RNA, 85 nt, Human
gguucuguguccuaggauaacaauuuguaguuucugaccauuucuuuacagaaaaaccacaauugguauuuuggacugcgggguu

SEQ ID NO: 4234160 - RNA, 63 nt, Human
ggugaugaagguggagaaucagaacuucuuggagaggaucuuccacuugaaccuucugucacc

SEQ ID NO: 4234161 - RNA, 70 nt, Human
ccaccuucugagggagggggagccguucuagaaagacucuggaacuuccucacuuucccucugagcaugg

SEQ ID NO: 4234162 - RNA, 61 nt, Human
gaauaagaauccacuucuggcagcauuuuucucuuaggcuguuagaggccaugucuuguuu

SEQ ID NO: 4234163 - RNA, 67 nt, Human
uuacaugcuugugcagguuuuguaauucaguacagaaaaguuuaaccuuguacauuuuuguauguaa

SEQ ID NO: 4234164 - RNA, 68 nt, Human
gcacgcuugcaucaggggcuggggccacacggccgccacacagauucccccgugaugccuggagcugc

SEQ ID NO: 4234165 - RNA, 74 nt, Human
guggggugguacaggugggcaccgugcugcaugucacaggaugucaggcagcaucccggccuccacugucccgc

SEQ ID NO: 4234166 - RNA, 64 nt, Human
gacagaccucugcugacuggaguaucuucaaguaugaaucccuucagaccucagaaggucuguu

SEQ ID NO: 4234167 - RNA, 75 nt, Human
gucccacuuuaccccuaaucuuggaaaugccauucccaugagaggcuuuccuaagauugguuucagaagugucac

SEQ ID NO: 4234168 - RNA, 127 nt, Human
cgauuuuaggaauuaccuuuugaaauguaauuguguuuuauaauuacguaaaauauuuaaaugcuucaaaacccaagucuaaaauguaaacuguauuuauaaaauauaauuucuauuccuguuuuug

SEQ ID NO: 4234169 - RNA, 61 nt, Human
caugugacuuagguuuuaucaccuaugaggagcucagaggauaaugcuuuggucagacaug

SEQ ID NO: 4234170 - RNA, 73 nt, Human
ucaccugagcccaggcacaaauugcagugagccgagauugcuccgcugcacuucagccugggugucagaguga

SEQ ID NO: 4234171 - RNA, 65 nt, Human
uccagcaggagcugaacccuuaacuggcuggaggaccagcugcuuuacuggucggcugggcugga

SEQ ID NO: 4234172 - RNA, 56 nt, Human
uuuuugcuuuuuugucaucuaaagauuaaugaacuucagauggcaaaaugcaaaga

SEQ ID NO: 4234173 - RNA, 71 nt, Human
cauuuuagaaaaauggguuguuugaagaugaaagucuuuuaucuuuuuucacaauuuauuuugguuauaug

SEQ ID NO: 4234174 - RNA, 67 nt, Human
agaggcagguauuugaaggcagugggacaggaagaggcuuguucuggacuuccaaauggcuuccuuu

SEQ ID NO: 4234175 - RNA, 92 nt, Human
ucggcccucaccggucucaccaaacgccccaaacucuccuccacacccccucugagugcccuggggcgccuggcugaggcugcaguggcaga

SEQ ID NO: 4234176 - RNA, 83 nt, Human
agacuacaaauaugguuagugcuguagauuaugauuuuguguauauuuguauauuucuacaggcugauuuuaauuuguuguuu

SEQ ID NO: 4234177 - RNA, 61 nt, Human
ucaagagauauaugcugguuuaagauacacaaaaacuugaacaguacuugagaucuuuuga

SEQ ID NO: 4234178 - RNA, 93 nt, Human
uucugugccauuuucgggacugguuguguguggugugguucuuggacuucgccaugucuacaccuuaagccgcggcucccgaagcaccuagaa

SEQ ID NO: 4234179 - RNA, 61 nt, Human
ggcaagauccagcacaaacacagguggcagcaaaucaggcacaauguuguguggauuuucc

SEQ ID NO: 4234180 - RNA, 60 nt, Human
ggcaauuacguauuagucaugugagcggagacagaaccgauuaugacaaguacuaguucu

SEQ ID NO: 4234181 - RNA, 68 nt, Human
uucuacuuggcaaagagaugcauaaggacucuuuucauuaugagucuguucaugucuuuuuaagugag

SEQ ID NO: 4234182 - RNA, 67 nt, Human
uucagcaagaaggcaucugcucgcuuccacuguaaaguggaaaugcuuagaggugaucuuuaaugaa

SEQ ID NO: 4234183 - RNA, 61 nt, Human
ggaugggcuuggggaggucuagccaguauggaacuuuccuggacauucgcaaaguucaucu

SEQ ID NO: 4234184 - RNA, 94 nt, Human
cuuaguuuucugaacugugaaaaaauugcuggcagagcugugaauccaguguaaauacuagcaguccuguagcgacuuuuuucguuuuacuaag

SEQ ID NO: 4234185 - RNA, 68 nt, Human
cucaaucucugggaacgacuguuaguacuugguagguauacuauuauuauugucguuuuacagaugag

SEQ ID NO: 4234186 - RNA, 74 nt, Human
uccaagaaacaguuaagaggaggcagagaagagcagaaacacuucuuugcugacacuuacacuguugccaugga

SEQ ID NO: 4234187 - RNA, 91 nt, Human
aguaauugugcaagguuaauaugaacagcagaaggaauguaaaaauguaaaguggucuucuaauucuuauguaagcuuugucauaguuauu

SEQ ID NO: 4234188 - RNA, 59 nt, Human
aguggugaucuguuacagucacuauucaacugggcacguguugugauuggucagucacu

SEQ ID NO: 4234189 - RNA, 61 nt, Human
uaucuuugccuuggguuuuguucucuccacagacugagauccagugcccguggaaaagaug

SEQ ID NO: 4234190 - RNA, 79 nt, Human
cagggcacagggccuggaggggcuccagguguugaggacucuucccggcaccgggagccccugcacggccucugcccug

SEQ ID NO: 4234191 - RNA, 71 nt, Human
uagcaacuuaaaaccauucauugaccuaugcugauaaacuagcagccaugcgucugcauuggguggugcug

SEQ ID NO: 4234192 - RNA, 67 nt, Human
ccaagaggaccuugccagggcagugcuaggcagagucucucugccugccuaggucuggccuccuugg

SEQ ID NO: 4234193 - RNA, 64 nt, Human
ucugcuuuuccccuacuaacacugaguuaugucuucuaauucucugaugcagguggaagauaga

SEQ ID NO: 4234194 - RNA, 81 nt, Human
gccuuugccaggacaugugauaaaggcccgcagauccuugaucaaggugucagccacuuugucggagcuccuggaaagggc

SEQ ID NO: 4234195 - RNA, 71 nt, Human
ggaaggagggaagggggaagagagcuggccguagacccgucuccggcccccgccucccccuuuccuccucc

SEQ ID NO: 4234196 - RNA, 66 nt, Human
uccuggauccacuagagggugaacucugggcccucccagacuccugcuccucuggggcccccagga

SEQ ID NO: 4234197 - RNA, 55 nt, Human
gaauuggggcucugggcagggagcucuguuugguucacugcucuagcccuaauuu

SEQ ID NO: 4234198 - RNA, 74 nt, Human
gcauugauguuuugaguuuuuuuacaccuaggauuuuuagcuuggguguguaggugaaggccaagacucucugc

SEQ ID NO: 4234199 - RNA, 79 nt, Human
caucauagugugacccauggcaagggcaguaauaaccaccaaaaucuccugcauuugcaauggguacacaaccaagaug

SEQ ID NO: 4234200 - RNA, 60 nt, Human
gaggagagaacaagaguauccugaggcggucuccugcagugcucauagcuguuccuccuu

SEQ ID NO: 4234201 - RNA, 58 nt, Human
gcuucccacagcuggacuggggcuccgcguuacugcacccagaaguuccauggggggc

SEQ ID NO: 4234202 - RNA, 59 nt, Human
gcaccuggcuggcaauuuauaauuuuuaaaaggugauucugauuaccagccaggcuugc

SEQ ID NO: 4234203 - RNA, 68 nt, Human
uuucagaaauggcacugaaaucuguuuuccgguuuuacucguugugcaauacagugcuguuuuagaaa

SEQ ID NO: 4234204 - RNA, 57 nt, Human
ucuucuuaggaaagucaggaggauugcaaauaaucaccaugacaugccuauagggga

SEQ ID NO: 4234205 - RNA, 86 nt, Human
guuuguuaaagagauuuccauauuuuguaacagugccccccuucuccugccccuguuaugauaaauuggcuagucucugugaaggc

SEQ ID NO: 4234206 - RNA, 73 nt, Human
cauucagaauuuuaguuauaggugaaucagagacaaguuugacuuuucugagccacauauaauuuguugggug

SEQ ID NO: 4234207 - RNA, 59 nt, Human
cuggcaguguccagcucgugaugggcuuaguugcauuaucacuagaguuacauugccag

SEQ ID NO: 4234208 - RNA, 71 nt, Human
auccaggggucugaauggauauaagagaaccaaauguaacagaaauuuaauaucauuuuuuccccugagau

SEQ ID NO: 4234209 - RNA, 57 nt, Human
aggagacaguuuggacguguagaauauaaauuucuacuuuggcuagaguugucucuu

SEQ ID NO: 4234210 - RNA, 87 nt, Human
ggacugggucuggaaacugcggaaggcagcgcaggguggaaguguucggacucagcccuggccucuucgcuuuccagcaccagcucc

SEQ ID NO: 4234211 - RNA, 72 nt, Human
uccuguccauugcaaggaaaacagaugaucaacaugagaagcucagcuguugauuaauuuucccaaacaggg

SEQ ID NO: 4234212 - RNA, 66 nt, Human
cgcccgcgggcagggcuucaccuuucucucuaugggcagaaaccgguacccuccugccugcuggug

SEQ ID NO: 4234213 - RNA, 129 nt, Human
ggcggcugggggccgccaggaccuggggucuguccguaguaagcggccugcugucuguaauauuccgcccaggcggcacuguagucuggcugggagccugggggagcuccuggacccccuccgguggcc

SEQ ID NO: 4234214 - RNA, 121 nt, Human
ggccccaccugaggcacagcgcugacucaucacggugguaccaguaggucagccaucuggaaacagaaguggcccuaauugggccaaaaugugguaagacucgcuggccucaggcagggcc

SEQ ID NO: 4234215 - RNA, 71 nt, Human
ucagugggcagauuaauuucucaauacgugcuaaucuacaauugagaugcuuaaaucuucaccugcacuga

SEQ ID NO: 4234216 - RNA, 91 nt, Human
cuuuuuuaaguuugaacagaaggguugaucaaaauguguuuugucuguuuuaggcuugaugauucacgcuucucuuuaaacugccuuaaag

SEQ ID NO: 4234217 - RNA, 69 nt, Human
gggguggaauggggucagagaaugguggguauaaaaacuagacccccuuucuugaccucaugucacccu

SEQ ID NO: 4234218 - RNA, 72 nt, Human
uuguuuuuccccuuggaaaugguucuuaacucugggauuuuagaagguuagaauauuuuuucaagagaacag

SEQ ID NO: 4234219 - RNA, 81 nt, Human
cauaacaaauuagagucagcuauccauucuccuaugaacgaucagcaaaucucacaggagucaaggaauaguacuguugug

SEQ ID NO: 4234220 - RNA, 101 nt, Human
uucagagcaacccucauucacauuuucuccuggccuuggggagagaaguuaggcaaguuccucagaagggccugggauggaagggagucgggguuuuugaa

SEQ ID NO: 4234221 - RNA, 56 nt, Human
auauuguagcaucacugucuugcguauuaucagguggguacaaugggcaacaauau

SEQ ID NO: 4234222 - RNA, 69 nt, Human
augguuguaaaaacaucaaaggaagaaugauaugugaaaauuacauggaauuuaaauuuugguguccau

SEQ ID NO: 4234223 - RNA, 59 nt, Human
ggcuagaggggcacaguggggccugggccucuggucccuacuccucuggucccucuguc

SEQ ID NO: 4234224 - RNA, 76 nt, Human
ucugcaccucccagccuggagaggagccugugacuugcccuguuccuuggcuccucaggcugggguaagguguggg

SEQ ID NO: 4234225 - RNA, 74 nt, Human
aucuggaacuucucugcauugaccacuguucuggaguugggcugauagaaaacugcggugaagagaguuuagau

SEQ ID NO: 4234226 - RNA, 113 nt, Human
uuugguaaauaacauaaaaccugaagguuuuguuugcaaaucaugucaguugccuucauaaauguacagguaaugauuuguuaacagacuuaaugaagguuuuaauuaccaga

SEQ ID NO: 4234227 - RNA, 56 nt, Human
ugccagucggcacuuuaucuggccggacauuggucccucaggaggucgaccuggca

SEQ ID NO: 4234228 - RNA, 67 nt, Human
acagagcgguggggacuuggggucagcgggggagccuccgcggauggggagucaccaccugccgggu

SEQ ID NO: 4234229 - RNA, 57 nt, Human
auuugagguuuagcucacuauuuacaauaacugaaguacugauucuguuccucaagu

SEQ ID NO: 4234230 - RNA, 83 nt, Human
gagauacauuuuuaaaccuaucuaagaaauagcccugauauugaaauggcuucuguggaauagguuugacagguguaagucuu

SEQ ID NO: 4234231 - RNA, 72 nt, Human
ggaaggagcuuucauuacagccuugugggucuugacucaccagucccugcaggagccaguggaguuccugcc

SEQ ID NO: 4234232 - RNA, 69 nt, Human
ggaaugggauuuagauuuaaaaagggugggaugggaaacuguguuuuucauuuuaaguccuucuguacu

SEQ ID NO: 4234233 - RNA, 63 nt, Human
gacuucucuuuucauuaauuuuguccuucauucugagguauaaagauaguuuaaaggugaguu

SEQ ID NO: 4234234 - RNA, 130 nt, Human
uaagggaaccggagcagguuuuacccaguggcuuucuaccauuaaauugaguucuuuaaaaaugugacaugaagugcaguuaaugauaggaauucggugauugaaccauaaugaucucucccuguccuua

SEQ ID NO: 4234235 - RNA, 63 nt, Human
acauacucauuggagaauuacgaggcauauaauuuugucuuuaaauucuuaugagugaauugu

SEQ ID NO: 4234236 - RNA, 60 nt, Human
cagguuccugagcaguuccuggccagcuccuauugcuugucaagauauuuuaggaggcug

SEQ ID NO: 4234237 - RNA, 65 nt, Human
aguucgcacaggcacagacacugggaugaugagggguaccaucccacugucuucucgugcucgcu

SEQ ID NO: 4234238 - RNA, 69 nt, Human
cgagaaaguuuucuaacaucuaguaauuuguaacuuagaaguggaguugccuuguggaugucuuuuuug

SEQ ID NO: 4234239 - RNA, 130 nt, Human
ugggacacacaucacaggcugccuuuguauuucacugguucugccacuuuccccuugaggacuguaaacuccccaagggcagaggcagggccccggggauuucacagggcagucuggcucccuucuccca

SEQ ID NO: 4234240 - RNA, 94 nt, Human
uguagaaauuuggaaauguagaaaagcagauugaagcauuugaggguauuuucuuugaaguuggucuuucuuuuacauauuugugauuuuuaua

SEQ ID NO: 4234241 - RNA, 92 nt, Human
agccccaucggggagacccucucagacuuccaggcacagaccacggacgcuuuuguuccuggaguggagggaggugacccgagacuggggcu

SEQ ID NO: 4234242 - RNA, 129 nt, Human
gggagcccagacccuguagggaguuuuguuuuccuuucuucucuuggguguggugucuuguguuucugaaugugaacccaaagacccuaccccuggagaggaagcaccuuccucuuuguguuggucucc

SEQ ID NO: 4234243 - RNA, 65 nt, Human
gaacauggccuuucucaguggugcuuuuuuucuaggaguuucacguagaucaggguccaggguuc

SEQ ID NO: 4234244 - RNA, 85 nt, Human
aagggggauggaguaaaagaugaggcaguagaaaugccuuugaaugguuuucuguagcuaauucucuuuaaauuuuguccugcuu

SEQ ID NO: 4234245 - RNA, 70 nt, Human
agugugacugaaaaugauugagugucggagaagcccgccauccuucugcucgauuauuucauuuugcauu

SEQ ID NO: 4234246 - RNA, 59 nt, Human
agcucugugcaggcagaggcauggaucccuguuucugaucagccucuguugacagaguu

SEQ ID NO: 4234247 - RNA, 55 nt, Human
acgccaggagcuucuccguucaccaaagagagggaacggccucguuccucggugu

SEQ ID NO: 4234248 - RNA, 62 nt, Human
cagcuccaucuugcuuauaccagagcugggguugacaguggguucaaagccugaugggguug

SEQ ID NO: 4234249 - RNA, 73 nt, Human
uacuucaguuacaugaagguauucuggcauagcaauaaaacaaccggaaaguccuuugaguguguuugaagua

SEQ ID NO: 4234250 - RNA, 115 nt, Human
ggugacuauaguuaauaaucauguauuauauacuugaaaauugcugagagagaucuuaaauguucucacaacaaaaaauaaguaugagaggugaugcauguuaauuagcuucauu

SEQ ID NO: 4234251 - RNA, 85 nt, Human
ccucugcaacccuuuggcuuuugaaaaggugauguacagcuggugcuagcuguauauacacugauuaggauuuucugggcagagg

SEQ ID NO: 4234252 - RNA, 59 nt, Human
agggguagaacagaaaccugccugcacuguuaaaggcaguuguagcuguuucuacuccu

SEQ ID NO: 4234253 - RNA, 63 nt, Human
cagagcuccaguugugucuuguaagaauuggucauuguuucauggggacgacuggcuccuuug

SEQ ID NO: 4234254 - RNA, 63 nt, Human
ggccaagaacaucguggcacgucgccgcagcgccuccgcugcugucaucgucuacggugggcc

SEQ ID NO: 4234255 - RNA, 85 nt, Human
guaugcagguuuauaucagaaggugagauugaauaaugcuugaugcagaaucgaaacuucucauuuaucuguauauuauguuuac

SEQ ID NO: 4234256 - RNA, 119 nt, Human
aguuucugcccaaggcugaaguuuagaaaaagugccuucucccuagcgaagcagagaggaaauagggagccuucaacaggugcacugguacaggcuucaguuugaaauagggcaaaacu

SEQ ID NO: 4234257 - RNA, 125 nt, Human
agucuggguuuacaaaggcgagauucaaagcuuuucaaacaggacagguccucugguucccugugagaagagcccaggacccacccugugaaaguucaucccaccuaaauuuguucaucuggacu

SEQ ID NO: 4234258 - RNA, 112 nt, Human
ggaaauguuaauuaccuuuaccagcuugaaagcaaauaguugcuuaauauuagaaaauaauaacgaaagcaauuauuuucauucuuucuauaagcuaaaguuauauaacucc

SEQ ID NO: 4234259 - RNA, 56 nt, Human
gcgucggagcggcugcacagggggucagcuggcuguccuguggccugcuccggugc

SEQ ID NO: 4234260 - RNA, 88 nt, Human
gaauuaugagauccaagcuggguuuggcugugcuugaauccaggcucuggguucauuucaagucuaauccauuugccucuccuuauuc

SEQ ID NO: 4234261 - RNA, 59 nt, Human
caccuccauggcucagguuccaagauguaacauucacuuggccuaggcacaggcaggug

SEQ ID NO: 4234262 - RNA, 93 nt, Human
uugagagcuagaaggaagcauuucuagaaggagagaaacaagguguagguugaccaaacauuugccuggguguguuaucuuccuuguucucaa

SEQ ID NO: 4234263 - RNA, 66 nt, Human
gcauugcuuucacugcaauagaugaaugucaugaaaauguucuucucuuguaauggaaucagaugu

SEQ ID NO: 4234264 - RNA, 82 nt, Human
guggcuuuauuuggugguguuacuguuguuuauucuuuguuuauaugggagauucaaaguaaagccuauuuaauaauaccau

SEQ ID NO: 4234265 - RNA, 91 nt, Human
gcugugaguguaccuggacaccucaguguguggauguuagagaccaguguuuccucauuuggcacaucugagcucagcuuggcaccacagu

SEQ ID NO: 4234266 - RNA, 78 nt, Human
cucccgccccacccuucuuuccacgccccuccggagcucccggggaggaagcuggaacacgggauugggguucgggag

SEQ ID NO: 4234267 - RNA, 83 nt, Human
ccauuauaaguuucuugaagacugauguuuauugccucuucuuaaguaauuauaggcauauaguguuuaaaaaaauauauugg

SEQ ID NO: 4234268 - RNA, 83 nt, Human
ucucagauaaucauguaacuggaaucacauggcauauaagcuuuugugucuggcuuucuucaguuagcaugauguuuuugaga

SEQ ID NO: 4234269 - RNA, 58 nt, Human
aggguuugugaagacuuggccagcucuccguugacaauggccaaggaauagaagcucu

SEQ ID NO: 4234270 - RNA, 60 nt, Human
gaggaugacaaagaaggcagacagauguaaagucugcaauuucuguugcuuuguguccuc

SEQ ID NO: 4234271 - RNA, 69 nt, Human
caguugcagagugauguguuugugucauuguugaugucaccuccuaaaaagaccuucacuuucuggcug

SEQ ID NO: 4234272 - RNA, 61 nt, Human
cggcuucucgggucggauuccgcggucccaacccuuccccauggccgacccugaggaguug

SEQ ID NO: 4234273 - RNA, 66 nt, Human
ggaagccaacacgugggagggagccagguuuucuccucauaucuucuuuccauguguuuugguucu

SEQ ID NO: 4234274 - RNA, 81 nt, Human
guuaacuugauguaucauguauauuuuugcuauuagcaugagcuguaguacuuagaaguauacugaaacuacauaguuaac

SEQ ID NO: 4234275 - RNA, 81 nt, Human
gccacgcuccguguauuugacaagcugaguuggacacuccaugugguagagugucaguuugucaaauaccccaagugcggc

SEQ ID NO: 4234276 - RNA, 76 nt, Human
uccugcuaguugggugggagcaggcaggggcagcacucagaccuggugaccccuaaacccgcugggcuggcuagga

SEQ ID NO: 4234277 - RNA, 59 nt, Human
agcuugauggauugcugaggcagagugcaccgagcaaggguucaguccuccauagagcu

SEQ ID NO: 4234278 - RNA, 60 nt, Human
ggggagaugauaagugcauuuguuucaccaagagugguuuaagaacauuaucuucuuccu

SEQ ID NO: 4234279 - RNA, 107 nt, Human
gcccuuagaaauuguuaugauugucccagaaauccaggcuuaaaugauacucagguguaauauucaagauaagggucugggagaauauaaaauauuaauuugagggu

SEQ ID NO: 4234280 - RNA, 69 nt, Human
ccacccagacuguuuucccaucucuuggcuuuuccagcaccaagccagaggcuuaugcagcugcugugg

SEQ ID NO: 4234281 - RNA, 75 nt, Human
cugccucggccucccaaagugcugagauuacagguaugagccaccaugccuggccucuucagcacuucugagcag

SEQ ID NO: 4234282 - RNA, 64 nt, Human
gguggaggaggggguugauaauuagagaaaugccaauuuuguggccucaaccuccuuucucucc

SEQ ID NO: 4234283 - RNA, 112 nt, Human
gaggagaacuggacaaguaagacaaugguuucuguucuguuggauucuuuaacucaguuggaguucacagcaauggaacaguugaaguguuuuguuuuuguuuguuuuucuu

SEQ ID NO: 4234284 - RNA, 59 nt, Human
ccagccacugacugauuuaaaacccagaaaugugguuuuaaacaauguggucguggugg

SEQ ID NO: 4234285 - RNA, 106 nt, Human
gguuaacugcaaagcaggaaaaggcggcucggggcuggaacguuacucccucugcucaugauccagggagaaguuuugggcccccuucucucugcugcugauggcc

SEQ ID NO: 4234286 - RNA, 118 nt, Human
gguuuccagaugacccucagguucuuccgcguugguuagagagggcuacgcaucuucuacugcucagccacagucuguagccagcuuagagcuuagaagacauugcagucuggaugcc

SEQ ID NO: 4234287 - RNA, 61 nt, Human
ugagugccaucuuugccccuauuuuagggauaaggauucugaaauguggagaugguaagua

SEQ ID NO: 4234288 - RNA, 73 nt, Human
cugcgcgacucggaggccaaggccaacggccucucggacccggggccgcuggccgacuuccgagagcccgcgg

SEQ ID NO: 4234289 - RNA, 78 nt, Human
ggguguagcgugguauccuaagguaguuuuaguuuggauuucuccagacuucucuaacuugaggaccuuuucauauuc

SEQ ID NO: 4234290 - RNA, 91 nt, Human
augaaucucauaaacauuaauaggaaggaaauguuuaccuguucagauguuccuuauaggcauuuucuuguuauuuuuaagguauuuucau

SEQ ID NO: 4234291 - RNA, 95 nt, Human
aaauucucuggucuagaaaacccauggcucucugggaugcuucuuaugcuuuucaggaguuucccucacaggucugcauuucuaucauggaauuu

SEQ ID NO: 4234292 - RNA, 56 nt, Human
gaaaaauuucuggugaaaugccucuguuuugagagaggugcccaggauuauuuuuu

SEQ ID NO: 4234293 - RNA, 77 nt, Human
gaaauggaaugcauaaauauuguugggaguauucauuugaauuuugagcuuuacuuaaaacacauuuagcauuuuuc

SEQ ID NO: 4234294 - RNA, 64 nt, Human
gcaaaggaucuuucuuuuuaccauuuuaauagccugugcaaugggauuaagaaagaucuugggu

SEQ ID NO: 4234295 - RNA, 66 nt, Human
guaagggaagaggaccagagucucugccucguaauccagagaauucuucuggaucuuguccaagac

SEQ ID NO: 4234296 - RNA, 64 nt, Human
uggaauaugucacacuccuuaauagggaccugugacuccuuaauaaggaccugugacaugccca

SEQ ID NO: 4234297 - RNA, 87 nt, Human
uccucugaacugggucggucuguuguauggcugucuaauuuguugcaaauucugcagucguacuauaauucaggccuguuugguaga

SEQ ID NO: 4234298 - RNA, 59 nt, Human
gcgauugguuuggggccagagugggcgaggcgcggaggucuggccuauaaaguagucgc

SEQ ID NO: 4234299 - RNA, 69 nt, Human
cuuucacacagcagcaucauuuaucugguaguagcaagacagccguaugacuuuuuguuguuguuaaag

SEQ ID NO: 4234300 - RNA, 65 nt, Human
gagcagcaggcugggaugagucuggguggagaccucuagaaggcacagaauccagucugcugcuc

SEQ ID NO: 4234301 - RNA, 108 nt, Human
ccaguccgucggagaagcgcucuuugauuggccaguggacagcgccguggcaugacgcgcuggggcgcuggccaaucgguugagagcugagcuggacuuggcgguggg

SEQ ID NO: 4234302 - RNA, 87 nt, Human
uagaaaauacuaagcagcaauaaaacugaaggugucacugggauaugccagcaccccuuaaauuuguuguuuaaauuaguguuucua

SEQ ID NO: 4234303 - RNA, 56 nt, Human
uggccuggaucugcagagcagggcuucagaggaggcaguggagcuggaauaggcca

SEQ ID NO: 4234304 - RNA, 57 nt, Human
uuuucacucaugagagaaaacgugcuucucagauucugaaggcuuucugagugaaaa

SEQ ID NO: 4234305 - RNA, 76 nt, Human
ucacuugagucugggagguugaggcugcagugagucgugaucacgccacugcacugcagccuggccaaccgaguga

SEQ ID NO: 4234306 - RNA, 128 nt, Human
cuuucaucuucuuaaaggcucuucucugaacuuccucuguaggacuggggguggagguagcugagaaccaucaccuuugagucaucaggcuguagaucuagacauguaggcccaggaagaguagaaag

SEQ ID NO: 4234307 - RNA, 64 nt, Human
ucuugacucuuucauuuauuauuuuuauuauauuaaguuucagaugaugaauaaagagugagga

SEQ ID NO: 4234308 - RNA, 91 nt, Human
gcuuuauuaugauuuccacugugcccagccucagggcaucagcuucuucuggagcgcugugaaggcugggccacgcagaggagcaugcagc

SEQ ID NO: 4234309 - RNA, 61 nt, Human
gauuaagugaauuggagaaaaggguaucaucugaacaaguuugcuccucuucauuuguauc

SEQ ID NO: 4234310 - RNA, 79 nt, Human
uccuuccucccuucaggggaggacuagggaguaaguacuuuuuguaaguuuguucuccuggguugaagggagggaagga

SEQ ID NO: 4234311 - RNA, 76 nt, Human
agguuguaucauaugaaacuguuguuuuuauagguaaaauacggucaaauaugaguaauuuccuaugauucagccu

SEQ ID NO: 4234312 - RNA, 72 nt, Human
auuugucaccucauacaguaccucauaaugccucauauuugcuaagugaucaguacuguaugagggaugaau

SEQ ID NO: 4234313 - RNA, 69 nt, Human
gggcggcugaggcuggcguuugaggaagcccggaaaugggccucuuucaccgugccugucccgcuggcc

SEQ ID NO: 4234314 - RNA, 90 nt, Human
gacuaaggaguagugauagacauuuauagagaaugacuuaacacuucagaaagaucacuuugauuagauguccuuuaguauuugguauuc

SEQ ID NO: 4234315 - RNA, 60 nt, Human
cagcccaucaaggggauccugaagaacaagaccuccaggacuuccucuaugguggcguug

SEQ ID NO: 4234316 - RNA, 56 nt, Human
uugaggaggugggcacacagagucagcauccacucgauucuuguuccauuucccag

SEQ ID NO: 4234317 - RNA, 90 nt, Human
aagcaauccaaguguauuuaaagaguaauacaauccaaacaacauuguguggagcuuuguguauuuuuaaugacacuacuagacuugcuu

SEQ ID NO: 4234318 - RNA, 60 nt, Human
uacuggaugcaacaaagcccagcaaaacccagcugugagacgugcuaguuguuuccagua

SEQ ID NO: 4234319 - RNA, 83 nt, Human
ucuuucuugcucugauugcaccauagagaagagacacaaagauucccuuugcuuugcuucuuuauggucaggacuaggaaaga

SEQ ID NO: 4234320 - RNA, 86 nt, Human
aagcuaaaugaaccugaggguagacaaguucacucuguauuaaccaaaggauaaugaaugaguucaccgcucaguucaauaagcuu

SEQ ID NO: 4234321 - RNA, 69 nt, Human
ggggaauggugaaggggaagcagggagaggagagagagcuuccucuccuugcuccccuuccuucucccc

SEQ ID NO: 4234322 - RNA, 65 nt, Human
auuggacauuguuguuggauccuuggugucuguaugaaggugcugggucagauacaguguuuggu

SEQ ID NO: 4234323 - RNA, 88 nt, Human
cggcugugggaggguugaggagccgggccugggcccugcgcaccucccggggcagcucgcccugcuuggccagauucucccauagcug

SEQ ID NO: 4234324 - RNA, 69 nt, Human
gguuuauucccacaaaggaaguaaccuucaaggguuuaaaacaaacuuccuuuuuuggggauagcagcu

SEQ ID NO: 4234325 - RNA, 78 nt, Human
guaugaaauuuuguugaaaaauauuuuaaaaucuuguauaaaugagauggcauaauguauuuuuaggcagaauauuac

SEQ ID NO: 4234326 - RNA, 67 nt, Human
ccacuggauucucuuacacagaugccaauaagaacaaaggcauuaccuggggagaggauaccgaugg

SEQ ID NO: 4234327 - RNA, 66 nt, Human
uuuuaucagagcuugcagugugcugaaugguuagcaaagagaguguacugcaagagacagaugaaa

SEQ ID NO: 4234328 - RNA, 58 nt, Human
ugagcugugaccaguuacgaaauuuuacuggaaauguuuaacuguggucagcagucca

SEQ ID NO: 4234329 - RNA, 91 nt, Human
guaucuuugaucugucuaaggaaaaagucuauuuuaaacugugaagugaagccaauuuuuuuaggucagauucuuacccaacaaagcauac

SEQ ID NO: 4234330 - RNA, 91 nt, Human
ccugauggugcucacagggccagcagcuuggccaaccuuggggagcugugccagaggcuggacuuucugcugggcuccgugguccaugagg

SEQ ID NO: 4234331 - RNA, 87 nt, Human
agcgcgccagcccuuggcagccccggagcagucgggcuccgggaggaaacuccuugggagcgcccuguccggggugcccucugcgcu

SEQ ID NO: 4234332 - RNA, 57 nt, Human
acaugcuuucuagguccuucugaguuuuaggauccugagggauuugguugguauugu

SEQ ID NO: 4234333 - RNA, 105 nt, Human
cacucuugguguugcccaggcagagagggcaguguggagggaaguugcuagaaaaaggcaggggacauaauccauacuggccucuuucccaggcacaucacagug

SEQ ID NO: 4234334 - RNA, 71 nt, Human
gaauucaguuugcuaguguuugguugaugguuuuugcauuaauaaucaucaaggauauuggucuguaguuu

SEQ ID NO: 4234335 - RNA, 89 nt, Human
ucaguguauacaacaaucauuuuuccccuucaguucugcugcuuuauacaacagugugauugacagaaaauuggauggcaugugccugg

SEQ ID NO: 4234336 - RNA, 79 nt, Human
uucacuuacuguucugaggaggguuucaagguucuguguuuaaagucaggauuuaccugucuguagaacauaaagugaa

SEQ ID NO: 4234337 - RNA, 80 nt, Human
gucuuauaggugguauuuaaaauuauuuggcucuuucaaauaaaaaggggagugaauaaucuuggguauuaauaaaaggc

SEQ ID NO: 4234338 - RNA, 109 nt, Human
ucuccgcgccauggcagugauggagaugggucccuggccgcccucggggcacagguggcccgcagggcccggcgggcucagcagagcacgggcacgccguccguggaga

SEQ ID NO: 4234339 - RNA, 128 nt, Human
uccaugugcaauuuuccucugauaguuucuggucacuguugccacggugauaaugacugggcuaugucauuaucuauccgccaacaguaagagaagcuuugcagucgagauauuguuuagcagaugga

SEQ ID NO: 4234340 - RNA, 97 nt, Human
gcgccggagccacgagccgcgcugcuggcggagcuggcgcugcuggagcccgaggcgcugcgcgagcacugccggcgggcggcggaggccugcgcgc

SEQ ID NO: 4234341 - RNA, 70 nt, Human
cucaugagucugucagagucaucgugggagggagaaccuuuguaaaccugaagacaguuuuacucaugag

SEQ ID NO: 4234342 - RNA, 129 nt, Human
gaauuucacagaaagucugaguccugaaggguuaagagauuuauugaggacuuccaggauauccacacagucaggggaagucagaucuuuugacucccaagucuaaacuucuuuccucugugcagauuc

SEQ ID NO: 4234343 - RNA, 77 nt, Human
gguguuccauguguagcguaugcugugugaugaauggguuucaaagugacguucuuuacuucgcaucugcuaacacc

SEQ ID NO: 4234344 - RNA, 62 nt, Human
ucagcguuaguuuuucaucuaaaccuggggugccuggcccagcacuuagagcuacauguuga

SEQ ID NO: 4234345 - RNA, 70 nt, Human
cuggacgagcaguagauccagcagccugcagcuccaaggaacauugccucucuggaucugcugugaccag

SEQ ID NO: 4234346 - RNA, 77 nt, Human
guagaguauuuugagucuggcaguuuuguucucauuaacagaucaagacaaaggaaaggcuaagaaaaaugcuuuac

SEQ ID NO: 4234347 - RNA, 77 nt, Human
uacagguuucuuucagauuauguucauggguuuguguguauacgauaugaagaaugaucugaaguaauugugcugua

SEQ ID NO: 4234348 - RNA, 69 nt, Human
uccuaaaggaaacuaugaaucucuggcucaugccaugaaagucaguaagauugauauuuccccacagga

SEQ ID NO: 4234349 - RNA, 105 nt, Human
ucuuauccgcugaaucaaggucaaacucugaaaggcuacaaaugcucgggaaccccguagcagagggucaguuuuuuaguuucuguugaguuuuucaggauggga

SEQ ID NO: 4234350 - RNA, 83 nt, Human
cugaagccagccuggcucaguaaucgagucuccuggagaaaucuacacuggggaggucgaggcugggccgcaggcucauucag

SEQ ID NO: 4234351 - RNA, 105 nt, Human
ggaaggugcaacguaagagcagacacaaccugagaugcccuugagauuuaggagaacaggagggcgcccuuucuguugugaccugacucuuaaaagaaaucuucu

SEQ ID NO: 4234352 - RNA, 130 nt, Human
cagcgggaggcuggcucuccuacccuugccucucccucuaggggcgggaggcuggcucuccuacccuugccucucccucuaggggguauguccuccugcagggccucuggacauggccugucucuagcug

SEQ ID NO: 4234353 - RNA, 57 nt, Human
agagaagaauccccugguggaguuuguggaagagcucccugcugggcgaucuucucu

SEQ ID NO: 4234354 - RNA, 67 nt, Human
uuucuccuuuuuauaucuuucucugagcuccauggccagaacagcucagcagaaaugagaggagaaa

SEQ ID NO: 4234355 - RNA, 74 nt, Human
gccaggcacauguaaguucacagucgauguugcuguuccggcaucuguuguguuaauuuacaccauuccccggc

SEQ ID NO: 4234356 - RNA, 57 nt, Human
ucuugcguaauuugagauuguaaaaccuagaagguuucuugucuuuguuauguagga

SEQ ID NO: 4234357 - RNA, 56 nt, Human
cgggcuuguaggugauggagaacucgcccagguaguggccgaucaucucgggcuug

SEQ ID NO: 4234358 - RNA, 84 nt, Human
cggcugggaaaguaucaaaauucggggaguuuugaggauccaauggguccugaaaaaaaucccugagugugcuaagcaucaccg

SEQ ID NO: 4234359 - RNA, 57 nt, Human
gacuauugcacacuucucucaccccgcucgugggucuuagaagggcuggcaggaguu

SEQ ID NO: 4234360 - RNA, 72 nt, Human
ggauaagcagauuguacagugcauuagucccugucucuuggauauugagccuuuucugcaauuugauugucc

SEQ ID NO: 4234361 - RNA, 86 nt, Human
gauagaugcuauuuuggguguuaacaaugaaaagacaauuauacaggccuuuuguuguauuaacccaggguaaauaugaaucuguu

SEQ ID NO: 4234362 - RNA, 76 nt, Human
ucacuugaacccgugaggcggagguuacagugagcaaagauuuugucacugcacuccagucugggugacagaguga

SEQ ID NO: 4234363 - RNA, 130 nt, Human
ucacuuuaaaaauuuaaaagaggagcccgucuggcuuccgaucagaucacucugggcggcgggagauagcucccuuucucccucgccccggguucuuucuggauggccgagcagauccucuuuaaagaga

SEQ ID NO: 4234364 - RNA, 112 nt, Human
agcgcuggggagaggaugaaggcagagagcgcgggugagucacgggcggagcuggccuuguucgcucgcuggcuccugcccgcccuccguccuccgcccucucgccagcgcu

SEQ ID NO: 4234365 - RNA, 81 nt, Human
ggugacccugcagguauguggcaggugggagaucagauaagcacguuauuaugacccccugcacaugugacuguggugacc

SEQ ID NO: 4234366 - RNA, 79 nt, Human
cacuaaguaauuuccacuccuacguauuuugauauagagauguugcuauuuuucuauuuacagugcuagguacauagug

SEQ ID NO: 4234367 - RNA, 56 nt, Human
uggcacguuggauugggaguucgcgucguggaugucucauacguuuccagguguca

SEQ ID NO: 4234368 - RNA, 65 nt, Human
acuugcucaaggucacacaggggugauugauggggucacccagacugucugacucuugugugggu

SEQ ID NO: 4234369 - RNA, 56 nt, Human
uguauguguuuuauguguguuuaaauaaauauguuagauacacguguauacauaca

SEQ ID NO: 4234370 - RNA, 78 nt, Human
gggcggcuggcgggggcggcgugggcgcggugaugcaggugugacacccgccggcgccugccuccgcccggaucgccc

SEQ ID NO: 4234371 - RNA, 84 nt, Human
gagggcaggggaggggcucagucuuucuuggcagcagcuuuccucauggcggccaguacguugcucagcuccucccgcuuccuc

SEQ ID NO: 4234372 - RNA, 71 nt, Human
cugcccugcagcuccacggacucgucuucucgggucaucccgagucccccccucuguggagcucagaguag

SEQ ID NO: 4234373 - RNA, 60 nt, Human
ucuggcaguugccgcuucagucuuggccuuagccucaucuugaaguggguagcuggcggg

SEQ ID NO: 4234374 - RNA, 80 nt, Human
cccaacuucuucauuacagcaaccauuugacuuagauucauuugagaauaaucucgagauguuuguuguggugaucuggg

SEQ ID NO: 4234375 - RNA, 74 nt, Human
uauguauggacagcuuucuuuguguugaagaacuguaagauaguaaaaaauggaaaggagccugacuauauaua

SEQ ID NO: 4234376 - RNA, 82 nt, Human
gaacaaucuaaaggaccuguacuagguuuaacauguugagcauuacucauguuagaccuaguacacguccuuuagauucuuu

SEQ ID NO: 4234377 - RNA, 56 nt, Human
gacacucuuaauccuaucccugaaaccaauaugguaaggauaagguuggagugauc

SEQ ID NO: 4234378 - RNA, 107 nt, Human
gaagucuaugaaagccaacauuuguggugagcagggaacgucaguuaaucacauauuagggaugauuccuuuguucauugugcaaaagugguuucuagcagacauuc

SEQ ID NO: 4234379 - RNA, 104 nt, Human
gaaauaaaacagacagugcacuccaggugggauuuugcugcuugaaggaaucccuuagucaagcaaggaauccuuuuguaaaguaagugcucacuguggauuuc

SEQ ID NO: 4234380 - RNA, 78 nt, Human
uaaauuuuagccagcaucugggucgaaggagucaggaauaacauuuccucgauccaggaaggcugguuuaaaaauuug

SEQ ID NO: 4234381 - RNA, 69 nt, Human
ccuggaguaucaucuuuuucaaccuccucaugguauagaugaggaaacugagucuuagagaacuucagg

SEQ ID NO: 4234382 - RNA, 81 nt, Human
ccucuuguuucuacauuuguaaccagauucaagucucaccaggccccagagugugaguuacaaagugugaaccaugagagg

SEQ ID NO: 4234383 - RNA, 71 nt, Human
auaaguaauaguggcuuggacuaaauauuuguugaauaaauguuuuaaaaaacaggcuaccuacaauuugu

SEQ ID NO: 4234384 - RNA, 55 nt, Human
ggcugugggguccugugguguguggggagcugucacauccaggguccucacugcc

SEQ ID NO: 4234385 - RNA, 122 nt, Human
ugaggucuguaauuucuuuaauaguuuuguucugguguugggucuugcuuuuagucauugugcuaugguuagguaagauguuaacagcugagauaacugggugaagaauauucagaaacuua

SEQ ID NO: 4234386 - RNA, 71 nt, Human
ggaguuguuauagaauguaagaaugcaaagauugaauggucaaugugguauuuuggcauucuuccaaaucc

SEQ ID NO: 4234387 - RNA, 78 nt, Human
gaaauguauucuaggggugaaggaucuaggauguaccugcucgucauuuccugacuucaccuuuuaccaauucuuuuc

SEQ ID NO: 4234388 - RNA, 61 nt, Human
guguguguguauauauauguaucauucauguauguauguauguauguauauacacacaugc

SEQ ID NO: 4234389 - RNA, 74 nt, Human
cagacuggccugggugcugugggguggaggggucccucauucuggcuccacccuagagggcccaugcaauccug

SEQ ID NO: 4234390 - RNA, 74 nt, Human
ggaggcggcggccucuuugcugccucaggugccaucucuuacgccgagguccugaagcaagggccccugccucc

SEQ ID NO: 4234391 - RNA, 82 nt, Human
gggcucaagggggcucuggagaagaggagcuggaagccugggccucccauguacccaccuccauucucaucugccugggccc

SEQ ID NO: 4234392 - RNA, 79 nt, Human
aaaauggugcaaagauggcaguugcaauuugaacuugagcucuaaaaauggucuauuugugguuauauuugcccauuuu

SEQ ID NO: 4234393 - RNA, 63 nt, Human
gaguuggggcugcguguuuccacguuuucugaagguucacauaaacaugcagccugccaauuc

SEQ ID NO: 4234394 - RNA, 64 nt, Human
gcugggguauccguuaguaagaugggcacggucccucgcugccugcucugauuuuugccccagc

SEQ ID NO: 4234395 - RNA, 58 nt, Human
gucugaggagaggcagcauaacuaauuagcauaacuaauaugcgaagccuuucuggac

SEQ ID NO: 4234396 - RNA, 57 nt, Human
ccuugugauugaucuaaguugccccucuugccaaagcaauuuagaguuuuaccaagg

SEQ ID NO: 4234397 - RNA, 62 nt, Human
ggguuccugaagugguucaggagcuuccauuaacuucgccuguggaugacuucaggcagccu

SEQ ID NO: 4234398 - RNA, 61 nt, Human
ccaaccguguucgggaacacuugucagaacuacaauugacaaguguuuccaauauggcugg

SEQ ID NO: 4234399 - RNA, 60 nt, Human
guugggcugaagugugugcuuauaaauguguuuaguuuuuaagcuaaacauucaguuaac

SEQ ID NO: 4234400 - RNA, 66 nt, Human
ggaggggagggagugggcccgugggcacagcgcaggcuggugcguggcccauccuccacccucucc

SEQ ID NO: 4234401 - RNA, 96 nt, Human
ggaugaacugacaucagguccgucgaugcuggcgcagguuucaccacacgggaagcugucugcccggcgcucaugggaccugcucucaggcuuucc

SEQ ID NO: 4234402 - RNA, 61 nt, Human
gccaacaaguugauuucacgcugccgcugcuguuguugcagccugaguuuagcucgucggu

SEQ ID NO: 4234403 - RNA, 75 nt, Human
uuguguggaguuuaucagagagcagaggugggcuuuaagaggcucacuagugguuucuggugguugcuauaacga

SEQ ID NO: 4234404 - RNA, 83 nt, Human
uuaugcguuaaaguauuuuaaaauacauuauccuuguaauguauuuuacaaggauaauguauuuuaaaaugggaguugcauag

SEQ ID NO: 4234405 - RNA, 75 nt, Human
ugguauugaauuauaugguauugaacaugcagucuuauagucacucauguuccuuuaaaauauagauuggcauca

SEQ ID NO: 4234406 - RNA, 99 nt, Human
ggccuaugaauaagcaaaagaccaaaaagccucuguuuuuccuuuuaaaauguggagauaauuaagacugcccauguuuuuauuuguuugacuagagcc

SEQ ID NO: 4234407 - RNA, 69 nt, Human
cauggagugauggggagagcgcagcuuuggagucagccaggccugcuccucuucucauccugcucccug

SEQ ID NO: 4234408 - RNA, 57 nt, Human
agugcgagaugaggacagaagcacgacgaaaaaaucuucucauuuugauuucgcauu

SEQ ID NO: 4234409 - RNA, 88 nt, Human
aguuuaauuaaauguuuaguuuuauuuuaguaauacuuuggccuuuguaguugccgagugguaaaguguacugaauaugaauaaagcu

SEQ ID NO: 4234410 - RNA, 120 nt, Human
ccccacccugcuacucaagaccauugaggccacgggguuugcugaaacuccucaaaaacugacaaguuuccacuggagacacuguggagaacauggucucagggaaauaacucucugggg

SEQ ID NO: 4234411 - RNA, 58 nt, Human
gagcccuguagcaagucaugucccuguaacgaugagugagcugacagcuaaggggcuu

SEQ ID NO: 4234412 - RNA, 57 nt, Human
ucuucaugucacugucuuagguaaaugugaacauuuauguauaacuugauaggauga

SEQ ID NO: 4234413 - RNA, 64 nt, Human
gugucuuggaacuggaauugaguuucgauguugaugaacugauucaaccagguguugaaggcac

SEQ ID NO: 4234414 - RNA, 59 nt, Human
gcagugccauguggaggaucucccuacaguagagaaaagauucucccuccuggcgcugu

SEQ ID NO: 4234415 - RNA, 57 nt, Human
ucaacagguucaagccuugcagcagccaggcugcuggagucucuugacccuggguga

SEQ ID NO: 4234416 - RNA, 62 nt, Human
cuguuaucaggaguuuucacggugucauugaccaaagaccaagugaaguuuucugaagacag

SEQ ID NO: 4234417 - RNA, 77 nt, Human
gcagagcugucuuccuucuggaggcucuagaggagaauccauuuucuugccuuuucuagcuucuagaggcugccugc

SEQ ID NO: 4234418 - RNA, 86 nt, Human
ggguuaagccaguccucccucaccucagucugggccucaucaugccccucgcacaugacccagacccagagggaggcagguugccc

SEQ ID NO: 4234419 - RNA, 84 nt, Human
ugcaacaaugcauugcaaccauuccaaauggcugacuaaacaaauuaggaugcuauuggcuaauuguugcaacacaguaaugca

SEQ ID NO: 4234420 - RNA, 57 nt, Human
caccauccaggugagggagaccugccggcuucucuguaggcuccuccaggaugugug

SEQ ID NO: 4234421 - RNA, 85 nt, Human
uguggacagggauggggaggcuggggggcagaggcuugcugaugaguuuggugucuccccacuggucuuccagugcccauuugua

SEQ ID NO: 4234422 - RNA, 56 nt, Human
agggcaggagguccgucccuucagaaucucccugucaggacacggcuuucugcccu

SEQ ID NO: 4234423 - RNA, 103 nt, Human
aguggguuuuggcuuuuagaaguaucaggugugagcauuuuaauuucugaauuuaaggagcauugaaaacugucaccuuuauuccuuugucuaacaaucuacu

SEQ ID NO: 4234424 - RNA, 75 nt, Human
gcgaggaucgcggucccggcccgcgcgcacagagacgccggucccugccaccagcgccgccauccgcauccucgu

SEQ ID NO: 4234425 - RNA, 67 nt, Human
uggauaaaggccgagaugacagagccacugcuucaucacacugacucacauuuugguuugcaaucca

SEQ ID NO: 4234426 - RNA, 58 nt, Human
ugugaagcgugugcaggggacagcagacaucagagcucuccuguaaaucaccuccgca

SEQ ID NO: 4234427 - RNA, 120 nt, Human
guaacauuugucuguuccagugauguaaggauauuaaguuauuaagcuaaauauuaauuuucaaaaauaguccuucuuuaacuuagauauuucauagcuggauuuaggaagaucuguuau

SEQ ID NO: 4234428 - RNA, 80 nt, Human
uguuucuuggagaguucaccccacugaugagucuuccuucccuguuggacucagucauuuggggaacagucuuagaagca

SEQ ID NO: 4234429 - RNA, 95 nt, Human
gggcagaaaccggagcuaaggcgggucuagggcccuggaguugagccaggggcugcugcacgguccuggcaccacgcauguccgccugucugucc

SEQ ID NO: 4234430 - RNA, 62 nt, Human
ugagucaccucucagaagccaccagcccaaaauaggacuauugcuugcggacagguggcuca

SEQ ID NO: 4234431 - RNA, 65 nt, Human
aagguauuguuuuaguagaaguuacaugaaguauauucauuuaucacuugcuaaacauaggccuu

SEQ ID NO: 4234432 - RNA, 128 nt, Human
ucugaguauucuguggggauaagugauuuuuuguuauuuuugugcuuuauugggguagaguuugauuucauauucuucagcauaaaaauucuuggugaauguguuuuuucuuuuuacagaaacccaga

SEQ ID NO: 4234433 - RNA, 102 nt, Human
uccuccagcugauugauuuuucuaauuauguuugcuuuagauggauauuuaaaugcauuugcauucccugagcucacauggcaggauauggagguuggagga

SEQ ID NO: 4234434 - RNA, 84 nt, Human
ggcgaaguguccuuugagcuuggccagcucuggaaggugguagguucucccucauggguuguagagcuggaaggggacaguguu

SEQ ID NO: 4234435 - RNA, 67 nt, Human
gccucucagagcuguucaguuugaggagccaaaagaaaaucaaaaugaacuuucaguucagagaggc

SEQ ID NO: 4234436 - RNA, 68 nt, Human
gcggagaggcagagacuccgcgcgucgccauuucuggacuaggcugcugcuuucugugcuuuuucugc

SEQ ID NO: 4234437 - RNA, 97 nt, Human
acagacccuucgauucuaauuacuuuaggaaaacuccucggcuaaugaaacuuggagaggguaaauucagaguaggagcuggagaagaagggauugu

SEQ ID NO: 4234438 - RNA, 66 nt, Human
guguggcucagcgcggccuggucuuucccgggaauugcgaggaaggccacacuugcuggccagcac

SEQ ID NO: 4234439 - RNA, 57 nt, Human
ggucuucauucuaccagacuuugcugucggaagagagaaaugguagaaugacaggcc

SEQ ID NO: 4234440 - RNA, 73 nt, Human
ggaaggaguuguucauuuccauuuuauagauaaggaaacuuaggcuaauagagauggaaugauuugcccaguc

SEQ ID NO: 4234441 - RNA, 84 nt, Human
uuuaacucuauauugcugguggcucugauuucaugaugcauugugcuuaugaaacucuagcuuucagcacuaaaaugaguuaaa

SEQ ID NO: 4234442 - RNA, 64 nt, Human
ucaaggcuuugugcugaguugucguuugaaccaagcaugauguuaucaagcacaaagcacgugg

SEQ ID NO: 4234443 - RNA, 75 nt, Human
gagagaucugacugcugucuuuauuucacugcuaaauuaagguuaagcaaaacuaaagacacagacagcaaucuu

SEQ ID NO: 4234444 - RNA, 60 nt, Human
uucccuacuagccuuaauguuuuccccaaaacugugagguggaauggguucuguagggag

SEQ ID NO: 4234445 - RNA, 81 nt, Human
agccuugauuaucaggauacaugucacaaguugugcaaaguuccuuuccuugaccuccugacaguaacuauggucauugcu

SEQ ID NO: 4234446 - RNA, 129 nt, Human
uguucugugguugaauguguuuuugcuuaaauaaagcuuuugguauuuguuuaaauuacacuucuugagaaguggaaauuuuaggaucaucuuugcuuuguuucaguuuugugauuuuugaaaugaaug

SEQ ID NO: 4234447 - RNA, 67 nt, Human
gaccccagagggcugaggauaugaacagugaucugguuuuguucuguucuuuguccccuugguuguc

SEQ ID NO: 4234448 - RNA, 88 nt, Human
gaaaaccuacaggaaucuggcugagggagacagugcggacuaauauuucauuucuccccacuccucccucugaggaauccaggacuuc

SEQ ID NO: 4234449 - RNA, 81 nt, Human
uccacauccaccgagggggcgggaggcggcaggaccagcaggggcagcccguucucuucgcuggcccucggggaggucggg

SEQ ID NO: 4234450 - RNA, 86 nt, Human
ugucuugcacugccagcugggucccugcuggggcucugggacuuccacuucucaguccacauaggaacccagcuuccacugaguca

SEQ ID NO: 4234451 - RNA, 84 nt, Human
acaagauauacaggagugauuugucuugucugguuuguaaggauuuuuaaucaccagccacacacauuagucacuggcuuuugu

SEQ ID NO: 4234452 - RNA, 72 nt, Human
aggcccacuaagcugugugguucacucagcaucacguggcuaauaugauaugaagccacacuagcuuguccu

SEQ ID NO: 4234453 - RNA, 116 nt, Human
ggaacgacaauucuacuuuagggauuuuuuaauuuuaagcuauuugucuguuaaguauauaauaccaaaacgcagguuguuuaaauuaggauuuccaaguaauuuaugucgucuuc

SEQ ID NO: 4234454 - RNA, 79 nt, Human
uauuuuggcuccugagcucugaacucugacacacaaagaauaaaaacgucaaaaaggcagaguaacucagugaaaaaua

SEQ ID NO: 4234455 - RNA, 62 nt, Human
cagagcugucauuugccagugagagccuccgacagggcagguacugugccagggcagcucug

SEQ ID NO: 4234456 - RNA, 70 nt, Human
gcuauacuacaucacagccaagaagcggcuagcugcagcagccaaagauuucucugggugaugagguggc

SEQ ID NO: 4234457 - RNA, 64 nt, Human
ggucuuuguugucuuucguauggaacacuacaaguugguccuuuccauuggagacacucagacc

SEQ ID NO: 4234458 - RNA, 56 nt, Human
gcuacaccggcugccacucgggcuuauuuucaaggccaaguggaugcugguuuagc

SEQ ID NO: 4234459 - RNA, 79 nt, Human
gcugaaucauuguagucuggacuuuugggaaacacgugguuuugaccuuuucuucuugcuggagucaaggcuacagagc

SEQ ID NO: 4234460 - RNA, 56 nt, Human
aacuuuuaugaaggaaaucauacauggaaucccaauguaugaaguugauaaaaguu

SEQ ID NO: 4234461 - RNA, 66 nt, Human
gcuccaggucaccgguuuuuagguaaacaugacaugacauguacuuguaauaucagugaaaggggc

SEQ ID NO: 4234462 - RNA, 60 nt, Human
gggagggaggagccccggccauccccacccucguggauguaacugguuuucuucccucuc

SEQ ID NO: 4234463 - RNA, 83 nt, Human
ggguuagggcagaaaggaaggcugggggcugugugugccuuggugacgugucccccucgcucccgagccuuacucuguucccc

SEQ ID NO: 4234464 - RNA, 62 nt, Human
gcaauuguauugucaagacauggcccuagagcuuguucuucaaguuuuggcuguacaguugu

SEQ ID NO: 4234465 - RNA, 109 nt, Human
gggacggccgaggcagcagaagcagccgcucaugggcccggagcagcccugcccacccaagcggccgcucaugggcccagagcagcccugccagccccugcggccgcuc

SEQ ID NO: 4234466 - RNA, 88 nt, Human
gugucuggacagggguaccuggguuaccugucugucccagaagagagggcuggggggagcuacaggucccuuggagucaucaggauac

SEQ ID NO: 4234467 - RNA, 70 nt, Human
uaauaaaaauuuaauucacauucaauuaaaacaaaaacaauaugaguaaugugaaauugaguuuuuguua

SEQ ID NO: 4234468 - RNA, 109 nt, Human
acuguuggucuucuguuuagccauuauucucaguucugugcaggagugagcugaaacaaaguuguauagcccagagagugagaagcugcauuucaugucucccaacagu

SEQ ID NO: 4234469 - RNA, 64 nt, Human
caagaaagcucagcugguggugauugcacccgacguggaucccaucgagcuggcugucuucuug

SEQ ID NO: 4234470 - RNA, 58 nt, Human
gagggggcaggcucggcaccggcccucccagcccggccagccugagcuugcugcccuc

SEQ ID NO: 4234471 - RNA, 67 nt, Human
uaaggcacagagggagugacggccaaccugggaauuagacuaagguuucuuuccucucugugccuug

SEQ ID NO: 4234472 - RNA, 65 nt, Human
ucagacggagggagagagggaggagagugaggccucuuacuugcccccuguccuucccuguauga

SEQ ID NO: 4234473 - RNA, 73 nt, Human
auuucaguuugcaguuucucucaccucagaaaaauaaauugugugggggagaugaacuuuuuuaaacuggaau

SEQ ID NO: 4234474 - RNA, 90 nt, Human
ugagccacugcgcccggccugcucucuguucuuaagcuuguaaauaacaaaaccaggagaugugggcugaacgguuuaguguagugauca

SEQ ID NO: 4234475 - RNA, 60 nt, Human
ccgucuggguuuccuucacaagcacuggagcaucuugugcuaugugcugaacucaggugg

SEQ ID NO: 4234476 - RNA, 109 nt, Human
gccaaucuuccuuauuagacuggaagcuccuugaggccaggggucaugcccagaaugauacuugguacagagugggcacucaguaauugcugaaugagugauacauggc

SEQ ID NO: 4234477 - RNA, 55 nt, Human
acccggccuacucagugcccagcagccagguggggggccugggccagggccgggu

SEQ ID NO: 4234478 - RNA, 63 nt, Human
ggucggggcuggccggcgugguccgugagacucggaagggaucgcccggguccagucccggcu

SEQ ID NO: 4234479 - RNA, 89 nt, Human
gcccuggaggaagaagugccuucuagaaucucuuaauggccauaaaacauuggcguugauagauuuuagaggcaggcagccuucaaggc

SEQ ID NO: 4234480 - RNA, 122 nt, Human
auuucuccacaggaugcuggaggucagcagauuggcuucuugcuaggaagcugugguauugccuuagcucuuaccagugaaguuugucuaaaaggacugccaaaaacccagaauggagaaau

SEQ ID NO: 4234481 - RNA, 57 nt, Human
caagcagauauuuuagucaagaauuccagagaaggcugcuccuaaaaugucuacuug

SEQ ID NO: 4234482 - RNA, 65 nt, Human
gggugccuaaugacccauuuauccuagaaggaagaaacuagugaaaaauggccaucaggacaguc

SEQ ID NO: 4234483 - RNA, 68 nt, Human
agcagcgggucugcaagccuucccuggggccugcagagcuagaaagggaggcccagcagacuggcgcu

SEQ ID NO: 4234484 - RNA, 81 nt, Human
gagacgaggagguuggggcugcagugagcugugaucaugccacugcgcuccagccugaguaacaaagugagacccugucuc

SEQ ID NO: 4234485 - RNA, 69 nt, Human
gcaggguauguuuuuaucuacugugagguuccuggggcggagaugugcaguggagcgagaacuuccugu

SEQ ID NO: 4234486 - RNA, 62 nt, Human
gacgggggagucuuuuacaucauuaucucugaguagguuauuaugaagaagacucgccuguu

SEQ ID NO: 4234487 - RNA, 97 nt, Human
cugcauuugguauugggacuguugucuaaaccauaaccuaaacuacuuuaugcaguuagguaauagucucaucucagauaacaaaaggaagaagcag

SEQ ID NO: 4234488 - RNA, 77 nt, Human
gcagcggacccugagggagcugcuggccuuggagccggguguggccuaccagcacgccuuccucuacauccgccagc

SEQ ID NO: 4234489 - RNA, 84 nt, Human
uuggucuacagcuuugccaaguaaggucuuugaaagguagcuauagacuuuugaaugccuucauuggcgaagugcuuagaccaa

SEQ ID NO: 4234490 - RNA, 59 nt, Human
cccagcaugcucagucuaaauuguauauauguauauaauagauagggagaguugcuggg

SEQ ID NO: 4234491 - RNA, 62 nt, Human
uucuuggccugcuccagaacaaggggcgagucuaugcacuccuggagcagcaggcgcaggga

SEQ ID NO: 4234492 - RNA, 99 nt, Human
aggccuagaugacccugcuugugucauuugagaggagacgaccaaacaaagccugguguccuauuugugauaggugacaugggagaggagauggggucu

SEQ ID NO: 4234493 - RNA, 75 nt, Human
agaguggaaauaucugaugacgugacuaugucuuagugagaagacagugcaugguuagacaucaaugugagcucu

SEQ ID NO: 4234494 - RNA, 79 nt, Human
aaagcuaagaagaaauagauagaggaauacucagagcuaucugaguauuuucuuuaguuuguuagcucuuuggagcuuu

SEQ ID NO: 4234495 - RNA, 74 nt, Human
cugcggucuauuguguaucauuucauggggauuuuauaucaguaaucccgugagugcuuuucgguguaccgugg

SEQ ID NO: 4234496 - RNA, 58 nt, Human
aaggaggaugaauugucugcaaaggugcugggcaagaucuagacuaauucauccccuu

SEQ ID NO: 4234497 - RNA, 64 nt, Human
cuuucugauguaaggaacuaggcgaaugcgaauggcucuuggcuguuucuuugcugucagagag

SEQ ID NO: 4234498 - RNA, 76 nt, Human
ggagggguacgaugguggggggcgaaaggucaggagauggagcauaggccuucuccuccccaccuuuguccccucc

SEQ ID NO: 4234499 - RNA, 81 nt, Human
augaagaaaguguugcuuuuauucuuugcuagguuccauccauaccuggaugaggaacagcaagaauauuuauuuccucau

SEQ ID NO: 4234500 - RNA, 89 nt, Human
auuuuagcugucucuugaguaacguaauuuguggaagggguagggcucccucuaugccuaccuccaaaauauauacucccaguaaaaau

SEQ ID NO: 4234501 - RNA, 61 nt, Human
aggggauggagcuggaaggcaguugagggucaccugaugaggccuuuuggugcagugccuu

SEQ ID NO: 4234502 - RNA, 70 nt, Human
cagagacaucgagaauuggcagcuaaagcuggaggauuuaaugacuuugcaacuuuagcugucaucuuug

SEQ ID NO: 4234503 - RNA, 59 nt, Human
gagucaggucaggcuuguagauucgaguucuguugcgaguuugauugccccucugacuu

SEQ ID NO: 4234504 - RNA, 66 nt, Human
agaucugugauuuuggcaagauuucaaagaaagugauucagaguaucugccagaaucucaguuucu

SEQ ID NO: 4234505 - RNA, 89 nt, Human
ugguagguuuaauuaaauguuugguuugagcuuauaaggaacuauguguuuuagccaguucggauuguaauagauaauuaaaaauucca

SEQ ID NO: 4234506 - RNA, 84 nt, Human
cuaacugcagagacauuaaugcauguaaaugugcaaaauauguaauuuugccccacaggcagcuuugguguucucauguuauag

SEQ ID NO: 4234507 - RNA, 100 nt, Human
ggugugcugugacacacugggauucugaaaauggauuacaaauacgccaagguauugguucuucagcccucagguccuaggccagucaccccuggcagcc

SEQ ID NO: 4234508 - RNA, 64 nt, Human
ugccagaugcuggaaauaacuuguguagaagauaaacucuucuuagauuuuauuucuucuggua

SEQ ID NO: 4234509 - RNA, 83 nt, Human
gagaaauaugaugccaaauugcuacaacugccggugccaccaccaccaaugcauucgguguucaguuugcuaucauaauccuc

SEQ ID NO: 4234510 - RNA, 83 nt, Human
uauuagguuggugcauaaguaauugugguuuuugccaugacuuuuauggcaaaaccugcaauuacuuuugcaccaacuuaaua

SEQ ID NO: 4234511 - RNA, 96 nt, Human
ccgcgaguccgccaaucccgcccuucggaaagcgucgccugguauccagcugccggagcgggucgcgccggaggggggcggaggcggaaguggcgg

SEQ ID NO: 4234512 - RNA, 74 nt, Human
ugugugugugcgcgcaccugcauauauaugugugcauaccugugcgugugugugcgugugcgugugugcacgca

SEQ ID NO: 4234513 - RNA, 80 nt, Human
aagcuuucuuagcagcccucuuggucacuaggcacacuaccuaggagucaagcugugacaagaggcugcuucuuaaacuu

SEQ ID NO: 4234514 - RNA, 59 nt, Human
gccccguggcgcuggccugugggaucccgggcgcggccugggccagggccagccggggc

SEQ ID NO: 4234515 - RNA, 58 nt, Human
cauaauuggugcuuauuaaauguuagucuccgcucuuccguuuaauaagccuguuaug

SEQ ID NO: 4234516 - RNA, 61 nt, Human
uaaguucugacucugaaucugggaauguggucaccuuccucagagacaaguugagagguug

SEQ ID NO: 4234517 - RNA, 76 nt, Human
ggcauuugggggccuccuguucccccagugcauggggcugccuaggggggugaaggaggucccugagcucaguguc

SEQ ID NO: 4234518 - RNA, 71 nt, Human
ggcgggagugcaguggcgugaucucggcucggugcaagcuccgccucccggguucaugccauucuccugcc

SEQ ID NO: 4234519 - RNA, 70 nt, Human
gaaagcauucuggaggggcagagcuguccagagaugaaaugggcugccuugucagcuagugaugcuguuc

SEQ ID NO: 4234520 - RNA, 70 nt, Human
gucagugaaccuucaccaaaccccacgugcauuuuauccucagugaauuguugguggaggugcaccugac

SEQ ID NO: 4234521 - RNA, 59 nt, Human
ucacuucugugacuccucagagauuuugcaccagugaacucuggcuagcauagaauaga

SEQ ID NO: 4234522 - RNA, 63 nt, Human
gcguagucauugggucuguggucaguuaaguggggaccugacugagacugcaaugaccgaagc

SEQ ID NO: 4234523 - RNA, 74 nt, Human
guaguugaugacuaaagaaagcugcugcacaucaaugccucugggcagcaggucagugguaaucaaaacucugc

SEQ ID NO: 4234524 - RNA, 60 nt, Human
agacuuuggcagggccagugguaggggaggcaucaccccagucacggucaaccagagccu

SEQ ID NO: 4234525 - RNA, 60 nt, Human
ggcgcaguguucgcccucucgccacgaaguaaacaagugggagggucugagagcugcacc

SEQ ID NO: 4234526 - RNA, 82 nt, Human
gaguuuuuaaucuauuucauauaagggauuaguuuggaaauauuugaaagcuucuuaaauaugaaaaggauuauuuaaacuu

SEQ ID NO: 4234527 - RNA, 57 nt, Human
ggcugguuagauuuguggucuucuuccuccuguggaggacccuagagagagccagcc

SEQ ID NO: 4234528 - RNA, 55 nt, Human
ggcaguguggauccuggagaaguauuaccaugacuucccugucuacaacccugcc

SEQ ID NO: 4234529 - RNA, 105 nt, Human
ggggauccugagggccagaaucccuguuuccugcgcuccuucguccgugcccacgacuccgcaggggaaggcagucuggggagcagccaggcccucggggucucc

SEQ ID NO: 4234530 - RNA, 59 nt, Human
aguuuucugccucuggaugcguaaagcuucaaccugcuggcuuuuagagggagaggacu

SEQ ID NO: 4234531 - RNA, 66 nt, Human
uuuauguuuguuuuugaaauaaaggauuuaguuuaagauucuaaauuuuagagaaacaaacguagg

SEQ ID NO: 4234532 - RNA, 67 nt, Human
uucuguggaaauaugggcaacaaagauuuagaauaugaauaguggcccagcauuucucaauccagga

SEQ ID NO: 4234533 - RNA, 73 nt, Human
auguuuacucagucugagcagguguguaguauccaagaauaacaaauaccuauagcagacugagacugaauau

SEQ ID NO: 4234534 - RNA, 68 nt, Human
gguaggugagaaggacuguugcauuucuguuguucacucaucaaauagcaauuacccuucaacucucc

SEQ ID NO: 4234535 - RNA, 55 nt, Human
ugggcaaaugcuuuuuagucaauccuaggauucuauucuaagaggucguuucuca

SEQ ID NO: 4234536 - RNA, 77 nt, Human
uuuuuuuugagaagaggucuuuugggaugcauggugcuccacauacagcuucacaaaauauuucauuauaagagaaa

SEQ ID NO: 4234537 - RNA, 71 nt, Human
ucuuauuucuuucuuuuccugugggacggagcuacagugagugcccugcaggcaggauucagagauacagg

SEQ ID NO: 4234538 - RNA, 84 nt, Human
gcgucucccaggcccaggggcuuuccuguuuauggaagagcuuauucugagagcuguagaagccuauuggauucccugucacgc

SEQ ID NO: 4234539 - RNA, 55 nt, Human
agagcagaggcauggccguggggaggaggguccauggaacccgggcgucugcucu

SEQ ID NO: 4234540 - RNA, 75 nt, Human
agguagguucgucugguuuggguugcuauggcugauagacuccaccaggcagcaccaaagccgguaaacuaaccu

SEQ ID NO: 4234541 - RNA, 72 nt, Human
aggaucuagcgaaguaaugugauugcucaggguaucacugaccaugcccaguuguuccuauucuucuuuccu

SEQ ID NO: 4234542 - RNA, 67 nt, Human
uugaaaugguuuugugaaaaugcuuugauaacuucccacucaaagaagagauuuacagagcuuucga

SEQ ID NO: 4234543 - RNA, 61 nt, Human
uugucauuucagcaugacuguuaucuuuuugauggaaaagaugaaguucagcgaagaacaa

SEQ ID NO: 4234544 - RNA, 64 nt, Human
gguugauuuaggguuuugguuuucuccugcaaaauggagaaaaugggaaaauuuuagauuaucc

SEQ ID NO: 4234545 - RNA, 55 nt, Human
ucagguuuaagcuacuggaaucauuccuacaugauuacuggcagcagaaaccuga

SEQ ID NO: 4234546 - RNA, 75 nt, Human
gggguggcccugcuuccccaguguacauauuguaucuguguaacauuuuguauauuccagggguagggccgcccc

SEQ ID NO: 4234547 - RNA, 86 nt, Human
aacuaauggguguaaagugguauuuaauuuuaaguugcauuucucugauuacuaaugaaauugaguaccucuuuauauuacuaguu

SEQ ID NO: 4234548 - RNA, 67 nt, Human
cacuguugaagauacuuccucuagcaauuaaacaccugaaaaagaugaugugugucuucagcuagug

SEQ ID NO: 4234549 - RNA, 76 nt, Human
cuacuugcuuggaacugauuugucuauauucaaauaugaugauuucaucuuuguuuuggauauaaucagcagguag

SEQ ID NO: 4234550 - RNA, 93 nt, Human
uugugugcauguauaugucuguauuuuuuacacacaugcaaaaauauacauugggggcacgugugugagagauaugaaugugugcuuauauaa

SEQ ID NO: 4234551 - RNA, 58 nt, Human
gagaaguagcgucuucccgggggugccgaauuggcggggcugggggacgcuuuuuuuc

SEQ ID NO: 4234552 - RNA, 76 nt, Human
ggacagguggaguugauggccauugaguugauggcaguugccgcucaguugauggcaguuaaugucccuccuaccc

SEQ ID NO: 4234553 - RNA, 61 nt, Human
gcaugaauaauucuuuuucuuggguguccuagaaacacuuaaggugccguguaauucaugc

SEQ ID NO: 4234554 - RNA, 77 nt, Human
gugcauuuauggaagaaaacuuggaaggcauuaaaggcuacauuuugagccuugcaugauuucauucauuuaugcau

SEQ ID NO: 4234555 - RNA, 96 nt, Human
gacuuccaguccuuccaucucaaaaucucaaugagugugugguucuaaaugacucauagucaagggaccaagcauucauuaugaagccugaaaguc

SEQ ID NO: 4234556 - RNA, 55 nt, Human
gcccagacaucuguugggaccugacccccggucauugguuaccagugugucuggc

SEQ ID NO: 4234557 - RNA, 76 nt, Human
auggcaguauuuuagaagauuuggagaaaaguccacauaauaauguuuucuuaaaagcuuuuaaaguuuuugcugu

SEQ ID NO: 4234558 - RNA, 57 nt, Human
ggaccucagccaucccucggaguauggaggacacgccugugggaaggccugaggucu

SEQ ID NO: 4234559 - RNA, 105 nt, Human
ggggggaaauguuauauuuuucuguuucuauaagagaugaauacaguggauacuuuuucuauugguaaugauugaguucaccucuuucagaagacauuuucuuuc

SEQ ID NO: 4234560 - RNA, 68 nt, Human
gcucgggacccccgcccgggcccgacccccgcgggggaggcugcgggcccaggcaggggcuccccggc

SEQ ID NO: 4234561 - RNA, 70 nt, Human
cuuuugcaauagugacacugauaucauuuauaaaauuaaugcacccugguucaguggcauaguugcuaag

SEQ ID NO: 4234562 - RNA, 74 nt, Human
cacacaccagaaagccugggacaaagccugggcuagagcccucaggauucauucucaggcuuccuggugcugug

SEQ ID NO: 4234563 - RNA, 91 nt, Human
ggauaguuaucucauucccuuugucaguagucuuaguggaauaguaaagcaucccacuugagagcugaagaagucuuuggauaaucuuucc

SEQ ID NO: 4234564 - RNA, 70 nt, Human
gacucguugauggaggaaaaguuggaaugcagccucuggugcuguuugagcaaucccucuaucccggguc

SEQ ID NO: 4234565 - RNA, 59 nt, Human
ugugugguaaugagagauccaaacaccaagcacuccaggggcuuuggauuugccacaua

SEQ ID NO: 4234566 - RNA, 72 nt, Human
cagcuauuguucuguauaaugaagcccuggcuguugacccucagaacugcaucuuauacagcaauagaucug

SEQ ID NO: 4234567 - RNA, 61 nt, Human
agugaggggggcacuuguuuugacuguccugccgggacaucugagccuggucccacccgcu

SEQ ID NO: 4234568 - RNA, 68 nt, Human
guggggauauuguuuuaagguguauuaauuacucagugaugauaccacucaauagggcaugccacuac

SEQ ID NO: 4234569 - RNA, 70 nt, Human
ugaaccagaagucaucagagcugaggcauggccuugaacaugucacucagucucuggggcuucuguuuca

SEQ ID NO: 4234570 - RNA, 91 nt, Human
cucucucacuuucucacuuuucaauccccagcagauuuccauacccacaaagacaucuguacagauaucaggagugaggaccgagccugag

SEQ ID NO: 4234571 - RNA, 56 nt, Human
aauguugacguuggccagggccuuuccaaacaagccaggccaaaagguucaacauu

SEQ ID NO: 4234572 - RNA, 70 nt, Human
ugggacuugguuagaauggacaaagcugaaaucaaacccagauuuucugauccuucuaacuugauaccca

SEQ ID NO: 4234573 - RNA, 56 nt, Human
aagcaauucacaguucacuuaaagcaauagugcugaaagucuauuuagaguugcuu

SEQ ID NO: 4234574 - RNA, 83 nt, Human
ccuuguuauacugcaguccguaauuuuugcuugcagauuuuuuuuaauucuaaaaauuagaaauuaggucuguuauuauaagg

SEQ ID NO: 4234575 - RNA, 72 nt, Human
gggucugaagcgcugguguuguagaaauccucaucacaaagaggugacugcguuccaguugcugccaggccu

SEQ ID NO: 4234576 - RNA, 87 nt, Human
ccagacuggggcuccuugagggcaggggccaagcucccauccaaggggaggcaagaaccugccacucgggcagggcuucagaacugg

SEQ ID NO: 4234577 - RNA, 127 nt, Human
uugaagguuugcaaagguuauuugugucuuaguuauuucugcacuuaaugacacaucagacgcauugaguauauuucauaaguuguugacuagcaaagauacaaucauuaguaacccaagucuucaa

SEQ ID NO: 4234578 - RNA, 62 nt, Human
gaucuguuccuuuuguuguuuuguuuucagccaaaacuagaacagagagagaagccaggauc

SEQ ID NO: 4234579 - RNA, 71 nt, Human
gucgcccaggcuggagugcaagcagcaagaucauagcucauugcagccuugaccuccagugcucaagugau

SEQ ID NO: 4234580 - RNA, 74 nt, Human
uguacugaguauuagaagaguaguuauucacauggaaacguggaaauuauugucuuuuuuaaaagcugguuaca

SEQ ID NO: 4234581 - RNA, 58 nt, Human
gugcuugaguaaaaauagucuucaaauaaaaauaaugaaguaaauuuuuacuuaggcc

SEQ ID NO: 4234582 - RNA, 70 nt, Human
ugcaguggaagccaugauaaccaguguggaagaacuucaucuacauuuacacaguuaggcuuaaacuuca

SEQ ID NO: 4234583 - RNA, 79 nt, Human
aauaccgauguggaaaauuucauuuuaaaauuucuguuguaaucagaguuucuauaaauagauuugacuacuugguguu

SEQ ID NO: 4234584 - RNA, 57 nt, Human
guugcucucugguuucgcaggaaauagauuguucuaaucuuugaaaucagggucaau

SEQ ID NO: 4234585 - RNA, 70 nt, Human
ccaacagacacugacaggguccauggaauucuucgggaaauccuccaaggacucuugucagcuguguugg

SEQ ID NO: 4234586 - RNA, 87 nt, Human
acuggcccuaauacuucauucaaguucgcuauaguuuuggccccucaaucccagacauaugcauaauuggauaaguagaagggaagu

SEQ ID NO: 4234587 - RNA, 105 nt, Human
caaucguuuaacucugggaguguaugacuguuaugaggugggugggucucugaccuacauuuauagcugucaguuuugaacacccuucccaugaggaaaucuuug

SEQ ID NO: 4234588 - RNA, 84 nt, Human
guuguuggaggccagggacaaugaggcagaugccacuuucuucagcacucaugccugcgauugucccuggacagcuuuggugac

SEQ ID NO: 4234589 - RNA, 62 nt, Human
caggggucccccggcucccuggguagaacgcucuccugcccagugccggccaggaccuccug

SEQ ID NO: 4234590 - RNA, 59 nt, Human
cagagaagaggucuugaccccugaggccuucucagaacagggucuggcaucucucucug

SEQ ID NO: 4234591 - RNA, 80 nt, Human
gcuccucccauggccaguggucagugggagggugugcccugcgccugucugcauggccacugggcauguguguugggagc

SEQ ID NO: 4234592 - RNA, 69 nt, Human
uucaggcugauaaaugacaguaauuguucuuaaguugaagagcugguuuaauaugcugucuggccuggg

SEQ ID NO: 4234593 - RNA, 67 nt, Human
accucaccccacucccuuucuuuugcuggugggaagucaguaagaacugugggugggguucugaggu

SEQ ID NO: 4234594 - RNA, 80 nt, Human
acaaugacugugcuguuagcgauuuuuaauauaaaauacauuuccuagcaguguuauaaaccgcuaacagcacuuuuugu

SEQ ID NO: 4234595 - RNA, 99 nt, Human
ucuuauauuuccuuucccucagacaaucaacuguugaugccuguacuugugaaaaguuguaaggcaauuuuuaggguuguugucaaagaaaagcuugga

SEQ ID NO: 4234596 - RNA, 86 nt, Human
cccuugauuugggagaggcagcagagucauguccagggcaucagaccagugacaucuuugccuuuaugccucuagucaucugaggg

SEQ ID NO: 4234597 - RNA, 81 nt, Human
agggacugacuuaccgaagcugcuuuugcauguguugaagggcugcaugcaggaagggcuuggggacguucacagauuucu

SEQ ID NO: 4234598 - RNA, 65 nt, Human
cauugcauuggaaacugcuuuaugcugcugcagucugcaaagucuagagcuuuuaucaggccaug

SEQ ID NO: 4234599 - RNA, 82 nt, Human
ggaguuuuaaacgaagagcuggagaaacacauaagaaggcagaucuaagauggaagaaaaggcggauucggguugaaacgcc

SEQ ID NO: 4234600 - RNA, 83 nt, Human
agaacaagcugcugcugaacgagcuggccaaguuccgcucggagcacgagcuggacguggcgcugucggaggacaguuguucu

SEQ ID NO: 4234601 - RNA, 72 nt, Human
ccucaucacucuuuaucuuuuaugucugcaguauaaauagcauagacauuuggugugaagggaggagaaagg

SEQ ID NO: 4234602 - RNA, 65 nt, Human
augagacuugaacuccagugccagcccuguuaaucacuauucuguacugucuuucagguucuuau

SEQ ID NO: 4234603 - RNA, 78 nt, Human
agaucuuggcgcauaauauugagaaauuauuaaaaaccaaacuugguaauuuaacaaaauugucacaugccaggauuu

SEQ ID NO: 4234604 - RNA, 65 nt, Human
gagcacauguggagagucugggcccaguccuugcucugggaucugccucauucucgcguguguuu

SEQ ID NO: 4234605 - RNA, 58 nt, Human
acuagccucauaaaguuugucucuugaaugacugggagaccccuguggugaugguggu

SEQ ID NO: 4234606 - RNA, 71 nt, Human
gacucucaaaagugcugggauuacaggugugagccaccacgccuggccuaaauuaguaauuuucaagaguu

SEQ ID NO: 4234607 - RNA, 90 nt, Human
ucuuggugacuuguuuuucucuagggaaggcuaaaaaggaauuugugacugaccaaauuagauaccucccugaaaaagacagugccuugg

SEQ ID NO: 4234608 - RNA, 71 nt, Human
cucugucaccuaggcuggagugcagugacgcaaucucugcucacugcaaccuccaccagccugggcucaag

SEQ ID NO: 4234609 - RNA, 69 nt, Human
acuaaguagaggagugaugauuugaaucccaauaguuccauuuccaaaaccaguacuucucuauucagu

SEQ ID NO: 4234610 - RNA, 67 nt, Human
uggccaagauguggccacaggagacggcucaacaguggaagcuccuacgguggccacagucuggcca

SEQ ID NO: 4234611 - RNA, 58 nt, Human
uaacucugcuguggaaaugggauuaucaauggaugcaucucauuuuaacacagaguug

SEQ ID NO: 4234612 - RNA, 77 nt, Human
uuccucaagugauuuuccuacuugcuaaagucuaaaaaucacuguaaggacauuucaaguagagggaucgcuaggaa

SEQ ID NO: 4234613 - RNA, 109 nt, Human
cccaagacaaaaccgcaaagccccagaaugaggaaugugacaaaaccaaggagcccugcagcuugccuuugaaagcauuucuccucuggccguuuugugggcuccuggg

SEQ ID NO: 4234614 - RNA, 76 nt, Human
cgcacaggaccuagaagagcaugucaaacuauaaacugccugugauugugaaugacuuuguucuuugcuucuugcg

SEQ ID NO: 4234615 - RNA, 102 nt, Human
ggcgcuucuuggggcugggacaauaguguguggucucucccuuguugcccggagaaagcaaggacagaagcccacacaggggucuuuugggucaugaggccc

SEQ ID NO: 4234616 - RNA, 58 nt, Human
agucaguaucuucugggcgguaugaccuaaccaguuuuacagcucaucaauuacugcu

SEQ ID NO: 4234617 - RNA, 58 nt, Human
uccugcucuaauucauucaugcuggaaaugccuucaguaucuugguguggugcagaga

SEQ ID NO: 4234618 - RNA, 60 nt, Human
ucgggcgaauguuguuuuucuccgcagccaugugucgaagggcgauuaacauucgcucga

SEQ ID NO: 4234619 - RNA, 56 nt, Human
uguccagccggcccacgcccaucuucucgaagagcacgguggguuuggcuggcacg

SEQ ID NO: 4234620 - RNA, 58 nt, Human
aaguauagacaucaaacugaagaugaguagaucauacugaguuucacugucugugcuu

SEQ ID NO: 4234621 - RNA, 58 nt, Human
agauugaacgagcuggcauggaugccucaggccgccaagucauuaucucuucuaaucu

SEQ ID NO: 4234622 - RNA, 71 nt, Human
uucuguggauauauuuuaaaaggaagaacagaaacuauauuucagauucuugugugaauauaauuacagaa

SEQ ID NO: 4234623 - RNA, 56 nt, Human
ggccagucaaggggauccugaagaacaagaccucuacagcuuccucuaugguggcc

SEQ ID NO: 4234624 - RNA, 78 nt, Human
cccuacucuggacagggacacagccagugagguggaugaccuggagccugacagcgugucccuggcccuggaaauggg

SEQ ID NO: 4234625 - RNA, 70 nt, Human
cauaguaaauguuaacagcaacaccugaaguauauggauacaagaaagguguuuuguaauagauacuaug

SEQ ID NO: 4234626 - RNA, 77 nt, Human
gguauuuacauaaaguguacaagucauaaguauacagcuggcaagcuuuugcauaugcauguaccuguguuacuacc

SEQ ID NO: 4234627 - RNA, 67 nt, Human
agcauaacaaagggcauaauuguuuacuguucuauugcuuauaucagugguguccuaugcuugugcu

SEQ ID NO: 4234628 - RNA, 67 nt, Human
gcuuuccuggcccugucccugccucgcaagaagcgugggcccaagcagcggcggccgggugaagagc

SEQ ID NO: 4234629 - RNA, 69 nt, Human
cugaggggaauggugaggagugcauugagagggucaccuucaguuuugcuuuuaaucaugaacuaacag

SEQ ID NO: 4234630 - RNA, 64 nt, Human
agacaguagucaccuacagcucaugcuucuuuuacaggacauggaaagugugugauuuguguuu

SEQ ID NO: 4234631 - RNA, 55 nt, Human
gaugucuauguccagggccaucaaccuaacccagaaacucuggacagcaggcauc

SEQ ID NO: 4234632 - RNA, 66 nt, Human
cuagaaauugcaggucguguggaagugacguuucguguucuuuuaauagagauccuguguuucugg

SEQ ID NO: 4234633 - RNA, 60 nt, Human
aagggaaacagccaggcccugugccccauaugcaaugaacaaggcugggcugugccccuu

SEQ ID NO: 4234634 - RNA, 56 nt, Human
uccucaaauccuagccucaucgaagaaaagcaucaugaagccuagagaauugggga

SEQ ID NO: 4234635 - RNA, 75 nt, Human
aaguaucugaggcuaauagaauuuucugaggggaaaaauuguuuucucgggaaguaaacauuauuucagguauuu

SEQ ID NO: 4234636 - RNA, 95 nt, Human
ggcuccugguuccagccucucccgcuuccugcuggcugccccauucaugugugcacccagggcaggaagugaggaccuggcaggucccuaggauc

SEQ ID NO: 4234637 - RNA, 78 nt, Human
ccuggcgcucuguggguggcugugccccaggaugcauccguguguucccugccagccugccaucccacagaggcaagg

SEQ ID NO: 4234638 - RNA, 68 nt, Human
guaggaggcauucuugucaguggggucaggguacaggccacuggcccugucagcacagaauccacuac

SEQ ID NO: 4234639 - RNA, 81 nt, Human
ggggccccggguggugggagugaucagaagaaccugccgaagagcacacccccucuggucugauggucccaccaccgcccc

SEQ ID NO: 4234640 - RNA, 69 nt, Human
acuuucccugugcaguauguuccaagaaugggauguuccacauuuggaaaagaaauacucauauaaagu

SEQ ID NO: 4234641 - RNA, 58 nt, Human
ggaauaaaaggagguggcgagaacguucuugccuaaaccauuccccuuccuuuguucc

SEQ ID NO: 4234642 - RNA, 62 nt, Human
uaugguuucuccugcagauuuggggaagugggagaaaucucugggucugcggggugaccgug

SEQ ID NO: 4234643 - RNA, 74 nt, Human
aggcuggggcucauuugcaggggggagccaaaagggucaucaucucugcccccucugcugaugcccccauguuu

SEQ ID NO: 4234644 - RNA, 58 nt, Human
ugcaacuacccccaggauuuuaagauucaaagaaguggaaauccuugggaguggugca

SEQ ID NO: 4234645 - RNA, 58 nt, Human
cugauagagcauuagugugagagucuggauuucauaaagucucuccuggcucuaucag

SEQ ID NO: 4234646 - RNA, 78 nt, Human
guucauggaagcugcucaaaaaaacacuagcuuuauuauuauuuuuuaaagccagauuuuuugagaggcgacgucaac

SEQ ID NO: 4234647 - RNA, 77 nt, Human
gggcgcuuuuuucuuccaucuggcuuuauuuauuuauuuagacuagaaaagcgagccggcuuggagggaguccgccc

SEQ ID NO: 4234648 - RNA, 79 nt, Human
aggugucuaggcaauauuagacuuugucuuuuuaauuuucauauaaaaauuugaaguauaaguaauugcuuucaggccu

SEQ ID NO: 4234649 - RNA, 74 nt, Human
ucugccugggugugcaccuacgaucucuuuguauuuuaaucuuguggaugagcucuaaguacaugcccagugga

SEQ ID NO: 4234650 - RNA, 66 nt, Human
aagauuuaccacuuuauucaaguuuuaguuauccauaaauuugugaaaguaaagugguggcauuuu

SEQ ID NO: 4234651 - RNA, 130 nt, Human
gcuggcuauaaggacuugggagcuggaguaggagcagauggcagcaggugauucuccguuggaaacagggaguauaaacauuuucugcaagucugcucaagagcccugccucauuuaucuugaaugcagu

SEQ ID NO: 4234652 - RNA, 77 nt, Human
gucuuccucauuccguuuuaaaaccuuaagcaguuguaagcacagcguugccugguuucaaaaggaaugaagaaguc

SEQ ID NO: 4234653 - RNA, 83 nt, Human
ggggagccccaggacugggguacagggacgggggcagggaaugucaagccaucacccccagaccucagugcccuggccucccc

SEQ ID NO: 4234654 - RNA, 80 nt, Human
aaaggggagacuuaaaauuugcuccaaugucaguucucuacagaugagaaccaauacuacagcaaguaagucuugccuuu

SEQ ID NO: 4234655 - RNA, 89 nt, Human
ggaguuucacucuuguugcucaggcuggcgugcaauggcaugaucucggcucacugcaaccuccgccuccuggguucaagcaguucucc

SEQ ID NO: 4234656 - RNA, 116 nt, Human
gaugggaguggcucucaguggaaggggagcuggaaaggggaugguaugggaagaaggggaucuuuuccugaagcccagcugucuccagccaggcuccucuccaaagucaugccauc

SEQ ID NO: 4234657 - RNA, 73 nt, Human
ggugccuggggcaugcaaaugugggugaccuucgucucagguagggacccucagcuuggaugucauggguacc

SEQ ID NO: 4234658 - RNA, 57 nt, Human
aagggagagaggucaagguggggacucccgcaagcccacccuggccgacugccccuu

SEQ ID NO: 4234659 - RNA, 61 nt, Human
ggcguguucuuuguagaggaucuugguugaagaccggagguccagucacaaguaacaagcc

SEQ ID NO: 4234660 - RNA, 90 nt, Human
gcuggaggcccugcggggcucuacuuggccuggacugucuccuccagccuguccaagcgcuucuggagcuccugcaccguggccuggagc

SEQ ID NO: 4234661 - RNA, 95 nt, Human
cugacagagcccuggcuuugaccugcucagcccuguguguuaauccucuaguagccaguuaacuacucugggguggcagguuccagagaaugcag

SEQ ID NO: 4234662 - RNA, 109 nt, Human
uucuugaugaugaucuuguguuugugccacugcguaguggcccgaagcuaggggagcguggcuggagcaggcugcacaguggagcagacacccuccuagcagaagagaa

SEQ ID NO: 4234663 - RNA, 55 nt, Human
aguguggccaaugaggaugggcgaaggguugcugccaucuugaaccaugcccacu

SEQ ID NO: 4234664 - RNA, 57 nt, Human
uacauuccccagcaggccuuuuguugguugcacuaacugcaagguugcugggaagua

SEQ ID NO: 4234665 - RNA, 71 nt, Human
gagacaagugggagggagugcaggcaggcagacacgcacgcucucuccccagcucgcucucuccccugcuc

SEQ ID NO: 4234666 - RNA, 89 nt, Human
gccagcccacuguccugcaugggcucagaggagcuggaacggugucagcuggugccagcucccugggggcagggcaggccgggccaggc

SEQ ID NO: 4234667 - RNA, 68 nt, Human
ccaaguuccacuagugacccagaaggcccgcugagauugugcugauucugaggucacgguggaccugg

SEQ ID NO: 4234668 - RNA, 74 nt, Human
guauuggcaguauacauagcacuacucaagaagccaaagaaacacuugugcagugcuaagugucacaugucugc

SEQ ID NO: 4234669 - RNA, 76 nt, Human
agauguucuggugcccucuggcucuacuccccucuuuaaggggcuugaggggcaguggggagagggcaaggcaucu

SEQ ID NO: 4234670 - RNA, 58 nt, Human
cagauuccaccccauccucccagguuaucccgauaaccuggucccaugggugggccug

SEQ ID NO: 4234671 - RNA, 66 nt, Human
guccagagccagcuguccuuggcauccgucaggcagaggggugaggugauugcugguguuugugac

SEQ ID NO: 4234672 - RNA, 58 nt, Human
uuauuuuuguaacacuguauaguuaaagaaauuauauggugauuuuaugcaggaauga

SEQ ID NO: 4234673 - RNA, 74 nt, Human
ccguuacagccccagcacuuagcugagugacuggcaccuaguaagcacucaguaacuguuugcugaauaaaugg

SEQ ID NO: 4234674 - RNA, 75 nt, Human
ggggcugcuaggcugguuagauuuguggucuucuuccuccuguggaggacccuagagagagccagccugagcccu

SEQ ID NO: 4234675 - RNA, 55 nt, Human
gggcuuuuccaacacucuggagauggaguugucaucuaccagguuggagaggccc

SEQ ID NO: 4234676 - RNA, 86 nt, Human
caucaccccaucacuggaaaacaaauguuuuaagcuaucaagagagggaaugugcagcuuuugguuucuagaugcaugguuuggug

SEQ ID NO: 4234677 - RNA, 120 nt, Human
auuugcuuguaaaauauuagccaauguugucauuauuuugauguauuuccuugguuaugaccaaaaauauguugagauacugaaacuaaugucuguguguuuaaauguuuaccagcaaau

SEQ ID NO: 4234678 - RNA, 69 nt, Human
gaggauggacagcucuuaugugggcauguuacaaaggccguacugacguaguagaguugcuucuuucuc

SEQ ID NO: 4234679 - RNA, 74 nt, Human
agcaaacauuugaaaaucuaugaugugcaagucuaauuguugauuucaguacaagauuuucuaaaucaguugcu

SEQ ID NO: 4234680 - RNA, 61 nt, Human
uagaaguuaaaggaauacagaauuagauguuugcugguuuucugugcuuuuuuggcuccua

SEQ ID NO: 4234681 - RNA, 72 nt, Human
gauggcaggucuugcggaagauauggcuuauagaacacgaagcacauguuucuuuugcaauugcagcacauc

SEQ ID NO: 4234682 - RNA, 64 nt, Human
cuuuuccacacucacugcacucauagggcuucaccccugcaugaauuaucugguguuggaaaag

SEQ ID NO: 4234683 - RNA, 112 nt, Human
gcaugcaggcuggaugaaaagaccucacagcuuuuuucuccauuccaggugccuucuccaagagaggcagcagggagggagaaauggcaaggagguugcugccagcccaugu

SEQ ID NO: 4234684 - RNA, 83 nt, Human
guccccuccuagccucaagagauucagggacagaucaccaguccuguccucugggagccuugagccuuuugaaggaggcagac

SEQ ID NO: 4234685 - RNA, 71 nt, Human
uuucuuuugcucuugcuuuuucuagaaagaugacaacauccuggcuguuagagaggcaaggaaaggagaga

SEQ ID NO: 4234686 - RNA, 62 nt, Human
ccuuucccuugcgcuugcucuccgguaccuguuccucaccugagcucaagggcagggagagg

SEQ ID NO: 4234687 - RNA, 102 nt, Human
ccgcugucccgucagguguucaucgugcaggagcuggagguccgagaccggcucgccuccucccagaucaacaaguuccuguaccuacacacgagugagcgg

SEQ ID NO: 4234688 - RNA, 59 nt, Human
auuuccagacaugguuuuucaaagcuaccuuugguuuuuggaaaaaccaguauggaagu

SEQ ID NO: 4234689 - RNA, 76 nt, Human
cugccuccccucccacuuuagccagcucucagggggccccccaccacccugagcacugagcuggaauuggaggcag

SEQ ID NO: 4234690 - RNA, 81 nt, Human
cauucauagcuguguguauaauguuugauaauuuaacauuuguuguuuaauaaauugugguaccagagccaaaaaugaaug

SEQ ID NO: 4234691 - RNA, 80 nt, Human
uggggccuugcaacucuaaauguggucugcagauaugcaguguccguguugaugaccacaauuuaugcugccagucccca

SEQ ID NO: 4234692 - RNA, 86 nt, Human
guacguuuguuugguaaaagaggacgugcuauuuuuuacaguuaaaucuaauucguaaguuguagaacguuuucuuaacaagguau

SEQ ID NO: 4234693 - RNA, 57 nt, Human
ugguggaggcgcugcuggccaggcucaggcugcugcgaggucggcucuccuccauca

SEQ ID NO: 4234694 - RNA, 72 nt, Human
uugugucuuuauuuagguaaacaugaguuuguucuuauuuuaauaaacuuagagcucuccuaaaugacucag

SEQ ID NO: 4234695 - RNA, 119 nt, Human
ucaacauccuccuucuuuugagugcccauguuucccagaucuuggccuuggcucuucucacucaacacacaacucuucaucugaacacacuacuccauuuaccaucuccuggauguugg

SEQ ID NO: 4234696 - RNA, 62 nt, Human
gcuguugcaaucaaggccauggcaaaauaacuggcucccaagguggcagugguggcagcagu

SEQ ID NO: 4234697 - RNA, 96 nt, Human
ccuacaaauaaaaggugcugaauaauuuuuuugugauuauguguaguucaauaaacuggcacacaagagauuguuauugcuucagguaauuuuagg

SEQ ID NO: 4234698 - RNA, 60 nt, Human
uucauaugaauuggguuuuuuuuacuuuguuuugaaggaaaguuacccaaucucuaugaa

SEQ ID NO: 4234699 - RNA, 69 nt, Human
ggauaccaugucaagacugaagauccagacuugaggacuuccuccuggauuaaacaguuugauacuucc

SEQ ID NO: 4234700 - RNA, 78 nt, Human
uaucuuguaguuagagggaagcgacucgguuucuucagugagggaguuacaugaugacagcauuccuuuuaggagaua

SEQ ID NO: 4234701 - RNA, 67 nt, Human
cucccugugucggacgugggcagcagaacgccccuuugaugccccguccuguacacuaagaagggag

SEQ ID NO: 4234702 - RNA, 60 nt, Human
caguggacacuuccucuacaauguuugccaguuucuguuaguugggagaagugucagcug

SEQ ID NO: 4234703 - RNA, 85 nt, Human
gccaaaguauaaacacguuuauccuaagaacucuguaguaagaaaaagccauuuguagggugcuuaagcuuguuuguaaaauggc

SEQ ID NO: 4234704 - RNA, 62 nt, Human
agcauuucuacugugucagaaauucucaaacuuuagaguguaacugaaacacagagagggcu

SEQ ID NO: 4234705 - RNA, 67 nt, Human
gcagcuauuccauggggcuguugcgcagauuaagcaguuaauacuugcaaggcucuuggaauagugc

SEQ ID NO: 4234706 - RNA, 61 nt, Human
gggaauguuugagugccaugugacguccagagugacguucuacaugacacucaacauuuuu

SEQ ID NO: 4234707 - RNA, 69 nt, Human
cugcauucauaagacuuugcucuugugagaauucgcucaugccccaaaagcaaagaucuuugauugaag

SEQ ID NO: 4234708 - RNA, 74 nt, Human
gaagcccuuugagugccucgagugugggaaggcuuucaaccaccgauccuaccucaaaaggcaccagcggauuc

SEQ ID NO: 4234709 - RNA, 128 nt, Human
uugaaaucauccagaggaguugggaaaucuacugaugccccgcugugccucccagaccgauuaagucagaaccucugggaggugggucgcaggcaucagugcgugcccgaggccuccgcguguuuggg

SEQ ID NO: 4234710 - RNA, 85 nt, Human
ucuguaauucaggcauacuaguuacuuuccuuggggucuguuuaaauaaugccuuaauaguguucuaauguuucugaaauacaga

SEQ ID NO: 4234711 - RNA, 57 nt, Human
gugguuugcugguguacguuuauuauaugcagugaaaguacuuaaucugcaaaccac

SEQ ID NO: 4234712 - RNA, 84 nt, Human
uuuuaauguauaugcagauuuucaucaucguuucuaucuugcaauaaaugaagcugcgaguaauuggaaauuugcuauuuagaa

SEQ ID NO: 4234713 - RNA, 64 nt, Human
cugugugcagggcacaauggaaguaaacaccacccacuauauauccccugugccuggcauacag

SEQ ID NO: 4234714 - RNA, 89 nt, Human
cugacuccccguugaugugggugaugagguccccagcccgcaggcccgccuccugggcggggcuuccguccuccacacucugggggcag

SEQ ID NO: 4234715 - RNA, 66 nt, Human
guggcguuuauucccuuaguauguaggugacccaggguggcuuugcuuuggcaagggagaagucac

SEQ ID NO: 4234716 - RNA, 89 nt, Human
uguaagaggucaggccaaugucacaaaugauuuagcaaucacaagcaaacuugagagaugauugaauaauguuaugugaacuucuugca

SEQ ID NO: 4234717 - RNA, 85 nt, Human
ucucauccuggccucugagucaagaacccagugaacugacuuucuaguucuagaaguuccgcugcaaggccaggaaagcuugaga

SEQ ID NO: 4234718 - RNA, 66 nt, Human
gauacuuuguggaauccuggaugaggaggcacagaaauacucccaccauaguuauaacaaaguguu

SEQ ID NO: 4234719 - RNA, 66 nt, Human
guccaauguggcaccacaggggcgucuguagcuggccagacugcaccccuguggagcacauguggc

SEQ ID NO: 4234720 - RNA, 129 nt, Human
uuucuuucuuuucucuuuuuaaguauauauuucuagaauuaaaauaauauuauaccacugcuuugcaaaguguggcccaugaauuauuggugguuucugaucuuaugguugagugcuuuuguagagaua

SEQ ID NO: 4234721 - RNA, 62 nt, Human
gucgccuaauuaggguauccuagcuauguuccauuucuaguaaggggcuguaguuagaugac

SEQ ID NO: 4234722 - RNA, 97 nt, Human
uguucccucuggcucccagcaccauaacucaggccuucuggcaggaacaggaacaggcugggaaguguguccugagagccagcagcgugguugagca

SEQ ID NO: 4234723 - RNA, 72 nt, Human
gguguccagaaagaaguggggauagaggucuuuaaccauaaauauugcagcuucuccauucuucuggcugcc

SEQ ID NO: 4234724 - RNA, 75 nt, Human
uggcugggaacgaggagguccaggagcaguaggaauguugaucuuaggucuugggccugccuccagcacccacca

SEQ ID NO: 4234725 - RNA, 78 nt, Human
aaaagaugcaagcauuuugaacugggaggagguaagaagagaaagggccaagugauccaguucuaagugucaucuuuu

SEQ ID NO: 4234726 - RNA, 119 nt, Human
acaguuuauccguuacagagcccagagaggugcuuaugcucaugguuuaggcuuuacugauugccaaucaugguacaaguaagcacguucuucugaacucuaucuuugcuagaaauugu

SEQ ID NO: 4234727 - RNA, 129 nt, Human
uaaggauggcauaaaauaaucauuuuugaaccuguguaauaaagcuugaaagcagggaaaagaauuuccuuuucccccuuuuuuguguugucuauaggaauuaacuugggauuguuuuguggguuuuug

SEQ ID NO: 4234728 - RNA, 57 nt, Human
acucucaauuaucuggacugaaggcacuguucucacuauggccagaugaaugggagu

SEQ ID NO: 4234729 - RNA, 76 nt, Human
uaagauaugacagcucuagcacacaguagguacucagaaaauguuagccucugugcuggacugauuucauauuuua

SEQ ID NO: 4234730 - RNA, 62 nt, Human
cugggacccagcccaagucuuucuggcugucuccagcuggaacagaaguggcuuggucucag

SEQ ID NO: 4234731 - RNA, 118 nt, Human
ccacuuucaaaacauaucaaguucaaagacaguuuuauuuacgcaaacaauugugcaauggugcuuuuugauagauauugcauuguuuauggaauaaaauaucuuaguuugaaacugg

SEQ ID NO: 4234732 - RNA, 87 nt, Human
ucacagguaucccugcagggccauugugcagacgguccccaucuggaugacaucuguggcugcgcccugggggagcucuaccuguga

SEQ ID NO: 4234733 - RNA, 117 nt, Human
caggccaauguggagggaaagcugggguggugcaggccucaugcagcugggucccuccuaccaggccuccagaguccugcaccagcuccaggacagcccucuccuccccauggccug

SEQ ID NO: 4234734 - RNA, 55 nt, Human
uuccuuuucuucuaccacaugucuugaacauucacauggguuaaagaagauggaa

SEQ ID NO: 4234735 - RNA, 93 nt, Human
ucagcaggcagauuuggggaagagggagcuggaaugauguacaugugaaucaucucaguugcuuucuuuuccugucugcucuucuucugcuga

SEQ ID NO: 4234736 - RNA, 62 nt, Human
ggcugacuguagcugggggaagacauuuuacucauuugcucuuuccuuucauacagucagcu

SEQ ID NO: 4234737 - RNA, 64 nt, Human
ucaagugaucaaagugcuggaauuacaggcgugagccacugugcuggccuuuggugacuucuga

SEQ ID NO: 4234738 - RNA, 57 nt, Human
cuuuauguuggggugucuuaguaauccguaaggaacaugauaggcauugacauaagg

SEQ ID NO: 4234739 - RNA, 63 nt, Human
auuuuuucaugugugguugagacauggguauacucguagcguaaggccacacuauuaaaagau

SEQ ID NO: 4234740 - RNA, 79 nt, Human
uauuuagcccuacgucuacaugcaauucuuauauuuggaacuucuuaaucagaaacuaaauguggauuugguuugaaug

SEQ ID NO: 4234741 - RNA, 57 nt, Human
ggaaagagaaacaugaacuagauacaagcacggcucaccuacaguguuuuucuuucc

SEQ ID NO: 4234742 - RNA, 80 nt, Human
cuuuuauucuacucuuuaaauaugaaaacaacuguagauucagaugcuauuucgggauuucaaagagcaaagaagaaagg

SEQ ID NO: 4234743 - RNA, 114 nt, Human
caggacgggucugcaguugggcagggagcuggaaccacacacccucucuccagacuucuuggucaagugaucuguggccuccuacucugcuccagcugcugauccugugucuug

SEQ ID NO: 4234744 - RNA, 85 nt, Human
uugcuccagaggguaguacguuccaaaucacuggagcaauuaaagcagcugccauauuuugaggauguacagggcuguggggcag

SEQ ID NO: 4234745 - RNA, 100 nt, Human
gcauuuuacagcuucaugacaaacaguuuugugcccauaccuuagaaaauguggugcugaguuaaauaaaggcuguuugagcacuggagcagaaaaaugc

SEQ ID NO: 4234746 - RNA, 91 nt, Human
acaguuuuucaggagcacauuuguuucucuagaguagguccucuuuggaguccacuuugagaagcugaugaaagcuauggauucucauugu

SEQ ID NO: 4234747 - RNA, 113 nt, Human
ugauugcaagugaugaaugccuagcaaacugaggggaggggagaaaauggugaucaggugaugauuuagaaagcuaguucugccuccccuaguguuguucacccccaugauca

SEQ ID NO: 4234748 - RNA, 76 nt, Human
ugagcggaagcgcggccgccgcggucgcugccgccgccgccucagcagccgccgccgccgcgcacuuucagccuca

SEQ ID NO: 4234749 - RNA, 61 nt, Human
guccccugcguguucauccugggcccagaucccccugccccagcaagacucgcagugggau

SEQ ID NO: 4234750 - RNA, 74 nt, Human
cgugaucguuaugauagagaaagagaucgugagccuuauuuugaucgucaaaguaaugucauagcagaucaucg

SEQ ID NO: 4234751 - RNA, 71 nt, Human
augugacuguggguuucugguuccugacccauaaauggaaaaggcagggcugaaagcucucacagucucau

SEQ ID NO: 4234752 - RNA, 70 nt, Human
gggucagcugcuauucuuggagcugauggaacccagccggguuucaaguucccucagggagcccuggccc

SEQ ID NO: 4234753 - RNA, 79 nt, Human
cuggcccaaaaaauccauagaaagagguaacuaguggcagauuuggggcgccaaccugauuuuauggauuuugaguuag

SEQ ID NO: 4234754 - RNA, 82 nt, Human
aggaagugaccuccuuucaggaaguagguggacauaugaccuaaaauucaacccuucucuucuuggaaggaacuuaucaucu

SEQ ID NO: 4234755 - RNA, 61 nt, Human
ggcagauaaacaauguuguauaggaacuucaacacacacuguacaauauucccacuuugcu

SEQ ID NO: 4234756 - RNA, 80 nt, Human
gaagagugacauguuuacaaaccucaagccagccuugcuccuggcuggggccuguugaagaugcuuguauuuuacuuuuc

SEQ ID NO: 4234757 - RNA, 92 nt, Human
aggucaugccucugccgcaggaggggcgauuucugcucucauuacugauccuuugcaggugcccaaaucuucuguuuucccaggcuugaccu

SEQ ID NO: 4234758 - RNA, 70 nt, Human
gaagaagaugcugcuuguucacgggcauuuuuauuacauuaggaucucugagcucgugcaguacuucuuc

SEQ ID NO: 4234759 - RNA, 76 nt, Human
uaguacacuguucagaauuuuaguuaacacagcugacaugguugugcucuguuugaaagucuaagaauagguauug

SEQ ID NO: 4234760 - RNA, 55 nt, Human
aaccuggguguacauuauggucaucuuuuaaauguuauauaaacacacuuagguu

SEQ ID NO: 4234761 - RNA, 73 nt, Human
ccauuguucagcugaugucucaccuguuagauggaccuugucuuucucagaagaaacaucugcuggauguugg

SEQ ID NO: 4234762 - RNA, 73 nt, Human
gcccccauccccugaaggagcuggcugucucaguccugggcucgcgcacuucaccccggcagauggagggggc

SEQ ID NO: 4234763 - RNA, 67 nt, Human
cuggucuugguauucgcagaagccauagcccuuggguuuucccgucucucuaucguauaccagccgg

SEQ ID NO: 4234764 - RNA, 74 nt, Human
ggugcucgggcuccuuugagugagaaauagaauauuguuuuccugcuaaaauucaccaaugcuguccaaguacc

SEQ ID NO: 4234765 - RNA, 61 nt, Human
uggcacugcccugucucgguggcuagacggcugguccauccuacugggaugggcagugcca

SEQ ID NO: 4234766 - RNA, 57 nt, Human
aggggcgagccuggguuuugaaguucaaacuagaguuuaaaucacaacucugccccu

SEQ ID NO: 4234767 - RNA, 64 nt, Human
gaggcggggggcucgggcagcucgggccggggaccugcccugugcuucgagggcuccccgccuc

SEQ ID NO: 4234768 - RNA, 73 nt, Human
uauagcucaagaaaaaggacaguagccuugaggucccgaucaaccuggacucugaucacuuuuguuugcugua

SEQ ID NO: 4234769 - RNA, 85 nt, Human
aaagugcuggucaacgauuugaguuaguuuuuagauauacauugaaaucuuuaaucagacauucucaaguuucacacaguaguuu

SEQ ID NO: 4234770 - RNA, 55 nt, Human
uucacuagcaucugaauauuguucugaguuuguuggagcagugaaaucuggugag

SEQ ID NO: 4234771 - RNA, 69 nt, Human
gcuuccuuagcuuaccaaguauucacaaggaaauucucuuguaccucuuuuugguuggcuaggggaagc

SEQ ID NO: 4234772 - RNA, 62 nt, Human
cugaggaggggcucuugggcaugaagggcuuugagcaucuuggucccugagcucuuucacag

SEQ ID NO: 4234773 - RNA, 56 nt, Human
uugcagcuguugcaaagucucuucaacuuccguugcuuugccuccagcagccgcag

SEQ ID NO: 4234774 - RNA, 81 nt, Human
uuaagaaguaagcagaacuguuuuguuuucugugcugcuuagugcaggacaauauagagcagaucuggcucugccccuuag

SEQ ID NO: 4234775 - RNA, 111 nt, Human
uggagacuugugacucuugugguugaguagugcugcaaggauggagaggcagacaccugcccugcagacccugcaguguccugaauagccaagcaaggaagcaggucuuca

SEQ ID NO: 4234776 - RNA, 60 nt, Human
cuucauguucaugcuaacauuuauuggauaucugcgaaaucacuggauuugagcaugagg

SEQ ID NO: 4234777 - RNA, 73 nt, Human
guagucuccacuguagaaguuaauugaugaguaguagccuacaaucaggcucuagcuucuccaggaacacuac

SEQ ID NO: 4234778 - RNA, 74 nt, Human
ucuugcuagaaugcaagugccauggauucagguucacugaugaaccaccacauaguaggcacuuaucgguaaga

SEQ ID NO: 4234779 - RNA, 87 nt, Human
gggaaauguguguaagaaaguauauuaacaaaucaaugccuccgucaagcaaacaaucauauguauacuuuuuuucuacguuaucuc

SEQ ID NO: 4234780 - RNA, 60 nt, Human
cuucacucagagcaggacagcccuggccuccuugguuuggguguuaugccucugagucag

SEQ ID NO: 4234781 - RNA, 60 nt, Human
cuagguuuuuuccuuuccccaccugucucuuagccuggggaauuaaaugagaagccuuag

SEQ ID NO: 4234782 - RNA, 59 nt, Human
uugcacagaugcacaugguugccuggagucuaucguacaaucaugugcacugcugacag

SEQ ID NO: 4234783 - RNA, 64 nt, Human
gcggagcuaaagauuggcuccuuccgcuuuuuuuggauccagaaugucagucuuaaguuucagc

SEQ ID NO: 4234784 - RNA, 63 nt, Human
cacuuucacuguacgccaggcucuccuuggagcacccgcuggucccugcaguucuagaaggug

SEQ ID NO: 4234785 - RNA, 60 nt, Human
uggucuucauaugccacagaguccuccaauuucaggggcucccgugggaugguggagcca

SEQ ID NO: 4234786 - RNA, 58 nt, Human
agaaaagaggcuuucuaagcauuccuuccucugcaggauauuugggauccucuuuucu

SEQ ID NO: 4234787 - RNA, 80 nt, Human
agagggaagcguccuucugcuggucaucccaguggucacagaguacaccaugcuccagcaggacacaccucacgcccucu

SEQ ID NO: 4234788 - RNA, 60 nt, Human
agcagggugugggugugagugugaggagcuccugggccaugcgcuucccuacgcucugcu

SEQ ID NO: 4234789 - RNA, 61 nt, Human
uggagggaagcaaacacuagauuuugcaccuuaccugcauugguguuucacuuccuugucg

SEQ ID NO: 4234790 - RNA, 61 nt, Human
auuuucucagccuccuugcuggagcacugggccugggcuccagcagaaagggcgaguggau

SEQ ID NO: 4234791 - RNA, 64 nt, Human
gcgugagugugugucuuggguaccgcuguguacuacugugugccuagauuccaugcacucucgu

SEQ ID NO: 4234792 - RNA, 76 nt, Human
gcugagccuuucugcgcacucuuccggugggagccaugcagcccgaggcggaggagcugcgcggagggggauccgu

SEQ ID NO: 4234793 - RNA, 64 nt, Human
ucaggcaggacccaaccucccugcucugugcucucacagugccuggcugauggguccugucugg

SEQ ID NO: 4234794 - RNA, 63 nt, Human
ugauuagauacuucagaugacaaagagcucucugcaugaagaguuacugagguauuuuuauca

SEQ ID NO: 4234795 - RNA, 55 nt, Human
gaggguggagccuccuggaagugaccagagccggugacuucgggaaucaacccuc

SEQ ID NO: 4234796 - RNA, 74 nt, Human
uguaugguguuugagaaauauacaccagacacauacaaauguguaucuguguguauguguuuauacaucucaca

SEQ ID NO: 4234797 - RNA, 85 nt, Human
cucaugcgauucuucuccuuugagcaaaucuuugaugaaguuguauuucacugaauguucucaaaggggagaaagagugcaugag

SEQ ID NO: 4234798 - RNA, 87 nt, Human
gcagaggugggacagugggcugggagguggcgaggaggcccuuuauugaggggccagcuuagaucccccagccccaagguccucugu

SEQ ID NO: 4234799 - RNA, 71 nt, Human
acuuauaaauuuaguacacuguucagaauuuuaguuaacacagcugacaugguugugcucuguuugaaagu

SEQ ID NO: 4234800 - RNA, 81 nt, Human
ucaggcuuuuauucauggcuguguuguuccucugaagcucauuuugccuucuggagacccagcaacagggccauguucuga

SEQ ID NO: 4234801 - RNA, 77 nt, Human
ucuauuauugucuuuaugauuaugauuuugucuugucuuauagaugaggggagaguuaaugugaaugugaugaugga

SEQ ID NO: 4234802 - RNA, 74 nt, Human
agaucucaccuagucuuggaggucuugggcauuuuuagaacucacccagccaggcugccacucagggugaggcu

SEQ ID NO: 4234803 - RNA, 99 nt, Human
cuggauaggucuaccugcaagucggauuucccagguuauuguuggagaugagcggcagcaauaccucuuggugauugggcagguuguagugauguccag

SEQ ID NO: 4234804 - RNA, 77 nt, Human
cuccugccuccacagccccuccaguggcagggacaggucuugggucuuugucaucuuggugcugugagagguaggag

SEQ ID NO: 4234805 - RNA, 78 nt, Human
ggcagaaagaguaaacagccuucucccagcuuucuuacuuuccacagcugagaguguaggauguuuacaguaucuguc

SEQ ID NO: 4234806 - RNA, 114 nt, Human
uuuuuauuaauuugaaaggaguuuugggguauuugguagacauuuuguacuccauauuauaaaaugcucagauaaauauauacaacaaugaaacucuuuugaaucuauuaaaaa

SEQ ID NO: 4234807 - RNA, 55 nt, Human
uccugauaccugagucuuccccguuuggaaaaguggguaaggacaggugucugga

SEQ ID NO: 4234808 - RNA, 79 nt, Human
gcagaaauggcaaaaguuucggaaauuucgucuguuccagcaucagacagaaugguccagaaucuuuuggacaaacugc

SEQ ID NO: 4234809 - RNA, 109 nt, Human
gucaucaauguguacuuuugguucuuugaaaaaauguguuuaaggagguaaaaucuuccccuuugucucaaugagcuauuuguuucauaguagcuuacacauugaaggc

SEQ ID NO: 4234810 - RNA, 64 nt, Human
gcaauguuauacuuaugugcaaaaauauacuuaagguauauuaugguuguagguuaacaauugc

SEQ ID NO: 4234811 - RNA, 55 nt, Human
gggaacugggguagggguagcuuucucuaagaaagaccaagagccccaaguuucu

SEQ ID NO: 4234812 - RNA, 82 nt, Human
uggggagcacgccucaggugagcgagcuaaauuagaagugauuuugauugcucgacacucugcuugaagguggaacuuugca

SEQ ID NO: 4234813 - RNA, 89 nt, Human
ggccauugggcaccaaucuccuauuuuguuucaaagccuaaacagcggaggcagcuuuggaaauagauguaggaaauuggacaguggcc

SEQ ID NO: 4234814 - RNA, 88 nt, Human
uccccgaagucugccucucucugucauuaugcuuggccaggauugcucauccugauggcacuggguugcagagagagagcugagggga

SEQ ID NO: 4234815 - RNA, 102 nt, Human
agccuggcauucguacuggcccuggucguggagggcaacaccagagauucuaaguguucccgaugacaggaccaggugccgccgguccacggagagcuggcu

SEQ ID NO: 4234816 - RNA, 58 nt, Human
caucagucugaaagccagggaguuggucugagugacaaggaauugguuucagaugaug

SEQ ID NO: 4234817 - RNA, 73 nt, Human
gugaccggguucuuguucuaggauguggagggagcagggacuuugaaacaaacugggauaggauccuguuuau

SEQ ID NO: 4234818 - RNA, 70 nt, Human
uuucguguaaaacaauaauaauuaggaaggaagucaguaggagauccuuuuuagguuauuguacaugaaa

SEQ ID NO: 4234819 - RNA, 80 nt, Human
cuaugguaguggcacaggaggaagagggcacuucggcccauuucacacguuucuacugcugccaagaagccuagucauag

SEQ ID NO: 4234820 - RNA, 62 nt, Human
gcuccuuaugguccugacccuacaguuccugucccaugaccagggccagaucaccaaggagc

SEQ ID NO: 4234821 - RNA, 55 nt, Human
aaagugcugggauuacagacgugagccaccacgccuggccuaucauaagcauuuu

SEQ ID NO: 4234822 - RNA, 62 nt, Human
aaagacucugagcagccagucauucaaaaacauuaauaaaguguuuguuguaucagagcuuu

SEQ ID NO: 4234823 - RNA, 60 nt, Human
ggcaggcaacagacaggcuugguucuuugucuaugaggaucaccagguuuguuguuggcc

SEQ ID NO: 4234824 - RNA, 56 nt, Human
caugagaguaaccuagagaagauguaugaaauacaaauuucuggguucaccucuug

SEQ ID NO: 4234825 - RNA, 88 nt, Human
agucaaauucuuuggauuuuuugcuuuuguagguauaaguaaacgguuaaaaaccuucauugcuacuuaaaauaccagaugagugacu

SEQ ID NO: 4234826 - RNA, 79 nt, Human
gaaauucugguuaauaagauguuguagauuagugagaacuugaaaauguuuuugcuucuaguauauuuuuuggaauuuc

SEQ ID NO: 4234827 - RNA, 118 nt, Human
uugcuugcauucaaugaugugauuuugaauauuaugucccacuuuauugucuauaaauaccgacaauaaagggagauaaaguaauuuuaagaauaaauggaugaggaguguggggcaa

SEQ ID NO: 4234828 - RNA, 72 nt, Human
cucauucaucuucaaaccccagugccucagggcacagugccaggcauugauggggucuuggggauuugggag

SEQ ID NO: 4234829 - RNA, 55 nt, Human
caacgggcacuuuauuuaaaaaaaacuuuuuuuuuuuuuuuaaauagagcuguug

SEQ ID NO: 4234830 - RNA, 71 nt, Human
ggggcugagagcuggaaucugagggauggggaugucuugggauccagccucugauuccauucuaggcaccc

SEQ ID NO: 4234831 - RNA, 79 nt, Human
cuggaguugucuauccagagggcauuccaagcagaacuaguaauggcacugaagcuggaaagccugaggcaaagaccag

SEQ ID NO: 4234832 - RNA, 73 nt, Human
cuucugugugcuaguuuugucaguauuggugucaugaaauaauuauaaggacuugaauuagacauuuaagaag

SEQ ID NO: 4234833 - RNA, 58 nt, Human
ucugaggacagugcugugccuggccuuuccccuucaacacgccagcugcucccucaga

SEQ ID NO: 4234834 - RNA, 110 nt, Human
acaaguauuucaguuuaauaauuauuuuuauaauacccuugacuaauagccauuauuaauaucaauauauuauaugaaaaaugagaacaaaacuguuuccuauacauugu

SEQ ID NO: 4234835 - RNA, 55 nt, Human
ucaccuugugauccacccgccuuggccucccaaagugcugggauuacaagcguga

SEQ ID NO: 4234836 - RNA, 110 nt, Human
cuggcggcgauguccagcggagagcguuuaaguauggaggccuaacugacaaguguuucaucuugcucauucucucguauucgcgaaucuguucugcauuccgccgccag

SEQ ID NO: 4234837 - RNA, 68 nt, Human
agauggacucuucucucccaaaugcccagcaugaugugcagggccuguccccccaggagaaccugucu

SEQ ID NO: 4234838 - RNA, 62 nt, Human
cauuagcacugucugguuaucuugcuucaguugagggauucgggacaauagcagugcugaug

SEQ ID NO: 4234839 - RNA, 77 nt, Human
uuccagagacacauuuucagcucugccaaaccauaaugcuuaggcuuucguuuggauauagcugaggugucuuggaa

SEQ ID NO: 4234840 - RNA, 67 nt, Human
gucuucugcccaggaggucccauggggcaugaaauauugauuuaggaauuugcugggcaugaaugac

SEQ ID NO: 4234841 - RNA, 82 nt, Human
gcagacucaacaaagcuaguucacugaagccuaugcuauuuuauggaucauaggcucuucagagaacugaauggcagucugc

SEQ ID NO: 4234842 - RNA, 109 nt, Human
gacugguggauaauuuuuccauuuuuccucaggcaauuugaguuacuccaauaaauucaaauaugggccagaggaaaucaucucucagaugggcagugauuggccaguc

SEQ ID NO: 4234843 - RNA, 64 nt, Human
gugcuguuagcgguuuauaacacugcuaggaaauguauuuuauauuaaaaaucgcuaacagcac

SEQ ID NO: 4234844 - RNA, 62 nt, Human
caauuguuuugugaaacauagugaguaauauauacucaccauguuuucauaggaacauguug

SEQ ID NO: 4234845 - RNA, 65 nt, Human
gagccauggaggaugugcagcaugggcaggaaaagagccuucagugguguacauuuccauaguuu

SEQ ID NO: 4234846 - RNA, 56 nt, Human
ucaccuuuugaauugcuguuguuuuacaugcuuuacauagcuguucuugaguguga

SEQ ID NO: 4234847 - RNA, 69 nt, Human
gagauaggaggauugcuuguggccaggaguucaagaccagccugggcaacauaguaaaaccuccaucuc

SEQ ID NO: 4234848 - RNA, 56 nt, Human
uuggaggaagcucaugggggaucuguguauuucuuagguuucucccuguucuccaa

SEQ ID NO: 4234849 - RNA, 79 nt, Human
caucuggcuuagauuccaaaauaguuugguuuuaugcuuguaaaaaugaaaccaaucaaauuggaauugaagauagaug

SEQ ID NO: 4234850 - RNA, 63 nt, Human
ugggcuagguaaacugaauuggauacugugugaacucauucauacaucaguuuucuuggcuca

SEQ ID NO: 4234851 - RNA, 87 nt, Human
gagcuuccauuacucauucgccuugcccaaggccucagcaaccgacguucgaaagccaggagaaaaggcgaaugauaaagggcgcuc

SEQ ID NO: 4234852 - RNA, 85 nt, Human
gccagaaaaacauugaugacauuuagcauaauuggcaguauauauggauaauaguugaaggucaucacuaguuaauaucuuuggc

SEQ ID NO: 4234853 - RNA, 73 nt, Human
cagcuggagggagcagcuagaggggguccuggcaggcucgaggggccucccggagcugcucccagagcagcug

SEQ ID NO: 4234854 - RNA, 99 nt, Human
cccgaaagcgcuugacucagguccccggagucccuggccagggccccagccccucgcuugcccugcacuguguggacucuggggaugcagguguaaggg

SEQ ID NO: 4234855 - RNA, 63 nt, Human
uagccaguuuauaaaguggaaguauuaggagauucauaaaucuucuauauugagaauuggcua

SEQ ID NO: 4234856 - RNA, 111 nt, Human
cugcuguagaggaagaaggagccgucggaguccagcacgggaggcguggucuuguaguuguucuccggcugcccauugcucucccacuccacggcgaugucgcugggguag

SEQ ID NO: 4234857 - RNA, 62 nt, Human
ugcuccuuccauucugauggcuaauuagggacaccucauuagcuaucagaguggaacaagua

SEQ ID NO: 4234858 - RNA, 65 nt, Human
cgcccucuaagcuuugguguuucacuuaauguauuuggcaguguucaucacaggcuagagaggug

SEQ ID NO: 4234859 - RNA, 82 nt, Human
accuaugccaaauauugaauuugaggauguaacuuaaacuccaguguuuguucuacaaaauucaaauaauguuuggcaaggu

SEQ ID NO: 4234860 - RNA, 65 nt, Human
cugccaggcagcagcgaggauggugaccgagaagguggggaccacguccugguggcuguuggcag

SEQ ID NO: 4234861 - RNA, 57 nt, Human
uaaagccuacagucaugguuagaaaagccaacugguaauuuagcuacugugguauua

SEQ ID NO: 4234862 - RNA, 83 nt, Human
cagagucaucgggcggguggugauacugcuucugcccuuuggagaagauggcaaagaguacaucguccuggcuggugauauug

SEQ ID NO: 4234863 - RNA, 60 nt, Human
uucaugucuuugauucugauaauuggauuuuccccaaucaucagaaucucuagauuugga

SEQ ID NO: 4234864 - RNA, 82 nt, Human
uuuuauuaccauaguacuaucaguuuaagacguucaaaacaaaagaugcuaaaaauaaaugauaguauugaagguagggaaa

SEQ ID NO: 4234865 - RNA, 95 nt, Human
uacugggaguuggaguuugcuucucuguaguugggcagcugcucuuggucuagugaccaccagccuggacagcuacggagaacccgccuuaggua

SEQ ID NO: 4234866 - RNA, 58 nt, Human
aguugcuucccuauucuuagcaggugugaaccuuuccugagguagaggaaauguagcu

SEQ ID NO: 4234867 - RNA, 66 nt, Human
ucauccugacuggguaaagcuuauccaaacuguacugucugcugcucuaagcugacccagggauga

SEQ ID NO: 4234868 - RNA, 63 nt, Human
ugcaggagcccaggaauacuaugcgacacuugauacuagcccugaguauuggcagguccugua

SEQ ID NO: 4234869 - RNA, 129 nt, Human
uagaggugggacccagguuccccggcugucuugggcucuuuccagaccagccccagcucagcuugggcugaguugcugccagguccugggaggagcccuccuaguacucacccucuugucccacugcug

SEQ ID NO: 4234870 - RNA, 84 nt, Human
ucacauucucauuuccaugccuaagagccugaagcuugaacaaagggcuucaguuaguuucaugugagccaaaauggaauguga

SEQ ID NO: 4234871 - RNA, 74 nt, Human
gggaaagucucaaacuauauaugggguucucuuguuauggggaggucacacugauagucuugagguuuguucuc

SEQ ID NO: 4234872 - RNA, 57 nt, Human
gucuaggggaagagugagguuuuggugggagcaacaaagaacuuucuuccuuuggau

SEQ ID NO: 4234873 - RNA, 57 nt, Human
guuggguaauuaagcacagaaauguucugggacaugcucugugugccaucaccuaac

SEQ ID NO: 4234874 - RNA, 56 nt, Human
aggccaaauagcagguuugcuaaauguuuuaauguuguaaacugcuuccuuggccu

SEQ ID NO: 4234875 - RNA, 103 nt, Human
gccccgaagccaucuuuguccugaagugucuuuagucgcugagcaaacaggcuugaugcugugggauugucaguggccugaggacagauggaggggagggggc

SEQ ID NO: 4234876 - RNA, 86 nt, Human
cuuguggaugguguccuagagaaauuacagcuuucuuuuggaucaguauguauaaaagacaauaauucucucuagccauuuuugag

SEQ ID NO: 4234877 - RNA, 60 nt, Human
ggcuuuggggguguccaagaaaugucaguugugggaaggauuuggagcaucccaaaggcu

SEQ ID NO: 4234878 - RNA, 83 nt, Human
aguacagguaucccuuucuaccugaacucaagcucccugacucagaaaccaaguagauucagauagcaagggauaccuguauu

SEQ ID NO: 4234879 - RNA, 64 nt, Human
guaaguuucucuuugguggguugagaguuggaccaucaauucuaaucuacaaaaggaaauucau

SEQ ID NO: 4234880 - RNA, 80 nt, Human
cuuugguucuguauauauccuagcaaauaaccccccacuagaacugaagggcauuuugcaggaaauguacugaaugaaag

SEQ ID NO: 4234881 - RNA, 76 nt, Human
cagcucuuugaagaagucaaaagcugcaguaaacuuuuccaacguuggcugcaguaacuauuuucaauaaaagcug

SEQ ID NO: 4234882 - RNA, 81 nt, Human
auuucaagcaaugagcgugguugugcuucuuugccucagaugauauuuguggcaggauggacagcagaagccacuugaaau

SEQ ID NO: 4234883 - RNA, 67 nt, Human
ugcucuuuguagcugcuuugcuucauuuaaagguacaugacauuggggcauguagccagcaaaggua

SEQ ID NO: 4234884 - RNA, 115 nt, Human
gggugcauggacuaggacccuggaggcagaaauaguuaccgaggggaaguuacaggccugagugugagucccuguuugguugcugaugagcuuugagguccuuggccagacacuc

SEQ ID NO: 4234885 - RNA, 80 nt, Human
ccuggaggaggagguuggagggcugcccugcagggucacugcaccucugcccagagccucuuaccuccagauccuucagg

SEQ ID NO: 4234886 - RNA, 55 nt, Human
uacuaaacugcauuucuaucuagcauauuuuugauauggaagugauaguauagua

SEQ ID NO: 4234887 - RNA, 58 nt, Human
agauaggcuuagccaagcuuucccugccacaggacacagugcuuggguggcuauguuu

SEQ ID NO: 4234888 - RNA, 55 nt, Human
guccucacuggccgcacgcugagaacgagaagcucgggugggcagcagcgggggc

SEQ ID NO: 4234889 - RNA, 66 nt, Human
gccuaggagaagucaggaguggagaacagcucugagaagauacuguuguccaacugaucuccaggc

SEQ ID NO: 4234890 - RNA, 56 nt, Human
guauuucaucugaacuucccaacaacuugacgaacuuggugggacaggugagauau

SEQ ID NO: 4234891 - RNA, 62 nt, Human
acuccauuccuguaggugaccacugcuggcuucugggaaagaguggagcuggaaaguggggu

SEQ ID NO: 4234892 - RNA, 70 nt, Human
cuugucuaguuccuggugauguucuaauaauacaacauauuucugaugcauuugcaggaaacuggaaaag

SEQ ID NO: 4234893 - RNA, 82 nt, Human
ggaucacaacggcagcccuugcgacacccuggcuggggaguuuuauuccugaggggguugcgcaggggcucccuuggacucc

SEQ ID NO: 4234894 - RNA, 61 nt, Human
ucuuaaguuccaggugugcucaauucacuccacuuggugagcagcaccuaucuggauaagg

SEQ ID NO: 4234895 - RNA, 71 nt, Human
uggaaguuuuugucagggcaggaggaagagugaccauuuccuuuuccuucuuccugccuugccaucuucua

SEQ ID NO: 4234896 - RNA, 62 nt, Human
ccugcuccaccucagugucaucuucugcaggagccaggggcugagaguuugauguggaaagg

SEQ ID NO: 4234897 - RNA, 58 nt, Human
acuccuggccauccagccuggggaaguuacugcuucacuuugcaaauggcacgggagu

SEQ ID NO: 4234898 - RNA, 62 nt, Human
ccuuuaguugcuuuaguugagcugcuccucuagcagcagcuccagcccaggcagcuccuugg

SEQ ID NO: 4234899 - RNA, 90 nt, Human
ccagccucugucgcaacggggugagaguguuuuaaagcaggcgcugcuuacgagcuauuuucacuuucuggaaacuugugcaaugguugg

SEQ ID NO: 4234900 - RNA, 75 nt, Human
ggaagguuucugaagagaacucuuaguguuucauuuggcuuuguaauucuaaugaguucuuaucuaaccaacucc

SEQ ID NO: 4234901 - RNA, 84 nt, Human
gcucuggaauggcugaggguuucagugggacggguuccuccugagagaaucugaccguggagaucuccagaucagaccaguugc

SEQ ID NO: 4234902 - RNA, 84 nt, Human
ugggacguuuuagccauguaguuucuuuuuauuccucuuugauacccugaauaacuagccuuagaaacacaaguaaagcuccca

SEQ ID NO: 4234903 - RNA, 58 nt, Human
agacccuugcagucugguugucuguguaaaaggcauucacgaacauauugcaggguuu

SEQ ID NO: 4234904 - RNA, 65 nt, Human
cugggccaaaugucugcauaaguucaaagucuuucuuuucauuuccagcagcauauuugucucag

SEQ ID NO: 4234905 - RNA, 75 nt, Human
cagauugauauccagcacuugggugauaguacuuuguaaaaugcaaauuagucacaccagugucuuccagcucug

SEQ ID NO: 4234906 - RNA, 76 nt, Human
gccgggaggcuggaugccuugggggaggaggaaacccacuuggauuucuccucagcaaggcagcuuuggcuccggu

SEQ ID NO: 4234907 - RNA, 97 nt, Human
uauauauuaaaucauaaaauauaaauaugcaugugguauucaucauggagagucauaugaaaacgugugugugugugugugugugugugugugugua

SEQ ID NO: 4234908 - RNA, 99 nt, Human
guucuuauuguuguugucauuagcuguuuaagcguaugcauaugacuuaucacaucuaagaugcuugaauaguuuuggauagcauauauucauaagaac

SEQ ID NO: 4234909 - RNA, 63 nt, Human
uaggucugaggcugcaucuuggggacacacuugguuguucccaugugcaggguucagcacuua

SEQ ID NO: 4234910 - RNA, 68 nt, Human
gugacaugugcaucagccaauuggagggaggcaaagucccgcccgcugggugguugauguacagcaac

SEQ ID NO: 4234911 - RNA, 60 nt, Human
agagccucucugaugugacagcuacaggaaguccggugcugugcuggcggcagaggcccu

SEQ ID NO: 4234912 - RNA, 70 nt, Human
gauauggaaacuugauguugugaaaucagaccucauauauuuuuguuugaagcauucaacuuucuauguu

SEQ ID NO: 4234913 - RNA, 83 nt, Human
cuccuaguucaguguguucuucacuguuagaaggugcugcugaacauaguuauaccauaugaagaucacacuaucuauuugag

SEQ ID NO: 4234914 - RNA, 66 nt, Human
ucuggacagggacacagccagugagguggaugaccuggagccugacagcgugucccuggcccugga

SEQ ID NO: 4234915 - RNA, 89 nt, Human
auauauauauauauguguguguguguguguguaauauauauauguauauauauaguacauguauauauauaguacauguguauauauau

SEQ ID NO: 4234916 - RNA, 67 nt, Human
ggcaguggugccuaagcgcggaggcgcccggcccuugggggugccccgcgcgcguagcgccgcuccc

SEQ ID NO: 4234917 - RNA, 66 nt, Human
ugcuuuucuguuuaugaaauuguguuacagacugcgaguaacauagcuuaaaugagaagauaagua

SEQ ID NO: 4234918 - RNA, 79 nt, Human
uggacaaaccuggaggaccuuaugcuaaaugaaauaaggcagacaaacauugcaugaucucacuuacagguggaaucca

SEQ ID NO: 4234919 - RNA, 56 nt, Human
uuguaauaguguuuuacguugucacaacaccaggcaaaacccaagugcuauugcaa

SEQ ID NO: 4234920 - RNA, 71 nt, Human
uuccuaaaucugugugugagaaauggcaggucuaguuugggcauugugauugcauugcagauuacuaggag

SEQ ID NO: 4234921 - RNA, 77 nt, Human
ucucauugugcaucacagaacucauacaggagagaaaccuuaugaaugcagagacugugggaaagcauucaguggga

SEQ ID NO: 4234922 - RNA, 72 nt, Human
aaacaucuccagagacauuguuauuccucaggaguuucccugacuccuuaauguggcugauguuucauguuu

SEQ ID NO: 4234923 - RNA, 129 nt, Human
cuucuuuugaagcacgauuugcucccuacaagccacaagacauuuuguugaaacccuuguuguuugaaguaccaagcauaacaacagacucuguguuugugggaagggauuggcucuuucaccagauag

SEQ ID NO: 4234924 - RNA, 65 nt, Human
gcuuggguucgauguauauguagcccgggcauggggcagggcuucuuaacauuuggacaccacgc

SEQ ID NO: 4234925 - RNA, 57 nt, Human
ucuagagcagggagaggcagagaggcaggcagccugcugggcucuuccugcuguuga

SEQ ID NO: 4234926 - RNA, 58 nt, Human
ggugggucaguagccuugcagaacuguccugagaaguuauugcuggugcuggccagcc

SEQ ID NO: 4234927 - RNA, 87 nt, Human
aaaauucaagaguaagaccauuuuguagccagcauauuguaaagagcauuauuuuagccaacagaaugaugagacuuuaugaauuuu

SEQ ID NO: 4234928 - RNA, 129 nt, Human
aacugcccaauguccucccuuccaguucaugagcggcccaguucuguaccaggagaagcugcugaagccggcagcuuugcugcuggagaagggugccgaccaggaggaagacgaggcccugcgggugcu

SEQ ID NO: 4234929 - RNA, 56 nt, Human
gagaucuguguuugcugaagcuacaauuacauggcuucagagugacucagcaucuu

SEQ ID NO: 4234930 - RNA, 110 nt, Human
gccccacauuuuuccuuggacagagccuaggguucagacuuuccgaagggcuggaguuuggcggggaaaggacuggagcccagcgcccuggaguggaggagugaggaggc

SEQ ID NO: 4234931 - RNA, 56 nt, Human
ggugcagguggauggcgagcccugcaagcuugcagccucacgcauccgcauugccc

SEQ ID NO: 4234932 - RNA, 63 nt, Human
uuaggaaggcacugggugccaaagucugucuuugaggucaggaucugcgccugugccuccuaa

SEQ ID NO: 4234933 - RNA, 74 nt, Human
gauguuuaaagucugaaaaaguuugugggaccacuaaccaaggucaacacaucaguucagucuugaugaacauc

SEQ ID NO: 4234934 - RNA, 72 nt, Human
gggagaucuuacucacuucagcuggcguugcucauuagugaauguaugacagcaggaugugaggggaugccc

SEQ ID NO: 4234935 - RNA, 60 nt, Human
uguaauguuagaaacaauugcuggucaaguucaacuuguugcuauuguuuuuaauuugca

SEQ ID NO: 4234936 - RNA, 57 nt, Human
guggugggcgugguguaugccuucaccuucugaggacggcacacccugcaccaccau

SEQ ID NO: 4234937 - RNA, 73 nt, Human
gggcuagagggcagggggcccagcugggaggggcucaugcugcccuuuuccugaggcccccugcugccugccc

SEQ ID NO: 4234938 - RNA, 75 nt, Human
gcuuccauccuuggagaaucuuguuuuacuaagagaauugcacuuggaugauaacagcauuucaacuguggaagc

SEQ ID NO: 4234939 - RNA, 130 nt, Human
agugagcaguugaguucaggacaagacauacuuugcggugauucaucuggggccuuauuuccacuuuguaauuccagugaauugacuucccaucaggugaguuuccuuuaaguauaauuuaaugcucauu

SEQ ID NO: 4234940 - RNA, 63 nt, Human
ccugcaaagagugugcauguaccugugcguacacacacacacacacacacacucucacacagg

SEQ ID NO: 4234941 - RNA, 93 nt, Human
cuucaugaaaauuaugugcccuguuauagucugaggccucagcuccaugcuaucaggcuucaaggacagcagccacaggauaccucuaugagg

SEQ ID NO: 4234942 - RNA, 99 nt, Human
cuggagggauuuuuggaucccuggccacgaagcugcccaggguagcuggggccugggcgcuuucugggucagggcuggagaaggaggcauuuguuccag

SEQ ID NO: 4234943 - RNA, 65 nt, Human
aggcuuugauuucucugguccaauccucucagugucaagguggguagguggggagauuaaagucu

SEQ ID NO: 4234944 - RNA, 66 nt, Human
cuuggcaagagauggcccaggggucugugcccaagaccccggucuccugggcuuuggcuuguuggg

SEQ ID NO: 4234945 - RNA, 56 nt, Human
cccaggcuggagugcaguggugugaucucggcucacugcaaccuccaccucccggg

SEQ ID NO: 4234946 - RNA, 94 nt, Human
guucagacaaugaauaaaauauacauauaugcacauuaauauuuuuuccuauugggcuaauagaguguguguuaugugugaaaucuuuuugaac

SEQ ID NO: 4234947 - RNA, 58 nt, Human
ggacggggcagccagcugguggccacuaacauagcgccaucugcugggugccccggcc

SEQ ID NO: 4234948 - RNA, 80 nt, Human
gggaggauguuagacuugcguggaucaugacuugcugcccaggacggagcucguauucagugcaagucaacguccagccc

SEQ ID NO: 4234949 - RNA, 55 nt, Human
ggggauuuuucuuacucuuagguuuaaccaagaacacugagcagggaaaaacccu

SEQ ID NO: 4234950 - RNA, 65 nt, Human
ucccaaagugcuggaauuacaggugugagccacugcgccuggcccccaguacuuugucaaaugga

SEQ ID NO: 4234951 - RNA, 60 nt, Human
uagccgcgcagccucauuaaggauuuggaagugugucuuuuuccuuaguugcugccgcua

SEQ ID NO: 4234952 - RNA, 86 nt, Human
uuuguuuucaaauucagaaagugaaucuuguuauuuugguuuuagaauagcaguauuaugagauaacuuacugccuuugaaucaaa

SEQ ID NO: 4234953 - RNA, 128 nt, Human
gauggaaguggcucucaaugggacggggagcuggaaaggggauggaaugggaagauaaucuuccuucuccgaacauccccagcugaacuccucuccaaccguagucuccaaugucuagccgccucuuc

SEQ ID NO: 4234954 - RNA, 129 nt, Human
auaucguuuguugcauaucuucuuaaauccaucuuccuuguaagggcuuuagaacuaaaacuuacuuauauuguuuuuccuuaacagagggagaaaaauaguggauuauuauuucuaaaauaaaaggau

SEQ ID NO: 4234955 - RNA, 66 nt, Human
ggggaaaggugccucuuacaaggcuuagguuuucgcagcagagccuguuaggcaccuguguucuuc

SEQ ID NO: 4234956 - RNA, 72 nt, Human
cugccaugguugugaaagagcaaagacuaaaaaaggaaacagucuaccuucuuucucaacugguuaaggcag

SEQ ID NO: 4234957 - RNA, 70 nt, Human
gggccaggguggaggacaggccagugagaacagaagccucuuuguuauuggcagcuccugcacauggccc

SEQ ID NO: 4234958 - RNA, 99 nt, Human
cauuaacaaaagcaccaaaaggaauguuuuccagaccuagaugguuugagaagcaucuagguuuggaagauagaguccuuccuuuagcuguaguugaug

SEQ ID NO: 4234959 - RNA, 81 nt, Human
guccuuuugaaaugacaacuuuaauggguuucagcucuuuuaucuagagcuugagauaauucaagcugaguuuuucagggc

SEQ ID NO: 4234960 - RNA, 72 nt, Human
ccugggcauuuguuucacagguccagugcucauaaagucagcaauuuucaaaccugguuuacugaucccagg

SEQ ID NO: 4234961 - RNA, 78 nt, Human
ggucaaggagcugauccuauauugguaugaggaauggcuuauuuucugaugaccacaugugggacuauuucaaccgcc

SEQ ID NO: 4234962 - RNA, 61 nt, Human
cuucuuuucuacuggccuagaaauacugauauucaggaugucaagguuguguaaaaagaag

SEQ ID NO: 4234963 - RNA, 58 nt, Human
gauagguacuguaagguccucuaaagagugucuugagacugggcuuugggguucuauc

SEQ ID NO: 4234964 - RNA, 79 nt, Human
ggccagccugggucgagagacgagaaacgcuaccagaaagauauuucuggucucucugaccuaggaggaacaaaaggcc

SEQ ID NO: 4234965 - RNA, 65 nt, Human
augcauucugugagcugcuggcuuuucuaucagauggaaagcaagacaggaguuucagaaaguau

SEQ ID NO: 4234966 - RNA, 62 nt, Human
cugacuuggagauacagaggacauuuggauucuguacuaagguccaugaauaucuaagccag

SEQ ID NO: 4234967 - RNA, 71 nt, Human
gccggaggggcuggucuuuccacuuacucuggacaccagggaaggguucaggugggccugccccucugagc

SEQ ID NO: 4234968 - RNA, 110 nt, Human
ucuauaacagagcccaaaaaauauaaaggauguggguuuugcaucuuaaacugaucauguucaugagaaagccauaucuauucuauucuguggccuuuguacauuguaga

SEQ ID NO: 4234969 - RNA, 70 nt, Human
gccuuuuuuguuccuugguuuuugucugucuccucuagacuacggguuccuugagggcaggaucuguggu

SEQ ID NO: 4234970 - RNA, 56 nt, Human
gggggcgcaagcaugugucugggugucuacaccgagcaggguguuugcgcacgucc

SEQ ID NO: 4234971 - RNA, 81 nt, Human
ggaauuuuggaugauacuuggagaaauauuacacugugcauaaaccaaauugaauugcuuucacaaguguuauaaaguuuc

SEQ ID NO: 4234972 - RNA, 77 nt, Human
acggugaggucauacaaggcacuggugauuuaugucuccuggccuuuuaucuccagcagugcuuuugagcccacugu

SEQ ID NO: 4234973 - RNA, 71 nt, Human
ggaugcaggcacagcuaagacuggccauaaccuauggagaguccuggccaaucagcugugaccugcugucc

SEQ ID NO: 4234974 - RNA, 129 nt, Human
cucgcuggccuggcaggcgcgacugugcgugcgcagccgagggugguggcggccggcaccccacgccaaggguggugguggccggcaccccacccucggccgccgccuccgcgugucaggugccgugag

SEQ ID NO: 4234975 - RNA, 59 nt, Human
uggccaaauuggccugauguauuuuaagcuuuuaucaugcaacauugccaguaugggca

SEQ ID NO: 4234976 - RNA, 75 nt, Human
aagggagaugcuguuuaaguggaauuuguuuuuagaaaacaggucagaaacaagagcuuacauggcugcucucuu

SEQ ID NO: 4234977 - RNA, 85 nt, Human
cucucuuucucucaaacacacauacaaacuucugccuccaaaaugggucaagugaaggcugugggcguggguuggggagggaggg

SEQ ID NO: 4234978 - RNA, 56 nt, Human
ugaauuacacugggaucagggcaguaacacgaagcuacugacccaacauuaguuca

SEQ ID NO: 4234979 - RNA, 64 nt, Human
caauggucccagaaugguuucccagaauugggcucaccggauuugaaucauuguggggcuuuug

SEQ ID NO: 4234980 - RNA, 84 nt, Human
gauguagaaguuucuccauuuuguguguucugggagcucauggauauuccaggacacaaaagguggagaagagcuuuguucauc

SEQ ID NO: 4234981 - RNA, 103 nt, Human
guguguguguguguguguguguguguguguuguaugaaauuuuccaauuuuuaaaacagaggaggauugaaaaaacacauauauguggcaugacgcaaaaugc

SEQ ID NO: 4234982 - RNA, 93 nt, Human
gagcaggagaaagggcgccaccucuaccuggccggccuucccggcagaagccgccgagcuaagcccuggagaggucggcgccuggacuacauc

SEQ ID NO: 4234983 - RNA, 126 nt, Human
caugugugauuaaacaaccuauuuuacauauuucuguaauucugaggagugggcuggggguaggaagaaauggcaccacuuaaaauucagggcuuauaugaagagguguuuuaagguuagcacaug

SEQ ID NO: 4234984 - RNA, 63 nt, Human
gguucuaggagucugguuccugccuuggugcaggagucuugggggagcuggacuccuagaucc

SEQ ID NO: 4234985 - RNA, 113 nt, Human
caaugcacuaaagaucacugaacuguuuaaacauuuccacuugccaguuuaauuucuugaagacuguugcuuguuuggaauguuucuugucacugauuuuaagguugcaucug

SEQ ID NO: 4234986 - RNA, 60 nt, Human
uguguagagcaugggguugugggugacauuggcaacaacaccacuucucugcucugccca

SEQ ID NO: 4234987 - RNA, 63 nt, Human
uacauaauagcaaggugcugucaugacuuuagauuggucagggggcuccuguggcuauaugua

SEQ ID NO: 4234988 - RNA, 86 nt, Human
gcaaggguucauaaaaaacucaggagagaguaacaggguggcugggagacucuucccuucuguaucuucugaguuuuggacuaugc

SEQ ID NO: 4234989 - RNA, 76 nt, Human
caggcccagcagggagaccaucucuuccuuaggacuugccuuaggucccauguccucccugaccacugauggccug

SEQ ID NO: 4234990 - RNA, 110 nt, Human
ggacacacaggccaggaggcaagcaugggcgucuugcgggcgguagcgccgacacugugcgcucuccugcagacagccucuccacgucaagcuuccagucugucaagucc

SEQ ID NO: 4234991 - RNA, 61 nt, Human
ugagagguagaacuuguaguguaauagguauaaugguagcuuucaaaguuuuaucuucuca

SEQ ID NO: 4234992 - RNA, 72 nt, Human
guggcuugcuggaaggguaguauuaacuauuuaacauguaaugguguacuucacucuuaccuagcacgcugu

SEQ ID NO: 4234993 - RNA, 68 nt, Human
guauuugacaccagugaaugguccccuuauaaaucauuggucuccauggcacuuuugugucuaaauac

SEQ ID NO: 4234994 - RNA, 58 nt, Human
gaugcauccuuucugucuucucugcuaaacagugagcuccaggaagaaaaggaucauc

SEQ ID NO: 4234995 - RNA, 71 nt, Human
uacaguugggugucugcugaauuucccuugaaaacauuuugaagugaaaaaagucaguacugaguacugua

SEQ ID NO: 4234996 - RNA, 129 nt, Human
ggcuuggaccacgagaggcaccugagucaggcagucacauacuucccacuggggucuaccaugugaggcauggugugggauccugggaaggagaccaagccucauuucaguuugcuuauggccaaagac

SEQ ID NO: 4234997 - RNA, 56 nt, Human
gacuacauuugguauugacgagcuccccccaacgguuugacagaccagguauaguu

SEQ ID NO: 4234998 - RNA, 81 nt, Human
uggggagcagcggggccccccagugaaccucucaccguuugguagaggguggcacucugggggcuccucuguacuuuccua

SEQ ID NO: 4234999 - RNA, 98 nt, Human
gggcgcggcgccggggcgcgcggcugcagcggagcaggcugggaagcguaguucccggcugagccucgccgcggccccgcagucccccagccccgccc

SEQ ID NO: 4235000 - RNA, 63 nt, Human
gcugaucugguuccaggacauugcaaaagauuuauuuacaaucacccaaagagccagaauagc

SEQ ID NO: 4235001 - RNA, 78 nt, Human
gaauggcagcauuggcuguguugaaaacguggaugcaaguagcuauccaccaccaucacagucagacucugcuucuuc

SEQ ID NO: 4235002 - RNA, 65 nt, Human
cucugaggauggggaaaaaauggaucuuuucuacauaaagacucaauuguucccuaaucuuagag

SEQ ID NO: 4235003 - RNA, 82 nt, Human
gcuaccugaacuucccauguacagacuggcucucuagauuagcucagugcaacguugugcauucaaggugaauguucagagc

SEQ ID NO: 4235004 - RNA, 108 nt, Human
ccuuucaucuuugagucuuaaauuauuuuaaaagcauuaauucuugcaggauuccugcaaggcacauauuuuagagucacagauuuauagagacuugaagauaaaagg

SEQ ID NO: 4235005 - RNA, 61 nt, Human
ucccuccuuaaagggagcagcagcuuggcagugaguaugcuggcaccuuugagugguggga

SEQ ID NO: 4235006 - RNA, 74 nt, Human
uugaaggaaucaauuauccauuuguuagucagaggagccuuacaaauuauacauuaggagauugauuucuuggg

SEQ ID NO: 4235007 - RNA, 71 nt, Human
caaagaaccuucgagacagggcagguucauggcugccucguccacaaaagcccuguuuucuggguuccuug

SEQ ID NO: 4235008 - RNA, 60 nt, Human
ggaguccuauaguuaucuguggauaagguuuuguuugaagccuacauuugacuauagucu

SEQ ID NO: 4235009 - RNA, 118 nt, Human
gccacagaauuguauggagacagcagggccggggagggcuguggggcccuucagggcuccggccuucugacuccccuggcccaggcucagagucccuccucccucaccugcccuuggc

SEQ ID NO: 4235010 - RNA, 59 nt, Human
gggguuggaggcauugaaacagaagcaguuaugcuuggucugccaguuucucuuacuuu

SEQ ID NO: 4235011 - RNA, 84 nt, Human
guccuaguaguaccaaagugcucauagugcagguaguuuuggcaugacucuacuguaguaugggcacuuccaguacucuuggau

SEQ ID NO: 4235012 - RNA, 67 nt, Human
acaaaggacaccaaacuaauugggauuaaaaaacucuuuugugucacuuaagguuggugucucuugu

SEQ ID NO: 4235013 - RNA, 57 nt, Human
ggaguguaagugacucaccuggaccccacagccagugagcauuagugcuuauauucc

SEQ ID NO: 4235014 - RNA, 71 nt, Human
uguuguccucucuguuaugcuuucaugaagauccacccaucuucucgaacaaccuacaggguggaacagca

SEQ ID NO: 4235015 - RNA, 71 nt, Human
auaggagcuaaggauuuuuauauguaucaccaaaaugcuaaagugguagauaaacaacucuuagcuguuau

SEQ ID NO: 4235016 - RNA, 118 nt, Human
auuaucuagagaugaauuguuuauauuauuucucagcauauugccuuugaaugcucuugggcacucagcucacaauguugagaaagugauugauaaucaaguauuuuaaauggauaau

SEQ ID NO: 4235017 - RNA, 76 nt, Human
uccuaaagcucaauuguuuggucucugguuuucauccuuagagaagccauggagaacagacuugaaaaguuuagga

SEQ ID NO: 4235018 - RNA, 76 nt, Human
aagauaucaaggcuggaauugcuugagcuaggaaaaacuaaauuuuucuguuuguaacuccagcaagacagaucuu

SEQ ID NO: 4235019 - RNA, 59 nt, Human
cagcuauggaauuggcccagauggucacccaagccaugugguccaaggacucauaccug

SEQ ID NO: 4235020 - RNA, 129 nt, Human
cuggaucagcaucucagccccugaaugccccuuccuccugcuuuuucuucuuccgaccugcugcuaugccagaucuggaggucucagggcgggaaaggggccuggggcaugaguaaggaugaaauccag

SEQ ID NO: 4235021 - RNA, 57 nt, Human
uucuagcucauggugacagaucuguuucaagggucugucacagugcacagcuaagaa

SEQ ID NO: 4235022 - RNA, 55 nt, Human
cggggcgggcgugggagguggacguguggaucccugaccgccgcaaccugcuccg

SEQ ID NO: 4235023 - RNA, 59 nt, Human
ccugggcauaaaucacuccaagcguaaauuucccauguuuuggagaucacguguccagg

SEQ ID NO: 4235024 - RNA, 99 nt, Human
aggauugacuguugucuguugccuuuuucuggaaugcagugagcauuagauauggucauuucaagccucacugcguuuuguaucaguuuagucuguucu

SEQ ID NO: 4235025 - RNA, 99 nt, Human
guaaacgccuugagccuugccugaauuuaucugaaugguggaacagaaaucauuuagggcucuauucuaauggauucugggaaguguuuuuagcuuugc

SEQ ID NO: 4235026 - RNA, 126 nt, Human
ucuauuauuuugcaaaccauuacauuaucacagcugcuaagcugcauaacuuaagaauucggaauacaacagagucucuaucguugagugugugcugcuuacauucugaauguauucaugcaggga

SEQ ID NO: 4235027 - RNA, 111 nt, Human
gggcgaagcgaggcgaggcgagggcggccgggccgggcaugcgagcugagcggccccccggcgucgccgccgccugcccgcgccccuagccgcccgcgcgcccgagucccc

SEQ ID NO: 4235028 - RNA, 79 nt, Human
cagcacuggggucaccaggauugggcuguaggccugcauggacgaugcgccgcguggcagucuuggugacugggugcug

SEQ ID NO: 4235029 - RNA, 56 nt, Human
ucccuugacauuacuugggaggugggcauuauuuccccagaaaaguaaacaaggga

SEQ ID NO: 4235030 - RNA, 76 nt, Human
aagcugaauaacuucagugugguauaaaacgugguuuuuaggcuauguuugugauugcugaaaagaauucuaguuu

SEQ ID NO: 4235031 - RNA, 70 nt, Human
aagcuguagguaguagagaacucugcucugcaggcuguaggggagaagcacuccuugccuuugacaguuu

SEQ ID NO: 4235032 - RNA, 88 nt, Human
uguaguacuuacguacuucuuagugauuuaacauguauagaacugcuuccucuauuacgugucacugaugaaguuuauagguguugca

SEQ ID NO: 4235033 - RNA, 79 nt, Human
gggccggacaggggauaggcaggaaggcaggaugcccacggccgaguccaugcugccuuccuucuccccuccuucgccc

SEQ ID NO: 4235034 - RNA, 85 nt, Human
aaauaaguuccugcuauuaacaggcucuguucuaguuguuugagauguaucagacaacuagugucuguaugauaagggcuuauuu

SEQ ID NO: 4235035 - RNA, 82 nt, Human
gaauggcuuucugcacuuugagaauuuuacuuguguggacgaugcagauguagauucugaaauggacccagaacagccaguc

SEQ ID NO: 4235036 - RNA, 60 nt, Human
gcucgggggucgggcggcgguccacagggccaucugguggccguccccugacucucuggc

SEQ ID NO: 4235037 - RNA, 69 nt, Human
uacuuuaauugcaaaaauaaaucuugaaaacauaaaugugagggguguguucuuugcuuaauuaaagua

SEQ ID NO: 4235038 - RNA, 61 nt, Human
ucaccacauguccgaaauucagcuggcuuucucuaguagcugccguuucccaucgugguga

SEQ ID NO: 4235039 - RNA, 126 nt, Human
gugccgggagccgucuccgucgccgccucgggggaaccggcccgggccucggccgccucuaguccucacacagccgaggcccucucggucccccgccgcggccccucggcgggcgggcccacgcgc

SEQ ID NO: 4235040 - RNA, 69 nt, Human
gugcagcuuuggagguggaacucuauuuucacacuuuucuauggagccuuccgagucccagguuuucac

SEQ ID NO: 4235041 - RNA, 77 nt, Human
gguguggaugucucagagacaucagguuguagcagugucugaaauuuguuuccuaagugucucugaaguccagcgcu

SEQ ID NO: 4235042 - RNA, 57 nt, Human
cucacugugggcuaugaaugggcuauguguuuauauucuguucucuugccacaugag

SEQ ID NO: 4235043 - RNA, 70 nt, Human
uucauuaucuguuccccuaugcucucuauuuuuaucagaaaucugagcaggaaagagcagagagaaugag

SEQ ID NO: 4235044 - RNA, 68 nt, Human
ggccucgggcacggaaggcgccaggggugcggguuccugcaaccccuuggaguccgcgcccagaggcu

SEQ ID NO: 4235045 - RNA, 59 nt, Human
aaugugcauaacuuuauaaauucagugaccacuguugucauagaguggugugucacauu

SEQ ID NO: 4235046 - RNA, 56 nt, Human
cuggauagaggaugguaggcacauaaaacauugcucaugccccacccucuauccag

SEQ ID NO: 4235047 - RNA, 120 nt, Human
cuccaguguccugaagcccgguuccugaugauuccuggguccucacaaucccaggcccugucagcucuggggucucagggaugggaggccccagguucuggaagcuguugugcacuugag

SEQ ID NO: 4235048 - RNA, 74 nt, Human
agugagggguuguuaacaaagaauauauauuggucauucuuacaacuacuauuuaaagucagcaacuuuucacu

SEQ ID NO: 4235049 - RNA, 61 nt, Human
auacaugcaccugucuuuuaaggauauuccuauaucuuagaagaaauggguccacuugugu

SEQ ID NO: 4235050 - RNA, 93 nt, Human
aauuuucaguuuuuaaucuaaucugccuuccuaaucuuccuggugauuggaaacagguuaggaaugggagguaauggaauaaacaugaggauu

SEQ ID NO: 4235051 - RNA, 89 nt, Human
aggguaugacauguuuugcuuucuggauaagcagggucucucuuaaauaugaagauggcuccaguguccagagggagacuaaaaucucu

SEQ ID NO: 4235052 - RNA, 71 nt, Human
gcuuuucagacugcccauguuugccauuugcuguuugacugguaaauuguuuggcaagucugugccucugc

SEQ ID NO: 4235053 - RNA, 63 nt, Human
agccauggaggaugugcagcaugggcaggaaaagagccuucagugguguacauuuccauaguu

SEQ ID NO: 4235054 - RNA, 65 nt, Human
gaacaucuucuauguguaggcauuuuggcaggugguagaaauaggcccuuacauggaaaugguuc

SEQ ID NO: 4235055 - RNA, 67 nt, Human
uuccucacuucuuucucuucacuuaaaacaauuuuuuuggagggguuuuggggaggaagugagcgga

SEQ ID NO: 4235056 - RNA, 85 nt, Human
uaucuccaugauggcuuguuuagcauaggucacugggagccucccagaccuggaaaacaggcuugcccaugguuuaugccaggua

SEQ ID NO: 4235057 - RNA, 64 nt, Human
aggggauucgggugccccuagucgaaugaggaggauggaaagacugggggugcccaucuccccu

SEQ ID NO: 4235058 - RNA, 78 nt, Human
uuucaagauuuuaaaagauguauaagguuaaguuugcaaauauaauggaaaugcuguauaucuuuugaagugaugaaa

SEQ ID NO: 4235059 - RNA, 67 nt, Human
ggauagagcuggggaagaagcugggccagaauacagcugcuucagaacucuagucucagccugaucc

SEQ ID NO: 4235060 - RNA, 83 nt, Human
ugguauguguugcaauguccuguaagauacaaguuuaagagacugucuuucuuggaagugucuaauacagguaguaggugcua

SEQ ID NO: 4235061 - RNA, 76 nt, Human
ggaaaggagccaggaggaggccgggaggaagcccucuauggagaagguucugcccaggccuccccaacuccuuacc

SEQ ID NO: 4235062 - RNA, 83 nt, Human
gagucuugcggagggcccucaggacugggugaugcugugagggagcaugaaccccgugucccugaggguccugagcgccacuc

SEQ ID NO: 4235063 - RNA, 62 nt, Human
ucuagaugcggcugugggggaaugggagcggccggaccucccagccugacagugcaucaaga

SEQ ID NO: 4235064 - RNA, 88 nt, Human
cugccucggcucgccgcuuccagaguaaggcgcugcccaccugguagcuguguucauucuggauguaggcuccggcgggugggggcag

SEQ ID NO: 4235065 - RNA, 67 nt, Human
uuuugguaguccagaguuuaguuccccagaagacaccaaugaggggaaaauucgacuaaaaccagaa

SEQ ID NO: 4235066 - RNA, 79 nt, Human
gccaacaccagguugagacuucggcuuuccuacauuuacucagaguuccagagucaaagccaagucugauuuuguuggu

SEQ ID NO: 4235067 - RNA, 101 nt, Human
uacuucuggggcuugcucauucuccguccacacuuagagaguuuaggaauaauuuuuuucagaauuacuccaguguguggguuggcagguuguagaaagug

SEQ ID NO: 4235068 - RNA, 72 nt, Human
ucugugaagguccugauuugugaccaucaaugucuuuuuaauguaucugcucaacuucuaggacuucagggg

SEQ ID NO: 4235069 - RNA, 126 nt, Human
cuguuacaauuuuugcaaaggcaguuucacagucaagguggaccagaaaaauucaguaaauagucugaaaaauauggaauacuccacuuuuauuucuuaguuguugcuuuuuaaaaggaguaccag

SEQ ID NO: 4235070 - RNA, 55 nt, Human
ugagggaaauauggguuugguuaugguaaucuuuaauauccaguuauuucccuca

SEQ ID NO: 4235071 - RNA, 70 nt, Human
ugccuagaauauaguaaauauuuucuaguuucuuaaaugacuaguaauauuccuacauuaugugauggca

SEQ ID NO: 4235072 - RNA, 78 nt, Human
aaaaguuacacgacuauuuaugugacauggagucguauuaguagugacgugcccacauaaauagcacugugaauuuuu

SEQ ID NO: 4235073 - RNA, 58 nt, Human
aggcagucugauucaagagcccauguuuccugaaagaggaauuuuggguggaaagucu

SEQ ID NO: 4235074 - RNA, 83 nt, Human
gcaacaugcaauagcacauguugguugaguaacuggacacgcaaacaauguucucugcuuacgcaaccuguguuuggaugugu

SEQ ID NO: 4235075 - RNA, 79 nt, Human
uggaggauaauggcccucuuaucacagcuccacuagucagugcuccaguggggacacuguguggggggcuacaacccca

SEQ ID NO: 4235076 - RNA, 89 nt, Human
uuucagaauuuuaagaaaggggaaguuccucuuggaaaagauauagcaaccaucggggaaugaccuuuucauuucagaaguggaugagg

SEQ ID NO: 4235077 - RNA, 59 nt, Human
cguggccacaguggagcugagcaugaccagcaguugcugcagcaucuccuugugccaug

SEQ ID NO: 4235078 - RNA, 120 nt, Human
gggccugagauggcugggaagcaggcggguuuaggacaaugcuuuuuaaaguucauuuuaaguacuuuuaaggauuuccaggccugcgccucgagcggcccuaaguaagcuucuaggccc

SEQ ID NO: 4235079 - RNA, 56 nt, Human
gaacgcugugcacuggguccaggaugacuugcacacccuguucacugcgcaguuuc

SEQ ID NO: 4235080 - RNA, 68 nt, Human
agccuaauuuguaggucugugugcagacauaugcugggacagccaggcacacagccuagaguuuggcu

SEQ ID NO: 4235081 - RNA, 101 nt, Human
gauaagggccuguuggugggccuggcucagagaugucugcugccuugcuacagagcagaaagcacccugcacuuucuggacaggacacccagguuuuuauc

SEQ ID NO: 4235082 - RNA, 79 nt, Human
gcagaaggugcugaggguccuggcuugaggcccauccuccuucugcagggccccaugccgggguggcuccagcaccugc

SEQ ID NO: 4235083 - RNA, 68 nt, Human
gcaacgcggagcaguggaggggccagggugcagcugcgacugugcccccucuacugcugaaguuuugu

SEQ ID NO: 4235084 - RNA, 130 nt, Human
cgguguauaauacuuuuaaugugcuguuuaauuuuguuugcuaguauuuuguuugagguucucaaucucuuuucuaccuggauaaaugaaggcauacagauaauuuucauaauaaagccauacuacagug

SEQ ID NO: 4235085 - RNA, 55 nt, Human
gcagacaucaagcacaggcccagugugcaucugcugggcuuuuggaauggucugu

SEQ ID NO: 4235086 - RNA, 82 nt, Human
agccgggaaguggcaggggaaggguuggauggagaucuguugucuccaaagucugugcuccuuccuugucaucuacugugcu

SEQ ID NO: 4235087 - RNA, 72 nt, Human
uucugucaguguugguggaaauaagagacggauuuuaccuacuguauuacauucaaccagcaauuggcagaa

SEQ ID NO: 4235088 - RNA, 70 nt, Human
ugaggaucucauggcucuaaagacauagauuucugaauuucaaggaccuauuguccagagccaggccuug

SEQ ID NO: 4235089 - RNA, 76 nt, Human
cuuacaauuuucuuggacuuuuuugcaguugagucgcucuugacagcuauaagugaagucaggaaggagauugaag

SEQ ID NO: 4235090 - RNA, 91 nt, Human
ucccacuucuuaagucacauggcuucugucuuggaaauuuuaccuuuaaaagauuauuuaagacaggaaccaggaggcuugggaacaggga

SEQ ID NO: 4235091 - RNA, 61 nt, Human
ggggaggucagcuggaggggaggcuggcaccuuccaagccccucuccuugugcaccugcuc

SEQ ID NO: 4235092 - RNA, 55 nt, Human
gauggugauggcccuaagcugagauuuuuuugaguucuaggguuugguuaucauc

SEQ ID NO: 4235093 - RNA, 61 nt, Human
aagugcuagugagucuauuguaugguagauaaugacagaauagccuugacucacagcucuu

SEQ ID NO: 4235094 - RNA, 79 nt, Human
gaaggaaggaugguaacaguuucauuugacagaugagcaagagaagucaagugauuuucccaccaucuacauugccuuc

SEQ ID NO: 4235095 - RNA, 69 nt, Human
ugcuuccacucaguuuuucauugcaaacuggauaauagccaucugcagauaaaauuuuugaugggagua

SEQ ID NO: 4235096 - RNA, 75 nt, Human
ggcuggagucucuuguaggggcagaggaagaaccagaugucugcccuuccuuccucugucaggcaggccccagcc

SEQ ID NO: 4235097 - RNA, 69 nt, Human
ccucagauugcuggaguagaaaacuuaacuuuccaaaacacugaguuguuuucagcccagcauuagagg

SEQ ID NO: 4235098 - RNA, 95 nt, Human
uaauauauaauaaaccucacauacaugggaaauauaagaauuuuccuagccagcugaaauuucuuuguuaucuugguagugauuuauagauguua

SEQ ID NO: 4235099 - RNA, 82 nt, Human
cagcauguaauuuuagccaagauauguccuguuacuaaguaucucccaaugcuuuaguaaaacguauuuaggagaaauguug

SEQ ID NO: 4235100 - RNA, 72 nt, Human
ggcugcgggccggcaggggaggaguuaacuccggagguaccggcugggcucacuguaccugccgccgccgcc

SEQ ID NO: 4235101 - RNA, 64 nt, Human
ggaagugaaauaugcccauugcugucuucacccagagaaaauagauugcucauauauuacuucu

SEQ ID NO: 4235102 - RNA, 57 nt, Human
ggaauuaagaggcuggacagggacuagagaucuguuaauuccaaaccuuuuacuucc

SEQ ID NO: 4235103 - RNA, 81 nt, Human
uuuucucuauuuaaccaucaacagucuacuuuuugccacuugaaaggcauagggauucaaacagguuuuagguagggaaaa

SEQ ID NO: 4235104 - RNA, 64 nt, Human
gugccaggcacaggaagcagcccccgagacacguuuucgcuggagguuucucugggcuuggcau

SEQ ID NO: 4235105 - RNA, 74 nt, Human
cucagaggggacaggacuccuggggccuggcuggggcccagagccaggccgcccucuccuguuagcccucagag

SEQ ID NO: 4235106 - RNA, 56 nt, Human
gaagcucaguugcuuagaucucuaaucaucgaucagguuuaggaaaacugagaguc

SEQ ID NO: 4235107 - RNA, 60 nt, Human
uaacuuuuuauccuguuaaauggggaccaucauaucuuauuucauaggguuaaaggguua

SEQ ID NO: 4235108 - RNA, 87 nt, Human
guguaguaaggugaugguugggggaugucagcaggacucaaagaccugggccucagcuguuucucucaucaguuugcuauuuuacac

SEQ ID NO: 4235109 - RNA, 77 nt, Human
gcugacugacuacauguccugucauuuucuuuacaugcacgauugauaaaacaaugacaguggcacagucacuuggc

SEQ ID NO: 4235110 - RNA, 80 nt, Human
ggccagaggugguggguguggaagcagcguggggcgccccaagggaccccaguuucaccuaccccgccacuagaucagcc

SEQ ID NO: 4235111 - RNA, 63 nt, Human
gaguugucggaggaagggggcggcgagcaauaagaacccgccgcacccgguccucagcgacuc

SEQ ID NO: 4235112 - RNA, 91 nt, Human
ugagaagauggaaauucauuuacguaacaguaacgcugaaucaauauauuuucagcuugcccugauguggaagaaauauaccaucucauua

SEQ ID NO: 4235113 - RNA, 77 nt, Human
ggaccaaggcagggaccagaggaaugggaggggaggcauggcuggcccucacucagguuuggacccugccucgggcc

SEQ ID NO: 4235114 - RNA, 61 nt, Human
gcgguauuuuggaugcauugagaugcauguuaaugcgcagugagguuaagaaugcagacgc

SEQ ID NO: 4235115 - RNA, 78 nt, Human
agaguaauguggaguuugugcuaacucuagccagcuuaauuagugacuggauaaauugcacaacucucacauucuucu

SEQ ID NO: 4235116 - RNA, 60 nt, Human
cggcggcgaaccgaccugggugccgaaggccccuuuaaacgcccacccgcacucccgccg

SEQ ID NO: 4235117 - RNA, 63 nt, Human
caaaggaauuacauguuucggagacuaacgaguguccuuucaucccggucaugcauuccuuug

SEQ ID NO: 4235118 - RNA, 57 nt, Human
gcaaagaauugauucauuuugcuggaggaaucagcaauuggaaugaauucuauuugc

SEQ ID NO: 4235119 - RNA, 68 nt, Human
uguauucuuuauuuucuguacuugcuucuagagagggaguaaauacuaugagauaaugaagaaagaca

SEQ ID NO: 4235120 - RNA, 59 nt, Human
cucacauacaagagaugguggaucuuguggcccagaaguaccacuucuuugugugugag

SEQ ID NO: 4235121 - RNA, 57 nt, Human
gcuaagcuuugagucuggacagaauggcuuuauucccucuaaugaagugagcuuagc

SEQ ID NO: 4235122 - RNA, 55 nt, Human
caaggggagcugguauggauggaaugacaagaauuaguccaaauggaaccccuug

SEQ ID NO: 4235123 - RNA, 70 nt, Human
uaagcuuucagcagcagccuccugugcuacagcucacacagucaggcuguggcaggcagcuggaagcuug

SEQ ID NO: 4235124 - RNA, 85 nt, Human
cacccauaugucccuccagugucccaguggggaguuagaggaaugguucucaucuccaggaaagacacuggacugauaccaggug

SEQ ID NO: 4235125 - RNA, 79 nt, Human
augaggguggggaaugggccauguaaugucugcuuucuuauauuugcccuuuuguaaguggucuguuucuucuuuucau

SEQ ID NO: 4235126 - RNA, 73 nt, Human
acauaaccuaaaucugaaggaaacagcuucacaacauugcguuugagcuuugguaccuucauuugggaagugu

SEQ ID NO: 4235127 - RNA, 73 nt, Human
gaggucaugaccaugggaauaaaguuauuucaauaguugacucuuuugaaaaguuuguuacucacaugacuuc

SEQ ID NO: 4235128 - RNA, 67 nt, Human
aagcccuagaguugagagcacccacaggauucacgcuucccugacucugggguucccuuuagggcuu

SEQ ID NO: 4235129 - RNA, 55 nt, Human
guucaaggagcagcuugcuacaguuuccguuucugcuggugcgcuguuccugagc

SEQ ID NO: 4235130 - RNA, 81 nt, Human
guaagaucugauaggggaagcauagguuuagaagaucuuugagggucugauuuggcaucaguguauccucccucagcagac

SEQ ID NO: 4235131 - RNA, 109 nt, Human
uugggguuguuggccauuguuugaagcucuccuacucucuuucuagcauagucaguguguugcagagaacuaaagggaguaaaagacacagugccucauugaauccuaa

SEQ ID NO: 4235132 - RNA, 99 nt, Human
gguugucuauuuucuaauuucuccuuuucaguuagaugauaugcaaaccccauggcacuaauuguuuaaggauaggaaugaggauucuuuugcacagcc

SEQ ID NO: 4235133 - RNA, 65 nt, Human
uugggagggggauucuggcgagaauguguaauccuaaguaccuuucucaagccuuccuuucccaa

SEQ ID NO: 4235134 - RNA, 70 nt, Human
ugaguuuuggaagauguuacagacauaugcugauuuauagaugaggugugugauugucuucugaaaguca

SEQ ID NO: 4235135 - RNA, 63 nt, Human
cuggagaacagagcuguuuagacuuuucugcaugaugagaacuuagcaguuguugauuuccag

SEQ ID NO: 4235136 - RNA, 67 nt, Human
ccucccuuggcuuaccuucuguguggcugccuaccaacacggucacugaauuucaagcuaguggagg

SEQ ID NO: 4235137 - RNA, 69 nt, Human
ugggugugaauagagccuggagcacacaccacaaaaauguguuugcucuguuuuaacucuuucaaccua

SEQ ID NO: 4235138 - RNA, 63 nt, Human
cagucugguacuggaggaguucagagaaagaaggaaucucuggacaucugcggugcuucacug

SEQ ID NO: 4235139 - RNA, 62 nt, Human
aaauguuucauucuauuuuuagugacucuguuuaaagaguuucugaaaggaaagaaauuuuu

SEQ ID NO: 4235140 - RNA, 101 nt, Human
uugagaugggagaauugcuugaacccaggaaguggagguugcagugagccgagauuauaccccugcacuccagccugggugacagcgagauucugucucaa

SEQ ID NO: 4235141 - RNA, 87 nt, Human
uugugaguguuaaaugauaugggaaggauuugucuuucauuaaccauauggaaaagaugucuuccugaauuacauagcauuucauag

SEQ ID NO: 4235142 - RNA, 55 nt, Human
gaauucuaguucuguaucucugauccaucaugugacgauauugagcugagaauuc

SEQ ID NO: 4235143 - RNA, 61 nt, Human
guuccaaggagagcucgaccucaaagguguuagugcuuuggggucaaggcugccuuggggu

SEQ ID NO: 4235144 - RNA, 99 nt, Human
cuuagaaaauauuucuaaaacuuuuccaaauuauguauaggcuuuuauaucucuagguaagaagugagcaaguuuaaauuagaaagcauauuuuuuaag

SEQ ID NO: 4235145 - RNA, 62 nt, Human
cucuguugucaguggaagcagcacagaucuucccugcaccguguggccauuugaaaacaggg

SEQ ID NO: 4235146 - RNA, 106 nt, Human
ggcccagcuccacccagggauauagcuggaggggcaggaugcuggcacugcagccgaccaguaucucccauucacagugugcugcugggccauggccugcugggcc

SEQ ID NO: 4235147 - RNA, 73 nt, Human
ccguguucuaaccuuauuguguaucaccauaacaguuuauuguggcucugaugucauaaaggaagagacaugg

SEQ ID NO: 4235148 - RNA, 67 nt, Human
gagaacaaggaagagucggcaguaguacccuggaaaugcuaaaugaaacacucuuccuuauguucuu

SEQ ID NO: 4235149 - RNA, 70 nt, Human
uuccaaggcugcuauuuguuucucagauaacuugugaaaauaaaucaagggcaguauuuccuuuuuggag

SEQ ID NO: 4235150 - RNA, 61 nt, Human
cucgauagcagcgcuggcccucugccuugaacgccacggcggcacgcaggcugcugucgag

SEQ ID NO: 4235151 - RNA, 91 nt, Human
uaggggcaugguuaauaccugagauuuuuacucaguaaauccugaugguuacuguguguaaaauaucuuuaaguaggauugaaggccucug

SEQ ID NO: 4235152 - RNA, 61 nt, Human
cuacuguaguuaaaguuuuguagaaacagcacaguuuuuuaagacuggcugaacuuaguag

SEQ ID NO: 4235153 - RNA, 96 nt, Human
ucucauguuaucauaauugcaagaaagaucugaaagaagcgaguggucugagccugcccugcuugggucuguuuugcaaagaagaggagggugggg

SEQ ID NO: 4235154 - RNA, 61 nt, Leptospira interrogans serovar lai str. 56601
aaugaucauccgacuugcaaaagauucuuuaccgaccggaaucguaggugguuugaucauu

SEQ ID NO: 4235155 - RNA, 68 nt, Leptospira interrogans serovar lai str. 56601
aaucaucaauuaugucaaaucucuggaucgucaaauuccgaucggagcguuggaauuaauuagugauu

SEQ ID NO: 4235156 - RNA, 62 nt, Leptospira interrogans serovar lai str. 56601
gaagauauucgaguggauuauuacgggaaucaaacuccgaucaaucagcuuggaaauauuuc

SEQ ID NO: 4235157 - RNA, 79 nt, Leptospira interrogans serovar lai str. 56601
gauagagagucuuacguaacaugggauauugggaauacaaauucgcaaaauauauuuuauuugcauggggcuuuacauc

SEQ ID NO: 4235158 - RNA, 71 nt, Leptospira interrogans serovar lai str. 56601
aaauucucuuucgguagaaguggaaacuaaaaacguguuuccucuagaaucuucuccgauggaucgaauuu

SEQ ID NO: 4235159 - RNA, 55 nt, Leptospira interrogans serovar lai str. 56601
aagcgauuacagauucucugauuugggaggacggaucuucgcugugacuucguuu

SEQ ID NO: 4235160 - RNA, 88 nt, Leptospira interrogans serovar lai str. 56601
gaucguaucgauaccauauucuuuggccaucugaaucgcuuguauaacacuugcuuuaaaugcagccguagaauaagguuuuacgauu

SEQ ID NO: 4235161 - RNA, 84 nt, Leptospira interrogans serovar lai str. 56601
cgaguucgguauaagaaaaacuaggaaaauuuuuacacucauuagagucguugaaaaauuccauaguucagauuagcaaaaccg

SEQ ID NO: 4235162 - RNA, 61 nt, Leptospira interrogans serovar lai str. 56601
ugacaacguugugcuugaauacaaccgauggacaucauugcuucucuugcgacguugauca

SEQ ID NO: 4235163 - RNA, 67 nt, Leptospira interrogans serovar lai str. 56601
gacgauuuuaaaucccucauuauaauuuuagaauaucuuccuuugauaaguggauauuggagucguu

SEQ ID NO: 4235164 - RNA, 82 nt, Leptospira interrogans serovar lai str. 56601
ugcccuccuaaaaauuuaguuagagaaugaacuacaauaucugcaccguguucaaucggauugacuaaauagggagagggua

SEQ ID NO: 4235165 - RNA, 56 nt, Leptospira interrogans serovar lai str. 56601
ucggauucuucuaaaagucguauaacuucuguuuggcgaauuucggaacggaccga

SEQ ID NO: 4235166 - RNA, 61 nt, Leptospira interrogans serovar lai str. 56601
aagugccggguaauggagagggaucacucgaacgaauugguuuuucucuaugcccugacuu

SEQ ID NO: 4235167 - RNA, 86 nt, Leptospira interrogans serovar lai str. 56601
uauuucuuuuggaaguaucgugaauugguuauccugcaaauccaauguuuguaaauucuucaauugaccaauuuccuuaggaagug

SEQ ID NO: 4235168 - RNA, 66 nt, Leptospira interrogans serovar lai str. 56601
caugagcguaaauaucuggccggaaucgaagcaaugaaugauuccgaaacgguuuacgcuaacgug

SEQ ID NO: 4235169 - RNA, 105 nt, Leptospira interrogans serovar lai str. 56601
acguuuuaggggugucucguucaggauucuaucaauuucuaaaacggaguaaaaacgaauuagaaaaauauaauccugaacuugucgaguucauucgggaaacgu

SEQ ID NO: 4235170 - RNA, 73 nt, Leptospira interrogans serovar lai str. 56601
guuuuucuugaauuggagcgggaaaaaauugaucguaaaaaguuucuccuaaaauuuucaauucaugaagaau

SEQ ID NO: 4235171 - RNA, 63 nt, Leptospira interrogans serovar lai str. 56601
gguuaaguuauugguauuuuauaaaaauuuaaucugguuuuggaauuucacaauaacuugacc

SEQ ID NO: 4235172 - RNA, 73 nt, Leptospira interrogans serovar lai str. 56601
cgucccuuauuuccagaagguuauuucugcgaagugcaacuucaaguucaaguacuuucugcagauggggacg

SEQ ID NO: 4235173 - RNA, 67 nt, Leptospira interrogans serovar lai str. 56601
gggcuggaaguuuacuccggauuuuaggagaacaucuuccuccugaaguuuacaaacaucuaggccc

SEQ ID NO: 4235174 - RNA, 79 nt, Leptospira interrogans serovar lai str. 56601
ugugggagcuaccacaauugauaaaauagaaguuuauaacgauugaaucuguuauauuucaagugugggaacucucaca

SEQ ID NO: 4235175 - RNA, 82 nt, Leptospira interrogans serovar lai str. 56601
ucggauuuacguucuauuuuuuauuagaaucacgugaguucgacguaaguaacucaugauucugaaaaaaguugaaaucuga

SEQ ID NO: 4235176 - RNA, 66 nt, Leptospira interrogans serovar lai str. 56601
ucucgaagaagaggguucaauugauacaauuccaaauuuguaaaccaaucgaaauucuuuuugaga

SEQ ID NO: 4235177 - RNA, 62 nt, Leptospira interrogans serovar lai str. 56601
agagaaggggauacgcagguuuuaugugccaauguggaucaaacggcgguucuugcuucuuu

SEQ ID NO: 4235178 - RNA, 65 nt, Leptospira interrogans serovar lai str. 56601
cugugguguguugaguuugaaaaagucuuccaacuugggacuuguucacguuaaauacauugugg

SEQ ID NO: 4235179 - RNA, 70 nt, Leptospira interrogans serovar lai str. 56601
gaaaugguagaucgacuuagaucccuuuauauacaacuuggguuguuacugaucuggggauuugccuuuc

SEQ ID NO: 4235180 - RNA, 90 nt, Leptospira interrogans serovar lai str. 56601
gggaucgaugcgaggucaaguuauugguauuuuauaauaauuuaauaugguucuaaaauuccacaauaacuugaccagagcugagagccc

SEQ ID NO: 4235181 - RNA, 61 nt, Leptospira interrogans serovar lai str. 56601
ugcgauuuuugauuuuguagucgcggauguuucuaacguuuugcaaauucaaaaggucgca

SEQ ID NO: 4235182 - RNA, 56 nt, Leptospira interrogans serovar lai str. 56601
guuccuauuucuguuggcucuucgauuugaaagguucccugagccagaguaggaac

SEQ ID NO: 4235183 - RNA, 77 nt, Leptospira interrogans serovar lai str. 56601
uuaucauaaacacgcugaagaaugguuugcggaguuacaaaagaaacgcagacaguucucucagaaagauaugguga

SEQ ID NO: 4235184 - RNA, 65 nt, Leptospira interrogans serovar lai str. 56601
uuuucaugagaauggcuugaaguuauggagugaaaagacaagacugucagagucuuucaugaaaa

SEQ ID NO: 4235185 - RNA, 76 nt, Leptospira interrogans serovar lai str. 56601
uugaaagauucuugggcaagagaaagggcugaauuucaaaacuucaaacgucgcucugcucaggaauucguuucaa

SEQ ID NO: 4235186 - RNA, 124 nt, Leptospira interrogans serovar lai str. 56601
augguaaauaaaaauuuuucaggaaguuuuugaagugguucuugaaaaguaggaaaagauucuacuccgggauaaacuacuuucaauuucgaacuuagauuugauuuaaauuuuaaaauaucau

SEQ ID NO: 4235187 - RNA, 77 nt, Leptospira interrogans serovar lai str. 56601
uuggacucuuccuucugcugccggaaacgucguggguucucucgcgguuccuauguuaguuagaaaaauucguccaa

SEQ ID NO: 4235188 - RNA, 89 nt, Leptospira interrogans serovar lai str. 56601
ucuucugagucuuuggaagaauauccuuauuccaauuuaucauccauagaauuggaaguagaacucuucaaccgggauaaaucagaaga

SEQ ID NO: 4235189 - RNA, 62 nt, Leptospira interrogans serovar lai str. 56601
gcauuugauucaaaauuucuaaagaaugaucguguagaaauucuuugagguuuugggcaagc

SEQ ID NO: 4235190 - RNA, 80 nt, Leptospira interrogans serovar lai str. 56601
ggaaccuuugaucgauuuaucugggguuuugugaaucauaaaacgaucuauaacucuuggaaaacgaucaaagaugugcc

SEQ ID NO: 4235191 - RNA, 99 nt, Leptospira interrogans serovar lai str. 56601
uuucaaaacuccaccuugaaguuccacgaguuguuuugugaugcuaagucccaaaccagaaccuccgaacuuucuggcgguagacguaucauuuugaga

SEQ ID NO: 4235192 - RNA, 81 nt, Leptospira interrogans serovar lai str. 56601
guggagccuugucucagauggacuuuguacuuuuuccaaaagaagauauagaaaucaucaugaucaaagccgaauuuccac

SEQ ID NO: 4235193 - RNA, 68 nt, Leptospira interrogans serovar lai str. 56601
uuaauacuagucaaaucgaccggaagaaacauaacguaagaaccuucauuauguuugacuagcauuga

SEQ ID NO: 4235194 - RNA, 77 nt, Leptospira interrogans serovar lai str. 56601
gaaauaaggaauucaagcucuaguagaaaaaauugcccgcaaggguaauuucaacacggagaguuugauccuggcuc

SEQ ID NO: 4235195 - RNA, 60 nt, Leptospira interrogans serovar lai str. 56601
guaaaaucgcgguuugugagaguucccacauuuuacuuuuacagaaaaaucagauuuuac

SEQ ID NO: 4235196 - RNA, 56 nt, Leptospira interrogans serovar lai str. 56601
aucuucauuagagauauacgaggauggaauuucuucuguuaaacuuuugugaagau

SEQ ID NO: 4235197 - RNA, 55 nt, Leptospira interrogans serovar lai str. 56601
cgucaaaaaauugcagagauagagaauauuucuuauucugagcaagauuuugaug

SEQ ID NO: 4235198 - RNA, 72 nt, Leptospira interrogans serovar lai str. 56601
cucacguuaugcucccuuuuagaccuucuucaauccauuccgaugauagucuaaaugcgaaguaugcggaag

SEQ ID NO: 4235199 - RNA, 77 nt, Leptospira interrogans serovar lai str. 56601
gcgggaacuacggaaauuaugaaagagaucauaggcagaagccugggacucugaaauaaauuucuaaugguucccgu

SEQ ID NO: 4235200 - RNA, 87 nt, Leptospira interrogans serovar lai str. 56601
ccguagaguuuucagauuucucaaaacaagaaacggaaauuucuucucguauucuuuugcuuuugggaaauuuaggaauuaaauugg

SEQ ID NO: 4235201 - RNA, 58 nt, Leptospira interrogans serovar lai str. 56601
gauuggaaaaaaucguuuuguuggaauucuuguuccggaacuacgauuucuucugauu

SEQ ID NO: 4235202 - RNA, 77 nt, Leptospira interrogans serovar lai str. 56601
gcggacccuaauacgggagauuauaacguuauccgaaauuauuuggauauuuuagaaucucuuccuugggagccagc

SEQ ID NO: 4235203 - RNA, 71 nt, Leptospira interrogans serovar lai str. 56601
ucgguaauacuucgaaguuuuuaaaugauagcucuuuagaaguuucuaaugaaauuuuggagugcugcugg

SEQ ID NO: 4235204 - RNA, 79 nt, Leptospira interrogans serovar lai str. 56601
gccaugcuuugaaucgaauacucaaaucgaugaguuuccaugaacaucaaucgggauuuuguucgcgggaaagcauggc

SEQ ID NO: 4235205 - RNA, 60 nt, Leptospira interrogans serovar lai str. 56601
aaguuuugcggaaaaucuucgauagaguuuuacucuuuguagaucauucugcauuuauuu

SEQ ID NO: 4235206 - RNA, 73 nt, Leptospira interrogans serovar lai str. 56601
cugaaauuauguuuugauucaauuuaaguuuagaagaauuuuaaaccgaagugaauuagaauguugugagcgg

SEQ ID NO: 4235207 - RNA, 75 nt, Leptospira interrogans serovar lai str. 56601
agguaguagagguagaaggaggauuuuucuuuaagauuuuuucuaaucaaaaauuacuuuugaccuuuggggcuu

SEQ ID NO: 4235208 - RNA, 58 nt, Leptospira interrogans serovar lai str. 56601
aguaguucccacauuuuagaguuuuuacugugagaucucgggguuugugggaacuacu

SEQ ID NO: 4235209 - RNA, 77 nt, Leptospira interrogans serovar lai str. 56601
uaguaauuuucucauugcacucaguuuguugauuguuucuuaauuuaacaugaguuugguguaagagaaucuuacua

SEQ ID NO: 4235210 - RNA, 75 nt, Leptospira interrogans serovar lai str. 56601
gguucgaagugguauuuuuagaaagggagauucuauuacgguucuuccaagugguuuuacaaguacgaucgaauc

SEQ ID NO: 4235211 - RNA, 130 nt, Leptospira interrogans serovar lai str. 56601
uguuuaaaauguucaucauaaagaacuguuugaaugugagauauugggugcucuauuauauaguuuuaaguggcaaaauuuuaauguaucauguucaaacgauuuaaaaaugauaguauacuuuuaaaua

SEQ ID NO: 4235212 - RNA, 61 nt, Leptospira interrogans serovar lai str. 56601
guaaauugugguguuuguucuuaaauucaacgaaagauggaacuugauaaccacaauucac

SEQ ID NO: 4235213 - RNA, 93 nt, Leptospira interrogans serovar lai str. 56601
ucuguauggccguaaucuucagaaugauuauuugcuuuggagauuauaaaaaguguuuuaucuucugaggaaauuuuaucguacacauaccga

SEQ ID NO: 4235214 - RNA, 77 nt, Leptospira interrogans serovar lai str. 56601
ucuucgagcucaguugagaaaagaagguucugagaugaaaguucucaagaacaaucuuuucuuaagagcuuugaagg

SEQ ID NO: 4235215 - RNA, 62 nt, Leptospira interrogans serovar lai str. 56601
uccaaacggauugaauuucuuaauuuucaaauucgggaaauuagagauguggaucugaagga

SEQ ID NO: 4235216 - RNA, 63 nt, Leptospira interrogans serovar lai str. 56601
agucgaaauacaauuuaccccugcuagucugauaggacucguagcgacguuguauuuuguacu

SEQ ID NO: 4235217 - RNA, 57 nt, Leptospira interrogans serovar lai str. 56601
uuugccgaacuuucugcaagccaggaagaauauuccuguuugguaaguucaggcaag

SEQ ID NO: 4235218 - RNA, 87 nt, Leptospira interrogans serovar lai str. 56601
gggaucgaugcgaggucaaguuauugauauauuauaauaauauaauguuauucuaguuuucaauaacuugaccagagcggagagccc

SEQ ID NO: 4235219 - RNA, 97 nt, Leptospira interrogans serovar lai str. 56601
cagcgaaaguauuucuauagaauauacgguucauaaaaaugauaucucucuuccuuugagaaacauggaaccguuucuuguagacaugaaaucgcug

SEQ ID NO: 4235220 - RNA, 83 nt, Leptospira interrogans serovar lai str. 56601
ggugguuaucggagguggaggaauugguugugacguggcucauaaacuuacagaagaagauucuucuacuaucgauuccuauu

SEQ ID NO: 4235221 - RNA, 61 nt, Leptospira interrogans serovar lai str. 56601
agaauccuacacuaaaauuauuuuaggucuucuagcuaauaaguuugguguaagagauuuu

SEQ ID NO: 4235222 - RNA, 77 nt, Leptospira interrogans serovar lai str. 56601
uguuauacaguaacccuucaaguaacggggcacguuucaacuauucccuuugcuucucaaggagguuuuguaggaca

SEQ ID NO: 4235223 - RNA, 77 nt, Leptospira interrogans serovar lai str. 56601
aacuauaugauggggugucuaaauuucuacugauaaacgaagauuugucuuagaauuuaugauacuuuauuagaguu

SEQ ID NO: 4235224 - RNA, 79 nt, Leptospira interrogans serovar lai str. 56601
cugacuuuguaugaauccguagccaggggaagaauacaucaucaauuuuuuccggaugcgguauuuauagaaaaaucag

SEQ ID NO: 4235225 - RNA, 87 nt, Leptospira interrogans serovar lai str. 56601
agaauauuauggguuuguuccaaaaguuggaauguaaguuuucucuuaaaaacguuauaaauuuuggaauugucccacuuauauuuu

SEQ ID NO: 4235226 - RNA, 77 nt, Leptospira interrogans serovar lai str. 56601
uaaaucuaucugauuuguaucgacuccaaaaugaauauacucgagcuaaggagauugcagcucagguauuagauuua

SEQ ID NO: 4235227 - RNA, 76 nt, Leptospira interrogans serovar lai str. 56601
ugcggaaaaggaaauuuuaggagaagaaguuuuucaaaccguaaaacaucuucgucaggaaacuucuguaaccgua

SEQ ID NO: 4235228 - RNA, 74 nt, Leptospira interrogans serovar lai str. 56601
ugaauacuugccguuggaucauugaucagguauuucuuaugaaggauucgauucuuugauccacaaguucguca

SEQ ID NO: 4235229 - RNA, 61 nt, Leptospira interrogans serovar lai str. 56601
cugcgucuauugcagaaugagaaacgucccaucuuagaauuaucguauguaauggauguag

SEQ ID NO: 4235230 - RNA, 61 nt, Leptospira interrogans serovar lai str. 56601
cgaucaauuugaauccgauuguucaaauuuccauuuugaauuucggacgcaaaaugaaucg

SEQ ID NO: 4235231 - RNA, 117 nt, Leptospira interrogans serovar lai str. 56601
ugaaguuuauuuuaacggagaaaaaaucggaagcggaggaaucguauuaaacggaaaaaucauaaaggacggauuuaaaagacaugugauucuuccgauuccggagaauaagguuca

SEQ ID NO: 4235232 - RNA, 73 nt, Leptospira interrogans serovar lai str. 56601
uuaaguuuugaauguguaauuaaaauuguuuuaaauucgaauugacaguauagauucacauucaaagcauuga

SEQ ID NO: 4235233 - RNA, 130 nt, Leptospira interrogans serovar lai str. 56601
aacgaagcuucucuuuuguaucgagguuugaugaacuuuugggaaauuuguucuggaaauuucguucguaaaaacgaucucuuaaaacuucuuagaaauccucuuuugcagaaaaagauucguauucauu

SEQ ID NO: 4235234 - RNA, 98 nt, Leptospira interrogans serovar lai str. 56601
auaaguccuuuguuuucuucuucaauuuuugcuuuagggacuuauucagaagguugggcaguaguaaaauugauacaguuugaaagccgcggacuuau

SEQ ID NO: 4235235 - RNA, 68 nt, Leptospira interrogans serovar lai str. 56601
cuggaaacuuuauuggaaguaggucuagguuauauucgucuaggacaaccugcgacuacuuuuuccgg

SEQ ID NO: 4235236 - RNA, 91 nt, Leptospira interrogans serovar lai str. 56601
uggacugucgugauccaauauucuccgagggcauaacuuuucauuccuaaaagacuuaacccuucggaagaaauggcgcaggauagaucca

SEQ ID NO: 4235237 - RNA, 78 nt, Leptospira interrogans serovar lai str. 56601
auuuuuauuggauacuggaaacgaauauuuggaaaauccagucacugaaaaagauauucuuuccguguuuguaggaau

SEQ ID NO: 4235238 - RNA, 66 nt, Leptospira interrogans serovar lai str. 56601
uucaucacgaauuucuugaaauugguguagaucaaauaccaaaguucagaaaucugugcacaugag

SEQ ID NO: 4235239 - RNA, 63 nt, Leptospira interrogans serovar lai str. 56601
uacuuguuucaaguagacgaacuaccgaacgcacuugcaaacggagcugcucucaaacaagua

SEQ ID NO: 4235240 - RNA, 65 nt, Leptospira interrogans serovar lai str. 56601
ggaggauuguaucaaguaagacuaaaaggaaaauuuuccaaauuagacgacuuggucgaucuucc

SEQ ID NO: 4235241 - RNA, 118 nt, Leptospira interrogans serovar lai str. 56601
uucggauugauugagucagaauauaguuuugagaauccaagaaucgguuuaucuuuaguacuaauuguaacugaauacuuuggauuuugauucuuuucguacuuuuguucuaucugaa

SEQ ID NO: 4235242 - RNA, 85 nt, Leptospira interrogans serovar lai str. 56601
uauggaaugaaaaaaaggaauccgaaauaucgauuucugugcauugagugagaucuguuuaucugugauuccuuuuucuaacaua

SEQ ID NO: 4235243 - RNA, 72 nt, Leptospira interrogans serovar lai str. 56601
uguaugggguggaguuggaaagacgaaaucggauggaagaauuugagaagucuucuaauuuaaucuuuggca

SEQ ID NO: 4235244 - RNA, 66 nt, Leptospira interrogans serovar lai str. 56601
uucagcuuauaaaagucguucgaaguuauacugaauuuucgaucuuauagacuuuaauagguugag

SEQ ID NO: 4235245 - RNA, 90 nt, Leptospira interrogans serovar lai str. 56601
gggaucgaugcgaggucaaguuauugguauuuuauaaaaauugaaucugauuuuguaguuucacaauaacuugaccggagcugagagccc

SEQ ID NO: 4235246 - RNA, 67 nt, Leptospira interrogans serovar lai str. 56601
ggaaaauccugaguucuauaaggauuccagagauuuacaacucggagaaauuccagagcucaauucc

SEQ ID NO: 4235247 - RNA, 63 nt, Leptospira interrogans serovar lai str. 56601
uuuucugauaaagaaaaccucccccacccaaaaauaggggcgggaacuaaguuuuacagaaga

SEQ ID NO: 4235248 - RNA, 109 nt, Leptospira interrogans serovar lai str. 56601
uccuaaaacguuagccaugcuuugaaucgaauacucaaaucgaugaguuuccaugaacaucaaucgggauuuuguucgcgggaaagcauggcugcaaacuuuuuuagga

SEQ ID NO: 4235249 - RNA, 82 nt, Leptospira interrogans serovar lai str. 56601
gguggacaaaucuaaucaaaguaauucagaacaaggcuauguccguugaacuggaauuccuuugguguagacacacuccucc

SEQ ID NO: 4235250 - RNA, 70 nt, Leptospira interrogans serovar lai str. 56601
uaaacuuuuuaaaauucagucugagcuuaacuuucaaucuggaaaguuuucggacggauuuaaaaguuug

SEQ ID NO: 4235251 - RNA, 56 nt, Leptospira interrogans serovar lai str. 56601
aaggcgauucuuuccgauuggggaguuuuauuugcuggauugauuuggguugcuuu

SEQ ID NO: 4235252 - RNA, 72 nt, Leptospira interrogans serovar lai str. 56601
ccuaacgucgacuuguuuucaaaauugaauuuccaaauaguaaaaaauuugaaguuacaaguggcgcguagg

SEQ ID NO: 4235253 - RNA, 71 nt, Leptospira interrogans serovar lai str. 56601
uaaaugugggaacucccacaauuuauaaaguuuaacuguaaauccacgauuugugggaguucccacauuua

SEQ ID NO: 4235254 - RNA, 56 nt, Leptospira interrogans serovar lai str. 56601
guggauucggaaucaggggauccuguuuuuggaaccgugaucaucguucgauccau

SEQ ID NO: 4235255 - RNA, 88 nt, Leptospira interrogans serovar lai str. 56601
uccaggcaaaagaaccgaaauuucagauucuuuuuggaacaaaguugcggaaguuucugaaauuucuuggauggguucuuaugaugga

SEQ ID NO: 4235256 - RNA, 90 nt, Leptospira interrogans serovar lai str. 56601
uuuucccgucuucaagaagaggaaguaaaucuuuccgaacuugcugaguugggaauuuuacuucuucaugacuuugaaaagucggggagg

SEQ ID NO: 4235257 - RNA, 76 nt, Leptospira interrogans serovar lai str. 56601
uccgauccguaaaaucaguuuggaaaucgcuucuaaaauuuuuucgggagaaauuucagauugguccaagaucgga

SEQ ID NO: 4235258 - RNA, 70 nt, Leptospira interrogans serovar lai str. 56601
uuuuuuaguggaugguuacguauuuaagaauauaacaaaaaacuuaaacguaaguguauccgguagaaaa

SEQ ID NO: 4235259 - RNA, 59 nt, Leptospira interrogans serovar lai str. 56601
ggucgcucugcagguccauguucugaaaaaaguuggaaucuggacuuuacagaucgauu

SEQ ID NO: 4235260 - RNA, 78 nt, Leptospira interrogans serovar lai str. 56601
acaagaaugagauuuguagaggauugcgccuaacgguaguaaaucgaaaguaugauccuuuaaaaauggcauuccagu

SEQ ID NO: 4235261 - RNA, 55 nt, Leptospira interrogans serovar lai str. 56601
ucgaauuagaaggguacuuucuccucaaagagaaauuguaaacagucuaauucga

SEQ ID NO: 4235262 - RNA, 88 nt, Leptospira interrogans serovar lai str. 56601
ucuaaacaugaaucgugaaacucagcgaacgucucuauggaucggccguucaggaaaaauguuugcugguuuguauggguguuuuaga

SEQ ID NO: 4235263 - RNA, 69 nt, Leptospira interrogans serovar lai str. 56601
gaguugcaauuggagcaguaggaguugcacgcgccgcgauggaacauucuauccaauacgcaaauacuc

SEQ ID NO: 4235264 - RNA, 69 nt, Leptospira interrogans serovar lai str. 56601
cuaguuugaguuuuucagcauccguauuuuuagauugaagaaucugcuuuuuggaagacucaaauuuag

SEQ ID NO: 4235265 - RNA, 79 nt, Leptospira interrogans serovar lai str. 56601
ugauaauugguuuauuuuggacuuagauuugaauuauaacugaauucuaauucguauuuuuuaaaguagaucgguuuca

SEQ ID NO: 4235266 - RNA, 107 nt, Leptospira interrogans serovar lai str. 56601
gaauccacacaaaagauuuuccaugcaguaugggaaagaauugcucccuuucacgagaugauccagucucguccugcgguucuuucuuacuccggcggaaaagauuc

SEQ ID NO: 4235267 - RNA, 124 nt, Leptospira interrogans serovar lai str. 56601
ggugaacuuagugaaauaugaguaguguuucggaucaaaaauuggaugacuagaaaaaggacauucuuaagugaucgaucaauuuguugaucaaaacgcgauucgauacaaagcuggauucacc

SEQ ID NO: 4235268 - RNA, 76 nt, Leptospira interrogans serovar lai str. 56601
aacucagcacaacgcucuuuaugaaucgcguuggaaaacucagcacaacgcucuuuaugaaucgcguugugggguu

SEQ ID NO: 4235269 - RNA, 56 nt, Leptospira interrogans serovar lai str. 56601
aaaguaacgacgugucggggcaaguggcggguguguuuaugacagguucuuacuuu

SEQ ID NO: 4235270 - RNA, 55 nt, Leptospira interrogans serovar lai str. 56601
ugcgagagaacuauuugaguauggauuuccguagcucucguauucucuuuuggca

SEQ ID NO: 4235271 - RNA, 90 nt, Leptospira interrogans serovar lai str. 56601
cugaaugcagauccuuagaaaggggcauccgcugaguuuuuuuggucguucgaaguaacucaguaucucuuuucuaugguugcucgacag

SEQ ID NO: 4235272 - RNA, 79 nt, Leptospira interrogans serovar lai str. 56601
cuucugaauuuuuagcaacuuccgcuucuauaacuccguuuuuuuuaagagaaguagaagcugcuuugggacucggugg

SEQ ID NO: 4235273 - RNA, 121 nt, Leptospira interrogans serovar lai str. 56601
aguuucaauugcauuuuuaauuuuuuggaaauuagaagaugauucuguuguggaucuucucuauuggauuauuacaggaaguaucuuuuugauuuucuuguuuaaacuugcauuuguuucu

SEQ ID NO: 4235274 - RNA, 72 nt, Leptospira interrogans serovar lai str. 56601
agaauaugagauccuuuuaaaaaagcuaaccauucuaggcuuggcacaauuucaagaggacuucuauauuuu

SEQ ID NO: 4235275 - RNA, 77 nt, Leptospira interrogans serovar lai str. 56601
uucaguaucucuuccgaauaaagaauuggaucguuuuuauuaugagguucgauuguuaagcgaagaggaaaucugga

SEQ ID NO: 4235276 - RNA, 88 nt, Leptospira interrogans serovar lai str. 56601
gcgauugaggcgggaugaacaaauugaauuuaggaaaagauuuuguuuucacucgauuuuuuaauuuguucaucggagcugaaagcgc

SEQ ID NO: 4235277 - RNA, 99 nt, Leptospira interrogans serovar lai str. 56601
gugcggcuacgauuggaaaggcgaucgcgaguuuugaaagaacgaucuuuucuacggagucggccuuugaucguuggaaaaaaggggauaaagccgcgc

SEQ ID NO: 4235278 - RNA, 97 nt, Leptospira interrogans serovar lai str. 56601
gccguaaaaucuuaaucugugggaacuaccacauuucaagguuucaccguaaaauuuaaauuugugagaguucccacagauuaagucgcauuacagc

SEQ ID NO: 4235279 - RNA, 114 nt, Leptospira interrogans serovar lai str. 56601
gccucuaagauugcuaccuuuagaugguuuggguuuauguuuagaaaaauauaaauuaaaaauaucauaauaggagaaauuagcaauuuauaaauaaguccgauagauagaggu

SEQ ID NO: 4235280 - RNA, 99 nt, Leptospira interrogans serovar lai str. 56601
gguuuuuucuauauuucaguagcuguugaucgauuccuuuuuuugcguccgguguaagagcaggagauuuucgauaguucuccagauaaagauaauacu

SEQ ID NO: 4235281 - RNA, 105 nt, Leptospira interrogans serovar lai str. 56601
ugauaauaguuugagaaacuucgggaagagucaguucuuuaccuaaaacagccgcggcggcaguaaaagaacugaccccuggaacaauuucauauugaauauuca

SEQ ID NO: 4235282 - RNA, 80 nt, Leptospira interrogans serovar lai str. 56601
cguucuuuuacuuggagcuucuuuggaauguauucauacuuauucuuugauucacgacgaucuuccaaguauggauaacg

SEQ ID NO: 4235283 - RNA, 58 nt, Leptospira interrogans serovar lai str. 56601
gaggaagcauuuccugcacuuuuagaaaaagaacuuucuaaaaaaggaauuguuucuc

SEQ ID NO: 4235284 - RNA, 83 nt, Leptospira interrogans serovar lai str. 56601
uuggaaucuuuuugaauacaaggaaaauucuuuggagaugacuuuaucuuuagauggaaagauucuuuguuuuaugauuuuag

SEQ ID NO: 4235285 - RNA, 96 nt, Leptospira interrogans serovar lai str. 56601
uuuuggauucuaccuuucucgcuuuggaaaaaaccguuuucgagaauuuucaagacauucagagcguggaauauagguuagacggguuauccgaaa

SEQ ID NO: 4235286 - RNA, 107 nt, Leptospira interrogans serovar lai str. 56601
ccuaaaacguuagccaugcuuugaaucgaauacucaaaucgaugaguuuccaugaacaucaaucgggauuuuguucgcgggaaagcauggcugcaaacuuuuuuagg

SEQ ID NO: 4235287 - RNA, 120 nt, Leptospira interrogans serovar lai str. 56601
acggucaacuaacguauggaguacuucugaaagacgucuaacgucuucaaaaugaagcccgguaguagguucaucuaagauguagagcguuuuuccaguuggucuuuuagaaaguuccgu

SEQ ID NO: 4235288 - RNA, 73 nt, Leptospira interrogans serovar lai str. 56601
gguccuaauugcguuccuuguauuaaagaaauaccggcucucaauuaucucuaucaggaaaugcaaaaggauc

SEQ ID NO: 4235289 - RNA, 62 nt, Leptospira interrogans serovar lai str. 56601
ccucuucagagagccaagugcgaagaaguugugcuacuucuuccgguuuuucucuggcgagg

SEQ ID NO: 4235290 - RNA, 58 nt, Leptospira interrogans serovar lai str. 56601
ggaguucuuggaaauuuuuaucauagcccuuaaaaucaggguuuuuccacagagcuuc

SEQ ID NO: 4235291 - RNA, 66 nt, Leptospira interrogans serovar lai str. 56601
gaaauuuagaaugacacgaucccguuuuccuucaggaauggauucguauuuuucuaggauuguuuc

SEQ ID NO: 4235292 - RNA, 79 nt, Leptospira interrogans serovar lai str. 56601
gcauuggcuuucgguuggccuuguagucuugaaauauuuuuccucuuuccagaguaccacccggaucgaaggucauugc

SEQ ID NO: 4235293 - RNA, 77 nt, Leptospira interrogans serovar lai str. 56601
aaccgcuucggucucuaaaacguuucacuauuccaggugaucuggaauaucgggauguuuggauccgauuugcgguu

SEQ ID NO: 4235294 - RNA, 61 nt, Leptospira interrogans serovar lai str. 56601
ccuaaaucuuguuguucuaucuugaucgguuuuucgguuugaucguuuaacgagaaguagg

SEQ ID NO: 4235295 - RNA, 56 nt, Leptospira interrogans serovar lai str. 56601
aucgauauuccuuuccggcuucuuuuuggaucauagccggaccgaaaggaaucggu

SEQ ID NO: 4235296 - RNA, 68 nt, Leptospira interrogans serovar lai str. 56601
uuucuuuagauuggaugaacgauuuuacaccuuugaaggaggugggacucgaugcaauuuuaaagaag

SEQ ID NO: 4235297 - RNA, 69 nt, Leptospira interrogans serovar lai str. 56601
ggaugcacggcucuagagcagccaaucucguuuuggaagaagcagauuuauugguugcuuugggcguuc

SEQ ID NO: 4235298 - RNA, 69 nt, Leptospira interrogans serovar lai str. 56601
gauuccagaaauaaaaucaacuuaucucuaucgucuuuuggaagguuuacgaacuuauuucuggacguc

SEQ ID NO: 4235299 - RNA, 83 nt, Leptospira interrogans serovar lai str. 56601
cgauuugguucaucuuuacguucucuaacucuuucaagcugaauuccggaauggcagguuuggaaacgagagugaccugaucg

SEQ ID NO: 4235300 - RNA, 86 nt, Leptospira interrogans serovar lai str. 56601
guuagccaugcuuugaaucgaauacucaaaucgaugaguuuccaugaacaucaaucgggauuuuguucgcgggaaagcauggcugc

SEQ ID NO: 4235301 - RNA, 60 nt, Leptospira interrogans serovar lai str. 56601
caaagauagaauacguuuuggaacacgaagacguugcaaacucuaguauucuauuuauug

SEQ ID NO: 4235302 - RNA, 80 nt, Leptospira interrogans serovar lai str. 56601
gagauuaccauuaagacgagaacuuggauuuuuagaauugaaacguuguaaguccaaauaacuuugucagugguaauauc

SEQ ID NO: 4235303 - RNA, 65 nt, Leptospira interrogans serovar lai str. 56601
uggucaaguuauuguguuuuguaggaacuccaacauuggaaccuagguugccaauaacuugacca

SEQ ID NO: 4235304 - RNA, 59 nt, Leptospira interrogans serovar lai str. 56601
ggaggaguuucguugcaaagauaauaaagugcuaaauuaucaaaguaagaaauuucuuc

SEQ ID NO: 4235305 - RNA, 77 nt, Leptospira interrogans serovar lai str. 56601
uuugaacuuugccggaaguuuuauuuacgagcgaacuuaaaauaccgaucgugguagacuuuccggcuccguuugga

SEQ ID NO: 4235306 - RNA, 76 nt, Leptospira interrogans serovar lai str. 56601
agauugcucuaaaauucuucuagaaucaccaauguuuccuacggaugauucccgagaucaauuuuagaaggaauuu

SEQ ID NO: 4235307 - RNA, 130 nt, Leptospira interrogans serovar lai str. 56601
agagccagaaaaauugacuccucguuuaaucgauucuauaguuccuguuucguccguaucguuucugauaugaagcaaaggauuuauaaauucaaacaagggagccaauaaaucccaaaaguuaggcucu

SEQ ID NO: 4235308 - RNA, 113 nt, Leptospira interrogans serovar lai str. 56601
ccuaauuuugagucaggaguuaauuuuauccgagaaaucaaucauagggaaauuccaacuucuaugauccgucucuccgaucaaaaugaaacucgucuuuaucaaacguuagg

SEQ ID NO: 4235309 - RNA, 105 nt, Leptospira interrogans serovar lai str. 56601
acguuuuaggagugucucguucaggauucuaucaauuucuaaaacggaguaaaaacgaauuagaaaaauauaauccugaacuugucgaguucauucgggaaacgu

SEQ ID NO: 4235310 - RNA, 76 nt, Leptospira interrogans serovar lai str. 56601
ucaauggaauuacgaaaucguuuuucuagauaauaaccuguaaguaaaacuagagcuacaaagauaguuccauuga

SEQ ID NO: 4235311 - RNA, 129 nt, Leptospira interrogans serovar lai str. 56601
cuccaggaauuuaaaagucuuugugcguccaguugaauuacguuugcaagugaaacuauauaagcccuucuuccagcguuuccauuugcaacguugauugcggcuaacguauguacuccauucccaucg

SEQ ID NO: 4235312 - RNA, 69 nt, Leptospira interrogans serovar lai str. 56601
ucacggaauuuuauuuuauggaauuaugaauucauccgaaacucaauccguagaaaaaguuucaaguga

SEQ ID NO: 4235313 - RNA, 82 nt, Leptospira interrogans serovar lai str. 56601
cuucucuccaguguaggagauccagaugcuucuuaucacgaguucaaaauuuauuuggaucggcuugcacuuagaguagaag

SEQ ID NO: 4235314 - RNA, 81 nt, Leptospira interrogans serovar lai str. 56601
gaaaagucuuuauaaaauaguauuuuugcauggucgcauaacggcgauuuuacguaaaauaugauugaauaaagauuuuuu

SEQ ID NO: 4235315 - RNA, 96 nt, Leptospira interrogans serovar lai str. 56601
ucuuuccgaaaagcuuggaggaaggcagguuggaaccuuggcucauacaauugcgaucaaauccggaccuguguucuuucacagcauuccgaacga

SEQ ID NO: 4235316 - RNA, 79 nt, Leptospira interrogans serovar lai str. 56601
gagucgaacgauuugcaaauauuugucacgguuguggugcucaacgccuaccggcacccgauuuuuguaaguuugacuu

SEQ ID NO: 4235317 - RNA, 95 nt, Leptospira interrogans serovar lai str. 56601
cauugaacgaccuaaaacugagauucguagaaaucaguauugucaaguuuggugggaugaacgauuucuauggaucacguuuuagguuuuuugug

SEQ ID NO: 4235318 - RNA, 60 nt, Leptospira interrogans serovar lai str. 56601
aacccuuuuaccuucaauuugggagcgggagagguaaucaaagguugggacagagggguu

SEQ ID NO: 4235319 - RNA, 57 nt, Leptospira interrogans serovar lai str. 56601
cuuccauaggauuucuggaucguguucuaaagcaccugcuucgggaauauuaggagg

SEQ ID NO: 4235320 - RNA, 78 nt, Leptospira interrogans serovar lai str. 56601
uuguguccuccaaauugcaaaaaaacagauucagcuuuuuuaagaagguuuaauacguuuucuuugccauaggcacga

SEQ ID NO: 4235321 - RNA, 69 nt, Leptospira interrogans serovar lai str. 56601
ggauucacuguaauugauauaguaguguuuguacuaccauaagcauugcuugcaguaaugguguaauuu

SEQ ID NO: 4235322 - RNA, 66 nt, Leptospira interrogans serovar lai str. 56601
aggaucaaacucuccguguugaaauuacccuugcgggcaauuuuuucuacuagagcuugaauuccu

SEQ ID NO: 4235323 - RNA, 58 nt, Leptospira interrogans serovar lai str. 56601
uucuucggugcacgaucacggucccguauauucggagauucgcaaagcuaccgaggaa

SEQ ID NO: 4235324 - RNA, 76 nt, Leptospira interrogans serovar lai str. 56601
gaaaaccuucuaacguuucguuugauuggagacgcucccgcuucguuuuuaucuaaaaacguggauuuagguuuuu

SEQ ID NO: 4235325 - RNA, 64 nt, Leptospira interrogans serovar lai str. 56601
ucacccgguuugcagauaguccauucuucauuggauguaaguggacacguugcaauuaccguga

SEQ ID NO: 4235326 - RNA, 58 nt, Leptospira interrogans serovar lai str. 56601
uuucuuacgucaguucaacucacguuauaaugacaaaaugugaguucgacguaaggaa

SEQ ID NO: 4235327 - RNA, 89 nt, Leptospira interrogans serovar lai str. 56601
aauuccaacuaacgugcauuuguggacauuagaagaauucagaagauuuuuaauacccaccacagagcugucucaaauaguugcgaauu

SEQ ID NO: 4235328 - RNA, 61 nt, Leptospira interrogans serovar lai str. 56601
ggaacuuuggcaaagguuaggaacuucuguagaaauccuuuuaccucuugcuauuaguuuu

SEQ ID NO: 4235329 - RNA, 58 nt, Leptospira interrogans serovar lai str. 56601
ucgaucauacguauuccuauuucacucauucuaugaagucuaagauacguaugauggg

SEQ ID NO: 4235330 - RNA, 120 nt, Leptospira interrogans serovar lai str. 56601
cuugggcaugguaguuacucuacgguuacggacuuagcaagguuucuagguugauccggaggacaaccucuagcgauugcugaguaauaagcgaguaauugaagaggaauuacguuuaag

SEQ ID NO: 4235331 - RNA, 58 nt, Leptospira interrogans serovar lai str. 56601
gcgcgucaaggaaagucuggaauggaguuuuaccaaaacaauacuugccuugaugcgu

SEQ ID NO: 4235332 - RNA, 81 nt, Leptospira interrogans serovar lai str. 56601
cggugccgaaaguagaaaguauauuuugaguugcgauuuguuguucuucguuuaaaguaacugguuuaccuucugcguccg

SEQ ID NO: 4235333 - RNA, 56 nt, Leptospira interrogans serovar lai str. 56601
uccuuggguucggcauaaauucuaccuuuaaguugaaucucuuucgaacucgcgga

SEQ ID NO: 4235334 - RNA, 69 nt, Leptospira interrogans serovar lai str. 56601
ucgucuggaauacguuagacgcucaaucuguaacuccugcgauuucgucaaagacgaauucuaaaacga

SEQ ID NO: 4235335 - RNA, 71 nt, Leptospira interrogans serovar lai str. 56601
cugucuuagauccugagucaucacaaguuuuuggguuuguuuuugaaccagugacugacuuagauucacag

SEQ ID NO: 4235336 - RNA, 71 nt, Leptospira interrogans serovar lai str. 56601
uggauaaagcuucugaaauagacauuccuaauuuauuuggaaacgccuuugucauuucauucgcuucucca

SEQ ID NO: 4235337 - RNA, 77 nt, Leptospira interrogans serovar lai str. 56601
aaaauagaagaaacuuacucaagaucggaaugaaucgacucguucuagucgauucccagguuucuaaauucuguuuu

SEQ ID NO: 4235338 - RNA, 55 nt, Leptospira interrogans serovar lai str. 56601
gaguugguaggagauuauucugauuuaguagaucgacuuauacuccuaucgauuc

SEQ ID NO: 4235339 - RNA, 120 nt, Leptospira interrogans serovar lai str. 56601
gcauccggaucgugaaagauggaggcagcacgaaucacguugaaauaauuaugaagugguucccccauucccauaaauacaacguuagucgcuuugucuccuacgauuuuuuccaccugu

SEQ ID NO: 4235340 - RNA, 88 nt, Leptospira interrogans serovar lai str. 56601
cccagaguaaaacugaaaucaaaagagaaccuaugaucaaaaguccucccaucguagguguuccuuuuuuaauuucgugagacuuggg

SEQ ID NO: 4235341 - RNA, 89 nt, Leptospira interrogans serovar lai str. 56601
uccuuauaaauugagauuagauuuucgaaucgacuugcgccagugagguacauuuugauuuuugaaaauucugauccauuuuaugggga

SEQ ID NO: 4235342 - RNA, 130 nt, Leptospira interrogans serovar lai str. 56601
uuggauaugcuuauaucguuuucgaaacguucuuuuuucuuggauuuaagaaguggaaugauuuuuucguaaagcacuuggaaguuaggaaaagaccaaaaguuuugaaacuuaugauuuucauauacug

SEQ ID NO: 4235343 - RNA, 74 nt, Leptospira interrogans serovar lai str. 56601
aauucuaguccuuuuugauucuauuuaacaccuaagacuguaaagucgcugaauggauugaaaugggcugaauu

SEQ ID NO: 4235344 - RNA, 78 nt, Leptospira interrogans serovar lai str. 56601
uauagauuauagcuucuucuuuuucuugaucuucauaccaauuaucucgaaguaaaggaucagaaacuauaguuugug

SEQ ID NO: 4235345 - RNA, 64 nt, Leptospira interrogans serovar lai str. 56601
cuuauucuucaaucgucucccgggcaaucgccacgcgagccucggaagaagauugaaagacugg

SEQ ID NO: 4235346 - RNA, 60 nt, Leptospira interrogans serovar lai str. 56601
ggaucaguauugauucucaagaucggauuacucagauucaggaugggaacaaugcaaucc

SEQ ID NO: 4235347 - RNA, 57 nt, Leptospira interrogans serovar lai str. 56601
uugaauuccccuaggaaagaaugucugauuacggauucuauuuuuauaggaguucaa

SEQ ID NO: 4235348 - RNA, 81 nt, Leptospira interrogans serovar lai str. 56601
ucaauucauucuaagauuuuggaacaaauccugauacaaucauauauuagaguuguuccagaaucccauaguggcaauuga

SEQ ID NO: 4235349 - RNA, 70 nt, Leptospira interrogans serovar lai str. 56601
ucgcgaucgauuacgagaggauauaaucccgguuuaacguucggauaaaaucucucuugaucgauuuugg

SEQ ID NO: 4235350 - RNA, 59 nt, Leptospira interrogans serovar lai str. 56601
acugaaaaggagggaaucuccaguaaaacaaaaucgaauggaguuccaacuuauuuagu

SEQ ID NO: 4235351 - RNA, 67 nt, Leptospira interrogans serovar lai str. 56601
aguucauaaaagaguucccgcauuaauuaaagguuaucucagggcgggagcucaaauuuguggaacu

SEQ ID NO: 4235352 - RNA, 130 nt, Leptospira interrogans serovar lai str. 56601
guucuaucgcaauucuauucuuagagaagucuguauaaauuugaaaauaagaaaguuguauaucguuuuuauucgacaaguuagaucgaauucgaacuucauaagaaucgucuggaauuugcaaaagaac

SEQ ID NO: 4235353 - RNA, 88 nt, Leptospira interrogans serovar lai str. 56601
uagccaacccaagagucuuuggaucuaaaucggaagcaaauauuuuuauuuccgaagaaagauuuaaauucucuuuaaaguuuggcug

SEQ ID NO: 4235354 - RNA, 61 nt, Leptospira interrogans serovar lai str. 56601
cuuguagaaauaaaucaacggaagaagaaaacgaagaacguuccggguugauuucuauaag

SEQ ID NO: 4235355 - RNA, 72 nt, Leptospira interrogans serovar lai str. 56601
cgguggccgauuuggauucaucuaugaaacggggucuuacaaagccccaagagagcgaucaaucugccaccg

SEQ ID NO: 4235356 - RNA, 60 nt, Leptospira interrogans serovar lai str. 56601
ggaaccuguaaauucggcguuucaauuuguguagauuggaaauuaggauugacaggaucu

SEQ ID NO: 4235357 - RNA, 76 nt, Leptospira interrogans serovar lai str. 56601
cgauuaccaaucagguucgucauuuuacgauucaaggaaggggauuuguuucugugauggacucugauagugauug

SEQ ID NO: 4235358 - RNA, 62 nt, Leptospira interrogans serovar lai str. 56601
ggacuuuuugaaacggaaucgguuccuacucuggcucagggaaccuuucaaaucgaagagcc

SEQ ID NO: 4235359 - RNA, 78 nt, Leptospira interrogans serovar lai str. 56601
gagcacuuucaaacucagcguuucgcuuccugaaugccuauccuaagaaagacauucgcugaguuuugugggucgcuc

SEQ ID NO: 4235360 - RNA, 81 nt, Leptospira interrogans serovar lai str. 56601
auacgguaguuccuagagauuaugucuauuuuaggugauauacuauuuuauuugaauuuuaucguaguuucuuaauuguau

SEQ ID NO: 4235361 - RNA, 94 nt, Leptospira interrogans serovar lai str. 56601
uuaugauagucguuuauuaauucuugcaaaaucaaaauuuucuguuacuuuguuuaggguuuuuugacagccagaaugauaaaugacauuauaa

SEQ ID NO: 4235362 - RNA, 81 nt, Leptospira interrogans serovar lai str. 56601
gcggauaguuucuaaaaguucuaucugcuuuugugauuuuccccaagacauuggaaguaugagaacuuuugaaauauuugu

SEQ ID NO: 4235363 - RNA, 99 nt, Leptospira interrogans serovar lai str. 56601
ggaucaauugggguaaaaaugagauuguuguuaguagggaugcaauauauccuaaaaacguaauagaguccaugucguuuuaaauuccgauuaagguuu

SEQ ID NO: 4235364 - RNA, 81 nt, Leptospira interrogans serovar lai str. 56601
gguuugcgguggccgauuuggauucaucuaugaaacggggucuuacaaagccccaagagagcgaucaaucugccaccggcc

SEQ ID NO: 4235365 - RNA, 105 nt, Leptospira interrogans serovar lai str. 56601
gguuuucaucaacaaaguugucguuucagcuaaguucgauaaauucagugcgaaagugauugaagcguaugggaacuuagcagaacguucuuucaaacuaaagcc

SEQ ID NO: 4235366 - RNA, 69 nt, Leptospira interrogans serovar lai str. 56601
ugauacucaguucguugggagugauuuuucauccgaacccaaucacugccgcggugcuuuuagugcuca

SEQ ID NO: 4235367 - RNA, 89 nt, Leptospira interrogans serovar lai str. 56601
aagauugauaugggaaaacucagcgucucgcuucuuaaaugccgauucuaaaagaagcauucaccgcugaguuuuccgguucacguuuu

SEQ ID NO: 4235368 - RNA, 72 nt, Leptospira interrogans serovar lai str. 56601
gcguucgucuccgucuuuuggguauucuauuuuucuuccagggaaauaguacaucagaagaacgucuaacgc

SEQ ID NO: 4235369 - RNA, 56 nt, Leptospira interrogans serovar lai str. 56601
caggaucuucguaaggaacuuggcgaaucaucccauuuucuucuacgaagguuuug

SEQ ID NO: 4235370 - RNA, 98 nt, Leptospira interrogans serovar lai str. 56601
uuuccugauauaccuuguuucggaaacgaucuuuuucacuuuuuuaucauauucuucgucaaaaagaguugcguccagauaagaauugauacaggaaa

SEQ ID NO: 4235371 - RNA, 57 nt, Leptospira interrogans serovar lai str. 56601
gaaauuuaaaucguucacaucgguagauuuucuuccgaugugaacgauuuaaauuuu

SEQ ID NO: 4235372 - RNA, 68 nt, Leptospira interrogans serovar lai str. 56601
cuacgacccuacuuauaaaaauuuuuuccaaucugugggaaugaucuuauggguagggccuaucguag

SEQ ID NO: 4235373 - RNA, 90 nt, Leptospira interrogans serovar lai str. 56601
guuuugauuguuuaucucaaaggacguuuggauguuuccaucgccaacgagguagaggaaaaucuaaaugaccugaucgacaaucaaggc

SEQ ID NO: 4235374 - RNA, 98 nt, Leptospira interrogans serovar lai str. 56601
gaguuuaugaaaauuaugcaguuccacguuuugauuuguaagaaugguucuccagucgucccggauuaaaacuuggauuucguauuuuuuuacggcuc

SEQ ID NO: 4235375 - RNA, 69 nt, Leptospira interrogans serovar lai str. 56601
gacuggcagaaauugcaaaaccucaaaagguaguuccugccaucauugaauuuguagacaucgccgguc

SEQ ID NO: 4235376 - RNA, 88 nt, Leptospira interrogans serovar lai str. 56601
aaguuuugguuugagaaguucccgaaguacugguuuuaccguaaguaaccguaaaagaauuuccggaaacuucuauguuccagaauuu

SEQ ID NO: 4235377 - RNA, 64 nt, Leptospira interrogans serovar lai str. 56601
uuguagauggaacuuuuaaucaugaucgcaaugcuguguuuauuauuuccaguuuuauuuacga

SEQ ID NO: 4235378 - RNA, 64 nt, Leptospira interrogans serovar lai str. 56601
uuuguagaucuuuaucaaacacauuggccggaucaugauuucgguuaugaagaaacucuacaag

SEQ ID NO: 4235379 - RNA, 57 nt, Leptospira interrogans serovar lai str. 56601
cuacucucaauagaccucuacaaggucaaucagacuuuguagcuaacuugaaaguag

SEQ ID NO: 4235380 - RNA, 61 nt, Leptospira interrogans serovar lai str. 56601
gcgauaaagauucauggagcuugauuuuauagagagcagucaaacucauagucuuuuucgu

SEQ ID NO: 4235381 - RNA, 55 nt, Leptospira interrogans serovar lai str. 56601
aguuccggacucugccaacauagcugcguuagguuaugcagaagaaucuggaauu

SEQ ID NO: 4235382 - RNA, 63 nt, Leptospira interrogans serovar lai str. 56601
uugucauuucguagagauuaucuacaaucgcuuugugaacgucuaauccuacgaaauccgcag

SEQ ID NO: 4235383 - RNA, 58 nt, Leptospira interrogans serovar lai str. 56601
acuaagagaauucagccaaaggaugaaaaauuaagaaguuggcauuauucuucuuggu

SEQ ID NO: 4235384 - RNA, 65 nt, Leptospira interrogans serovar lai str. 56601
ugaaucgggauuuuacauaugguaacucugaaauuuuuggauacuaugcaaguggaauugguuca

SEQ ID NO: 4235385 - RNA, 71 nt, Leptospira interrogans serovar lai str. 56601
guagugguuuccuguugucccggagguguugcgucuaacguuauuacauaucuugcaaaaggagauuuggc

SEQ ID NO: 4235386 - RNA, 62 nt, Leptospira interrogans serovar lai str. 56601
aaggaguacaauucgaaggcaauuguaagaucaacccaguugcacauugaaaguacucacuu

SEQ ID NO: 4235387 - RNA, 92 nt, Leptospira interrogans serovar lai str. 56601
gcucucaagcucugguaaauaaauuguauacaggaaucauaauguaauauauugucuuuaguuacaauuuagaaugcggugucuugcagagc

SEQ ID NO: 4235388 - RNA, 90 nt, Leptospira interrogans serovar lai str. 56601
gggaucgaugcgaggucaaguuauugguauuuuauaaaaaccgaaucugguucuggaauuuuacaauaacuugaccagagcggagagccc

SEQ ID NO: 4235389 - RNA, 89 nt, Leptospira interrogans serovar lai str. 56601
ugccggauuucuaauaucuguuucuugauccaauagcucgaauacccggucucccgccgagaucgcgcuuuggaucgaauuagagagca

SEQ ID NO: 4235390 - RNA, 82 nt, Leptospira interrogans serovar lai str. 56601
aucucuccaaucuaaauuuuuacuaggagaauuaucuaaaauuccguucaugggagaaauuucuaaaagauuaggagaagau

SEQ ID NO: 4235391 - RNA, 87 nt, Leptospira interrogans serovar lai str. 56601
cuccugcguauucguccguuccaguuuuacggaucauagaagcucggacuuguucguaagauugugcgagaugauuucuagaaggag

SEQ ID NO: 4235392 - RNA, 57 nt, Leptospira interrogans serovar lai str. 56601
cuugaguucucgaacggaaaaugguuuugugauauaaucauccgcuccuagcucaag

SEQ ID NO: 4235393 - RNA, 64 nt, Leptospira interrogans serovar lai str. 56601
gacgguaagaucaccgauuugugguaguucccacaaguuagaauaugacgguaagaucaccguu

SEQ ID NO: 4235394 - RNA, 80 nt, Leptospira interrogans serovar lai str. 56601
ucuuuuugagaggaaguuucuacgagaauggaggaauucucuuuccaaguuucugguauaggaacuucuuuuugauugga

SEQ ID NO: 4235395 - RNA, 59 nt, Leptospira interrogans serovar lai str. 56601
uaucgaaagggcucgacgucaaugccaaagacgaacuuggauugacuccccuuaugaua

SEQ ID NO: 4235396 - RNA, 78 nt, Leptospira interrogans serovar lai str. 56601
caugauauaaauuguguggauaaauuuguuuggaauuacgaucaguauucggacuauauuuauucacaagagaacaug

SEQ ID NO: 4235397 - RNA, 67 nt, Leptospira interrogans serovar lai str. 56601
guccguugggaagaauuuauccuuugguauaacauuuuauuuucgaaaggauauucuuuuuccggac

SEQ ID NO: 4235398 - RNA, 82 nt, Leptospira interrogans serovar lai str. 56601
uggcuggcuaaagguuugagcaauucuuggguagaauauucaccccaaaaaucagacuucgaaucucuuuaugcccaggcca

SEQ ID NO: 4235399 - RNA, 61 nt, Leptospira interrogans serovar lai str. 56601
ccggcucggauggaagcucggaaguuagauaauaaauuccgaguacgauauccugagucgg

SEQ ID NO: 4235400 - RNA, 63 nt, Leptospira interrogans serovar lai str. 56601
cuggaauugaaagugauuugaaacauggguaucuaguuuaugaagauuuuaguucaauuccag

SEQ ID NO: 4235401 - RNA, 65 nt, Leptospira interrogans serovar lai str. 56601
ccaaagauaaggaauuuaaggaaauucuaaucaaucaagaaguucaaggaacucuuuaucgcugg

SEQ ID NO: 4235402 - RNA, 65 nt, Leptospira interrogans serovar lai str. 56601
uucuacaaagcucaaauuagauuguaaaugauaagucuuuugcaaagaauuuguguuuguuggaa

SEQ ID NO: 4235403 - RNA, 66 nt, Leptospira interrogans serovar lai str. 56601
gaccggugaucuuaccgucauauucucaauuugugggaacuaccacaaaacggugaucuuaccguc

SEQ ID NO: 4235404 - RNA, 94 nt, Leptospira interrogans serovar lai str. 56601
uuuuuggugaaguuacucguuuuacuuccaauuugagaagccaguugauuucucucaaagcggaaugugaagcggagauugauuuuuccacaga

SEQ ID NO: 4235405 - RNA, 82 nt, Leptospira interrogans serovar lai str. 56601
gcuuugcagucuuugguugcagucauaagaaaaaaggaauauuacuuccauuucuaacuuuacucaaucaagacgcgggugc

SEQ ID NO: 4235406 - RNA, 85 nt, Leptospira interrogans serovar lai str. 56601
guuucugcgaucggaggaguuaaucauauaacuuuuuccguaagaaaaaguuauaccgaaggcccuagcccgauccugugcaaac

SEQ ID NO: 4235407 - RNA, 59 nt, Leptospira interrogans serovar lai str. 56601
gagcagcgcugauauuuuccucuugaacaguuccuaaaagaggaagauaauuugcucuc

SEQ ID NO: 4235408 - RNA, 86 nt, Leptospira interrogans serovar lai str. 56601
uccaaaaucaaaauugucaagucgucuguaaguuuuccguuauuaaaguugagggcuagaucgauugcgguuuugagaauuuugga

SEQ ID NO: 4235409 - RNA, 57 nt, Leptospira interrogans serovar lai str. 56601
cucuuuccgauuuuuuaucuacgauuccgggaauuccuaagaugaaauuggacggag

SEQ ID NO: 4235410 - RNA, 58 nt, Leptospira interrogans serovar lai str. 56601
augggaaauuuggauugugaccgcuucuccugaggaaauuauacaauccguuucucau

SEQ ID NO: 4235411 - RNA, 58 nt, Leptospira interrogans serovar lai str. 56601
gcgauuugaacgaucauuuuuuccucuauaucagaaagaacgaucggauccaaauugu

SEQ ID NO: 4235412 - RNA, 68 nt, Leptospira interrogans serovar lai str. 56601
guuuuggaaaaucgauucugacucuuuuucuggauugcgcucuaaacaauccgaguuagauucaaaac

SEQ ID NO: 4235413 - RNA, 64 nt, Leptospira interrogans serovar lai str. 56601
aguguuccgccuaauucuuuuuggaugauaguuguuaucauagaauagggaauuggacgaaccu

SEQ ID NO: 4235414 - RNA, 63 nt, Leptospira interrogans serovar lai str. 56601
guucaggauuauauuuuucuaauucguuuuuacuccguuuuagaaauugauagaauccugaac

SEQ ID NO: 4235415 - RNA, 73 nt, Leptospira interrogans serovar lai str. 56601
auaauauaaacguuuugagcuuuuccuuugaggauuaauucuuuugccagagguucaaaaagaguacuauuau

SEQ ID NO: 4235416 - RNA, 82 nt, Leptospira interrogans serovar lai str. 56601
gaguagaucugagaauuuuuucagaagucaauuuaauucgauucacuucugagacaaauuuuuggauaauugauuuuugcuc

SEQ ID NO: 4235417 - RNA, 128 nt, Leptospira interrogans serovar lai str. 56601
uucugguuuaccaaaauacgaguauaaacaaggaaacgcgauuuuaaaaggaggagaauuuucgauucaagcagaacuuuuccguaaacucguuuuuuccgguggaaucgauauuguuuauucuagaa

SEQ ID NO: 4235418 - RNA, 65 nt, Leptospira interrogans serovar lai str. 56601
ugcuuugauauccaacauaggacuuacguaguuuaccugaugcaucauguuggaauguuugagca

SEQ ID NO: 4235419 - RNA, 95 nt, Leptospira interrogans serovar lai str. 56601
aaaauggaugaguuugucggaacaauugauuucguuuucaggguuuuaccguaaaacuugaaguguaguaguuccuacaaauuacgucguauuuu

SEQ ID NO: 4235420 - RNA, 79 nt, Leptospira interrogans serovar lai str. 56601
uggcgauuuuacaaagaggcagaaauuuucaaaaaauuauaucaacuugaaaucguugucuuuuuuguaugagauccca

SEQ ID NO: 4235421 - RNA, 65 nt, Leptospira interrogans serovar lai str. 56601
uggucaaguuauuggcaaccuagguuccaauguuggaguuccuacaaaacacaauaacuugacca

SEQ ID NO: 4235422 - RNA, 76 nt, Leptospira interrogans serovar lai str. 56601
uauuuuguagauuagacaacauaagaauuugucggcuaucuggguagauucuuauguuguuugauaaggugaaaua

SEQ ID NO: 4235423 - RNA, 73 nt, Leptospira interrogans serovar lai str. 56601
gagguuugagaaaaguucuuaaugcaaguuugaaccaaaaaucucagacuuagaaugaacuauuuaaaaucuc

SEQ ID NO: 4235424 - RNA, 61 nt, Leptospira interrogans serovar lai str. 56601
gaagcacgagaaaguucaaacugaauccuaaaauuucgauuaaaguuuggaucucugcuuc

SEQ ID NO: 4235425 - RNA, 59 nt, Leptospira interrogans serovar lai str. 56601
auguguuuguacuaucggauugagaagacucaaaaucaauucgacccguaaaaauacgu

SEQ ID NO: 4235426 - RNA, 84 nt, Leptospira interrogans serovar lai str. 56601
uuuuuuguugacuuucuucguauucuuuugagaauuuuguccgcaaaacacucuuggagaauggaaugaauaagucuaaguuga

SEQ ID NO: 4235427 - RNA, 108 nt, Leptospira interrogans serovar lai str. 56601
aaaagaaucgauugagguugguaucaaaaauugauucggaucuugaaaaaaaucggaaacgauuuuauuuucugaaucaaaacagauauagaucgaaacgauuuuuuu

SEQ ID NO: 4235428 - RNA, 67 nt, Leptospira interrogans serovar lai str. 56601
acuugauuggcgaacucgacgauagauuuagaaauuucuucguuuaagucuucuuugucgauuaggu

SEQ ID NO: 4235429 - RNA, 57 nt, Leptospira interrogans serovar lai str. 56601
gcucggaaaaaagagcggauuuggaauucuuuuuccuucugauucugguuuuagagc

SEQ ID NO: 4235430 - RNA, 79 nt, Leptospira interrogans serovar lai str. 56601
guuucgggacaagcuuugauauauauucuaauuauuauagaugauuaucgugaaucgcagaguuucucuaaauugaaac

SEQ ID NO: 4235431 - RNA, 69 nt, Leptospira interrogans serovar lai str. 56601
uccugcuguagaugcuuguuuauuuucuucugaguuuacggaugaaggugaaauucguuuagagacgga

SEQ ID NO: 4235432 - RNA, 84 nt, Leptospira interrogans serovar lai str. 56601
cugucauuuuacuuguucccgaaaucaguuuaacauuucauauuauucgaaaguuagaacuuauuuuuccgggacaauuggcgg

SEQ ID NO: 4235433 - RNA, 88 nt, Leptospira interrogans serovar lai str. 56601
uucaaagauuaugauggagcuacucuggauuauuauuaucuuacgauuugggauggugguaauugggauggauauuuauaucuuugga

SEQ ID NO: 4235434 - RNA, 130 nt, Leptospira interrogans serovar lai str. 56601
uuagaaagaauuuucuaaaaguauggguucuacaauuuuagaguuguucguaaaaucgugauuuacgggagaucccacauuuuaggaaucgauucacaaaguuuggauucuaacuuuuucugaaaaauga

SEQ ID NO: 4235435 - RNA, 85 nt, Leptospira interrogans serovar lai str. 56601
uccguauuuucuggcaauuagucuugaaaauucuccuacuucuuccaugagaauugcaagauugguuaguucugaaaaauaucga

SEQ ID NO: 4235436 - RNA, 71 nt, Leptospira interrogans serovar lai str. 56601
ugguucuccuggagcucgacuaaaaucauccauuguaucguuuaacacaauuccaguuccaggagcgacua

SEQ ID NO: 4235437 - RNA, 77 nt, Leptospira interrogans serovar lai str. 56601
gccugacuuucugcaauuacacaagagauuuugauuucugaaguagaaaucauuucuauguugauuccguugucggc

SEQ ID NO: 4235438 - RNA, 74 nt, Leptospira interrogans serovar lai str. 56601
gcuuccuuggguccuauaugagcagguuccauaaaccaucuagguuuaaacgcuccuaugggaaguauggucgc

SEQ ID NO: 4235439 - RNA, 119 nt, Leptospira interrogans serovar lai str. 56601
gauuuugauccagcaagaaaacgggcgucuaaaaacgcgugauaaguagacauauuaucuaaauauagaaaacauucuuuaauuguucugcaggaauguccgacuucuuuuccagaauc

SEQ ID NO: 4235440 - RNA, 66 nt, Leptospira interrogans serovar lai str. 56601
cagcaguaagaaaaauuuuggaucguauggaaagagaaauuuuagcuaccagaguucuaauugcug

SEQ ID NO: 4235441 - RNA, 119 nt, Leptospira interrogans serovar lai str. 56601
cuccguuuuuucgauuuuagaaaugauguuugucggaaauaguuucaaauuuugaucuccugucaaaagagguucuggaacuuuccgauagacgucugcgauacuuaaaucaacaggag

SEQ ID NO: 4235442 - RNA, 74 nt, Leptospira interrogans serovar lai str. 56601
guuaguugaaaaaccuuuaucauuguuaucgggugaauuuaacaaccagacauugacaaaguuuuucaaagugc

SEQ ID NO: 4235443 - RNA, 67 nt, Leptospira interrogans serovar lai str. 56601
gauugcgauuguacgagagaauaauuugaaggaaauuauagaucaaucugugcaguuagacgcgauc

SEQ ID NO: 4235444 - RNA, 65 nt, Leptospira interrogans serovar lai str. 56601
cacaacgcuuuccuaugggucgcguuggaaaacucaacacaacgcucuuuaugaaucgcguugug

SEQ ID NO: 4235445 - RNA, 95 nt, Leptospira interrogans serovar lai str. 56601
acaguuuugucaauugccacuaugggauucuggaacaacucuaauauaugauuguaucaggauuuguuccaaaaucuuagaaugaauugaauugu

SEQ ID NO: 4235446 - RNA, 85 nt, Leptospira interrogans serovar lai str. 56601
cgcaacauaauaaucguuuucguauuguuagguaucucaaaaacuuguuugagugcaaaauacugaauaucuuuguuauagagug

SEQ ID NO: 4235447 - RNA, 97 nt, Leptospira interrogans serovar lai str. 56601
uuugauagaggauaaaagaguucuuaccgaauugauuucuugaaugucugcuccacaggaaauaaguuuagaauuccaaacgaucagaucuuccaaa

SEQ ID NO: 4235448 - RNA, 70 nt, Leptospira interrogans serovar lai str. 56601
ucugucggaauuacgacaaagccucugugaaauuuaguucccacaacgcgaucugucgagugcccauaga

SEQ ID NO: 4235449 - RNA, 80 nt, Leptospira interrogans serovar lai str. 56601
cguuuaaauaucuuuucaucugaucguucugaauccaauccucuucacguaugauuccaugagaaagaucuuugauugcg

SEQ ID NO: 4235450 - RNA, 59 nt, Leptospira interrogans serovar lai str. 56601
guaugaguuccuacaauuuuagaauuuguucguaaaaucgugguuugugggacucauac

SEQ ID NO: 4235451 - RNA, 71 nt, Leptospira interrogans serovar lai str. 56601
uugcauuuuuuucauacuauccgcuuguuucugguuuaacggauaaaaaacgaguuugaaaaggaucgcaa

SEQ ID NO: 4235452 - RNA, 73 nt, Leptospira interrogans serovar lai str. 56601
ugaaucauaauuuuaucucccgguuugagagugcuaaucugaauuccggaaacgggagaaagaacguauuuca

SEQ ID NO: 4235453 - RNA, 74 nt, Leptospira interrogans serovar lai str. 56601
uugaguuuacugaguuuccaccgaaccgugagauuuaaguuucacaaaaugugggaacuacuagaaaaauuuaa

SEQ ID NO: 4235454 - RNA, 58 nt, Leptospira interrogans serovar lai str. 56601
gauacaaguucuggaggacuugcucguuugaacugggcgaugucauccgauuuugauc

SEQ ID NO: 4235455 - RNA, 58 nt, Leptospira interrogans serovar lai str. 56601
ggaguuaggugagaaaggauuucauacaggaguagaaaucuuagguucaauuaauuuu

SEQ ID NO: 4235456 - RNA, 97 nt, Leptospira interrogans serovar lai str. 56601
ucaaaugaauuuuauuuucucggauguaaucaagcgcgguuggaaauaucccaucauaaaccuuauugaucuuagaagaaagaauuccauugucuga

SEQ ID NO: 4235457 - RNA, 66 nt, Leptospira interrogans serovar lai str. 56601
uacgauucuugcaaugauuucucguacgucauaagacuuacgaaugucuuuuuguaugauuccgua

SEQ ID NO: 4235458 - RNA, 84 nt, Leptospira interrogans serovar lai str. 56601
uuuguuugccuaucaguuuauauuuugaauucgauuaaauuauauuucccgaauauucuaaaaauugagauugaugcgaauaaa

SEQ ID NO: 4235459 - RNA, 62 nt, Leptospira interrogans serovar lai str. 56601
accaucugaauauaaaagaauucuguccccuuuuuuuagauagaguucauaucuucggaggu

SEQ ID NO: 4235460 - RNA, 66 nt, Leptospira interrogans serovar lai str. 56601
gaugcagauucauauuuaaccuccguuuugcugaaaaguuugguucaauaugugaucuagugcauu

SEQ ID NO: 4235461 - RNA, 109 nt, Leptospira interrogans serovar lai str. 56601
gcggucuuaaaagacucaaccgauaugauaagaaaauuuuaaggauccuaaaguuaggagguaaauucacuucuuuuagucaaauuggguuuucuagaaaaacuuccgc

SEQ ID NO: 4235462 - RNA, 59 nt, Leptospira interrogans serovar lai str. 56601
uucuaucaguguuuugccuuuauucuccuccgauaaagcgauagaauacgcugauaggg

SEQ ID NO: 4235463 - RNA, 77 nt, Leptospira interrogans serovar lai str. 56601
cuauagguaggauuuuacgagcuucuugauauguccagaguuuccguuccaagaaaauuagaaauccuguccuaaag

SEQ ID NO: 4235464 - RNA, 86 nt, Leptospira interrogans serovar lai str. 56601
guuagccaugcuuugaaucgaauacucaaaucgaugaguuuccaugaacaucaaucgggauuuuguucgcgggaaagcauggcggc

SEQ ID NO: 4235465 - RNA, 84 nt, Leptospira interrogans serovar lai str. 56601
uccaaacgaauuuuuauggagaaugaaaucaagaauuugucuucuaagguaaauuucgauuauuaucuacaagguucuuuugga

SEQ ID NO: 4235466 - RNA, 96 nt, Leptospira interrogans serovar lai str. 56601
gucuucuuucuccggagaucaaaguauuuucuagaucaauuaaaaucggauguagaaguccuaauuuuugaauugauucuuugagagguugaagau

SEQ ID NO: 4235467 - RNA, 56 nt, Leptospira interrogans serovar lai str. 56601
gaauucuuccuugggaaauguaaucguucgagagacguauucucuuagaagaauuu

SEQ ID NO: 4235468 - RNA, 83 nt, Leptospira interrogans serovar lai str. 56601
aaaaugcaauugcuucuuacaccagugguacaaaucaaguauccaguuauuuggaguauauauuuguuguaggaacucauuuu

SEQ ID NO: 4235469 - RNA, 79 nt, Leptospira interrogans serovar lai str. 56601
guuucucucagagaaggagaauuggaauuugcauuuaacaacgauaaguugaucaagccagauuuucuucggaguaagc

SEQ ID NO: 4235470 - RNA, 56 nt, Leptospira interrogans serovar lai str. 56601
auugucgaaaauugaauaucuuucuacaaccaaaggccuucacaguuuucgacgau

SEQ ID NO: 4235471 - RNA, 68 nt, Leptospira interrogans serovar lai str. 56601
cuguuguaagguuggaaacucccggaguauuguugauagcagacauugcaguuucuccccuuugacgg

SEQ ID NO: 4235472 - RNA, 80 nt, Leptospira interrogans serovar lai str. 56601
uuguaaaauagagaucgauuacaauuuggaaauagacaagcguaaguuuaugagaaaaaugaaucgaucgaauuuuauaa

SEQ ID NO: 4235473 - RNA, 57 nt, Leptospira interrogans serovar lai str. 56601
agaugacuuuugaaaccgaagguuccacaaaagcagcugcgguaggagagguuaucu

SEQ ID NO: 4235474 - RNA, 123 nt, Leptospira interrogans serovar lai str. 56601
gagaauacaauaacgguguugauauugguucauuugcagguucugaaguuuuugcaaccgcucccggaacuguauaugaaaucgguuauacaagaaacacagguuauuucguaaaaguuucuc

SEQ ID NO: 4235475 - RNA, 66 nt, Leptospira interrogans serovar lai str. 56601
cuaaaauuuuucguaaauaugauuuaguuucuguggcugugcucgacgauuuaggaagaauuuuag

SEQ ID NO: 4235476 - RNA, 61 nt, Leptospira interrogans serovar lai str. 56601
agagaagacaucauggucguugccgguggagugauuccacaacaagauuaugauauucuuu

SEQ ID NO: 4235477 - RNA, 78 nt, Leptospira interrogans serovar lai str. 56601
agauccuuguuuuuauuuaguucuugaucccggauggaauuguauaaaccgggaacgucuaguauaaaagcgauuucu

SEQ ID NO: 4235478 - RNA, 58 nt, Leptospira interrogans serovar lai str. 56601
cuaaguauucuguagugaucggagguucuuacggcgcuggaaacuacggaaugugugg

SEQ ID NO: 4235479 - RNA, 64 nt, Leptospira interrogans serovar lai str. 56601
ggagaaugauccguaaaaaaccuguggauggaccguucucaggauuuuuuacggaggcuucccc

SEQ ID NO: 4235480 - RNA, 57 nt, Leptospira interrogans serovar lai str. 56601
uuacaguugucgcagacuguuucggcgcagccgccuuaguaguuguaacagauguag

SEQ ID NO: 4235481 - RNA, 119 nt, Leptospira interrogans serovar lai str. 56601
gaaauaguugcaaauucuauuauauucuguaauucucauucgauuggaaaguuaaucgcuucuuuauuugaaggagaagaaccguuuccaauucgaaaaguuaggggacaacuuauauc

SEQ ID NO: 4235482 - RNA, 57 nt, Leptospira interrogans serovar lai str. 56601
uaauguuucuggaauuuuuugggaagcuuugauaaucccaacauugcaggaauauug

SEQ ID NO: 4235483 - RNA, 77 nt, Leptospira interrogans serovar lai str. 56601
uuuuuacucgauugguuuauggguuacuugaucaauccuucuuguuuuuggauugcguauagauugaucgguaaaaa

SEQ ID NO: 4235484 - RNA, 84 nt, Leptospira interrogans serovar lai str. 56601
gguuuaauucaauugugggaacuaguacgagauauuuuucuaaacuguagagguucuuacaaaacuuuguauugaaguuaaacc

SEQ ID NO: 4235485 - RNA, 63 nt, Leptospira interrogans serovar lai str. 56601
uuuugaaucguauuuacuggaucagaucgaaaucuacgauccgaauuuggauacguuucagaa

SEQ ID NO: 4235486 - RNA, 91 nt, Leptospira interrogans serovar lai str. 56601
gggauagaaguucuaaaguuuuuugccaauucaugaucgguuaaaccuuuagaguugagaucaaaaaacuucgcuaacuugguuuuauccc

SEQ ID NO: 4235487 - RNA, 102 nt, Leptospira interrogans serovar lai str. 56601
uuugugguuccgguuuuuuuagcagaauuuuugcgcauaaauuucugaaaaucacaggaauagauucaaucgaaaguucuuuagaaauagcacggaaacaga

SEQ ID NO: 4235488 - RNA, 79 nt, Leptospira interrogans serovar lai str. 56601
gcguuuacaaagaaagaaauucuacccacacauuguucaaacucaucugggguaaaacaguuucuuuccuugauugcgu

SEQ ID NO: 4235489 - RNA, 55 nt, Leptospira interrogans serovar lai str. 56601
gggagguucgaucggaagugaacucuguagacagguugcaguuuuugaaccuucu

SEQ ID NO: 4235490 - RNA, 78 nt, Leptospira interrogans serovar lai str. 56601
ucaggaagaauuccggugauuucuaauaguucuaauauauuuucucuuguuagggaauugaaaagaucaccuucuuga

SEQ ID NO: 4235491 - RNA, 102 nt, Leptospira interrogans serovar lai str. 56601
ucgugauuggacccgauucucuuuuguuucaaaggauacgcgcucaucuuaagauauuaggaugggaaacguuuccuugcagagaguuagccgcacuuacgg

SEQ ID NO: 4235492 - RNA, 89 nt, Leptospira interrogans serovar lai str. 56601
uagggcaaaaaaaaacuacaggugauauuuuugcggauaagcguuuuuauaaacguuuccggaagaauaaucuaguaaaaaugguucua

SEQ ID NO: 4235493 - RNA, 87 nt, Leptospira interrogans serovar lai str. 56601
aguguuguaaaugcguagccugcuauuuuuggaugugcgucuguaauuuuagaaauuaaaguagauuuaccugcguuuggcaaaccu

SEQ ID NO: 4235494 - RNA, 76 nt, Leptospira interrogans serovar lai str. 56601
ccguguuuucugacaaagaugucagcaaacaaaggacagauguacuucguuugcucguuuuagucaaaagaaacgg

SEQ ID NO: 4235495 - RNA, 63 nt, Leptospira interrogans serovar lai str. 56601
ucggaagagauuuuaauucuuuccaggaaacguccuugauagaagcguucagauuuuuuccgg

SEQ ID NO: 4235496 - RNA, 130 nt, Leptospira interrogans serovar lai str. 56601
uccguucgagaugacggucccaagucucacgaaauuaaaaaaggaacaccuacgaugggaggacuuuugaucauagguucucuuuugauuucaguuuuacucuggggaaauuuaaaaaauccgaauguga

SEQ ID NO: 4235497 - RNA, 60 nt, Leptospira interrogans serovar lai str. 56601
guaugaguuccuacaauuuuagaauuugguuauaaaaucgugguuugugggaacucauac

SEQ ID NO: 4235498 - RNA, 67 nt, Leptospira interrogans serovar lai str. 56601
uucucuaaaggucugcauucaggaagcgauguauugaguucaagaaaugagacgcuuuaauugagag

SEQ ID NO: 4235499 - RNA, 67 nt, Leptospira interrogans serovar lai str. 56601
cauccuacgguccacgcuuuuugaauaucggaaaucguuuuucgaaucggcggaccuucguagauug

SEQ ID NO: 4235500 - RNA, 81 nt, Leptospira interrogans serovar lai str. 56601
ucuugugugguaucguaaucaaaucguuuugaacugguaaguugccagucacgaucuuucgauuucagauuacaggcggga

SEQ ID NO: 4235501 - RNA, 55 nt, Leptospira interrogans serovar lai str. 56601
gcuguuucuguuguauguggauuuguccugcggaugcaauuuauauagaagcagc

SEQ ID NO: 4235502 - RNA, 61 nt, Leptospira interrogans serovar lai str. 56601
ucuauucuuugccguuucgauuagaaggaaaacaucccuaugaaaaggacgaauggauaga

SEQ ID NO: 4235503 - RNA, 57 nt, Leptospira interrogans serovar lai str. 56601
guuuggaaacucgccuuggcccaauccggaaaucgauccgagggcgcguuugcaaac

SEQ ID NO: 4235504 - RNA, 67 nt, Leptospira interrogans serovar lai str. 56601
ucuguuuauucuuaaguccuaaaauacgagucaucguuuagaguuagguuuugauuugaugaauaga

SEQ ID NO: 4235505 - RNA, 96 nt, Leptospira interrogans serovar lai str. 56601
aguuuuauccaaaaaagaaccugaaggaaugacucgaaucgucgauucuaaauuggauuuuguagcccauucuuuuagauccguuucggaaggauu

SEQ ID NO: 4235506 - RNA, 89 nt, Leptospira interrogans serovar lai str. 56601
aucgccucuucuucuuuaagagauuuaaacguagguuccuguaaaacggaauuaaaguuuucgauuuuuugaacggaagaacaaucgau

SEQ ID NO: 4235507 - RNA, 84 nt, Leptospira interrogans serovar lai str. 56601
uuacucgcuuauuacucagcaaucgcuagagguuguccuccggaucaaccuagaaaccuugcuaaguccguaaccguagaguaa

SEQ ID NO: 4235508 - RNA, 126 nt, Leptospira interrogans serovar lai str. 56601
aagcgaaaaaaguuccagauguuuccaaagcguuuuuuuuaggaacuggaauggacuauaaauauaaugauagcuuucuggaacgaaugaaagcggaaaaaagauuugggacugauuuaagugcuu

SEQ ID NO: 4235509 - RNA, 86 nt, Leptospira interrogans serovar lai str. 56601
aaaaugugggaacucauacaaaaacuacaauguuaaagggccguaagucacacaauguugacgguuuuuguaggaacucauauuuu

SEQ ID NO: 4235510 - RNA, 65 nt, Leptospira interrogans serovar lai str. 56601
aggucgucucaaaaauauuguaggauguugcucuaagagacucuaagcuauuuuugagaugauuu

SEQ ID NO: 4235511 - RNA, 63 nt, Leptospira interrogans serovar lai str. 56601
guaccgaagauaauccuuuaggacucguccucuagaaacguucaaaagaguuacuucagguac

SEQ ID NO: 4235512 - RNA, 66 nt, Leptospira interrogans serovar lai str. 56601
uuugaacaaaucgguucuucuauaaaucuuuuuauagaucgucacguuaaccgaaauuuguucgga

SEQ ID NO: 4235513 - RNA, 68 nt, Leptospira interrogans serovar lai str. 56601
agauucuuucuuaaucccgauucuaccaauguuuuuucucguuaggauagaucaauaggaaagaauuu

SEQ ID NO: 4235514 - RNA, 89 nt, Leptospira interrogans serovar lai str. 56601
acgauccguuugaaauuccagaagugaucgauccgauuuacaaagguaaggcggauguuguuuuuggaagcagguuuuugggaggucgu

SEQ ID NO: 4235515 - RNA, 56 nt, Leptospira interrogans serovar lai str. 56601
gaucguuuuugucuucuucaggagaaccuuuacguuuuugaagaauaggagcgauu

SEQ ID NO: 4235516 - RNA, 59 nt, Leptospira interrogans serovar lai str. 56601
gauggauuuagagcgcucuuacuggccaaggcagguuuucaaggugcuuugggugcguu

SEQ ID NO: 4235517 - RNA, 67 nt, Leptospira interrogans serovar lai str. 56601
aaaucguuuaucuauguccgucaugaugauuucacucugguuuguaauggaaguauuuaaacgauuu

SEQ ID NO: 4235518 - RNA, 84 nt, Leptospira interrogans serovar lai str. 56601
caaaagaagccgccgcuggaaccauucgagcucuuuaugcagaaaguaaagaagccaaugcaguccacgguucggauucagaug

SEQ ID NO: 4235519 - RNA, 67 nt, Leptospira interrogans serovar lai str. 56601
gaguuuguacaauuaaguuaagauguaagaaccaaucaauucuuagauaaacaaauuguaagaacuc

SEQ ID NO: 4235520 - RNA, 98 nt, Leptospira interrogans serovar lai str. 56601
gaaaagaacgaacuggagaaugaacaccuccgggagaaacuuuuuuugcucuuucaaaaaguucuucagagguuuucccuuuccaaaaaucggaaauc

SEQ ID NO: 4235521 - RNA, 75 nt, Leptospira interrogans serovar lai str. 56601
aggcaucaaguuuaaggaagcguuuugcugaguucaacacaacuugcagagcaaccauccauagaauuaugcgcu

SEQ ID NO: 4235522 - RNA, 67 nt, Leptospira interrogans serovar lai str. 56601
gauaugauucuuguuuugggaaccaucaccuacaagauggcuccgguuuuaagacagaucuacgauc

SEQ ID NO: 4235523 - RNA, 57 nt, Leptospira interrogans serovar lai str. 56601
uggaauucaaaugggaggaggaauuuuagaagauucuacuuuaccagaugaauuuca

SEQ ID NO: 4235524 - RNA, 112 nt, Leptospira interrogans serovar lai str. 56601
uuagagggcuuuuauuagauacaucaucuaguuuggauuuauuucagaaaauuuuuucuaaagucaaagguaucgaauauguggaugaaaacauuaaaguaaagcuuguuaa

SEQ ID NO: 4235525 - RNA, 72 nt, Leptospira interrogans serovar lai str. 56601
ggagaaagcaugagcauccauguuuccaacugagcuuucggagucaguggaacguggaucgccaucugaucc

SEQ ID NO: 4235526 - RNA, 102 nt, Leptospira interrogans serovar lai str. 56601
guuugguauucucagaacuuuugaccauggauucuacgaucggaagauucauaaaauuuguauucgauuguagaaguuuagggucugaaugagcgaucagau

SEQ ID NO: 4235527 - RNA, 63 nt, Leptospira interrogans serovar lai str. 56601
gguuaaguuauugguauuuuauaaaaauugaauuugguucuggaauuucacaauaacuugacc

SEQ ID NO: 4235528 - RNA, 125 nt, Leptospira interrogans serovar lai str. 56601
ggauuaacuucaaucguauucaaaaauuguaacauuuuuagcccuggcguauuauuguuucgguuucuuccgcaaaacgaagauccaaaucggugaucguauuuuuagaaugugugaagauuucc

SEQ ID NO: 4235529 - RNA, 61 nt, Leptospira interrogans serovar lai str. 56601
gugaugguagagagcguuuuacugaguuucuuaaacucaaugcugcuucucuacaggucgc

SEQ ID NO: 4235530 - RNA, 58 nt, Leptospira interrogans serovar lai str. 56601
cgguucaauagguuuucgugaucuuccauccagguuucacggagugcguaucgaaucg

SEQ ID NO: 4235531 - RNA, 71 nt, Leptospira interrogans serovar lai str. 56601
aucuggacuuuguagaucgauucuuaaaaugugggaacucccacaaaacuuaagauugucuauauaaugau

SEQ ID NO: 4235532 - RNA, 57 nt, Leptospira interrogans serovar lai str. 56601
ucggaucguagaguagaguuguauggaaccgcugacgaacucaauucuaccauugga

SEQ ID NO: 4235533 - RNA, 60 nt, Leptospira interrogans serovar lai str. 56601
gguacugguggaacgaacgcuguaaccguggacaauuacgaauaucguccuaccgguauc

SEQ ID NO: 4235534 - RNA, 56 nt, Leptospira interrogans serovar lai str. 56601
gauggaagauuacaaacacuucggaauucauuccgugcuguuugaaguuuucauuc

SEQ ID NO: 4235535 - RNA, 127 nt, Leptospira interrogans serovar lai str. 56601
uucgagaagaagcguugaucaguccggucucuaucgcugcggaauauaaaaucgguuugauagaagauccgguuugacguuucauagcaguaguucuguccaauugauuauccgcuuuaaauucgga

SEQ ID NO: 4235536 - RNA, 71 nt, Leptospira interrogans serovar lai str. 56601
uccuucuauuuccgaagaagagaacuuuagcuuaaaagaaaauuuaaauucagugauuugggaaggaagga

SEQ ID NO: 4235537 - RNA, 75 nt, Leptospira interrogans serovar lai str. 56601
uuggaauaaggaucguauguuaggagcuucaccguuuaaaauuuguuccgaagagaagcuacgagccuuguccaa

SEQ ID NO: 4235538 - RNA, 112 nt, Leptospira interrogans serovar lai str. 56601
ggaagaaaaaaaaugguacgaucaaguugaauuuuccggauuugcagacguguauuauauguacaaucucaauccgaaacaaggcaacgauauugauucaaccagagcuuuc

SEQ ID NO: 4235539 - RNA, 65 nt, Leptospira interrogans serovar lai str. 56601
cggcgggaaaaugaaaauuggaucguauccaaaaccauauauuccaauucuaucauauuccuccg

SEQ ID NO: 4235540 - RNA, 65 nt, Leptospira interrogans serovar lai str. 56601
gguucgaauugaacuaugaagguuauuccggguaaacggaaaccugcauuuuuaauuugguaacc

SEQ ID NO: 4235541 - RNA, 130 nt, Leptospira interrogans serovar lai str. 56601
gaagauuucgaaguagaugaaaaggcgcguaacguucuuuugacugaaaaagguguuucucacguugaagaaauacuuucgaucgaaaauuuauacgcuccugagaacgucgaucuaguucaucacguuc

SEQ ID NO: 4235542 - RNA, 79 nt, Leptospira interrogans serovar lai str. 56601
accagagauucuuccacaagguucuacuuccaaucugguuuuagaaacgauugguaagggaauucguaaauuuuuuggu

SEQ ID NO: 4235543 - RNA, 67 nt, Leptospira interrogans serovar lai str. 56601
ugauuccuuuaaaauuaaccacucgaauacacgaaagugauacuuggugaguugguuucaggauuua

SEQ ID NO: 4235544 - RNA, 58 nt, Leptospira interrogans serovar lai str. 56601
gaucgcauugauacgauucccuucuuugccuuugagaaaauccgagucaauugugauc

SEQ ID NO: 4235545 - RNA, 89 nt, Leptospira interrogans serovar lai str. 56601
ccagauugauaagaaauuccagauucuucugcauaaccuaacgcagcuauguuggcagaguccggaacuggaaugacuacauccgcugg

SEQ ID NO: 4235546 - RNA, 79 nt, Leptospira interrogans serovar lai str. 56601
guagaaagaccuaaguuuguauuuauuuuucuaagauccucuugauugagguauuggaaaggaacacaaauggcucuac

SEQ ID NO: 4235547 - RNA, 66 nt, Leptospira interrogans serovar lai str. 56601
ucugaagucuaaaucguugucuucuaagggugggcauuuucuagaaaaaacuuuugugauuuuagg

SEQ ID NO: 4235548 - RNA, 83 nt, Leptospira interrogans serovar lai str. 56601
auccagaaccuauaaaguauugggaugcgccuacaauccaggaaauuggaaaucagguuccuauguauuuucuuucuuuggau

SEQ ID NO: 4235549 - RNA, 81 nt, Leptospira interrogans serovar lai str. 56601
ucgaaaaucuuuucgucuagcuuucucucaguuuccagaauagauuggccuaacugggcacuggaugguugugauuuuuga

SEQ ID NO: 4235550 - RNA, 101 nt, Leptospira interrogans serovar lai str. 56601
ccauuuucauuuaggaacguguagggagccggauuggggagacacacauuguuuuauuucucauaccguuuaucuugcaaacaguucggcgauuaaggugg

SEQ ID NO: 4235551 - RNA, 68 nt, Leptospira interrogans serovar lai str. 56601
gcaggucguggauuugcuguaguugcucaagagguuaguaaacuugcagaauuuacggcuacaaaugc

SEQ ID NO: 4235552 - RNA, 113 nt, Leptospira interrogans serovar lai str. 56601
aaugugcggaaauaagaucgaaucgaaucguuuccaagauuuuuuugaauucgaauuccgacuuuucgaaauaucuggaugcgauuucgguuugaaaauagucuccccacguu

SEQ ID NO: 4235553 - RNA, 104 nt, Leptospira interrogans serovar lai str. 56601
guuuggaguuguaaaaguaauaguuccugaaccagauacggcuuuuaguuuuguaaaaaaacuggaacguuuuacugguaaggguggaacugauaauucuauau

SEQ ID NO: 4235554 - RNA, 71 nt, Leptospira interrogans serovar lai str. 56601
agcggggucaaaaaauuguuuuucgauauaugaauuuuauaaaaaaugaauacaauuuuuugaccagagcu

SEQ ID NO: 4235555 - RNA, 130 nt, Leptospira interrogans serovar lai str. 56601
gguugcguccaagugagcaaacgcguuugcaggagccgggucggucaagucgucugcaggaacguaaaucgccugaacagaagugauugauccuuuuuuaguagauguaauucuuucuugaagcgcaccc

SEQ ID NO: 4235556 - RNA, 56 nt, Leptospira interrogans serovar lai str. 56601
uuggaguugggaauucuaucgugaguacgauaaaugaaggaguucccacauuucaa

SEQ ID NO: 4235557 - RNA, 90 nt, Leptospira interrogans serovar lai str. 56601
gggaucgaugcgggguuaaguuauugguauuuuauaaaaauuuaaucugauucuggaauuucacaauaacuugaccagagcugagagccc

SEQ ID NO: 4235558 - RNA, 58 nt, Leptospira interrogans serovar lai str. 56601
gauacaaagauuacaauuucgugggauuccccuguuuuucggauugagucuuuguauu

SEQ ID NO: 4235559 - RNA, 105 nt, Leptospira interrogans serovar lai str. 56601
guuuugacuaaggaagcuuuucaguugggaauucuuuuaggauauaaaccaguagaguuuauagauuucuuaaaaaguucuaguaaagcugaucuugcucaaaac

SEQ ID NO: 4235560 - RNA, 77 nt, Leptospira interrogans serovar lai str. 56601
aagagagugauuuauuaguuucucauuuaaacgaucuauacggauuugcgagugaaaagcuaaauaugacugaucuu

SEQ ID NO: 4235561 - RNA, 56 nt, Leptospira interrogans serovar lai str. 56601
ggacaaucauaccuacguagucgguggaagugagaccgguaaagguuauguugucc

SEQ ID NO: 4235562 - RNA, 60 nt, Leptospira interrogans serovar lai str. 56601
ggacauagaauuuccgaacgaucuacuuuuagaauuagaucgaauggaauuuuauauucc

SEQ ID NO: 4235563 - RNA, 89 nt, Leptospira interrogans serovar lai str. 56601
gggaucgaugcgaggucaaguuauuggaaauuauaaaacuagaucauauuuuucuaaaauaccaauaacuugaccaaagcugagagccc

SEQ ID NO: 4235564 - RNA, 56 nt, Leptospira interrogans serovar lai str. 56601
gaaaaccucugaagaacuuuuugaaagagcaaaaaaaguuucucccggagguguuc

SEQ ID NO: 4235565 - RNA, 116 nt, Leptospira interrogans serovar lai str. 56601
uggcuaacguuuuaggagugucucguucaggauucuaucaauuucuaaaacggaguaaaaacgaauuagaaaaauauaaucccgaacuugucgaguucauucgggaaacguggcua

SEQ ID NO: 4235566 - RNA, 129 nt, Leptospira interrogans serovar lai str. 56601
gacuuugaaguugugggaacucuuacaauuugagauuuuacagugggacuuugaaguugugggaacucuuacaauuugagauuuuacaguaaaacuuugaaguugugggaacucuuacaacuugagauu

SEQ ID NO: 4235567 - RNA, 68 nt, Leptospira interrogans serovar lai str. 56601
cuuuuuagaugaguugaccgaacucgaucaaaaacuuacuggcgggucggguaaacucguuucuaagg

SEQ ID NO: 4235568 - RNA, 62 nt, Leptospira interrogans serovar lai str. 56601
ggaauggccgauugauuuuuggauauugguuuguauuuuuaccggaaaauguuggugauucc

SEQ ID NO: 4235569 - RNA, 74 nt, Leptospira interrogans serovar lai str. 56601
aaacugucguaucuagauauuugcaaacuuuucaauuucucuuuauuaggaaguuuuaaguuuuggaacaguuu

SEQ ID NO: 4235570 - RNA, 57 nt, Leptospira interrogans serovar lai str. 56601
agaguggguagauagucguucguuuaaaaugaguuuagcgacuguuuauaauacucu

SEQ ID NO: 4235571 - RNA, 84 nt, Leptospira interrogans serovar lai str. 56601
uucuuuuuccguagauaaucgaucgucuuguaucuggcaauugcaaaaauccaaggugcaggaugacgaucuucucuauaagaa

SEQ ID NO: 4235572 - RNA, 72 nt, Leptospira interrogans serovar lai str. 56601
ggguagauacauugguuccuuaguugcggauuuucauagaaaucuucuaaaaggaggaaucuuucucuaucc

SEQ ID NO: 4235573 - RNA, 111 nt, Leptospira interrogans serovar lai str. 56601
accuuuuauauccguuuuuuaaaaggaaaaucuaaaggagaucuugcguuuaaagacaaucguaaacucagggcuucuuuguuucaauauuuagaagaggcggcgaaaggu

SEQ ID NO: 4235574 - RNA, 69 nt, Leptospira interrogans serovar lai str. 56601
gaaucuugagagaaauuuuacucgcuugggaauguuuaaucacguucugaaagauuuccugaacgauuc

SEQ ID NO: 4235575 - RNA, 92 nt, Leptospira interrogans serovar lai str. 56601
auugcauuuuguagaauuacuucuaaacuugcagacuugccuuuuuuaaaaaugguguugguuuuagaagaauuugaagauagaauuguagu

SEQ ID NO: 4235576 - RNA, 84 nt, Leptospira interrogans serovar lai str. 56601
cgggcucuuugcaggaaugauuccgggacagcauucuccucaaguacccuuguuuuuccggaauaucuuucaaaugcuagcucg

SEQ ID NO: 4235577 - RNA, 74 nt, Leptospira interrogans serovar lai str. 56601
aaucgaaauaacgaauaccauuauuucuagcguucacuucuacggagauaaacuuggauucugcaauuucgauu

SEQ ID NO: 4235578 - RNA, 75 nt, Leptospira interrogans serovar lai str. 56601
cuuuagaagaaaauucagauuucuucagucaucguaaaaaagaaguaggaagaaaucugaauuugauuuggaaag

SEQ ID NO: 4235579 - RNA, 66 nt, Leptospira interrogans serovar lai str. 56601
ggauucguuuuuaaaauucggagaaagaacauaaccacauucuccggaauucaaaaaacggucucc

SEQ ID NO: 4235580 - RNA, 75 nt, Leptospira interrogans serovar lai str. 56601
gaguuguugaaaaauuaauucgccaucgauuuccguuguauggaaacugucgauugaaguaguuuuguuaaacuc

SEQ ID NO: 4235581 - RNA, 68 nt, Leptospira interrogans serovar lai str. 56601
ucuaauuccuccauucaggaaguucgagauaaaaucggagaaauucguucuucuuuggaugaauuaga

SEQ ID NO: 4235582 - RNA, 75 nt, Leptospira interrogans serovar lai str. 56601
cgaaguuuuauucugauauauucgauuuugaaucguuagaugagaaaucaggagaauauguuauaauggggcucg

SEQ ID NO: 4235583 - RNA, 103 nt, Leptospira interrogans serovar lai str. 56601
cguuucccgaaugaacucgacaaguucaggauuauauuuuucuaauucguuuuuacuccguuuuagaaauugauagaauccugaacgagacacuccuaaaacg

SEQ ID NO: 4235584 - RNA, 59 nt, Leptospira interrogans serovar lai str. 56601
guaguaguuucuacaagcucgagcuuuacaaauaaguuuggaauugugggaacucauac

SEQ ID NO: 4235585 - RNA, 63 nt, Leptospira interrogans serovar lai str. 56601
guucgggauuauauuuuucuaauucguuuuuacuccguuuuagaaauugauagaauccugaac

SEQ ID NO: 4235586 - RNA, 80 nt, Leptospira interrogans serovar lai str. 56601
gauauaggaauucuuagcaaaccguuuuccagcaucaauucuuggaauuuuaaaccugugcgagaauuaccuaaaaaauc

SEQ ID NO: 4235587 - RNA, 76 nt, Leptospira interrogans serovar lai str. 56601
auucuauuuuuuugauguaagagaauugaccauacucuacguuucagaucuuauagaaguauuaggagaauagaau

SEQ ID NO: 4235588 - RNA, 90 nt, Leptospira interrogans serovar lai str. 56601
cuccgauggaacuuaggacgauucaagauuggaacaucaugccuaagaugcuuucaauuccuggaaucgccgaugugguuacauuuggag

SEQ ID NO: 4235589 - RNA, 62 nt, Leptospira interrogans serovar lai str. 56601
guugaaguuuuagaucuucguucgauccgaccuuuggacgaagaagcgaucuauacuucaau

SEQ ID NO: 4235590 - RNA, 72 nt, Leptospira interrogans serovar lai str. 56601
aauacauaaggaaauuugaauucugcaauucccgauuuagcagcggauugaagaagaauuucuuuuaguauu

SEQ ID NO: 4235591 - RNA, 72 nt, Leptospira interrogans serovar lai str. 56601
uccuuuagaugcaaguucuuuaaauucuuuuucaacuuucagaagaaugcugucugcuugcucucgaaguga

SEQ ID NO: 4235592 - RNA, 78 nt, Leptospira interrogans serovar lai str. 56601
auagaaccgaaucaaauguucuacuucaggaaggaaaaccugcuuggauugcuuuugauucucuugcagagguucuau

SEQ ID NO: 4235593 - RNA, 96 nt, Leptospira interrogans serovar lai str. 56601
cggaagaaugaaucgaauguuccaucuuuaaauuaggauuuccagaucuggaagaaaauuguucaaucugaaguggagcguuauaguguucucccg

SEQ ID NO: 4235594 - RNA, 59 nt, Leptospira interrogans serovar lai str. 56601
gucuauaucaaguccggaaucaguuucguccaauaccgaaaguuucgguuugaguagac

SEQ ID NO: 4235595 - RNA, 87 nt, Leptospira interrogans serovar lai str. 56601
ucgggagacucucaacauucuuuaaaaguauaugaugaaauuauaauucauuauccagauuauuauaggauucgagauguuuaucga

SEQ ID NO: 4235596 - RNA, 62 nt, Leptospira interrogans serovar lai str. 56601
uuucaaauacaugauagacuugcucaaagaaaaaggggcgggucauaucaaaguauuuggag

SEQ ID NO: 4235597 - RNA, 61 nt, Leptospira interrogans serovar lai str. 56601
gaagcagagauccaaacuuuaaucgaaauuuuaggauucaguuugaacuuucucgugcuuc

SEQ ID NO: 4235598 - RNA, 58 nt, Leptospira interrogans serovar lai str. 56601
gauucggaagguauuucacuuuauuaccgggguacgacgaaagugaacuuacugaguu

SEQ ID NO: 4235599 - RNA, 62 nt, Leptospira interrogans serovar lai str. 56601
gaauuguaggaacucccaugaacauuuauaaaccaccaauugugugggaacuccuauauuuu

SEQ ID NO: 4235600 - RNA, 59 nt, Leptospira interrogans serovar lai str. 56601
uaaagaacauauuagagcggaucgcuucucuuucgaucgcgccucucgcuuguuuuuua

SEQ ID NO: 4235601 - RNA, 58 nt, Leptospira interrogans serovar lai str. 56601
ugggaacuagagucuugguuucggucuauuuuaaaagaauuagagauucuagaucuua

SEQ ID NO: 4235602 - RNA, 63 nt, Leptospira interrogans serovar lai str. 56601
ggaaguuuuucuuucuucguuuuauccagagugaucaccggaacgaugggaggaaacauaucc

SEQ ID NO: 4235603 - RNA, 60 nt, Leptospira interrogans serovar lai str. 56601
cuucagaagaauguguagugggcuuucgguuuucuucaauagccucuacuucuucugugg

SEQ ID NO: 4235604 - RNA, 61 nt, Listeria monocytogenes EGD-e
acgaaauaauaaacgaacggaacaaauucucggaaggggauagguuccguuuuuuugucgu

SEQ ID NO: 4235605 - RNA, 99 nt, Listeria monocytogenes EGD-e
gcaucuucaauggaugaagcagaugcuuuaguugcgauggauugauuguucacguuagauacauuguagcuaaggcgacucauaccagcaccuagaagc

SEQ ID NO: 4235606 - RNA, 74 nt, Listeria monocytogenes EGD-e
ucauuggaauacauugaaacagcugcaaaauaugguuuuagccguauuuuuacuuguuugauuucugcuaauga

SEQ ID NO: 4235607 - RNA, 85 nt, Listeria monocytogenes EGD-e
uauucuauuuuggaaaguaaaguucggaggaauaaauuauuaaauguggucuugaccgaacuuugcuuucuguuuuaaaggagug

SEQ ID NO: 4235608 - RNA, 87 nt, Listeria monocytogenes EGD-e
cggcuuagauacagcuagcucacuuguuccgcccgccucuuugaaauacucgauuugguugcaaguagcuaacuguauuugaugcug

SEQ ID NO: 4235609 - RNA, 61 nt, Listeria monocytogenes EGD-e
auguacgaaugaaaaaagcgauuuggaugauugguccaaaucgcuuuuuccuauuuagcau

SEQ ID NO: 4235610 - RNA, 86 nt, Listeria monocytogenes EGD-e
gugacagauacagucgccaaaucaccuagagucguauuguuacuaccaaugaugcagcuaggaaugauugcauuguuuaucuuuau

SEQ ID NO: 4235611 - RNA, 64 nt, Listeria monocytogenes EGD-e
ugccuguuaaaacugcauuuugaacuucacgcuugcgaagaacaugcucaacguuuugacggca

SEQ ID NO: 4235612 - RNA, 72 nt, Listeria monocytogenes EGD-e
cagauauggcagaagggcacaugacaaaaaugcgugcagcaauuguuugugagccuucuuuaguugaguuug

SEQ ID NO: 4235613 - RNA, 61 nt, Listeria monocytogenes EGD-e
caugacgucgauuccaaugaaauggccuucaaaguggcugcuucaauggcauuacguaaug

SEQ ID NO: 4235614 - RNA, 130 nt, Listeria monocytogenes EGD-e
auugccauguaaaaucacguccuuuuauuauuuacugucagaccauucuuugagccaaguuuuuugcuugucugucaagggauaguuuuuuaguaaaucugggcggcguucguagguucuuuugagugau

SEQ ID NO: 4235615 - RNA, 94 nt, Listeria monocytogenes EGD-e
cugcguuauuacaccgagcuuguguacgggaaagcacgucauuugcacaaacuuauugaugauuuguuuucuuauacaaggcucgauagcgugg

SEQ ID NO: 4235616 - RNA, 73 nt, Listeria monocytogenes EGD-e
uccagcucuaagugcuucuguuacauauucaucuguaucaugaauagucaagacgauuacuuugaugcuagga

SEQ ID NO: 4235617 - RNA, 62 nt, Listeria monocytogenes EGD-e
ucugaaagugauuuuuggacuuguuuauuuucuagauauucaagcauauugauuacuucagg

SEQ ID NO: 4235618 - RNA, 70 nt, Listeria monocytogenes EGD-e
gcuuaauguaacagagcgccaguugugguaguugauagcuaauacaacuggcuuucgguauauagggggu

SEQ ID NO: 4235619 - RNA, 125 nt, Listeria monocytogenes EGD-e
ucuuuaaagaugaaguggauuauagcgaucaguauuaucauuguacuuuuagucguggggugguuucuugggacuagguugacggugaaaaaauaugaagucaguucuacuaaaauugaaaaaga

SEQ ID NO: 4235620 - RNA, 93 nt, Listeria monocytogenes EGD-e
caacgacuuauuuggagcggauuuucgaaacgauggauguugagccagacauuaaagacauaccaaacgcgaagaagaugccgccaaucguug

SEQ ID NO: 4235621 - RNA, 89 nt, Listeria monocytogenes EGD-e
agccagaugcauguagaacagaaugcaaguaaaagcacaaguuucacacaaaugcuuuuaguuugccguuuuuuucuaggcaucuggcu

SEQ ID NO: 4235622 - RNA, 81 nt, Listeria monocytogenes EGD-e
uucguucuauucggaccuaguagcuuauucucuaaaguuucuucugauaccguagagaaaagcgcuacaucaaugaacgaa

SEQ ID NO: 4235623 - RNA, 57 nt, Listeria monocytogenes EGD-e
uaucacuuagacgaaucgcuaaaguagacgcacuagaugcuauucgaggaggugaug

SEQ ID NO: 4235624 - RNA, 73 nt, Listeria monocytogenes EGD-e
ucccguaaaaaagugauugcgaguggcuuuuuugaaaaauuaaucgaacgagugacagaaauuauuacggaga

SEQ ID NO: 4235625 - RNA, 82 nt, Listeria monocytogenes EGD-e
cgaagcacaaaugguacuaacuauuacuuaugaugaggaugcucaaaaagaaaugguuggugaaaaauucacacuugcuucg

SEQ ID NO: 4235626 - RNA, 68 nt, Listeria monocytogenes EGD-e
agggugaacugacagaauuuauuaacgggaauauaguucuagguauaaauggcuguuuuuucacgccu

SEQ ID NO: 4235627 - RNA, 71 nt, Listeria monocytogenes EGD-e
uaguuguagguucuguagugucgguuguugcuuccuuagugauuuggaccgcaguuauaguaucugcacua

SEQ ID NO: 4235628 - RNA, 77 nt, Listeria monocytogenes EGD-e
agaauauuuagaaacacuacaaaaagcuauuagugacuuaaacuauggcgcgauugcuacuguuucuggacguuucu

SEQ ID NO: 4235629 - RNA, 82 nt, Listeria monocytogenes EGD-e
guacuuccguugcuacugcauaguguucuuccccaacaauaucaggagaaagcgcacgagauguagaagcaaguggaucuac

SEQ ID NO: 4235630 - RNA, 58 nt, Listeria monocytogenes EGD-e
ugaaguguuacuggauucuguagcaaaagcaaucgcgacgaaugaaguuaaugcuuca

SEQ ID NO: 4235631 - RNA, 55 nt, Listeria monocytogenes EGD-e
auaaaaacaccuucguuggauucauguaaaaugaaacuaacggagguguuucuau

SEQ ID NO: 4235632 - RNA, 86 nt, Listeria monocytogenes EGD-e
guaauggaaacuauucgaauuaugcgcgaacaggaagauauuacggugauuucgauuacgcaugauuuggaugaaguccuuuuugc

SEQ ID NO: 4235633 - RNA, 64 nt, Listeria monocytogenes EGD-e
uuaauacuugcuccauccgguccgggucauaggaauacucuaaaucggguguuucaaguucuaa

SEQ ID NO: 4235634 - RNA, 80 nt, Listeria monocytogenes EGD-e
gcuaucgagccuuguauaagaaaacaaaucaucaauaaguuugugcaaaugacgugcuuucccguacacaagcucggugu

SEQ ID NO: 4235635 - RNA, 94 nt, Listeria monocytogenes EGD-e
gcggacaaacaaaggcgcauucauugcacaucguacaguuuucagaaauccauucaggaacuucgagugcaauuccgcguuuuucguaagcugc

SEQ ID NO: 4235636 - RNA, 64 nt, Listeria monocytogenes EGD-e
auauucgccguaucaaagaaauuuaugccuaaaucgagugcuuuuuuuaugauagggcgacugu

SEQ ID NO: 4235637 - RNA, 65 nt, Listeria monocytogenes EGD-e
ucugcgacaaguacagcacuucgacuaggugauuauguagugacagaagcuggauuuggcgcaga

SEQ ID NO: 4235638 - RNA, 74 nt, Listeria monocytogenes EGD-e
uacuagaacuggaauuuuugaugugguuaagcaaauggguggcaguuuaguugucaaagauuccagcagaagua

SEQ ID NO: 4235639 - RNA, 58 nt, Listeria monocytogenes EGD-e
caacacaacgacagcgagcauuucaaaaaauuucagaaagcugcugccgauuuuguug

SEQ ID NO: 4235640 - RNA, 82 nt, Listeria monocytogenes EGD-e
uccgacugaaguagauccagaaaucuuggaacaaaugaaagaauaugcgauccaagcguuuuuaggucuggacgcaagcgga

SEQ ID NO: 4235641 - RNA, 66 nt, Listeria monocytogenes EGD-e
gguagaaguuguguaguaugaaauuuugacagaaucuguuaaauuuccuagaucaacuuuaaaacc

SEQ ID NO: 4235642 - RNA, 59 nt, Listeria monocytogenes EGD-e
uugcucaucggcaacgauaacaguuccuucagggcuuguuucgaucuguuggugagcaa

SEQ ID NO: 4235643 - RNA, 129 nt, Listeria monocytogenes EGD-e
cugcgaguuguccuacgccugaaacuaguuuuggugaguuagcugauaguugguuuagaccgccugcuaauugguuugaaccugcuuguaguugauuaacaccaccugcaaguguuggaacuuuugcag

SEQ ID NO: 4235644 - RNA, 129 nt, Listeria monocytogenes EGD-e
auuucguguagaacgguuguuguaaugacgauagauauucuucggacucuuuaaagaaugguuuaucuuuaaguccguaguuagaaacaucugcuucguucauaucauaguaacuggcaucaaagaaau

SEQ ID NO: 4235645 - RNA, 56 nt, Listeria monocytogenes EGD-e
auugaagcaggaacauuuaugauugcugcggcgauuacugguggaaauguuuuaau

SEQ ID NO: 4235646 - RNA, 56 nt, Listeria monocytogenes EGD-e
gcaguggugcuugcgguuuacuugaaaacucguucuagaaaucaaaaagcacuugc

SEQ ID NO: 4235647 - RNA, 61 nt, Listeria monocytogenes EGD-e
uuuaagacaagggaaugucacguugccaguauuuuuugcaauggaagauccuuuucuuaaa

SEQ ID NO: 4235648 - RNA, 69 nt, Listeria monocytogenes EGD-e
guuuguucuuaugaaauucuuaccugguacgccuuaccguaaucaggagaaacuaucugacgaacaaau

SEQ ID NO: 4235649 - RNA, 56 nt, Listeria monocytogenes EGD-e
guuucgccuaaguguuauaauuuauaaaauauuguaagguugaaaguagguggaau

SEQ ID NO: 4235650 - RNA, 62 nt, Listeria monocytogenes EGD-e
ucuagaaguagcucuugaaaagauuuuuaauuuaucuuuuugaucaagggcugcuuuucuga

SEQ ID NO: 4235651 - RNA, 84 nt, Listeria monocytogenes EGD-e
uaucuucuacgauacuccaaaguuuaucaugauuuucgccuaaaagaaugacagcgcgagaacuuugggaguugaaagaagaug

SEQ ID NO: 4235652 - RNA, 64 nt, Listeria monocytogenes EGD-e
aauugguacuauucucgcaaccagcuuuuuugagaagagaagcaggacgagauauggaugaauu

SEQ ID NO: 4235653 - RNA, 67 nt, Listeria monocytogenes EGD-e
gugcaacuuuuacauuuuuugauguuggacaaggugauagcacacuuauccaagcagaagauggcac

SEQ ID NO: 4235654 - RNA, 105 nt, Listeria monocytogenes EGD-e
acccugacgucucacgaucgagucuuguuacaauaugaauagcguucgucaguccuugcgcuucauaaugcccuuugacaaaauuugcaacggauccauuugggu

SEQ ID NO: 4235655 - RNA, 62 nt, Listeria monocytogenes EGD-e
aguaagauguuacuggguaaggcauauaccaaaguaagaaugauugcgcgggaauacuuacu

SEQ ID NO: 4235656 - RNA, 60 nt, Listeria monocytogenes EGD-e
cggucgugaaaguaggauuuucaaguaguuuuacaaaaucuuuauuagcuuuuaaggccg

SEQ ID NO: 4235657 - RNA, 122 nt, Listeria monocytogenes EGD-e
uacaagcaaaaguccaaguuaaaccugauuuaguagcggaauuuuugguggaagugaauuuaguaauccaaggcucgcuuucagaaaccggaaaucauggcuacgaauuaguuugcucugua

SEQ ID NO: 4235658 - RNA, 72 nt, Listeria monocytogenes EGD-e
ccauuuuuccgagcaguguacuucuuacccgugaucacuucauggguagcuguuucacucguuuggaaaugg

SEQ ID NO: 4235659 - RNA, 99 nt, Listeria monocytogenes EGD-e
uuuggaucuguugguuucaagucaagugucacgccgauuucuuuguauuguuguugcaaguaaagcgcgauacuuucuugugauuuacuguuguuuaaa

SEQ ID NO: 4235660 - RNA, 106 nt, Listeria monocytogenes EGD-e
uaugaugaaaauaaguggucagaugaacaaacguugauuucuuuggccgauuuagaugaaguaagccaaacgaauccgauuuuaguucggcgcauugauuaucaua

SEQ ID NO: 4235661 - RNA, 74 nt, Listeria monocytogenes EGD-e
aguuagcguauguaauaaaucuacguucggaauauuguuuugaacgcaaaaauuaguugcguacucagcuaacu

SEQ ID NO: 4235662 - RNA, 82 nt, Listeria monocytogenes EGD-e
uguuaaggaacugauuucacucgcaaguagcgucacuucguauuuuucuaguucuucuuguuggaauaaguaauccuuggca

SEQ ID NO: 4235663 - RNA, 63 nt, Listeria monocytogenes EGD-e
gcugaagccauuuauacuagagucaauccgcagccaaauagauuuugggauagauacuucggu

SEQ ID NO: 4235664 - RNA, 56 nt, Listeria monocytogenes EGD-e
ucuguaugagaaagugguugguccaaaauuccggccgccauauucguaauacaaga

SEQ ID NO: 4235665 - RNA, 58 nt, Listeria monocytogenes EGD-e
aguagaugccguucuuaucgcgacaccgaaugauagccauaaagaacuggcaauuacu

SEQ ID NO: 4235666 - RNA, 97 nt, Listeria monocytogenes EGD-e
uugaaaguuaugagcaaaaaguuugugcauuccuugugaaauguuuauaguauauaagcaagcaugugaaaggaaguacaguucacaauagcuucaa

SEQ ID NO: 4235667 - RNA, 67 nt, Listeria monocytogenes EGD-e
aauucagcaguauauuguuuacgaucuucaucacugaaugaaccguuagaagauuguacugcuaauu

SEQ ID NO: 4235668 - RNA, 62 nt, Listeria monocytogenes EGD-e
gaaucgguucuaucguuuagugaaucuauuuacggauguaccucacuuacgaggaacgguuc

SEQ ID NO: 4235669 - RNA, 112 nt, Listeria monocytogenes EGD-e
uguuuccuggacguuugccucaauugggugcggugccgcaaguccauuaccuaaauaagucgguacaauuucuucgcgcucaaaaagugacgguaaauaguccucgccaaca

SEQ ID NO: 4235670 - RNA, 59 nt, Listeria monocytogenes EGD-e
uucgcuuaugaaaugauagacaguuuagaacaaaaagugaguaucauuuccaugacgaa

SEQ ID NO: 4235671 - RNA, 59 nt, Listeria monocytogenes EGD-e
gguugaaaauaaguaaauggcggcucugcaccaaguguugucgcaugcauuuucauucc

SEQ ID NO: 4235672 - RNA, 130 nt, Listeria monocytogenes EGD-e
gugcauuauuuuuuagcuucgccgaguagugaacguaucguuauccaauuugauuuaaguuuauuucaagaagaaaugcaaauggaugacaaaaugcaaacauuacgcgaaaugcuuacagaaauggcac

SEQ ID NO: 4235673 - RNA, 55 nt, Listeria monocytogenes EGD-e
uaaaguugaagcaauuuauggaggggcaguugcccuugcuagcuucuugauuuua

SEQ ID NO: 4235674 - RNA, 71 nt, Listeria monocytogenes EGD-e
ugcuuuagugcuugguauugcuuugauuguuuuugcuguauuaauuaaacgcaaugcuaaaguauuuggua

SEQ ID NO: 4235675 - RNA, 64 nt, Listeria monocytogenes EGD-e
uauucaucuggaaugacaggaagaccuggugguaaaucugguccuuuugucgcuucuuggaaua

SEQ ID NO: 4235676 - RNA, 67 nt, Listeria monocytogenes EGD-e
aaccacauguucacgaaaacuucaaacuuaccgucuaaguugaaaguuuccguugaauaaugugguu

SEQ ID NO: 4235677 - RNA, 96 nt, Listeria monocytogenes EGD-e
uaagguggauaacuaaugacaacugugaaggcgcaugauccgcggcgaaaacguagacggauaacuuuuauaguaguaaucguuuuacucauuuua

SEQ ID NO: 4235678 - RNA, 67 nt, Listeria monocytogenes EGD-e
uucguggcaauuggaccaggauugaucguuguaacauugauuuuaucuggcauuaguuccaaacgaa

SEQ ID NO: 4235679 - RNA, 61 nt, Listeria monocytogenes EGD-e
ggucguaaugcagacggcgcacguucgaauaucgaaugugauacgcuuauuauggauaacc

SEQ ID NO: 4235680 - RNA, 86 nt, Listeria monocytogenes EGD-e
augggauugaucuuagcucuugcauuuuugagucuaucacugcaaugccgcaagauuugaagggcaugagcauugauuuuucucau

SEQ ID NO: 4235681 - RNA, 84 nt, Listeria monocytogenes EGD-e
ucaaacucgccguggaaugcuuuuauugaauuaaaaucaacgacuuguuuugguccaauaaagucuucauaaacggcauuuuga

SEQ ID NO: 4235682 - RNA, 59 nt, Listeria monocytogenes EGD-e
agaagucaagccuuggauuuagaccauaaggaauuuggucugauacaucuuguauuucu

SEQ ID NO: 4235683 - RNA, 130 nt, Listeria monocytogenes EGD-e
acgccgauuuccugcauuugaaauuugaaauuuugugcgaaaaauaaauuggcggaagcugcauaaacaucgaugguuuucgcuugaauuaauuuuucgccaauuuugacgaguucuucuggaucggcgu

SEQ ID NO: 4235684 - RNA, 69 nt, Listeria monocytogenes EGD-e
ucguuugagagcaucccauccauccucaugacauugaccggaaguggugauuucucaacaaaugcgcga

SEQ ID NO: 4235685 - RNA, 86 nt, Listeria monocytogenes EGD-e
augcagagauuaauucacuuaguacacugauuuauuauccagaagaaaagauggauuugauugcuagugaaacagaagauuugcau

SEQ ID NO: 4235686 - RNA, 74 nt, Listeria monocytogenes EGD-e
gcaauugccggacuauuaaucacuucaucaaauguauaagaaacuuuugauaagccugauaguucuccgcuugc

SEQ ID NO: 4235687 - RNA, 95 nt, Listeria monocytogenes EGD-e
guuucauccaaacauucagucuccaagcuccaacacuggaagaaauuuucaaauggaaggcuggugaguugaaugaguaaauuuugggugauaac

SEQ ID NO: 4235688 - RNA, 58 nt, Listeria monocytogenes EGD-e
guaccauaugcggccauuuuuucugcacccauguacaagcagugguuuuauauggugc

SEQ ID NO: 4235689 - RNA, 62 nt, Listeria monocytogenes EGD-e
cguuccguaguagcucggauaagugaaaauacauaguuuuacaucugggugauuauguaaug

SEQ ID NO: 4235690 - RNA, 87 nt, Listeria monocytogenes EGD-e
gguacuaauaccaucacuuauagcuaugauggaguuucgaaaacuauuacaguuaccgucuuagaaaauaaggaagguaucagugcu

SEQ ID NO: 4235691 - RNA, 55 nt, Listeria monocytogenes EGD-e
gccaauuaauaaauuuguugcugauuuuaucggcgaauccaacauuguuaauggc

SEQ ID NO: 4235692 - RNA, 71 nt, Listeria monocytogenes EGD-e
uuuggaaauaacaacuacuuaacacuuauugaucaauuauuggaugauuauggaguagucguuauuccaga

SEQ ID NO: 4235693 - RNA, 59 nt, Listeria monocytogenes EGD-e
uucaauagcaauuuuacggcuugcuucuuccgguaguugugucuguacuuguuguugaa

SEQ ID NO: 4235694 - RNA, 130 nt, Listeria monocytogenes EGD-e
uggcuuuauccaaugucgauccacguguuguugauuuauuccaguaucguuuugcgguagauggugauuuaucgggacauguuauugggaauuugauuuuaacggcuuuaucgcaauugaaugauaguua

SEQ ID NO: 4235695 - RNA, 72 nt, Listeria monocytogenes EGD-e
auugagcauauugacgcuaucguuuguguggacgguaacaguuucuuuaaaccaguggcguuguguuucgau

SEQ ID NO: 4235696 - RNA, 64 nt, Listeria monocytogenes EGD-e
uacaucaaagcguugauccgcaaaaccuucgccguugaaguuugcguuacgaccuuuguaugua

SEQ ID NO: 4235697 - RNA, 99 nt, Listeria monocytogenes EGD-e
gcugauuucgaaagcguuuacaaggagauuucacauguuaccgauaacaacauuuuuccgguaaacaugugaaaaauuccuuugcgcuauugauuuagc

SEQ ID NO: 4235698 - RNA, 75 nt, Listeria monocytogenes EGD-e
caugguauaauaaggcuaaaagguguuggagguuuuggggugaaacuagaacggauuuuagcaauauuagucaug

SEQ ID NO: 4235699 - RNA, 123 nt, Listeria monocytogenes EGD-e
gccgaaaaaauccccuaucuggucguuucgcuuggagcaaaagggucaauuugcgcgcauaauggcaaauuguaucaaguuauuccaccaaaaguucaggaacgaaaugauaccggggcuggc

SEQ ID NO: 4235700 - RNA, 65 nt, Listeria monocytogenes EGD-e
uguauacauuaguagcaaauuuagugucuugggcacuaggcgugaauuauguagcaauguaugca

SEQ ID NO: 4235701 - RNA, 65 nt, Listeria monocytogenes EGD-e
gguuuauuuguagguuuggucauugcguuuuucgcgagcaaugcauuaagucaaacaaauauucc

SEQ ID NO: 4235702 - RNA, 86 nt, Listeria monocytogenes EGD-e
gccugcaaguacuaagcacauuacaggaauuagaauccagaauaaaauuuuucuucugcguuuguauuucuugcugcuucuucggc

SEQ ID NO: 4235703 - RNA, 130 nt, Listeria monocytogenes EGD-e
ucguuuccuuaucgauuacaacugccgcaaaaacacauaagauugaagcgguaaacgagucugaaucagaugaacuuagacaucauauccuugaacuugugaagguggcgaaagaagauguuugaagaaa

SEQ ID NO: 4235704 - RNA, 74 nt, Listeria monocytogenes EGD-e
ccgauaaagaccgauuuaauauucggauuuaguggcauaucuaaaaaacuaaucuggauauuugaaaucaucgg

SEQ ID NO: 4235705 - RNA, 72 nt, Listeria monocytogenes EGD-e
ccaucacagaugaagauaauacuggcacaauguuugauaaauuaagcauauuaggcgcagaauuauugaugg

SEQ ID NO: 4235706 - RNA, 68 nt, Listeria monocytogenes EGD-e
guguagcuuuuagaaguauuagcaugauccgcaaguauuugauagguuaaaaauucuggaaguucuac

SEQ ID NO: 4235707 - RNA, 63 nt, Listeria monocytogenes EGD-e
ugucgguauuagguggaauuuaggaauucaaaaggaaaauuuuuauuucaccuaugccggaca

SEQ ID NO: 4235708 - RNA, 57 nt, Listeria monocytogenes EGD-e
guauuugcaggagaaaucagcggauguuugugcguuugagguuucgguuggggaugc

SEQ ID NO: 4235709 - RNA, 109 nt, Listeria monocytogenes EGD-e
guaagucuuaugaaggcgcgauuauggagguguuccacggaugauuauucaaaucgcuuuauccauugguuuacuucucuauucgauuucgacuuucuuauaucuuuac

SEQ ID NO: 4235710 - RNA, 81 nt, Listeria monocytogenes EGD-e
cggcaacauaugguaguaucgguguaauuauuauuuuaauguuaugguuuuauuugaccgguauuauuuugaugauuggcg

SEQ ID NO: 4235711 - RNA, 66 nt, Listeria monocytogenes EGD-e
cgugaugagucuauguuguuuggcccaauaaugaaagugaaaaaaggcgacaagauuuaucuaacg

SEQ ID NO: 4235712 - RNA, 76 nt, Listeria monocytogenes EGD-e
ggaucagcaagcauuuugucaaagucaucguauacauuuucuauuccguauugacuugcgaaugcuugccccuucu

SEQ ID NO: 4235713 - RNA, 71 nt, Listeria monocytogenes EGD-e
guuuuaauuguuucuucgaguggaaguguuguucuauugguuaacauuuccaucgacgggaaaaauucugc

SEQ ID NO: 4235714 - RNA, 64 nt, Listeria monocytogenes EGD-e
acucuaaaucugaccaguuucaaguaggcgaugagguuauugucacuaguuaugauuuuggagu

SEQ ID NO: 4235715 - RNA, 113 nt, Listeria monocytogenes EGD-e
uuucuuugaagaaacagucgcuuuugccaagaaucauaauaucguuguugcgcacgauuucgcauauggagguauuggauuugacgguaaaaagccaauuaguuuuuuagaaa

SEQ ID NO: 4235716 - RNA, 86 nt, Listeria monocytogenes EGD-e
uuucuugauaauguuuuucuguauuuggaauuucagcuuggaugaucuccaagcuauucucaagugcggcgagauguuguuugaaa

SEQ ID NO: 4235717 - RNA, 77 nt, Listeria monocytogenes EGD-e
ucaaaucauuaaagguuuuucaccgaaucuaacucaaugcuauugaguuagauuggauggaaggucuuugugcuuga

SEQ ID NO: 4235718 - RNA, 76 nt, Listeria monocytogenes EGD-e
uuuguaugagugaaagcauuguuuagggcuuuguucucuuggaauucgccuucuucaauagcuuugucaauacgag

SEQ ID NO: 4235719 - RNA, 61 nt, Listeria monocytogenes EGD-e
agcagaugcuacuuuugauccgauuacgacagauguuggcuuagaagugaagcgucugacu

SEQ ID NO: 4235720 - RNA, 59 nt, Listeria monocytogenes EGD-e
uaaucauuuuguuguucguccuguacagcauaauuaggacgauuuacuugaauagauug

SEQ ID NO: 4235721 - RNA, 57 nt, Listeria monocytogenes EGD-e
uaaauaaaggaaaguuguccuaacuaaaauaaguguuagggcaacuuuccuuguuua

SEQ ID NO: 4235722 - RNA, 74 nt, Listeria monocytogenes EGD-e
auguaaaacagucacagcuucaauaugugucgucauuggaaacauaucuacugguuggacuuuuuucgcuacau

SEQ ID NO: 4235723 - RNA, 68 nt, Listeria monocytogenes EGD-e
agcgcaauagguugaauauuagucgcuaucacuuuuuuauuggcaucucgguauuugauuguugcgcu

SEQ ID NO: 4235724 - RNA, 63 nt, Listeria monocytogenes EGD-e
gaaaaugguuauauugaagcaacugcugaaaaauuaguaggugcuaaaguauacuuagauuuc

SEQ ID NO: 4235725 - RNA, 78 nt, Listeria monocytogenes EGD-e
uucauuuagcauaaaaaaacacgcagcaaggcuucucccuaagaaguccgcugcguguuuuuauuaguuuaacgugaa

SEQ ID NO: 4235726 - RNA, 65 nt, Listeria monocytogenes EGD-e
aaauuuguugcaaaacuggcuggcuauucacaaucgaauaaccaagauucccuugcaacaaguuu

SEQ ID NO: 4235727 - RNA, 79 nt, Listeria monocytogenes EGD-e
gauuuugacacacaugccaguuacggcagaagucgcggauaucgcccgucauuucuugaacggcauuuguaucgggauu

SEQ ID NO: 4235728 - RNA, 59 nt, Listeria monocytogenes EGD-e
uguuagaagaaaaauucggugacgccucucuuaaggucguuauugaggacuucuuagca

SEQ ID NO: 4235729 - RNA, 74 nt, Listeria monocytogenes EGD-e
guagacauuguuucagaguuaccauggucagcaaagauaauagcugaaccaccuuuuucuaaaauaaggucuac

SEQ ID NO: 4235730 - RNA, 57 nt, Listeria monocytogenes EGD-e
aaucgucguauauggcuccaaguauuccgcaauugcuugaaguuccuugcggcgguu

SEQ ID NO: 4235731 - RNA, 130 nt, Listeria monocytogenes EGD-e
uauaaagucauugauucuaaaauuaaguauagcgaacauaaaaaaacgccaugcuucauuucccuaaaaaagggaaguaagcguggcguuuuuuagcuauauguaguaaauacagcgagcauuuuuucua

SEQ ID NO: 4235732 - RNA, 58 nt, Listeria monocytogenes EGD-e
aguaucaaaaaagugcgaggaagcgugauuuaacgcuaucucgcacuuuuuugauauu

SEQ ID NO: 4235733 - RNA, 91 nt, Listeria monocytogenes EGD-e
gacuacacuugaaaauagcguuauuuuugauaaaggggaacugauuacuaaugauuacuuuaucggaaauacuuauuuaaaaaugcuuguc

SEQ ID NO: 4235734 - RNA, 62 nt, Listeria monocytogenes EGD-e
guaucaucuggauuaacaagcacuccuacaccgacggaagaguuuauuuguucggauguugc

SEQ ID NO: 4235735 - RNA, 110 nt, Listeria monocytogenes EGD-e
uaaacucccagaaacacgagcggaauuugaaaauagagcgauuuuauuccaauuuaugaaugauuugcguuauuuguuagaaaugaagcgugacuuuuaugcggaguuug

SEQ ID NO: 4235736 - RNA, 73 nt, Listeria monocytogenes EGD-e
aaugaagcguuuggucaugcauauauuuauaagcgucacguuggugaauaagcauaucauuaauuucuucauu

SEQ ID NO: 4235737 - RNA, 105 nt, Listeria monocytogenes EGD-e
aucugguucaaaacaauauuuuucuccagucgauaugggugaugaaugggcucaaguuauuuacggcggaccauaugauaaagaaaaauggguucgggauucgau

SEQ ID NO: 4235738 - RNA, 68 nt, Listeria monocytogenes EGD-e
augggagccgaguuguucaucgacgcgcuguaaauguuguaaugcuuucguuucgacuuggcuaauau

SEQ ID NO: 4235739 - RNA, 68 nt, Listeria monocytogenes EGD-e
uuacaagucuuuuucuauuaauuaaacguuuucaguggggguguaacaugguagaauaggauuugugg

SEQ ID NO: 4235740 - RNA, 56 nt, Listeria monocytogenes EGD-e
guuucauuuggucgucgcuuaguucuauuccuuuuucagcgagcgccauuuggaau

SEQ ID NO: 4235741 - RNA, 66 nt, Listeria monocytogenes EGD-e
ggaaauguuaggauuaucucuuaagauaaagaauguuugugaauaagaguaaguuuuaauaauucc

SEQ ID NO: 4235742 - RNA, 74 nt, Listeria monocytogenes EGD-e
uaguauuccugguauugguagucaauucguuucuucuauucaaacaaaugacuauccaguuauuaugggaacua

SEQ ID NO: 4235743 - RNA, 104 nt, Listeria monocytogenes EGD-e
guugagaguuuccaucauuuuuagaacagauagugggaaagcagguaugcgauaagggcuaccugcuuuuucuuuaucuauaaugggaauuagaugcuuuaaac

SEQ ID NO: 4235744 - RNA, 58 nt, Listeria monocytogenes EGD-e
auggaugcacguuuuuuaugcacuucuugauggacugaguguggaacacggcauuuau

SEQ ID NO: 4235745 - RNA, 65 nt, Listeria monocytogenes EGD-e
caucagguuggaaaaaaguuggcgagauuccauucaauuuugaucgacgccguuugagcguggug

SEQ ID NO: 4235746 - RNA, 71 nt, Listeria monocytogenes EGD-e
uacuggcaacuguuucugguaaaauccgcaugcauuacauucguauuuuaccuggagauaaagugacagua

SEQ ID NO: 4235747 - RNA, 76 nt, Listeria monocytogenes EGD-e
gcacgugucccagcugaacgaacaucuaaaucugggcgcaaguuuugcaagauuuuuucagcuaaagggcuucggc

SEQ ID NO: 4235748 - RNA, 70 nt, Listeria monocytogenes EGD-e
auggaguacauugugccggggcugauuaugauguccgucauuacuaguucuuaugccaauguaucuucgu

SEQ ID NO: 4235749 - RNA, 84 nt, Listeria monocytogenes EGD-e
gguugguauuacgcaaauuaucguuacacaugaucacacuuuugccgaaaaaguugcggaucaaaugauggaaguagaaccacu

SEQ ID NO: 4235750 - RNA, 87 nt, Listeria monocytogenes EGD-e
cuucugagguaagcauuauguuuggcgugaaagaagagcaagaaaacacagcuguucgcgcgcuauauaaugaauucuuuucagagg

SEQ ID NO: 4235751 - RNA, 62 nt, Listeria monocytogenes EGD-e
ccugaaauuguugacuuggcaaacuuccuuaaccaaaugggugcuagaguuaucggugcagg

SEQ ID NO: 4235752 - RNA, 115 nt, Listeria monocytogenes EGD-e
gucagccggacaugauaugguuuucuuggauuaucgaaauugcggaaaaacaggcgagcccgcagucguucauauugaucaagaggcugauuauaaaauaaugaagcuagcugau

SEQ ID NO: 4235753 - RNA, 85 nt, Listeria monocytogenes EGD-e
ggucuugaagcaauguauaaaaaauuggguggagauaauuuugaaauucucgguuucccauguaaccaguuuuuacgucaagacc

SEQ ID NO: 4235754 - RNA, 86 nt, Listeria monocytogenes EGD-e
uaucgccuccacugaaauucauuuugaugauggagcacgacaaaaaauagcugaugcuuuaucgcagauugaaauuguuggugaua

SEQ ID NO: 4235755 - RNA, 64 nt, Listeria monocytogenes EGD-e
gaugaugcacuggaguucaaacgcaucguaacggaaaugcgcuuugaugaagcaagugcucguu

SEQ ID NO: 4235756 - RNA, 115 nt, Listeria monocytogenes EGD-e
agagguaccggaacacgaugaacuugauuuugggguuaucagugucgcagccagacaaaugagcggugauuacuauagcuuuacagaagaaggcgacaaacaaauugguaucgcu

SEQ ID NO: 4235757 - RNA, 61 nt, Listeria monocytogenes EGD-e
ggcuuguuguucaauuguuucgauaauugguggcaguaauccguccaauugauagcuugcu

SEQ ID NO: 4235758 - RNA, 89 nt, Listeria monocytogenes EGD-e
uaaaucaauguaaucuguuuuuagccguuugagagagccuucaaccgcggccuugaugcuuucuggacggcuaucgacuucguuauuua

SEQ ID NO: 4235759 - RNA, 86 nt, Listeria monocytogenes EGD-e
caaucugaauuauguuggaaguauuacgauugauucugcuauuuuagaagcgguggauaugcuuccaaacgaaaaaguucaaauug

SEQ ID NO: 4235760 - RNA, 96 nt, Listeria monocytogenes EGD-e
ucgugauuuuauuauugaguuucuuaguaacaguucuaucuugaugaugcauuuaucgcguuuuugugaggaauugauacuuuggacgagucauga

SEQ ID NO: 4235761 - RNA, 85 nt, Listeria monocytogenes EGD-e
cuaacuuaccuauucauugcccaugauuuaucaaugguuaaguacauuagugaucguauugguguaauguacuucgguaaauuag

SEQ ID NO: 4235762 - RNA, 84 nt, Listeria monocytogenes EGD-e
ucuuugaauaaacacaugaugccagaaaaugaaaugcguagaauaauaucgcgaaaucauucucuggcauuguugugauaagga

SEQ ID NO: 4235763 - RNA, 57 nt, Listeria monocytogenes EGD-e
guaauggaaaacggaaaaguuguugaacucggcgauguuuuagauguuuuccgucac

SEQ ID NO: 4235764 - RNA, 58 nt, Listeria monocytogenes EGD-e
cuaggauuuucuuaugaaauucaagggaguuuuccuuuaguugaauuagaggacuuag

SEQ ID NO: 4235765 - RNA, 120 nt, Listeria monocytogenes EGD-e
ccauucaagugauacuacguggcuaugaggcagcuauuacagaaaaaguaauuccauuugcaguagaacggaugcuugauuuuguagcaacgcauagcgcggaaauaguagagagaaugg

SEQ ID NO: 4235766 - RNA, 72 nt, Listeria monocytogenes EGD-e
guagggcauauuuggacgacguuuagugaggaucagauugauuugaacuuugcuuguccggaagugcuuuau

SEQ ID NO: 4235767 - RNA, 55 nt, Listeria monocytogenes EGD-e
uggcagauuuucaccguguaaaaguugcgagugacaugcacgguaaaaguuucca

SEQ ID NO: 4235768 - RNA, 62 nt, Listeria monocytogenes EGD-e
agauaacgggcaaagacguuuaaucggcaaguguuaugccgcacgugcuuuguucguuauuu

SEQ ID NO: 4235769 - RNA, 86 nt, Listeria monocytogenes EGD-e
guggagaugcuacuuaguuacaggaaacaacaaaaaccaacaggaauguuuuugaugauuuuuguuauuguaguaguaauuaccau

SEQ ID NO: 4235770 - RNA, 72 nt, Listeria monocytogenes EGD-e
gaaauguugacuuuaaagauguuuauuuccguuacgaggaaggcguggacauuuuaaaaggaauuaacuuuc

SEQ ID NO: 4235771 - RNA, 59 nt, Mycobacterium avium subsp. paratuberculosis
cggugccgaucuacgagccggccgacgacgcgauuccggcggccgagguuccggcgcug

SEQ ID NO: 4235772 - RNA, 79 nt, Mycobacterium avium subsp. paratuberculosis
ccgcugcgucgaccucgcucacccgcacgaacagauccgcgugcggauggucggcgccgugggcgagcucgacgaccgg

SEQ ID NO: 4235773 - RNA, 88 nt, Mycobacterium avium subsp. paratuberculosis
guggcugggaauggcaggggugccaccgugcgcagcgcgccgagcgccggcucgaugcucacgaaggcauucuuggacaaacggccac

SEQ ID NO: 4235774 - RNA, 79 nt, Mycobacterium avium subsp. paratuberculosis
ccgcuguuuuugugcaucuggaucaccgggacgucgauccugauggucagcaagaucccgaugcgcaagaugcacgcgg

SEQ ID NO: 4235775 - RNA, 72 nt, Mycobacterium avium subsp. paratuberculosis
gcagcgaacgccgcccgauguugccggugguccacuggaucacccgcagcggacggguggugcuuggcuugc

SEQ ID NO: 4235776 - RNA, 63 nt, Mycobacterium avium subsp. paratuberculosis
gccgccaccacggcaguagcaucggggauguaugcgguccucgagcuggccguugauggaagc

SEQ ID NO: 4235777 - RNA, 71 nt, Mycobacterium avium subsp. paratuberculosis
gauuccucaccggcgaugaacucagcgcacagccggguggcguagcugcguucgucgucggugagccguuc

SEQ ID NO: 4235778 - RNA, 55 nt, Mycobacterium avium subsp. paratuberculosis
ggcggucggcucguccaccaccagcaggcucggucgcgugacgagcucgaucgcc

SEQ ID NO: 4235779 - RNA, 86 nt, Mycobacterium avium subsp. paratuberculosis
acucagugucuuuggucgcggugcgcaggaaugccgucaccggcgacguguagcgcagcauuucuucgaucgcggucggcaugagu

SEQ ID NO: 4235780 - RNA, 74 nt, Mycobacterium avium subsp. paratuberculosis
ggggcgcuggccggcuucgcgggcguggccgggcagccgccccuccccgcgccggucgcggagccggcgacccc

SEQ ID NO: 4235781 - RNA, 103 nt, Mycobacterium avium subsp. paratuberculosis
cccggcgaucggcacccuggcguugauggccgagcaggucgacuggaugcugggcaacggcgggcuggacugggccgucaagcgcaccgccgacuccgccggg

SEQ ID NO: 4235782 - RNA, 83 nt, Mycobacterium avium subsp. paratuberculosis
gcaaccggaccacccgcuggcgaugcggccgcaucggcuccaguaauucgagcaugcccgcgucgucgacgggacggcccagc

SEQ ID NO: 4235783 - RNA, 72 nt, Mycobacterium avium subsp. paratuberculosis
cguggcgguggccgaccugggcauggcgcugcaggaacuggagcccgccugcgccgcguuggccgcgcggcg

SEQ ID NO: 4235784 - RNA, 56 nt, Mycobacterium avium subsp. paratuberculosis
ggacggcgccgcgucggugguggcgcgagugccgccgcugcacgcggccgccgugc

SEQ ID NO: 4235785 - RNA, 55 nt, Mycobacterium avium subsp. paratuberculosis
cggguggccgagaucgacgucgccaaccugcagucggugaucgacgagccgcucg

SEQ ID NO: 4235786 - RNA, 100 nt, Mycobacterium avium subsp. paratuberculosis
cgucgcggcgggcuccggugugggcgcggaccacguugccggcguugacaauucgccgaccguggcggccgagcccaugcuggccagcaccggcgcggcg

SEQ ID NO: 4235787 - RNA, 82 nt, Mycobacterium avium subsp. paratuberculosis
ggucagcggcgccaccgucuacccgagcgaggucgagcgcgcgcuacgcaccaucgacgggguggacagcgccgucgucacc

SEQ ID NO: 4235788 - RNA, 69 nt, Mycobacterium avium subsp. paratuberculosis
cccauggcaacugacgguuuugcgcccaucgagauccgcgggcucaccaagaacuucggugcggugcgg

SEQ ID NO: 4235789 - RNA, 75 nt, Mycobacterium avium subsp. paratuberculosis
guggcucgcugugcuggcgguaugcguggucggcugcggugugcggcaugugucggcggccagcgcgcgagacau

SEQ ID NO: 4235790 - RNA, 105 nt, Mycobacterium avium subsp. paratuberculosis
gugccgcggucccggacacgugauggcgaucggcgggcacggccgcggcuaccggacggcgccacgcggaaucgccagcgcgccaacauguuucgggcccggcgc

SEQ ID NO: 4235791 - RNA, 62 nt, Mycobacterium avium subsp. paratuberculosis
ccacgcacugaccgggcugcaggucgauccacuucucgcugugcgagcccggcgguagcggg

SEQ ID NO: 4235792 - RNA, 59 nt, Mycobacterium avium subsp. paratuberculosis
cuagcacacgaauacccuccgggcggcaccgcugccggccgaaggguauucgugucuag

SEQ ID NO: 4235793 - RNA, 84 nt, Mycobacterium avium subsp. paratuberculosis
cgaugacaccggaaucgcugcgugaccggcagcgcgcacagauccgggccgacauccggcgcgcggcguuccgguuguucgucg

SEQ ID NO: 4235794 - RNA, 55 nt, Mycobacterium avium subsp. paratuberculosis
gcgucgcugaucgccgucgaugcggcccugcugcucggcggcaccaucgggacgc

SEQ ID NO: 4235795 - RNA, 61 nt, Mycobacterium avium subsp. paratuberculosis
gugggcgagcucaaggucgaacuggcgcgcagcagcgaaaccaucguguugagccgcccgc

SEQ ID NO: 4235796 - RNA, 55 nt, Mycobacterium avium subsp. paratuberculosis
cggggcauucggugacgguaucgcuguuguagaucgccaccccgucgaugccccg

SEQ ID NO: 4235797 - RNA, 76 nt, Mycobacterium avium subsp. paratuberculosis
ggccaccggcgggcggagcagcuucgccggguuggcaaccggcaucccggugaucaugcucaccacgaccggcgcc

SEQ ID NO: 4235798 - RNA, 55 nt, Mycobacterium avium subsp. paratuberculosis
cgccgcgaguaggccggcgcggcgcagcgcuccgccgugccggcgggacguggcg

SEQ ID NO: 4235799 - RNA, 67 nt, Mycobacterium avium subsp. paratuberculosis
ccgcaggcuggucucgagcugcacccgcaccagcggaugggcggcgcagaagggaucggugagcagg

SEQ ID NO: 4235800 - RNA, 58 nt, Mycobacterium avium subsp. paratuberculosis
gggccgacggugagaauuugcgcuaccgagcaccgcaacaaguccucaccgcggaccu

SEQ ID NO: 4235801 - RNA, 57 nt, Mycobacterium avium subsp. paratuberculosis
gucggugcccgacaucccggggagcaucaggucgagcagcacgaugucggcgccggc

SEQ ID NO: 4235802 - RNA, 62 nt, Mycobacterium avium subsp. paratuberculosis
ucggcaccaaucggcugcuggccggcgagaaccaccggcuggucggcacccggcugugcugg

SEQ ID NO: 4235803 - RNA, 84 nt, Mycobacterium avium subsp. paratuberculosis
cgccguucccgcccggcgucacgcuggcgugacgcucggcggcgccggucacgccagcgugacgcucggcagccgagggcggcg

SEQ ID NO: 4235804 - RNA, 58 nt, Mycobacterium avium subsp. paratuberculosis
ccacgacuggucggcgaccgaggugcaggucggcgccgcggugucgaccgagucgcgg

SEQ ID NO: 4235805 - RNA, 66 nt, Mycobacterium avium subsp. paratuberculosis
ggauagcugguucucgcggagggccgacccugaagggcugugugcuccgccgggacaccggaagcc

SEQ ID NO: 4235806 - RNA, 67 nt, Mycobacterium avium subsp. paratuberculosis
caccaacagguccgcgggccgcgccgucuccagcgagucccccgauucggucuggcggaccugggug

SEQ ID NO: 4235807 - RNA, 94 nt, Mycobacterium avium subsp. paratuberculosis
gauggcggccaacaccccgaugcugcugaaagccggucugguggaaggcaacaccgaggccggggugcuggcgucgggucagguggccggcauc

SEQ ID NO: 4235808 - RNA, 106 nt, Mycobacterium avium subsp. paratuberculosis
cgucgucggcgugccgccgggcgaccugcgcgucgggcugcgggugcgggugcaguuccacaccgucgcagccgacgugacgcugccguacuucaccgacgagacg

SEQ ID NO: 4235809 - RNA, 76 nt, Mycobacterium avium subsp. paratuberculosis
guccuacguguggugggcgcuggcggucaucgucgcggcgggcgucacggucaccgcccgcgccgccucgcgggac

SEQ ID NO: 4235810 - RNA, 100 nt, Mycobacterium avium subsp. paratuberculosis
gcgagcgggcgagcggcaccagggugucggcgagccgguccaccaccucgaucgggcggcccuguucgucgacgcccucggcguagcgagcccagcucgc

SEQ ID NO: 4235811 - RNA, 74 nt, Mycobacterium avium subsp. paratuberculosis
gaggugauccccggugaugacuucgccgaguccgccgagaucgcggcgcgaggucagacaccgggggucgccuc

SEQ ID NO: 4235812 - RNA, 55 nt, Mycobacterium avium subsp. paratuberculosis
cgaggcgguggugcgccggcgcgaagcguucuucggcgagcacgccaucgccucg

SEQ ID NO: 4235813 - RNA, 89 nt, Mycobacterium avium subsp. paratuberculosis
acugauguagagggccaucgcgugagucucuguggugaaacgaccaaggaucacuaccgagaggaacaucgcgauggcccuggaccagu

SEQ ID NO: 4235814 - RNA, 86 nt, Mycobacterium avium subsp. paratuberculosis
ucccggucguacuacgagaaggggcugcacgacgucauccgcuaccacgucucgaugacgucgagcgccgacuucccggaccggga

SEQ ID NO: 4235815 - RNA, 83 nt, Mycobacterium avium subsp. paratuberculosis
gccgacuacggcgacggcuggugcccguuucccgccccgccgcagcuggcccggacggccggcaccgccgucaucgacucggu

SEQ ID NO: 4235816 - RNA, 84 nt, Mycobacterium avium subsp. paratuberculosis
cucgccgccgauauucagcgucgagccguugguguggaucggcacgcugaccgcgucgaccggcucgaacaacgucgaggugag

SEQ ID NO: 4235817 - RNA, 87 nt, Mycobacterium avium subsp. paratuberculosis
gcucggcgacgcccgccgagcgugacgguaguuucacgcugggcgccgagcgugaaguuaauuucacgcucggcggaaaggccgggc

SEQ ID NO: 4235818 - RNA, 60 nt, Mycobacterium avium subsp. paratuberculosis
gcgccguucauggucaucgacacgcucaccgucgacaggucgaugccgucgaacagcugc

SEQ ID NO: 4235819 - RNA, 55 nt, Mycobacterium avium subsp. paratuberculosis
ccgggugaugcgcgaccagcuguccggcgugcggguggugcgggcguucgcccgg

SEQ ID NO: 4235820 - RNA, 95 nt, Mycobacterium avium subsp. paratuberculosis
ggucggcgacgucggguucgagccagcggaccugggguggcccggaacgcgacugccacaccaggucgugcucggcguacccggcggcggccgcc

SEQ ID NO: 4235821 - RNA, 73 nt, Mycobacterium avium subsp. paratuberculosis
gcucucggucaacgugcccgucuuguccgcacacaccacgucgacgcgggcgagaccuucgauggccggcagc

SEQ ID NO: 4235822 - RNA, 72 nt, Mycobacterium avium subsp. paratuberculosis
ccgugcagccacucgaugucaucgucguccaagcucucgagcucgaccaucuccgcguugagauguugcggg

SEQ ID NO: 4235823 - RNA, 65 nt, Mycobacterium avium subsp. paratuberculosis
gcugccgacggggccgucaugagacgcgcggucgucgcagcacucgugguagcuugcgcggcagc

SEQ ID NO: 4235824 - RNA, 72 nt, Mycobacterium avium subsp. paratuberculosis
ggucagaugguggugacaaggccucgacgcggacuaccccugcggguggggcuggucgccgccacccuggcc

SEQ ID NO: 4235825 - RNA, 89 nt, Mycobacterium avium subsp. paratuberculosis
ccgggguguucggggcgaacaugcaggucgagcuggugaacgacgguccggucaccgugcuucucgagcugugagcgccccggccgcgg

SEQ ID NO: 4235826 - RNA, 85 nt, Mycobacterium avium subsp. paratuberculosis
gcgcccgcccacaacgugcugacgcugacgguggccgagaucgagcagaacuaccccagcuucgcgcacguggugcgcgcggugc

SEQ ID NO: 4235827 - RNA, 81 nt, Mycobacterium avium subsp. paratuberculosis
ggauguaggcgaugucggcgcccaccugcugggcgugcagcgucaacuccacgcaguccuucgccgacauggccgccgugc

SEQ ID NO: 4235828 - RNA, 92 nt, Mycobacterium avium subsp. paratuberculosis
ggcgaccuggcgccccgcgagccagcccgcggcguacgcgccaaaggugacgcgcucgggcugcuuggcggaggcgacgucccagagucccc

SEQ ID NO: 4235829 - RNA, 86 nt, Mycobacterium avium subsp. paratuberculosis
gcagcgggccggcuucggugugcagcgggugcaggcgcugcgcccgcacuacgcccgcacccuggacaccugggccgccgcgcugc

SEQ ID NO: 4235830 - RNA, 56 nt, Mycobacterium avium subsp. paratuberculosis
gcgggcaacgucgggcacgccgucaaggucgccggcgaggugcucggcucgcccgc

SEQ ID NO: 4235831 - RNA, 79 nt, Mycobacterium avium subsp. paratuberculosis
guggcgugcgcggucgucaccgccgccgccuggucgucggccaguccgggcggcacggugacggccaggcgcgcgucgc

SEQ ID NO: 4235832 - RNA, 63 nt, Mycobacterium avium subsp. paratuberculosis
gcugacgucggcggcgcuguaggccgugccguacagccuggccauaugggcggugacgucggc

SEQ ID NO: 4235833 - RNA, 65 nt, Mycobacterium avium subsp. paratuberculosis
cgaggacggcugguucccgacgcgcgacaucgccaugcucgacgacgagggcuaccuguucaucg

SEQ ID NO: 4235834 - RNA, 57 nt, Mycobacterium avium subsp. paratuberculosis
gugccccagcagcucggugagcaccucggcggugugcucgccguagcgcggcggcac

SEQ ID NO: 4235835 - RNA, 84 nt, Mycobacterium avium subsp. paratuberculosis
cggccgcgcggcugcccgucgcucgucggguuggucacccauucauugugccgcccgccaccggcgcgggccaugaugcggccg

SEQ ID NO: 4235836 - RNA, 76 nt, Mycobacterium avium subsp. paratuberculosis
ccggcucacgccgucggugcugggccaguugaucgcgcucuacgaacaccaggucuucaccgagggcgugaucugg

SEQ ID NO: 4235837 - RNA, 127 nt, Mycobacterium avium subsp. paratuberculosis
gcccagcuggacggcgccaagcaucugguguuggccggcgccaagucgccggugucguucuucgccuacccgggcaugccgagcgaucuggugcccgccgguugcgaggugcacguccucgccgggc

SEQ ID NO: 4235838 - RNA, 66 nt, Mycobacterium avium subsp. paratuberculosis
gacgucgaucuccgcggugucgcgccacgcgcccggggugcgaacggugucgccgcggccgauguc

SEQ ID NO: 4235839 - RNA, 95 nt, Mycobacterium avium subsp. paratuberculosis
uguggcggugaaguuggugauccggaagcgcucgaucacgucgagaaccaaugcggcaucgaacuuuucgaggaucaccagauggucgccgccca

SEQ ID NO: 4235840 - RNA, 57 nt, Mycobacterium avium subsp. paratuberculosis
gucgaccacacgccggggcacacucgcggaucgaugugcuuccgggugucgucggac

SEQ ID NO: 4235841 - RNA, 60 nt, Mycobacterium avium subsp. paratuberculosis
ccggcaucaccaccgucgaacucgugugcccgacacgucgaccgcaguggugaugacugg

SEQ ID NO: 4235842 - RNA, 69 nt, Mycobacterium avium subsp. paratuberculosis
cgucgcggcguccgcggucgccggcuacaucaccgacccgaggagugugaccgcaugacgcugcgcucg

SEQ ID NO: 4235843 - RNA, 79 nt, Mycobacterium avium subsp. paratuberculosis
gugcaggugaccgccgacgccgacgccgccgcggccgccgacggacugguggugcccggcgucggcgccuacgaggcau

SEQ ID NO: 4235844 - RNA, 83 nt, Mycobacterium avium subsp. paratuberculosis
cggcaccaucaccucgauggugagccgggugggcgucgacccgaucagccacccggacaccgcgauccuggcgaugcugcucg

SEQ ID NO: 4235845 - RNA, 64 nt, Mycobacterium avium subsp. paratuberculosis
accugugggcguucgcgcaguacgcggugcagaugacgcugguggugcgccggaugcccaaggu

SEQ ID NO: 4235846 - RNA, 91 nt, Mycobacterium avium subsp. paratuberculosis
cgacgugcagauguagacccggucgggcgcgaggccgcgcagcuguuugaucagcgccucggcgugcgccgcggucagcucgggcgccucg

SEQ ID NO: 4235847 - RNA, 74 nt, Mycobacterium avium subsp. paratuberculosis
cgccgccccgggguguacgcccgcuuucgauaaacuuccacgguggcgaaacgacccgacacccuggccuggcg

SEQ ID NO: 4235848 - RNA, 67 nt, Mycobacterium avium subsp. paratuberculosis
ggcaggcgggugacgcuccagccgguggccuccagguggucgccggccgggcggcgcucgccgagcc

SEQ ID NO: 4235849 - RNA, 78 nt, Mycobacterium avium subsp. paratuberculosis
cgcggccgccggugacggacuguucgguggacuggggcaugaacagcggauagucgccguaccggucaccgugccgcg

SEQ ID NO: 4235850 - RNA, 55 nt, Mycobacterium avium subsp. paratuberculosis
cuccaucggguuggccggaucgcugcccuggccgaucaccaugaacccguuggag

SEQ ID NO: 4235851 - RNA, 62 nt, Mycobacterium avium subsp. paratuberculosis
gggccgagucguuguccuugagccacuggucggcuucuugcucggucucggcguacuggccc

SEQ ID NO: 4235852 - RNA, 82 nt, Mycobacterium avium subsp. paratuberculosis
cgaccggcgguucccgagcgucacgcuggcgcugccgucggcggccggugucacuccugcgugacgcucggcgcugcggccg

SEQ ID NO: 4235853 - RNA, 61 nt, Mycobacterium avium subsp. paratuberculosis
gucguagaugaucugccccuuguaggcggugaucguguugagcggguggaacaucagcggc

SEQ ID NO: 4235854 - RNA, 72 nt, Mycobacterium avium subsp. paratuberculosis
gucucgccguucugggcggugcucggcuucggccgggccucggccggccccggccagcacacgccgcgaaac

SEQ ID NO: 4235855 - RNA, 74 nt, Mycobacterium avium subsp. paratuberculosis
gcuugaccaaccgcgcgaccaccgccguggugccccaguggaaccacggcgugugcgcgcggccgaucucgagc

SEQ ID NO: 4235856 - RNA, 63 nt, Mycobacterium avium subsp. paratuberculosis
gucgucggacggcgcgggcgggcccaucauccagaaccgguccgccgcaaugccguccaccac

SEQ ID NO: 4235857 - RNA, 56 nt, Mycobacterium avium subsp. paratuberculosis
gcaggcgcugaaccugcgcagcggcgcgccgcugcugcgcgacacgucggugcugc

SEQ ID NO: 4235858 - RNA, 64 nt, Mycobacterium avium subsp. paratuberculosis
ggcgcggcugcugaccgaauccgacgugcuggucggcacgucggcggguucagcggucgccgcc

SEQ ID NO: 4235859 - RNA, 104 nt, Mycobacterium avium subsp. paratuberculosis
ccagcuagcgcaucaccuagcgcgaaaagacgcgaaagucccccaaaacccggcauuuugggggacuuucgcgucugcucgccggcuaccggcgcuggaacagg

SEQ ID NO: 4235860 - RNA, 78 nt, Mycobacterium avium subsp. paratuberculosis
ggacgccgcaacagaucgccgacgaccuucaugcccgcuuggacaacaagggcgugacguuguuggacgucggcagcc

SEQ ID NO: 4235861 - RNA, 82 nt, Mycobacterium avium subsp. paratuberculosis
caccgagaucgaggccgccgaacggcggguggccggcggcaucgaccccggcgcccgcggcuucguggugucgauccuggug

SEQ ID NO: 4235862 - RNA, 75 nt, Mycobacterium avium subsp. paratuberculosis
gaucugcuggugcuggcugaccagaaagucgaccacaucggugggcgacuugauggcggucggugccaugcuguc

SEQ ID NO: 4235863 - RNA, 94 nt, Mycobacterium avium subsp. paratuberculosis
agggcgugggcaucgaucagcagggcggugggcaacucgacaacacaggugcgaauggcccccaccgccuguugaucccuucugccccaaaccu

SEQ ID NO: 4235864 - RNA, 89 nt, Mycobacterium avium subsp. paratuberculosis
ggcgaagugggucggccgcugccuggaaugcggcaccuggggcaccgucgacgagguucccgcgcucagcgcgguggccggccgucgcc

SEQ ID NO: 4235865 - RNA, 74 nt, Mycobacterium avium subsp. paratuberculosis
gccugaccuucacugcuggucgcgcggcugacgcgucgcugucggucgggccuccggcaggagaagaucauggc

SEQ ID NO: 4235866 - RNA, 67 nt, Mycobacterium avium subsp. paratuberculosis
gggaacucccgacgaccuggucggcaugugccuguuccugcuguccgacgaggcgucguggaucacc

SEQ ID NO: 4235867 - RNA, 68 nt, Mycobacterium avium subsp. paratuberculosis
cuacgucaucaacgggucgaagacguucaucuccaauggaacucacugcgaccuguuggugaucgugg

SEQ ID NO: 4235868 - RNA, 78 nt, Mycobacterium avium subsp. paratuberculosis
gccgucgccccacagcgcgaccgcggugagccgguugugcagcgauucgagcaccgugucgcgcacccgggcgucggc

SEQ ID NO: 4235869 - RNA, 81 nt, Mycobacterium avium subsp. paratuberculosis
ucaucgagcgccugcugagcgaccuugagguuggugaaaggcucacggccgcuaaggaacucagcgcgcagacugcgguga

SEQ ID NO: 4235870 - RNA, 59 nt, Mycobacterium avium subsp. paratuberculosis
gucgacgggagagcugaaggccggaaucgacagugauucccggguagcucuccggaggc

SEQ ID NO: 4235871 - RNA, 79 nt, Mycobacterium avium subsp. paratuberculosis
gggugcgcggacgcggcggcagcacaucgguggcggggaaagcgcccgucgccggcuugcgccgccguucggcgcggcc

SEQ ID NO: 4235872 - RNA, 68 nt, Mycobacterium avium subsp. paratuberculosis
gccgaacaguuugcucauaguuaaccuuguuacuguuagcuucguggcugcgagacgggcuggucggc

SEQ ID NO: 4235873 - RNA, 115 nt, Mycobacterium avium subsp. paratuberculosis
cgggccgcgcacgucaucgccgucgaacccgacgcgcggaugcgggccgugcuggcccaccggucgcccgcuguccgugugcucgaggggcgcggcgaggcgauaccgcugcccg

SEQ ID NO: 4235874 - RNA, 68 nt, Mycobacterium avium subsp. paratuberculosis
cgugcugucgaucgacuaccggcuggcgcccgagcaucccgcgccggccgccaucgacgacgcguacg

SEQ ID NO: 4235875 - RNA, 86 nt, Mycobacterium avium subsp. paratuberculosis
gcacaaccgggugcgcaugaccguugccucuuuccuggugaaggaccuucaccugcccuggcaguggggcgcgcacugguuucugc

SEQ ID NO: 4235876 - RNA, 89 nt, Mycobacterium avium subsp. paratuberculosis
cggcgucgucguccucggcgucgucgucgaaguccggcgcccacgacugggugccggugucggcggcgucgucgucaucggagaagucg

SEQ ID NO: 4235877 - RNA, 130 nt, Mycobacterium avium subsp. paratuberculosis
gcacaccaugcugccgggcaacgcggucgaccaccugcacgcgguggucggggaguggcagcugcuggccgaccuguccuucgccgacuaucugaugugggugugccgcgacgacggcaugcuggugugc

SEQ ID NO: 4235878 - RNA, 63 nt, Mycobacterium avium subsp. paratuberculosis
gcgggcacauccugugcggcgucgacggccgggucuacggcgucgaccacggggugugccugc

SEQ ID NO: 4235879 - RNA, 79 nt, Mycobacterium avium subsp. paratuberculosis
ugccaguaccagcggccgucgcgcagccucagauucuucuucagccccucggggcugcgcggcuugcugcgguagggca

SEQ ID NO: 4235880 - RNA, 129 nt, Mycobacterium avium subsp. paratuberculosis
ccuguaggcgcauggccgaccuggacggcgucuuccgccgggaguggggacccgccgucgccgcgcuggcgcgguggucgggugaccucaccgucgccgaggacgccguccaggaggccugcgccgagg

SEQ ID NO: 4235881 - RNA, 57 nt, Mycobacterium avium subsp. paratuberculosis
gcggccggguucucggugaaggucagcgcgugcacgcccuucuuggacacccggcgc

SEQ ID NO: 4235882 - RNA, 58 nt, Mycobacterium avium subsp. paratuberculosis
ggccgccgcgcacgccggcgccugggaaggacccagcgccgagcaguacguggccgcc

SEQ ID NO: 4235883 - RNA, 76 nt, Mycobacterium avium subsp. paratuberculosis
cgcacggcccggcgaugcgcgggagccgcuugucgcgcuugucgcguaacggguuaugccauugcugcgcggugcg

SEQ ID NO: 4235884 - RNA, 76 nt, Mycobacterium avium subsp. paratuberculosis
ccgguugagguauuccuguucgagaauuucacggaacuuuucuaugccccaguccuugaccaggaacuucagccgg

SEQ ID NO: 4235885 - RNA, 61 nt, Mycobacterium avium subsp. paratuberculosis
ggcucgacggcuggccggaagccaguccguucgccggcucuggccucggagccgccgagcc

SEQ ID NO: 4235886 - RNA, 72 nt, Mycobacterium avium subsp. paratuberculosis
gcacgguuuggucguugucggccagggcauucgagaacgacgucgccuuggugaacagcgagucgagagugc

SEQ ID NO: 4235887 - RNA, 58 nt, Mycobacterium avium subsp. paratuberculosis
ggccgaguuccgcgugaucgacccgcacgggcggguggucgcgacgcagaauuucgcc

SEQ ID NO: 4235888 - RNA, 87 nt, Mycobacterium avium subsp. paratuberculosis
cgccugaaccacgcgaaagugcaacugccgacggucccacucgggaaaugcgucggcaguagcacuuucgcggcaaagggcuaggug

SEQ ID NO: 4235889 - RNA, 85 nt, Mycobacterium avium subsp. paratuberculosis
gccgucucguucgccgagcgugcagcuaccgcgagaauugccucgaauuaucgcggugagugcacgcucgcggcgcucagucggc

SEQ ID NO: 4235890 - RNA, 81 nt, Mycobacterium avium subsp. paratuberculosis
cuggccgcccugccggugcuuggcgugcugcucggccaacugaucggcgcccggccgcuggauuuccugcugggcgggcag

SEQ ID NO: 4235891 - RNA, 56 nt, Mycobacterium avium subsp. paratuberculosis
cggguggagaaguggcuggucacacccuugucggugaccugcacgcuguccgcgug

SEQ ID NO: 4235892 - RNA, 59 nt, Mycobacterium avium subsp. paratuberculosis
guggucgccgugccgguggcugaucagcaccagcgcgaugcggcccagcgcggcgaucc

SEQ ID NO: 4235893 - RNA, 89 nt, Mycobacterium avium subsp. paratuberculosis
gcuggugagcaccugcgcguaggcgauggcggccugcugggccuguucaccggccgccuucaccugaugcuccugccauugccgccagc

SEQ ID NO: 4235894 - RNA, 73 nt, Mycobacterium avium subsp. paratuberculosis
gggcggcucgucgucgccgggguccgccccgaaucguugcgguggggucaguucccggcgacguugcgcgccc

SEQ ID NO: 4235895 - RNA, 66 nt, Mycobacterium avium subsp. paratuberculosis
ugaccggcaccgcgcucggcuggcuggucucccggggauggcggcagcccaccgcggugcugccca

SEQ ID NO: 4235896 - RNA, 92 nt, Mycobacterium avium subsp. paratuberculosis
cgagcugggccacccuggccuucggauccugcuggccgacaucgaaucuggcgaauucggccggccaggauccggcgcccaggcccaacucg

SEQ ID NO: 4235897 - RNA, 65 nt, Mycobacterium avium subsp. paratuberculosis
ggggguugcgucggcggugacgucgaagccguccugaucgacggucagcccgccggccgauucuc

SEQ ID NO: 4235898 - RNA, 88 nt, Mycobacterium avium subsp. paratuberculosis
ugucaccagaucgagcaccaccuguaccccgaucugcccagcaaccgguugcacgagaucucggugcgggugcgucaggucugugaca

SEQ ID NO: 4235899 - RNA, 60 nt, Mycobacterium avium subsp. paratuberculosis
gacgaauuccuggacauggucaccggguggacccgcacccgcaccacccaggagaucguc

SEQ ID NO: 4235900 - RNA, 56 nt, Mycobacterium avium subsp. paratuberculosis
gucgcgcugcucggugggguggcccugcugaucggguacaccgccgcgcagguggc

SEQ ID NO: 4235901 - RNA, 72 nt, Mycobacterium avium subsp. paratuberculosis
ccugcagaucgcccucgaugcccugcagcuuucccucgauggccugcagauccgagaggguguucugauagg

SEQ ID NO: 4235902 - RNA, 78 nt, Mycobacterium avium subsp. paratuberculosis
gauguugaucgcggugaugcccagcucggcggccuuggcgaucaggucgcgcggguaggucgccgccucgucggcguc

SEQ ID NO: 4235903 - RNA, 65 nt, Mycobacterium avium subsp. paratuberculosis
gccagcguggcggucuugaauucgaucaccugagguuggucgaucucgaacaccgucguaccggc

SEQ ID NO: 4235904 - RNA, 78 nt, Mycobacterium avium subsp. paratuberculosis
cgcuccagcgccgcggccugcccgucuagauuccaagccacggcggacauuucgggucgagagcggcggcgcacagcg

SEQ ID NO: 4235905 - RNA, 72 nt, Mycobacterium avium subsp. paratuberculosis
caccgcgauggcggucgcgggccgggccgcuaccgauccgggugaccaggccgccgcugccgccucgcugug

SEQ ID NO: 4235906 - RNA, 66 nt, Mycobacterium avium subsp. paratuberculosis
uucaccuggaacggcuugcgggcgcucgggguucccggggacgcccuugccagcuuuccggaagag

SEQ ID NO: 4235907 - RNA, 62 nt, Mycobacterium avium subsp. paratuberculosis
cgagccgggcgugcucguuggcgucgagcaggucgaccgccgacaggcggcgcugcggaucg

SEQ ID NO: 4235908 - RNA, 60 nt, Mycobacterium avium subsp. paratuberculosis
gcgcgucguccucguugugguaggugcgccgcuccgagugcccgacgacgacgaacgugc

SEQ ID NO: 4235909 - RNA, 73 nt, Mycobacterium avium subsp. paratuberculosis
gagcagcugcuugaucauggucccgauccgcaucaccuuggcgggcugcucgaccaggucggucagcgagcuc

SEQ ID NO: 4235910 - RNA, 85 nt, Mycobacterium avium subsp. paratuberculosis
cgcgcuggaggccacgcuggccgcgguggaggccggcagccacgggcgggccuucgccuccggcauggccgccaccgacugcgcg

SEQ ID NO: 4235911 - RNA, 65 nt, Mycobacterium avium subsp. paratuberculosis
cacgccgcuuuccaccgucaccucggguucggcgccguccggcaguacgguggaaagccagcgug

SEQ ID NO: 4235912 - RNA, 83 nt, Mycobacterium avium subsp. paratuberculosis
caucgaucggcuuccaaccuugaccaggaucauuggucaccuucacaagccaugaaccgcccgucggguucagcuggucggug

SEQ ID NO: 4235913 - RNA, 69 nt, Mycobacterium avium subsp. paratuberculosis
ccggcaccgucgacguggccgucuuuccgccgaucucggugcaggacuggacacuugacacgcugccgg

SEQ ID NO: 4235914 - RNA, 85 nt, Mycobacterium avium subsp. paratuberculosis
gaucaugcgacugaccggcaucaccacggcgauggugucggacgcgccggccaucgacgcggugcugccgauguuccucgaguuc

SEQ ID NO: 4235915 - RNA, 75 nt, Mycobacterium avium subsp. paratuberculosis
ggcgcggggguugagcccggccgagguggucgacguccggaccggccuggccgacaccaaccccgaaguggcgcc

SEQ ID NO: 4235916 - RNA, 95 nt, Mycobacterium avium subsp. paratuberculosis
gcgcgcggcgaccgcucuggcugacgucagcgacuucgccgcguuggcggccgcgguggacgaggccgucggccgacucggucgccuggacgugc

SEQ ID NO: 4235917 - RNA, 66 nt, Mycobacterium avium subsp. paratuberculosis
gcacguaucgucggcggaugcugccaggugcggcccaccgacaucgcggccguucgccgugcgugc

SEQ ID NO: 4235918 - RNA, 76 nt, Mycobacterium avium subsp. paratuberculosis
cgcgggcgucgaguacgacagcccguucgugugcauuuucgacacccgcgacgggcugaucgugucgaugcgcgug

SEQ ID NO: 4235919 - RNA, 69 nt, Mycobacterium avium subsp. paratuberculosis
ucgccgcgucgaugccgcuggggaugucgacggccaccaccggaauucccgcgucgucgacggcggcga

SEQ ID NO: 4235920 - RNA, 64 nt, Mycobacterium avium subsp. paratuberculosis
gauggcggugucguaggcgucgacgaugugcgagcagcccucgaugcccauggcgccgcccauc

SEQ ID NO: 4235921 - RNA, 73 nt, Mycobacterium avium subsp. paratuberculosis
ccggacaaggucuacuccggggcguacaaggccugggcuaucacccccgacgaguugauccuguacaugccgg

SEQ ID NO: 4235922 - RNA, 55 nt, Mycobacterium avium subsp. paratuberculosis
aauggccggucaccgccaccauggccagcaggcucacggugaucagccggccguu

SEQ ID NO: 4235923 - RNA, 69 nt, Mycobacterium avium subsp. paratuberculosis
ccagcaggucgagcaugcguccggucugcuccggugaaccgcugaccaggaagaugccgaucaggcugg

SEQ ID NO: 4235924 - RNA, 55 nt, Mycobacterium avium subsp. paratuberculosis
guaucgacuacccaccaaguuuguucuucacggacguggacagaauagucgguac

SEQ ID NO: 4235925 - RNA, 88 nt, Mycobacterium avium subsp. paratuberculosis
ggcgaggucgucgucgccgucgucggugccggucugcaccgguuugcacaccgccacgucgaugccggccugacgggcaugacacgcc

SEQ ID NO: 4235926 - RNA, 75 nt, Mycobacterium avium subsp. paratuberculosis
gccggcggcguggcgcccagcgcggucgcgagguucugcaggauuugcggugcguuggccgccgagcugaucagc

SEQ ID NO: 4235927 - RNA, 79 nt, Mycobacterium avium subsp. paratuberculosis
cggcguugucgcccuugaggaucagguucagcuggcugguuuccuucagcgccgaauccagguccucgaggcugauccg

SEQ ID NO: 4235928 - RNA, 57 nt, Mycobacterium avium subsp. paratuberculosis
cagcgcgugccguuccagcugguucacccaguucugccggcgggacagguacggcug

SEQ ID NO: 4235929 - RNA, 59 nt, Mycobacterium avium subsp. paratuberculosis
gcaggacaucaccgucgccgggcggauccugcggauccgcgacuucgguggugugcugu

SEQ ID NO: 4235930 - RNA, 72 nt, Mycobacterium avium subsp. paratuberculosis
gcgguaacggcacccccagcgauuugggcggugacaacgugccggccaaguuccuggagggguugacgcugc

SEQ ID NO: 4235931 - RNA, 56 nt, Mycobacterium avium subsp. paratuberculosis
guggugaccuacgugcggguggucgacggcaagaucaccccgcgcgaacgcaucgc

SEQ ID NO: 4235932 - RNA, 99 nt, Mycobacterium avium subsp. paratuberculosis
gccggugccgcucggcgcuccggugccggugccgcugggcgcuccguugccgcugggugcccccgugccacucgcgcccccggugccgguggugccggc

SEQ ID NO: 4235933 - RNA, 58 nt, Mycobacterium avium subsp. paratuberculosis
cguuggcccgcgcccaggcgauggcgguuuugacgucgacgaugugacgcggccagcg

SEQ ID NO: 4235934 - RNA, 129 nt, Mycobacterium avium subsp. paratuberculosis
caccgcgaaagcgucggcuagcggcugacccgcccgggugugggcgccgucaaugguguagcucagccacgccggcacaccgagcgagcgcaccagauucaccagcgccucggccucgucgacgucggg

SEQ ID NO: 4235935 - RNA, 67 nt, Mycobacterium avium subsp. paratuberculosis
gaucgcgucgcccaucucgucggcgcgccgcagcgucacggugaugacggcgacgaccacgucgauc

SEQ ID NO: 4235936 - RNA, 66 nt, Mycobacterium avium subsp. paratuberculosis
gcaucauguacaccgucaccugcuucgcguucuucuucaucggcgggcugauggcguugcugaugc

SEQ ID NO: 4235937 - RNA, 89 nt, Mycobacterium avium subsp. paratuberculosis
ucgggcugugcacccggcaaacgauggugcgccagcucacaaaauacgcgugauucggcucaccauuuguuugcccgggcaauccgcga

SEQ ID NO: 4235938 - RNA, 80 nt, Mycobacterium avium subsp. paratuberculosis
cgucucggcggccgaggaucgcuaucugaugacggugaucgcgaccgcguccaauccccgguucucggugagccgggucg

SEQ ID NO: 4235939 - RNA, 90 nt, Mycobacterium avium subsp. paratuberculosis
auccgcgacccgcagcgcccgguagucgcagucguagcccuuggcccgggccaccucgaacagcgccugcuggguggugccgcgcaggau

SEQ ID NO: 4235940 - RNA, 83 nt, Mycobacterium avium subsp. paratuberculosis
uucgcgcaagucgaggcgcccaugcgggugguggagcugaucgaggacuucaucgccaccgaugagcgccgcgaugcgacgag

SEQ ID NO: 4235941 - RNA, 61 nt, Mycobacterium avium subsp. paratuberculosis
cgcagcggucgacgacgcgcuggccaaacacaccgaagcccggcgcgagaucgaccgcgcg

SEQ ID NO: 4235942 - RNA, 69 nt, Mycobacterium avium subsp. paratuberculosis
cgaccgcgggcguaacgccguggcgaaauccggccgggaaaaucgccguggcguuacgcccgcggaucg

SEQ ID NO: 4235943 - RNA, 73 nt, Mycobacterium avium subsp. paratuberculosis
ggccgcggugaucccguucguggcguucgcgguggccgcgcugcugcgucauguggcgggcgaucgcgcggcc

SEQ ID NO: 4235944 - RNA, 64 nt, Mycobacterium avium subsp. paratuberculosis
ccgaggcguucuacaugcgggucgccgcgccgggcgacuugcguuccgagggcgcacaacucgg

SEQ ID NO: 4235945 - RNA, 77 nt, Mycobacterium avium subsp. paratuberculosis
gcucgcccggcggcggagccaugcccggggcgugcgggucgccgcccgggggaagcuccugcugccaguaggcgggc

SEQ ID NO: 4235946 - RNA, 60 nt, Mycobacterium avium subsp. paratuberculosis
ggcgugaccgugucggugccgagcaacaucguguugccgcaacuucccgacgguuacgcc

SEQ ID NO: 4235947 - RNA, 69 nt, Mycobacterium avium subsp. paratuberculosis
cggcggccgucggugucggugaaccgcaccgcgucgcccgggugcaguuccccgacacccucgacgucg

SEQ ID NO: 4235948 - RNA, 81 nt, Mycobacterium avium subsp. paratuberculosis
ucgucgcaucgcggcgcucaucgguggcgaugaaguccucgaucagcuccaccacccgcaugggcgccucgacuugcgcga

SEQ ID NO: 4235949 - RNA, 60 nt, Mycobacterium avium subsp. paratuberculosis
gguggcgguggaccugccggcccucgagcagcugccggcgguggaggucucgccgccgcc

SEQ ID NO: 4235950 - RNA, 129 nt, Mycobacterium avium subsp. paratuberculosis
cgauugccauucgcccgauccccuacuuggugaccacccggcugaucgcgucggugguggcgaucgucccgcuguacgcggcaugccuggcgaucgguuaccuaagcacccagaucguggugagcaucg

SEQ ID NO: 4235951 - RNA, 87 nt, Mycobacterium avium subsp. paratuberculosis
cguccggugggcgacagcaugcccucggccgacccggcggagaacuugcgcggguccaacgccaggguggcgccgccggccagggcg

SEQ ID NO: 4235952 - RNA, 57 nt, Mycobacterium avium subsp. paratuberculosis
uuuccgccccggcgcugaacaacaggcugaagaacagguacagcucgaggucggaaa

SEQ ID NO: 4235953 - RNA, 68 nt, Mycobacterium avium subsp. paratuberculosis
ccucccaggccuggucaucgagcuggcggucgcgcaccaggcccagcuccuuggcccggucguugagg

SEQ ID NO: 4235954 - RNA, 69 nt, Mycobacterium avium subsp. paratuberculosis
ggccgacucggcggccugggcgugcucaacggcgagggccugaucggccggcacgccgacgucgaggcc

SEQ ID NO: 4235955 - RNA, 63 nt, Mycobacterium avium subsp. paratuberculosis
gucggcaggcuggcguaguugcccaucgggaacgccgagaacggcagcgagcuagccgccggc

SEQ ID NO: 4235956 - RNA, 77 nt, Mycobacterium avium subsp. paratuberculosis
cgccgacuggaugcucaccggccguaccgugucggccgccgaagccgaccggcgcgggcuggugagcgaggucgucg

SEQ ID NO: 4235957 - RNA, 72 nt, Mycobacterium avium subsp. paratuberculosis
ccgacgacuaccugcgcuucgugcgaauguugcugggcgacgggacgaucgacggggugcgggugcucucgg

SEQ ID NO: 4235958 - RNA, 60 nt, Mycobacterium avium subsp. paratuberculosis
gccgaagaucagcgccgccgucgacacgaucagcacgccgacggcgaacucggucucggu

SEQ ID NO: 4235959 - RNA, 57 nt, Mycobacterium avium subsp. paratuberculosis
cgggugcucggcggcggcguggugccugguucggucacgcugcuggccggcgauccg

SEQ ID NO: 4235960 - RNA, 127 nt, Mycobacterium avium subsp. paratuberculosis
gcccgccgcgagcgccugcgcgacgaacgccucgaucgggauggcgccgucgccgggcacggcucggcccggcagcgcgcggucgccgagcacguagucgcucaacuggaugagcgcggugcgcggc

SEQ ID NO: 4235961 - RNA, 70 nt, Mycobacterium avium subsp. paratuberculosis
gucguagaagguggugucggcggccucguugacggugaccuugucgauccgguugcacaccaucgccgac

SEQ ID NO: 4235962 - RNA, 60 nt, Mycobacterium avium subsp. paratuberculosis
cgcggccgggucgaagacggucaccgccccagcauaggucgacggucccgcccggccgcg

SEQ ID NO: 4235963 - RNA, 55 nt, Mycobacterium avium subsp. paratuberculosis
ggccaccagcgccgagagccggucguugucgccgaaccggaucucguugguggcc

SEQ ID NO: 4235964 - RNA, 65 nt, Mycobacterium avium subsp. paratuberculosis
cgggaucagcggcagcgugaucgccacgaucacgguggauuucacgucguaggccgcgaucaccg

SEQ ID NO: 4235965 - RNA, 62 nt, Mycobacterium avium subsp. paratuberculosis
ccggaucucgaucucgccgaugccguccggugcaucguggcgcggcgagauccggaucucgg

SEQ ID NO: 4235966 - RNA, 105 nt, Mycobacterium avium subsp. paratuberculosis
cguucggugaggucaucgagucguucgcggacgggcuggccggcaagggcaagcaguucaacacgacgcugaccaaccugucgcgggcauugaccgcgcugaacg

SEQ ID NO: 4235967 - RNA, 55 nt, Mycobacterium avium subsp. paratuberculosis
aggucgucacggucgucgacgacgaagccguucuccucgacgacgucgaucaccu

SEQ ID NO: 4235968 - RNA, 64 nt, Mycobacterium avium subsp. paratuberculosis
gcuguaccggaucaccuaugacgggucgaucgccgacgagccgcauuucguggucaugggcggc

SEQ ID NO: 4235969 - RNA, 117 nt, Mycobacterium avium subsp. paratuberculosis
gcaccgguucggggaagucgacgcugaucucguugaucugccggcucuacgacgucaccggcggagccguccagaucgacggcaucgacgugcgugacuaccgcaccgagcggcugu

SEQ ID NO: 4235970 - RNA, 58 nt, Mycobacterium avium subsp. paratuberculosis
agguugccgugcaggucgaccgagggaacccccgauucggugaguugccuggcgaccu

SEQ ID NO: 4235971 - RNA, 82 nt, Mycobacterium avium subsp. paratuberculosis
gcggcgcgucgcccagguuggacagguucgacgccacccaacccgggugggucagcugagucacgaucggcgaccccgccgc

SEQ ID NO: 4235972 - RNA, 57 nt, Mycobacterium avium subsp. paratuberculosis
cuggucagguacaguguuuagauggccucaauggucgaaauaccuugacuuguccag

SEQ ID NO: 4235973 - RNA, 80 nt, Mycobacterium avium subsp. paratuberculosis
ggcgccccgacgagauugcaaccacgcacaucccgaucggcgugucgggugcguaguugcagugucgcgaaggggcagcu

SEQ ID NO: 4235974 - RNA, 80 nt, Mycobacterium avium subsp. paratuberculosis
cggcaucgacgugggcagcgugcgcaucgggguggccugcagcgaccccgacgccgugcuggccaccccggucgagaccg

SEQ ID NO: 4235975 - RNA, 62 nt, Mycobacterium avium subsp. paratuberculosis
cgccgaacguguagcuguugcgacuuuucggcucgaauuucgcaaccagcgcacguucggcg

SEQ ID NO: 4235976 - RNA, 87 nt, Mycobacterium avium subsp. paratuberculosis
ccuacgacgugcugcgggccgacgacgugguguucagcgucgaggcgcugcgcgccuacaucgcggccaacaccgguacucccgagg

SEQ ID NO: 4235977 - RNA, 74 nt, Mycobacterium avium subsp. paratuberculosis
gccgaggugcacgacuugagcgcagcgacgucggcgcagccgucggcgaucgcgcauuucaggucgcccuuggu

SEQ ID NO: 4235978 - RNA, 63 nt, Mycobacterium avium subsp. paratuberculosis
ccaccgccuggcgggaucugcccauucccggccgggagcuggacggcauccaccaggcgaugg

SEQ ID NO: 4235979 - RNA, 130 nt, Mycobacterium avium subsp. paratuberculosis
guacgcgaggacuucgccgcccacgcccugccgggccgccuggcgaucggugagcaggcccgaggagguggagaugaucgccacgcccaggccgcccagaacgcgcggcagguugguggauuucgcguac

SEQ ID NO: 4235980 - RNA, 77 nt, Mycobacterium avium subsp. paratuberculosis
cgcgggauauccagagggcgugccgccgaccgacaccuucccggugcucgcguugcuggcgcgccggcuguccggcg

SEQ ID NO: 4235981 - RNA, 82 nt, Mycobacterium avium subsp. paratuberculosis
gaucucgguggcgaugaauucguugaagcuggucugcuccucggugagcggcaggccgcgcuccacgaucugcuccgggguc

SEQ ID NO: 4235982 - RNA, 81 nt, Mycobacterium avium subsp. paratuberculosis
cccagugugccgcacgcgagccgucgguggugaugaccguccacuggucgucgagcaccacggucuugccggugcccaggg

SEQ ID NO: 4235983 - RNA, 84 nt, Mycobacterium avium subsp. paratuberculosis
agccuaugaggcgacccccggugucugaccucgcgccgcgaucucggcggacucggcgaagucaucaccggggaucaccucgcu

SEQ ID NO: 4235984 - RNA, 91 nt, Mycobacterium avium subsp. paratuberculosis
agcacggguauccgggcgucgaggcgcggauugaagaaguagggcaccgagauccgcucugccgucgaccccgccagauucacccggugcu

SEQ ID NO: 4235985 - RNA, 87 nt, Mycobacterium avium subsp. paratuberculosis
cgcaccgucuaugugcugccguggauuugcgcgccgcuggccauugcggugcuguggcgcuggauccuggcgcccaccgacggcgcg

SEQ ID NO: 4235986 - RNA, 69 nt, Mycobacterium avium subsp. paratuberculosis
acgagaucucggugcacuucgcgcccgggcguaccgacgccucgcaggagagcaccgacguggacucgu

SEQ ID NO: 4235987 - RNA, 107 nt, Mycobacterium avium subsp. paratuberculosis
ucuacggcgccucccgcgacgccgccgucgucgacgccgcgcaguucccggucaacgaaccgagcgccgcggucucggcgauggcggcggugaccgagacgcuggga

SEQ ID NO: 4235988 - RNA, 84 nt, Mycobacterium avium subsp. paratuberculosis
ggcgaacaucgucggguccagguggccgcccgucggggugauggcgugcccggccggcaccacccggggcccgucgauccagcc

SEQ ID NO: 4235989 - RNA, 76 nt, Mycobacterium avium subsp. paratuberculosis
ggacggugccgcggugcuggccuuguguucguuccuguuguugaggaccgucacgaccaccgccgcgaucaccgcc

SEQ ID NO: 4235990 - RNA, 64 nt, Mycobacterium avium subsp. paratuberculosis
gccgugcagcgcuggggcgaguugucgccgacgcgggacaacguggugguggugcugcacgcgc

SEQ ID NO: 4235991 - RNA, 130 nt, Mycobacterium avium subsp. paratuberculosis
acguguucgccgagcucgacgccgcccgccgccgggcacuggccgcgguggccgaauccgccgaacagguguuggucaccgcggcggugcucgaagacaucccgacgggcuggcaggcucggcggcucuu

SEQ ID NO: 4235992 - RNA, 91 nt, Mycobacterium avium subsp. paratuberculosis
gacgucgggccgggccggcggcgccacgcgccggcgcagcauggcgcgcagccgcgccgggcugagcugccgcccgcccuuggcgcggguc

SEQ ID NO: 4235993 - RNA, 59 nt, Mycobacterium avium subsp. paratuberculosis
gggaugugcugcagguugauccggauccgguaccagaucgagcugggcccgcgcauccc

SEQ ID NO: 4235994 - RNA, 89 nt, Mycobacterium avium subsp. paratuberculosis
guaacgcaccgcgugagcgcgauccacugcgcaccggcaucuucgguguggugcugguggugugcgucgugcucaucgcguucgguuac

SEQ ID NO: 4235995 - RNA, 78 nt, Mycobacterium avium subsp. paratuberculosis
cgccgguggccgcggauucgcgcgggcugggcaccgggcauuucuucgaccgguccgggcaaccgcuggccaccgucg

SEQ ID NO: 4235996 - RNA, 63 nt, Mycobacterium avium subsp. paratuberculosis
gucgcugaggcugcggguggggaagacgugcacgugcaggugcggcaccuccagcccggcgau

SEQ ID NO: 4235997 - RNA, 81 nt, Mycobacterium avium subsp. paratuberculosis
gccccggaacagaucgggucgcccggcacgcacaauucgauggucuuggcggcauacagcggcccgauggugaccggcggc

SEQ ID NO: 4235998 - RNA, 60 nt, Mycobacterium avium subsp. paratuberculosis
gccgaggugauaucgcacggcuugcggcugcacgccgaaggcggcaccgaucaccgcggc

SEQ ID NO: 4235999 - RNA, 61 nt, Mycobacterium avium subsp. paratuberculosis
gccgcucguaacggcagggcgcaaaccgggccccggaaucgccguggcguuacgagcgagc

SEQ ID NO: 4236000 - RNA, 124 nt, Mycobacterium avium subsp. paratuberculosis
uuucagggcggcgacccgcaguaacugaacggucagguugguggcucccaguaucgggaacaacccgauguagaugcgcagcgaucugaccccgugcaguucgagggugcugaacacgaugaag

SEQ ID NO: 4236001 - RNA, 55 nt, Mycobacterium avium subsp. paratuberculosis
ccgaggagaucggcgcgccgcccucgcuggcggccggcccgcaggucuuucucgg

SEQ ID NO: 4236002 - RNA, 65 nt, Mycobacterium avium subsp. paratuberculosis
guccacgaucgcgcggugccagucgacggugaaccauucggugagcgccgccgcgaucgucgggc

SEQ ID NO: 4236003 - RNA, 101 nt, Mycobacterium avium subsp. paratuberculosis
cagccgacaucuacggggugcgcacccaaccccacccgggcgagccggccgacucgcccgucgucguucgggugcgcgagcuguccaagaccuaucggcug

SEQ ID NO: 4236004 - RNA, 65 nt, Mycobacterium avium subsp. paratuberculosis
gcuguggcccgguggugggcucggugcucgacgucgucgacacccgggccgccaccaucgucagc

SEQ ID NO: 4236005 - RNA, 57 nt, Mycobacterium avium subsp. paratuberculosis
gccugcgcaucccaggugaaugacauggcugcaugcaaucaccggggugugacaagc

SEQ ID NO: 4236006 - RNA, 57 nt, Mycobacterium avium subsp. paratuberculosis
gucgucguccggcaccgcgaacaccagcgaccgcgcgucgucggucucggcgaugac

SEQ ID NO: 4236007 - RNA, 128 nt, Mycobacterium avium subsp. paratuberculosis
ccugcggcugcugcugccggccgggguggagacgacguaccgggcgcugggcagccugcugcuugcgcugcuguccgauccggagcaguuggaugccauccgcggggaccgcucgcugcugccgcagg

SEQ ID NO: 4236008 - RNA, 68 nt, Mycobacterium avium subsp. paratuberculosis
gccuugagcgggcccuggaucgggucacgucacgugacgucggcccaauccaggguccgcugcacggc

SEQ ID NO: 4236009 - RNA, 63 nt, Mycobacterium avium subsp. paratuberculosis
cguccggguggucggcgcgcugcgccgccccgccgaggcggugccgcacgaccagcccggucg

SEQ ID NO: 4236010 - RNA, 71 nt, Mycobacterium avium subsp. paratuberculosis
gccgcgggcgccggggucgaugccgccggccacccgccguucggcggccucgaucucggugcgcagcgcgc

SEQ ID NO: 4236011 - RNA, 77 nt, Mycobacterium avium subsp. paratuberculosis
gcggaugcgggcgucgucgaccaucucguaguacuucucggucaccgagaugucggcgaacggcagcccguagacgc

SEQ ID NO: 4236012 - RNA, 64 nt, Mycobacterium avium subsp. paratuberculosis
acgacgcgaugaaggacauggacgacaucaacgacgaguucgcccgcaccgacgucgcgaucgu

SEQ ID NO: 4236013 - RNA, 64 nt, Mycobacterium avium subsp. paratuberculosis
ggccuaccggccggaggccacggcgaucacgagagcgaucgcccacgcgccggccggacuggcc

SEQ ID NO: 4236014 - RNA, 63 nt, Mycobacterium avium subsp. paratuberculosis
ggcuuggccggcagcucaccgcgcuucugcagauagucgcggacggcgccggccaccagggcc

SEQ ID NO: 4236015 - RNA, 71 nt, Mycobacterium avium subsp. paratuberculosis
gggauguuguugugcgagaugggcagcggaccgccggcgccgauccgcuucaugucgggcgagaacguccc

SEQ ID NO: 4236016 - RNA, 68 nt, Mycobacterium avium subsp. paratuberculosis
gcgcuacgccggccggucgaugaccuaccgcgaacucgacgaggcgucgacccggcuggcccaccugc

SEQ ID NO: 4236017 - RNA, 77 nt, Mycobacterium avium subsp. paratuberculosis
gaccgcgccuccagcgucacgccggcguggcucucggcgccgaacgccacgcuggcgugacgccgggugucgcgguu

SEQ ID NO: 4236018 - RNA, 89 nt, Mycobacterium avium subsp. paratuberculosis
ucgaggugcugggcuggcugcuguacgccgugccggugcucgucguguuccugcggccggcccggcuggcggccaccccgcgcgcccga

SEQ ID NO: 4236019 - RNA, 59 nt, Mycobacterium avium subsp. paratuberculosis
guugccgaagugaaaggaugccaccccguuggcggcggggcuuuuuugagcuucgcagc

SEQ ID NO: 4236020 - RNA, 57 nt, Mycobacterium avium subsp. paratuberculosis
ccuugugaccgcgcuguacguccguauagacuggacgaucguauagcaggugcaggg

SEQ ID NO: 4236021 - RNA, 59 nt, Mycobacterium avium subsp. paratuberculosis
gggccggagacgucgccgaccagcaggucggccagcacuucggcgauggucuccggucc

SEQ ID NO: 4236022 - RNA, 96 nt, Mycobacterium avium subsp. paratuberculosis
acugcaccggaccgaaauugguggcgaucggcuucaucgcggugaaccaggugcgggccggcucguuaccgccguacaggucgcccucgccgcagu

SEQ ID NO: 4236023 - RNA, 95 nt, Mycobacterium avium subsp. paratuberculosis
ggucggcguuggguucgguggcgaucagguggucggccagcuuggcgaacuugucgaccgcccgggugccgccgauggccaccccgaugccgacc

SEQ ID NO: 4236024 - RNA, 94 nt, Mycobacterium avium subsp. paratuberculosis
gacgacgaagggccguucgaucaggaucggguguucgaucauggcgucgagcaacugcucgucggacgccucggccagguugagcucgucguac

SEQ ID NO: 4236025 - RNA, 98 nt, Mycobacterium avium subsp. paratuberculosis
gggucggacuacaaccugaugcuggugucgcggaucgaggaggagaucggcgccggccugaaaaccggacucauccgcggcaugggagucaccggccc

SEQ ID NO: 4236026 - RNA, 83 nt, Mycobacterium avium subsp. paratuberculosis
ggccgccuggcaccggucggggcugcagcgccgcuggcugucggucagcgagcgcggcggccccgccgccgcccaggccggcc

SEQ ID NO: 4236027 - RNA, 83 nt, Mycobacterium avium subsp. paratuberculosis
cgccgcccgucguagggcaucaccagcgcguacgaaggcuugucgaccacgcuguagaugcccgcgcugccguccgggcggcg

SEQ ID NO: 4236028 - RNA, 60 nt, Mycobacterium avium subsp. paratuberculosis
gauuccggcggcgacgcauucgguugugcugcugcgcuggugcagucgacgccggcgauc

SEQ ID NO: 4236029 - RNA, 66 nt, Mycobacterium avium subsp. paratuberculosis
gccgcgagcagacgcaaaggcaccgcuuuugcugugcaaaaggguccuuuugggucugcuggcagc

SEQ ID NO: 4236030 - RNA, 88 nt, Mycobacterium avium subsp. paratuberculosis
cgggccgugcccaagaucgucgaugugcgcgacgaggccgccaugaaggcggcggucgacgcggccgucgacgagcucggcgggcucg

SEQ ID NO: 4236031 - RNA, 70 nt, Mycobacterium avium subsp. paratuberculosis
ccgcgccgaacgugaagcuaguuucacguucgcggucgagcgugaaacuagcuucacgcucggcaggcgg

SEQ ID NO: 4236032 - RNA, 56 nt, Mycobacterium avium subsp. paratuberculosis
gcucgguggugauccgcgcgaccggccgcagcggacgguugcggacgaucgccagc

SEQ ID NO: 4236033 - RNA, 62 nt, Mycobacterium avium subsp. paratuberculosis
gccgccuguaacgccaugacgaaaaucggugccauucuucgccguagcguuacgagagcggc

SEQ ID NO: 4236034 - RNA, 86 nt, Mycobacterium avium subsp. paratuberculosis
guuggccaaugcccguucggugucggugcgggucggcucgguccggccgccggugcugaccaccggccggggcaggccgggccgau

SEQ ID NO: 4236035 - RNA, 82 nt, Mycobacterium avium subsp. paratuberculosis
ggcuccgcuuccgcgacacugcaacuacgcacacgacacgccguggcgggugugcguaguugcagucucgugcucgugggcc

SEQ ID NO: 4236036 - RNA, 67 nt, Mycobacterium avium subsp. paratuberculosis
gaucugcgcgaucucgccgcauacaccacauuuccuugcuggugaucgguagcagguccgacagauc

SEQ ID NO: 4236037 - RNA, 61 nt, Mycobacterium avium subsp. paratuberculosis
uugagcgcggcggaccgcuucggcgacgcggaagcagucgucgacgguccgcugcgcuuga

SEQ ID NO: 4236038 - RNA, 85 nt, Mycobacterium avium subsp. paratuberculosis
ggccuggccuucgacggcgacgccgaucgcugcuucguggucgacgagcgcggcaacccggugucgccgucgaccgugaccagcc

SEQ ID NO: 4236039 - RNA, 111 nt, Mycobacterium avium subsp. paratuberculosis
ggucagcaacaggcgcagaccgucgccggcguucuggcggcgcggggcccggucgccgcgaucuucgccucgcagcugaucaggacgcagcagaccgcggcgccgcuggcc

SEQ ID NO: 4236040 - RNA, 57 nt, Mycobacterium avium subsp. paratuberculosis
cagcggcaggaugucggcgaugcggugccggcuuugcagcucgucgaucugcugcug

SEQ ID NO: 4236041 - RNA, 59 nt, Mycobacterium avium subsp. paratuberculosis
ggucggcgaggcagacgugcaacgccugcgcgcggcgcugcucgccugacccgccgacc

SEQ ID NO: 4236042 - RNA, 112 nt, Mycobacterium avium subsp. paratuberculosis
gugccgcauccaagcgaugaccugaaccgucgaacguggaguuguugcggaaaaucggccggauccgcgcaacaaccccacguucggcgucacgacgaacgguagcgagcac

SEQ ID NO: 4236043 - RNA, 93 nt, Mycobacterium avium subsp. paratuberculosis
gacggcggugucgucguugagcgucuugcgcgaaaaguuuuccagcagacggauuuucgccucguacgacgccggcagugcgacgccgccguc

SEQ ID NO: 4236044 - RNA, 86 nt, Mycobacterium avium subsp. paratuberculosis
gccgcugugaauuagcgccgagcgugcaaccacugcgaaaauucggcggauuuuucgcaaccacugcacgcucggcgcgucagggc

SEQ ID NO: 4236045 - RNA, 129 nt, Mycobacterium avium subsp. paratuberculosis
gcccgcgacgucggcgaccugugcgcggccggcgaacccgaacagauucuggcccggaugcgacgcuucgccgacgccggcgucacggaucugucggugcggcugcugcccaucggcgacaaccgcgac

SEQ ID NO: 4236046 - RNA, 68 nt, Mycobacterium avium subsp. paratuberculosis
gggagcgugcggauugcgauacaugucggccagaucgagccgacacagcucgcugauccgcaaacccc

SEQ ID NO: 4236047 - RNA, 68 nt, Mycobacterium avium subsp. paratuberculosis
uccccgcagggguuggagucggugucgcuggugcuggccggcgaggccugcccgcccgagguggugga

SEQ ID NO: 4236048 - RNA, 119 nt, Mycobacterium avium subsp. paratuberculosis
ucgggcuccgccgcacccucgauugcucucaacgacgaaaacacgaugccggugcugggccucggugucgcggaguugucggaugacgagaccgaacgcgcggugucggcggcgcugga

SEQ ID NO: 4236049 - RNA, 78 nt, Mycobacterium avium subsp. paratuberculosis
ggacaucuguuggaggaguucgacagucagcugacccgcgucgagcugcgccggacgggcuaccugcaacggaugucc

SEQ ID NO: 4236050 - RNA, 130 nt, Mycobacterium avium subsp. paratuberculosis
gaaccagccgauccgcagcccggggugaucgucgaggaugccgccgaagauguauuuggagaacgucucccggaauccgucgauguugaucaucaucccgacgacgacgcuguugaacucggucgggcuc

SEQ ID NO: 4236051 - RNA, 75 nt, Mycobacterium avium subsp. paratuberculosis
gcgcggugagcgcgggcuggcugcugcgcacccaccgcaaggugcgcgaagccgaacugcgcuggcacgccgcgc

SEQ ID NO: 4236052 - RNA, 61 nt, Mycobacterium avium subsp. paratuberculosis
gguuguggugcacgaacggcacguugcccaggaaguagccggccagcgucgcgccgccacc

SEQ ID NO: 4236053 - RNA, 125 nt, Mycobacterium avium subsp. paratuberculosis
cgggcacgguggcguugaucgggauccggucgcggcgcaccggcggcgccggccgguaggcggacucgacggccgacgccagccagugcgcggccucgggcggcccguauucgacgaacgccccg

SEQ ID NO: 4236054 - RNA, 101 nt, Mycobacterium avium subsp. paratuberculosis
uuugaaacucacgccguccagcggcuucugggcgauccccuugacgguuuccggcggggacaugcccagcaggucguacacggucggggugaugucgcaga

SEQ ID NO: 4236055 - RNA, 92 nt, Mycobacterium avium subsp. paratuberculosis
cgaacagcaugcuggcgcggucggggucguugacggcgacgggcuccaccugcuuguccaccggcagcgacuccccggucagcagcgacucg

SEQ ID NO: 4236056 - RNA, 73 nt, Mycobacterium avium subsp. paratuberculosis
gccgcgacgaauccgacgcucaacucgaugaaccucuuccgcuggugcgggucaugcgacggauuugucgcgc

SEQ ID NO: 4236057 - RNA, 127 nt, Mycobacterium avium subsp. paratuberculosis
cagguucgaaaaguauucccgcaguucggcuugcagcugacgcuguucgggggucaggucuaugaacauugcgcucccaccaggucgucugcgugccgacccgcugcgcccggcugcgccgcgcuug

SEQ ID NO: 4236058 - RNA, 92 nt, Mycobacterium avium subsp. paratuberculosis
gcgcgcucgccugcgccacgacggcgucguuuuggcugaugacggccucgaccagccauaaccgccgccggucguggcgcaccugagugugc

SEQ ID NO: 4236059 - RNA, 100 nt, Mycobacterium avium subsp. paratuberculosis
ccugccgucgacgccgcuggagugcccggucuggaacgcgacgugggugaccaccacacccauggccgcgcaggcgcgcaugcccuccacggccggcagg

SEQ ID NO: 4236060 - RNA, 71 nt, Mycobacterium avium subsp. paratuberculosis
gcgacgacgccguguggcagcgcugguuggaccguacgccucucuagccgcgcgaccacacgguaacuugc

SEQ ID NO: 4236061 - RNA, 64 nt, Mycobacterium avium subsp. paratuberculosis
gaucggguucacccgcgccggcgcacuguggucgucgcugaucgccggcuucgugauccugauu

SEQ ID NO: 4236062 - RNA, 127 nt, Mycobacterium avium subsp. paratuberculosis
ggaccggccccagguaguugacgucgauggugcgcuggaagucgugcggccggucguacuggugaugcagcgagcggcgcagcgacuugccggcguugcucaccacgacgucgagcgggccguguuc

SEQ ID NO: 4236063 - RNA, 106 nt, Mycobacterium avium subsp. paratuberculosis
cgccgggcgcgcacaucgacguccgguugccgucgggccggcgccggcaguauucgcugugcggcccgcccggacggcgcaccgacuaccgaaucgcggugcggcg

SEQ ID NO: 4236064 - RNA, 79 nt, Mycobacterium avium subsp. paratuberculosis
cccggugauguacuucgggcaguagugcgcggccgagagguaggugaacuuggccgcgcuggcgcccuggaacgccggg

SEQ ID NO: 4236065 - RNA, 57 nt, Mycobacterium avium subsp. paratuberculosis
auggcagcggauccucgacaucaaccugaccggaguguuucugggcauccgcgccgu

SEQ ID NO: 4236066 - RNA, 56 nt, Mycobacterium avium subsp. paratuberculosis
ccagcgcgguggcgcccagcgucggcgucggccgagcgggcggcgaaacccgcugg

SEQ ID NO: 4236067 - RNA, 130 nt, Mycobacterium avium subsp. paratuberculosis
gcgcggacggugcggucaugcaugaaucgacgguaaccgacgugacggcgccgacgcgcgcgcagcgccuuguuugcccgccgcgccgguuagccugacuucaugcggauagcugcgaugaucgccgcgu

SEQ ID NO: 4236068 - RNA, 84 nt, Mycobacterium avium subsp. paratuberculosis
ccgccgaucuggaccagcgcgaugucggugaacccggccucccaguacggccggacccccucgacgaucgcguccaggucgggg

SEQ ID NO: 4236069 - RNA, 59 nt, Mycobacterium avium subsp. paratuberculosis
gcggcgccgcugcaagugcgcgaugauccagaacggcagcgccacgaagacggugccgc

SEQ ID NO: 4236070 - RNA, 102 nt, Mycobacterium avium subsp. paratuberculosis
ucgccgagugcacuucagcugccgaaagugcaacuggcgacgcauuucccgagaacggccgucgcuaguugcacucucgcggcgggaccuaggccucggcga

SEQ ID NO: 4236071 - RNA, 78 nt, Mycobacterium avium subsp. paratuberculosis
cacacccucggcgaucauguucaucaggugauagauguaguucagcgccaugaagcugacguauugcucguagguuug

SEQ ID NO: 4236072 - RNA, 97 nt, Mycobacterium avium subsp. paratuberculosis
ggacacggugugcacgauggucgacaccgacaccguggugauguacgccaacgucgucgacgcgcucucggcguucaccauccagcgcaccccgucc

SEQ ID NO: 4236073 - RNA, 68 nt, Mycobacterium avium subsp. paratuberculosis
cggggcguugguugcggccccgccagcagaugccgcccaggugcagcgggccggagcucagcgccccg

SEQ ID NO: 4236074 - RNA, 59 nt, Mycobacterium avium subsp. paratuberculosis
gacaccuucaucggcucgccgcugaucaggcuuuucggcgcggcagucgggaagguguc

SEQ ID NO: 4236075 - RNA, 58 nt, Mycobacterium avium subsp. paratuberculosis
cgcuuugaguuggccggcgccgucgucgagcuuggcgaugccgccggccaauucggcg

SEQ ID NO: 4236076 - RNA, 84 nt, Mycobacterium avium subsp. paratuberculosis
gcagcgagaccggcacggugcacacgccgaggcggguguauucgcccaccccggcguccacgccguguugacguaacacccugc

SEQ ID NO: 4236077 - RNA, 78 nt, Mycobacterium avium subsp. paratuberculosis
aucgcaccugggguucaucuccgcggcgucgaagugccuggcguccgacgucgcgauggaggugaccacggacgcggu

SEQ ID NO: 4236078 - RNA, 66 nt, Mycobacterium avium subsp. paratuberculosis
gccguuugauguuucggacuuggaagcgcugcgcgcgcuggccgaccagaucacgucgaaccaggc

SEQ ID NO: 4236079 - RNA, 57 nt, Mycobacterium avium subsp. paratuberculosis
agucgacuacuccggucaggacuggacgacccgcagucccgccgggguggucagacu

SEQ ID NO: 4236080 - RNA, 83 nt, Mycobacterium avium subsp. paratuberculosis
gcgcaaucaugcuggcccgcaccgucgucgcgcuggcccagacgccggccgagcgcgaucgggugcuggccgcgcacgagcgc

SEQ ID NO: 4236081 - RNA, 84 nt, Mycobacterium avium subsp. paratuberculosis
gugaccccgaacugcuugcgggucuugagguagucgguggucaggcgcagcgauuccuccaucgccccaagcgcuucggagcac

SEQ ID NO: 4236082 - RNA, 77 nt, Mycobacterium avium subsp. paratuberculosis
gcgggccaggacgcugauccugggcucguuccccagcgcgcaaucgcugcugacgggccaguauuacgccaacccgc

SEQ ID NO: 4236083 - RNA, 106 nt, Mycobacterium avium subsp. paratuberculosis
ggugaugaugucccccgccgcgauggccgccugcaccggcgccgcgccgcgccaggccggcagcagcgagaagugcagguugauccacccgugcgggggaaccgcc

SEQ ID NO: 4236084 - RNA, 65 nt, Mycobacterium avium subsp. paratuberculosis
gccaccagggugggcaggcucaaccguuccgguuucucggucacgagccgguagaccuggcuggc

SEQ ID NO: 4236085 - RNA, 109 nt, Mycobacterium avium subsp. paratuberculosis
gagaugaaccaccagcggggaugggcugguucggccggugaccgcgagcccugcggcucggucgacgggugcgccagcucaaccgucacgucugaucagcccucaucuc

SEQ ID NO: 4236086 - RNA, 63 nt, Mycobacterium avium subsp. paratuberculosis
cuugccgaccgcgucgggaucggcgucgaacagcccggccaggucccagccgcggucggcggg

SEQ ID NO: 4236087 - RNA, 67 nt, Mycobacterium avium subsp. paratuberculosis
gcccagcgggucggcgccgauccgcacgccggccgaccggauggcgucgaugucgaccacguugggc

SEQ ID NO: 4236088 - RNA, 92 nt, Mycobacterium avium subsp. paratuberculosis
gcuucacgcggcccaugaugaugucgaugaucggcuugcccggcggguaggcgccggucagcgacgccaugguguggccguagucgaccagc

SEQ ID NO: 4236089 - RNA, 67 nt, Mycobacterium avium subsp. paratuberculosis
ucgguuucgggaucccacggaucggugcgggcuucgaugcgcgccgccgugguggucacgaugccga

SEQ ID NO: 4236090 - RNA, 123 nt, Mycobacterium avium subsp. paratuberculosis
cggcaccgcggcgccgguggccuggccgaaguccgggcuguaguacugauccucguaggacgggaucguguacgcggcggcccgggccuccucggucggcugcaccuggauguugcgguaccg

SEQ ID NO: 4236091 - RNA, 74 nt, Mycobacterium avium subsp. paratuberculosis
ggucgcgucacccaaguugcuggccgaugguggcgaccauggcgucgacggcgaacuugggcuugacguugacc

SEQ ID NO: 4236092 - RNA, 55 nt, Mycobacterium avium subsp. paratuberculosis
gccgucgcugauggccugggccaugccgccgugcucggccaccucggcgaugugc

SEQ ID NO: 4236093 - RNA, 82 nt, Mycobacterium avium subsp. paratuberculosis
gaccgucggcgaugaccuggccggccucgacccggucgccggcgucgacgaucgggcucugguuggcgcaggugccgugguu

SEQ ID NO: 4236094 - RNA, 55 nt, Mycobacterium avium subsp. paratuberculosis
gaccagcuugggcagcagcgcgcgggugacccgcagcgugccgaucacguugguc

SEQ ID NO: 4236095 - RNA, 66 nt, Mycobacterium avium subsp. paratuberculosis
gcggcccgcgacggccggcgacccgacagcccaacuggauucgggcgccuucaccgucguccccgc

SEQ ID NO: 4236096 - RNA, 82 nt, Mycobacterium avium subsp. paratuberculosis
cgcuggcccggcgcggucacccgguggacgcgguggagaugaccgcgaaguucgccgaggcgaugcgcgccgaugccgagcg

SEQ ID NO: 4236097 - RNA, 57 nt, Mycobacterium avium subsp. paratuberculosis
gugggcgacggucgccggcgcggucgcguggcugauccugcuggcggccucgcccgc

SEQ ID NO: 4236098 - RNA, 56 nt, Mycobacterium avium subsp. paratuberculosis
guucgugccgaccgucaucgcgucggcggugaucgccaaaaacgguacggcagaac

SEQ ID NO: 4236099 - RNA, 61 nt, Mycobacterium avium subsp. paratuberculosis
ccgagcaggucggcggcgucgucgggauccaucuccucgagcacgucggccgaccguucgg

SEQ ID NO: 4236100 - RNA, 57 nt, Mycobacterium avium subsp. paratuberculosis
agucggccggcccgaucggcgaucacugcaugguggucagcgucaagccggccggcu

SEQ ID NO: 4236101 - RNA, 62 nt, Mycobacterium avium subsp. paratuberculosis
gcgcuggguggcgaccaucgccgggcugaucggguucgugcugucggucgccaccccgcugc

SEQ ID NO: 4236102 - RNA, 62 nt, Mycobacterium avium subsp. paratuberculosis
gcgccgcggaauccaacuacugccccugauccgucacgggcgcgccgguugauuccgggcgc

SEQ ID NO: 4236103 - RNA, 59 nt, Mycobacterium avium subsp. paratuberculosis
ucgcgccagucgaccguggugccgccgaugaguucgugcauccggucgacgguggucgg

SEQ ID NO: 4236104 - RNA, 68 nt, Mycobacterium avium subsp. paratuberculosis
gcgccggcacgucgaucuccacgucggcgauggacagcaucucggcggguucgucgucguugcggcgc

SEQ ID NO: 4236105 - RNA, 67 nt, Mycobacterium avium subsp. paratuberculosis
ucuaccgcaacgugcugcagcaugcgacggcggcgccgcgccggaugcgcagcacgggccuggugga

SEQ ID NO: 4236106 - RNA, 79 nt, Mycobacterium avium subsp. paratuberculosis
ggcugaucccggcggucccguucucggcgcugaacuacgccgcgggugcgucgagugugcgggugcugcccuaugggcu

SEQ ID NO: 4236107 - RNA, 79 nt, Mycobacterium avium subsp. paratuberculosis
gucgcccggagaacuucgucggcauccacuucuucucaccgguggaaaagauggacccgaucgagaucauccgcggcgc

SEQ ID NO: 4236108 - RNA, 128 nt, Mycobacterium avium subsp. paratuberculosis
ggcgcggcuggcgcggcgacggucgggucgccggaccggugcggccggccggugcgggacggcgugggccgcggucguccucgccgaccggccgcugcgccggcgccguugucccgcggcagccggcc

SEQ ID NO: 4236109 - RNA, 56 nt, Mycobacterium avium subsp. paratuberculosis
cugcugcagcgcggcgacgucgacgccgcccgucggcugcugccgucgcugugcgg

SEQ ID NO: 4236110 - RNA, 82 nt, Mycobacterium avium subsp. paratuberculosis
ccggcgguaagaagaucucccuggccgaccugaucgugcuggccggcucggccgcggucgagaaggcggccaaggacgccgg

SEQ ID NO: 4236111 - RNA, 74 nt, Mycobacterium avium subsp. paratuberculosis
gcucgagaucggccgcgcgcacacgccgugguuccacuggggcaccacggcgguggucgcgcgguuggucaagc

SEQ ID NO: 4236112 - RNA, 79 nt, Mycobacterium avium subsp. paratuberculosis
cgggucccggauugggugccguugccggugcaguaugucgauuacacguuguggcagcgcgcccaguucggugaccucg

SEQ ID NO: 4236113 - RNA, 60 nt, Mycobacterium avium subsp. paratuberculosis
cgaucccguuguugugcagcgucggucuggccgccgggcuguugcgcggcagcggccucg

SEQ ID NO: 4236114 - RNA, 89 nt, Mycobacterium avium subsp. paratuberculosis
aucggugacguagcgcugcaccaggccggugucggugaggauguugacgaagauguccuucgaccccuuggccugcgccuugucccggu

SEQ ID NO: 4236115 - RNA, 58 nt, Mycobacterium avium subsp. paratuberculosis
ggucuggcugacgccgacgaacuugccgcggcccuguucgucggcgaacggccagucc

SEQ ID NO: 4236116 - RNA, 94 nt, Mycobacterium avium subsp. paratuberculosis
gcccggacacgucuuucagcgccgccucgguguagucgacgacguggaugccgcgcaagaaggucugcaccgacaggccgcuggaaugccgggc

SEQ ID NO: 4236117 - RNA, 78 nt, Mycobacterium avium subsp. paratuberculosis
gggguauugcucgagcggcagcaccagauggcggcugccgaccuuggcgcuggcaugcagcugccgcacgauguccuc

SEQ ID NO: 4236118 - RNA, 79 nt, Mycobacterium avium subsp. paratuberculosis
ggucggcaucaccuacggcauucagcccuacgguggccauccgacgggcuggacgaacccgugggugcugggcucgauc

SEQ ID NO: 4236119 - RNA, 72 nt, Mycobacterium avium subsp. paratuberculosis
gcccgccgcgcugguggccgugcacguggcgggggcggccgcgugcaccgcggccaccgccgcgcuaugggc

SEQ ID NO: 4236120 - RNA, 58 nt, Mycobacterium avium subsp. paratuberculosis
cagccggucgaguucggugacggccaccgcguccaccuuggccggcucgacaugguug

SEQ ID NO: 4236121 - RNA, 63 nt, Mycobacterium avium subsp. paratuberculosis
gucgggcaccuccaguugcgaccccgccgucgacgcgugcgucaucgcgcuggggugcucgau

SEQ ID NO: 4236122 - RNA, 64 nt, Mycobacterium avium subsp. paratuberculosis
ggcguaguaccaccaccggcccugccgggucggcacggacaggucggucucuuuggugcgcgcc

SEQ ID NO: 4236123 - RNA, 129 nt, Mycobacterium avium subsp. paratuberculosis
ccggcugccucggcggguagcgggucuucggcgcgccgagcgugaaguuaguuucacgcucggccgcgaccgugaagcuaauuucacgcucgccgggggcaggcgcgggcucgccggggggccgccgcg

SEQ ID NO: 4236124 - RNA, 63 nt, Mycobacterium avium subsp. paratuberculosis
cgcuggcggcgcgggucacggccgagaccgcgcgguuucugcucgacgaccucgccgacggcg

SEQ ID NO: 4236125 - RNA, 65 nt, Mycobacterium avium subsp. paratuberculosis
ggaugcgguuggacgcgugcgugacggccucauacauggcgugcgugcacaucccgaccgcgccc

SEQ ID NO: 4236126 - RNA, 57 nt, Mycobacterium avium subsp. paratuberculosis
gucgccuaucaggccaccacgaccgauuucuggaauucgauggaggcggugggcggc

SEQ ID NO: 4236127 - RNA, 100 nt, Mycobacterium avium subsp. paratuberculosis
cagcaccucgcggucggggucgauggacgccaccacgucgaccgcauuggacgaggugcagcagaugucggugagcgccuugaccgccgcggugguguug

SEQ ID NO: 4236128 - RNA, 55 nt, Mycobacterium avium subsp. paratuberculosis
gucugcauggugggacugguggagccgcgacugcgggucgccaucaccagcgggc

SEQ ID NO: 4236129 - RNA, 56 nt, Mycobacterium avium subsp. paratuberculosis
cgaacacgccggucugcgauccggccagcgacgcgggguccaggcccgcguguucg

SEQ ID NO: 4236130 - RNA, 55 nt, Mycobacterium avium subsp. paratuberculosis
guagccggugagccgcggugcgccgucgcgguggcgcaccagcacaccggcgugc

SEQ ID NO: 4236131 - RNA, 57 nt, Mycobacterium avium subsp. paratuberculosis
gggcggcucaacacgaugguuucgcugcugcgcgccaguucgaccuugagcucgccc

SEQ ID NO: 4236132 - RNA, 91 nt, Mycobacterium avium subsp. paratuberculosis
guacuacauuccacuggccgacgugcgcaccgaguugcugcgcgacgaaaaccacgcucagcgagugcaauucgguccgucgcggcuguac

SEQ ID NO: 4236133 - RNA, 124 nt, Mycobacterium avium subsp. paratuberculosis
gggucgcggcgaucacccggggcaccaccagccgguggaucgggucgaugccgagcaccuccaucgcgucgaucucuucacggauggugcgcgcccccagguccgcgcagaucgccgucgaccc

SEQ ID NO: 4236134 - RNA, 73 nt, Mycobacterium avium subsp. paratuberculosis
ucgcguucagcgccuacgcccguggcgacgguccgcuggccggggugucgcuggucgaggcgcugcgcugcga

SEQ ID NO: 4236135 - RNA, 66 nt, Mycobacterium avium subsp. paratuberculosis
gcgagcggguguugcagccgugcgggagcagcacggucaccucccagccggccaucgcccggucgu

SEQ ID NO: 4236136 - RNA, 62 nt, Mycobacterium avium subsp. paratuberculosis
ggucuccugcgagcugccgcugcaggccaucgccggucugcuggguguuccgcaggaggacc

SEQ ID NO: 4236137 - RNA, 56 nt, Mycobacterium avium subsp. paratuberculosis
gcgccgcaucgagauugcgcugcaccaggcgggcgcggcgcucgccgauguggugc

SEQ ID NO: 4236138 - RNA, 60 nt, Mycobacterium avium subsp. paratuberculosis
gccaaggcgucggcggcgaugaccccgaaggugcugggguacgucgccggcggcgccggc

SEQ ID NO: 4236139 - RNA, 128 nt, Mycobacterium avium subsp. paratuberculosis
ggccggcugccgcgggacaacggcgccggcgcagcggccggucggcgaggacgaccgcggcccacgccgucccgcaccggccggccgcaccgguccggcgacccgaccgucgccgcgccagccgcgcc

SEQ ID NO: 4236140 - RNA, 94 nt, Mycobacterium avium subsp. paratuberculosis
cgcggucaggaugccgucgcgguugccgaaccggugauacagcgugcccgccggcgcgccacuggcuuucgcgaucgcggccacgcuggccgcg

SEQ ID NO: 4236141 - RNA, 61 nt, Mycobacterium avium subsp. paratuberculosis
gcgucgauguugcggcgggucucggccagcgagucgccgccgaacuucugcagcgucgcgc

SEQ ID NO: 4236142 - RNA, 90 nt, Mycobacterium avium subsp. paratuberculosis
ccgagaugccguaggcgccccggccgaaauagaugauguucagauaagacugcagcacuucgucuuuggaccacucgccggacaucuugg

SEQ ID NO: 4236143 - RNA, 67 nt, Mycobacterium avium subsp. paratuberculosis
gaugaucaaggccuacaacgacuggcacaucgacgaguggugugccgcguacccgggccgguucauc

SEQ ID NO: 4236144 - RNA, 63 nt, Mycobacterium avium subsp. paratuberculosis
ucgcgcguguaacgccacggcggguuucggggugauuucuccgccguggcguuacacgcgcgg

SEQ ID NO: 4236145 - RNA, 78 nt, Mycobacterium avium subsp. paratuberculosis
gguuggucucgucgaucaccgugcgcagguugucgcggggaaucgcuugcagcgcacgguuggucaugucgagcagcc

SEQ ID NO: 4236146 - RNA, 82 nt, Mycobacterium avium subsp. paratuberculosis
gccaccgugcuguucguggccgguuucuacgggcuguaucuguccaaccuguucgacaccaccgcgagcagucaugccgggc

SEQ ID NO: 4236147 - RNA, 56 nt, Mycobacterium avium subsp. paratuberculosis
aucgcggccgacuuggagucgacgacgcguagguugggguccaggucggccgcggu

SEQ ID NO: 4236148 - RNA, 57 nt, Mycobacterium avium subsp. paratuberculosis
gacgaggugauggagcggcuggagaacgacaaguacuaccgcuacugcaccuacguc

SEQ ID NO: 4236149 - RNA, 69 nt, Mycobacterium avium subsp. paratuberculosis
gacguaugcccggacgaaguccucggcguucuccuccagaacgucgucgauuucguccagcagaucguc

SEQ ID NO: 4236150 - RNA, 129 nt, Mycobacterium avium subsp. paratuberculosis
gugaauugcccugggccgcaacagccuacuggcgccgagcgugggccguauggacgaauucccggcgguuggcguacguggggcccacgcucgggcgccggccuagcgacccguggcgagcgcgagcgc

SEQ ID NO: 4236151 - RNA, 57 nt, Mycobacterium avium subsp. paratuberculosis
cuaccccggcuggauuuugcgacguugccgaugagcgucgaucgcggucuggggugg

SEQ ID NO: 4236152 - RNA, 63 nt, Mycobacterium avium subsp. paratuberculosis
ccaucgccugguggaugccguccagcucccggccgggaaugggcagaucccgccaggcggugg

SEQ ID NO: 4236153 - RNA, 57 nt, Mycobacterium avium subsp. paratuberculosis
gcuuggugaacucggccagcugguccuuguccggcagcucgccguagaucaacaggu

SEQ ID NO: 4236154 - RNA, 58 nt, Mycobacterium avium subsp. paratuberculosis
ccgcccggcggaugcgggucgaagaggucuccaucggcgacuacguguugccgggcgg

SEQ ID NO: 4236155 - RNA, 75 nt, Mycobacterium avium subsp. paratuberculosis
ggcaucgugcacgucaagcagguguucgcgaucccgcgggccgcccgcgcgcacacacugcugaccacgguggcc

SEQ ID NO: 4236156 - RNA, 61 nt, Mycobacterium avium subsp. paratuberculosis
ggucaggcucacgaucgcggcgcccagcaccgcgcgcggcgccgccagccgcgagccgacc

SEQ ID NO: 4236157 - RNA, 56 nt, Mycobacterium avium subsp. paratuberculosis
ggcggcggucgcuggccgcgcugcgcgcccaggucgagccggucagcaccgccgcc

SEQ ID NO: 4236158 - RNA, 79 nt, Mycobacterium avium subsp. paratuberculosis
ucgauuccauucucgacaugcggcagcuguucgacggcaucgaccugucgacggugagcgugucgaugaccaugaacgg

SEQ ID NO: 4236159 - RNA, 68 nt, Mycobacterium avium subsp. paratuberculosis
gggcgggcgggugccaguaguugggcugcugcgacugcugcggcggccagcccggcgcccgccagccc

SEQ ID NO: 4236160 - RNA, 73 nt, Mycobacterium avium subsp. paratuberculosis
gcgguguccggcggcgggcgccggcucgagguaugcuucgagcacggcuaucccgccgcgcagaucuucacgc

SEQ ID NO: 4236161 - RNA, 81 nt, Mycobacterium avium subsp. paratuberculosis
ggguguugugauugguugcggcgguggcgaucugcauccggugggugaccgcgcacgccgccccgaccagagacgacgccu

SEQ ID NO: 4236162 - RNA, 61 nt, Mycobacterium avium subsp. paratuberculosis
ucgacgaaauggccgagcagcgugucggccaccgcggcgggcugcucggcgaucuccuuga

SEQ ID NO: 4236163 - RNA, 73 nt, Mycobacterium avium subsp. paratuberculosis
gucgcacaacgugucagucaaccggggccggugccagaagagucggccccggugggccggaccguugguugac

SEQ ID NO: 4236164 - RNA, 76 nt, Mycobacterium avium subsp. paratuberculosis
cggcgucaccggugagccgggaauggcgaccuauugcggcacaaagcauuucguggucggcuucaccgaaucgcug

SEQ ID NO: 4236165 - RNA, 56 nt, Mycobacterium avium subsp. paratuberculosis
uccgaagcgcccgaagagguuucggugaucucggucgcgcccuuggcggcuuugga

SEQ ID NO: 4236166 - RNA, 70 nt, Mycobacterium avium subsp. paratuberculosis
gcggcaucggucagcccuucguggacgcguugcgcucgcagaucggcucgcgaucgcuggccguguacgc

SEQ ID NO: 4236167 - RNA, 57 nt, Mycobacterium avium subsp. paratuberculosis
ggcgggguugagcagcggaugcaauucgagcacgcgcagcaccgcgucgaucccgcc

SEQ ID NO: 4236168 - RNA, 60 nt, Mycobacterium avium subsp. paratuberculosis
cgccggcgucagagguuggcgaagcaggggucguuguuguugccggucgggauggcggcg

SEQ ID NO: 4236169 - RNA, 58 nt, Mycobacterium avium subsp. paratuberculosis
ucucagugccgagcggcaguucgggcacacaaacgggcugucgcucgguugcugauga

SEQ ID NO: 4236170 - RNA, 76 nt, Mycobacterium avium subsp. paratuberculosis
gccaaggugcacgacaugugggucucaguggugguugacuuguucgccaaccucaccgagauccgcgagcacccgc

SEQ ID NO: 4236171 - RNA, 100 nt, Mycobacterium avium subsp. paratuberculosis
caagcugugggugucggccggcccgccgcccugcguggucggcgacaugcccgaacugccgaccacccacgacgggcugcucgccgacaucgcggauuug

SEQ ID NO: 4236172 - RNA, 74 nt, Mycobacterium avium subsp. paratuberculosis
cgccugcgugcuggccuuucucgacgucgacgggcucaagcaggucaacgacgagcagggccacgacgcgggcg

SEQ ID NO: 4236173 - RNA, 94 nt, Mycobacterium avium subsp. paratuberculosis
gcccgaccggccggacggaaucgccagaaggccguucugcgaggcauauucgaagcaguccagcgccucggcgauggugccgaccugguugggc

SEQ ID NO: 4236174 - RNA, 79 nt, Mycobacterium avium subsp. paratuberculosis
ggccagcgggcggcggauggaccggccggcguuguugaucaggaugucgacgccgccgagccgcuguuguacgucggcc

SEQ ID NO: 4236175 - RNA, 99 nt, Mycobacterium avium subsp. paratuberculosis
gucgggcccgacgugcugcucgggcuguccagccacgaccgcgaccagauggccgcggcggcggcgggaccggccgacuacuucugcgucgggcccugc

SEQ ID NO: 4236176 - RNA, 64 nt, Mycobacterium avium subsp. paratuberculosis
cggcgagcagacgcaaaagcccccaaugucacggcgggucgggggauuucacgucugcucggcg

SEQ ID NO: 4236177 - RNA, 92 nt, Mycobacterium avium subsp. paratuberculosis
cagucggguucgucuuccgcaucgcacaguacagugcuccgcggcagccaaugccgcggagcacuccugguaugaacgguuuacucgaguug

SEQ ID NO: 4236178 - RNA, 55 nt, Mycobacterium avium subsp. paratuberculosis
guugacccgcucgugcguucgggcgccucaucgcccgaacgcacgagcggucagc

SEQ ID NO: 4236179 - RNA, 55 nt, Mycobacterium avium subsp. paratuberculosis
cucgaucguccgggacgcgaucgcgcaccugcgguccgcguccggucugaucgag

SEQ ID NO: 4236180 - RNA, 95 nt, Mycobacterium avium subsp. paratuberculosis
ggcaccgugguccagggcgguguggugaucgggguggggauccugcuggacaccuuccuggugcgcaccgucaccguucccgccaucgcggcgcu

SEQ ID NO: 4236181 - RNA, 98 nt, Mycobacterium avium subsp. paratuberculosis
uguuucgcggccgccggugacggacuguucgguggacuggggcaugaacagcggauagucgccguaccggucaccgugccgcgcggucaccgagaaca

SEQ ID NO: 4236182 - RNA, 86 nt, Mycobacterium avium subsp. paratuberculosis
gucgcucucaggacgaacuugcgacaacggguugguuugucggcuuugugccgcucaccgucucugucgccgguuccuucagcgac

SEQ ID NO: 4236183 - RNA, 77 nt, Mycobacterium avium subsp. paratuberculosis
ccuguucggcgcgcuggugucggucguggcgcugguguuguucuucgucgccgccggcaccggcucggcggugcugg

SEQ ID NO: 4236184 - RNA, 83 nt, Mycobacterium avium subsp. paratuberculosis
ucggugcugagcaaggcgcugcuggcccaggacgaggccgagaacgcggcggugucggcgucggucagcgccaucgacaccga

SEQ ID NO: 4236185 - RNA, 65 nt, Mycobacterium avium subsp. paratuberculosis
cggcgcgccggugcugguggucggccacuccuucggggccgggcuggcgaugcaccuggccgccg

SEQ ID NO: 4236186 - RNA, 116 nt, Mycobacterium avium subsp. paratuberculosis
gugcggcgcgcaauccggcuagggucgcgaugaucucccgccgcaacaccuugccgguggcgguggugggcagcucgucgcgaaacacuaccucgucgggcgugcgcgaaccgcgc

SEQ ID NO: 4236187 - RNA, 85 nt, Mycobacterium avium subsp. paratuberculosis
cguggagccguaaaacgcgaugagggaggccaccgcgucgaucgccgucgccaggucggccucgucgcggccgacggccaccaug

SEQ ID NO: 4236188 - RNA, 64 nt, Mycobacterium avium subsp. paratuberculosis
cgagaauccgaccgccuggaccaacuggcuggaggucuuccugauccuggugaucggcuucucg

SEQ ID NO: 4236189 - RNA, 74 nt, Mycobacterium avium subsp. paratuberculosis
cgcugcggaucggccuggugacggaagugguucccgccgaacggcucugggaccgggcccacgagaucgcggcg

SEQ ID NO: 4236190 - RNA, 56 nt, Mycobacterium avium subsp. paratuberculosis
ggucaggcguagugauaccggaccugcaggaucugcaggucgugaacucgccgauc

SEQ ID NO: 4236191 - RNA, 101 nt, Mycobacterium avium subsp. paratuberculosis
ccgucgaccgggugaucgacgagacgcugcgccgcgccgcgcgggugcgucccgagcggugagcgauccggcgucucagucggccaccgcgaucucgaugg

SEQ ID NO: 4236192 - RNA, 81 nt, Mycobacterium avium subsp. paratuberculosis
ggggcccgaacagaucgagguggccgucagcgcguccagcaucaacuucgccgacgugcuggucgcauucggccgguaccc

SEQ ID NO: 4236193 - RNA, 88 nt, Mycobacterium avium subsp. paratuberculosis
ucgccaaacucggccugcgcggcggaguguugcugcccgggaucgcccccggcaccggcaucccgccgcuguacgccgagcacuggga

SEQ ID NO: 4236194 - RNA, 62 nt, Mycobacterium avium subsp. paratuberculosis
ggaauccacaucgccgacggcgugcccaacgacagguacuccggcucaccggugugggcgcc

SEQ ID NO: 4236195 - RNA, 88 nt, Mycobacterium avium subsp. paratuberculosis
gcgaauacgucgcgcaguuuuugaucucgggcgccggcgcgcugcacaucccgucgcugcccgacaucgaggggcgcgacgaauucgc

SEQ ID NO: 4236196 - RNA, 59 nt, Mycobacterium avium subsp. paratuberculosis
cgccugcucgcugggcaugcugaccgccgagcagguggagcagcucgccgagaugggcg

SEQ ID NO: 4236197 - RNA, 68 nt, Mycobacterium avium subsp. paratuberculosis
guccgggcgaucgauuccacccucgcgugcggcagcgacgaguaggggccgaagcgcaucgcccgcau

SEQ ID NO: 4236198 - RNA, 76 nt, Mycobacterium avium subsp. paratuberculosis
cccgcgccccccaacgugcacucagcgcgaauuuccugccgguuuuucgccgugagugcacguucggcguuucggg

SEQ ID NO: 4236199 - RNA, 59 nt, Mycobacterium avium subsp. paratuberculosis
ggcgcgacugaccgaccggcccggaucgucggacuacguggccggcgguguggucgccu

SEQ ID NO: 4236200 - RNA, 86 nt, Mycobacterium avium subsp. paratuberculosis
gcccauccggcgccgcgcaaucaaaaaccccgcucccauccggaagcgggguuuuugauugcgcuugucagcggccucggaagggc

SEQ ID NO: 4236201 - RNA, 87 nt, Mycobacterium avium subsp. paratuberculosis
gugcuuccaaaagcguugaucggcuugacuugccgcguuuugcaggcggggugccggccgggugagcugaucgaaccuggcaagcgc

SEQ ID NO: 4236202 - RNA, 60 nt, Mycobacterium avium subsp. paratuberculosis
caccugcagggcuggacgcuggaccggcugcccgccguggaccgcgccauccugcgggug

SEQ ID NO: 4236203 - RNA, 67 nt, Mycobacterium avium subsp. paratuberculosis
ggcgucgagugugcacugguggcgccgacacgccgagaagucgcuaccuggugcuacaccgaacgcc

SEQ ID NO: 4236204 - RNA, 70 nt, Mycobacterium avium subsp. paratuberculosis
gucgaccagguccggcgcgguggacugcaacccgcggguggcguccagcagcgccgagaccguggacggc

SEQ ID NO: 4236205 - RNA, 68 nt, Mycobacterium avium subsp. paratuberculosis
cguugugggcuuggcgcagcgccgcauagacgucgacguugugcggugcgaugccgggcagaugcacg

SEQ ID NO: 4236206 - RNA, 83 nt, Mycobacterium avium subsp. paratuberculosis
agcuucuugcgauugcggcuggcgaccagcagcgggcucaacaguuaucccugaacaugcgucggcugcacuugcacgacucu

SEQ ID NO: 4236207 - RNA, 57 nt, Mycobacterium avium subsp. paratuberculosis
ggaucgacgacuuucagcuggagcuggucgacggcgucgggcauuggaucgucgacc

SEQ ID NO: 4236208 - RNA, 63 nt, Mycobacterium avium subsp. paratuberculosis
gaucaacaggcggugggggccauucgcaccuguguugucgaguugcccaccgcccugcugauc

SEQ ID NO: 4236209 - RNA, 59 nt, Mycobacterium avium subsp. paratuberculosis
cggcgaggucgucgaggucggcgccgaggugaccgggcuggccgucggugaccacgucg

SEQ ID NO: 4236210 - RNA, 57 nt, Mycobacterium avium subsp. paratuberculosis
ugucggcgacgaggcccuugaugacugcuugcgggucgacggccugguugugcggca

SEQ ID NO: 4236211 - RNA, 101 nt, Mycobacterium avium subsp. paratuberculosis
guucgaccgccagcagcgcggccgucuggucggggaaugcgcgcagguagucgugcaugcgcgccacuccggccgcaccggccacgcagcccaggccgaac

SEQ ID NO: 4236212 - RNA, 56 nt, Mycobacterium avium subsp. paratuberculosis
gagcagacacaaaagcacccgacacgccgauggaucgggggcuuuugcgucugcuc

SEQ ID NO: 4236213 - RNA, 73 nt, Mycobacterium avium subsp. paratuberculosis
cuggccgaacacggggcgcagcccgccugcaaccgggucgccgugccgguggaucugcgccacgacuggccgg

SEQ ID NO: 4236214 - RNA, 115 nt, Mycobacterium avium subsp. paratuberculosis
gccgacucggcgcggucggagccucgcggaccccugaccaccgguuugccgagucgucgucgcgcacuagcagagcugguggucaucgcggagcauaggcguuugccgggucggc

SEQ ID NO: 4236215 - RNA, 65 nt, Mycobacterium avium subsp. paratuberculosis
uguccaggugguuggucggcucgucgagcgcgaugacgucccacucgccgaucagcaaccgggca

SEQ ID NO: 4236216 - RNA, 66 nt, Mycobacterium avium subsp. paratuberculosis
cugccgcucucguaacgcuacggcgaagaauggcaccgauuuucgucauggcguuacaggcggcgg

SEQ ID NO: 4236217 - RNA, 76 nt, Mycobacterium avium subsp. paratuberculosis
gcgcucaauccgguucgucugggucuggcucugcugaugauuucgcggccgcggcccgggucgagccugcuggcgu

SEQ ID NO: 4236218 - RNA, 108 nt, Mycobacterium avium subsp. paratuberculosis
gaccgcggcggccacggccugggcggcguugccgcgguucaccgcgcccgguagcgccaaccgcaucggcagcgccacaccgccggggccguacagguugccgccguc

SEQ ID NO: 4236219 - RNA, 80 nt, Mycobacterium avium subsp. paratuberculosis
cgggcucuccggugcgguguggggugacgacguggaucgcgccgucggcgucgcgcgccgcauucgcaccggccagaucg

SEQ ID NO: 4236220 - RNA, 73 nt, Mycobacterium avium subsp. paratuberculosis
cugggucuacaucgcgacgcugauggugccgggcacggucaccaucgugccgauguaucugaugauggcccag

SEQ ID NO: 4236221 - RNA, 81 nt, Mycobacterium avium subsp. paratuberculosis
gcggcggcggcgaauccggacgucaugcccaugcccucgcggcgcauggccgcggcgauccgcagauagcgguccggccgc

SEQ ID NO: 4236222 - RNA, 88 nt, Mycobacterium avium subsp. paratuberculosis
ggccgucgaggcgcgggugaaggcggcgguggugaucgaagccgucggccaucccgccgcgcugcagacugcgaucgaccugacggcc

SEQ ID NO: 4236223 - RNA, 73 nt, Mycobacterium avium subsp. paratuberculosis
acccccgccggcgucgccgaguugacccgccgcggccacgaggugcuggugcaaagcggcgccggcgaggggu

SEQ ID NO: 4236224 - RNA, 81 nt, Mycobacterium avium subsp. paratuberculosis
ggcgacggcggccaucuugcccucgggauuggucggccgcggauugccgaccagauacaucagggcgacguccucgucacc

SEQ ID NO: 4236225 - RNA, 57 nt, Mycobacterium avium subsp. paratuberculosis
ggcgcggcaucgagcuggugguggcgcugguggccaucaugaaggccggugccgguu

SEQ ID NO: 4236226 - RNA, 78 nt, Mycobacterium avium subsp. paratuberculosis
ucgccugcgccggcggcggucacgcuggcgugacgcucgccggcggcggucacgcuggcgugacgcucggcgcgguga

SEQ ID NO: 4236227 - RNA, 81 nt, Mycobacterium avium subsp. paratuberculosis
acacccggaccucgaaaucgucugcggcccggccgauccgaugcgcgaucgccucggcggcgacggucacggugcgguagu

SEQ ID NO: 4236228 - RNA, 60 nt, Mycobacterium avium subsp. paratuberculosis
gccgagcgucacgccagcguggcgccggcccgcgagcgccacgcuggcgugacgcucggc

SEQ ID NO: 4236229 - RNA, 90 nt, Mycobacterium avium subsp. paratuberculosis
ggcagccgcgauccgcggucggccgccaaugccgaggccgucgccgaucggcuucggcggaugcggcccggccucgacgugcggcuggcc

SEQ ID NO: 4236230 - RNA, 66 nt, Mycobacterium avium subsp. paratuberculosis
ccgggaccucggcguggacgcugaucgaguugauccgccauccagacguguacgccgaggugcugg

SEQ ID NO: 4236231 - RNA, 107 nt, Mycobacterium avium subsp. paratuberculosis
gcagccgcgccuggaucugcgccgccaggucgucgcggcagcaggccgacggguccagcggggccagcugcauggcgaccucgaugccggccaccagcgcggccugc

SEQ ID NO: 4236232 - RNA, 68 nt, Mycobacterium avium subsp. paratuberculosis
gggcuggcggucaauguccgcgacgaugcggugcgccggucguugaugacguugaccacgcuggaccc

SEQ ID NO: 4236233 - RNA, 104 nt, Mycobacterium avium subsp. paratuberculosis
gcacgaaccggccccgcggcggcaaggcguacaaccggccaccggguccggcggugucgguaccgcccgguucggggucggucaccgucgucggaccgucgugc

SEQ ID NO: 4236234 - RNA, 66 nt, Mycobacterium avium subsp. paratuberculosis
gcuuggucugcaacgcguugaccgccuuggccaucgccagauaggucuugccggugccggccgggc

SEQ ID NO: 4236235 - RNA, 67 nt, Mycobacterium avium subsp. paratuberculosis
gaucgccgagaucgccggccgccgccgcgacgacauugcgcaucggcggaccgcgaucaccggcguc

SEQ ID NO: 4236236 - RNA, 80 nt, Mycobacterium avium subsp. paratuberculosis
gccucgacgccgggcaggucgccgaugcgguagccgugcgcgcgcauggcccgcagcagggcgaccgcgcuggccggggu

SEQ ID NO: 4236237 - RNA, 69 nt, Mycobacterium avium subsp. paratuberculosis
cuggggcagauggacaagccggacguggacuucaucgaggggcugucgccggcgguguccaucgaccag

SEQ ID NO: 4236238 - RNA, 79 nt, Mycobacterium avium subsp. paratuberculosis
gaugagcgucaucgcgauugcgguguucgugguggccuacgcccugaucgccagcgaucgcgucaacaagacguucguc

SEQ ID NO: 4236239 - RNA, 59 nt, Mycobacterium avium subsp. paratuberculosis
guccucgaccacgauggugcguucgucgcugacgaaccaccgcucggugucgaucgggc

SEQ ID NO: 4236240 - RNA, 64 nt, Mycobacterium avium subsp. paratuberculosis
gcgccgagcgucacgccagcgugaccgucgcgcccgggugccacgccagcgugacgcucggugc

SEQ ID NO: 4236241 - RNA, 57 nt, Mycobacterium avium subsp. paratuberculosis
aucucgcugugcacgguguugccggcgcuggcuggcugcgccgcgccgcacgcggau

SEQ ID NO: 4236242 - RNA, 130 nt, Mycobacterium avium subsp. paratuberculosis
gcccuacuuccagacgcugggcaucccgcuggccaucggcaugguggugguggucgcggcggcguugacgcugggccccgcggucaucucgguggccucgcguuuccgucagacgcuggaacccaggcgc

SEQ ID NO: 4236243 - RNA, 61 nt, Mycobacterium avium subsp. paratuberculosis
gacccggucguggucgcauggcgagcgggagcccgcggcggugcuguaccaggccgugguc

SEQ ID NO: 4236244 - RNA, 102 nt, Mycobacterium avium subsp. paratuberculosis
aggcggugcacagccgcgacgccggcugcucggaggcugcgaucaggccacgcagcgagauguagcccagcgagucggcgccgauggcgugccgcaccgccu

SEQ ID NO: 4236245 - RNA, 61 nt, Mycobacterium avium subsp. paratuberculosis
gcugacuguugcgccggccuggaacgcuuuggcgacgauaucgggcggcagcgcaggcagc

SEQ ID NO: 4236246 - RNA, 73 nt, Mycobacterium avium subsp. paratuberculosis
gcgcuucgacuucgugaucggagucgcuaccggugcauugaccagucuggacgagaucgcggagcgacugcgc

SEQ ID NO: 4236247 - RNA, 97 nt, Mycobacterium avium subsp. paratuberculosis
ggacaccgaaccgccccgcgcgaucaggccggccaccaggucgcacaccagcacggcggcgcugaugccguccuugucgcgcaccgcggcggggucc

SEQ ID NO: 4236248 - RNA, 97 nt, Mycobacterium avium subsp. paratuberculosis
cgccgcucggucaaggacaaggaguugcggcgcaagcugacuccgcacuaccggaucggcugcaagcgaauccugaacuccuccaccuauuacggcg

SEQ ID NO: 4236249 - RNA, 91 nt, Mycobacterium avium subsp. paratuberculosis
gugggguucgugcuggccggcaugcuggucaccgggcugcagaccuggcugcccgaccaggacaugcugagcuacggcuggcgaauuccgc

SEQ ID NO: 4236250 - RNA, 72 nt, Mycobacterium avium subsp. paratuberculosis
uggugguguccgggcgcaguacagagcagguccgcgagcuggccacgcugaucugaacccggcgcaccacca

SEQ ID NO: 4236251 - RNA, 128 nt, Mycobacterium avium subsp. paratuberculosis
ggccuccgcccgagcgguaauaggugugcgccgagggcguguggcaccacacggugcccgccaugagggcaucgauguccgcgacguauuccucguaggcgcgcugcgucaccucgacggugguggcc

SEQ ID NO: 4236252 - RNA, 57 nt, Mycobacterium avium subsp. paratuberculosis
cacgcugggcggggcgucggucgacaccugcggggaccgcgacgccgagcccacgug

SEQ ID NO: 4236253 - RNA, 78 nt, Mycobacterium avium subsp. paratuberculosis
cccgcaacgccccucaucuggugcacgcgaugccgcaacuggugccguugcugccgucaaugagccgggccacgcggg

SEQ ID NO: 4236254 - RNA, 79 nt, Mycobacterium avium subsp. paratuberculosis
gcgucugcagauaacgcagcugcagcgacgccgggcucuucgacagggucucggcggccucgcgcagcuccucggacgc

SEQ ID NO: 4236255 - RNA, 92 nt, Mycobacterium avium subsp. paratuberculosis
cgaguugggccugggcgccggauccuggccggccgaauucgccagauucgaugucggccagcaggauccgaaggccaggguggcccagcucg

SEQ ID NO: 4236256 - RNA, 101 nt, Mycobacterium avium subsp. paratuberculosis
gcggcggugaucagcuccugcuugaucugcucgcgguucucgauguccuugcggugcuugcgauuucgacugaccgcgaaccagaucaggccggccgucgc

SEQ ID NO: 4236257 - RNA, 63 nt, Mycobacterium avium subsp. paratuberculosis
gucgucgacgaggacgacuuucggucccgcugccgcgagaucgcgucggccuucggcggcggc

SEQ ID NO: 4236258 - RNA, 130 nt, Mycobacterium avium subsp. paratuberculosis
guugucgguguucucccacuccaucagcgaacagccggccggggucugggcguugaggcccagguaaccgcgggcgcucagcgccggcccggcggccaggcugcccuugaccgagcggguccacugcaac

SEQ ID NO: 4236259 - RNA, 113 nt, Mycobacterium avium subsp. paratuberculosis
gcgggcggcgcugcagcggcugcgcaccgccgcgacggcuagcgggccagggugaccaggcccagcucguugccggcggccagcaucggaugccggggcagcacccgcaccgu

SEQ ID NO: 4236260 - RNA, 63 nt, Mycobacterium avium subsp. paratuberculosis
cggcgcggcgucacgcuggcgugacgcucgcuugcggcggucacgcuagcgugacgcucgccg

SEQ ID NO: 4236261 - RNA, 57 nt, Mycobacterium avium subsp. paratuberculosis
gcuggcuggagccgcaggcccgguugacgguggucccgggaaugcuuuccggccagc

SEQ ID NO: 4236262 - RNA, 101 nt, Mycobacterium avium subsp. paratuberculosis
cggcgacggcgguggcggcgucgacggugaggucgggaagguucuggaucagauagaucaggaucagcucggccgucgggucggccugccaccacgucccg

SEQ ID NO: 4236263 - RNA, 78 nt, Mycobacterium avium subsp. paratuberculosis
gguugagcaugccuuugaccucgacgaucgacucgacgacggugcccuugucgaucuggucgggcaaggugcugcgcc

SEQ ID NO: 4236264 - RNA, 78 nt, Mycobacterium avium subsp. paratuberculosis
gauggccucgcgcagcauguccugccggcgggugauggucggccagccuuugccgacgacaugcucguugagguuuuc

SEQ ID NO: 4236265 - RNA, 58 nt, Mycobacterium avium subsp. paratuberculosis
ucggugaccacccgcucgcgcgggucggcgacgcccugcgcccgcaguuggucggcga

SEQ ID NO: 4236266 - RNA, 57 nt, Mycobacterium avium subsp. paratuberculosis
cggauccaccggguggcgcacuggcuguaugcgggggcgccccgaacgcuggauccg

SEQ ID NO: 4236267 - RNA, 74 nt, Mycobacterium avium subsp. paratuberculosis
ggccuucaccgaacgugcauucagugcgaaauccggcgcguuuuuucgcggccagugcacgcucggcgaaggcc

SEQ ID NO: 4236268 - RNA, 113 nt, Mycobacterium avium subsp. paratuberculosis
gccggugucauuucccgcgaguucccccgcgagcagacgcaaaagccccucgacgcccggcgugucgggggcuuuugcgucugcucgcgggaaacggcgggggucaauccggc

SEQ ID NO: 4236269 - RNA, 60 nt, Mycobacterium avium subsp. paratuberculosis
gugcuccuugccggauucgaugugguaggcguccuccaccccgaugaucuggcgggacac

SEQ ID NO: 4236270 - RNA, 79 nt, Mycobacterium avium subsp. paratuberculosis
ucgcgcagcgccuugcccgccgcgcugaccgauucgccggcgccgaucaucggcagcggcgggcucaugugcagcgaga

SEQ ID NO: 4236271 - RNA, 70 nt, Mycobacterium avium subsp. paratuberculosis
ugagccgcgaaagugcaaccagcgacguguuucccgagaggcagcgucgguagaugcacucucgcgguca

SEQ ID NO: 4236272 - RNA, 67 nt, Mycobacterium avium subsp. paratuberculosis
ucgaccugcggccgucggaugcggagcuggcuuucaccgccgacgucaccgaccggucgcagguaga

SEQ ID NO: 4236273 - RNA, 55 nt, Mycobacterium avium subsp. paratuberculosis
ugcucgaacuggggcuuguucagguugcuggcguuggaucccaaguccucgagcg

SEQ ID NO: 4236274 - RNA, 79 nt, Mycobacterium avium subsp. paratuberculosis
cggcggcaugauggucuuccccgcguccaacgaucugcugacuauguucgucgcgcuggaagugcugucgcugccgcug

SEQ ID NO: 4236275 - RNA, 111 nt, Mycobacterium avium subsp. paratuberculosis
cugcgggucgaccgcgacggcggcgacguguugauggucgccggcagcaccggccuggcgccgcugcgggcgcugaucauggaccugucccgguuugcggugaacccgcgg

SEQ ID NO: 4236276 - RNA, 103 nt, Mycobacterium avium subsp. paratuberculosis
ucgggaugcuguucgucggugccggcggcgagguugcgcaggaacgcccgggcguccggguugcucuuggaggccuugcucgcccggcgggccaguugcucga

SEQ ID NO: 4236277 - RNA, 83 nt, Mycobacterium avium subsp. paratuberculosis
gauccgccggcagggacccgucgucaccgaccggcaccggcugugucggggugugcaggacgggaucucccacgaugcggauc

SEQ ID NO: 4236278 - RNA, 68 nt, Mycobacterium avium subsp. paratuberculosis
gaccgccgagcguggaguuguuggcguugaaauggccgauucggcacaacaacucgacguucggcguc

SEQ ID NO: 4236279 - RNA, 120 nt, Mycobacterium avium subsp. paratuberculosis
ccggccggggcgccggcugcugcgguucgggggccggcucgggcgcccguuccggggccggccugggcgccgggcuggccucccaccagggcgucgccagcucacggcgcugccggcggg

SEQ ID NO: 4236280 - RNA, 55 nt, Mycobacterium avium subsp. paratuberculosis
guacggcggcaacgcgaugaccgacgacacccugcggcgcgccuucgccgccgac

SEQ ID NO: 4236281 - RNA, 82 nt, Mycobacterium avium subsp. paratuberculosis
ggugguguugcucgagcccaucgacgagaucucggugcuggugcccgacgauuucgucggugcggugaugggcgaucugucc

SEQ ID NO: 4236282 - RNA, 78 nt, Mycobacterium avium subsp. paratuberculosis
ggcgccggacggcccgauccgcccgucgaacagccccaucacgcccucgacgacggcgaugucggcgccggcggcgcc

SEQ ID NO: 4236283 - RNA, 90 nt, Mycobacterium avium subsp. paratuberculosis
gcugaccggcccgccgaacgugcacuggcggcgaaaauuucgcgugaacgucaccgugagugcacguucgguggcgacgggccggccggc

SEQ ID NO: 4236284 - RNA, 80 nt, Mycobacterium avium subsp. paratuberculosis
gugaaugccgggcgaauucgcguguccaggaugcaucggaccccgguccggugcgcagcgcaugcgacacacccggccgc

SEQ ID NO: 4236285 - RNA, 129 nt, Mycobacterium avium subsp. paratuberculosis
gaccgcgagccgguggccgccugagcgacucccgagcgugggggccauguacggauugcggacgccucgccuacacagcccccacgcucggcgcaacgggauggcucagcgcaccgccgucggggcguc

SEQ ID NO: 4236286 - RNA, 60 nt, Mycobacterium avium subsp. paratuberculosis
gcaacugcucagccacuccuugaccuuacaacugucgcaaggucuguacugagcggaugc

SEQ ID NO: 4236287 - RNA, 77 nt, Mycobacterium avium subsp. paratuberculosis
gugguuucguggccggccugcaucaugaucacgcuguucauagcggugguggcgugaucgaguuggcccgucgcuac

SEQ ID NO: 4236288 - RNA, 62 nt, Mycobacterium avium subsp. paratuberculosis
gccaccggcgccgauucgaacagcaccgcgaaacgcccgcugucggagucggugucgguggc

SEQ ID NO: 4236289 - RNA, 77 nt, Mycobacterium avium subsp. paratuberculosis
gccggcggcggggagaaggugacgcugcgcaucgccgcggaauacgcgcaguacaccaacuucacgcccgagccggc

SEQ ID NO: 4236290 - RNA, 73 nt, Mycobacterium avium subsp. paratuberculosis
cgucgugaccucguugaucagcccgccgguguagaggcccuuguacaccagggcgaucagccaggagacggcg

SEQ ID NO: 4236291 - RNA, 107 nt, Mycobacterium avium subsp. paratuberculosis
ucggccuuggcggcuucagcuucggccuugggugccucggccuugggugccgccuucuucgcgccgggccgcuuggcgcccgcggcgaugcccagccccuucaccgg

SEQ ID NO: 4236292 - RNA, 112 nt, Mycobacterium avium subsp. paratuberculosis
gugcugucggugguggggacgggccccgaccuggcggccgcgcgggccaaggcauaccagauccucggcucgauucgguugccgggcagccauuuucgcaccgacaucgcac

SEQ ID NO: 4236293 - RNA, 84 nt, Mycobacterium avium subsp. paratuberculosis
guggauacuggccggguuggccguacuggcccggcugggcguacugcccgggcuggccguauuggccgggcuggccguauugac

SEQ ID NO: 4236294 - RNA, 63 nt, Mycobacterium avium subsp. paratuberculosis
cggaucauggcgaugacggugcgcgagagaaaggucugcgcgcucugggauaucgccaauccg

SEQ ID NO: 4236295 - RNA, 77 nt, Mycobacterium avium subsp. paratuberculosis
caccucccgguuggggcccgcgagcgcguccgagauccaaaacgucgguuugcccgcgcggccguagccgauggcug

SEQ ID NO: 4236296 - RNA, 70 nt, Mycobacterium avium subsp. paratuberculosis
caccgcggcggcguugacccgcuccacgucgcccaccaggccgaugucgguggucacgccguccacggug

SEQ ID NO: 4236297 - RNA, 94 nt, Mycobacterium avium subsp. paratuberculosis
ggcgcgcgcggccgcgucggcgagcccguccaggucgugcugcccgugcucguccagcgcgacggcgaugguguucagccgggccauccgcgcc

SEQ ID NO: 4236298 - RNA, 77 nt, Mycobacterium avium subsp. paratuberculosis
acugcgcggguugcguucgaucucggcggcgucggcgcguccggcaccgugggucagggcgcggaaccguggcucgu

SEQ ID NO: 4236299 - RNA, 68 nt, Mycobacterium avium subsp. paratuberculosis
cgcucagcagcugggaaucggcaugaugcuggggucgcaacggaucaugcucgacaccgcgcugggcg

SEQ ID NO: 4236300 - RNA, 91 nt, Mycobacterium avium subsp. paratuberculosis
cggccaacucgcgcgaccaguuguuggacgagcuacgucacgccuacgaaagcggcgccagcauccgcagucuggucgcgcggaccggccg

SEQ ID NO: 4236301 - RNA, 75 nt, Mycobacterium avium subsp. paratuberculosis
ggacguggcggccgccgcgcuggcggccacgccgcacaccgaaccggcgccgcgggugauggcggccgccgcgcc

SEQ ID NO: 4236302 - RNA, 56 nt, Mycobacterium avium subsp. paratuberculosis
gugauucggauucgccgcgcagcgguacgcacacauggcggcacauucgaagucac

SEQ ID NO: 4236303 - RNA, 80 nt, Mycobacterium avium subsp. paratuberculosis
gcccaacaagcgcugugcggcaacgcguuuggcguugacgaugccgggcucgugcaggcugcgcagcgcggcguucaggc

SEQ ID NO: 4236304 - RNA, 75 nt, Mycobacterium avium subsp. paratuberculosis
cggcgaucgguguaaucgacgaacaccugcgccgccacggggcgggacggguggagugguugaccgacgacgucg

SEQ ID NO: 4236305 - RNA, 61 nt, Mycobacterium avium subsp. paratuberculosis
gugacauggugaacgauguugugcaccagucguucccgcucggcgucguccaucacgucgc

SEQ ID NO: 4236306 - RNA, 69 nt, Mycobacterium avium subsp. paratuberculosis
cggcgccgagcgucacgccagcguggcgcucgcgggccggcgccacgcuggcgugacgcucggccggcg

SEQ ID NO: 4236307 - RNA, 86 nt, Mycobacterium avium subsp. paratuberculosis
gguagugcagccgcagcgcggcaagcacgugcggaucggccuugauggccucuucgaucuguuugccguaggcgcggacggcuucc

SEQ ID NO: 4236308 - RNA, 91 nt, Mycobacterium avium subsp. paratuberculosis
gcugcccgccgagcuggaacgggugcacauggucggcaucgggggagccggcaugucgggcaucgcccgcauccugcucgaccgcggcggc

SEQ ID NO: 4236309 - RNA, 123 nt, Mycobacterium avium subsp. paratuberculosis
ucggaugcagaucugcgcgacgucggccaccuugccgccgcccgcaccggugagggugacggucgucaucccggccuggcgggcggccucgagcgcgcgaacgacguuggcggaguugcccga

SEQ ID NO: 4236310 - RNA, 55 nt, Mycobacterium avium subsp. paratuberculosis
guaccgguugccgaucaggucgagguagcggaucugcgccgucgucgacugguac

SEQ ID NO: 4236311 - RNA, 76 nt, Mycobacterium avium subsp. paratuberculosis
ggcggccgaccggcugcggguccgcccgggccgcugcguggugguggccggcgaccccgcggccgucgaggcggcc

SEQ ID NO: 4236312 - RNA, 65 nt, Mycobacterium avium subsp. paratuberculosis
agcugggcgacuuucgcggaguucuggaaccugauccacggauccaucugcaggguggcccaguu

SEQ ID NO: 4236313 - RNA, 76 nt, Mycobacterium avium subsp. paratuberculosis
cgccgcggaugaucucgaucggguccaucuuuuccaccggugagaagaaguggaugccgacgaaguucuccgggcg

SEQ ID NO: 4236314 - RNA, 61 nt, Mycobacterium avium subsp. paratuberculosis
gguucgagcucgaucguggugagguucuccgcugcgauccccgccgcggcggggucgaacc

SEQ ID NO: 4236315 - RNA, 58 nt, Mycobacterium avium subsp. paratuberculosis
acgugcgggguauccucgguggccucggugaagaacaucgacacgaucacccgcacgu

SEQ ID NO: 4236316 - RNA, 55 nt, Mycobacterium avium subsp. paratuberculosis
ccgacgucgacgacgacgagcaccacgaccgguugcucgacgucggccggcgcgg

SEQ ID NO: 4236317 - RNA, 76 nt, Mycobacterium avium subsp. paratuberculosis
cgugcugauuguguucgcggcggccuacauucgccgcuucggcgcgcggggccgcgcgcugggcacggugugcacg

SEQ ID NO: 4236318 - RNA, 66 nt, Mycobacterium avium subsp. paratuberculosis
gcgccgagcgugggggcuacguccguccacaccccggaauucgugcacagcccccacgcucggcgc

SEQ ID NO: 4236319 - RNA, 60 nt, Mycobacterium avium subsp. paratuberculosis
gccgagcgugaaguuaaguucacgcucggcgccgagcgugaagcuagcuucacgcucggc

SEQ ID NO: 4236320 - RNA, 60 nt, Mycobacterium avium subsp. paratuberculosis
guuaccggugguguagcuucgaugggcacgacuucucggggcuauggcgcagcugguagc

SEQ ID NO: 4236321 - RNA, 59 nt, Mycobacterium avium subsp. paratuberculosis
cgcggccaggcucagcagccagccgcccaggaacgccaggcugcucggccgcggccgcg

SEQ ID NO: 4236322 - RNA, 82 nt, Mycobacterium avium subsp. paratuberculosis
acggcgggcggcugcuggugcggcuggccggcgucaccgaccgggacgccgccgacgcgcugcgcggcacccuguucgucgu

SEQ ID NO: 4236323 - RNA, 81 nt, Mycobacterium avium subsp. paratuberculosis
gucgagcagcgucgacuccagcguggcggccaccaggcuuuccagauugcguugcgccacuugggguucggcguauuuggc

SEQ ID NO: 4236324 - RNA, 66 nt, Mycobacterium avium subsp. paratuberculosis
gccggugcgggccgaucugaccgaccgcgacgacgucgcgcggcugguggauucggcucgagaggc

SEQ ID NO: 4236325 - RNA, 129 nt, Mycobacterium avium subsp. paratuberculosis
gacgccccgacggcggugcgcugagccaucccguugcgccgagcgugggggcuguguaggcgaggcguccgcaauccguacauggcccccacgcucgggagucgcucaggcggccaccggcucgcgguc

SEQ ID NO: 4236326 - RNA, 58 nt, Mycobacterium avium subsp. paratuberculosis
ucggucuugcgucccucggcgguggcccgggccagcuccgguucgggaugcgagcuga

SEQ ID NO: 4236327 - RNA, 85 nt, Mycobacterium avium subsp. paratuberculosis
cgcccacgccaggccgucggccaccgacaccucgaacaacgacgacccguaguuguuuuuggccggauggccgugcuugcgggcg

SEQ ID NO: 4236328 - RNA, 130 nt, Mycobacterium avium subsp. paratuberculosis
cgcccccaucgagcggcucgaggagcuggugccgaucuacgccgagcugcugucgcugcucgccgacaacggggcgcagugggugcagcucgacgagccggcgcuggugaccgacaugugcgccgacgcg

SEQ ID NO: 4236329 - RNA, 111 nt, Mycobacterium avium subsp. paratuberculosis
gcgcagcugcccuugccggacucgucggucgauguuguggucaacuuccaggugaucgagcaucugugggaccaaacacaauucgucgucgagugcgcgcgggugcugcgc

SEQ ID NO: 4236330 - RNA, 109 nt, Mycobacterium avium subsp. paratuberculosis
gcgcagccuguccgaggccgacgacccgcugugggagcgcauggauuucgcuguggcagaagccaauuuccucaccgcggcgcggcacggcaucgacgcccggcugcgc

SEQ ID NO: 4236331 - RNA, 78 nt, Mycobacterium avium subsp. paratuberculosis
cguaguugacgaacacgcuggaggcgccgauguugcugugcucgccgaugucggcgucgcccacguaggucaggugcg

SEQ ID NO: 4236332 - RNA, 112 nt, Mycobacterium avium subsp. paratuberculosis
gccgucgggcaggucgucgcgggccaccccggugaccguggcguagcgcagccccaucgugcgcacgcugucggccacccggcggggcucgucgcgguccagcucggcuggc

SEQ ID NO: 4236333 - RNA, 127 nt, Mycobacterium avium subsp. paratuberculosis
ccgggcggcuuuucgguguucgggguguucuggggggcuuucgggcuggucaccggcgcggccaacgggcugcugcaggagaccacccgggaaguccgggugaugcccuaccucgaggucgcaccgg

SEQ ID NO: 4236334 - RNA, 56 nt, Mycobacterium avium subsp. paratuberculosis
cuugccgccggccuccucgaccagcgcgacggucuggucgagcuccgcgcggcagg

SEQ ID NO: 4236335 - RNA, 89 nt, Mycobacterium avium subsp. paratuberculosis
ggcgcccagcgcgauggcgugccgggucugccgguagucggcauucguaugcccaacugccacaacgacucccgcguccgcgaaacgcc

SEQ ID NO: 4236336 - RNA, 85 nt, Mycobacterium avium subsp. paratuberculosis
gcccgcgcgcuccuggucguccugcggauccaaaacauauugcuugaguuggggauugagcaugaugccgggcgccacgccaagc

SEQ ID NO: 4236337 - RNA, 58 nt, Mycobacterium avium subsp. paratuberculosis
guggugugcgcccggcuguugcugcccucggccagcgacaccgaaucggcgcugcugc

SEQ ID NO: 4236338 - RNA, 66 nt, Mycobacterium avium subsp. paratuberculosis
ccauggcuucgaugguggucagcgaccugcgcaucaucggucaggucgguaccaccaucggucugg

SEQ ID NO: 4236339 - RNA, 90 nt, Mycobacterium avium subsp. paratuberculosis
ggggagccgucgaugcggcggcgguugugauaggcgauggcgcagucgaauccgcgcagccugguagcgaucgccgagccgaugcgcccc

SEQ ID NO: 4236340 - RNA, 61 nt, Mycobacterium avium subsp. paratuberculosis
gcccaacguggacuuguugggcacaacccagccgauuucgcccaacaagucgacguucggc

SEQ ID NO: 4236341 - RNA, 74 nt, Mycobacterium avium subsp. paratuberculosis
gcccgcaucaucagcguguugaccgaggagcgacgcuuccacggcucgcucgacgaccucgacgcgguccgggc

SEQ ID NO: 4236342 - RNA, 104 nt, Mycobacterium avium subsp. paratuberculosis
gcgucgagggacuuggccagcucgucggggcggcggugggugacgacgacggcgaagacggugucgcucauggcuguucggcggucucggccagcaccucgcgc

SEQ ID NO: 4236343 - RNA, 80 nt, Mycobacterium avium subsp. paratuberculosis
accgcagccaggcggcggguucggcauccacguccucgaagagcgugggcgaggucaugcggacccgcacgaaaugcggu

SEQ ID NO: 4236344 - RNA, 55 nt, Mycobacterium avium subsp. paratuberculosis
uguggcgguucgucgcguaucugugcgaugcgggcagugccgacgaucugcccca

SEQ ID NO: 4236345 - RNA, 56 nt, Mycobacterium avium subsp. paratuberculosis
ggcagcggcggcucggcacggcuggucacccccgagcuguccggcucgcugcugcc

SEQ ID NO: 4236346 - RNA, 76 nt, Mycobacterium avium subsp. paratuberculosis
uaugaccgcgaggugcucgaccgcgccgcguggggcccgcgcucgucgcggcugcuggucgaguacugggcgcaug

SEQ ID NO: 4236347 - RNA, 70 nt, Mycobacterium avium subsp. paratuberculosis
cucgccgcgcccguaacgccacggcgggaauucgacccgaaaaucgcccugacguuacggacgcgguggg

SEQ ID NO: 4236348 - RNA, 61 nt, Mycobacterium avium subsp. paratuberculosis
gauugggcgacgacgagugaaucugccacugugccaagccuuucagucgcgcgcuucgauc

SEQ ID NO: 4236349 - RNA, 81 nt, Mycobacterium avium subsp. paratuberculosis
cgguuggccgucggcgacgaguucguggugcgucccggggaacggaucgccaccgacgggaucgucgucgcgggcuccucg

SEQ ID NO: 4236350 - RNA, 76 nt, Mycobacterium avium subsp. paratuberculosis
guggcacggcucgugguucgcggccgaguccggcgagguggugcgcgggccggcggcggcgccgcugccgugcuac

SEQ ID NO: 4236351 - RNA, 60 nt, Mycobacterium avium subsp. paratuberculosis
ggccguucgcgccgcacgaugcgcuugacgacgacggcagcagcgugcgcgacgaacgcc

SEQ ID NO: 4236352 - RNA, 118 nt, Mycobacterium avium subsp. paratuberculosis
gcccaggugcucggccgccagcacggcgucggccagcugguccagcacgucggggugggugguuuugauggcgucgaucagcucgucgaggcggaccggguggacgaugcggaugggc

SEQ ID NO: 4236353 - RNA, 55 nt, Mycobacterium avium subsp. paratuberculosis
ggcagucgacgaugccccaggcgcccagguaggcguuggcggucagcgggcugcc

SEQ ID NO: 4236354 - RNA, 62 nt, Mycobacterium avium subsp. paratuberculosis
auggaggccaucgagggacugcacgacggcacccgggugcugcacgacccgaugaccuucau

SEQ ID NO: 4236355 - RNA, 91 nt, Mycobacterium avium subsp. paratuberculosis
gcagcgcuuuuggugccgacgaugcgguuccggccguucauccgguugaccguggaauggguggaagugcucgcguucaucguccugcugc

SEQ ID NO: 4236356 - RNA, 61 nt, Mycobacterium avium subsp. paratuberculosis
cucacucugcaggaacucggggucacccgaugagggacuuuccgaauguuugaggggugag

SEQ ID NO: 4236357 - RNA, 58 nt, Mycobacterium avium subsp. paratuberculosis
ccgaacgugcacuggcagcgaaaaaccggccggaaauucgcggugaguacacgcucgg

SEQ ID NO: 4236358 - RNA, 69 nt, Mycobacterium avium subsp. paratuberculosis
cgcgaaccgaugcugacgcucgaacugccgggccgcgaacccaucaccggcgucagcuucgcguucgug

SEQ ID NO: 4236359 - RNA, 90 nt, Mycobacterium avium subsp. paratuberculosis
gaucucgucaccgaauacugcuggggugccguguggggccgcgaggagcugccccgcaagacccgcagcaugcucaaccuggcgaugauc

SEQ ID NO: 4236360 - RNA, 83 nt, Mycobacterium avium subsp. paratuberculosis
ggauggucaccggcccgaucugcgcggaguugugcacgugcgugccgccgcagagcuccagcgagaacgggccgccgaucucc

SEQ ID NO: 4236361 - RNA, 55 nt, Mycobacterium avium subsp. paratuberculosis
gauccugguguugcugcgggccuucgccaacggcgguucgucgcugaccgggguc

SEQ ID NO: 4236362 - RNA, 60 nt, Mycobacterium avium subsp. paratuberculosis
cgagccggcuucggcggccggcuccgcgccgcgcgcggccggccgccgggccggucaucg

SEQ ID NO: 4236363 - RNA, 89 nt, Mycobacterium avium subsp. paratuberculosis
gcaucugcucgagucguggauuccguugcuggcguuggccgcucacgaucgcggccgcgacuggucggcggugugcaucgggcggaugc

SEQ ID NO: 4236364 - RNA, 70 nt, Mycobacterium avium subsp. paratuberculosis
gcccgccgggugguaguagccgccggcggcguacaccggcaccgccggcgcgggcugccgcccggcgugc

SEQ ID NO: 4236365 - RNA, 62 nt, Mycobacterium avium subsp. paratuberculosis
ucggcgacguagugguggccgugcccgucgggcacguucugggcgaccgccauguccgccga

SEQ ID NO: 4236366 - RNA, 87 nt, Mycobacterium avium subsp. paratuberculosis
uguccguuuaagccagccauugcguugcugauccugucagcggugcguacguccgcucugaugagaucagcggcacgcugauggaua

SEQ ID NO: 4236367 - RNA, 66 nt, Mycobacterium avium subsp. paratuberculosis
gcgcgaucgggagccggacugggucaacaccaucuuccuguccacccgguucaaggccuggcgcgu

SEQ ID NO: 4236368 - RNA, 67 nt, Mycobacterium avium subsp. paratuberculosis
ggguuggucgcgauggccgucgcaucaaaggugaaauccuggaugguguggcacaucgcgcggaccc

SEQ ID NO: 4236369 - RNA, 80 nt, Mycobacterium avium subsp. paratuberculosis
ccggaucggaccccaacgucgacuugugggcgccaauucgcggguuuucgcccagcaagucgacguucggcgcgaaucgg

SEQ ID NO: 4236370 - RNA, 73 nt, Mycobacterium avium subsp. paratuberculosis
ccgggcuugauccgaucgagcacguguucggcgcccgcgcgcaccagcaugucgcugaucuugucgaucucgg

SEQ ID NO: 4236371 - RNA, 76 nt, Mycobacterium avium subsp. paratuberculosis
gguggaguacacgcaggaucucuacgacgagguggggcugaccgaggacgucaagaaguuccugcgcuacaacgcc

SEQ ID NO: 4236372 - RNA, 71 nt, Mycobacterium avium subsp. paratuberculosis
ccgcgggugugaccgagaccgaggucgcaaucguguugcaggcguugguagaucggcacgccaugcugcgg

SEQ ID NO: 4236373 - RNA, 63 nt, Mycobacterium avium subsp. paratuberculosis
aaugggagccagcugucgaccggcuaucauguagguagauggcgguuguauuugucuucuauu

SEQ ID NO: 4236374 - RNA, 70 nt, Mycobacterium avium subsp. paratuberculosis
gcgccgccacgaaccgcgucugcgguauggcgucuucgaugucgugcgguggucugcggucguagcgggc

SEQ ID NO: 4236375 - RNA, 97 nt, Mycobacterium avium subsp. paratuberculosis
cgcgggcuggcacaaggccgugcagcggacccuggauugggccgacgucacgugacgugacccgauccagggcccgcucaaggcaacucaguccucg

SEQ ID NO: 4236376 - RNA, 86 nt, Mycobacterium avium subsp. paratuberculosis
gccgccgcgccggccuucgacugcagcaggacguugccgcuggccaggaccguccgcaccgcggugaagccggcgucggucagggc

SEQ ID NO: 4236377 - RNA, 58 nt, Mycobacterium avium subsp. paratuberculosis
uuaggucaccgugggcccaauccucaaacgagcccgguuuuggguccaaguauccuga

SEQ ID NO: 4236378 - RNA, 84 nt, Mycobacterium avium subsp. paratuberculosis
gcacccucgccgccgaacgugcacccaccgcgagaauuccgccgauucuucgcuaccagugcacgcucgacgacggcgaggugc

SEQ ID NO: 4236379 - RNA, 60 nt, Mycobacterium avium subsp. paratuberculosis
ucccgugugcacccucguagccgacgaugaacugcgcgcuaccaccgguguacggcggga

SEQ ID NO: 4236380 - RNA, 68 nt, Mycobacterium avium subsp. paratuberculosis
ggccuuuguaggucaccuugaccucggcgaugagcagcccgauggucaggaugucgaccucgaacgcc

SEQ ID NO: 4236381 - RNA, 102 nt, Mycobacterium avium subsp. paratuberculosis
ugcguuggugccgguggaggcgcugggcgcggugcucgaugccggagcggccgaguggccgccgcucgagcagccgaccagcgucaccgcggccgcagcgca

SEQ ID NO: 4236382 - RNA, 81 nt, Mycobacterium avium subsp. paratuberculosis
ggcguuggugcugugggaugaggugcaggugcacgccgccgcacccaacgugcacguggaauucacccgcuacaccgagcc

SEQ ID NO: 4236383 - RNA, 58 nt, Mycobacterium avium subsp. paratuberculosis
cacguugggaaucguuggcgugcacaaggaaccggugcccgucgaccugaucaacgug

SEQ ID NO: 4236384 - RNA, 55 nt, Mycobacterium avium subsp. paratuberculosis
caccguguuacgccgggaacgccgcucgcgcaggaugucccggaucggcacggug

SEQ ID NO: 4236385 - RNA, 68 nt, Mycobacterium avium subsp. paratuberculosis
gcgcgcggguguguuuggaggucaccgccgagccgcggccgaguuuguccgucgagcgcaccuggcgc

SEQ ID NO: 4236386 - RNA, 85 nt, Mycobacterium avium subsp. paratuberculosis
agccgaucggcgccuacggggccggugucgaccugcuccgcaaggccggcaucgacaaccggcucgccgaggacaccgacgugcu

SEQ ID NO: 4236387 - RNA, 93 nt, Mycobacterium avium subsp. paratuberculosis
ggcggcgggauggcgcaccacguauaccgacgcgccggcggccgcggcggcgcguucggcgaucacgucggucaucucuuccagcccgccgcc

SEQ ID NO: 4236388 - RNA, 60 nt, Mycobacterium avium subsp. paratuberculosis
cgcucguugcgaaggggcugggcgugggucucguuccucaaucagcccucgcgcaaagcg

SEQ ID NO: 4236389 - RNA, 72 nt, Mycobacterium avium subsp. paratuberculosis
cgcuacgccgacagguucgacgugcccgcggccggccccggugggcugucggugaccuggcuggggguggcg

SEQ ID NO: 4236390 - RNA, 61 nt, Mycobacterium avium subsp. paratuberculosis
ucguucaccugacgguugaggcccgaggucagcucggccagccugggcaccaggucgacga

SEQ ID NO: 4236391 - RNA, 65 nt, Mycobacterium avium subsp. paratuberculosis
gcgcucagcggcgccuggucgggauagcuggucggaccccccacgucauaggcggcguugagggc

SEQ ID NO: 4236392 - RNA, 73 nt, Mycobacterium avium subsp. paratuberculosis
gguuccaccauccgggaucuggaauacgugcgcgagcgccacguguucgucgagaaucccgcggguuuccacc

SEQ ID NO: 4236393 - RNA, 60 nt, Mycobacterium avium subsp. paratuberculosis
ugggcgacuucauggcggccaccgccucggagguguugcgccgucaacuggaguccuuca

SEQ ID NO: 4236394 - RNA, 58 nt, Mycobacterium avium subsp. paratuberculosis
ggcaaugguucgcgacgccagguauugguuuuccacauagauggugucgcgggcugcc

SEQ ID NO: 4236395 - RNA, 65 nt, Mycobacterium avium subsp. paratuberculosis
ggcgcgcucguaacgccacggcgcaaacucgcccggauuuccgcccuggcguuacgagcggggcc

SEQ ID NO: 4236396 - RNA, 60 nt, Mycobacterium avium subsp. paratuberculosis
gcgagcagacgcgaaagcacccgacacgccgggcggcggggagcuuuugcgucugcucgc

SEQ ID NO: 4236397 - RNA, 58 nt, Mycobacterium avium subsp. paratuberculosis
ggccgcgucgucacccaguggccgcgcagcgcacgcgccuucuggucgaugacgcgcc

SEQ ID NO: 4236398 - RNA, 57 nt, Mycobacterium avium subsp. paratuberculosis
uggaguugacuucucgggcgucgaugcccuccagguugacgccgacgaguuucuuca

SEQ ID NO: 4236399 - RNA, 129 nt, Mycobacterium avium subsp. paratuberculosis
cgggcgcgccggacuuccucgccaucagcgucgcgcaggugcuccugguggucgucgccguggcggugcuguucgucgcgcugcggccgcuggagaacaacccgcuguccggcugggacggcgcgcccg

SEQ ID NO: 4236400 - RNA, 129 nt, Mycobacterium avium subsp. paratuberculosis
cgucggcaagcccgagcggcggcccggaccgcccggugguggucagcguggucggccuggugcacacgcccggccuggucacgcuggcgccgggggcgcggaucgccgaugcggugcaggcggccggcg

SEQ ID NO: 4236401 - RNA, 73 nt, Mycobacterium avium subsp. paratuberculosis
gcacaaccugguggccuucggugagccgcugugcgauuccgaagcggugcucaucgagagcgaccgggguggc

SEQ ID NO: 4236402 - RNA, 66 nt, Mycobacterium avium subsp. paratuberculosis
gccucucgagccgaauccaccagccgcgcgacgucgucgcggucggucagaucggcccgcaccggc

SEQ ID NO: 4236403 - RNA, 96 nt, Mycobacterium avium subsp. paratuberculosis
gccgccggugcugcgguucuucggcgaucugcucuacuucgaccgguacuggcuggaggaagagcaggugugcaccgaucugcuggcacugucggc

SEQ ID NO: 4236404 - RNA, 61 nt, Mycobacterium avium subsp. paratuberculosis
ucgguucccgcggcgaucgccagcauggugaggauguuggcggcgaagguggugagcccga

SEQ ID NO: 4236405 - RNA, 64 nt, Mycobacterium avium subsp. paratuberculosis
ggccucgucgucgcgggccgggcugggcuacgaagugaucgucagccgccucgacgacgaagcc

SEQ ID NO: 4236406 - RNA, 64 nt, Mycobacterium avium subsp. paratuberculosis
gcaccgagcgucacgcuggcguggcacccgggcgcgacggucacgcuggcgugacgcucggcgc

SEQ ID NO: 4236407 - RNA, 70 nt, Mycobacterium avium subsp. paratuberculosis
gcggucaaggaggcggugcugcccuuccaccgguuccgcaccguggagggcgccggcaucgacucgcugc

SEQ ID NO: 4236408 - RNA, 117 nt, Mycobacterium avium subsp. paratuberculosis
ggaauucgaguguguagcuagggauuucaguguguacucacggcgggauuucggccggaaucucgccaugaguacacacuccaggccgaagcccccggccccuacuuguacaggucc

SEQ ID NO: 4236409 - RNA, 59 nt, Mycobacterium avium subsp. paratuberculosis
cuagacacgaauacccuucggccggcagcggugccgcccggaggguauucgugugcuag

SEQ ID NO: 4236410 - RNA, 94 nt, Mycobacterium avium subsp. paratuberculosis
guggucauucaaccgcgacacccggcgucacgccagcguggcguucggcgccgagagccacgccggcgugacgcuggaggcgcggucaggccgc

SEQ ID NO: 4236411 - RNA, 71 nt, Mycobacterium avium subsp. paratuberculosis
cgugcgggccaaccggcuggcccggcugcucgacgacgacgcgccgcugggccgggcgguggcgccggacg

SEQ ID NO: 4236412 - RNA, 62 nt, Mycobacterium avium subsp. paratuberculosis
cgcggcgggcugaccaccaacgcggucuacggcuucaccgcgaugcugaucaaccugcugcg

SEQ ID NO: 4236413 - RNA, 60 nt, Mycobacterium avium subsp. paratuberculosis
guccgucagcucuucgcggccggggccggacaggcucggcucgguggcgaguuggcggac

SEQ ID NO: 4236414 - RNA, 103 nt, Mycobacterium avium subsp. paratuberculosis
cggcgcguucuggucgcguucccgcugcaggauggugaucuccuggacgaacgggcgguucaucgccgacagcgccggaaccucggccgccggaaucgcgucg

SEQ ID NO: 4236415 - RNA, 57 nt, Mycobacterium avium subsp. paratuberculosis
gaugccgcgcugaccgagcucgucgucgaggacggccgaguggucggcgcgcgcguc

SEQ ID NO: 4236416 - RNA, 78 nt, Mycobacterium avium subsp. paratuberculosis
cccacggcaccgggucguccgucggcgccggcgccaccgucggcccguucgccuaucugcggcccggcaccgugcugg

SEQ ID NO: 4236417 - RNA, 86 nt, Mycobacterium avium subsp. paratuberculosis
cgcgcugcuggggcucggcguggccgaccggcguucgggcuacccgcuggaacugcuggugcgcgccgcggccgccggcuggcgcg

SEQ ID NO: 4236418 - RNA, 120 nt, Mycobacterium avium subsp. paratuberculosis
gggcugccgaacggcgaccaaccgauggccgacgucugguggcgguuccgggaggccaucaccucggcgccgcagcugaacaucggcgcguucgugcagggcgguugccgccggcggcuc

SEQ ID NO: 4236419 - RNA, 105 nt, Mycobacterium avium subsp. paratuberculosis
cggcgcgagcggcguucgacgccggaccguggagccgcggcgggccgucacaccgcaucgccgcgauccgccggcuggccgacaucuacgaccggcgccgcgccg

SEQ ID NO: 4236420 - RNA, 90 nt, Mycobacterium avium subsp. paratuberculosis
gcggaaaggccgacguggugcaucacgauccggcgggcccggucauccacucggcgaccagcucgaucgugaugccgucggugauccagc

SEQ ID NO: 4236421 - RNA, 90 nt, Mycobacterium avium subsp. paratuberculosis
gcgucguccaccagggccagcacgucacgcgcgcaaccccaggacagggugacgccguugcugcugugcccguaauuguggaugcagcgu

SEQ ID NO: 4236422 - RNA, 62 nt, Mycobacterium avium subsp. paratuberculosis
cgucaaugguguugggcggcaaggugaauggaaucucgacccaggugcccgacaccgggacg

SEQ ID NO: 4236423 - RNA, 74 nt, Mycobacterium avium subsp. paratuberculosis
cgagcccggaaucgagcggccacgagacaucggugauccacgcccgaucguggcagcgcugcgccgggcgagcg

SEQ ID NO: 4236424 - RNA, 58 nt, Mycobacterium avium subsp. paratuberculosis
gagaaccuccgagugaagugcgagcugcuuaggaaacgcacucaccucggagguccuc

SEQ ID NO: 4236425 - RNA, 66 nt, Mycobacterium avium subsp. paratuberculosis
guccacuuugacgaucgugcccucgacgaugucgccaucguugaaguacuugaucguuuugucgau

SEQ ID NO: 4236426 - RNA, 64 nt, Mycobacterium avium subsp. paratuberculosis
gcugcgcgagcucgacgugcugcuggaaacacuguccgcggcaccgguuuccgagcugcgcagc

SEQ ID NO: 4236427 - RNA, 57 nt, Mycobacterium avium subsp. paratuberculosis
gccggugacgugcgucgucucguccuugagguacagcgcgacgucggcgucgccggc

SEQ ID NO: 4236428 - RNA, 76 nt, Mycobacterium avium subsp. paratuberculosis
gucgagaaaccaaggcgucuacgguuugcugaguaacaaggaucgcgucaccggucgucuuggugaguugcucgac

SEQ ID NO: 4236429 - RNA, 64 nt, Mycobacterium avium subsp. paratuberculosis
gcaucgaggugaucaucgccggcgccggaggcgccgcccaccugcccggcauggucgccucggc

SEQ ID NO: 4236430 - RNA, 59 nt, Mycobacterium avium subsp. paratuberculosis
ccgcuacuacgugagcaugaacguggccgacaagccggguguguugucgucgguggcgg

SEQ ID NO: 4236431 - RNA, 67 nt, Mycobacterium avium subsp. paratuberculosis
ucgccguccacgccgugcagcgcgaucaccggacgcagcaucccggucugccccggcgggauggcga

SEQ ID NO: 4236432 - RNA, 81 nt, Mycobacterium avium subsp. paratuberculosis
gcgaacucgaggaacaucggcagcaccgcgucgauggccggcgcguccgacaccaucgccguggugaugccggucagucgc

SEQ ID NO: 4236433 - RNA, 65 nt, Mycobacterium avium subsp. paratuberculosis
ccggccgagcgugaaguuagcuucacgcucggccccgaccgugaagcuaacuucacgcucggcgg

SEQ ID NO: 4236434 - RNA, 67 nt, Mycobacterium avium subsp. paratuberculosis
gcgugcccugcagauccaugccggcggcgaacagccgcuggaugacguggucgugcaggucgugcgc

SEQ ID NO: 4236435 - RNA, 105 nt, Mycobacterium avium subsp. paratuberculosis
cggccggguugcgcaggucgugaucggucucgaucaucaacagcucgggauugagccgagccuggucgaaaugccgguccgcggcggcauaaccgacauuggccg

SEQ ID NO: 4236436 - RNA, 72 nt, Mycobacterium avium subsp. paratuberculosis
cgcuugccgcgcguguaacgccacggcggagaaaucaccccgaaacccgccguggcguuacacgcgcgagug

SEQ ID NO: 4236437 - RNA, 99 nt, Mycobacterium avium subsp. paratuberculosis
agcgggacaaaccugaccgaacguuauugcucagggacuugugugagcuuccaggcuggucgcgacgucaugggcgagcuggucggcuaggagccugcu

SEQ ID NO: 4236438 - RNA, 70 nt, Mycobacterium avium subsp. paratuberculosis
gccguggacgugcaccgagaugcugccggaggccaccgacagcguggugcucucgguguggguccacggc

SEQ ID NO: 4236439 - RNA, 56 nt, Mycobacterium avium subsp. paratuberculosis
cgcgaucuucuucgucggccguuaccacgaggcacgccacgaagggcaggaucgcg

SEQ ID NO: 4236440 - RNA, 69 nt, Mycobacterium avium subsp. paratuberculosis
gaaguaugucggcaacccgaaauggauguagaagaagugcgccaugucggugacguugucgaugauguc

SEQ ID NO: 4236441 - RNA, 90 nt, Mycobacterium avium subsp. paratuberculosis
gaacaaaccggcgccgggcuggguuaagcgcaucagacucaacuuuuggaggauuugauggcugaggccuacucggugccggugcuguuc

SEQ ID NO: 4236442 - RNA, 104 nt, Mycobacterium avium subsp. paratuberculosis
ggcgacucgggaaggucgcggcggguacgcgcgcugcuguucaucgggcucaaugcugccaugacggcgucgcugcguaguaucgacgaccgugccagucagcc

SEQ ID NO: 4236443 - RNA, 60 nt, Mycobacterium avium subsp. paratuberculosis
gccucgcugauggacaucgacaccaucuacguguggacgcacgauuccaucgggcugggu

SEQ ID NO: 4236444 - RNA, 99 nt, Mycobacterium avium subsp. paratuberculosis
gcuucuccaucgcccggcugucgcugcuggaccgcggcaugguguucgcgaucgcacacgugcgcgguggcggcgagaugggccggcugugguacgagc

SEQ ID NO: 4236445 - RNA, 82 nt, Mycobacterium avium subsp. paratuberculosis
gcgcagguggccgucguugaggauguacggcagccgggccaggcugccgacgucggcgacgauggccagcuugaccucgcgc

SEQ ID NO: 4236446 - RNA, 98 nt, Mycobacterium avium subsp. paratuberculosis
gcuccaccaccgcggccgagcgggcguccucggcggucagcgacaaccggcggugccgcggccacgcccgcuccacguagaggccgaagguggcgggc

SEQ ID NO: 4236447 - RNA, 60 nt, Mycobacterium avium subsp. paratuberculosis
cgcggucggguagugacgaaucugacugaagcgguugaggguucgucccuggccgccgcg

SEQ ID NO: 4236448 - RNA, 70 nt, Mycobacterium avium subsp. paratuberculosis
cgcggaacgcuucugauuccuugccguuucgcgcguagugggcacgagcgagggccaggcgcgcuccacg

SEQ ID NO: 4236449 - RNA, 93 nt, Mycobacterium avium subsp. paratuberculosis
gguugaugugcacguaguugggcuugccguaggccgcgggaaugacguugucgaccgcgccgacgagcagcccgugauacuugacgucggacc

SEQ ID NO: 4236450 - RNA, 55 nt, Mycobacterium avium subsp. paratuberculosis
gcgggacagccgcgaccagucggccgucgacgccgcgcuggccgagcugucccgc

SEQ ID NO: 4236451 - RNA, 76 nt, Mycobacterium avium subsp. paratuberculosis
ucacccgggacacgucgacguugaggucgucgcgcaggaugccgagaagcucggcgcugacgugguuuucggguga

SEQ ID NO: 4236452 - RNA, 59 nt, Mycobacterium avium subsp. paratuberculosis
uugucgacggcugccguagcggcgguggaauuucucuaccugcccggcagugucgacga

SEQ ID NO: 4236453 - RNA, 93 nt, Mycobacterium avium subsp. paratuberculosis
ggccccggccgcggcgucgagcguggacuaguugcgcgaucacccggcgugucggcgcaacaagucgacgcuggaccggugcgcgccggggcu

SEQ ID NO: 4236454 - RNA, 55 nt, Mycobacterium avium subsp. paratuberculosis
gggcgucugcuugccgccggugauccaggccgcgcuggugcacacguugacgccc

SEQ ID NO: 4236455 - RNA, 55 nt, Mycobacterium avium subsp. paratuberculosis
cgagucagcgucggcgagucggagccuucuuacugcgacggcgaggcuuggcucg

SEQ ID NO: 4236456 - RNA, 76 nt, Mycobacterium avium subsp. paratuberculosis
ccgcgcccgucgagcgucacgcuggcguggcucggcccgccgggcgccacgcuggcgugacgcucggcggccgagg

SEQ ID NO: 4236457 - RNA, 84 nt, Mycobacterium avium subsp. paratuberculosis
gugcugcgccgcggugccgugguggcgcugaaaucgaccgucccggucggcaccacguccaccauggcacagcggcugugccac

SEQ ID NO: 4236458 - RNA, 99 nt, Mycobacterium avium subsp. paratuberculosis
cccgauggaucgauggcgcugugguguugguggccaaugccuuucgcgcgcucggcgcgggugagccuggccaacaccggcgccggcccggucuucggg

SEQ ID NO: 4236459 - RNA, 105 nt, Mycobacterium avium subsp. paratuberculosis
ucgcggagaaccugguuuucgaucgcgcgccgcggcuggugcggcaugugcagaacucgcagaccgugcugcgcgagcugcagcaggccgugaagaucaccgcga

SEQ ID NO: 4236460 - RNA, 64 nt, Mycobacterium avium subsp. paratuberculosis
gaagugguccgacgaccuggugugcggccugaguucgcacaucgaccccacgucggccgaauuc

SEQ ID NO: 4236461 - RNA, 75 nt, Mycobacterium avium subsp. paratuberculosis
cgguuccggccgaggccgccguggacguggugaucccguaucaccgcggcgaccugguggcccggcugcacgccg

SEQ ID NO: 4236462 - RNA, 67 nt, Mycobacterium avium subsp. paratuberculosis
gaccgggguguucugcggcggcgccggcgccucgggcaggcgcacgugcagccacgccccgccgguc

SEQ ID NO: 4236463 - RNA, 58 nt, Mycobacterium avium subsp. paratuberculosis
aucaggucgucgccgggccgcucgcggcgcuggguggccaggucgccgacgaccuggu

SEQ ID NO: 4236464 - RNA, 61 nt, Mycobacterium avium subsp. paratuberculosis
gcccagcagacgcaaaagcccccgacacgccggggagucgggggcuuuugcgucugcucgc

SEQ ID NO: 4236465 - RNA, 70 nt, Mycobacterium avium subsp. paratuberculosis
gugaggaucgguuucgacggcgacagcgcauugaccgcgaugcgauggucggcgagaucguaugccacac

SEQ ID NO: 4236466 - RNA, 75 nt, Mycobacterium avium subsp. paratuberculosis
ucccaccgcguccguaacgucagggcgauuuucgggucgaauucccgccguggcguuacgggcgcggcgaggcga

SEQ ID NO: 4236467 - RNA, 62 nt, Mycobacterium avium subsp. paratuberculosis
gccucgaggaccuggauucggcgcugaaggaaaccagccagcugaaccugauccucaagggc

SEQ ID NO: 4236468 - RNA, 55 nt, Mycobacterium avium subsp. paratuberculosis
ucgaugaugccccgcacgauuuugccguugagcaggucgucguaggcgucguuga

SEQ ID NO: 4236469 - RNA, 56 nt, Mycobacterium avium subsp. paratuberculosis
uucagggucucgccgaucaccccgccgauccggucggugacggccugaccgcugga

SEQ ID NO: 4236470 - RNA, 55 nt, Mycobacterium avium subsp. paratuberculosis
gccguggugguuagcggcaugauggggugaugucuucuccggugaccaccacggc

SEQ ID NO: 4236471 - RNA, 65 nt, Mycobacterium avium subsp. paratuberculosis
ggcgacggugucggcguuggcgguccacagcucgucgucgggaaccggcggcccgacccgcagcc

SEQ ID NO: 4236472 - RNA, 68 nt, Mycobacterium avium subsp. paratuberculosis
guggaagaccaggucgauguugccgauggugacgacgucgccgucgcgcagcacggccgaaucgacac

SEQ ID NO: 4236473 - RNA, 94 nt, Mycobacterium avium subsp. paratuberculosis
uccagcucgucggccugcucgagcauguucgccauggugucguucaugaacuuggccgucugcagcgugcccgaguucugcauggcgaucugga

SEQ ID NO: 4236474 - RNA, 84 nt, Mycobacterium avium subsp. paratuberculosis
gccgcaucucuaccgcgagcagacacaaaagcccauucccagcggcgugucggggggcuuuugcgucugcucgcggugggcggc

SEQ ID NO: 4236475 - RNA, 57 nt, Mycobacterium avium subsp. paratuberculosis
ucgagcuugucaacgguguauaucuacggcauagaucuacuacugucaacagcguga

SEQ ID NO: 4236476 - RNA, 69 nt, Mycobacterium avium subsp. paratuberculosis
gcgaacgaggucggccggcaccaguucggugagagcuuucgcuggguggugcuggccgaccccgaaggc

SEQ ID NO: 4236477 - RNA, 82 nt, Mycobacterium avium subsp. paratuberculosis
ggccgguacgaaaaggacuaugccaccuacggauacgaauucgguacugucgcaucccgcaugucgcucuucgacgccagcc

SEQ ID NO: 4236478 - RNA, 128 nt, Mycobacterium avium subsp. paratuberculosis
ggcgccugccgccagcccagccgcgggugguccaccuggccgguggcgcugucgacggugccgccgaucgcgacgccgauccacagcggccgccggcggugccagcgucgcagguagcggcgggcgcu

SEQ ID NO: 4236479 - RNA, 61 nt, Mycobacterium avium subsp. paratuberculosis
guuuuuggccggcgugcacgggcguuccggaguaggucgcaccguucacccggccgacggc

SEQ ID NO: 4236480 - RNA, 68 nt, Mycobacterium avium subsp. paratuberculosis
cccgguguucggcuucggcgucaucuucggcgccaucugggccgaagaagccuggggccgguacuggg

SEQ ID NO: 4236481 - RNA, 130 nt, Mycobacterium avium subsp. paratuberculosis
ucggguggcucgggcggcggucacguucccacgcccggugccgguggcucgggcggcggucauguucccacgcccggugccgguggcucgggcggcggucacguucccacgcccggugccgguggcccgg

SEQ ID NO: 4236482 - RNA, 86 nt, Mycobacterium avium subsp. paratuberculosis
gccgagaacuccucgaauguggugugcccggugcaucugggccugaugcagggggccauggaaaccuggggcgcgccggucucggu

SEQ ID NO: 4236483 - RNA, 65 nt, Mycobacterium avium subsp. paratuberculosis
gaggggucggccugggugaugauccacagcacggcgcaguggcucaacggcccggccaccaccuc

SEQ ID NO: 4236484 - RNA, 95 nt, Mycobacterium avium subsp. paratuberculosis
gggcggcgaucggcaucaaccugugguugcuggcgcucaugcgccgagauuacccgggcugacagcgcgggcaccacagggugguccggccgccc

SEQ ID NO: 4236485 - RNA, 55 nt, Mycobacterium avium subsp. paratuberculosis
gcccgcgacgacggugucggcgacaugggccucgaccgaaucgucguugugcggc

SEQ ID NO: 4236486 - RNA, 60 nt, Mycobacterium avium subsp. paratuberculosis
gccggcccgauccagcaccgcgcccgcgacgcgcagcgcgguguccgggaucgggacggc

SEQ ID NO: 4236487 - RNA, 59 nt, Mycobacterium avium subsp. paratuberculosis
gccagccacccggugacgucgauguuccugacgcuguccaucaucaccgggcugcuggc

SEQ ID NO: 4236488 - RNA, 82 nt, Mycobacterium avium subsp. paratuberculosis
gcugucggcccuggcgguguuccagacccgcucgacgcgaaucaucgguucggggaucgacgaauaccgccggaucggcagc

SEQ ID NO: 4236489 - RNA, 90 nt, Mycobacterium avium subsp. paratuberculosis
cuggaucagguacggcguggcgaugguguugucgacgaucagcggcacgccguuggcgugggcgacgcccgagacgccagggauguccag

SEQ ID NO: 4236490 - RNA, 64 nt, Mycobacterium avium subsp. paratuberculosis
cgcguuguacggcgugauggcggugacgacgccgacggguucgugccgccgcacgcucagcgcg

SEQ ID NO: 4236491 - RNA, 74 nt, Mycobacterium avium subsp. paratuberculosis
gcaggaugguggcguuguucugccgcggcaccacgaugugcaggccguuggccaccgcgccgccgaucaccagc

SEQ ID NO: 4236492 - RNA, 99 nt, Mycobacterium avium subsp. paratuberculosis
cucauucggccgcagugccccugguccggcuggccgaaaacgcagcaaggucacuugggcgauucugccagccggccgcgggaguguccgcugaagaag

SEQ ID NO: 4236493 - RNA, 123 nt, Mycobacterium avium subsp. paratuberculosis
uguuggggaaguagcccuccagggugcggccguugagguugaacuugccggugcccggcaccagccgcacccgcaccacggccuccuugcggcggccgacggucuggaugggccgcucgaaca

SEQ ID NO: 4236494 - RNA, 95 nt, Mycobacterium avium subsp. paratuberculosis
ccgcggugacgucgacguugagcuggucggcgaugacgugcgacggcaucagcguggucgcggugaacagcugguuguagucgacgaugccgcgg

SEQ ID NO: 4236495 - RNA, 78 nt, Mycobacterium avium subsp. paratuberculosis
gcaugggcuccgucccgaggugcucggcgaguucgucacccacggugacgucgccgaccgccucaccgucgcccaucc

SEQ ID NO: 4236496 - RNA, 79 nt, Mycobacterium avium subsp. paratuberculosis
gccccgaaucucagcgguccugcugcauggucgcccacaaaccggcggcaugcaguuuggacacguccacuuccauggc

SEQ ID NO: 4236497 - RNA, 77 nt, Mycobacterium avium subsp. paratuberculosis
augcgcggcugcgcggcacgguccgguugcgcaucaucuacgccaacggccgcggcgugcugcgcgagcugcugcgu

SEQ ID NO: 4236498 - RNA, 66 nt, Mycobacterium avium subsp. paratuberculosis
cggccgggugugcgggaccgccaucggcacggugcccaggccgauggucuggcgcacgcccagccg

SEQ ID NO: 4236499 - RNA, 82 nt, Mycobacterium avium subsp. paratuberculosis
cggccccuaccgccgagcgugaaguuaacuucacgcucgcgugcgaacgugaaacuagcuucacguucggcgagugaggccg

SEQ ID NO: 4236500 - RNA, 57 nt, Mycobacterium avium subsp. paratuberculosis
caggucuuccagaaggcggucgaauacuccgacgucgaccugaccuucuacgaccug

SEQ ID NO: 4236501 - RNA, 55 nt, Mycobacterium avium subsp. paratuberculosis
ccgcguucaccgaucccggcuacuacgugcggauggcccggaucgccgaacgcgg

SEQ ID NO: 4236502 - RNA, 63 nt, Mycobacterium avium subsp. paratuberculosis
ccgccggugucgcgaaaacacuuguggggcaugaucuucccagugcccugcugcgcgccgggg

SEQ ID NO: 4236503 - RNA, 106 nt, Mycobacterium avium subsp. paratuberculosis
gcgccugggccauccgcuggcggaccgccccgacgguguggcuguguuccggggacgcggccccgccgucggggaaguugaucagcacccggaucgggcccagcgc

SEQ ID NO: 4236504 - RNA, 61 nt, Mycobacterium avium subsp. paratuberculosis
gagcucuuguccgacgcgucgcggcgcucccccggcgugaacgucucggagaagaccguuc

SEQ ID NO: 4236505 - RNA, 70 nt, Mycobacterium avium subsp. paratuberculosis
cgcaauuggugacgacggcgcucaacccggagaucgugcgccaguugaucgccgacgacgucaccaagcg

SEQ ID NO: 4236506 - RNA, 56 nt, Mycobacterium avium subsp. paratuberculosis
gcugagccgcaccgccacgguguggcaccugugcacgccgaucagcgggcggcugc

SEQ ID NO: 4236507 - RNA, 71 nt, Mycobacterium avium subsp. paratuberculosis
ggccgccucgcugguggccgcggugcugacggcgucggccgucggcuccgcgaucaccgccgaccucggcu

SEQ ID NO: 4236508 - RNA, 63 nt, Mycobacterium avium subsp. paratuberculosis
ccggagccaaccugucagccugggcaucgcacgggaugcucgagcgggggggcuggcaucugg

SEQ ID NO: 4236509 - RNA, 57 nt, Mycobacterium avium subsp. paratuberculosis
ggugauugguggcgguggcgucgaugaagaccagcgagccgcccggcgccaguaacc

SEQ ID NO: 4236510 - RNA, 62 nt, Mycobacterium avium subsp. paratuberculosis
uacgggaugcucagcucgcggaagaugucgucccagaacccguccgacagcagcaucucgug

SEQ ID NO: 4236511 - RNA, 82 nt, Mycobacterium avium subsp. paratuberculosis
ucgcccagcgcgggcagcggcugauuuugcgggccgcccggggugcggccccggccgucgccguagagcagucccgggguga

SEQ ID NO: 4236512 - RNA, 56 nt, Mycobacterium avium subsp. paratuberculosis
gagaaccaguccucgggcgucauccccaucaugaagcugcuggaggacucguucuc

SEQ ID NO: 4236513 - RNA, 88 nt, Mycobacterium avium subsp. paratuberculosis
cgaccggcucgaaggcgucaucacgguggagaucgcggcggacaagaucaccaauuucuacgugaugcgcaacccgcacaagcuggcg

SEQ ID NO: 4236514 - RNA, 64 nt, Mycobacterium avium subsp. paratuberculosis
guugucgcgcugggcgaugucgugggugagcaccacccgcgagccggugcccagccgggacagc

SEQ ID NO: 4236515 - RNA, 69 nt, Mycobacterium avium subsp. paratuberculosis
ggacaccggcgucacgaucgggacgacgaacucuucgaucaucgcccgcucgucggccucgucgugucc

SEQ ID NO: 4236516 - RNA, 96 nt, Mycobacterium avium subsp. paratuberculosis
guccagcagcgucaugcccgguuugagguccagcuuguccagguugaggucgaucuuggcguacugcgccucuuccaggcucaugucgucgcgcgc

SEQ ID NO: 4236517 - RNA, 64 nt, Mycobacterium avium subsp. paratuberculosis
ggugacgguuuggucgacgaaaaccaaagccaccgcgugguuuucggcgaccgagaccgaugcc

SEQ ID NO: 4236518 - RNA, 56 nt, Mycobacterium avium subsp. paratuberculosis
gccggggucaggcaugcggguaacuuuacaguaagcaauccaguaugugacccugc

SEQ ID NO: 4236519 - RNA, 85 nt, Mycobacterium avium subsp. paratuberculosis
gguguuguggaacggcggcaucagcuucggcggcgugaucgcguucaucuacgccgaccugcugauccugccgauccugaacauc

SEQ ID NO: 4236520 - RNA, 65 nt, Mycobacterium avium subsp. paratuberculosis
gaucaaggugcucgucaagcagauucagugcuacugaacguagggcauuguuggcggcacugauc

SEQ ID NO: 4236521 - RNA, 93 nt, Mycobacterium avium subsp. paratuberculosis
gcuacagcgccccguggucaccaucaguugccacgacgaccucaccagcuccgaccucgucgggcgcuucauggugaccggcggcgacguggu

SEQ ID NO: 4236522 - RNA, 60 nt, Mycobacterium avium subsp. paratuberculosis
gaccucuucggcggccgagcgggacagcggccugaucacgcucagcgcgccggugagguc

SEQ ID NO: 4236523 - RNA, 58 nt, Mycobacterium avium subsp. paratuberculosis
gggugccagcugggagggcggcuggcggugcggcgaagucguccugucacugguggcc

SEQ ID NO: 4236524 - RNA, 91 nt, Mycobacterium avium subsp. paratuberculosis
ucggauaacgagaccguggaugcggugacuuucgaucugcgcuggaaagcagcgugcggguugccgaucacggcgggcgcguuucauucga

SEQ ID NO: 4236525 - RNA, 61 nt, Mycobacterium avium subsp. paratuberculosis
gaugugcagcgcgucggcgaguuggccguugcgggucaacuccacgccggccugcaguauc

SEQ ID NO: 4236526 - RNA, 93 nt, Mycobacterium avium subsp. paratuberculosis
gcgccggcacaaguggacccggcugggcgccuacgcgcaguccaagcucgcggucaugcugugggggcucgagcuggaccgccggcugcgcgc

SEQ ID NO: 4236527 - RNA, 56 nt, Mycobacterium avium subsp. paratuberculosis
gaaccccgccgauuuccuggugcugcaucgacuugccaagggaguauucgggguuc

SEQ ID NO: 4236528 - RNA, 81 nt, Mycobacterium avium subsp. paratuberculosis
gguguccucgccggcggcgugcgcggccugcgccuccugacucagguguucgcggcugaccacgcugucuuggugaucgcc

SEQ ID NO: 4236529 - RNA, 62 nt, Mycobacterium avium subsp. paratuberculosis
cgccgagcgucacgcuggcgugacgccagagcccgacggucacgcuggcgugacgcucgccg

SEQ ID NO: 4236530 - RNA, 130 nt, Mycobacterium avium subsp. paratuberculosis
cgacaacgccucauggaccuggcgaacggucugagguucggggguggaccacaggugguccaugacggcccguuccagaucccccagccgugucaguuuggccauaguucguuccaucuccugagcgucg

SEQ ID NO: 4236531 - RNA, 84 nt, Mycobacterium avium subsp. paratuberculosis
gggaugcggugcgaguggguggccagauccguuugcgaauaccgcucuucguagaacagggucugccacuggcgcaccaugccc

SEQ ID NO: 4236532 - RNA, 130 nt, Mycobacterium avium subsp. paratuberculosis
gcacgcggccagguuguccgggcucggcguggcacucuuggccgcgacgagcauggccccaccccacuggccgucguugcgccgguaggcgcgcgccccgaacccggcguuguuguccuggcacgucaac

SEQ ID NO: 4236533 - RNA, 67 nt, Mycobacterium avium subsp. paratuberculosis
ucgcgcugaaguuacucaccgacaacuaugccgacgaugaaaaguuucgugagcgauuucugcgcga

SEQ ID NO: 4236534 - RNA, 57 nt, Mycobacterium avium subsp. paratuberculosis
uggccaccagaucgacgccgcgccgggaugcuucgucgaacgcgauuucgguggcca

SEQ ID NO: 4236535 - RNA, 62 nt, Mycobacterium avium subsp. paratuberculosis
cgccggugaucgcgguccgccgaugcgcaaugucgucgcggcggcggccggcgaucucggcg

SEQ ID NO: 4236536 - RNA, 56 nt, Mycobacterium avium subsp. paratuberculosis
ggucggcgaugccgucggcgaguuuggccaccgagucgaugacggcggugccggcc

SEQ ID NO: 4236537 - RNA, 55 nt, Mycobacterium avium subsp. paratuberculosis
agauggcgccgccggauccgucgguaacccgcaucgacgggccguggcgccaucu

SEQ ID NO: 4236538 - RNA, 58 nt, Mycobacterium avium subsp. paratuberculosis
gcugggcaccgugccgugaugcugcagcuggaaccacagcaugaagccggugcucagc

SEQ ID NO: 4236539 - RNA, 63 nt, Mycobacterium avium subsp. paratuberculosis
ggaacucgcccgcaaccacgacgcggucgucgcguugggcgucgugauccgcgggcagacacc

SEQ ID NO: 4236540 - RNA, 68 nt, Mycobacterium avium subsp. paratuberculosis
cggccuucagcgcggucaccuggcgguguugcgagacgccgccgaagaucgugcugacccgcaggccg

SEQ ID NO: 4236541 - RNA, 97 nt, Mycobacterium avium subsp. paratuberculosis
ggcccugcggaaucgugugcugcccguaaccgucgugcugguugguccgcaccugcgccaccgggcgguugaccggcagcugcgcgaaguuggggcc

SEQ ID NO: 4236542 - RNA, 61 nt, Mycobacterium avium subsp. paratuberculosis
acuucccguauguguuccucgacgccacuuacugcaaggcucgggucaaccaucggguggu

SEQ ID NO: 4236543 - RNA, 73 nt, Mycobacterium avium subsp. paratuberculosis
guccagcagcgcggccagcagcgcgugggaguuggccaccagcccggcgaucugcuggcugcgccggcccagc

SEQ ID NO: 4236544 - RNA, 58 nt, Mycobacterium avium subsp. paratuberculosis
ccgagcgucacgccagcgugacgcgcgccgccgagcgucacgccagcgugacgcucgg

SEQ ID NO: 4236545 - RNA, 130 nt, Mycobacterium avium subsp. paratuberculosis
gcggcuucgcgcaccugccgguugcugcugucgagcucgggcagguaccggcggcggcccagcaccgucgagguguagccguccuugcgggccuguucgacgacggcgugcagguagucgcgcaccccgc

SEQ ID NO: 4236546 - RNA, 121 nt, Mycobacterium avium subsp. paratuberculosis
gcgucuggaucuaaggucgccaucgcaccgcgagcagacgcaaaaacccccaauucuucggcgugucgggugguuuugcgucugcucggcggcucaggggaucucggggaucagcagaugc

SEQ ID NO: 4236547 - RNA, 56 nt, Mycobacterium avium subsp. paratuberculosis
gcuguggcuggacgaacgccgcgccgcgcuggugcggcucgcgcccggcuacgagc

SEQ ID NO: 4236548 - RNA, 63 nt, Mycobacterium avium subsp. paratuberculosis
uguaaucgguugccucguuuacgaaccggcgcccgugcugguccacgaucaggcagcccggca

SEQ ID NO: 4236549 - RNA, 64 nt, Mycobacterium avium subsp. paratuberculosis
gcgcgagcagacgcaaaagccccugaugcgcggcgugucgcggggcuuuugcgucugcucgcgc

SEQ ID NO: 4236550 - RNA, 56 nt, Mycobacterium avium subsp. paratuberculosis
uugaucaccgcgguuuccagcucgccgucgcgcagcuggaugaucucggugaugag

SEQ ID NO: 4236551 - RNA, 74 nt, Mycobacterium avium subsp. paratuberculosis
cggcggcggguugaccggggccaagaccgucagucucggcgggcuggcgaccgacugguccacguccgccgccg

SEQ ID NO: 4236552 - RNA, 122 nt, Mycobacterium avium subsp. paratuberculosis
uacaccugcgggcugaaccgccgguugagccgcaguuccucgucgcagucggcgcggcguugcucgaugcuggugaagucgaggaagcccagguucaccggcuucuucagcuuguaggcgua

SEQ ID NO: 4236553 - RNA, 127 nt, Mycobacterium avium subsp. paratuberculosis
gcuggcccugcgccaguacagcggcgaguuccugcggcugcugucgaacaucaccuggggcaacgggucgaucguggugggcggcggcaccgcgggcguggccguggugcuggggaugacggucggc

SEQ ID NO: 4236554 - RNA, 63 nt, Mycobacterium avium subsp. paratuberculosis
gucgccggccaggccggccugccggaugccgcgcggcgccagcggccgaucauggucggcgac

SEQ ID NO: 4236555 - RNA, 115 nt, Mycobacterium avium subsp. paratuberculosis
cgugaacgcccuggacgcggggcccggggcgcgguucuagacugucugcgugccgaaacugcagcuuguccaagagccggccgccgacgcccugcuggacgagaacccguucgcg

SEQ ID NO: 4236556 - RNA, 130 nt, Mycobacterium avium subsp. paratuberculosis
ccgaggaacauguugcgcagcaucuguucggugacucgcggggugcgcgaguagccgaugaaauaggugccguauucgcucuugccgaguucgccgaagggcauguugugccggacgauuuucagcucgg

SEQ ID NO: 4236557 - RNA, 68 nt, Mycobacterium avium subsp. paratuberculosis
gucugccagcgcggcagcacgccgauugccgucuccagagcgggaaucggcccgcugccgucggagac

SEQ ID NO: 4236558 - RNA, 74 nt, Mycobacterium avium subsp. paratuberculosis
cgcugaucgcauggucggccgacgacguguucuucgcgcaggaggacggcgcgcggcuggccgcgacgaucccg

SEQ ID NO: 4236559 - RNA, 64 nt, Mycobacterium avium subsp. paratuberculosis
gggcgcgcugugggguccggcgucgggcgcacgcuaccucgauccgcugggccuggucgcgucc

SEQ ID NO: 4236560 - RNA, 70 nt, Mycobacterium avium subsp. paratuberculosis
ggccgguggugacggcgcccuguucagcuuccuggccggcgccaaacacagcgucgucgccgaccccgcc

SEQ ID NO: 4236561 - RNA, 71 nt, Mycobacterium avium subsp. paratuberculosis
gucgggguugucgaacgccucgggcggcagguagaagaagucgucguucuucgacgcgucgaagcucugac

SEQ ID NO: 4236562 - RNA, 57 nt, Mycobacterium avium subsp. paratuberculosis
ccgggagaacgcggccgcggcguugcgguccggcggcguggugaucguguuccccgg

SEQ ID NO: 4236563 - RNA, 74 nt, Mycobacterium avium subsp. paratuberculosis
cggugccuugacguggugcgacugcuccggaucacgaccgacucgcccgcggucgaagccacgucgacgcggug

SEQ ID NO: 4236564 - RNA, 80 nt, Mycobacterium avium subsp. paratuberculosis
cgccaaccccagccggucaggagacuuucguccccaaccgcaaggacgacagaccuuccucggccgcucgcgaaguggug

SEQ ID NO: 4236565 - RNA, 70 nt, Mycobacterium avium subsp. paratuberculosis
ccgccgccgccagcaccgcgcugugcguggcgcugggggugccgauggcgcuggugcuggcgcgcggcgg

SEQ ID NO: 4236566 - RNA, 61 nt, Mycobacterium avium subsp. paratuberculosis
ggugauccgcagcggccgcaugcugcgccaguacgacgacaugaucugcgagcgguucacc

SEQ ID NO: 4236567 - RNA, 84 nt, Mycobacterium avium subsp. paratuberculosis
gcggucucgcgucgagcgugggggguaugcacgauucgggccgcgguuucauccaugucccccacguucggcgaacggaaucgc

SEQ ID NO: 4236568 - RNA, 108 nt, Mycobacterium avium subsp. paratuberculosis
gucgccgccgcgcgacgccgacacccgggccgagguggucggcggcgaguaccgcagcgcguugucgaucagcucggcgaacagguggauggcgccgccggcggccgc

SEQ ID NO: 4236569 - RNA, 105 nt, Mycobacterium avium subsp. paratuberculosis
cgccggcuuccugcggaucuggggugcggcgcugacccugaucaucauugucgcggugaucaacgucaucgccgcggccacccgauuccuggccggucgccggcg

SEQ ID NO: 4236570 - RNA, 100 nt, Mycobacterium avium subsp. paratuberculosis
gcggcgaucggggccagcgugcugggcgcggugguggccgccaucggcauggcgcacgccgucgcgcccaccacccuggcgguccugauguugcugccgc

SEQ ID NO: 4236571 - RNA, 67 nt, Mycobacterium avium subsp. paratuberculosis
cggcgugcgggucgacucgucgcugcugcccggcaccguggugggcagcgacuacgacccgaugcug

SEQ ID NO: 4236572 - RNA, 102 nt, Mycobacterium avium subsp. paratuberculosis
ggcggccaacgccggcgccaccgaggugcgcaccgucagcgaggaguucaccgccgcgauguucggcuggccggugcgcaccuucgaggccucggugccgcc

SEQ ID NO: 4236573 - RNA, 57 nt, Mycobacterium avium subsp. paratuberculosis
cuguccggacaggcggccgacccguucaagauuccgcccggcacggcuucgggacag

SEQ ID NO: 4236574 - RNA, 57 nt, Mycobacterium avium subsp. paratuberculosis
gcgucauuuaagcuggugcuccccgggaaucggacaggagaucaccgcagauggcgc

SEQ ID NO: 4236575 - RNA, 60 nt, Mycobacterium avium subsp. paratuberculosis
cgggccgucgccgaggcauucgacggcgccaccgucucgguggccauccacgacggccug

SEQ ID NO: 4236576 - RNA, 69 nt, Mycobacterium avium subsp. paratuberculosis
ccccgcgggggguaggagguuaugccaugucggacgcgaaucuggccgccguccuugcccugugcgcgg

SEQ ID NO: 4236577 - RNA, 99 nt, Mycobacterium avium subsp. paratuberculosis
cgaccgcucgggucgucgggguugggccgggucagcucgucgauguagggccggugcagguuguccggccgcaccccgaagucgcgcucgaguucgucg

SEQ ID NO: 4236578 - RNA, 108 nt, Mycobacterium avium subsp. paratuberculosis
ggacgcggcuggucccggccacgaucgaacgcagcaccuacguggugcuguccagcgccgugcuggugcugcuguacuggcaguggcggacgaugccggccgugaucu

SEQ ID NO: 4236579 - RNA, 63 nt, Mycobacterium avium subsp. paratuberculosis
cgacgcagggcgaggcguucaccgcggauggcaaugacauucgacgugacguuccccugcccg

SEQ ID NO: 4236580 - RNA, 72 nt, Mycobacterium avium subsp. paratuberculosis
guagcucgcuggaaaagauggguccgguccgugaaaaugggccgggcccaucgcuuuucugggaucgccugc

SEQ ID NO: 4236581 - RNA, 83 nt, Mycobacterium avium subsp. paratuberculosis
cgacgucgcugaagucgugugagaaggccagguaggcgacgccgucggugucgaccgccgccuucugcaggacgucgaggucg

SEQ ID NO: 4236582 - RNA, 64 nt, Mycobacterium avium subsp. paratuberculosis
gcggcgagaagggcaccgccaagucgacggccgugcgcggccuggcggcccugcuguccgccgc

SEQ ID NO: 4236583 - RNA, 79 nt, Mycobacterium avium subsp. paratuberculosis
agccgcaaguuuuucugcauucgaaaguacuauuucaggauuucugaaguaucuagaugaauucagugagaauucgguu

SEQ ID NO: 4236584 - RNA, 70 nt, Mycobacterium avium subsp. paratuberculosis
gccuccgccgagcgugaaguuagcuucacggucggggccgagcgugaagcuaacuucacgcucggccggc

SEQ ID NO: 4236585 - RNA, 55 nt, Mycobacterium avium subsp. paratuberculosis
gacggugcugaucgucgcgcacggcaacucgcugcgcgcccuggucaagcaccuc

SEQ ID NO: 4236586 - RNA, 73 nt, Mycobacterium avium subsp. paratuberculosis
caggucgccgaugucgucggugugguagcugccgaugccgguguagaagaccaucgcgaugucggugacgcug

SEQ ID NO: 4236587 - RNA, 82 nt, Mycobacterium avium subsp. paratuberculosis
ggugauagccgaugugcguucgguauucgacaacgucgucugcguggacgacggcagcaccgacgacaccggcgaaaucgcc

SEQ ID NO: 4236588 - RNA, 81 nt, Mycobacterium avium subsp. paratuberculosis
ggccguguccgaucagcaggucgaugcgguugcgcaucaacugguugcgcaccacgucgaucuccuugccgaucacgugcu

SEQ ID NO: 4236589 - RNA, 82 nt, Mycobacterium avium subsp. paratuberculosis
ccggcguccuuggccgccuucucgaccgcggccgagccggccagcacgaucaggucggccagggagaucuucuuaccgccgg

SEQ ID NO: 4236590 - RNA, 96 nt, Mycobacterium avium subsp. paratuberculosis
ggcgacguugccggcgaacuggacgauuuguucguugcuggacgacagcgcguugaccaguaucugcagguucuucaccgugccgaagaugucgcc

SEQ ID NO: 4236591 - RNA, 105 nt, Mycobacterium avium subsp. paratuberculosis
ggucgguggcccgguucgccgcgccggugguggcgguggccaccgggcugggcgccgcggccaccgcgaucaucggcuaccugcagugcgagcgggugcugcgcc

SEQ ID NO: 4236592 - RNA, 58 nt, Mycobacterium avium subsp. paratuberculosis
cgacggcuccaagcggacgaucucuucgaugaaaacccuugucugcuuuggguugucg

SEQ ID NO: 4236593 - RNA, 60 nt, Mycobacterium avium subsp. paratuberculosis
gugucgucggugguguccauccucgucccaucgcgucggcgggcaugcaucgggcgacac

SEQ ID NO: 4236594 - RNA, 103 nt, Mycobacterium avium subsp. paratuberculosis
ccgaugugcccguccggcagcucgcuggcggucuccgggucgacgaugaccgcccacucgucgacgccgaugacgccggcggacaccugggccaccgcguugg

SEQ ID NO: 4236595 - RNA, 60 nt, Mycobacterium avium subsp. paratuberculosis
gucccgcuggucggcgucuucgaggucggccgcgaucccgaacgccgaaccaccggcggc

SEQ ID NO: 4236596 - RNA, 89 nt, Mycobacterium avium subsp. paratuberculosis
ggauggggucgaucggaugcggcaccgcggcuucggcgcgcgaccaggacgccagccaggcaucgucgggccgcccggucagcaccacc

SEQ ID NO: 4236597 - RNA, 57 nt, Mycobacterium avium subsp. paratuberculosis
gcgcgccgucgggcaacgggugcacgacggccgucgcagucguauccggcggcgggc

SEQ ID NO: 4236598 - RNA, 64 nt, Mycobacterium avium subsp. paratuberculosis
gcugaucggcgggucgaacgucuugagcacggacagggcggcgacgucgacccggccgaucggc

SEQ ID NO: 4236599 - RNA, 93 nt, Mycobacterium avium subsp. paratuberculosis
ucgccgcggucggcaccgucgagaucagcgugugcagauacggcgcaccgccgaugcggcgcagcagauuacggcgguccagcuccgcggcga

SEQ ID NO: 4236600 - RNA, 61 nt, Mycobacterium avium subsp. paratuberculosis
guaccggucaguccguccgcggugucgaucgaauuggccgacggguuggggcugccggugc

SEQ ID NO: 4236601 - RNA, 62 nt, Mycobacterium avium subsp. paratuberculosis
uguugaagaagacgcccauguuggugaacauccacaauccggggugggcgucgaauucgacg

SEQ ID NO: 4236602 - RNA, 129 nt, Mycobacterium avium subsp. paratuberculosis
uggcgcuguacuucguggcgugcucgcgcggccgggucgccgcgcggugaccgcgcucagccggugugcgcgccggcgcggugccguauacccgccccggcccguucuagcggagcccggucagcgcca

SEQ ID NO: 4236603 - RNA, 60 nt, Mycobacterium avium subsp. paratuberculosis
cggguggacgaacagucgcuggacgcggcacucgucgcgcugggcgacuucgucgaccug

SEQ ID NO: 4236604 - RNA, 55 nt, Mycobacterium avium subsp. paratuberculosis
ugcuggucggguauugcgcgggcuggcugcccugguucgccgacaucgaccggca

SEQ ID NO: 4236605 - RNA, 63 nt, Mycobacterium avium subsp. paratuberculosis
ccgggauggucgugcucggcggcuucgaucagcgccgggucgacgucgacgccgaccaccugg

SEQ ID NO: 4236606 - RNA, 124 nt, Mycobacterium avium subsp. paratuberculosis
cgccgugcucgccgaccgguccaccgccgcgcuguauguccgugucggugaggaucugcauccggugcucaaccugaccucggcccgacugaucacgggucggccgguggacccgaccauggug

SEQ ID NO: 4236607 - RNA, 57 nt, Mycobacterium avium subsp. paratuberculosis
cggccggcgaucucggcggcgguggccuugacggccgccucgucgauaucgcugacg

SEQ ID NO: 4236608 - RNA, 71 nt, Mycobacterium avium subsp. paratuberculosis
cgccggugccgaacucgacgcggccguuggacagcagguccaggguggcgaugcguucggcgacccgggcg

SEQ ID NO: 4236609 - RNA, 72 nt, Mycobacterium avium subsp. paratuberculosis
agcgccgcgcggugugggugaccgcggccaccaacggaucgucggcgugcgcaccgccggagaagagacgcu

SEQ ID NO: 4236610 - RNA, 102 nt, Mycobacterium avium subsp. paratuberculosis
ucgccgaggccuaggucccgccgcgagagugcaacuagcgacggccguucucgggaaaugcgucgccaguugcacuuucggcagcugaagugcacucggcga

SEQ ID NO: 4236611 - RNA, 81 nt, Mycobacterium avium subsp. paratuberculosis
ggcgcgccgcccggcgcggucagcucgccgggcgcccuacaccgccagccucaugagguggccgcgcccaucguggcggcc

SEQ ID NO: 4236612 - RNA, 64 nt, Mycobacterium avium subsp. paratuberculosis
ggcggucggcgggucaggcgagcagcgccgcgcgcaggcguugcacgucugccucgccgacccc

SEQ ID NO: 4236613 - RNA, 98 nt, Mycobacterium avium subsp. paratuberculosis
cgauguccucgauggcgaugcgccgcugcccggucuggaugaugcucagguagcgcaucagcucuucgaccgcgguggcgaugaccuuggggucgucg

SEQ ID NO: 4236614 - RNA, 103 nt, Mycobacterium avium subsp. paratuberculosis
cagggccagcgagcgggccgcggcgaugucggccggcccgggaugcagcaucaccgccgcggagaugucgucgaacaccccggccuugagcagcagcgccuug

SEQ ID NO: 4236615 - RNA, 88 nt, Mycobacterium avium subsp. paratuberculosis
ggcgcucaaguuccaccugcgcgaccuggcggugacguuccgguucggcgaggaggugaccgcggucgacgucgggucggcgggcacc

SEQ ID NO: 4236616 - RNA, 82 nt, Mycobacterium avium subsp. paratuberculosis
gcgguucaguucguucgacgacaccccgguggccucggccagcaucggccaggugcacaagggggugugguccgacggccgc

SEQ ID NO: 4236617 - RNA, 63 nt, Mycobacterium avium subsp. paratuberculosis
uguagccggucuuggugcguuuggucuucggcaucugaagcucgucaaagagcaccgccugca

SEQ ID NO: 4236618 - RNA, 76 nt, Mycobacterium avium subsp. paratuberculosis
ggccgagcucgccggcccggugauccagucgauggcgcagaccaccggccgggccaucggguuggacggcucggcc

SEQ ID NO: 4236619 - RNA, 96 nt, Mycobacterium avium subsp. paratuberculosis
gguacgagucgccaucgucggcgucgguaacugcgcaucuucgcucguccagggcgugcaguacuacuucgacgccgacgagaacagcaccgugcc

SEQ ID NO: 4236620 - RNA, 73 nt, Mycobacterium avium subsp. paratuberculosis
ucgccccggcugauucggcaaguucucgagggcagccgugcucuaugagauccuugacgaguuucucagguga

SEQ ID NO: 4236621 - RNA, 59 nt, Mycobacterium avium subsp. paratuberculosis
cgcagcgucgccccggugguguuggguucgggcuugaccaucgccggcgcgauguugug

SEQ ID NO: 4236622 - RNA, 99 nt, Mycobacterium avium subsp. paratuberculosis
uguugcgcaucaggaacuccagcaccccguacucgcgcggcgucagcgcgaucggcguggagccgcgcuggacggugugccgggccggauccagcgaca

SEQ ID NO: 4236623 - RNA, 61 nt, Mycobacterium avium subsp. paratuberculosis
agggcguuggcgaucagguugcccagcaccugccggaugcggggcucgucgccgaacaccu

SEQ ID NO: 4236624 - RNA, 64 nt, Mycobacterium avium subsp. paratuberculosis
cgagaagccgaucaccaggaucaggaagaccuccagccaguugguccaggcggucggauucucg

SEQ ID NO: 4236625 - RNA, 70 nt, Mycobacterium avium subsp. paratuberculosis
acgcgcagcuggcguggaucgaccgcugaccgaaccgguuagucggcggucgccaaugccgcugugccgu

SEQ ID NO: 4236626 - RNA, 83 nt, Mycobacterium avium subsp. paratuberculosis
gcagcgccacccgauagguguggaucagcgcguacaccggggaacgcugcgcggccucgauccacucgucgggaaugcccugc

SEQ ID NO: 4236627 - RNA, 107 nt, Mycobacterium avium subsp. paratuberculosis
gguccauggcgcggacuuccacgaucagcuggucggccgcggcggugucgacccacaggaugcgcggcggcgcggucgaccgggugacgggcaccccgaccuggacc

SEQ ID NO: 4236628 - RNA, 73 nt, Mycobacterium avium subsp. paratuberculosis
agcucucgacaaacugcgguagaacguguucuaguuuuggcgugagcagcccgcaauucucccgcagugagcu

SEQ ID NO: 4236629 - RNA, 98 nt, Mycobacterium avium subsp. paratuberculosis
ucggaccggcagcuguucggcaucggcaucgcggugcugguggucagcgcccugcucaccaccgugauguuggugaaaucgacuggcaggcuggacga

SEQ ID NO: 4236630 - RNA, 58 nt, Mycobacterium avium subsp. paratuberculosis
guggccgaggucgucacgaucuugugcgacaacacaauugacguucgcucucggccac

SEQ ID NO: 4236631 - RNA, 58 nt, Mycobacterium avium subsp. paratuberculosis
cagcgcggcggagaaguuguggaugaucucgccgaucugucccagcccucccccguug

SEQ ID NO: 4236632 - RNA, 78 nt, Mycobacterium avium subsp. paratuberculosis
gcgcagcccgggcguguucggcgagcugacguugaccaccagauacgacgccagcgggccgagcagccgcgcgcuggc

SEQ ID NO: 4236633 - RNA, 101 nt, Mycobacterium avium subsp. paratuberculosis
gccgggcccgaaacauguuggcgcgcuggcgauuccgcguggcgccguccgguagccgcggccgugcccgccgaucgccaucacguguccgggaccgcggc

SEQ ID NO: 4236634 - RNA, 82 nt, Mycobacterium avium subsp. paratuberculosis
cgacaccaagaccgccaucgccaucagcgcccgcaaauacgccuuccgcaagcgggugcugauggcgauggcggucguguug

SEQ ID NO: 4236635 - RNA, 63 nt, Mycobacterium avium subsp. paratuberculosis
ccaagcccggccgcagccuggagcggcucaaguccgagcugcugcugcugauggcgggcgugg

SEQ ID NO: 4236636 - RNA, 68 nt, Mycobacterium avium subsp. paratuberculosis
ccgguacgaggacauccgggcgcugaccuacaugaacggcuucaggcuggaagugcucggcuugccgg

SEQ ID NO: 4236637 - RNA, 83 nt, Mycobacterium avium subsp. paratuberculosis
ucacgcgcugggaucucaggccguugacgggggccgcgguguugcuaccgcgccgaaccgccagcgcccggguucccgguuga

SEQ ID NO: 4236638 - RNA, 77 nt, Mycobacterium avium subsp. paratuberculosis
ggcucgggcagcagaucgcgcaucagcaccuugcacgccagccgguugacaccguugaugcgcauggcguccgagcc

SEQ ID NO: 4236639 - RNA, 78 nt, Mycobacterium avium subsp. paratuberculosis
ggaaggccagccgcacgucgaggccgggccgcauccgccgaagccgaucggcgacggccucggcauuggcggccgacc

SEQ ID NO: 4236640 - RNA, 129 nt, Mycobacterium avium subsp. paratuberculosis
guagccgcacuugcugcgguguaccacccgaagcagcgcgacuucgcguauccggggcgacagcgucgaccgggugagcaaguacgcguugaacggcagguaggccgcggugaggucgggguggcggac

SEQ ID NO: 4236641 - RNA, 80 nt, Mycobacterium avium subsp. paratuberculosis
gucuucagcgcgcucaucaucugcuuggccuggucgaacugcucggggguggacaggugggugaggucgccgguguggau

SEQ ID NO: 4236642 - RNA, 70 nt, Mycobacterium avium subsp. paratuberculosis
gcucggcgcggugccgcgcgccgagcacguccgcaucucggcacugcucgacgacggcaccgugcugagc

SEQ ID NO: 4236643 - RNA, 103 nt, Mycobacterium avium subsp. paratuberculosis
cgccgcgucguggcgguugccggugguguucgucgugcagaauguccgcggcggcccggaugcccggcggugcgccuaccgguccgagacgaugcccauggcg

SEQ ID NO: 4236644 - RNA, 69 nt, Mycobacterium avium subsp. paratuberculosis
gccgaugaccgucacaugggcccggcuucccgcgucguguguggcggccagcccauugacgucgccggc

SEQ ID NO: 4236645 - RNA, 67 nt, Mycobacterium avium subsp. paratuberculosis
uggacuugauugagcgguuacacgcgggccguugaauggccucggagaauccgcucgacccgaucca

SEQ ID NO: 4236646 - RNA, 70 nt, Mycobacterium avium subsp. paratuberculosis
cgaagacguucugguccuucauccggugcgccagccauuggucgcccugggucuggaucagcgcguagcg

SEQ ID NO: 4236647 - RNA, 63 nt, Mycobacterium avium subsp. paratuberculosis
ccgccgaguccuugaccuugggcauccgcucgccgcgggugucgcccucgggguacucggcgg

SEQ ID NO: 4236648 - RNA, 110 nt, Mycobacterium avium subsp. paratuberculosis
cgaucaggacgacgacggagaccacccaggcgaucagcaucgcgggccggcgauaccagggggugggcucagccugcuggucgaacgggucgacguugccggguugcucg

SEQ ID NO: 4236649 - RNA, 78 nt, Mycobacterium avium subsp. paratuberculosis
gccgugcguguggucgccguuggagugcgugaucaccgcuuuggugaucggcgccgacgcggugaucggccgcauggc

SEQ ID NO: 4236650 - RNA, 72 nt, Mycobacterium avium subsp. paratuberculosis
ggcaaucgcauucuggugcacgcggauucgccgaucaccucggucuccgaccugcgcgggaaggcgaucgcc

SEQ ID NO: 4236651 - RNA, 61 nt, Mycobacterium avium subsp. paratuberculosis
gcugcugagcgccgccgagacgaugacguucccgcuguucgucaaggcggucgccggcggc

SEQ ID NO: 4236652 - RNA, 94 nt, Mycobacterium avium subsp. paratuberculosis
gggcaccgccgccugcgccuugcgccggaucgucggcuggucgaagaacuggccggccgcguucugggcgaucgcgaucagcgcggugcguccc

SEQ ID NO: 4236653 - RNA, 129 nt, Mycobacterium avium subsp. paratuberculosis
gguagcgggccgugacaccggcgaacagcccgccgucgccgccgccggcgccggccagcacgcccgccggcgccauguguucggcgacggccgcgaccagccggcgcacccgcgcggcgugccgcugcc

SEQ ID NO: 4236654 - RNA, 55 nt, Mycobacterium avium subsp. paratuberculosis
ccccgguggaaugcggucgcaggcaacgaguucgauugacuccagaucaccgggg

SEQ ID NO: 4236655 - RNA, 72 nt, Mycobacterium avium subsp. paratuberculosis
gcggucggcgaauggcagcagcaucgugguggcgcugaagcgcucggcgaugguguuggccaacagcaccgc

SEQ ID NO: 4236656 - RNA, 65 nt, Mycobacterium avium subsp. paratuberculosis
ggcucaacagaugucaauagugugaguucgcucgugggcuaucucacuuugaucaucucguagcc

SEQ ID NO: 4236657 - RNA, 60 nt, Mycobacterium avium subsp. paratuberculosis
acccgacgcagguggucggauuggccgcggugucaaugaaauucagccgcuuggucgggu

SEQ ID NO: 4236658 - RNA, 89 nt, Mycobacterium avium subsp. paratuberculosis
gugugaauccugggcguuucagugugcauccugggcgggccccaucggcgugucgccuaccuggcugcacacugaacgccggggcgcgc

SEQ ID NO: 4236659 - RNA, 75 nt, Mycobacterium avium subsp. paratuberculosis
gccgggcgugcuugaugacguaguugaccgccuucacgucggccaucucggcuuugaucaugaaguaggcgcggc

SEQ ID NO: 4236660 - RNA, 75 nt, Mycobacterium avium subsp. paratuberculosis
ccggaugacguugccggucaccgcguucgacgccgggcuggcgaaguaggcgaugguuucggcgacguccaccgg

SEQ ID NO: 4236661 - RNA, 92 nt, Mycobacterium avium subsp. paratuberculosis
cggcauggcgcugucgcuggaggagaaacccaagacgccgaaauccaauuacgcggugccggguuuguauuucuacgacaacgacgugaucg

SEQ ID NO: 4236662 - RNA, 86 nt, Mycobacterium avium subsp. paratuberculosis
gucaccgccaucacgccguacaacgcggcgcugaucaugggcuuucagaagcugauucccgcguugauggcgggcaauucggugau

SEQ ID NO: 4236663 - RNA, 71 nt, Mycobacterium avium subsp. paratuberculosis
ccggcgugucagccgggcccgugccggguaugccggaugcaugacaccgcggagccugcgcugagcgccgg

SEQ ID NO: 4236664 - RNA, 59 nt, Mycobacterium avium subsp. paratuberculosis
gcgcugcacgagcacauccugggcgccaacccggcggucuggauguacgccggcggcgc

SEQ ID NO: 4236665 - RNA, 83 nt, Mycobacterium avium subsp. paratuberculosis
guuggcucaccgcgccggugaucguguuguccgcccgcaccgauucgucggacaaggucgaagcgcuggacgccggggccgac

SEQ ID NO: 4236666 - RNA, 64 nt, Mycobacterium avium subsp. paratuberculosis
gacgcggcaguguggucgcauccgguucggugacggcccggaucagaaaccacgcgucgcuguc

SEQ ID NO: 4236667 - RNA, 61 nt, Mycobacterium avium subsp. paratuberculosis
accaggcguuguagaucugcaggaagauccacugcguccacuuguagaacucgacgucggu

SEQ ID NO: 4236668 - RNA, 107 nt, Mycobacterium avium subsp. paratuberculosis
gccuccgacggcacagauacuaccgcccggacggcuacccgagccgcggcugcgagcgccggcgcagcucgccgggugccgucgguggaucacgcugucgggcaggc

SEQ ID NO: 4236669 - RNA, 85 nt, Mycobacterium avium subsp. paratuberculosis
gcugcgcgcgaucgccgaggugaucggccgccggcucggcgugcccgucgaguccgccccggccgacaccuucgguccgcucggc

SEQ ID NO: 4236670 - RNA, 73 nt, Mycobacterium avium subsp. paratuberculosis
gaucgacggcgcgcgcucggucgugguggacgaugccgggcacuguccgcagaucgagcagccguccgugguc

SEQ ID NO: 4236671 - RNA, 85 nt, Mycobacterium avium subsp. paratuberculosis
guuggacacgaugguguugaacacguuccaggacaccacgucgaagccggcguugccgacguuguucaccaccggguugcccagc

SEQ ID NO: 4236672 - RNA, 69 nt, Mycobacterium avium subsp. paratuberculosis
gccggcgcugcaacgcgacgucgucgacuuugaccaccacaccgucgaucucguguugcaggucguagc

SEQ ID NO: 4236673 - RNA, 86 nt, Mycobacterium avium subsp. paratuberculosis
cgcgaugauguugcgcuguacuucgcugcugccgccguagaucgacgucuugcgauaguucagguagugcggcgcgcuggauugcg

SEQ ID NO: 4236674 - RNA, 55 nt, Mycobacterium avium subsp. paratuberculosis
ggcgaucgggccgaucgccgugcagcgccgcaacgggguggucggccuggucgcc

SEQ ID NO: 4236675 - RNA, 83 nt, Mycobacterium avium subsp. paratuberculosis
cccggcaccgaggcgcugcugccggugcugggcaccgcgcugaucaucgguggcggcgccgucaccggcgggcucgggccggg

SEQ ID NO: 4236676 - RNA, 77 nt, Mycobacterium avium subsp. paratuberculosis
cucuccccggcgagcgugaaguuaguuucacguucggcgccgagcgugaaauuaguuucacgcucggcgggaaagag

SEQ ID NO: 4236677 - RNA, 93 nt, Mycobacterium avium subsp. paratuberculosis
cgcggcacaguugcaccgugggggcgcguuugccggggaauuccuggcagggguaguugcgcgcgccgcgcacggugcucggaucguucugcg

SEQ ID NO: 4236678 - RNA, 85 nt, Mycobacterium avium subsp. paratuberculosis
ccgcucggcgcgcggcgucuacggcaucucgguggcuuccgaacuguccgggauccccccgcagacgcugcggcacuacgagcgg

SEQ ID NO: 4236679 - RNA, 57 nt, Mycobacterium avium subsp. paratuberculosis
gguuacgccgaauucgcggucucguccuucgggaccgacgccgcgaucggcgacacc

SEQ ID NO: 4236680 - RNA, 62 nt, Mycobacterium avium subsp. paratuberculosis
ugggcuucgggucgggggugguggugccgggaaccgggaucucgcugcagaaccgaggcgcg

SEQ ID NO: 4236681 - RNA, 76 nt, Mycobacterium avium subsp. paratuberculosis
gccgccccgaugcgccguccuggccgaccccggcaacggacgcgaccagucggcgcagggcgugucggggucgggc

SEQ ID NO: 4236682 - RNA, 69 nt, Mycobacterium avium subsp. paratuberculosis
gaagggcccgccgagggcgacgauguuggagaacgucuccggguccuuguagaccucgguggccucuuc

SEQ ID NO: 4236683 - RNA, 58 nt, Mycobacterium avium subsp. paratuberculosis
uuggcgauucgguugcucgacgccagcggcuugccggccucggcgccgaauccguuga

SEQ ID NO: 4236684 - RNA, 61 nt, Mycobacterium avium subsp. paratuberculosis
guacgggccguaggagucggcggugucgaugaaguucaccccgaguucgacggcccgccgc

SEQ ID NO: 4236685 - RNA, 84 nt, Mycobacterium avium subsp. paratuberculosis
cacgggccggccacgcuggucgacgccugccccugguugcccuggcugagcggguggccuucggugucgaccgcgccgaccgug

SEQ ID NO: 4236686 - RNA, 58 nt, Mycobacterium avium subsp. paratuberculosis
ggcgggaugcgcugggaauugaucugcauaagugaaucacuauucgcgucucucgacc

SEQ ID NO: 4236687 - RNA, 96 nt, Mycobacterium avium subsp. paratuberculosis
cgguacgcgauggugaucacuacaucgucaacggcgccaagaccuacaucaccuccggggugcgugccgacuauguggugaccgcggugcgcaccg

SEQ ID NO: 4236688 - RNA, 73 nt, Mycobacterium avium subsp. paratuberculosis
gcugccgggcgcgguaggacggguggcgacgcaucgcuucacugcguucccgcucgcuccgcugcgcggcggc

SEQ ID NO: 4236689 - RNA, 72 nt, Mycobacterium avium subsp. paratuberculosis
ucucggcgccggaccgcuugugcgccuugaacuucgaacccauccgcgccgccagcaggucggcgaccauga

SEQ ID NO: 4236690 - RNA, 61 nt, Mycobacterium avium subsp. paratuberculosis
gaaggugaaguuggcguuguugggcugguugguguggacggcgaugcuggccuucacguuc

SEQ ID NO: 4236691 - RNA, 59 nt, Mycobacterium avium subsp. paratuberculosis
guggcggugcacaggucccagcggaccggcugggucagcugggcgaccagcgccuccau

SEQ ID NO: 4236692 - RNA, 55 nt, Mycobacterium avium subsp. paratuberculosis
ucgugguuggcgacgugcuugagcugauacggcgacgauacgucaccgagcgcga

SEQ ID NO: 4236693 - RNA, 75 nt, Mycobacterium avium subsp. paratuberculosis
gcagcuggcucgaaauccgcaguguggcacggucuuccaugagcgccacgucguggaugucgggcaccuucgagc

SEQ ID NO: 4236694 - RNA, 56 nt, Mycobacterium avium subsp. paratuberculosis
cgucgcggcccucgaccggcagcgagugaaacagcgugcugucgaccaccguggcg

SEQ ID NO: 4236695 - RNA, 78 nt, Mycobacterium avium subsp. paratuberculosis
cggucgagcugugcucgcugaccuaccccggcuacaagccgucgcuggccgggcuggucggcagcgcccuguucgccg

SEQ ID NO: 4236696 - RNA, 124 nt, Mycobacterium avium subsp. paratuberculosis
aucgccccgaacucggcgugcucuacccgucgcaucuggccaccgggaugcggaucuacgucgaauacaacaagaacgaucccaaccugguucgggugcaacaccgcaacgccgggcuggcgau

SEQ ID NO: 4236697 - RNA, 73 nt, Mycobacterium avium subsp. paratuberculosis
ggcgcgcaggcuggcaucgucggcgccggcgcgcaacagcgucucgacggcgccgacgaugcugucgcggguc

SEQ ID NO: 4236698 - RNA, 96 nt, Mycobacterium avium subsp. paratuberculosis
cagcgccucgaccuccagcggguccagggugaucgagcgcccggucuugggggcgcugaucagcagccgugacccguugcgagucucgacccgcug

SEQ ID NO: 4236699 - RNA, 66 nt, Mycobacterium avium subsp. paratuberculosis
cauguugucgguguugaugccgaagucgucgaccaggcguuuguugguggagacggcgacgaaaug

SEQ ID NO: 4236700 - RNA, 56 nt, Mycobacterium avium subsp. paratuberculosis
cgaacgucacgccagcgugacaccggugaccgagugucacgccagcgugacggucg

SEQ ID NO: 4236701 - RNA, 55 nt, Mycobacterium avium subsp. paratuberculosis
acccggcuggcgaccuggguggccgugcccggccacaccgcgucaccggcggggu

SEQ ID NO: 4236702 - RNA, 62 nt, Mycobacterium avium subsp. paratuberculosis
gcgggcgcuacuucgagaacccgacaccggucaccggccagacguucugcgagguggcccgc

SEQ ID NO: 4236703 - RNA, 90 nt, Mycobacterium avium subsp. paratuberculosis
acgccgucgccgccgggcugaucgcgcugcgcgccugccggauuccggccgaccggugggcgugggcgcugaucgccgccggcauggcgu

SEQ ID NO: 4236704 - RNA, 55 nt, Mycobacterium avium subsp. paratuberculosis
gguggugaucccggccgagcgggccgacuucggcuggcaggucgucgacgccacc

SEQ ID NO: 4236705 - RNA, 78 nt, Mycobacterium avium subsp. paratuberculosis
cugcaccgcugcccggaacacgucggugggagcuaucgacccguugaucggcuucuccggcgugcgguaguugugcag

SEQ ID NO: 4236706 - RNA, 85 nt, Mycobacterium avium subsp. paratuberculosis
guuggcaucccgcgccugccuggccacguggucgcugaccuucuuggucagcggcaggucccaggccaggaucugggugagcgac

SEQ ID NO: 4236707 - RNA, 60 nt, Mycobacterium avium subsp. paratuberculosis
gccgaacgugcaccuacugcgacuuucgggcccgauuuucgcgcucagugcacgcucggc

SEQ ID NO: 4236708 - RNA, 64 nt, Mycobacterium avium subsp. paratuberculosis
gcugugggugggcuugaccuguuugacuuccuucuugguggagcgguccuuggccuccagcagu

SEQ ID NO: 4236709 - RNA, 92 nt, Mycobacterium avium subsp. paratuberculosis
cgcggcgcauccgcccggcggccaucuggucgcucagcagcugccgcaaaaacagcguguugcccccggugagccgccggaaccgcgccgcg

SEQ ID NO: 4236710 - RNA, 73 nt, Mycobacterium avium subsp. paratuberculosis
cgccuggaccggcagcccguccacgcucuggucgucggccgggacaagcuggauguggugcacggucgaggug

SEQ ID NO: 4236711 - RNA, 76 nt, Mycobacterium avium subsp. paratuberculosis
gaugcgccgugugccgugaacgccgcgguggccgccuccagcagccgcuggcgauugcggcgcgcguccgaccuuc

SEQ ID NO: 4236712 - RNA, 55 nt, Mycobacterium avium subsp. paratuberculosis
caccagcgcgcgcuggcacgucagcaucuggcccgacgucccaauccugcuggug

SEQ ID NO: 4236713 - RNA, 84 nt, Mycobacterium avium subsp. paratuberculosis
cgaauucgcuggcggcgcugugcgcgcgggugggcgccgacaucgacgacgucaccugcugcaugggcgccgaccggcggaucg

SEQ ID NO: 4236714 - RNA, 64 nt, Mycobacterium avium subsp. paratuberculosis
gccgccgcgaugggggugacgcuacggcccgacgaccagcuggugaccaccuaucgcggccugc

SEQ ID NO: 4236715 - RNA, 68 nt, Mycobacterium avium subsp. paratuberculosis
cguuuugcaggguggucagguuggacugcaggccgccgggccgauccauucccaucgcccgcagcacg

SEQ ID NO: 4236716 - RNA, 79 nt, Mycobacterium avium subsp. paratuberculosis
ugggucaggacggugacguguucgcgaacgagcaggucguggaacucguucggggagcgcgacaccguuucgggcacca

SEQ ID NO: 4236717 - RNA, 100 nt, Mycobacterium avium subsp. paratuberculosis
gcccggggcgacgauccagcccggcuggguguugcggugcgacgucgggguguccggcacccagauacccggcacggugguguccuuguaaccguugggc

SEQ ID NO: 4236718 - RNA, 85 nt, Mycobacterium avium subsp. paratuberculosis
ggccgccgccgggacgggcuugccgaggguggugcggaacagcugcuccagcgcuagcccggccagccccaccgggauggugccc

SEQ ID NO: 4236719 - RNA, 56 nt, Mycobacterium avium subsp. paratuberculosis
cggguugcuguccgggaugccgacgccgaaguagagguuccacggcagcaacaccg

SEQ ID NO: 4236720 - RNA, 86 nt, Mycobacterium avium subsp. paratuberculosis
cucgcgacacccuccgcucgagcgugaaguuaacuucacgcucggcgccgagcgugcaccuaauuucacgcucgggcgggcgcggg

SEQ ID NO: 4236721 - RNA, 66 nt, Mycobacterium avium subsp. paratuberculosis
gcccaggauggugcgggccugcaguucgaacgccgagagccgcuggcugcgcaccgucacccaggc

SEQ ID NO: 4236722 - RNA, 62 nt, Mycobacterium avium subsp. paratuberculosis
ucggcggacauggcggucgcccagaacgugcccgacgggcacggccaccacuacgucgccga

SEQ ID NO: 4236723 - RNA, 82 nt, Mycobacterium avium subsp. paratuberculosis
gccggcccgucgccaccgaacgugcacucacggugacguucacgcgaaauuuucgccgccagugcacguucggcgggccggu

SEQ ID NO: 4236724 - RNA, 78 nt, Mycobacterium avium subsp. paratuberculosis
gauguccguuucgggugauccaugucguucucgccgccgcgaaugaucaaggugggcaccgugauucggucgaacauc

SEQ ID NO: 4236725 - RNA, 58 nt, Mycobacterium avium subsp. paratuberculosis
gaugucgaagucacggcucagcucgccggccaaggcgaaguagucgaugcucgacguc

SEQ ID NO: 4236726 - RNA, 58 nt, Mycobacterium avium subsp. paratuberculosis
guugggguugacccugcuggucgcccugccgcuggccggcaugcggaucggcuucaac

SEQ ID NO: 4236727 - RNA, 76 nt, Mycobacterium avium subsp. paratuberculosis
cgacacgcccacgaccagcaggaaggcgccgaucauguagggcagcaggcgcuuguccuccuggcgcuggauguug

SEQ ID NO: 4236728 - RNA, 64 nt, Mycobacterium avium subsp. paratuberculosis
aucacgacgaggguggucaugacuguuugaacucuucgagggucacgguuacuccguacgugau

SEQ ID NO: 4236729 - RNA, 55 nt, Mycobacterium avium subsp. paratuberculosis
uaccggugaccgcgaaccaaccaaccaaccgguagguuaucggguaccgccggug

SEQ ID NO: 4236730 - RNA, 55 nt, Mycobacterium avium subsp. paratuberculosis
cagcgucuuggcccccugcucgcccaucacccaggccagcgcgucgacgacguug

SEQ ID NO: 4236731 - RNA, 74 nt, Mycobacterium avium subsp. paratuberculosis
gugacccgccgagcagacgugaaaucccccgacccgccgugacauugggggcuuuugcgucugcucgccgucac

SEQ ID NO: 4236732 - RNA, 55 nt, Mycobacterium avium subsp. paratuberculosis
ccgcugauccgcugcugcacgacaccggugcgcgcagcggugcgcggaucggcgg

SEQ ID NO: 4236733 - RNA, 61 nt, Mycobacterium avium subsp. paratuberculosis
gcgaacuggcgaugagccucggagcgccggcccagugccuccagcgccaucaccagcucgc

SEQ ID NO: 4236734 - RNA, 56 nt, Mycobacterium avium subsp. paratuberculosis
gucuucgucacagcacgaucgcccggcgcgcgccggcggccgugcuguggcaggau

SEQ ID NO: 4236735 - RNA, 63 nt, Mycobacterium avium subsp. paratuberculosis
gggugcggcggucgucgcugaccagcagggugcccggcucggccagcgucgccgucagcagcc

SEQ ID NO: 4236736 - RNA, 58 nt, Mycobacterium avium subsp. paratuberculosis
gggcguuggugugcugggcgcgcaucgagaugucgugcgcgcucagcagcaccugccc

SEQ ID NO: 4236737 - RNA, 81 nt, Mycobacterium avium subsp. paratuberculosis
cuggcaucugcuggccggcgacgaaucggcgcugccggccaucgccgcggcacuggaggcguugccgcccagcgcggucgg

SEQ ID NO: 4236738 - RNA, 61 nt, Mycobacterium avium subsp. paratuberculosis
gccgcggauccgcgucacggcaaacggucaauauccgcgugucggcacgcuagucugcugc

SEQ ID NO: 4236739 - RNA, 70 nt, Mycobacterium avium subsp. paratuberculosis
gauggucagccgcggcgaauggucggucagcgcgcaguauucgugaccgagcgccgccgcggcggccauc

SEQ ID NO: 4236740 - RNA, 65 nt, Mycobacterium avium subsp. paratuberculosis
gccgccgguuacucggccacgcuggccgaacugcgcggccccgcgugguccggugacgcggccgc

SEQ ID NO: 4236741 - RNA, 79 nt, Mycobacterium avium subsp. paratuberculosis
gguccgcaggauucgcagcacggaccagaugaauacccauagcaacauuaaaaauccggcgcgcgucagcugcaguacc

SEQ ID NO: 4236742 - RNA, 74 nt, Mycobacterium avium subsp. paratuberculosis
gcuguuuucaguuucuuccaggagguuuugugcgcauggcggucgaugaccucgugguggaaaccgguuacggc

SEQ ID NO: 4236743 - RNA, 100 nt, Mycobacterium avium subsp. paratuberculosis
ccccacgaucgcgucggaauacagcagcugcgucaugccguaaguggcgccgcggucgcacuugaagcugaagcggcccuguucgccgucgcgggugggg

SEQ ID NO: 4236744 - RNA, 66 nt, Mycobacterium avium subsp. paratuberculosis
guagagcacagcgaaaacgggcggcagucccggaagaccaccgcccguuuuccguugaugcgcuac

SEQ ID NO: 4236745 - RNA, 80 nt, Mycobacterium avium subsp. paratuberculosis
gcgcgccgcgcgggacggcgucgacuggcgggcacuggccgagcgcgaggugucgcuguuccgcgaagacauggccgcgc

SEQ ID NO: 4236746 - RNA, 65 nt, Mycobacterium avium subsp. paratuberculosis
guagccguggcccagcaugucgaucgaccagguccagaaauggucggcgugcgcggccagguugc

SEQ ID NO: 4236747 - RNA, 89 nt, Mycobacterium avium subsp. paratuberculosis
aacgacaaggacaucaagcaguacgcgaugucggaucugcugaucgcggcgaucgcggcguucgugcugaucuucuugaucauguuguu

SEQ ID NO: 4236748 - RNA, 65 nt, Mycobacterium avium subsp. paratuberculosis
cgaccuggugguggccgaggcggacguggagaccgcggugaccacccuggccagcgccggguucg

SEQ ID NO: 4236749 - RNA, 62 nt, Mycobacterium avium subsp. paratuberculosis
ugccgagcgugcacugagcgcgaaaaucgggcccgaaagucgcaguaggugcacguucggcg

SEQ ID NO: 4236750 - RNA, 55 nt, Mycobacterium avium subsp. paratuberculosis
cgccuuggacaaaugacccgagucgaacggcggcugcgggucguacuccagggcg

SEQ ID NO: 4236751 - RNA, 105 nt, Mycobacterium avium subsp. paratuberculosis
cccauugggaagagggcccgucgaccgaggucaaucuggcgcggcgguuucugacgaucugauucgcgucgcucggguggacgucgggcguucgggcaguauggg

SEQ ID NO: 4236752 - RNA, 89 nt, Mycobacterium avium subsp. paratuberculosis
accggcgaacggugcgggugacaggcugaugcggaacccgugccggcgggccgcgcggccgaugaucagccgcaucaagaucagcuggu

SEQ ID NO: 4236753 - RNA, 62 nt, Mycobacterium avium subsp. paratuberculosis
gccgucuugcuccucgagccgccgcgccaacagaacaacggcggcaggacauggcgaacggc

SEQ ID NO: 4236754 - RNA, 88 nt, Mycobacterium avium subsp. paratuberculosis
gggucggugugccagaagucgccggagguggcgaagccggcguuguugaccagcacccgcacuccggcggccaggcgcucagcgaccc

SEQ ID NO: 4236755 - RNA, 67 nt, Mycobacterium avium subsp. paratuberculosis
ggugggcgccguacuugugcaccucgaugccggugugcggcucggguuccgaguaggcguugccgcc

SEQ ID NO: 4236756 - RNA, 62 nt, Mycobacterium avium subsp. paratuberculosis
cgggacguucggcgcgcaguggcuggucgacaaccggccggagcuguucgccggggucaccg

SEQ ID NO: 4236757 - RNA, 72 nt, Mycobacterium avium subsp. paratuberculosis
ggagugucgagcaccaggucgcggcucuugacgaacugcaccgucugcugcaccgcggugaucggcaggucc

SEQ ID NO: 4236758 - RNA, 78 nt, Mycobacterium avium subsp. paratuberculosis
ucgacggcucggugcugcccgccaucaccagccgcggcccgcacgccaccaucgugaugaucgggcaccgggccgcgg

SEQ ID NO: 4236759 - RNA, 100 nt, Mycobacterium avium subsp. paratuberculosis
aacccgucccggccaccagcgccgcgucgauguucacuucgcucaugucguugacgaugaccgcgacgcggcggccuuccugguuagccaggacgugguu

SEQ ID NO: 4236760 - RNA, 87 nt, Mycobacterium avium subsp. paratuberculosis
gcgcggcggcguuguugcgggcgaucaccuggcuuucguggugguagcgcagcgccagguagccgcccgcgccgaugccggcggcgc

SEQ ID NO: 4236761 - RNA, 79 nt, Mycobacterium avium subsp. paratuberculosis
ggccggcgacgaggcgcggcugcggcugcuggucaacgacauguucgagaccaugucgcggcgcagccgcucgcugguc

SEQ ID NO: 4236762 - RNA, 57 nt, Mycobacterium avium subsp. paratuberculosis
cgcuacgugacggggguggccaucccgguggacgccggccacgucgucaugugagcg

SEQ ID NO: 4236763 - RNA, 86 nt, Mycobacterium avium subsp. paratuberculosis
ccccaccucuugaugacauuggcgcucacgguguugcuacgacuaucgggcaccaugccgauugacgccagugcgacgcgguaagg

SEQ ID NO: 4236764 - RNA, 130 nt, Mycobacterium avium subsp. paratuberculosis
gcagggcucccgcaucaucuaccgcaacccggacuucaauuccgguggugugcugaacgcucgcgaggauuucaucaccgcccacccggauuccguccaguugguggucgacaccuaugaggaggcccgc

SEQ ID NO: 4236765 - RNA, 79 nt, Mycobacterium avium subsp. paratuberculosis
cccucggccagccacggcagcacguagugcaccuugaucacuucggugacgcugucgcaguuguugugggugccgaugg

SEQ ID NO: 4236766 - RNA, 64 nt, Mycobacterium avium subsp. paratuberculosis
cggguccgcccgguuggcgggguccaacagcugcagcagcagcccuugcgauucggcggacucg

SEQ ID NO: 4236767 - RNA, 115 nt, Mycobacterium avium subsp. paratuberculosis
ggcgucgucgaugagagugcgcagcgcgagauugacggccucccgggcgucggccagauggaaccggcguauggcgucgucaaucauguugacgucaaccucgauuucgaccguc

SEQ ID NO: 4236768 - RNA, 63 nt, Mycobacterium avium subsp. paratuberculosis
gagcugggaacugugggccuacggcguauucgccaucgccgcaguggguaucacguccaguuc

SEQ ID NO: 4236769 - RNA, 58 nt, Mycobacterium avium subsp. paratuberculosis
guccggcucguacaagcgguucagggugcgcaacagggucgacuugcccgagccggac

SEQ ID NO: 4236770 - RNA, 72 nt, Mycobacterium avium subsp. paratuberculosis
ugagcgccgcgagcgugcacucaccgcgauaauucgaggcaauucucgcgguagcugcacgcucggcgaacg

SEQ ID NO: 4236771 - RNA, 81 nt, Mycobacterium avium subsp. paratuberculosis
ggcgcgcggccggcccgcagggggugggcgcgcaucgcgacgccggugugcucacgcugcugcuggccgagccgggcagcc

SEQ ID NO: 4236772 - RNA, 103 nt, Mycobacterium avium subsp. paratuberculosis
ccgugccggugagccggucgggcggcgcggacagcggcgcggggacgucgugcaggcuggucguggugcugucgcagcugcccaggccggucgccuccaucgg

SEQ ID NO: 4236773 - RNA, 62 nt, Mycobacterium avium subsp. paratuberculosis
cgucuccccagcgggcccggcgguccaccgaggugugcaaaccgccgaagcugguggaggcg

SEQ ID NO: 4236774 - RNA, 62 nt, Mycobacterium avium subsp. paratuberculosis
gccgcggccagaccguugaugucggugucguugacgacgcuggcgguggucuuggccggggu

SEQ ID NO: 4236775 - RNA, 57 nt, Mycobacterium avium subsp. paratuberculosis
cgucgggcggguccuggaagguggucuugugaaacgccucgagaucgcgcccgaacg

SEQ ID NO: 4236776 - RNA, 69 nt, Mycobacterium avium subsp. paratuberculosis
cggccgcggucggcgggcugccgguggccgugcgcgacggcgucaccggcacccugguggccgggcacg

SEQ ID NO: 4236777 - RNA, 77 nt, Mycobacterium avium subsp. paratuberculosis
gaccggaaggcccaccaguugguaccggcuccgucguggcggaucccgaugccguugguggugcgcuuggucugguc

SEQ ID NO: 4236778 - RNA, 80 nt, Mycobacterium avium subsp. paratuberculosis
cggaaucagucaccggagccgcugacccggccgauauucgggcccggcugggucagcggcugccggccuacauggugccg

SEQ ID NO: 4236779 - RNA, 68 nt, Mycobacterium avium subsp. paratuberculosis
augccgccgacgauguuccacaccacgaguuuggucaccaucucgggguagagcaucguggucagcau

SEQ ID NO: 4236780 - RNA, 64 nt, Mycobacterium avium subsp. paratuberculosis
gcuccggggugaucgucgggccgaucuugacgccgaucggguuggcgaucaccucggcgaacgc

SEQ ID NO: 4236781 - RNA, 67 nt, Mycobacterium avium subsp. paratuberculosis
gaguucgccgaucggggugcgcagcugcgcgaugacggcggcgcgcgguuccucgucgacgaucauc

SEQ ID NO: 4236782 - RNA, 58 nt, Mycobacterium avium subsp. paratuberculosis
gaaggucggcaccgugucggacgugaagcugcaucgcggcgacgcccuggugaccuuu

SEQ ID NO: 4236783 - RNA, 62 nt, Mycobacterium avium subsp. paratuberculosis
cgggacuacuaccagcacgacaucaaauucaucaucgcggucaccugcugguggugcuccug

SEQ ID NO: 4236784 - RNA, 110 nt, Mycobacterium avium subsp. paratuberculosis
ggaagacgucgucgccaccaucgaguaccuggugcgccugcacgagggucagcccacgaugaccgucccgggcggcaucgaggugccgguggagaccgacgacaucgacc

SEQ ID NO: 4236785 - RNA, 76 nt, Mycobacterium avium subsp. paratuberculosis
cgugguccgcgccaggucggcccgcgaauccgugcugaccuccacgcguccgggaaccucgaccucgugguccaug

SEQ ID NO: 4236786 - RNA, 65 nt, Mycobacterium avium subsp. paratuberculosis
cugaugggcuucggcuaucaccgcggccgcgacgaaggccagcugguguugcuggacgcccagag

SEQ ID NO: 4236787 - RNA, 74 nt, Mycobacterium avium subsp. paratuberculosis
gcgauggaggccgauuggcugaucgucggcgcguugaucgagcgcaccgaccgcaucgauccggcguuggucgu

SEQ ID NO: 4236788 - RNA, 129 nt, Mycobacterium avium subsp. paratuberculosis
ggcggugagcgcgucgacgaccgccgccucguucucgguguccagcgcgcuggucgccucgucgaccagcaguaugggcgccgguuugagcagugcgcgggcgaugcugacgcgcuggcguucaccgcc

SEQ ID NO: 4236789 - RNA, 76 nt, Mycobacterium avium subsp. paratuberculosis
cacgcuggccggcuucggggugaagaaccgggaccgcggcaccagcaccgcgaacaccgccgugccggccagcgug

SEQ ID NO: 4236790 - RNA, 66 nt, Mycobacterium avium subsp. paratuberculosis
gauguuggauuauggggcguuuccgccggaguucaauucggcgcggauuuauucggguccgggguc

SEQ ID NO: 4236791 - RNA, 128 nt, Mycobacterium avium subsp. paratuberculosis
gcgggccagccccugcaccggcgaggucagccgcagcagcuccucgacggcgucggggaucagcuccggcucgucgaccagccgcugccguuggucgggccgcuggugcagcaaaggcauugacccgc

SEQ ID NO: 4236792 - RNA, 94 nt, Mycobacterium avium subsp. paratuberculosis
ccucgacguggaacccucggucaucgacccgacgaucgacgacgacugacccccggucguugcgggagcgggucagaugaugccgcgcuugagg

SEQ ID NO: 4236793 - RNA, 65 nt, Mycobacterium avium subsp. paratuberculosis
cgaugccgaccacguaccggcccagccgcuugcagcgcugggccaacggaauguagucggagucg

SEQ ID NO: 4236794 - RNA, 85 nt, Mycobacterium avium subsp. paratuberculosis
ggauuucauggugguggucagcguggggucggcgccggggaacuucucgaacgcgaaccgcggcgccuugaccaccacguagucc

SEQ ID NO: 4236795 - RNA, 80 nt, Mycobacterium avium subsp. paratuberculosis
cggcgcggguguccauucucggccgggugcacacuccguuggggacgcugucgcugccgcggguggagauccggaugccg

SEQ ID NO: 4236796 - RNA, 58 nt, Mycobacterium avium subsp. paratuberculosis
ggcgucgaucaacaugugcuggcuggugccgagccgcucggugauguagaucggcgcc

SEQ ID NO: 4236797 - RNA, 89 nt, Mycobacterium avium subsp. paratuberculosis
gcgucuccgggucgagcagcggcgacggcgccuccucgaugaccuuuugauggcgccgcugcaggcugcacucgcguucgccgagaugc

SEQ ID NO: 4236798 - RNA, 55 nt, Mycobacterium avium subsp. paratuberculosis
gccuaucagcucgagggcagggauucgaagcaucaccugcaugagcugguggcgc

SEQ ID NO: 4236799 - RNA, 109 nt, Mycobacterium avium subsp. paratuberculosis
gcaucgaugccggugccacgccgcccgccguggguggugaccucccagcccgacggggugggcaccgcgcccggcggcaccgugcgggcguccacggacaacacgaugc

SEQ ID NO: 4236800 - RNA, 56 nt, Mycobacterium avium subsp. paratuberculosis
ccagcggguuucgccgcccgcucggccgacgccgacgcugggcgccaccgcgcugg

SEQ ID NO: 4236801 - RNA, 72 nt, Mycobacterium avium subsp. paratuberculosis
cucggcuccuuggccucgccagucgucaggucgauguaguggcugacguacuggucgacgucgagguccgag

SEQ ID NO: 4236802 - RNA, 55 nt, Mycobacterium avium subsp. paratuberculosis
ccgccggguggucgagccggucagucgaacagaccggguugacccagcccggcgg

SEQ ID NO: 4236803 - RNA, 81 nt, Mycobacterium avium subsp. paratuberculosis
cgcugguucgacgggacgggcggaccgucggcaaugcgggacaucggcgugcgcgacggccgcgucgucacgaucgccgcg

SEQ ID NO: 4236804 - RNA, 96 nt, Mycobacterium avium subsp. paratuberculosis
cgguacugauguagagggccaucgcgugagucucuguggugaaacgaccaaggaucacuaccgagaggaacaucgcgauggcccuggaccagucug

SEQ ID NO: 4236805 - RNA, 59 nt, Mycobacterium avium subsp. paratuberculosis
gaucgacgcugugcagaucgaccagcacccggaucagcgagucgacgcagccuucgauc

SEQ ID NO: 4236806 - RNA, 88 nt, Mycobacterium avium subsp. paratuberculosis
gcgaucggcggcugcgugucaucggcgugaccuggaacgacgaggcguccguaccggccgcgcuggugcucgaggcgcugaccgacgc

SEQ ID NO: 4236807 - RNA, 73 nt, Mycobacterium avium subsp. paratuberculosis
gcgcagccaauucagcgcgucgagcaggucgcuggucgucggcgaucgcaccguccgacugcugggucugggc

SEQ ID NO: 4236808 - RNA, 69 nt, Mycobacterium avium subsp. paratuberculosis
ugucggcgggcaggucgcggcggaucgaggugaugcccaccuuggcgcagucggcgugcuugccgcgca

SEQ ID NO: 4236809 - RNA, 58 nt, Mycobacterium avium subsp. paratuberculosis
gguggggucccaggcgccgucccauugccggcccgcggacggcgccggcgcgcccgcc

SEQ ID NO: 4236810 - RNA, 98 nt, Mycobacterium avium subsp. paratuberculosis
gcgaccucagggccgaaaucaccgccgggcgguugggcaucgagccguucgaugacgcgcuggugcagccguccagcgucgacguccgccuugacugc

SEQ ID NO: 4236811 - RNA, 58 nt, Mycobacterium avium subsp. paratuberculosis
cgaggguucggcguccgcggccgcaucggaguccgaugccgcgccgccgggccccucg

SEQ ID NO: 4236812 - RNA, 94 nt, Mycobacterium avium subsp. paratuberculosis
guuguccggguagaggaagggcuggccgaccgacuucuuguaggcguacgcggcgauggucggcagcuuggccagcaaccggaucguggacagc

SEQ ID NO: 4236813 - RNA, 61 nt, Mycobacterium avium subsp. paratuberculosis
cgggaacuucuugaucgccugcaccagcgcguagcccaacaggugagugaacgagaucuug

SEQ ID NO: 4236814 - RNA, 84 nt, Mycobacterium avium subsp. paratuberculosis
cggaggagccggcggcgaucaggagaaacgcauggacgacaccgcgcgccgcgccuccggguugccgcugcugucgcugcucug

SEQ ID NO: 4236815 - RNA, 69 nt, Mycobacterium avium subsp. paratuberculosis
gaucagcggcgcguagcuuucgaugucggggcacaucaccaggaugucgcgcggcugcagcgucggguc

SEQ ID NO: 4236816 - RNA, 57 nt, Mycobacterium avium subsp. paratuberculosis
gcgcuuccuuuccuguccuguacacacauaccuguacaugcgugcgcgaggaggcgu

SEQ ID NO: 4236817 - RNA, 64 nt, Mycobacterium avium subsp. paratuberculosis
ucgaggaauugccgcagcgacuggcaggccucgucgccgaaggugaacugcggcagcgccucga

SEQ ID NO: 4236818 - RNA, 65 nt, Mycobacterium avium subsp. paratuberculosis
gaaucgugcucggugagccacgacugcacggcggccagcgccucgugggugcgccgauacgauuc

SEQ ID NO: 4236819 - RNA, 86 nt, Mycobacterium avium subsp. paratuberculosis
gccgggauaggucuugguccaguucugcggauuggugacgaagucguacaccguuucggcggacugggugaacgcggucuccgagc

SEQ ID NO: 4236820 - RNA, 66 nt, Mycobacterium avium subsp. paratuberculosis
cucgccggggccguagaacgacgccgugucgaugugguugacgccgaguucgacggcgcggcgcag

SEQ ID NO: 4236821 - RNA, 69 nt, Mycobacterium avium subsp. paratuberculosis
gcgcuacacaggccgcgggauggcguuccucgauuugauccaggagggcaaccugggccugauccgugc

SEQ ID NO: 4236822 - RNA, 93 nt, Mycobacterium avium subsp. paratuberculosis
gucguagauucugugaaugcgugugcggauuucgaugcucggcggaugaaggcgggcaugcggaaguugcgggcgugguguagggauaacgac

SEQ ID NO: 4236823 - RNA, 83 nt, Mycobacterium avium subsp. paratuberculosis
ccgaaccgguggugauguccgacggauucauccacggcgugcacguguggaccgggccgucggacaucgagccgccggagcgg

SEQ ID NO: 4236824 - RNA, 96 nt, Mycobacterium avium subsp. paratuberculosis
cgcccgcccgucgccccgcgagcagacgcaaaagcacccgacacgccgggcuucagggcgcuuuugugacugcucgcgcugggaccgggcgaggug

SEQ ID NO: 4236825 - RNA, 79 nt, Mycobacterium avium subsp. paratuberculosis
cucgaccugcccgggcccgauggcggccugcaggaacgccuugaccgccuuggccacgucgaagcccggguauuucgag

SEQ ID NO: 4236826 - RNA, 62 nt, Mycobacterium avium subsp. paratuberculosis
cgcgagcagacgcaaaagcucccgaaacgccgugccggaggcggauuuugcgucugcucgcg

SEQ ID NO: 4236827 - RNA, 72 nt, Mycobacterium avium subsp. paratuberculosis
guuucgauguggugaccaucgcggcggaggugcugcagaaagucgccgcggaauggcacaccgcguugucgc

SEQ ID NO: 4236828 - RNA, 104 nt, Mycobacterium avium subsp. paratuberculosis
cgccgacccggcgguccuccucgugggugugcugccagucggugacgccggugacggccgaacccaggcuggccaggaugcccaccccgagcgcgcggguggcg

SEQ ID NO: 4236829 - RNA, 76 nt, Mycobacterium avium subsp. paratuberculosis
cgcaguaaccaggucguagccgccaacucgaagcggugcgucuucgagugcggcacgcacccaguucacccugacg

SEQ ID NO: 4236830 - RNA, 76 nt, Mycobacterium avium subsp. paratuberculosis
gcugcgugugccugaccgucggcgcggggaccgacgugcagucccugcgccggguguucggcacuaccgcgcacgc

SEQ ID NO: 4236831 - RNA, 77 nt, Mycobacterium avium subsp. paratuberculosis
ccucgccgucgucgagcgugcacugguagcgaagaaucggcggaauucucgcggugggugcacguucggcggcgagg

SEQ ID NO: 4236832 - RNA, 84 nt, Mycobacterium avium subsp. paratuberculosis
ggucccgacggggagaucgaggucuuccaggaauucgggaaaaucgggaagagccugaagaauucgaucucacccgacgagauc

SEQ ID NO: 4236833 - RNA, 82 nt, Mycobacterium avium subsp. paratuberculosis
gcgaaaagcguggggcgggcgcggccuggucgacgccgugggcggugaucaccguggaccgcgcccgcaggugcucgcucgc

SEQ ID NO: 4236834 - RNA, 90 nt, Mycobacterium avium subsp. paratuberculosis
ccggggccgggccgacgucgagggugucggggaacugcacccgggcgacgcggugcgguucaccgacaccgacggccgccgcgucaccgg

SEQ ID NO: 4236835 - RNA, 87 nt, Mycobacterium avium subsp. paratuberculosis
gucgucgaugcgguacuggcgugcggcggcgaccggcaccgacgggucgaucucgccgucgcgcgccagcgccucgagcaccgcgac

SEQ ID NO: 4236836 - RNA, 85 nt, Mycobacterium avium subsp. paratuberculosis
accggcccgcaccgggaugacguuguggcccggcuugagggugaaggccggggcuagcacggucgugucguugaggccggccggu

SEQ ID NO: 4236837 - RNA, 91 nt, Mycobacterium avium subsp. paratuberculosis
ccuugcgccgccaccggccgagcgucacgcuggcgugacggccggcgccgagugucacgccagcgugacgcucgggcgcggcggccggagg

SEQ ID NO: 4236838 - RNA, 79 nt, Mycobacterium avium subsp. paratuberculosis
gcgacgacgccgacgagaacuagcgcgccaccgccagcagcaccggaaucggcguguucucgucggugugauaacucgc

SEQ ID NO: 4236839 - RNA, 56 nt, Mycobacterium avium subsp. paratuberculosis
guugguggaucgucgcgaaguccuuguggcgcaacgcacugcgacgaucaaccggc

SEQ ID NO: 4236840 - RNA, 63 nt, Mycobacterium avium subsp. paratuberculosis
gagacggucggggugggccaguccgagaucgagaucgccgccguggccgacccgaccgucguc

SEQ ID NO: 4236841 - RNA, 57 nt, Mycobacterium avium subsp. paratuberculosis
gagcucacccggcucgccgugcaccagaagaccggcgugcggagccggcugaugcuc

SEQ ID NO: 4236842 - RNA, 59 nt, Mycobacterium avium subsp. paratuberculosis
ccgccggugcuggugcucaccuggucgggccugcgcgcgggugagugccgggcuggcgg

SEQ ID NO: 4236843 - RNA, 60 nt, Mycobacterium avium subsp. paratuberculosis
cgcgagcguaaccccacggcgauaaucccaacgagauuucgccgugggguuacgcgcgug

SEQ ID NO: 4236844 - RNA, 76 nt, Mycobacterium avium subsp. paratuberculosis
gguguaccuguuccgcgggccgucgggcgaggugcucuauaucggcaccgccgucgaccugcggcgccgggucgcc

SEQ ID NO: 4236845 - RNA, 75 nt, Mycobacterium avium subsp. paratuberculosis
ccgaacugguaacacacgguggugagcaauccgugcucggaccgcacgaugcucucaccgguguugagcagcagg

SEQ ID NO: 4236846 - RNA, 63 nt, Mycobacterium avium subsp. paratuberculosis
gcaggccggugaccagugggugcuugggauugaguuccaguauucgcuugcccaccggaaugu

SEQ ID NO: 4236847 - RNA, 68 nt, Mycobacterium avium subsp. paratuberculosis
agccgcgaaagugcaacuggcgacgcauuuaccgaguaacggugucgguagaugcacuuucgucgguu

SEQ ID NO: 4236848 - RNA, 76 nt, Mycobacterium avium subsp. paratuberculosis
gcgaccgagcgucaggugaccaagcagaucguggucuacaccuggcugacggugcuggccacgcuggcgcuggcgc

SEQ ID NO: 4236849 - RNA, 56 nt, Mycobacterium avium subsp. paratuberculosis
cgacggugugcugggggugcgcgaggaguaccuggccgccgcucggcaaaccaucg

SEQ ID NO: 4236850 - RNA, 56 nt, Mycobacterium avium subsp. paratuberculosis
guggccucgggaugcaugccgaucagcucacccucgcgcaugcgcugcacggccac

SEQ ID NO: 4236851 - RNA, 112 nt, Mycobacterium avium subsp. paratuberculosis
gauggucggcgaugaccucggagaucaccuggugcacggcgucgaucugggccagcggguugacgucggagccgucgacgacgugcaccagcaaaucggcgucgacgaccuc

SEQ ID NO: 4236852 - RNA, 57 nt, Mycobacterium avium subsp. paratuberculosis
cccgguucgcgaauucggcggcgguggcggcgucgccgagcgagucggcgaaccggg

SEQ ID NO: 4236853 - RNA, 55 nt, Mycobacterium avium subsp. paratuberculosis
gggguaggcggcggucagcggugggaugggcucaccgcuccgcucggccugcgcc

SEQ ID NO: 4236854 - RNA, 61 nt, Mycobacterium avium subsp. paratuberculosis
ggaccgacgccgcggugugcgccagccggccgagguggugcgcggcggcggcgucggugcc

SEQ ID NO: 4236855 - RNA, 60 nt, Mycobacterium avium subsp. paratuberculosis
cgccgcgcgaucucgccguuguucucgauguugucgcacgacgcgauggucggugcggcg

SEQ ID NO: 4236856 - RNA, 63 nt, Mycobacterium avium subsp. paratuberculosis
cacggcugccguugucgguggcgacgacauguacaagauucucaccaccagcgauggcacgug

SEQ ID NO: 4236857 - RNA, 92 nt, Mycobacterium avium subsp. paratuberculosis
ucccccacccccucccucgagcagacgcaaaagcccccgacacgccgggcgucgaggggcuuuugcgucugcucgcggaggaacucgcggga

SEQ ID NO: 4236858 - RNA, 92 nt, Mycobacterium avium subsp. paratuberculosis
cgcugcgcgacgcccucgacccggcgucgcgggcguggcgcgcaugaccaccccgcugcugucggucgagggccugcaugucggguucggcg

SEQ ID NO: 4236859 - RNA, 88 nt, Mycobacterium avium subsp. paratuberculosis
cggaucgcgaucggggugugcauccuggcgggcgucgucaucgucuacgugcugucgcuguucggggugcauuuccugcagcgcuccg

SEQ ID NO: 4236860 - RNA, 85 nt, Mycobacterium avium subsp. paratuberculosis
gcaggaccagauggugcgccgggugguggugccggcgguggcgaccacccgccgccgacuggaggccgcccggcacgccacccgc

SEQ ID NO: 4236861 - RNA, 86 nt, Mycobacterium avium subsp. paratuberculosis
gaccaguccuucggcgcggccagccgcugaucgggggccggugccugcagguccuuggugaccagcggcuggccgcucgucagguc

SEQ ID NO: 4236862 - RNA, 63 nt, Mycobacterium avium subsp. paratuberculosis
gcgcugguugucgacgcugcagguggcccacacgcgauagaccucacggucggcguccagcgc

SEQ ID NO: 4236863 - RNA, 85 nt, Mycobacterium avium subsp. paratuberculosis
cauggccccaacuuagggaucgggcucgcgguuuuccggcgaagacgcauagaugcggccguugaucuucagguacgggguggug

SEQ ID NO: 4236864 - RNA, 128 nt, Mycobacterium avium subsp. paratuberculosis
gcuggccggcgaggacgcccgcgcgcuguucaccggcguugccgcccauaucauuucgcggaugcccucguugacggcggccggcgccggguugaugcuggccacgcuggcgcauucggucggcuggc

SEQ ID NO: 4236865 - RNA, 72 nt, Mycobacterium avium subsp. paratuberculosis
ucaccgcgacccgcuugccggucaggucgacgguguggucccacucggcggaauggaaagcgggaccggcga

SEQ ID NO: 4236866 - RNA, 75 nt, Mycobacterium avium subsp. paratuberculosis
gcggcaaagaccggauccagcguucggggcgcccccgcauacagccagugcgccacccgguggauccguucccgc

SEQ ID NO: 4236867 - RNA, 73 nt, Mycobacterium avium subsp. paratuberculosis
ccgccggugacaccuucccgacugccgcgccgaaaagccugaucagcggcgagccgaugaagguguccugggg

SEQ ID NO: 4236868 - RNA, 112 nt, Mycobacterium avium subsp. paratuberculosis
gauggugcgcugguugacgauuccgucguuggcgcgggugaucucggcgacguaguccucggguucggccuugcccgggaucaccgcguuguugacgccguccaugcccauc

SEQ ID NO: 4236869 - RNA, 61 nt, Mycobacterium avium subsp. paratuberculosis
gcccgcgaacccgccgccgaggacggcgacgucgauguccucgcggaugggcucgcgcggc

SEQ ID NO: 4236870 - RNA, 61 nt, Mycobacterium avium subsp. paratuberculosis
ucggcggcgcgcuugcccagcuugucgccgaacggcggcagcacggcgggcgcggcgucga

SEQ ID NO: 4236871 - RNA, 109 nt, Mycobacterium avium subsp. paratuberculosis
ucaccggcugguucauggucggcuggucaccggaguuccccaucggagaggugcgcccguugcacuauuucggcgaggaccugguggccuaccgcgacgaguccggcga

SEQ ID NO: 4236872 - RNA, 69 nt, Mycobacterium avium subsp. paratuberculosis
gccgaaccggugcgggcgggcuggcagacgaucccgggguccacgcggcccgccucguaucagggcggc

SEQ ID NO: 4236873 - RNA, 61 nt, Mycobacterium avium subsp. paratuberculosis
acgugauggacgagugguuccggcagggcgaccgguacgagggcugcucguucaucaacgu

SEQ ID NO: 4236874 - RNA, 72 nt, Mycobacterium avium subsp. paratuberculosis
aauguccgggagacggcggaguuauuucgcagauauggucagccagaagauauuuccuugcuccccgacauu

SEQ ID NO: 4236875 - RNA, 63 nt, Mycobacterium avium subsp. paratuberculosis
cugcugcacgcggccgacgacaugaugcucuacaaguacaucgucaagaacaccgcguggcag

SEQ ID NO: 4236876 - RNA, 122 nt, Mycobacterium avium subsp. paratuberculosis
gccgucgucaccauggcgucgcacggcaccucgacacgcggcuuucaggccgaauggcgggagaucggacuucugacguucgacggagagcugcugagccguugcgagcuuuucgacgaggc

SEQ ID NO: 4236877 - RNA, 80 nt, Mycobacterium avium subsp. paratuberculosis
gccgcggaguuucaggauacuuggacccaaaaccgggcucguuugaggauugggcccacggugaccuaagcugacguggc

SEQ ID NO: 4236878 - RNA, 114 nt, Mycobacterium avium subsp. paratuberculosis
gacgcugccggcgcgcuacggucucccgcuaccgggccggcccgcgccguugcaccccaaugccgccgggaugcgugcgguggcggaauugauugcggcgcgacuguaaacguc

SEQ ID NO: 4236879 - RNA, 119 nt, Mycobacterium avium subsp. paratuberculosis
ccagcggcaccgcggcgcccagcgucacccggccgucguccuguguuauccagcccaccggggguuuggugacggcgggauaggcgaucggcccgcacucggcgccgggcagcagcugg

SEQ ID NO: 4236880 - RNA, 55 nt, Mycobacterium avium subsp. paratuberculosis
cgcgguggcguugcuguccuaccgggcggauucgguggacaaggaccucgccgcg

SEQ ID NO: 4236881 - RNA, 73 nt, Mycobacterium avium subsp. paratuberculosis
guagcggcucagcgcguagaaguuguacuucucguuguaguacagcggcgcuucuucgcgcaugcgcugccac

SEQ ID NO: 4236882 - RNA, 82 nt, Mycobacterium avium subsp. paratuberculosis
gcgagcgagcaccugcgggcgcgguccacggugaucaccgcccacggcgucgaccaggccgcgcccgccccacgcuuuucgc

SEQ ID NO: 4236883 - RNA, 79 nt, Mycobacterium avium subsp. paratuberculosis
guucgggauccaggaguuguccaccacgguguugacgucgacgaucgucagccucggccuggacagucgccuggccggc

SEQ ID NO: 4236884 - RNA, 96 nt, Mycobacterium avium subsp. paratuberculosis
gcugcacguuggcccgcacgaugcggcugccgucgguggacagcaccacggcgccguccaucuucgccagcucgcgcagccgggucggcgcguagc

SEQ ID NO: 4236885 - RNA, 107 nt, Mycobacterium avium subsp. paratuberculosis
ucucgcuggugcccucguagagccgcagcaggcgcacgucgcgguagaugcguuccaccgggacaccgcgcauguagccgcugccgccgugcaccuggaccgcgaga

SEQ ID NO: 4236886 - RNA, 61 nt, Mycobacterium avium subsp. paratuberculosis
aguggguggauuccgagcgcccggccgaccggcugcgcgaggugcuggugucgcaugcgcu

SEQ ID NO: 4236887 - RNA, 70 nt, Mycobacterium avium subsp. paratuberculosis
ggccgaccuggguuguuucggcaugaaaauuccguccgaauucggcgggcugaacaugucccaggucgcc

SEQ ID NO: 4236888 - RNA, 85 nt, Mycobacterium avium subsp. paratuberculosis
cuuggugccguugagggcggcgucgauguuggacuggaugcugcgaucgcagaugccggugagguuggacggcgccugcaccagg

SEQ ID NO: 4236889 - RNA, 101 nt, Mycobacterium avium subsp. paratuberculosis
cgggcgccgcgccgaugauggccgccgcggcggcguucagcaaccuggccgacgaguugagcaccaccgccgcggccacccagucggcgaucgcgaaccug

SEQ ID NO: 4236890 - RNA, 86 nt, Mycobacterium avium subsp. paratuberculosis
gcggcggcgaacacgaugcuggagaucaccaggaucggcguccagugcgcguaccccugguucugcagcgugcggaucaccgccgc

SEQ ID NO: 4236891 - RNA, 64 nt, Mycobacterium avium subsp. paratuberculosis
gcagaugcgccucgacggcgucgggguccagguagcaggucccggugcggucgggcgcgucggc

SEQ ID NO: 4236892 - RNA, 123 nt, Mycobacterium avium subsp. paratuberculosis
ggaggcuccgguggggcaagggauuccaugcugaccacgaugcucuaccccgagauggugaccaaacucgugguguggaacaucgucggcggcaucuacggcaccuuugugcucggcuccuuc

SEQ ID NO: 4236893 - RNA, 75 nt, Mycobacterium avium subsp. paratuberculosis
gucggggucggcgaaguggcuaucgucgcgguugcccgacggguagaacauugccacccguucgccggccuugac

SEQ ID NO: 4236894 - RNA, 77 nt, Mycobacterium avium subsp. paratuberculosis
ggugcagguccuuggucgucguggugccgcugcucgaaccgcagccggacaccgcggugaccgcggcgaccaccgcc

SEQ ID NO: 4236895 - RNA, 72 nt, Mycobacterium avium subsp. paratuberculosis
gcucgcccaucucggcgguguaggcguucagccggucaggccgguugagcgugagaaccgcgacgcccgagu

SEQ ID NO: 4236896 - RNA, 55 nt, Mycobacterium avium subsp. paratuberculosis
gcuguacgaccugcccaucgucggcgacguccgcggcgagggcuucuucuacggc

SEQ ID NO: 4236897 - RNA, 129 nt, Mycobacterium avium subsp. paratuberculosis
augcggguuggcggcgcggcgcagguacggcaggcacgccuuggugagcaggaaggugccgcggauguucaccuccugcaucaggucgaacuucuuggccgacagcuccgccgucggcuccaccgcgau

SEQ ID NO: 4236898 - RNA, 76 nt, Mycobacterium avium subsp. paratuberculosis
agcagcaccaggucgcggcggugccgguaguggaagucgaaauagcccuccagcaacucgcgcgccucggugugcu

SEQ ID NO: 4236899 - RNA, 116 nt, Mycobacterium avium subsp. paratuberculosis
ccaacugcugcaagcacuucgcagcgacgugcacgccaugugcguggggccggugaccgcgcagccguugauccgcgcgggugugccgacgucgucgccggagcgaaugcgguugg

SEQ ID NO: 4236900 - RNA, 80 nt, Mycobacterium avium subsp. paratuberculosis
ggcgcucgcccaucacgaucgggucgggcgugguggcgcuggccgcuuucgucgcguucgucgugguggagcgcaccgcc

SEQ ID NO: 4236901 - RNA, 72 nt, Mycobacterium avium subsp. paratuberculosis
uggccaagggcaccacgucgcugcaccggauccggcagaucgaucccccgccgaucguggugucggugguca

SEQ ID NO: 4236902 - RNA, 64 nt, Mycobacterium avium subsp. paratuberculosis
cgccgagcgugggcccugugcacgccaucgcaaggcuuuucgugcauaacccccacgcucggcg

SEQ ID NO: 4236903 - RNA, 63 nt, Mycobacterium avium subsp. paratuberculosis
uccaccgggcgcggagcgaucggccggcuguugcucgguucggucaguuccggccuggugcga

SEQ ID NO: 4236904 - RNA, 107 nt, Mycobacterium avium subsp. paratuberculosis
gcgccggcgaccggccaggaaucggguggccgcggcgaugacguugaucaccgcgacaaugaugaucagggucagcgccgcaccccagauccgcaggaagccggcgu

SEQ ID NO: 4236905 - RNA, 68 nt, Mycobacterium avium subsp. paratuberculosis
gaacaggugcuggccgacauggcgagaaucgacgaccacggggaugccgugcuuggccagcucgcguc

SEQ ID NO: 4236906 - RNA, 62 nt, Mycobacterium avium subsp. paratuberculosis
cgguucggcgucgaugcgggccagcgucgccucgucgaccagucuggccaucgacgccgccg

SEQ ID NO: 4236907 - RNA, 60 nt, Mycobacterium avium subsp. paratuberculosis
gccuccacccgcagagaucccaaggcgcgcaacgucauucggagcucgugggugaaccgc

SEQ ID NO: 4236908 - RNA, 67 nt, Mycobacterium avium subsp. paratuberculosis
ggugcugggcuucugggacaucacggugcccaucgucggcgcgccgauggccggcgggcccggcacc

SEQ ID NO: 4236909 - RNA, 71 nt, Mycobacterium avium subsp. paratuberculosis
cgaccugagauuuguuggcugacaagccauuugacgaagaaucagaauuagcuagcgagguuucaugguug

SEQ ID NO: 4236910 - RNA, 63 nt, Mycobacterium avium subsp. paratuberculosis
gcgauggcgugcgcgaugggguguucggaggcggccuccagcgccccggcguagcgcaacagc

SEQ ID NO: 4236911 - RNA, 70 nt, Mycobacterium avium subsp. paratuberculosis
gcugaucgccgccggccuggugcugggugcgcugcgcaccgcgcacgaggccggcuggcugaacaucggc

SEQ ID NO: 4236912 - RNA, 103 nt, Mycobacterium avium subsp. paratuberculosis
uccgcgccgcgccgaaagaccugcaggagaagcugauaccgccgacgcugcgcggcgagaucgcguggugccagcuguucagcgaacccggcgccggcucgga

SEQ ID NO: 4236913 - RNA, 91 nt, Mycobacterium avium subsp. paratuberculosis
uugacguacuggcgccggucggugcgaugguggucgccgucguauucgacggcgaccauccacucgggccagcccauguccagguacgcga

SEQ ID NO: 4236914 - RNA, 63 nt, Mycobacterium avium subsp. paratuberculosis
cggugacgaucacccaccugggugccggccauaccgcgucggaccuggugguggucgugcccg

SEQ ID NO: 4236915 - RNA, 89 nt, Mycobacterium avium subsp. paratuberculosis
ccggcgcggccgugauggcgagcggggccgccgcggcggcgaugacggcggccgcgccgagcccgcucaguaugcgcggccgcgaucgg

SEQ ID NO: 4236916 - RNA, 88 nt, Mycobacterium avium subsp. paratuberculosis
ggccgggcucgccucgccggucaugaucugguccauggcccaggccgccuguccgcgggccaggucgucaccgccggucagccgggcc

SEQ ID NO: 4236917 - RNA, 86 nt, Mycobacterium avium subsp. paratuberculosis
ucccgguccgggaagucggcgcucgacgucaucgagacgugguagcggaugacgucgugcagccccuucucguaguacgaccggga

SEQ ID NO: 4236918 - RNA, 69 nt, Mycobacterium avium subsp. paratuberculosis
gggcgaugccuucgacaaggcgaagaacgacgacacguucuaccuuccgccggaggcguucaagagccc

SEQ ID NO: 4236919 - RNA, 59 nt, Mycobacterium avium subsp. paratuberculosis
cgcacucggugucguugucgaacgagccggugggaucgacgaacaccagcaccggggcg

SEQ ID NO: 4236920 - RNA, 67 nt, Mycobacterium avium subsp. paratuberculosis
gugaaucggccggcgcagcgauccgcgcguugagagaaucgcgggauuggucgcuggccgaccuugc

SEQ ID NO: 4236921 - RNA, 58 nt, Mycobacterium avium subsp. paratuberculosis
ccgagcgucacgcuggcgugacgcucggcggcgcgcgucacgcuggcgugacgcucgg

SEQ ID NO: 4236922 - RNA, 83 nt, Mycobacterium avium subsp. paratuberculosis
acgucgagcaccguguccuuggccgagcgcaccgcggccuggugauaaccggcaaugcgcucggccagggcgugggccgccgu

SEQ ID NO: 4236923 - RNA, 77 nt, Mycobacterium avium subsp. paratuberculosis
guuuggggcucauguauuggaccgcggauaucaguaggucaguuguacuggauucgcauauuagugcgugagcugac

SEQ ID NO: 4236924 - RNA, 61 nt, Mycobacterium avium subsp. paratuberculosis
guugcucgcugcugaucccggcgcugcuguccacggcggcgacgcggucggcgacgacgac

SEQ ID NO: 4236925 - RNA, 65 nt, Mycobacterium avium subsp. paratuberculosis
ccgcgcucaacuggucgacgacgucgucgccggcgccgucgaugaccggugccaguugaucgcgg

SEQ ID NO: 4236926 - RNA, 61 nt, Mycobacterium avium subsp. paratuberculosis
gcaccccggucgaggugagcgaugagcuguucgacgcgcugcgcgcgcacuucgacaccgc

SEQ ID NO: 4236927 - RNA, 101 nt, Mycobacterium avium subsp. paratuberculosis
gcugggccgcgccaacggcaucgacugcgccguggugccgcagcccggucggcacgacuggccguucgcggaccgcgcguucgcggccgcgcugcccuggc

SEQ ID NO: 4236928 - RNA, 63 nt, Mycobacterium avium subsp. paratuberculosis
gggugucguucaucgucgcgaucacgguggccggcauggugauucccgacgacgggcacgccc

SEQ ID NO: 4236929 - RNA, 59 nt, Mycobacterium avium subsp. paratuberculosis
cuuucuacucuaggggcuugcgauguguccgggcgucggaggagccaugagaagaacag

SEQ ID NO: 4236930 - RNA, 55 nt, Mycobacterium avium subsp. paratuberculosis
gcaauguggcagaucgccgaaucgugguggcgcucgguggucaugagccgcuugu

SEQ ID NO: 4236931 - RNA, 57 nt, Mycobacterium avium subsp. paratuberculosis
gucggcgagcuuggcgguguucuugcccgaauugcgcugcaccgcagucuuguugac

SEQ ID NO: 4236932 - RNA, 101 nt, Mycobacterium avium subsp. paratuberculosis
cggucaggugccgucggcgaugacguuucuggugucgggccgggugcagcugaccgcgacggccgaggacgggaccgucguucccgucagcacccuggccg

SEQ ID NO: 4236933 - RNA, 64 nt, Mycobacterium avium subsp. paratuberculosis
ggcgcgccgagauggccgccgccacauagucgcuguaggcgaugguggcggccgaucgugcgcc

SEQ ID NO: 4236934 - RNA, 81 nt, Mycobacterium avium subsp. paratuberculosis
ggaacuuugcccgccucugagcgacaacgacgcgucgggggaucggacuucggugauugucgcucagaggcgggcacuucc

SEQ ID NO: 4236935 - RNA, 74 nt, Mycobacterium avium subsp. paratuberculosis
cgggugcgguccugcccgcgagagcauuugcuuuggugaccgucgcucugcucugcgggcagacucgauacccg

SEQ ID NO: 4236936 - RNA, 86 nt, Mycobacterium avium subsp. paratuberculosis
ucgccggcccgcguuucgucgagacuuaaaccacgcacacccggcccggcgugucgugugcgugauuuaagugucgcgggcggcga

SEQ ID NO: 4236937 - RNA, 96 nt, Mycobacterium avium subsp. paratuberculosis
gauuccgcaacgugcuguuccccuacguguaccgguucgggcagccgguguucgaccggcucuucuaccaccgguaucggcggcaggcgaugaguc

SEQ ID NO: 4236938 - RNA, 91 nt, Mycobacterium avium subsp. paratuberculosis
acuaggucugccgagcagacgcaaaagcccccgacacgcccugcgugcgggggcuuuugcgucuucucguucccuacggcggacguuuagu

SEQ ID NO: 4236939 - RNA, 60 nt, Mycobacterium avium subsp. paratuberculosis
caugaggugacguucgaauccgcuagcgccugcgguagcgcguucgaaagugacgucgug

SEQ ID NO: 4236940 - RNA, 77 nt, Mycobacterium avium subsp. paratuberculosis
gccgcaccgacaucgggccguagcgggucagcgcacggaccagcccgcgcugaaugcgcauggcccgcggugugcgu

SEQ ID NO: 4236941 - RNA, 66 nt, Mycobacterium avium subsp. paratuberculosis
gccgcuucuugguggcagcgucgucguagccgugcagcacgauggcguccccaccggcccggcggc

SEQ ID NO: 4236942 - RNA, 62 nt, Mycobacterium avium subsp. paratuberculosis
gguuuccgacuaucugcucgagcguuugcgggcguggggcgucgagcauguauucggguacc

SEQ ID NO: 4236943 - RNA, 58 nt, Mycobacterium avium subsp. paratuberculosis
cggggcacaaccucccugucacgcuuucucgccgaaguggcgcggguguugcgcccug

SEQ ID NO: 4236944 - RNA, 62 nt, Mycobacterium avium subsp. paratuberculosis
gaggugcugcgcggccugggcgccaccgucgaacucgacggcgacgucgcccgcaucaccuc

SEQ ID NO: 4236945 - RNA, 90 nt, Mycobacterium avium subsp. paratuberculosis
cguucgcggccgaugaaucgccggucggcgacgacccggcggugacgucgcugcuggaugcgcuggccgcccacacccgguucguggacg

SEQ ID NO: 4236946 - RNA, 105 nt, Mycobacterium avium subsp. paratuberculosis
gucacgucgucgggggucggccgcuacaugccggccauguucagcaugcacaugguggugcacaugugccuguccaugcuggugccgauccugcuggcgcugggc

SEQ ID NO: 4236947 - RNA, 79 nt, Mycobacterium avium subsp. paratuberculosis
ggccacccgccgcauccgaccaucccggccgcucgccccgcacgggcugcccggccaccuggucggguucguggaagcc

SEQ ID NO: 4236948 - RNA, 56 nt, Mycobacterium avium subsp. paratuberculosis
gcgggucguaaucggcgagcagccguucgaugcgggccucgucgagucguacccgc

SEQ ID NO: 4236949 - RNA, 83 nt, Mycobacterium avium subsp. paratuberculosis
gcuccaagcgcgagcugcucgaggcgcggucgcgcaccggaucgagagcaucgugaccgcgcgagagcaguacgacgcggggc

SEQ ID NO: 4236950 - RNA, 62 nt, Mycobacterium avium subsp. paratuberculosis
cggguucgggaucaugaacuucgcgaacccgacguucucgggccucaugguuccgcugcccg

SEQ ID NO: 4236951 - RNA, 82 nt, Mycobacterium avium subsp. paratuberculosis
cuccuugagcgcgagcagacacaauagcgccgcgacacgccgugaagaaggggcuuuugcgucugcucgcgagauaacggag

SEQ ID NO: 4236952 - RNA, 68 nt, Mycobacterium avium subsp. paratuberculosis
gcuucucguucaggucgagcugggcgcugugcauggccucgguggucugcucggccugacgggacagc

SEQ ID NO: 4236953 - RNA, 55 nt, Mycobacterium avium subsp. paratuberculosis
ggcggucuugcuguuguaguugccgguuccgauguggcaguaccggcggaucgcc

SEQ ID NO: 4236954 - RNA, 59 nt, Mycobacterium avium subsp. paratuberculosis
cggggucggccagcaccacccagcgaaagcucucaccgaacuggugccggccgaccucg

SEQ ID NO: 4236955 - RNA, 64 nt, Mycobacterium avium subsp. paratuberculosis
uguggccgaaccggguucggacgagccgacacucagcggcgaucggccggcccggucggccgca

SEQ ID NO: 4236956 - RNA, 86 nt, Mycobacterium avium subsp. paratuberculosis
ccggcgcagguacaggugcaggucguguucccaggugacgccgauaccgccgugcaucugcacgcaggccugcacgaucugcccgg

SEQ ID NO: 4236957 - RNA, 92 nt, Mycobacterium avium subsp. paratuberculosis
ggggccggucggcggauucguugugcgcgcggaagguucggacaugacgucgcggcgacugcucgccgcgcagcgcaaccucggccggcucc

SEQ ID NO: 4236958 - RNA, 107 nt, Mycobacterium avium subsp. paratuberculosis
cguccuccaugguggugcggcgcaucccgacgaguucggccuguucgaggguggcggccagaauucgggcggugaucucgucgggguugucgaccugggcgaggacg

SEQ ID NO: 4236959 - RNA, 68 nt, Mycobacterium avium subsp. paratuberculosis
ggcgcgccaacgucgacuuguugucgggaauuucggguuuucggcccaacaacucgacguugggcguc

SEQ ID NO: 4236960 - RNA, 64 nt, Mycobacterium avium subsp. paratuberculosis
gcugguggcguagagcuugcgcagcgacgccagcucgcugucgccgcacgcgaugcgccccagc

SEQ ID NO: 4236961 - RNA, 103 nt, Mycobacterium avium subsp. paratuberculosis
aggucgccguccgggaccggaucggcccgcucgaugcgucggcgcgcccggcuggccagcuugcgggccgacuccggcgugccguccacgaucgcggcgaucu

SEQ ID NO: 4236962 - RNA, 57 nt, Mycobacterium avium subsp. paratuberculosis
ccggccgcagcauguauccgacaccgcggacgguguggaucaucggcucgcggccgg

SEQ ID NO: 4236963 - RNA, 60 nt, Mycobacterium avium subsp. paratuberculosis
aacugggugcgugccgcacucgaagacgcaccgcuucgaguuggcggcuacgaccugguu

SEQ ID NO: 4236964 - RNA, 62 nt, Mycobacterium avium subsp. paratuberculosis
gcgcccggaaucaaccggcgcgcccgugacggaucaggggcaguaguuggauuccgcggcgc

SEQ ID NO: 4236965 - RNA, 74 nt, Mycobacterium avium subsp. paratuberculosis
gugggcgaugcugucggcggcgcgguucccggucgucuuggugggacccgugcaucugcccggcaucgcaccgc

SEQ ID NO: 4236966 - RNA, 73 nt, Mycobacterium avium subsp. paratuberculosis
gcugaugucgcacccgcaguggggacgcgccgcgaaguccuuuguggugcccagcauuucggguggggucagc

SEQ ID NO: 4236967 - RNA, 63 nt, Mycobacterium avium subsp. paratuberculosis
ucgcgacuacaucgguuggcuggccggccgcgaucugcaagccagccaacggguuuggcgcga

SEQ ID NO: 4236968 - RNA, 74 nt, Mycobacterium avium subsp. paratuberculosis
cgagccgcuccucgcgcagguagcccucggccgccugcucggcgcucgggugugccugcagcgacagcggcucg

SEQ ID NO: 4236969 - RNA, 58 nt, Mycobacterium avium subsp. paratuberculosis
uugccgcagaagggauuucggacggcggcaucgcccccgccgaaucgcugcugugcga

SEQ ID NO: 4236970 - RNA, 59 nt, Mycobacterium avium subsp. paratuberculosis
cggcgcccaucgcggcggccuggguggccgcgccuucgaggccgccgaugaugccgccg

SEQ ID NO: 4236971 - RNA, 100 nt, Mycobacterium avium subsp. paratuberculosis
gcuggacuacgaccagaccaagcgcaccaccaacggcaucgggauccgccacgacggagccgguaccaacuggugggccuuccggucggcgugcaccagc

SEQ ID NO: 4236972 - RNA, 55 nt, Mycobacterium avium subsp. paratuberculosis
caccagcaggauugggacgucgggccagaugcugacgugccagcgcgcgcuggug

SEQ ID NO: 4236973 - RNA, 59 nt, Mycobacterium avium subsp. paratuberculosis
cggcggcccgccggcugcggcgcuugccgcuggugaugcgcccgcucggcuggcugccg

SEQ ID NO: 4236974 - RNA, 68 nt, Mycobacterium avium subsp. paratuberculosis
gagcgccggccgucacgcuggcgugacgcucggcgacgacggucacgcuggcgugacgcucggcgcuu

SEQ ID NO: 4236975 - RNA, 57 nt, Mycobacterium avium subsp. paratuberculosis
ugcgcgaccugcuguucgcccggcugcugcaguaccgggcguucaagcacgucgccg

SEQ ID NO: 4236976 - RNA, 56 nt, Mycobacterium avium subsp. paratuberculosis
gcgcguuggugcuggauugcuucacaugcugacgggcaacucaggcaccaacgcgc

SEQ ID NO: 4236977 - RNA, 84 nt, Mycobacterium avium subsp. paratuberculosis
gagucgcugggcuuugagugugcgcugacggcgagcccgcucggcgugucgccgccgcagauacacacgcaaggccaacgauuc

SEQ ID NO: 4236978 - RNA, 86 nt, Mycobacterium avium subsp. paratuberculosis
gcccuuccgaggccgcugacaagcgcaaucaaaaaccccgcuuccggaugggagcgggguuuuugauugcgcggcgccggaugggc

SEQ ID NO: 4236979 - RNA, 65 nt, Mycobacterium avium subsp. paratuberculosis
gcagggcgcggccggucugcucgagcauguccagcgcgugccgcagcgacagccggccgguccgc

SEQ ID NO: 4236980 - RNA, 73 nt, Mycobacterium avium subsp. paratuberculosis
gcgaugccgguggcgucgaaguggucgauguggucggugaccacgucggcgcgcccggcggugauggcguugu

SEQ ID NO: 4236981 - RNA, 66 nt, Mycobacterium avium subsp. paratuberculosis
gcacgccuccgaucuggccgaccggcugcgggugagccggcaggcgguggcccaggcggucgcggc

SEQ ID NO: 4236982 - RNA, 69 nt, Mycobacterium avium subsp. paratuberculosis
caggaccucggugucaccgcuagcaccagcgucgacgaggugcuggcgcuggacgccgauugcgucgug

SEQ ID NO: 4236983 - RNA, 86 nt, Mycobacterium avium subsp. paratuberculosis
gcggucgccgggcauccgggucgggcugauggaugccgaccgccagccggggucgcagccccagcuccggccgcucggcgacgcgc

SEQ ID NO: 4236984 - RNA, 80 nt, Mycobacterium avium subsp. paratuberculosis
ggccggcguccucgcgggcgccgaucugcucgacggcggcgacggcgucgagcuggucgagcuccggggcgacgauggcc

SEQ ID NO: 4236985 - RNA, 76 nt, Mycobacterium avium subsp. paratuberculosis
uugaugcuggcggccucgccgcgggccagcgcgauggucgcgacgaucaccaccgcgacggcgccgaccagcacga

SEQ ID NO: 4236986 - RNA, 73 nt, Mycobacterium avium subsp. paratuberculosis
gaucuugggcggcaacgccgcucggcucuaccguuucgaccucgacaagcugauuccgguggccgccaagauc

SEQ ID NO: 4236987 - RNA, 61 nt, Mycobacterium avium subsp. paratuberculosis
cgugucgaccuggauccugccgggcgucgugcugaccgccggcaugaccuggucgaaugug

SEQ ID NO: 4236988 - RNA, 81 nt, Mycobacterium avium subsp. paratuberculosis
gccaaaucgacuugucggcaagcuuuuugcggcgcgccuucgagcugggcgccacggccagcaugcuggaaccgaucuggc

SEQ ID NO: 4236989 - RNA, 129 nt, Mycobacterium avium subsp. paratuberculosis
ggcgaccaccgcgagcagcgccggaaaugucgugaauuuguucaccaucgcgccccagguuagaccgcggcccgggugggcggauucaggacacggcguccucagacaugcagcgcggugaacggcgcc

SEQ ID NO: 4236990 - RNA, 75 nt, Mycobacterium avium subsp. paratuberculosis
cgacggcuucggcggugaauccgaauucacggaacaacguuuuguagucggcggauucgccguagugcucgaucg

SEQ ID NO: 4236991 - RNA, 77 nt, Mycobacterium avium subsp. paratuberculosis
cuagcgcuuucgucgaccgucacgcuggcgugacacucggucaccggugucacgcuggcgugacguucgucagcuag

SEQ ID NO: 4236992 - RNA, 60 nt, Mycobacterium avium subsp. paratuberculosis
gccgucccgaucccggacaccgcgcugcgcgucgcgggcgcggugcuggaucgggccggc

SEQ ID NO: 4236993 - RNA, 83 nt, Mycobacterium avium subsp. paratuberculosis
gggccaguuccaggcagucgucgaaguugccgucgaucugaaugaucuuggcgccgugcaugaccgccugcgcgagcuugccc

SEQ ID NO: 4236994 - RNA, 56 nt, Mycobacterium avium subsp. paratuberculosis
gggcgacgacgucagcacgcugcucgucaucggacacgagccgacgaugucggccc

SEQ ID NO: 4236995 - RNA, 65 nt, Mycobacterium avium subsp. paratuberculosis
uggcgcugcaacugguagcggaugcggccgugcuuaccgcgcggauuuccguccagguagcgccg

SEQ ID NO: 4236996 - RNA, 71 nt, Mycobacterium avium subsp. paratuberculosis
gcaccgccugaugccggcgauagguggcgaugaugcgggucaucgccgcccgcacgucgucggggucgugc

SEQ ID NO: 4236997 - RNA, 58 nt, Mycobacterium avium subsp. paratuberculosis
cucgagccagggcgcaacgguuuucggcaucggccgcgacaccguccgccuggccgag

SEQ ID NO: 4236998 - RNA, 102 nt, Mycobacterium avium subsp. paratuberculosis
guugucgggguauuaccaaauaucucuguuggauucccguuugcguuaccuauguacagcuguacggcgcccgggccagcaguugcguugaauccugacagc

SEQ ID NO: 4236999 - RNA, 126 nt, Mycobacterium avium subsp. paratuberculosis
cccgaggagagaagcgguguugugcccgccucacagcgacaacgcguuuccgcaggucagacguccuaacgagguugucgcugugaggcgggcacuugacacaccccccacuucuuggugccaacg

SEQ ID NO: 4237000 - RNA, 66 nt, Mycobacterium avium subsp. paratuberculosis
ucgcugucgccaagucgucgauggggggcaguucacgcggcugcgacgacgacugcguggcggcga

SEQ ID NO: 4237001 - RNA, 68 nt, Mycobacterium avium subsp. paratuberculosis
gaccgcgagagugcaucuaccgacgcugccucucgggaaacacgucgcugguugcacuuucgcggcuc

SEQ ID NO: 4237002 - RNA, 99 nt, Mycobacterium avium subsp. paratuberculosis
ggcgccugcugaccgacgccugaggccgagcgucacgccaguguggccgcggcggcccggcgucacgcuggcgugacgcucggggccgguuggugcgcc

SEQ ID NO: 4237003 - RNA, 67 nt, Mycobacterium avium subsp. paratuberculosis
gcggcguccgcaacgucgacuccgagucacccgaaggcaacucggagucgagcgucgugggaacugc

SEQ ID NO: 4237004 - RNA, 67 nt, Mycobacterium avium subsp. paratuberculosis
gcgcugaugcaggcgaccggcauggucgacgaccauauucgcgguugcugggugcccgcggcggugc

SEQ ID NO: 4237005 - RNA, 90 nt, Mycobacterium avium subsp. paratuberculosis
caggucgagguccucggcgauguugaccacccgcagcgaggcgauggugcccucgugguggacggucagcgcgccgucggacuccuccug

SEQ ID NO: 4237006 - RNA, 79 nt, Mycobacterium avium subsp. paratuberculosis
gucgacgacgguggugaagcccuugaugaccccgcuguccagcauccggucgacgcggcgcuucaccgccggcgccgac

SEQ ID NO: 4237007 - RNA, 86 nt, Mycobacterium avium subsp. paratuberculosis
ggcgccgaaccgguucgcggaaccacguugcgggacuucacugcgaaauuccgggcggcuggucugcgggaugaugucauggcgcc

SEQ ID NO: 4237008 - RNA, 55 nt, Mycobacterium avium subsp. paratuberculosis
gcugaccgacgcgggccgguugucgauuccguucaccaccggucugcuggucggc

SEQ ID NO: 4237009 - RNA, 65 nt, Mycobacterium avium subsp. paratuberculosis
ugagcccucccgcgaggagcaggcgcgggcccugugccugcgccugcucaccgcgcgagcgcgca

SEQ ID NO: 4237010 - RNA, 71 nt, Mycobacterium avium subsp. paratuberculosis
cgcuggcgaugaugcuggucggguugucgcgcaccacgcgcagcaccgagaagcccagcgugucgcgggug

SEQ ID NO: 4237011 - RNA, 55 nt, Mycobacterium avium subsp. paratuberculosis
ccugcgaucccgacgcggcccgugcauuccggcauggccugcagguggucgcggg

SEQ ID NO: 4237012 - RNA, 106 nt, Mycobacterium avium subsp. paratuberculosis
ccgaggcauucccgcgccgaaacgcugaccugcgaccaggaccgguccggcacgcugggcuugaggucgucgcggucaccggagucggugcucgacgcccauucgg

SEQ ID NO: 4237013 - RNA, 60 nt, Mycobacterium avium subsp. paratuberculosis
ucgaacaucguuguggcacagcacuuucgagcagugcaccaugcuggggucgguguucga

SEQ ID NO: 4237014 - RNA, 67 nt, Mycobacterium avium subsp. paratuberculosis
gucgccagcuugccgggccgcgaacggcgcgccuuaacgugcgcacgcgugugcgccaagcuggcgc

SEQ ID NO: 4237015 - RNA, 56 nt, Mycobacterium avium subsp. paratuberculosis
cgaacgugggguuguugcgcggauccggccgauuuuccgcaacaacuccacguucg

SEQ ID NO: 4237016 - RNA, 70 nt, Mycobacterium avium subsp. paratuberculosis
aggucguccucgccgaccucgaccgggucgaucgggucggacgccagcaggucggcgacggugaggaccu

SEQ ID NO: 4237017 - RNA, 75 nt, Mycobacterium avium subsp. paratuberculosis
gucuccgucgacgaccaggagcucggaccgaugacggugcaggcgcccguuccgcgcuucucgucggcguccggc

SEQ ID NO: 4237018 - RNA, 60 nt, Mycobacterium avium subsp. paratuberculosis
uguggguuucgcgggucaccgggaucagcgcaagcgaccugaccgcccacgagaaccacg

SEQ ID NO: 4237019 - RNA, 75 nt, Mycobacterium avium subsp. paratuberculosis
uugcgguucacgcgcguaaccccacggcgaaaucucguugggauuaucgccgugggguuacgcucgcgggcguga

SEQ ID NO: 4237020 - RNA, 75 nt, Mycobacterium avium subsp. paratuberculosis
cggguugcccugccgguuguuggugcgggcggucucgaucagcccaguguagacggccagcucggcguugauccg

SEQ ID NO: 4237021 - RNA, 55 nt, Mycobacterium avium subsp. paratuberculosis
ccugcgacaaaugcgcggaauugcauuggaugcaacauuucgggacuguugcggg

SEQ ID NO: 4237022 - RNA, 98 nt, Mycobacterium avium subsp. paratuberculosis
gcacgccgacgcgcgccaaggugccggcauagcguucggccaccuccgccggcagggugcugaccagcaccucggccgcggccaccucgucggccagc

SEQ ID NO: 4237023 - RNA, 81 nt, Mycobacterium avium subsp. paratuberculosis
gccaacuucgcgucccggaugcgggugggcaccgucaacgucaacggcggugucugguacuccgcggaugcgccguucggc

SEQ ID NO: 4237024 - RNA, 90 nt, Mycobacterium avium subsp. paratuberculosis
gcgagccaucgggucaccggauggucgaugacggcgaugccgucgcccucgagcacgucgucgagcacuucggugaagccgaccgccagc

SEQ ID NO: 4237025 - RNA, 112 nt, Mycobacterium avium subsp. paratuberculosis
guucggcaggaagcgcacguccaucaccaugucggcguccaucggcaggccguacuugaagccgaacgacucgacggugacgcugauggucgcguuggcgccgccgccgaac

SEQ ID NO: 4237026 - RNA, 70 nt, Mycobacterium avium subsp. paratuberculosis
ccgccugccgagcgugaagcuaguuucacgcucgaccgcgaacgugaaacuagcuucacguucggcgcgg

SEQ ID NO: 4237027 - RNA, 63 nt, Mycobacterium avium subsp. paratuberculosis
cugggccgccgaggccggcgcucggguggccgccaccgcccagcacguccacggcggcaucgg

SEQ ID NO: 4237028 - RNA, 92 nt, Mycobacterium avium subsp. paratuberculosis
cacgcgggccaugacccggccgucggcgucggcggcuaacgccuugaccgcggugcugccgacgucgaugccgauugugacguccuugcgug

SEQ ID NO: 4237029 - RNA, 76 nt, Mycobacterium avium subsp. paratuberculosis
cccaggcgguugccgagucguggucggugacccgguggucgcugggcggcagcucggcauagcccaauccccuggg

SEQ ID NO: 4237030 - RNA, 67 nt, Mycobacterium avium subsp. paratuberculosis
agcagguggugcgcugcagcgaccgguccggcuucguggucaacgcgcugcuggugcccuaccugcu

SEQ ID NO: 4237031 - RNA, 71 nt, Mycobacterium avium subsp. paratuberculosis
gcgcgccgagcgucacgcuggcgugacgcucgaccgccgccgccacgcuggcgugacgcucgcgagcgcgc

SEQ ID NO: 4237032 - RNA, 55 nt, Mycobacterium avium subsp. paratuberculosis
gaucuccggcugggcggacugauacucggagaucaucugccacagcccgaagauc

SEQ ID NO: 4237033 - RNA, 56 nt, Mycobacterium avium subsp. paratuberculosis
cgagcgucacgcuggcgugacccucggcgucgagcgccacgccggcgugacgcucg

SEQ ID NO: 4237034 - RNA, 80 nt, Mycobacterium avium subsp. paratuberculosis
gcgguuugcaggagaucguugacugccggcauuggaucagcccauccacuguccgccggcgacaucgauggucuggccgc

SEQ ID NO: 4237035 - RNA, 78 nt, Mycobacterium avium subsp. paratuberculosis
gcccggcucuugucggugacggucagcuggucgucccaggacacccuuccggcggugaccgcgccggccagggcgugc

SEQ ID NO: 4237036 - RNA, 64 nt, Mycobacterium avium subsp. paratuberculosis
ggcuuucgaccugcagccggaugugcugacccgggguccagcccaguccuugcagucgcgggcc

SEQ ID NO: 4237037 - RNA, 60 nt, Mycobacterium avium subsp. paratuberculosis
cgcuggacgagaucuucgcgacccgcccgcucgacgagugggcgcagaucuucgccaacg

SEQ ID NO: 4237038 - RNA, 63 nt, Mycobacterium avium subsp. paratuberculosis
ccagcagcgaacgcgccgacgucgaccccgacaucggcgacgacauggacguguuccugcagg

SEQ ID NO: 4237039 - RNA, 90 nt, Mycobacterium avium subsp. paratuberculosis
gagguagucgcccauguucuugccggccauccggaugacggccuccacggucgucaucuucuccagcgaguccagcagggcgcgccccuc

SEQ ID NO: 4237040 - RNA, 61 nt, Mycobacterium avium subsp. paratuberculosis
gaggucucccggauuugcgccgaucuggacaccgagguaggcgccuuucgggaccggccuc

SEQ ID NO: 4237041 - RNA, 62 nt, Mycobacterium avium subsp. paratuberculosis
ucgcaccugcuggccacucucgccgaagccaacugccuggugguggugcccagcggggccga

SEQ ID NO: 4237042 - RNA, 67 nt, Mycobacterium avium subsp. paratuberculosis
gccggccacauaccgcacgaucggcgucagucccagcucgacggccaucucggcgguggucaccagc

SEQ ID NO: 4237043 - RNA, 58 nt, Mycobacterium avium subsp. paratuberculosis
gaucggggguugcgggcggucauccuggguggcagcggcuuccugcaugcccucgauc

SEQ ID NO: 4237044 - RNA, 130 nt, Mycobacterium avium subsp. paratuberculosis
acaucgccggcgugcugcgccgcaucgaacaccugccgaucggcaccguggugcgccugcccaacgccgacgccgcaccgaucgggcggguggccgacgccggggccgacgccgucaucaucgcgaugau

SEQ ID NO: 4237045 - RNA, 57 nt, Mycobacterium avium subsp. paratuberculosis
cgauggugagcuggccguagcguccgggacccagauagcgugcggucaucgccaccg

SEQ ID NO: 4237046 - RNA, 59 nt, Mycobacterium avium subsp. paratuberculosis
gacacccacgacggcacggcccgccagcacgcggucggcgccggggcgaucgugguguc

SEQ ID NO: 4237047 - RNA, 67 nt, Mycobacterium avium subsp. paratuberculosis
gaaguccgccaacaagauucgccgcucccccgcuucgggaugggugagcaggauguuggccggcuuc

SEQ ID NO: 4237048 - RNA, 64 nt, Mycobacterium avium subsp. paratuberculosis
ggccgaguucuuggaacgggucucgcuggucuccgacagcgacgagauccccgaggacggcgcc

SEQ ID NO: 4237049 - RNA, 71 nt, Mycobacterium avium subsp. paratuberculosis
agggccaucgcgugagucucuguggugaaacgaccaaggaucacuaccgagaggaacaucgcgauggcccu

SEQ ID NO: 4237050 - RNA, 86 nt, Mycobacterium avium subsp. paratuberculosis
gagacguccagcggaaugcgcuucgcgccgucgucgucccaccggccgggaccgacggcgacgacggugccuuccugcggcuucuc

SEQ ID NO: 4237051 - RNA, 80 nt, Mycobacterium avium subsp. paratuberculosis
gccgugcuagacgggugaucguguugcaucggagucggucuuggcgacguccgcgaauacgguuaccugaucugugccgc

SEQ ID NO: 4237052 - RNA, 60 nt, Mycobacterium avium subsp. paratuberculosis
ggaucgaggacgucgccgacgcguugccgaugacggugaucggcgacauccucggcaucc

SEQ ID NO: 4237053 - RNA, 84 nt, Mycobacterium avium subsp. paratuberculosis
ggcggugcccugagcaucggcguggugcgcgcccggucgaaucagacaccccgcgacgcgggcccgcugguguucaccaccggc

SEQ ID NO: 4237054 - RNA, 80 nt, Mycobacterium avium subsp. paratuberculosis
cgccggguggacagcccgaccagcgugcccgguccuaccccccuaucgacgagcagcgcggccagguuguccgaacggcg

SEQ ID NO: 4237055 - RNA, 81 nt, Mycobacterium avium subsp. paratuberculosis
cucuuuggacgccgaacgucgacucguggugcggauucgcccgaaaucgcgcaauagagucgacguucggcggacgacggg

SEQ ID NO: 4237056 - RNA, 103 nt, Mycobacterium avium subsp. paratuberculosis
gggggugacggugaccggggcgcuggcgccgaaguccgcggcgaucggguggugaucgaccgcgucggcgcgcagcgccacggcgaacccgaaccccgccccc

SEQ ID NO: 4237057 - RNA, 105 nt, Mycobacterium avium subsp. paratuberculosis
cgcgauuacgaccugagcucgcugcgcuucgcggugaccggcgcggccaccguacccgucgugcuggucgagcggaugcaguccgagcucgacaucgacaucgug

SEQ ID NO: 4237058 - RNA, 129 nt, Mycobacterium avium subsp. paratuberculosis
guugcgguacggcuuucgguguugcgcuacggcuuucgguguugcaccagggcgcggaucgucggcgugucgccgcccuguguacacacucgacgcccaggaugcacacucgggccgagacgccgagac

SEQ ID NO: 4237059 - RNA, 77 nt, Mycobacterium avium subsp. paratuberculosis
gggugcggcagggcgacugaccgccgcguacgccaggugcgccgguuauccacaggucgcgguccugccaagcgccc

SEQ ID NO: 4237060 - RNA, 84 nt, Mycobacterium avium subsp. paratuberculosis
cgggcaggaugcgcagcgcgcgggcggccagguaggcccgcagcugcggguugcucagccagcucgcggugaucaggaagcccg

SEQ ID NO: 4237061 - RNA, 77 nt, Mycobacterium avium subsp. paratuberculosis
gccgacggguacuucagguagcccagggcggcguaggcggcgcuguccucggauugcuugaagucggcguuguuggc

SEQ ID NO: 4237062 - RNA, 77 nt, Mycobacterium avium subsp. paratuberculosis
gcagcuacguccgggugcccuaccgggcgcgggucccgaugacccgcgccgcgcugaugcaccgcgaccgguucugc

SEQ ID NO: 4237063 - RNA, 61 nt, Mycobacterium avium subsp. paratuberculosis
gguauuccguucugccacaacgguuguccgcugggcaaccugaucccggaguggaaugacc

SEQ ID NO: 4237064 - RNA, 96 nt, Mycobacterium avium subsp. paratuberculosis
agaacuucgggcuggguucgucgcgaccaguggcggcguuguucgucgaacucggcgucgcggggcuggucgccgaggaauucaacucgcuguucu

SEQ ID NO: 4237065 - RNA, 106 nt, Mycobacterium avium subsp. paratuberculosis
ccaaguucaaggcgcccgaacaaguggugcucugggaugcccugccgaagaacgacgccggcaaggugcucaagcaucggauccgcgcggcgcugaguaaggaugg

SEQ ID NO: 4237066 - RNA, 64 nt, Mycobacterium avium subsp. paratuberculosis
gguggccaugggugcggcggucaccggcugggugacccggcugcccgccgcgccgcaaaccacc

SEQ ID NO: 4237067 - RNA, 64 nt, Mycobacterium avium subsp. paratuberculosis
caccucgggggugcccgaacggcagggcaucgugcaccgccucgacgucggcaccuccggggug

SEQ ID NO: 4237068 - RNA, 86 nt, Mycobacterium avium subsp. paratuberculosis
cgucggcgaucgcgguggccaucggcacgcugaugcccagcaccucgucgcugguggucacgccgcggguggcgccguagccgacg

SEQ ID NO: 4237069 - RNA, 57 nt, Mycobacterium avium subsp. paratuberculosis
cgugcgcgccgacggcggcgaucguggcgccgacgaugccgccgaucagugcgugcg

SEQ ID NO: 4237070 - RNA, 59 nt, Mycobacterium avium subsp. paratuberculosis
ggcgcauguugguuugcgcguugcgcucauaggcgacgacgacgccgggugacagcgcc

SEQ ID NO: 4237071 - RNA, 130 nt, Mycobacterium avium subsp. paratuberculosis
uugagggucucccgcggugucgcgagcgcgccccauacccccgguucguccgccagcacgguuugccagugcgaaaggucguggcgggcgaacguguucgccagcagcucggucgccgcggccgcauugg

SEQ ID NO: 4237072 - RNA, 62 nt, Mycobacterium avium subsp. paratuberculosis
ccggaucggcgccggugaugaugacgacguccacgucgucguccgucucggcgucggccagg

SEQ ID NO: 4237073 - RNA, 63 nt, Mycobacterium avium subsp. paratuberculosis
cggcagcugaucgccucgggcuacaucggguucuuccugugcccgggcgcggcggaacugucg

SEQ ID NO: 4237074 - RNA, 110 nt, Mycobacterium avium subsp. paratuberculosis
ucaccugggucgcggcgcgggccggguguccgucgacgcggugcugggcggccgguucggccugccgcgcacggucgacgagaucgacccggcggugcugucccggguga

SEQ ID NO: 4237075 - RNA, 56 nt, Mycobacterium avium subsp. paratuberculosis
uccgccggcucugagucgccgucgauuccucuuccggugcacaucgacccggcgga

SEQ ID NO: 4237076 - RNA, 78 nt, Mycobacterium avium subsp. paratuberculosis
cugcgcaccggcggcucguacuagagggccuucgcgaucagccgaagggucuaguugaacgagucgccgcaggcgcag

SEQ ID NO: 4237077 - RNA, 75 nt, Mycobacterium avium subsp. paratuberculosis
gccgucggccagcacgacguccgucgcgccggccgccguggcgaugucggccuuguccgucgugcugaccacggc

SEQ ID NO: 4237078 - RNA, 79 nt, Mycobacterium avium subsp. paratuberculosis
cggcaugcugcggcggguguucgucaucgccucggccaucaccgcggugcugagccuggacgccgccgugguguugcug

SEQ ID NO: 4237079 - RNA, 81 nt, Mycobacterium avium subsp. paratuberculosis
gcucgaaauacccgggcuucgacguggccaaggcggucaaggcguuccugcaggccgccaucgggcccgggcaggucgagu

SEQ ID NO: 4237080 - RNA, 67 nt, Mycobacterium avium subsp. paratuberculosis
gacggcggcgguguucuucgagacgccgucgaacccgaugcagucgcugguggacaucgccgcgguc

SEQ ID NO: 4237081 - RNA, 87 nt, Mycobacterium avium subsp. paratuberculosis
ccggccgugcaccgcacgggccagcaggucggcgguggccggugccaccaccaccaggucggccugcuugcccagcugcacgugcgg

SEQ ID NO: 4237082 - RNA, 77 nt, Mycobacterium avium subsp. paratuberculosis
gccccacgagcuguccgguggcgagcagcagcgggucgcgaucgcccgcgcguucgucaaccggccgcuggugcugc

SEQ ID NO: 4237083 - RNA, 62 nt, Mycobacterium avium subsp. paratuberculosis
gcggucagcuggaucggcggcaggucgaagucguauucgacucgguucuugauccgcaccgc

SEQ ID NO: 4237084 - RNA, 62 nt, Mycobacterium avium subsp. paratuberculosis
gccggucggucucguggccgcgcaggugcgcgaugccggacagccgcgacaccgaucccggc

SEQ ID NO: 4237085 - RNA, 85 nt, Mycobacterium avium subsp. paratuberculosis
caucaagguccucaccgucgccgaccugcuggcguccgacccgaucgacccggucgaggucggcgaggacgaccuggcgcugaug

SEQ ID NO: 4237086 - RNA, 62 nt, Mycobacterium avium subsp. paratuberculosis
ucgcggccgggcgggaccgucgaccuaugcuggggcggugaccgucuucgacccggccgcgg

SEQ ID NO: 4237087 - RNA, 82 nt, Mycobacterium avium subsp. paratuberculosis
ggugggccagcacggcggccgucucguagccgaugccgguguuggcgccggugaugacgacgacgcggccgcucugaucacc

SEQ ID NO: 4237088 - RNA, 55 nt, Mycobacterium avium subsp. paratuberculosis
gaucgugcugcugcacggcgagcccaccuggagcuaccuguaccgcaccaugauc

SEQ ID NO: 4237089 - RNA, 72 nt, Mycobacterium avium subsp. paratuberculosis
gccggcggugaucgguagggccggcggauccggcagcuccggcagacggcgugcccaccagucgcggucggc

SEQ ID NO: 4237090 - RNA, 82 nt, Mycobacterium avium subsp. paratuberculosis
ggcgaucucgggcaugcgggccgggccgcgcucgucgagccagcgcacgaacuccgggccggccugcagcgucgaauacgcc

SEQ ID NO: 4237091 - RNA, 79 nt, Mycobacterium avium subsp. paratuberculosis
gcuggcggcaaccagguggccguaauggaugggaucgaacgucccacccaucacucccaaccugcgaagcugcuuuugc

SEQ ID NO: 4237092 - RNA, 130 nt, Mycobacterium avium subsp. paratuberculosis
gcugauccaccgcaaccggccgguguccgucgacgcguugaucgacgggguguggggcgcggcgccggugccggcggcgcgcaccagcauccaguccuauguguccacccugcgccggcugcugcgcagc

SEQ ID NO: 4237093 - RNA, 55 nt, Mycobacterium avium subsp. paratuberculosis
cucguuggacggcgcgcaguccagguucgaccacagccgcuuauuguccagcgag

SEQ ID NO: 4237094 - RNA, 92 nt, Mycobacterium avium subsp. paratuberculosis
ggcguacaaccggccaccggguccggcggugucgguaccgcccgguucggggucggucaccgucgucggaccgucgugcgucgcggugcgcu

SEQ ID NO: 4237095 - RNA, 73 nt, Mycobacterium avium subsp. paratuberculosis
ucgugcgcggccagcacccgaucgcgcucggccggcgucugggccagcgcgacgacggugcgggccagcauga

SEQ ID NO: 4237096 - RNA, 57 nt, Mycobacterium avium subsp. paratuberculosis
gaucgcggugugcuucuugauccgguugacgcccucgaccaggacgcgcucgcgguc

SEQ ID NO: 4237097 - RNA, 118 nt, Mycobacterium avium subsp. paratuberculosis
gcacaucgccggccuguucugagccggcacgaccggaacgaggguggggcagaugcgccgagcgugugccccaccuuucgucuuucuuccccggcuggggaucccgcgcggugagggc

SEQ ID NO: 4237098 - RNA, 99 nt, Mycobacterium avium subsp. paratuberculosis
gcggcgaccugagcguaggucaccaucacgccgugguacuccggcgcgauccgcggguugcuguuggagaaccgcggguccagcgccaggccgugccgc

SEQ ID NO: 4237099 - RNA, 118 nt, Mycobacterium avium subsp. paratuberculosis
ggcugccggagcccgccgcgcugcggaucgacggcaccaccagcgaggugcgggcccaguaguccagcugccgguaggugaugccggcgaucuggcaggcgcucgggccgcgguagcc

SEQ ID NO: 4237100 - RNA, 64 nt, Mycobacterium avium subsp. paratuberculosis
gugucguccgguuucaccuggggcgcaaccacaaccggcucguccccggugggccuggcgacac

SEQ ID NO: 4237101 - RNA, 66 nt, Mycobacterium avium subsp. paratuberculosis
agcgccgagcgucacgccagcgugaccgucgucgccgagcgucacgccagcgugacggccggcgcu

SEQ ID NO: 4237102 - RNA, 78 nt, Mycobacterium avium subsp. paratuberculosis
cacgcccagccgguaggugacgcugcugcggcccagccgggugacggccagccccaccugcaggcccucggggaagug

SEQ ID NO: 4237103 - RNA, 80 nt, Mycobacterium avium subsp. paratuberculosis
gcuguccgggcuguuccgcacccggcgguuccgcgucuacaccaccgacgacgucgucggggcggagauggccggggcgc

SEQ ID NO: 4237104 - RNA, 72 nt, Mycobacterium avium subsp. paratuberculosis
gucgcgguggauggccaccaccaauagguaaacggcagaaggcuauuggggucgccgcuacuguuugucgac

SEQ ID NO: 4237105 - RNA, 77 nt, Mycobacterium avium subsp. paratuberculosis
gcccgcaugccgguguugccgguggcgcgaccgaagaccuucuucgcgcugcccuuggcggcuucgaacuugugggc

SEQ ID NO: 4237106 - RNA, 73 nt, Mycobacterium avium subsp. paratuberculosis
gcggugucccagucgaucuccucguagcugccgucggggcggcggcgcagcggcgaggucaaccgggcgcggc

SEQ ID NO: 4237107 - RNA, 69 nt, Mycobacterium avium subsp. paratuberculosis
guugcgaugugugaucgcaacgccuuugggcacaccgguggugcccgacguguaaaucacauaggcgac

SEQ ID NO: 4237108 - RNA, 61 nt, Mycobacterium avium subsp. paratuberculosis
ggucggcucgcggcuggcggcgccgcgcgcggugcugggcgccgcgaucgugagccugacc

SEQ ID NO: 4237109 - RNA, 75 nt, Mycobacterium avium subsp. paratuberculosis
gccguccgggccgacgaucacgaugucguugcuguagcgcagguauucggucuuguugucgucggcccgcgccgc

SEQ ID NO: 4237110 - RNA, 86 nt, Mycobacterium avium subsp. paratuberculosis
cugcgcgaugauguugagcuggaucucgcgggugcccccgccgaucaguucggcgggcagaugcagauacggcucgacgacggcgg

SEQ ID NO: 4237111 - RNA, 115 nt, Mycobacterium avium subsp. paratuberculosis
cggaugcggcuagcguugccgcaacucgacccgucggcgcugacguugggccgggucgacgacgaccugaucaucagcgccggcggguugcggcgcagggugagguuggcguccg

SEQ ID NO: 4237112 - RNA, 56 nt, Mycobacterium avium subsp. paratuberculosis
gcggguggaccccgacgcgcugcgcaaacggaugcggcugcgcgggagucgcccgc

SEQ ID NO: 4237113 - RNA, 66 nt, Mycobacterium avium subsp. paratuberculosis
ggcagcacggaugcuccggaggcgcuguggcccuuggccacucgccggaucagcauccggguggcc

SEQ ID NO: 4237114 - RNA, 79 nt, Mycobacterium avium subsp. paratuberculosis
gaccggaaucgagguccgaggucgcugcgccgacgaccacgaggucuucggugaguagaucgcgguagaagauucgguc

SEQ ID NO: 4237115 - RNA, 99 nt, Mycobacterium avium subsp. paratuberculosis
gggacaccuggucguaggugucggcgcggaagguggugaucuccaggcggcggucgcccuugccgacgccgacggugccgaauucgauuccgguguccc

SEQ ID NO: 4237116 - RNA, 80 nt, Mycobacterium avium subsp. paratuberculosis
guggcgaucagucauguccgggugcgcguggcagcgggguaugucgacgggccugcagcccuggacgucucgaucgccgc

SEQ ID NO: 4237117 - RNA, 111 nt, Mycobacterium avium subsp. paratuberculosis
uucgccgcgcugcgcccucuucgccgcgcucguaacgccacggcggaaucucggccggauuuccgcccuggcguuacgagcggcgucgccgggcgucgcgcacccggcgga

SEQ ID NO: 4237118 - RNA, 101 nt, Mycobacterium avium subsp. paratuberculosis
gauccgucggucggcagucgugucaggcgugugcgccgccgucgacgcgaaucuccgucccggugaugaacgcgccgucgucggaggccaccaucgcgauc

SEQ ID NO: 4237119 - RNA, 74 nt, Mycobacterium avium subsp. paratuberculosis
gcgccgcgcggcggcgcgcaucgucgccgggcuaaggugauugcccguggccgagaucgcgccgcugcgcgugc

SEQ ID NO: 4237120 - RNA, 56 nt, Mycobacterium avium subsp. paratuberculosis
gaguacgucgacuggcugaucgaggcgggcuaccugaucgagcgggucgacgacuu

SEQ ID NO: 4237121 - RNA, 70 nt, Mycobacterium avium subsp. paratuberculosis
gcucagcacggugccgucgucgagcagugccgagaugcggacgugcucggcgcgcggcaccgcgccgagc

SEQ ID NO: 4237122 - RNA, 81 nt, Mycobacterium avium subsp. paratuberculosis
caggaacaugaacgacccggucggccgguucgggucggccacgccggcccgggcgcgccgcaccgcgucggacaccgccug

SEQ ID NO: 4237123 - RNA, 59 nt, Mycobacterium avium subsp. paratuberculosis
gcagcaggacgagcucaccucgcuggucgaaccgcaagacggugagccguucgugcugc

SEQ ID NO: 4237124 - RNA, 57 nt, Mycobacterium avium subsp. paratuberculosis
gccgcggcaccgaugguguugagaccaaacagguuucgacguucuccacgcugcggc

SEQ ID NO: 4237125 - RNA, 109 nt, Mycobacterium avium subsp. paratuberculosis
cgcagcggcugggguugugcgugcgcaaacugcggaaccgcggcgcgguggugaucgugggcaccugcccggaucugggguucaucagcgccauuccgcaaccgcugcg

SEQ ID NO: 4237126 - RNA, 100 nt, Mycobacterium avium subsp. paratuberculosis
gccgaccucaccguugaagcgcgagcagacgcaaaagcuccccgccgcccggcgugucgggugcuuucgcgucugcucgccggacgaccggggucccggc

SEQ ID NO: 4237127 - RNA, 70 nt, Mycobacterium avium subsp. paratuberculosis
ggaugcccggacugcguggccucgcacgagcacacgcugcgcgaggcgggcgucagccgggagaccaucc

SEQ ID NO: 4237128 - RNA, 61 nt, Mycobacterium avium subsp. paratuberculosis
ccggcgucgacguccucgucgguggccgccaguccguccaguucgacggcgucgacgccgg

SEQ ID NO: 4237129 - RNA, 85 nt, Mycobacterium avium subsp. paratuberculosis
ucaguugcacgcgcagcggcgcgaucucggccacgggcaaucaccuuagcccggcgacgaugcgcgccgccgcgcggcgcgagga

SEQ ID NO: 4237130 - RNA, 95 nt, Mycobacterium avium subsp. paratuberculosis
gccggcgcugggaaucaugcucacgcuguucagcgcggccggcgaaucgaccgcgucgcugcugggcagcgcggccuggauccuggccgaccggc

SEQ ID NO: 4237131 - RNA, 85 nt, Mycobacterium avium subsp. paratuberculosis
ccgcgggucugguguucgccgccacgauggccucguuugucuucagugaucugaaggucaucgggcaggugggcaccaccauugg

SEQ ID NO: 4237132 - RNA, 74 nt, Mycobacterium avium subsp. paratuberculosis
gcggcgccggcgucgacgccgucgaacuggacggacuggcggccaccgacgaggacgucgacgccggggcccgc

SEQ ID NO: 4237133 - RNA, 79 nt, Mycobacterium avium subsp. paratuberculosis
ucgccgggcugggcgcggacuggacggccgccaacaucgccggugugcugguggagcagguccgcgcgcagaucggcga

SEQ ID NO: 4237134 - RNA, 76 nt, Mycobacterium avium subsp. paratuberculosis
ggagccuccgucacggcgcaggucagcgcgucgguggcguucgucgugcugauguacgccgugguggaggucaucc

SEQ ID NO: 4237135 - RNA, 65 nt, Mycobacterium avium subsp. paratuberculosis
gcccgagcugggcaccacgaucggccugcugcccgccuggaagaucgugcugauccugcuggugc

SEQ ID NO: 4237136 - RNA, 70 nt, Mycobacterium avium subsp. paratuberculosis
cggcgccgagcgucacgcuggcguggcgccggcgcgcgagcgucacgcuggcgugacgcucgaggccccg

SEQ ID NO: 4237137 - RNA, 97 nt, Mycobacterium avium subsp. paratuberculosis
ucgccgaccaacgcaccuucggcggcuggaugcucgccgaccuucucgagguggacggcagcauccugccccggcccgucgcgcaccuggcgcgcga

SEQ ID NO: 4237138 - RNA, 63 nt, Mycobacterium avium subsp. paratuberculosis
cgccgaacgucgacuuguugggcgaaaucggcuggguugugcccaacaaguccacguugggcg

SEQ ID NO: 4237139 - RNA, 74 nt, Mycobacterium avium subsp. paratuberculosis
gcccgguggcgucgaucucgcgguucgcgguggccccguucaccgcgccgaccgccgcgaucacgccgucgcgc

SEQ ID NO: 4237140 - RNA, 58 nt, Mycobacterium avium subsp. paratuberculosis
guuggagguggccgccagcacgaacaccccgcggucgugcgcggcggcggcuuccagc

SEQ ID NO: 4237141 - RNA, 68 nt, Mycobacterium avium subsp. paratuberculosis
ggacgacccacugaccaggaggacagcgcugcaugguuagccgguuguccccggcggaugcgucguuc

SEQ ID NO: 4237142 - RNA, 81 nt, Mycobacterium avium subsp. paratuberculosis
cgcgcugaaguucgggucgcgggcguccaagacgcgguuugcgaucuaucugggcgaccugggcaccgacaccgccgcgcg

SEQ ID NO: 4237143 - RNA, 69 nt, Mycobacterium avium subsp. paratuberculosis
ugugcacgaugccggcuucccagccgggcauggucucgcuguggacggcggugaagccggcgucggcca

SEQ ID NO: 4237144 - RNA, 72 nt, Mycobacterium avium subsp. paratuberculosis
gacggccucgucggucauguaggccagccggguggccucgccggcgaacagcugcuggcccaccaggccguc

SEQ ID NO: 4237145 - RNA, 87 nt, Mycobacterium avium subsp. paratuberculosis
uggccaccucccggauuuacuuaacguuagguaagccuagcauccgguuuacuuaucgguaagucaguuaagcugguggggugggca

SEQ ID NO: 4237146 - RNA, 105 nt, Mycobacterium avium subsp. paratuberculosis
cgggucaguacgucggcgacggccuccuggaagccggccgcgacgucggcguucaccgcguccggguggcuuuccagguaccgcgccacggccgucuugagcccg

SEQ ID NO: 4237147 - RNA, 103 nt, Mycobacterium avium subsp. paratuberculosis
ggcgcgaucggccaccgcgcgcaucuggaccgccucguagccgcccuuggaggcgaucgccaugguggcguccaggaugcguuugcggcguucccgcugcgcc

SEQ ID NO: 4237148 - RNA, 95 nt, Mycobacterium avium subsp. paratuberculosis
gcgaagucgccgccagggccgccgcgguuugggcgggucgaugacguugagccgcaucgaccagccggccgggccguccucgucauagguuucgc

SEQ ID NO: 4237149 - RNA, 96 nt, Mycobacterium avium subsp. paratuberculosis
gcgggccgggacggugacaccggccggcgaccugucgaucuggccgccgaucggggcgaccgcggucgacgucaccggcggguacgcccggcucgc

SEQ ID NO: 4237150 - RNA, 63 nt, Mycobacterium avium subsp. paratuberculosis
gcccgccgacgugucuugguccgacggcgcgcagcuguucuccaccauggacgcgcggccggc

SEQ ID NO: 4237151 - RNA, 58 nt, Mycobacterium avium subsp. paratuberculosis
caucaucugcggauuggagcccgcguggcugaacgacaugguuccuccgucgguggug

SEQ ID NO: 4237152 - RNA, 74 nt, Mycobacterium avium subsp. paratuberculosis
cguauucguggaacaccuugccgaugugcugcaucgccugaaacgacggcgcggccgggguguucagggacacg

SEQ ID NO: 4237153 - RNA, 113 nt, Mycobacterium avium subsp. paratuberculosis
gggcgagaccgccgaccagcucgccgcgcucggccagggccggguggaaagcgugcugugcgacgugacguccaccgcccaggucgaugcgcuguucgcgucggcccacgccc

SEQ ID NO: 4237154 - RNA, 130 nt, Mycobacterium avium subsp. paratuberculosis
guugauggccgucgcccggccggcccgcccgaugcggaccuggacgcugaucccggcgcuggccggcgccggccuggugacgggcgucugcucgcauugguggcccgaauugcccggcaacggccgcagc

SEQ ID NO: 4237155 - RNA, 61 nt, Mycobacterium avium subsp. paratuberculosis
cuugcagguaguggauucggcugugucacuuggugauuggccgaucgcacugccacgcgag

SEQ ID NO: 4237156 - RNA, 61 nt, Mycobacterium avium subsp. paratuberculosis
gccuggcauagaucuccggauuccccagcagcgcaacgguucccaacgagaucauguuggc

SEQ ID NO: 4237157 - RNA, 55 nt, Mycobacterium avium subsp. paratuberculosis
gucgcgcaggucggcaggguggaguucgccggcuucaucgccuggcuggcguggc

SEQ ID NO: 4237158 - RNA, 79 nt, Mycobacterium avium subsp. paratuberculosis
cgcacggauuaguaacggugcgucgccccggcggggccgucgcgguuaccgcgcggaccggcccaccgugacgccggcg

SEQ ID NO: 4237159 - RNA, 77 nt, Mycobacterium avium subsp. paratuberculosis
cuggggcggcuggaaaaggagcucguccgggauccggccgcgguggccgaugucgacgaguuccucgagcgcaccgg

SEQ ID NO: 4237160 - RNA, 83 nt, Mycobacterium avium subsp. paratuberculosis
gccgggccuuccaggacggugcagcgcucaucuacuuggggcgcuugagguaggcgacgugcugcucgccgguggggccgggc

SEQ ID NO: 4237161 - RNA, 76 nt, Mycobacterium avium subsp. paratuberculosis
ggucccgcccugcagcaggaugaacauguaggccgagaucaggcccaugucguggugcugcggcagccaggagacc

SEQ ID NO: 4237162 - RNA, 58 nt, Mycobacterium avium subsp. paratuberculosis
cugccgguaucccucgccggucgccagcagcaccucgccggcgagcggacugccgcag

SEQ ID NO: 4237163 - RNA, 78 nt, Mycobacterium avium subsp. paratuberculosis
cccgaccuguucuugcacucggcaugggcgagugcuaagaaugacuuggcacucgcgaccagugagugcuaggucggg

SEQ ID NO: 4237164 - RNA, 129 nt, Mycobacterium avium subsp. paratuberculosis
gcagaccagcaaacgccgccaguucuucaccaucgcccgccgucagguccggcuggugaucgccgaccgcgccuacuuccuguuccuggcggugcugccguucgugaugggcgcgcugucgcugaccgu

SEQ ID NO: 4237165 - RNA, 59 nt, Mycobacterium avium subsp. paratuberculosis
gaguucggguucuucgucauccugcuggccguggccggcaacgagaccacccgcaauuc

SEQ ID NO: 4237166 - RNA, 55 nt, Mycobacterium avium subsp. paratuberculosis
guggaguuccugcucgacgaacgcggcaaccacguguucaucgagaugaacccgc

SEQ ID NO: 4237167 - RNA, 64 nt, Mycobacterium avium subsp. paratuberculosis
gcgcgagcagacgcaaaagccccgcgacacgccgcgcaucaggggcuuuugcgucugcucgcgc

SEQ ID NO: 4237168 - RNA, 62 nt, Mycobacterium avium subsp. paratuberculosis
ggcgcacggggugaccacgguggugaugggcaacugcggcgucggcuucgccccgugccgcc

SEQ ID NO: 4237169 - RNA, 98 nt, Mycobacterium avium subsp. paratuberculosis
ccacgcugggcgcguugcugcggcggcugcagccggauuggucgaugaccuucgucgagcgccuggacgcggucgccgcugagagcagcagcccgugg

SEQ ID NO: 4237170 - RNA, 87 nt, Mycobacterium avium subsp. paratuberculosis
uggccgagcggaccggggcgaagauccgcaaggcgcuggagagcuacaccagcaccuaccugcgguucgucuggacguugucggcca

SEQ ID NO: 4237171 - RNA, 122 nt, Mycobacterium avium subsp. paratuberculosis
gucaagcacaaucggcgccgauccucgccgcgagccgaauuagaguccauggcaacgacuuugccgaggcuguuggaucgcgccggggcgcugcuggcucggcgccgaugaguguuacuggc

SEQ ID NO: 4237172 - RNA, 56 nt, Mycobacterium avium subsp. paratuberculosis
cgcccagccgaaccuguugcugcgguugucccacagccgauaguucgggcugggcg

SEQ ID NO: 4237173 - RNA, 59 nt, Mycobacterium avium subsp. paratuberculosis
guggugcugcggccggacgguagcguugcccagacgcugccgcgugcuuucagcacggc

SEQ ID NO: 4237174 - RNA, 61 nt, Mycobacterium avium subsp. paratuberculosis
cgccgccgucacgcuggcgugacgcucggcgccgacggucacgcuggcgugacgcucggcg

SEQ ID NO: 4237175 - RNA, 129 nt, Mycobacterium avium subsp. paratuberculosis
gccccgcuggccuucgcgcuggccgacgccgaccgcgccggccggauccggcugcacgugcgcaucgacgagcgcaccgccggcuaucuggccaucggccuggccaucgcggccggcgcuccggugugc

SEQ ID NO: 4237176 - RNA, 62 nt, Mycobacterium avium subsp. paratuberculosis
ucguuggugggcugcuggggcggcugccccuugcgcagcgucuccagcagcucgcgguacgg

SEQ ID NO: 4237177 - RNA, 64 nt, Mycobacterium avium subsp. paratuberculosis
auggccgcgguguggcugagcgugcugcugguuuucgccgcccgccgccaaucccguuggccgu

SEQ ID NO: 4237178 - RNA, 87 nt, Mycobacterium avium subsp. paratuberculosis
ggugcgcucgucgaccggggugaucgccgagauggugcgguugucgaucaugccccagcucuuggucaccgcgaucccgagcccgcc

SEQ ID NO: 4237179 - RNA, 77 nt, Mycobacterium avium subsp. paratuberculosis
uuggggguguuaugagagucucaugggcaucaucggucacauggguaccgguuugccuaccaugagaucacucccaa

SEQ ID NO: 4237180 - RNA, 74 nt, Mycobacterium avium subsp. paratuberculosis
guggguguagccgcgccugccaccaugaucaucggaagcuaugugcuggacuggcgggucgggcucgcauucac

SEQ ID NO: 4237181 - RNA, 98 nt, Mycobacterium avium subsp. paratuberculosis
cugaugacgagguccuugaagccgucgcccuuggugagaaugucguaggccagccugaugcccucgcgcagggcgaugaugucgagcucguuggacag

SEQ ID NO: 4237182 - RNA, 62 nt, Mycobacterium avium subsp. paratuberculosis
augggcgacgccgccgcggacgucuugaucgggggaccggcgccgcaggaggcgucgcccgu

SEQ ID NO: 4237183 - RNA, 66 nt, Mycobacterium avium subsp. paratuberculosis
ggugauccacgacgccucgucggacagcaggaacaggcacaugccgaccaggucgucgggaguucc

SEQ ID NO: 4237184 - RNA, 68 nt, Mycobacterium avium subsp. paratuberculosis
cgucguggucaccgucaccgacgccaccaguuaccugcgcgggccgucggugcugguggcccacggcg

SEQ ID NO: 4237185 - RNA, 86 nt, Mycobacterium avium subsp. paratuberculosis
cgcccgccgguaggcggcgaccgacucgcccggaguggcggcgccguauguccagcgcgggucggugccguccggccaggcgggcg

SEQ ID NO: 4237186 - RNA, 108 nt, Mycobacterium avium subsp. paratuberculosis
gaugaggugaucggccggcuggcagaggguuuggccaccaccgugcaguacaaggggccgcugucggugguggaaggcgagcucgccgaccaggccgaagccgucguc

SEQ ID NO: 4237187 - RNA, 56 nt, Mycobacterium avium subsp. paratuberculosis
guucccgguguggcugucgguggcgccgaacgcuuuacgacgcccaucguggcgac

SEQ ID NO: 4237188 - RNA, 58 nt, Mycobacterium avium subsp. paratuberculosis
cgagaagacgcaaaagcccccgcacgcagggcgugucgggggcuuuugcgucugcucg

SEQ ID NO: 4237189 - RNA, 63 nt, Mycobacterium avium subsp. paratuberculosis
gaugacguugagcgcgaugugggcgucggcggguuugacgucgucgucgaguucgaugucauc

SEQ ID NO: 4237190 - RNA, 76 nt, Mycobacterium avium subsp. paratuberculosis
gucacgcuggcguggcuucgcccgccgagcgucacgccagcguggcuucgcccgccgagcgucacgccagcgugac

SEQ ID NO: 4237191 - RNA, 87 nt, Mycobacterium avium subsp. paratuberculosis
gguuggccaucguggcggcgcuggccgugcuggucacgguuuucacgcugauccgcgaccggccggcgccggugaugucggccaagc

SEQ ID NO: 4237192 - RNA, 66 nt, Mycobacterium avium subsp. paratuberculosis
ggcucccagaccgggaaccguggcacugugucaaauacgggcuugguucucgaucugaauggcgcc

SEQ ID NO: 4237193 - RNA, 56 nt, Mycobacterium avium subsp. paratuberculosis
gcgcguuggugccugaguugcccgucagcaugugaagcaauccagcaccaacgcgc

SEQ ID NO: 4237194 - RNA, 88 nt, Mycobacterium avium subsp. paratuberculosis
gcuggucggccuacccgcgggugcuggacuucgcggcguucgcgucgaucgccgacgaggucggcgccaagcugugggucgacauggc

SEQ ID NO: 4237195 - RNA, 58 nt, Mycobacterium avium subsp. paratuberculosis
gucgguggugcaggccauggugugcccggccuuacgggccgccucgcccaccaccggc

SEQ ID NO: 4237196 - RNA, 57 nt, Mycobacterium avium subsp. paratuberculosis
caggucguagaaggucaggucgacgucggaguauucgaccgccuucuggaagaccug

SEQ ID NO: 4237197 - RNA, 97 nt, Mycobacterium avium subsp. paratuberculosis
ggugauccggggugaucucgcgguugccggccuggugggcggcguucugggccgccaccaccgcgccgcgcgcccgcggggugaaccgcuggaagcc

SEQ ID NO: 4237198 - RNA, 67 nt, Mycobacterium avium subsp. paratuberculosis
gcgggugcuggcgccguugggucugguguucgacgagaacucgcccuggcugagcgucagcgccugc

SEQ ID NO: 4237199 - RNA, 60 nt, Mycobacterium avium subsp. paratuberculosis
gggggauggguuucggugucggggcccgcuucgaguaucucggcgcugaauucguguccc

SEQ ID NO: 4237200 - RNA, 93 nt, Mycobacterium avium subsp. paratuberculosis
gagauccccugagccgccgagcagacgcaaaaccacccgacacgccgaagaauuggggguuuuugcgucugcucgcggugcgauggcgaccuu

SEQ ID NO: 4237201 - RNA, 55 nt, Mycobacterium avium subsp. paratuberculosis
ggcggugcugcggggcaccgccgccaaccaggacggccgcaccgucaacaucgcc

SEQ ID NO: 4237202 - RNA, 60 nt, Mycobacterium avium subsp. paratuberculosis
cucggggacgucggcguccuggcggcgauccgguugucccggaacgccgacgucgucggg

SEQ ID NO: 4237203 - RNA, 69 nt, Mycobacterium avium subsp. paratuberculosis
gucgugcggcugacgcucguuucgcauggcaugacggaugccauggcggacgggcguuuucccgccgac

SEQ ID NO: 4237204 - RNA, 55 nt, Mycobacterium avium subsp. paratuberculosis
uugugacacgcugauuucucguaccuccgugggcgaggauuccggugugucgugg

SEQ ID NO: 4237205 - RNA, 84 nt, Mycobacterium avium subsp. paratuberculosis
gaccaugcucgauaggccguucggacggcgcagccugcugcgcggugcgggcgcgcuuuccgcggcggcgcucgccccaugguc

SEQ ID NO: 4237206 - RNA, 82 nt, Mycobacterium avium subsp. paratuberculosis
gucgcgaccguugagcguggcgcugcgcacggugucggcggcaaugucgaugacggugucggcgccggccagcgcgucgaac

SEQ ID NO: 4237207 - RNA, 76 nt, Mycobacterium avium subsp. paratuberculosis
gagcgcggcgcgaccguaccguuuccauugccgcgccgcgguuuucggcugagauucgguacgguccgccgugguu

SEQ ID NO: 4237208 - RNA, 70 nt, Mycobacterium avium subsp. paratuberculosis
cccggcgcuggccaggguggucaccgcggucuccacguccgccucggccaccaccaggucggcgucgugg

SEQ ID NO: 4237209 - RNA, 91 nt, Mycobacterium avium subsp. paratuberculosis
guagcggguguacugcgucaucuuggccugaccggacugaccuuccuugcgcaguuccucgaagcgcgggaugacgacggugagcagcugc

SEQ ID NO: 4237210 - RNA, 94 nt, Mycobacterium avium subsp. paratuberculosis
ggugcuggccgggguggagcgggcgcuggcgcuggacagcgaaccgccggacucgcuggccgaggccgacgcgcugcucaccgcggcgcagacc

SEQ ID NO: 4237211 - RNA, 76 nt, Mycobacterium avium subsp. paratuberculosis
ggcucccacagcgugaccucgucaccaagaucguugccgcccagugcgaucggcgaccagaucacgucgagcagcc

SEQ ID NO: 4237212 - RNA, 99 nt, Mycobacterium avium subsp. paratuberculosis
gcgccaucgucgaccaucucgagucgaccgggguggauucgcugugguucuccgagcugguguacuccccggcggucgauccgguggucgggauggcgu

SEQ ID NO: 4237213 - RNA, 62 nt, Mycobacterium avium subsp. paratuberculosis
cacaucgaaaucggacugcccagccauaucgcccacgugcgggggcggcugaccgucgagug

SEQ ID NO: 4237214 - RNA, 64 nt, Mycobacterium avium subsp. paratuberculosis
ccucgccgagcgucacgccagcguggcgccgggacccgagcgccacgcuggcgugacgcugagg

SEQ ID NO: 4237215 - RNA, 98 nt, Mycobacterium avium subsp. paratuberculosis
cgucggugaagaugaggucggccagguuguuguuggugcggcgcaaccggcgggccagcacccgcaacagcuguucggcgaucucggggcggucggcg

SEQ ID NO: 4237216 - RNA, 129 nt, Mycobacterium avium subsp. paratuberculosis
gcacguccucgagcagcaugcguuccggcggcgcggcgaccacgucgaccagcagcgcgguggugccgcgccgcgccacuuugcugacgucgaugccgucgcgcugcgccugcugcaggaucgacgugc

SEQ ID NO: 4237217 - RNA, 94 nt, Mycobacterium avium subsp. paratuberculosis
ggucgccgcccaccgcgagcagacgcaaaagccccccgacacgccgcugggaaugggcuuuugugucugcucgcgguagagaugcggcaugacc

SEQ ID NO: 4237218 - RNA, 62 nt, Mycobacterium avium subsp. paratuberculosis
ccagcugcaccgacgcggacggcgaguaguggucgcgcuccccuucggcgucgggcagccgg

SEQ ID NO: 4237219 - RNA, 70 nt, Mycobacterium avium subsp. paratuberculosis
acuccggcagcgacggcccgguugccggccggcucagcgccggccgguugccccaccguugcagccgggu

SEQ ID NO: 4237220 - RNA, 76 nt, Mycobacterium avium subsp. paratuberculosis
accgggaccggggcuacuggcgcgacguggggacgcuggacgcguucuacgacgcgcacauggaccuggugucggu

SEQ ID NO: 4237221 - RNA, 58 nt, Mycobacterium avium subsp. paratuberculosis
gaucgccgcaagcucggucucgucgagauagguuucggccgaaccgcuuucggcgguc

SEQ ID NO: 4237222 - RNA, 73 nt, Mycobacterium avium subsp. paratuberculosis
ccggcggcucgauguccgacggcccgguccacacgugcacgccguggaugaauccgucggacaucaccaccgg

SEQ ID NO: 4237223 - RNA, 87 nt, Mycobacterium avium subsp. paratuberculosis
ccgauuugcccugauugaccgugaacugcgugccacgucaauauugcggugugaugacgccguucgaugauccucagggcgaacugg

SEQ ID NO: 4237224 - RNA, 58 nt, Mycobacterium avium subsp. paratuberculosis
ucgaccggcagccgggcgagccgacggccccgcucggugaucgcgcccugccggucga

SEQ ID NO: 4237225 - RNA, 75 nt, Mycobacterium avium subsp. paratuberculosis
cggcggucgcgcugcagcagucggugcaggugaucgcgcaucuggcgcugcuggugcuguucagcgcggcggccg

SEQ ID NO: 4237226 - RNA, 63 nt, Mycobacterium avium subsp. paratuberculosis
gacgggaaucuccuugcggcggaacgcauucggguucaacgcgccguugcggaaauucuuguu

SEQ ID NO: 4237227 - RNA, 109 nt, Mycobacterium avium subsp. paratuberculosis
ccgacgacggccgggugcccgccgcccgcaucgucgaccgcccggaguggaucgccgcggcggcggagucgaugcgggugaugaugaacggcaccgagcggccgcgcgg

SEQ ID NO: 4237228 - RNA, 55 nt, Mycobacterium avium subsp. paratuberculosis
ucgaugguuucggcggccucggcggucgccaggccgccggccucggagccgucgg

SEQ ID NO: 4237229 - RNA, 61 nt, Mycobacterium avium subsp. paratuberculosis
cggaccuuggucaggcuggcggcuucgcccgagaccggggcgaucggcuucaccagguccg

SEQ ID NO: 4237230 - RNA, 67 nt, Mycobacterium avium subsp. paratuberculosis
ucccuuccggaccgcaggcccaggucuggcgcucgcgccagucgggcaccucgcgguccagcaggga

SEQ ID NO: 4237231 - RNA, 63 nt, Mycobacterium avium subsp. paratuberculosis
accacaccgugaccgcggcgggacuggccccgcugccgguccagcggccgaucccgguguggu

SEQ ID NO: 4237232 - RNA, 66 nt, Mycobacterium avium subsp. paratuberculosis
ggccgggaugggugccgcgcugguggcgcugacgcgggcgccgcugggccugcacccgccgcggcu

SEQ ID NO: 4237233 - RNA, 77 nt, Mycobacterium avium subsp. paratuberculosis
ugucgaccgcguugugccgaccgacguccucgcgcaccaccagcauggugccgucggcgcggaacagcgcggcggca

SEQ ID NO: 4237234 - RNA, 92 nt, Mycobacterium avium subsp. paratuberculosis
ccgacauagaaaugucacccaucaaccgacucugaacaggggcacuuugucuguuguaugaccucgguugaugcuugacguuucggcuucgg

SEQ ID NO: 4237235 - RNA, 105 nt, Mycobacterium avium subsp. paratuberculosis
gccgucggaacucucgcggucgaggauggcgacgucggcgccgcgcgccgcgaacagcucggcgcuggcgcgucccauucccgaugcaccgccgacgacgacggc

SEQ ID NO: 4237236 - RNA, 114 nt, Mycobacterium avium subsp. paratuberculosis
acucggugcuggaugcgaugcgggaucugcuggugacccgggacuggucggccaucacgcuguccgacguggcccgggccgccggcaucagccgucagaccaucuacaacgagu

SEQ ID NO: 4237237 - RNA, 66 nt, Mycobacterium avium subsp. paratuberculosis
ccgaggaggucggucacggcgccagucauggucugccgccggacgucgccgaacugaucuccgugg

SEQ ID NO: 4237238 - RNA, 56 nt, Mycobacterium avium subsp. paratuberculosis
ccgccaggugagcgccgagcacccgggccagcuccucggcguuuccggccuggugg

SEQ ID NO: 4237239 - RNA, 94 nt, Mycobacterium avium subsp. paratuberculosis
ggcgccggcggcgguggccgucgugguggcguugcugaccgccacccuggcgccgcagggccucaucgcggucgccgcgcugcucaccggcgcc

SEQ ID NO: 4237240 - RNA, 68 nt, Mycobacterium avium subsp. paratuberculosis
gcgccgacggccgcgagccgcacggugcccggcgcgcucggcgccgcggcggcggccaguccggcggc

SEQ ID NO: 4237241 - RNA, 91 nt, Mycobacterium avium subsp. paratuberculosis
gccccggcgcgcaccgguccagcgucgacuuguugcgccgacacgccgggugaucgcgcaacuaguccacgcucgacgccgcggccggggc

SEQ ID NO: 4237242 - RNA, 91 nt, Mycobacterium avium subsp. paratuberculosis
cgcccagcucggccgguguguagguguugaaaucgcaguaaccgcaacggguuacgcaaaacggcacgugcacauagaggccgaacgggug

SEQ ID NO: 4237243 - RNA, 65 nt, Mycobacterium avium subsp. paratuberculosis
ucggcgagcgucacgcuagcgugaccgccgcaagcgagcgucacgccagcgugacgccgcgccgg

SEQ ID NO: 4237244 - RNA, 55 nt, Mycobacterium avium subsp. paratuberculosis
accggcgacgagcagcccggcaccgccgccuacgggaucgcgcugcugucccggu

SEQ ID NO: 4237245 - RNA, 57 nt, Mycobacterium avium subsp. paratuberculosis
gcgcacuggcuggcgucggccgucgaguccgccuaccggccggcgccgccggugcgc

SEQ ID NO: 4237246 - RNA, 70 nt, Mycobacterium avium subsp. paratuberculosis
gcugggccuuggccuugcucaucacgaccaccgcggccgcgccgucggagaucugcgaggccgacccggc

SEQ ID NO: 4237247 - RNA, 62 nt, Mycobacterium avium subsp. paratuberculosis
ugacguugcggcgcagcgcguggaucaggugguugccgccgaucgacaaugcgucgccguca

SEQ ID NO: 4237248 - RNA, 94 nt, Mycobacterium avium subsp. paratuberculosis
cguagucggcaaucgcgaucaauguguuagccacgaugcauaacaccguggcugcgaacagcaccuuggucaugcgcaguaucucccgacaacg

SEQ ID NO: 4237249 - RNA, 81 nt, Mycobacterium avium subsp. paratuberculosis
guucucgccggccagcagccgauuggugccgaccaccgucucggugagggucucgaucggguugucggccaggucgacgac

SEQ ID NO: 4237250 - RNA, 94 nt, Mycobacterium avium subsp. paratuberculosis
gguggcgcaugacucggugaucucccggugcaguuuggcgucgucgcaacgggccaggaucgggugggucaccgugugcggauacagcgucacc

SEQ ID NO: 4237251 - RNA, 56 nt, Mycobacterium avium subsp. paratuberculosis
auggucagcuggcugcccugcuuccacgacaugggcauggucggcuuccugaccau

SEQ ID NO: 4237252 - RNA, 65 nt, Mycobacterium avium subsp. paratuberculosis
guucggucgcgcccuggacgccgcggacgagguuuucgugcuggacgucuacggcgcgcgcgaac

SEQ ID NO: 4237253 - RNA, 73 nt, Mycobacterium avium subsp. paratuberculosis
gugucggcgggcgggccgcucggugagcugggucugguaucggcgcaccagcgggcugccgacgccgaucggc

SEQ ID NO: 4237254 - RNA, 74 nt, Mycobacterium avium subsp. paratuberculosis
gcugaagcgggccuuccgcaacgacaucgagcugcaccugcagggcgacaucgaaagcgagggccugcugcugc

SEQ ID NO: 4237255 - RNA, 57 nt, Mycobacterium avium subsp. paratuberculosis
ggguuugcccggcucggcaucgaaccggcgccgggcgaugccgaggcgggcaaaccc

SEQ ID NO: 4237256 - RNA, 55 nt, Mycobacterium avium subsp. paratuberculosis
gucgucggcgcccaagccggugucggccuaccgcauggaccgcuucgccgacgac

SEQ ID NO: 4237257 - RNA, 74 nt, Mycobacterium avium subsp. paratuberculosis
ccuggugcacgacgucgcggccgcggguggucagcgcggcgagcagcucgcgccgugaggucgggugcggcagg

SEQ ID NO: 4237258 - RNA, 99 nt, Mycobacterium avium subsp. paratuberculosis
uguucgccugcuccuccugguagugcugggucugcagccggcccgcggccugcgcgcccaucugaaaacccagcgugcuguggucgagcggggugccca

SEQ ID NO: 4237259 - RNA, 61 nt, Mycobacterium avium subsp. paratuberculosis
aucggguugacucacgcggcgccguccuccucgucggcuccgucuuguuggucagccugau

SEQ ID NO: 4237260 - RNA, 67 nt, Mycobacterium avium subsp. paratuberculosis
uggccccgcucguaacgccagggcggaaauccgggcgaguuugcgccguggcguuacgagcgcgcca

SEQ ID NO: 4237261 - RNA, 56 nt, Mycobacterium avium subsp. paratuberculosis
cggcggccaucugcaugccguacaugaucagcucgacggaagcggugauggcgucg

SEQ ID NO: 4237262 - RNA, 82 nt, Mycobacterium avium subsp. paratuberculosis
ccgcggcgagcaguuggucgagcgggucgaggucgccgucggucgccgcggcgagcgccuccucgaccagaugguugcgcgg

SEQ ID NO: 4237263 - RNA, 58 nt, Mycobacterium avium subsp. paratuberculosis
gccggcguggagguguccagggccagcaccagcgggcucaugacggcuccccgccggc

SEQ ID NO: 4237264 - RNA, 78 nt, Mycobacterium avium subsp. paratuberculosis
ugcagcgacaacagcuggcccuugugcagcucgacggccaugucgacgagcuuggccugggucagcuggaauccggcg

SEQ ID NO: 4237265 - RNA, 88 nt, Mycobacterium avium subsp. paratuberculosis
caccacguugagcagguggccgaggugcuuggggucgcccaucucaaaggugaagcggcugauggcaacccggucaccggagguggug

SEQ ID NO: 4237266 - RNA, 56 nt, Mycobacterium avium subsp. paratuberculosis
ucgaucgcgaccuccuugaugacguagcggaacgucaucacguugucggccaucga

SEQ ID NO: 4237267 - RNA, 100 nt, Mycobacterium avium subsp. paratuberculosis
ggugaucgcggucggggggcagaccgugcagugccgggccgagaccgggcugacggucaacggcaagccgcugcgcgagcccuaccuggaucgcaacacc

SEQ ID NO: 4237268 - RNA, 66 nt, Mycobacterium avium subsp. paratuberculosis
ccuucgggaccaucgccggccuggucggcugcuaucgcgggcugaccaccaaggguggucccaagg

SEQ ID NO: 4237269 - RNA, 64 nt, Mycobacterium avium subsp. paratuberculosis
gugggacgagcuggugcgccagcacgccgaccggguguaccggcuggccuaccggcuuuccggc

SEQ ID NO: 4237270 - RNA, 60 nt, Mycobacterium avium subsp. paratuberculosis
gcgguggagcugccgggaaucgaacccggguccuacggcauucccucaaggcuucuccgu

SEQ ID NO: 4237271 - RNA, 63 nt, Mycobacterium avium subsp. paratuberculosis
ccccaccgcuucaucugcaggaagccgauggcagcggcgauccgcauggugaagacggucagg

SEQ ID NO: 4237272 - RNA, 65 nt, Mycobacterium avium subsp. paratuberculosis
gccgcgacgucacccugcuguggccgccgaccgagccgggcggcuacucgcugaucgucgacggc

SEQ ID NO: 4237273 - RNA, 115 nt, Mycobacterium avium subsp. paratuberculosis
cgucugccaguucaccauggucaaguaagccggccagcgucgaguuguugggccgaaaaacggcuuaaucgcccaacaacucgacguucggcgggcaggccgaagaacucagccg

SEQ ID NO: 4237274 - RNA, 110 nt, Mycobacterium avium subsp. paratuberculosis
gggcgggccccaguuuggcgagguugaucuggugcgggaaguuccacggcgugaucgccccgaccacaccgacggcuucccgcgcgauggugcgccggguggggaugccc

SEQ ID NO: 4237275 - RNA, 60 nt, Mycobacterium avium subsp. paratuberculosis
gaguaauggucgguucuauguaaguuggaccgguucugccaacauaagagccgacgacuc

SEQ ID NO: 4237276 - RNA, 81 nt, Mycobacterium avium subsp. paratuberculosis
gucgagguggccgagaugcccagcaccugguugaucaccgcaaucgggucgccgggaacguuggcgcucggaaucaucggc

SEQ ID NO: 4237277 - RNA, 64 nt, Mycobacterium avium subsp. paratuberculosis
cgccgcucguaacgccagggcggaaauccggccgagauuccgccguggcguuacgagcgcggcg

SEQ ID NO: 4237278 - RNA, 70 nt, Mycobacterium avium subsp. paratuberculosis
ggcaccaggcccuguaccgcgagggcuucuucgggcugucguggccccgcgaguacggcggccaggagcu

SEQ ID NO: 4237279 - RNA, 113 nt, Mycobacterium avium subsp. paratuberculosis
gccggcggggcacaugggaagugcccgccucugagcgacaaucaccgaaguccgaucccccgacgcgucguugucgcucagaggcgggcaaaguuccuauuccccgggccggc

SEQ ID NO: 4237280 - RNA, 56 nt, Mycobacterium avium subsp. paratuberculosis
uucggugacgugccgcugaaccuggaguacaagcucgaggugugggacucgccgaa

SEQ ID NO: 4237281 - RNA, 72 nt, Mycobacterium avium subsp. paratuberculosis
ugaaggugagccggggcggcgcgucguccggaucguucaggguccacgacagcaccgcgccgcugaccucca

SEQ ID NO: 4237282 - RNA, 57 nt, Mycobacterium avium subsp. paratuberculosis
gucggcgaugucgugcucggugcguucggugccgcgcaccagccggcggucgccggc

SEQ ID NO: 4237283 - RNA, 55 nt, Mycobacterium avium subsp. paratuberculosis
ggacaguugcguggcgccggcggcgagcgucgccgagccgguccgcgcgcugucc

SEQ ID NO: 4237284 - RNA, 65 nt, Mycobacterium avium subsp. paratuberculosis
cggcguggcuggccgucaucaccggcgccacgcuggugucggugucgugggcggccgccucgccg

SEQ ID NO: 4237285 - RNA, 74 nt, Mycobacterium avium subsp. paratuberculosis
gucgacgccguggugcuggccgaggcgcgucgcuaccucgagggggacgcgcaggccugggcgcagggcgcgac

SEQ ID NO: 4237286 - RNA, 56 nt, Mycobacterium avium subsp. paratuberculosis
gccgcccagcaccgcgcgacggccgaaagcugcgccgccgaaggugauugggcggc

SEQ ID NO: 4237287 - RNA, 87 nt, Mycobacterium avium subsp. paratuberculosis
gauguagagggccaucgcgugagucucuguggugaaacgaccaaggaucacuaccgagaggaacaucgcgauggcccuggaccaguc

SEQ ID NO: 4237288 - RNA, 71 nt, Mycobacterium avium subsp. paratuberculosis
uucggcucaaguucggcggcggaggccgucgccgcaaguaacgccuacccgccgccgagcuucuuguagaa

SEQ ID NO: 4237289 - RNA, 129 nt, Mycobacterium avium subsp. paratuberculosis
gucaccacggugaucaucaaccggccggcggcgcgcaacgcggucaacggcccgacggcggccgcgcuguacgcggcguucgaggaguucgaccgcgacgacuccgcgucgguggccgugcuguggggc

SEQ ID NO: 4237290 - RNA, 65 nt, Mycobacterium avium subsp. paratuberculosis
agugugugaucgagguugccggccaaccugaagcacgcguuggucgaaguuguugcucgcacacu

SEQ ID NO: 4237291 - RNA, 55 nt, Mycobacterium avium subsp. paratuberculosis
ucgaagcuggcgcuggucaggccgcgacgggcggccuucucacgcgccagcuuga

SEQ ID NO: 4237292 - RNA, 129 nt, Mycobacterium avium subsp. paratuberculosis
gacagcgucgacgcggugacggaccggcugccgcuggugcugggauugauggcggcgaucaccuucguguugcuguuccugcucaccggcagcgugcugcugccggccaaggcgcucgcgugcaauuuc

SEQ ID NO: 4237293 - RNA, 56 nt, Mycobacterium avium subsp. paratuberculosis
ggucgucgcgaucggcaucaccccgcaaggcucgugggugcucaccgacggcgacc

SEQ ID NO: 4237294 - RNA, 55 nt, Mycobacterium avium subsp. paratuberculosis
gccggucauggcgcuggccugaucccacagcccccagcccagcgagauggccggc

SEQ ID NO: 4237295 - RNA, 71 nt, Mycobacterium avium subsp. paratuberculosis
ccgcuucgacacgguguugauagcgugguuuucaugacugaacaccuugacguccucaucgugggcgccgg

SEQ ID NO: 4237296 - RNA, 130 nt, Mycobacterium avium subsp. paratuberculosis
gcgacgagcugcuggcgguucccccgcacggguggaucaaccugcacuucucgcugcugccggccuggcgcggcgcggcgccggugcaggcggccaucgcggcgggggacaucaucaccggggcgucgac

SEQ ID NO: 4237297 - RNA, 119 nt, Mycobacterium avium subsp. paratuberculosis
gccaucgacgacgacggcagcgggauuccggaguccgagcgcgccaccguguucgaacguuucgcccgcgggucgacggcggcgcgcucggguuccgggcugggccuggcguugguggc

SEQ ID NO: 4237298 - RNA, 65 nt, Mycobacterium avium subsp. paratuberculosis
guggcggugcugguggccgacgagucgggcaugucgaccgucgaguacgccaucggcaccaucgc

SEQ ID NO: 4237299 - RNA, 130 nt, Mycobacterium avium subsp. paratuberculosis
caagccggugcugaccgcggugaacggaaucuguugcggcgcgggcauggacugggucacgacgaccgacaucgugaucgcguccgagcaggccaccuucuucgacccgcacgucagcaucggccuggug

SEQ ID NO: 4237300 - RNA, 65 nt, Mycobacterium avium subsp. paratuberculosis
gguggccggugccguggucugcgccgugggaccggccgcggccgccacgugcaccggcgcucgcc

SEQ ID NO: 4237301 - RNA, 73 nt, Mycobacterium avium subsp. paratuberculosis
uagcuacggcccggucuugguccauuggccggcgucaccgacgaugccgaccgggaccgcgccggacaggcug

SEQ ID NO: 4237302 - RNA, 61 nt, Mycobacterium avium subsp. paratuberculosis
ggugacgccgcaucugcuggugaugacggcgacgccgauaccgcgcaccguggcgcucacc

SEQ ID NO: 4237303 - RNA, 93 nt, Mycobacterium avium subsp. paratuberculosis
cgcgucgcgaacgcggccgagcaugugcugucccuggucgugcaccacaucgcauccgaccauuggucggcgggugugcuguucgccgacgug

SEQ ID NO: 4237304 - RNA, 56 nt, Mycobacterium avium subsp. paratuberculosis
gcucgacgguaaccgugacggcgccgggcgggcagccgaucgcgauggcguugagc

SEQ ID NO: 4237305 - RNA, 60 nt, Mycobacterium avium subsp. paratuberculosis
gccgaacguguacucgcggcgagaaaacggccgaugucucgcggugguugcacgcucggc

SEQ ID NO: 4237306 - RNA, 79 nt, Mycobacterium avium subsp. paratuberculosis
cgcucggcgcagcgcggcgucguggucggggaccggcgaggauuccucgccgaugcguuccacgaugcccgucgaggcg

SEQ ID NO: 4237307 - RNA, 61 nt, Mycobacterium avium subsp. paratuberculosis
gcggcggucgguggccgaggcgcugcgcauguagucgcaggcccggguggcgaccagccgc

SEQ ID NO: 4237308 - RNA, 57 nt, Mycobacterium avium subsp. paratuberculosis
cccgcgcugaccgacgcguuggcgccggggucggugccgaugacguggucgggcggg

SEQ ID NO: 4237309 - RNA, 76 nt, Mycobacterium avium subsp. paratuberculosis
ggauguucgaggucggcgcguugaccaccagcaccccgcgcucgguggcggcguccacgucgacguuguccaggcc

SEQ ID NO: 4237310 - RNA, 89 nt, Mycobacterium avium subsp. paratuberculosis
acugguccagggccaucgcgauguuccucucgguagugauccuuggucguuucaccacagagacucacgcgauggcccucuacaucagu

SEQ ID NO: 4237311 - RNA, 87 nt, Mycobacterium avium subsp. paratuberculosis
cuggcggaucgugagcuuggccugggggaccucccgccggaucgcggcgaccgccuggucgcccuuggccgggucgcggaccgccag

SEQ ID NO: 4237312 - RNA, 83 nt, Mycobacterium avium subsp. paratuberculosis
cgaugauccggugccgggugcugaacgccugaugguuggugacgaucucaucgaucguggcggcgacccgugcccggucgucg

SEQ ID NO: 4237313 - RNA, 97 nt, Mycobacterium avium subsp. paratuberculosis
ggucucgaccaacccggcgccggcacgugugacgcuucgccacgucgaucggacguucggaacgcacaccgugcugcgcgacgucgacgucgagauc

SEQ ID NO: 4237314 - RNA, 55 nt, Mycobacterium avium subsp. paratuberculosis
gcgcggugaucaugcuggucaucgacaugucgcaauccaugcgggccaccgacgu

SEQ ID NO: 4237315 - RNA, 93 nt, Mycobacterium avium subsp. paratuberculosis
gacgucguggugagcaacgccggcaagucgcugcgccgcucgcugcaucaccaguacgaccggccgcacgacuuccagcgcaccaucgacguc

SEQ ID NO: 4237316 - RNA, 65 nt, Mycobacterium avium subsp. paratuberculosis
gggucgcggcggcgaucgcgugcgaccaggaggccgguugcagcgaaccgucggcgucgcggacc

SEQ ID NO: 4237317 - RNA, 66 nt, Mycobacterium avium subsp. paratuberculosis
gcgccgagcgugggggcugugcacgaauuccgggguguggacggacguagcccccacgcucggcgc

SEQ ID NO: 4237318 - RNA, 58 nt, Mycobacterium avium subsp. paratuberculosis
gaucggccgggucgacgucgccgcccuguccgugcucaagacguucgacccgccgauc

SEQ ID NO: 4237319 - RNA, 64 nt, Mycobacterium avium subsp. paratuberculosis
accucacggacucggucuaugagcgcuugcuguccgagcgcaucaucuuccuggguucggaggu

SEQ ID NO: 4237320 - RNA, 57 nt, Mycobacterium avium subsp. paratuberculosis
ggguuugcccgccucggcaucgcccggcgccgguucgaugccgagccgggcaaaccc

SEQ ID NO: 4237321 - RNA, 69 nt, Mycobacterium avium subsp. paratuberculosis
cacguugugcggacguucggcggugaacagcgcgccgguguacaccgacgaggcguccagcgggucgug

SEQ ID NO: 4237322 - RNA, 72 nt, Mycobacterium avium subsp. paratuberculosis
gucgucaccgcgcugcgcgccauggacaacgacguccccgucugcgugcugucggcccgcagcucggucgac

SEQ ID NO: 4237323 - RNA, 71 nt, Mycobacterium avium subsp. paratuberculosis
ggauggcgccgugccgcucggcggugacccggcgcagcgagccccaccguugggcgucggggugccgcgcc

SEQ ID NO: 4237324 - RNA, 61 nt, Mycobacterium avium subsp. paratuberculosis
ggucggaaauucgugcgccugguccuucuccauccaguacuggucgucgaauuucccggcc

SEQ ID NO: 4237325 - RNA, 68 nt, Mycobacterium avium subsp. paratuberculosis
gccugcgugacauacagcgugucgagcugguugaccaccaccucggccugcgagaugugcacgugggc

SEQ ID NO: 4237326 - RNA, 60 nt, Mycobacterium avium subsp. paratuberculosis
acccggcgucgacgacgacuucuuccugcucggcggugacagccucgucgcgacccgggu

SEQ ID NO: 4237327 - RNA, 55 nt, Mycobacterium avium subsp. paratuberculosis
ccgacgacguucaccaggaauucgggauagccgccguuuugguuggggucguugg

SEQ ID NO: 4237328 - RNA, 55 nt, Mycobacterium avium subsp. paratuberculosis
gaccaggguguugccgacggccagggugauguucuggcugaugucgcucugcguc

SEQ ID NO: 4237329 - RNA, 87 nt, Mycobacterium avium subsp. paratuberculosis
gccgcccccgccgcgagcagacacaaaagcgcccgauuccccggcgugucgcgugcuuuugcgucugcucgccagacucacggcggc

SEQ ID NO: 4237330 - RNA, 55 nt, Mycobacterium avium subsp. paratuberculosis
cgcgcuggugcggccgucguugaaacacgucaugcacgacgcguacaucagcgcg

SEQ ID NO: 4237331 - RNA, 58 nt, Mycobacterium avium subsp. paratuberculosis
cgcgcgcucgagcuuggaucgugccgaucauauucgccgcgucccggacgagcgugcg

SEQ ID NO: 4237332 - RNA, 72 nt, Mycobacterium avium subsp. paratuberculosis
gccugguugucgggaaggcuggucggcucgugcgaucuaccucgacgagcuguggguuuccagguagcgggc

SEQ ID NO: 4237333 - RNA, 60 nt, Mycobacterium avium subsp. paratuberculosis
gcgggugcguuguugacguuccugggucucaacgccaccuacuucggcaugcgcacccgc

SEQ ID NO: 4237334 - RNA, 105 nt, Mycobacterium avium subsp. paratuberculosis
ggacgcgaugaaggacaaguggcgcgccgaccuggccggcgacggccggcccgccgagucgaucgaacgccggguggcgcgcggccagauccucuacgacgcgcc

SEQ ID NO: 4237335 - RNA, 65 nt, Mycobacterium avium subsp. paratuberculosis
gccgcgagagugcaacuaccgacggcgccacucgggaaacgcguugccaguugcacuuucgcggu

SEQ ID NO: 4237336 - RNA, 69 nt, Mycobacterium avium subsp. paratuberculosis
cagcccggcuggcaggucgcgccggagccggagaacuaucuggucugggcgauccugugcaccgugcug

SEQ ID NO: 4237337 - RNA, 61 nt, Mycobacterium avium subsp. paratuberculosis
gguggugggcaucuccggcucgggggcgcugcggcccgccgcggccgagguguucgccgcc

SEQ ID NO: 4237338 - RNA, 55 nt, Mycobacterium avium subsp. paratuberculosis
gaucgcgaguuuggucauggagccagccuaggcaugccgaggccgaacucgcggc

SEQ ID NO: 4237339 - RNA, 61 nt, Mycobacterium avium subsp. paratuberculosis
guuguguugcagugcggcgcugacguuuucgaccugacguuuguccgcggugccgcgcagc

SEQ ID NO: 4237340 - RNA, 60 nt, Mycobacterium avium subsp. paratuberculosis
gcucaggcuaugcaagcaggccggcaaggaggcgucgcuggccugcauggccgccugggc

SEQ ID NO: 4237341 - RNA, 68 nt, Mycobacterium avium subsp. paratuberculosis
ggccggcguaacuggugauguugcgggcgauuucggagaucgccguggcgaucaucgugacgucgguc

SEQ ID NO: 4237342 - RNA, 63 nt, Mycobacterium avium subsp. paratuberculosis
ggcgucgaugugcucgucggcguagccgaaggugaacugcuccgccgagggcaucgaccagcc

SEQ ID NO: 4237343 - RNA, 56 nt, Mycobacterium avium subsp. paratuberculosis
cgggauggugaccgcggagaugaugcccucgaucauguccgggucgcucauccgcg

SEQ ID NO: 4237344 - RNA, 85 nt, Mycobacterium avium subsp. paratuberculosis
gccgugggcgcgcagcacgccggcggcccgcucgucggcgcacucgccgacaugccaguugccggugccggcgcugcucacccgc

SEQ ID NO: 4237345 - RNA, 61 nt, Mycobacterium avium subsp. paratuberculosis
gcgcucgcccgucagcaucaucaccgcgucgccggccggugcggugccggcgggcgggugc

SEQ ID NO: 4237346 - RNA, 76 nt, Mycobacterium avium subsp. paratuberculosis
gccgccgcgcccgagcgucacgcuggcgugacacucggcgccggccgucacgccagcgugacgcucggccgguggc

SEQ ID NO: 4237347 - RNA, 88 nt, Mycobacterium avium subsp. paratuberculosis
ucccguggcugcaccgguucggugaccuggucgccccgcugaccuuccucggcgcggccuaugucaccgucuucgucagcugcuggga

SEQ ID NO: 4237348 - RNA, 78 nt, Mycobacterium avium subsp. paratuberculosis
ugcgggugcccaucgccguguacagcggcgcaagcaccuuggcgccgugcgccugcucggcggcgauggccacccgca

SEQ ID NO: 4237349 - RNA, 57 nt, Mycobacterium avium subsp. paratuberculosis
ccggccgcgagccgaugauccacaccguccgcggugucggauacaugcugcggccgg

SEQ ID NO: 4237350 - RNA, 103 nt, Mycobacterium avium subsp. paratuberculosis
ggcacucgucguggcggugcucuuggugguggucgucgacgagcccgccggcggguuggccgucgaacugcagccggccaacagcagcgccgcggccggugcc

SEQ ID NO: 4237351 - RNA, 61 nt, Mycobacterium avium subsp. paratuberculosis
caccgaccugcucgacggguggguggccuacuucgccgaccacccgcacgagcgggcgcug

SEQ ID NO: 4237352 - RNA, 74 nt, Mycobacterium avium subsp. paratuberculosis
gucggcgacggucuuccaguuggcgucgaccucgacagugagcguggcguagcaacggaauucgucgagccggc

SEQ ID NO: 4237353 - RNA, 62 nt, Mycobacterium avium subsp. paratuberculosis
gacggcggcagggucgaucaggccgcguggucgucacccuggucggcuucuuguucgccguc

SEQ ID NO: 4237354 - RNA, 79 nt, Mycobacterium avium subsp. paratuberculosis
gggucgcgauauccguccaggguggcgagcacguucuggaacugcuggucgaucugguggaccagguuguugucgaucu

SEQ ID NO: 4237355 - RNA, 71 nt, Mycobacterium avium subsp. paratuberculosis
ccgcgcgggaccacggucuacgagaucgaccggccgcgggugcucgauuucaaggccggggugcugcgcgg

SEQ ID NO: 4237356 - RNA, 74 nt, Mycobacterium avium subsp. paratuberculosis
ggguuucgccgggcucggcgcccagggcggugggcagccgucggcucacaucgucgaggacgccgagcacuccc

SEQ ID NO: 4237357 - RNA, 86 nt, Mycobacterium avium subsp. paratuberculosis
cggcgcuggccacgccgggaucggugucgcggcuguccggcaucgcgcaccugcgcggccacgagaccgaccggcuggccgcgcug

SEQ ID NO: 4237358 - RNA, 83 nt, Mycobacterium avium subsp. paratuberculosis
cggccaucggcugcagguggugccgggcgagcacgccgagcugacgccguggaucuucggcagcacccgcggccagagcgccg

SEQ ID NO: 4237359 - RNA, 58 nt, Mycobacterium avium subsp. paratuberculosis
gguuuucggugccgucgacgaacccgagcaggucgcgguugucgaaguaccggaagcc

SEQ ID NO: 4237360 - RNA, 78 nt, Mycobacterium avium subsp. paratuberculosis
cccgcaacaagucgacguucgcgcgcgaccgacuagcccaggaucagcgagucgccguccgggcugacguugaccggg

SEQ ID NO: 4237361 - RNA, 64 nt, Mycobacterium avium subsp. paratuberculosis
cgcagucgggaauuagcacggcgcugggucgaauucacuagcgucgccuucuacucgugcugcg

SEQ ID NO: 4237362 - RNA, 68 nt, Mycobacterium avium subsp. paratuberculosis
gccgccaguucggcgacaccguggauucgcugacccagcgccuggcgcgggucuccgagcuggacggc

SEQ ID NO: 4237363 - RNA, 129 nt, Mycobacterium avium subsp. paratuberculosis
cgggugccguaguacuugcgguagauguucaggaucggcaggaucagcaggucggcguagaugaacgcgaucacgccgccgaagcugaugccgccguuccacaacaccgcggccagcggcacauugccg

SEQ ID NO: 4237364 - RNA, 81 nt, Mycobacterium avium subsp. paratuberculosis
ggcgcggagaagcugaucggcaugggcgacggccuguuccugccgaugggcgcguccaagccgauccgguugcagggcgcc

SEQ ID NO: 4237365 - RNA, 68 nt, Mycobacterium avium subsp. paratuberculosis
ccucaacgagcaugucgucggcaaaggcuggccgaccaucacccgccggcaggacaugcugcgcgagg

SEQ ID NO: 4237366 - RNA, 83 nt, Mycobacterium avium subsp. paratuberculosis
ucgaggaacaacgcgaagaagucgucggaaaugucguagguugcuugcgacucuucguaauacggcuucagcuuggccaucgg

SEQ ID NO: 4237367 - RNA, 60 nt, Mycobacterium avium subsp. paratuberculosis
gagcgguucgcgcgccggaucgccgcgcagaucgugcgccgccgcgccaaagagccguuc

SEQ ID NO: 4237368 - RNA, 87 nt, Mycobacterium avium subsp. paratuberculosis
gcgcugcccgucguaguagggcgccaggaacugccgguccgcggcgaucagguagccgcgcaggccgguuuccuggucccgcagcgc

SEQ ID NO: 4237369 - RNA, 64 nt, Mycobacterium avium subsp. paratuberculosis
caccggggccacaacgcggacacgcucgccaauccguuuggccaacgcguugauggucucggug

SEQ ID NO: 4237370 - RNA, 62 nt, Mycobacterium avium subsp. paratuberculosis
cggucccgcaaccggcucgccgaccgccagucgcgggcgauggcgacggauucgcgggucug

SEQ ID NO: 4237371 - RNA, 77 nt, Mycobacterium avium subsp. paratuberculosis
gcguucuucguggcggccgacgucaugcuggucacgccgcugcgcgacgggaugaaccuggucgccaaggaguacgu

SEQ ID NO: 4237372 - RNA, 90 nt, Mycobacterium avium subsp. paratuberculosis
cccaacagguuucgcggcgugugcuggccggggccggccgaggcccggccgaagccgagcaccgcccagaacggcgagacgauguugcgg

SEQ ID NO: 4237373 - RNA, 78 nt, Mycobacterium avium subsp. paratuberculosis
accggcgccggguucggugucgccguaugucugugccagcgagcgcaacucggugcggucgccgagccugguuccggu

SEQ ID NO: 4237374 - RNA, 61 nt, Mycobacterium avium subsp. paratuberculosis
ccgucuuggugcaauacgucccgggagcgggcagcuccgagacguagcccaccaacugcgg

SEQ ID NO: 4237375 - RNA, 73 nt, Mycobacterium avium subsp. paratuberculosis
gccgacgaucuguucgucggaucgcaucccagcaagaguccgaugcgaacguucggcggacagcucaugucgc

SEQ ID NO: 4237376 - RNA, 70 nt, Mycobacterium avium subsp. paratuberculosis
gccgcugcuggaccggguggaccugcgggugcagaugcauccgaugcgggccggcgcguucggcggcggc

SEQ ID NO: 4237377 - RNA, 65 nt, Mycobacterium avium subsp. paratuberculosis
gucaacucgggacucggcggaucggcgcucugcgcggcgcgcauggccgccgaguucggguugac

SEQ ID NO: 4237378 - RNA, 57 nt, Mycobacterium avium subsp. paratuberculosis
ucgggcguagcacgacgggcccguaagccucggcgcgcacguggugcaccugcccga

SEQ ID NO: 4237379 - RNA, 68 nt, Mycobacterium avium subsp. paratuberculosis
gucguuaccggugcugcccgacgacuagacgccgucagcgucgcggacggcaccgaccuuuucacggc

SEQ ID NO: 4237380 - RNA, 60 nt, Mycobacterium avium subsp. paratuberculosis
gcauggcccugcccgucgucagcgccaagacggugcgcaucaacgacggcggcgccgugc

SEQ ID NO: 4237381 - RNA, 66 nt, Mycobacterium avium subsp. paratuberculosis
agcacuucccguauguguuccucgacgccacuuacugcaaggcucgggucaaccaucggguggucu

SEQ ID NO: 4237382 - RNA, 64 nt, Mycobacterium avium subsp. paratuberculosis
cguguacccgggccgcagccaguccucgcuguaggugaucucgcuggggcgggccuggguaccg

SEQ ID NO: 4237383 - RNA, 67 nt, Mycobacterium avium subsp. paratuberculosis
ggccgcgugcaggcccgccacgucuccgucgggccacaccucggagacgagcgccuguaugaccgcc

SEQ ID NO: 4237384 - RNA, 70 nt, Mycobacterium avium subsp. paratuberculosis
gcugagcccggcgcaggcggucgagcugcagccgcuggccugcgugcucuacgccugcgagcagcucggc

SEQ ID NO: 4237385 - RNA, 94 nt, Mycobacterium avium subsp. paratuberculosis
uuucccgcgaguuccuccgcgagcagacgcaaaagccccucgacgcccggcgugucgggggcuuuugcgucugcucgagggaggggguggggga

SEQ ID NO: 4237386 - RNA, 55 nt, Mycobacterium avium subsp. paratuberculosis
gccggguucggcggcccgcccggcgauguacgcgcugggcgccuccgaacgcggc

SEQ ID NO: 4237387 - RNA, 66 nt, Mycobacterium avium subsp. paratuberculosis
gugcgcggucgaggccgccuugccgagcugcgccagcgccucgcgcaucaucgccucgccgcgcac

SEQ ID NO: 4237388 - RNA, 130 nt, Mycobacterium avium subsp. paratuberculosis
cuggcugcgccugaccguggcaccggccgcggcgcugcuguuggccggcugcaguucgacggccaacccgccggcgggcucgucgacgaccaccaccaagagcaccgccacgacgagugccggcgcggcg

SEQ ID NO: 4237389 - RNA, 68 nt, Mycobacterium avium subsp. paratuberculosis
ggccacccgcgggcaggccgacgccgcgcggguacgcgaacuggugcuggccgccugcggccaaggcu

SEQ ID NO: 4237390 - RNA, 70 nt, Mycobacterium avium subsp. paratuberculosis
caagcuggcgcugaucgacgugcgcgaaccgguggaguucgacaucgugcaccucgacggcgcgcagcug

SEQ ID NO: 4237391 - RNA, 62 nt, Mycobacterium avium subsp. paratuberculosis
cuggcagcaggagcuucccccgggcggcgacccgcacgccccgggcauggcuccgccgccgg

SEQ ID NO: 4237392 - RNA, 89 nt, Mycobacterium avium subsp. paratuberculosis
cgaacaccggcucgucgggauuggguugcauguuccggucgaccgcgagcagcaugccgucgcggcgaaacaccuugcgccggugggcg

SEQ ID NO: 4237393 - RNA, 98 nt, Mycobacterium avium subsp. paratuberculosis
uaucucggcguuucggcucgcggugggcucggcucggcuggguuuaacaguagccgcagaccuaccuugcccgcgcggacugagaguccacugagaua

SEQ ID NO: 4237394 - RNA, 91 nt, Mycobacterium avium subsp. paratuberculosis
gccguggccgcggugcuguucgccuucgugucggggucgcuguggggcguguucgcggugcucgccaaggaggugauggcgcggcuggggc

SEQ ID NO: 4237395 - RNA, 80 nt, Mycobacterium avium subsp. paratuberculosis
ccccgcuagcccgcgagcgucgaguuguugcgccgaaaucgcuuauuuuccaucauaacucgacgcucggcgguacgggg

SEQ ID NO: 4237396 - RNA, 65 nt, Mycobacterium avium subsp. paratuberculosis
gccgguagcguucguaggcgagaauguucgccgaccgaaacggcuugccgacgugcguugccggu

SEQ ID NO: 4237397 - RNA, 60 nt, Mycobacterium avium subsp. paratuberculosis
cccaguucccgcaccgcccgccguacggggcgucgacggucgccugggcgggaaccgagg

SEQ ID NO: 4237398 - RNA, 57 nt, Mycobacterium avium subsp. paratuberculosis
gaggugcucgccgcggcggaccacguacgggaugcgggcgucggugucgagcaccuc

SEQ ID NO: 4237399 - RNA, 88 nt, Mycobacterium avium subsp. paratuberculosis
cccaucgggugcgggcccugugcacagccucggguuaguccacagaucggcccggcggcgccgcgcagcgggccgucgcgccgguggg

SEQ ID NO: 4237400 - RNA, 76 nt, Mycobacterium avium subsp. paratuberculosis
ggccgaggccgacuacgacgccgaguggaucgucgugcucgacgacuggaccgacggcgucggcaagagcccggcc

SEQ ID NO: 4237401 - RNA, 78 nt, Mycobacterium avium subsp. paratuberculosis
guugcuuuuuggugcagcaccgcagccgguugcggcgcuccgccgccgggcugccggucugcgccgacugcgcguaac

SEQ ID NO: 4237402 - RNA, 106 nt, Mycobacterium avium subsp. paratuberculosis
ggaccaagucaggguuucggcaaugccagcccaaucauguucguaaucaacaaaaguaaaugcggcgucauugggcugcaugccggcgcgcucacgcagcacgucc

SEQ ID NO: 4237403 - RNA, 77 nt, Mycobacterium avium subsp. paratuberculosis
ggaagucaccgucgacguccgcggccgcgccgccacgugcgagguggugcggcccccguucgucgcggugaaaaccc

SEQ ID NO: 4237404 - RNA, 80 nt, Mycobacterium avium subsp. paratuberculosis
ggcgugguguugcugcugcugacccugggcugcgaguucucccucgccgaauucuccagcagcaugcggcaccacuugcc

SEQ ID NO: 4237405 - RNA, 103 nt, Mycobacterium avium subsp. paratuberculosis
acgaacaguccgugggugaccgcgcggcgcuugagcaguccgcggucgcgggucagcaggaugcggugcugcucggcgcugaucgcggccagggucuggucgu

SEQ ID NO: 4237406 - RNA, 59 nt, Mycobacterium avium subsp. paratuberculosis
ucggcguucgaucucgaagcagcgcggcgcggagauguccucgagguugacggcgccga

SEQ ID NO: 4237407 - RNA, 94 nt, Mycobacterium avium subsp. paratuberculosis
ggacgucggcucgucgaggaucagcagcgacggcccggugagcagcuccagcgccaccgacgcacgcuugcgcugaccgccggacagcuugucc

SEQ ID NO: 4237408 - RNA, 100 nt, Mycobacterium avium subsp. paratuberculosis
ggacggguagggcuggacaccugcgccggcuucggcugagccccacgacacuuacccgguggcgccgacacgccggcgcgggccgccauggcuuacgucu

SEQ ID NO: 4237409 - RNA, 58 nt, Mycobacterium avium subsp. paratuberculosis
uccuggucgugacgggcaucgacacggacacccagaucgugcaccucaacgacccggg

SEQ ID NO: 4237410 - RNA, 60 nt, Mycobacterium avium subsp. paratuberculosis
cugcacgugcugcucaucccggaagaccuugccgucgaacggguccggcaccgcgugcgg

SEQ ID NO: 4237411 - RNA, 96 nt, Mycobacterium avium subsp. paratuberculosis
gucggccagcgccgggucgucgaugacggcgcgcaccuucuccucguagaacuugcgggccuccucguuggcgaccgggucgaucaucuggucggc

SEQ ID NO: 4237412 - RNA, 78 nt, Mycobacterium avium subsp. paratuberculosis
cgucgugguucuacugggcgaucggaaucgcgaucggauugccgaucgggaugaucgcgcucaccgagauccacgacg

SEQ ID NO: 4237413 - RNA, 85 nt, Mycobacterium avium subsp. paratuberculosis
ggacuucagcccguucaccgacugcggcccggccugcugcugcagcaugcuggucauggccugguuggucucgggaugcgcgucc

SEQ ID NO: 4237414 - RNA, 60 nt, Mycobacterium avium subsp. paratuberculosis
gucgagccuggccggacgcgcggucggcgggaccgcgacccgcgccgucgccgggucgac

SEQ ID NO: 4237415 - RNA, 120 nt, Mycobacterium avium subsp. paratuberculosis
gucgcgccggaucagcaccccgucgggggcacgaguguugugguggaucaacucgaucgggacagcaucggggauccacgcggcgccgugcaccgccgccgcggccgcgccggcgaugac

SEQ ID NO: 4237416 - RNA, 75 nt, Mycobacterium avium subsp. paratuberculosis
uggcggccugguugagcgcguugucgaccuccuggcgguccacuuugcugacgaugucgaacgaugaguccgcca

SEQ ID NO: 4237417 - RNA, 87 nt, Mycobacterium avium subsp. paratuberculosis
guucuucgauggugaagcugcgccgcgcgaaggugacccgcucgaaggggucacgucgcuggucgugcagcggcagcagcggagggc

SEQ ID NO: 4237418 - RNA, 122 nt, Mycobacterium avium subsp. paratuberculosis
gcuggccggcgcgcggccguucguggcgacuccggucggcgggaccgcgcagaucgcccccgacccgggcaugcuggucccggucgacgacgugcccgcgcuggccgacgcgaucggccggu

SEQ ID NO: 4237419 - RNA, 67 nt, Mycobacterium avium subsp. paratuberculosis
ggggcgcuggcuggugggguggcggugcuguucguccagcagcgcgacgcccaggccaaacaguccc

SEQ ID NO: 4237420 - RNA, 77 nt, Mycobacterium avium subsp. paratuberculosis
ggugccgguguccggaauaucagucaugccugcucaacccgguccggcuugacaucuauuccggacuucgugcugcu

SEQ ID NO: 4237421 - RNA, 91 nt, Mycobacterium avium subsp. paratuberculosis
ggccggcgccggagcccacgugcacaucucgcaggccgaggugguggucaaccagcucgacacgcuguaugucacgcaggcugcgcuggcc

SEQ ID NO: 4237422 - RNA, 75 nt, Mycobacterium avium subsp. paratuberculosis
ggacgaagugcccgccuuugagcgacaaccguugaggcgagccgauugucgcugcgaggcgggcacacgcggucc

SEQ ID NO: 4237423 - RNA, 57 nt, Mycobacterium avium subsp. paratuberculosis
gccgcuuacgcccagcugucggccgucacguacggcgucagcgauuucgugggcggc

SEQ ID NO: 4237424 - RNA, 56 nt, Mycobacterium avium subsp. paratuberculosis
caucgcuguucaggacgucgcugcuggggaugaccaguagggcgucgagcaggaug

SEQ ID NO: 4237425 - RNA, 77 nt, Mycobacterium avium subsp. paratuberculosis
cgaguuccagcgacgcgauccgcggcgucagcgcgccgaggaccagcggguugaugccguagucggucgcggucucg

SEQ ID NO: 4237426 - RNA, 70 nt, Mycobacterium avium subsp. paratuberculosis
ggcgcagcgcccgcucccgggcggcggccagcgcgcugacgcccgccgacccgaggugggugaccgcgcu

SEQ ID NO: 4237427 - RNA, 129 nt, Mycobacterium avium subsp. paratuberculosis
guugaucgcggcgaugaucgguuugcgcagugcggucaggaaguggggauggcgaucgccgaccaacgcggugacgucggugucgccgucgcccagcuucgcgucgauggaucccgcgccgcccagguu

SEQ ID NO: 4237428 - RNA, 99 nt, Mycobacterium avium subsp. paratuberculosis
ggccagcucgucggcuucggccuggggauggucggcgucgaacugcucacgguccgcaccccgcgcaucgccaggccgggacgguccaugucgcuggcc

SEQ ID NO: 4237429 - RNA, 80 nt, Mycobacterium avium subsp. paratuberculosis
cgugcaggacaacguguugccgacgaucgugccgcgcaagccgucgcgcaccgagcgucgcgacaagagcgccugacgcg

SEQ ID NO: 4237430 - RNA, 76 nt, Mycobacterium avium subsp. paratuberculosis
ggcgcgacgacggcggcguggccgccggugcugacgugcgcgcgcagcaucgcgaagaugccgucgaugucguguu

SEQ ID NO: 4237431 - RNA, 60 nt, Mycobacterium avium subsp. paratuberculosis
ucgacgaguucuacgagugguuccgcaucaugccgaccgccguggacgugcucgacucga

SEQ ID NO: 4237432 - RNA, 70 nt, Mycobacterium avium subsp. paratuberculosis
ugcgccacgaccggcggcgguuauggcuggucgaggccgucaucagccaaaacgacgccgucguggcgca

SEQ ID NO: 4237433 - RNA, 71 nt, Mycobacterium avium subsp. paratuberculosis
agggccaucgcgauguuccucucgguagugauccuuggucguuucaccacagagacucacgcgauggcccu

SEQ ID NO: 4237434 - RNA, 80 nt, Mycobacterium avium subsp. paratuberculosis
gcuggagaccgucucgcggcccaccggcgcgguguucaucaagggcaccgcccuguggcuggaaagcgcgguugaacagc

SEQ ID NO: 4237435 - RNA, 68 nt, Mycobacterium avium subsp. paratuberculosis
gcccgccgaacgucgaguuguugggcgauuaagccguuuuucggcccaacaacucgacgcuggccggc

SEQ ID NO: 4237436 - RNA, 111 nt, Mycobacterium avium subsp. paratuberculosis
cgaugccggccugcggcucgggcaacaccgcgcgguucgugugcccguaccacgccuggacguacaagaacaccggcgaacuguucucggugcccggcaaggccggcuucg

SEQ ID NO: 4237437 - RNA, 73 nt, Mycobacterium avium subsp. paratuberculosis
aagugacggcaaucucaggcggggccggccgggcucauccgccguggccgggcugcuugggcuugccgcacuu

SEQ ID NO: 4237438 - RNA, 79 nt, Mycobacterium avium subsp. paratuberculosis
cgccgcacaccgcgggauggaucggcugccgcuggccaagagcgccuccggcggcgagcugucccgggugaugcuggcg

SEQ ID NO: 4237439 - RNA, 64 nt, Mycobacterium avium subsp. paratuberculosis
cgacgccgagacgcuggcacaaggcauucugcugaccgccgacguguccugucucaaggcguug

SEQ ID NO: 4237440 - RNA, 61 nt, Mycobacterium avium subsp. paratuberculosis
cgaagccggugaagcagcccagcacccaggccagcugggugugggcgggcacguggcuuug

SEQ ID NO: 4237441 - RNA, 56 nt, Mycobacterium avium subsp. paratuberculosis
gcggcgcagcgucugauacacgacuuccuucucgucggugcucagccggugcccgc

SEQ ID NO: 4237442 - RNA, 55 nt, Mycobacterium avium subsp. paratuberculosis
ugaggacgacaucgagcggcuaguggcgaucgccgcuaccgacgguucgucguua

SEQ ID NO: 4237443 - RNA, 55 nt, Mycobacterium avium subsp. paratuberculosis
cgcaguucaucuaucugcuuuccggugccgaucaugaccagauggaucggaugcg

SEQ ID NO: 4237444 - RNA, 58 nt, Mycobacterium avium subsp. paratuberculosis
ccgagcguguacucaccgcgaauuuccggccgguuuuucgcugccagugcacguucgg

SEQ ID NO: 4237445 - RNA, 56 nt, Mycobacterium avium subsp. paratuberculosis
gcgggccgucgaacucggggugaacuucaucgacaccgccgacuccuacggcccgu

SEQ ID NO: 4237446 - RNA, 107 nt, Mycobacterium avium subsp. paratuberculosis
ggccggcggcggccaguuccugacgccaguucuccgcgccgaucaccacguggaagaugucggugcgcgggaagcugucguagcgggugcgagcggcauggccggcc

SEQ ID NO: 4237447 - RNA, 121 nt, Mycobacterium avium subsp. paratuberculosis
ucgucgcggaccuucagcagcaauucccccgccucggcggcgagaucgguggccagcgcggcgucggucaucucguccgacggguugcggggggucaccgcuucaguaucgccgacggcga

SEQ ID NO: 4237448 - RNA, 63 nt, Mycobacterium avium subsp. paratuberculosis
ucgccugcagauaguccagcguguccaggaaauccugguugacgcgcuccuucucguaggcgg

SEQ ID NO: 4237449 - RNA, 63 nt, Mycobacterium avium subsp. paratuberculosis
aucggcgcagcugaccugguuccugggcgggcgcaccgccucgcugagccagcugcugccgau

SEQ ID NO: 4237450 - RNA, 66 nt, Mycobacterium avium subsp. paratuberculosis
cuugccguagcggaccaucaccaccccgaagccaccgaauuguggugcuuggcuguuacggcgcag

SEQ ID NO: 4237451 - RNA, 73 nt, Mycobacterium avium subsp. paratuberculosis
cggcggaucgugcgggccggccccaacacccugcagccguuccaggaacgcccgccggaccgcacgaucgccg

SEQ ID NO: 4237452 - RNA, 64 nt, Mycobacterium avium subsp. paratuberculosis
gcacuggcgaucgagcucgucacgcgaccgagccugcuggugguggacgagccgaccgccgggc

SEQ ID NO: 4237453 - RNA, 65 nt, Mycobacterium avium subsp. paratuberculosis
cggccgcaccggcgaugacggcccgcagcccguccgcaccggccaccgucacgccggugucgccg

SEQ ID NO: 4237454 - RNA, 81 nt, Mycobacterium avium subsp. paratuberculosis
gcggcgcggcggcccguaguggccggcgacgucgaggcgccaggccagcuccacguccccccacacgggcacccccgccgc

SEQ ID NO: 4237455 - RNA, 56 nt, Mycobacterium avium subsp. paratuberculosis
gagcagacgcaaaagcccccgauccaucggcgugucgggugcuuuugugucugcuc

SEQ ID NO: 4237456 - RNA, 105 nt, Mycobacterium avium subsp. paratuberculosis
ccgccugccaguccagcagcccggccuugccgccguggaaguacauguugcccggaugggcgucgccgugcaucacggugugcggggcggcgucgaugagggcgg

SEQ ID NO: 4237457 - RNA, 55 nt, Mycobacterium avium subsp. paratuberculosis
cgccgcgaacacgacauccuggcguucgaacgccagugguggaaguucgccggug

SEQ ID NO: 4237458 - RNA, 67 nt, Mycobacterium avium subsp. paratuberculosis
aggaugaucgccuggccgccgcggcgcaccgcagugugcggcggcgcggugaccaggcugaucaccu

SEQ ID NO: 4237459 - RNA, 76 nt, Mycobacterium avium subsp. paratuberculosis
gcugauccaggccgaugcgcggcgcagcgccgacacccaucugcugcgcuacccgcugccgucggccugggccggc

SEQ ID NO: 4237460 - RNA, 80 nt, Mycobacterium avium subsp. paratuberculosis
ucggcucgccugcgagcgugaaguuaguuucacgcugggcuccgaccgugaagcuaguuucacgcucggcggguugcuga

SEQ ID NO: 4237461 - RNA, 62 nt, Mycobacterium avium subsp. paratuberculosis
ggcgcugguggucggcgcguuccugaucuacaccacgaugacgauggcgaucacccagcgcc

SEQ ID NO: 4237462 - RNA, 77 nt, Mycobacterium avium subsp. paratuberculosis
cgccgcggaguucgucgacguggugcuggcgcuguggcgcgacgccgcgaccggcggcggcgucgaucaccgcggcg

SEQ ID NO: 4237463 - RNA, 63 nt, Mycobacterium avium subsp. paratuberculosis
gccuaccucacuugucugacugguuugcgccuccaccuuauucagcacgucggugaggugggc

SEQ ID NO: 4237464 - RNA, 56 nt, Mycobacterium avium subsp. paratuberculosis
gcggcggucgaggagcugguggcgaccgcgcgccaacaggauuccgacaccgccgc

SEQ ID NO: 4237465 - RNA, 87 nt, Mycobacterium avium subsp. paratuberculosis
ccuucgcgguacgccgggcguaacgccacggcgaaaucccgggcgcauucucgccguggcguuacgcuggcgcugcucgguguaagg

SEQ ID NO: 4237466 - RNA, 72 nt, Mycobacterium avium subsp. paratuberculosis
gccggcucgucgagcugcacccacugcgccccguugucggcgagcagcgacagcagcucggcguagaucggc

SEQ ID NO: 4237467 - RNA, 89 nt, Mycobacterium avium subsp. paratuberculosis
accgugacagcgugcuggcgccggugcgcggcguguucgccgcgcagcagaucaaaccgcaagcccgcacgcuggccaccgaucgcggu

SEQ ID NO: 4237468 - RNA, 71 nt, Mycobacterium avium subsp. paratuberculosis
gcggcgccggcgccggcggcggcggcgauugccgccgucggccgagccgucgucaccggugucggagucgu

SEQ ID NO: 4237469 - RNA, 101 nt, Mycobacterium avium subsp. paratuberculosis
gcagcugcccugacgcgccgagcgugcagugguugcgaaaaauccgccgaauuuucgcagugguugcacgcucggcgcuaauucacagcggcggcagcugc

SEQ ID NO: 4237470 - RNA, 91 nt, Mycobacterium avium subsp. paratuberculosis
gcagggugcacaguuccggcggccggcccagcgggggcagccacacccggugcgcggccggcccguggccggccagccgguccagcaccgc

SEQ ID NO: 4237471 - RNA, 78 nt, Mycobacterium avium subsp. paratuberculosis
guuggccggaacgcugucgggcauguagagccgguuguuguaacuggucuuguagcccggcagggugaccagaccgac

SEQ ID NO: 4237472 - RNA, 113 nt, Mycobacterium avium subsp. paratuberculosis
gccgaugucgcggccuucgggguggccacggcguuguggccggcgucgcugcaaaucgccgacgcgugccguacgccguagccgacuuucgcuccgaacacgugcgcgacggc

SEQ ID NO: 4237473 - RNA, 75 nt, Mycobacterium avium subsp. paratuberculosis
ucgucgccggcgcgggcgucccgguggugcucgacgccggcaucggcaccgccagcgaugccgcgcuggcgaugg

SEQ ID NO: 4237474 - RNA, 126 nt, Mycobacterium avium subsp. paratuberculosis
gacgcggcgaucaucgcagcuauccgcaugaagucaggcuaaccggcgcggcgggcaaacaaggcgcugcgcgcgcgucggcgccgucacgucgguuaccgucgauucaugcaugaccgcaccguc

SEQ ID NO: 4237475 - RNA, 67 nt, Mycobacterium avium subsp. paratuberculosis
ucgccgaaagcgaacuggagugggggaccacgugguccaccucgcugaagucgcuguggaugggcga

SEQ ID NO: 4237476 - RNA, 64 nt, Mycobacterium avium subsp. paratuberculosis
gcuaaguggagcgcguuccgauuagcugacgagaguacauaaccggaacguguuccgcuagagu

SEQ ID NO: 4237477 - RNA, 77 nt, Mycobacterium avium subsp. paratuberculosis
gcucguuuucgcccaacgacgcggccagcgcggcgaaaugccggcgcagcucgucgucgucguuuugcgcggcgagc

SEQ ID NO: 4237478 - RNA, 65 nt, Mycobacterium avium subsp. paratuberculosis
gggccgcacucccgagauggcgguggcggccgaggacggcaccgccgagucgacggguguggccc

SEQ ID NO: 4237479 - RNA, 65 nt, Mycobacterium avium subsp. paratuberculosis
ggucagcgucgaaaagaucuucaccagcgagcugcgucagcgcaucgcggaucuggcgcucgacc

SEQ ID NO: 4237480 - RNA, 79 nt, Mycobacterium avium subsp. paratuberculosis
guagagggccaucgcgugagucucuguggugaaacgaccaaggaucacuaccgagaggaacaucgcgauggcccuggac

SEQ ID NO: 4237481 - RNA, 87 nt, Mycobacterium avium subsp. paratuberculosis
gguggagccgcugccgaugucgaucuugccgccggugcgcacgcaggugaccgaggcgggguugacgcccggcaggucggcgccgcc

SEQ ID NO: 4237482 - RNA, 74 nt, Mycobacterium avium subsp. paratuberculosis
uucgacgcgaucgacgguguugacgagaucaacgacaagcugggcgaucuggugaagaaccucgaucaguugga

SEQ ID NO: 4237483 - RNA, 75 nt, Mycobacterium avium subsp. paratuberculosis
gaccgggcacgggucgccgccacgaucgaugagaucgucaccaaccaucaggcguucagcacccggcaccggauc

SEQ ID NO: 4237484 - RNA, 61 nt, Mycobacterium avium subsp. paratuberculosis
accacgaggaccagcgucgcgaacccgaucagaaaccaguucucgauguggccgacguggu

SEQ ID NO: 4237485 - RNA, 62 nt, Mycobacterium avium subsp. paratuberculosis
gcacuucuucgauuucaucgucacgccgcgccgcggcgacgacggcucgaucgagggcgugc

SEQ ID NO: 4237486 - RNA, 59 nt, Mycobacterium avium subsp. paratuberculosis
gacgcgcugggcgcgcggcuggcuccggguacggugcugccgccuccgaccgguguguu

SEQ ID NO: 4237487 - RNA, 94 nt, Mycobacterium avium subsp. paratuberculosis
cggugaucgcgucccagucgcgggcuuugaaauaggcgugcaggcgcucguaugcgcgugucgcgccauucucgagcggcggucgcggacaccg

SEQ ID NO: 4237488 - RNA, 84 nt, Mycobacterium avium subsp. paratuberculosis
cgacgcgccguuuuucggcaugucggcgcgcgaggccaggcugcuggacccgcagcaucggcugcugcucgagacggcguggcg

SEQ ID NO: 4237489 - RNA, 85 nt, Mycobacterium avium subsp. paratuberculosis
gguagccgcuuuucucggcgaccaugcggcaagccaucuugucuauggcgauguugugaugcguucgacgaaaagccggcaugcc

SEQ ID NO: 4237490 - RNA, 66 nt, Mycobacterium avium subsp. paratuberculosis
ccagccagauguucaucaccgggcccgacgucaucaagaccgucaccggugaggacgucaccaugg

SEQ ID NO: 4237491 - RNA, 76 nt, Mycobacterium avium subsp. paratuberculosis
gcgacuaccccgcgauuccggcacgcccagcagaucggccugggccugccgcugggcccggcgaucgcggaguugc

SEQ ID NO: 4237492 - RNA, 69 nt, Mycobacterium avium subsp. paratuberculosis
cgucgaucgcggucgcccugaaggucgcgcgagcccucgacgucgacgucgggcggcuguucuccgacg

SEQ ID NO: 4237493 - RNA, 89 nt, Mycobacterium avium subsp. paratuberculosis
gcacccugccggcggcgcgcaggaugcggucgucgucgcccucgggcagcacgaugugcuugcgguccgcgcgcgccugcagggucagc

SEQ ID NO: 4237494 - RNA, 55 nt, Mycobacterium avium subsp. paratuberculosis
acgccgaggauccggcgcggggcuuccugcccaccggcggccgggugcucggcgu

SEQ ID NO: 4237495 - RNA, 100 nt, Mycobacterium avium subsp. paratuberculosis
uagcccucgacugucacgccagcgugacgcucgaggucgaccgucacgccagcgugacgcgcgaggucgacugucacgcuagcgugacgcucggcggcua

SEQ ID NO: 4237496 - RNA, 57 nt, Mycobacterium avium subsp. paratuberculosis
gccgcuguuggacaggcuggccgcgcgcaccccggcggccaccuuguccggcggcgc

SEQ ID NO: 4237497 - RNA, 92 nt, Mycobacterium avium subsp. paratuberculosis
accgcggugguguucguggugucggcggccgcgcaccugacacccucggacugcgcgcugcuggacgccgcgaccgaacacaccgacgcggu

SEQ ID NO: 4237498 - RNA, 99 nt, Mycobacterium avium subsp. paratuberculosis
caugcccugaaccgguacgccgcgagagugcaacuaccgacggcaccucucgggaaacgcgucgcuaguugcacuuucgcggucagccggcucgguaug

SEQ ID NO: 4237499 - RNA, 124 nt, Mycobacterium avium subsp. paratuberculosis
aaucgucgcgcugguggaacuucgugccggaaccggugccgccgccgacgaguugcacgcgcacugcacgucgcggcuggcgcgguucaaggcgcccaaggaauuucuguucgucgcugcgguu

SEQ ID NO: 4237500 - RNA, 75 nt, Mycobacterium avium subsp. paratuberculosis
ggugguggcguaguuggucuggccgcgguugcccgcgaugccggccaucgacgaaaggccgacgaugcggccgcc

SEQ ID NO: 4237501 - RNA, 74 nt, Mycobacterium avium subsp. paratuberculosis
gcgcaauugcaugaaggcguacucggccggcgccagucccugcucggcggcggccgggucguccaucaacuggc

SEQ ID NO: 4237502 - RNA, 63 nt, Mycobacterium avium subsp. paratuberculosis
ugagcuucacccggaugcccaucuuccagaccaugggccugccgugcucggugggcaugcuca

SEQ ID NO: 4237503 - RNA, 71 nt, Mycobacterium avium subsp. paratuberculosis
agcguagaacgauacucucguguugaacaguauugaaguucucguaaugcggauguaucguucugcucgcu

SEQ ID NO: 4237504 - RNA, 57 nt, Mycobacterium avium subsp. paratuberculosis
ugcccgcguuguugaccaggacgucgaccgugucgaugccgucggcgaagcggcgca

SEQ ID NO: 4237505 - RNA, 58 nt, Mycobacterium avium subsp. paratuberculosis
gggacgucggcgcgcucggugcuggugaaguucuccagcacgaaggccgccggguccu

SEQ ID NO: 4237506 - RNA, 58 nt, Mycobacterium avium subsp. paratuberculosis
cgaacucggcaucaccugccagaucgccuccagcauguuggugguggcgcccaguucg

SEQ ID NO: 4237507 - RNA, 85 nt, Mycobacterium avium subsp. paratuberculosis
ccgcgcgacccgcacgcaagagugcggccccgacaaucgucgaggccgcaccguuuugcguuauccggguuaaaccccgcugcgg

SEQ ID NO: 4237508 - RNA, 82 nt, Mycobacterium avium subsp. paratuberculosis
cucgguguuccgcgacuacggguaccgccggcugcgcuccaaggcgcggcugaaguuccuggucaaggacuggggcaucgag

SEQ ID NO: 4237509 - RNA, 129 nt, Mycobacterium avium subsp. paratuberculosis
gaucacggcaagaucgucgaccggguguugcaguccccgcuggugaccgaggcgauggugcugucgacaugcaaccgggucgaggucuacgcggugguggacgcguuccacggcggguuggccgugauc

SEQ ID NO: 4237510 - RNA, 70 nt, Mycobacterium avium subsp. paratuberculosis
gcccgcaccugcaggccgccgucgcguucaagaacuuccaguacaccgcggcggcccaaaagguuugggc

SEQ ID NO: 4237511 - RNA, 74 nt, Mycobacterium avium subsp. paratuberculosis
gcgggccggcggcgaugcggcgcugggacaggucggccaccuguucggucaacgcggcguggcgggacacccgc

SEQ ID NO: 4237512 - RNA, 85 nt, Mycobacterium avium subsp. paratuberculosis
ucggccgcgccggaucggagacguccucggcgaccaggaugucuuccaggucgacgcggcguuuccaggcuucgacgucggccgg

SEQ ID NO: 4237513 - RNA, 92 nt, Mycobacterium avium subsp. paratuberculosis
cgagggcuucgucaacuacaacgccggcacgcugggcgccucgaugguggagggccgcaucucggcgggcgucguggugggcgacggcuccg

SEQ ID NO: 4237514 - RNA, 79 nt, Mycobacterium avium subsp. paratuberculosis
cagccccaagucgguggccacgaucgccgcgguggcggugaucuucgucggcggcaucguggcccuggcgugggcgcug

SEQ ID NO: 4237515 - RNA, 55 nt, Mycobacterium avium subsp. paratuberculosis
ucgaugaucaccgcggccaggcugucggcgccgaucuggccgucgaugauguuga

SEQ ID NO: 4237516 - RNA, 59 nt, Mycobacterium avium subsp. paratuberculosis
ccuggccggcgccucgaucgccgggcgguucaccgaccggcaucgagaagccguccggg

SEQ ID NO: 4237517 - RNA, 73 nt, Mycobacterium avium subsp. paratuberculosis
acgccgagagcaccaugaucagacccagcguggucagcagccccgcgauggcgaugaucaggugaaacgacgu

SEQ ID NO: 4237518 - RNA, 76 nt, Mycobacterium avium subsp. paratuberculosis
guccggaucaccgcgcugggcaccgcgcgcgggcuggagacccggcuggugcccgagcgcggcuaugaccucgagc

SEQ ID NO: 4237519 - RNA, 55 nt, Mycobacterium avium subsp. paratuberculosis
gcgggacagcucggccagcgcggcgucgacggccgacuggucgcggcugucccgc

SEQ ID NO: 4237520 - RNA, 56 nt, Mycobacterium avium subsp. paratuberculosis
gucggcgcugauggccgcguggacgucgcuguacgacgcggccaagagugaucgac

SEQ ID NO: 4237521 - RNA, 57 nt, Mycobacterium avium subsp. paratuberculosis
ugaucgcggcgugcccgcugaccuucccguggaacgugcugggcuggccgucgauca

SEQ ID NO: 4237522 - RNA, 80 nt, Mycobacterium avium subsp. paratuberculosis
gcggggcugcggccgcugcuggccggggagagcgaggaaacauccaagcucucccgcgagcacgcgguggcggugcccgc

SEQ ID NO: 4237523 - RNA, 60 nt, Mycobacterium avium subsp. paratuberculosis
gcuccagggugagcgugacgcugcgcggcguggugcggcgcacgucggucacuuuggcgc

SEQ ID NO: 4237524 - RNA, 73 nt, Mycobacterium avium subsp. paratuberculosis
ggugacggucggcuucgucucgguguugagccugcgcggcuacgucaacgccaugagcgacgccgacgucgcc

SEQ ID NO: 4237525 - RNA, 61 nt, Mycobacterium avium subsp. paratuberculosis
uguucgccggcgucgaucagcgcgacgucccgcaacgucuggucgaggucgucggcgaacg

SEQ ID NO: 4237526 - RNA, 103 nt, Mycobacterium avium subsp. paratuberculosis
cccgcgcgaccugcgcucggccaucgguucgguggugcacgcccugaucgcccaaccgcaccgcagcccggccgaacugguggccgagcuggaccgcgucugg

SEQ ID NO: 4237527 - RNA, 62 nt, Mycobacterium avium subsp. paratuberculosis
ucucauuccugagacuuucuugaauuaucgaaacucgaauguaagauucgccggggaagaga

SEQ ID NO: 4237528 - RNA, 77 nt, Mycobacterium avium subsp. paratuberculosis
gcggcggcggacggcggugcugacggcgacgcucaccuucggggcgacgacggccgguaucgcggugcugccgccgu

SEQ ID NO: 4237529 - RNA, 74 nt, Mycobacterium avium subsp. paratuberculosis
cggcgacgaaauagcgcaccacggcguuguccacgcacuggucgccguugaacaccgcggugugcugcgucccg

SEQ ID NO: 4237530 - RNA, 107 nt, Mycobacterium avium subsp. paratuberculosis
gcugggugguugccucggcgcuggguggcccguuguugaugacggcggucgcgcuggccgucauccacgacgcgucgucggugaucaccgaguugcagacgcccagc

SEQ ID NO: 4237531 - RNA, 67 nt, Mycobacterium avium subsp. paratuberculosis
gaucggcccgguauccgcggucacgcugaugcugcagagccugggcggaccgcuggugcuggccguc

SEQ ID NO: 4237532 - RNA, 66 nt, Mycobacterium avium subsp. paratuberculosis
cguguggcgcugcuguuuucgcggucggucgaugcggucguggcgauccuggcagugcucaagacg

SEQ ID NO: 4237533 - RNA, 79 nt, Mycobacterium avium subsp. paratuberculosis
gccgaccgugguggugucggugccgcggguguucgagaagguuuacaacaccgccgagcaaaacgccgccaacgacggc

SEQ ID NO: 4237534 - RNA, 80 nt, Mycobacterium avium subsp. paratuberculosis
cgaacgguucaccgagcuggccaaggaagugcccgggcuggagacgggccaggugcacauccuggccggcagcccguucg

SEQ ID NO: 4237535 - RNA, 74 nt, Mycobacterium avium subsp. paratuberculosis
gccgcgcuacauggugcgcagcaccaucgcggcgaccgccgccgacgggcuggaggccauguauccgccguggc

SEQ ID NO: 4237536 - RNA, 94 nt, Mycobacterium avium subsp. paratuberculosis
guugcgcggugccccggacagccggugaccccgguggugcgccgcgacgucguucaccgcgaucgcggggucaccgagcugcgcgccgcgcagc

SEQ ID NO: 4237537 - RNA, 60 nt, Mycobacterium avium subsp. paratuberculosis
gcgagcagacgcaaaagcccccgacacgccgggcgucgaggggcuuuugcgucugcucgc

SEQ ID NO: 4237538 - RNA, 112 nt, Mycobacterium avium subsp. paratuberculosis
cccgagccgcggccgcgcggacguggacuggucggagguggccggcaucuauguggucggcggggccggcggcuucccgcuggugucccggaugcugcgcgcccgguucggg

SEQ ID NO: 4237539 - RNA, 88 nt, Mycobacterium avium subsp. paratuberculosis
ggaaguggaccgcgugugcccgccucgcagcgacaaucggcucgccucaacgguugucgcucaaaggcgggcacuucguccaucgucc

SEQ ID NO: 4237540 - RNA, 56 nt, Mycobacterium avium subsp. paratuberculosis
gcggucacaaugacuuccggaguggccucgagcgccucgggcaguguucugaccgc

SEQ ID NO: 4237541 - RNA, 77 nt, Mycobacterium avium subsp. paratuberculosis
gccgguuggcgaugaugucggcagguucgcacacgcccaccaggugagcgaccgaugccagcguguggccggccggc

SEQ ID NO: 4237542 - RNA, 67 nt, Mycobacterium avium subsp. paratuberculosis
ccgagccgcaacguuugauuuugugucugagacaagaccacaggugaucaucgaugcggccgcacgg

SEQ ID NO: 4237543 - RNA, 92 nt, Mycobacterium avium subsp. paratuberculosis
gccccugcaucgaggucccuguccgaaggcacgaaccuggcguuggggaaguacgccagggucgguucgggcagaggccacguugcacgggc

SEQ ID NO: 4237544 - RNA, 55 nt, Mycobacterium avium subsp. paratuberculosis
uccgccagucccgcaggaucgccgagggccugccgaaccugaucgagcuggugga

SEQ ID NO: 4237545 - RNA, 58 nt, Mycobacterium avium subsp. paratuberculosis
gccgauguaguucuugcggucguagaagaagucccgcaccuccucgaacggcaucggc

SEQ ID NO: 4237546 - RNA, 64 nt, Mycobacterium avium subsp. paratuberculosis
gaugaacaucggccagauccuggagacccaccugggguggguggccaaguccggcuggaacauc

SEQ ID NO: 4237547 - RNA, 105 nt, Mycobacterium avium subsp. paratuberculosis
ggugugcugcgcagccugaaggucggcgcccgcaccaugugggccaaggcgaccggcaagaaccuggucggcaugggccgggcgcugaucgggccgcugcgcauc

SEQ ID NO: 4237548 - RNA, 79 nt, Mycobacterium avium subsp. paratuberculosis
cagcgccggaccgccgaggugcacgucgaagcugacgacggaaccguccgccuugggcugcaccuuggccaucagcuug

SEQ ID NO: 4237549 - RNA, 56 nt, Mycobacterium avium subsp. paratuberculosis
guggugggccagccgcggcgcuugcccagcacgaucgccagcaucaggcccgccac

SEQ ID NO: 4237550 - RNA, 64 nt, Mycobacterium avium subsp. paratuberculosis
gcgguugggagcgcgcgguucucggcaaugcccgaacaccgaggcgccgccgcucccacgccgu

SEQ ID NO: 4237551 - RNA, 70 nt, Mycobacterium avium subsp. paratuberculosis
gccgcuggguuaccucaaccuggccaucuggcugauuccggccauguucgggguggccuaccgucgcggc

SEQ ID NO: 4237552 - RNA, 58 nt, Mycobacterium avium subsp. paratuberculosis
gccuucuuguucuccucguggucgcggaccacguggcacacguucuggcacaggaagc

SEQ ID NO: 4237553 - RNA, 85 nt, Mycobacterium avium subsp. paratuberculosis
ggcuggucacggucgacggcgacaccggguugccgcgcucgucgaccacgaagcagcgaucggcgucgccgucgaaggccaggcc

SEQ ID NO: 4237554 - RNA, 92 nt, Mycobacterium avium subsp. paratuberculosis
gggccuggcccgcggugaggccgcguccaugucggccggcgccgggcgggacgugcggccgaccgaccggcccaaggcggccuaccaggccu

SEQ ID NO: 4237555 - RNA, 101 nt, Mycobacterium avium subsp. paratuberculosis
uucuccucgccgaccagguuggucaccggcacccgcacgucggaguaauagguggcgcuggugucggggccggccauggugugcaccggcguccaggagaa

SEQ ID NO: 4237556 - RNA, 68 nt, Mycobacterium avium subsp. paratuberculosis
ugcgacugggcgcuggacucgaccagcuucgggcgcccgcgcuguucgaggaagccguccgggccgua

SEQ ID NO: 4237557 - RNA, 80 nt, Mycobacterium avium subsp. paratuberculosis
ggccucacucgccgaacgugaagcuaguuucacguucgcacgcgagcgugaaguuaacuucacgcucggcgguaggggcc

SEQ ID NO: 4237558 - RNA, 75 nt, Mycobacterium avium subsp. paratuberculosis
gucguagccgugccgcaugucgccgacgaugcgcggauuguccagcgucgaggguuccagcgggcgcggcccgac

SEQ ID NO: 4237559 - RNA, 105 nt, Mycobacterium avium subsp. paratuberculosis
gucgcgguggucggcccgaagagcgccgagcagaucccggcggugcugggcauccuguccgucggcgccgccuaucugccgaucggggccgaccagccccgcgau

SEQ ID NO: 4237560 - RNA, 61 nt, Mycobacterium avium subsp. paratuberculosis
cgcgaaagugcuacugccgacgcauuucccgagugggaccgucggcaguugcacuuucgcg

SEQ ID NO: 4237561 - RNA, 58 nt, Mycobacterium avium subsp. paratuberculosis
gguggugacgaucacgucgccggggccgacggcccccucgaaacgguugucccccacc

SEQ ID NO: 4237562 - RNA, 69 nt, Mycobacterium avium subsp. paratuberculosis
gccgggcguugaugggcagggcgaagagcaccgagaacaucagcagcgccugcaccagcaacaccgagc

SEQ ID NO: 4237563 - RNA, 59 nt, Mycobacterium avium subsp. paratuberculosis
ggugagggcgagaugagucccggcgauagucccuauccgaaauccguuucgucccgauc

SEQ ID NO: 4237564 - RNA, 61 nt, Mycobacterium avium subsp. paratuberculosis
gccgagcgucgaguuguuggcgccgaaagccacgauuucacgcaacaagucgacguugggc

SEQ ID NO: 4237565 - RNA, 55 nt, Mycobacterium avium subsp. paratuberculosis
gcacccugcuggacagccugcuguccgacccggacgcgacgcugucggcaugugc

SEQ ID NO: 4237566 - RNA, 64 nt, Mycobacterium avium subsp. paratuberculosis
ucugcgccggggcaucgccggaauggccaaugagggguggccauuuucccgagucccggcaaga

SEQ ID NO: 4237567 - RNA, 56 nt, Mycobacterium avium subsp. paratuberculosis
gcugcaucgcgaaccggucgccgccgaccagcgcggcgaccucggucgcgugcggc

SEQ ID NO: 4237568 - RNA, 88 nt, Mycobacterium avium subsp. paratuberculosis
cagucgguccacccgggugucggcgugcucggucaggcccagcucgucgaggaccugggcgaccaccugagcccggucggacuugcug

SEQ ID NO: 4237569 - RNA, 59 nt, Mycobacterium avium subsp. paratuberculosis
uggacagcagcaccgccagggcggccugcaccaccaugaagcugguggcguuguguuca

SEQ ID NO: 4237570 - RNA, 63 nt, Mycobacterium avium subsp. paratuberculosis
gaggggcugaugcccucggccgcggcgaguucccuuuugcuccggccggucaucaggccccuc

SEQ ID NO: 4237571 - RNA, 65 nt, Mycobacterium avium subsp. paratuberculosis
cauugacugauggcuuacccgaaacuuuccgggcacgaaccagcgggggugggcuaacagcggug

SEQ ID NO: 4237572 - RNA, 73 nt, Mycobacterium avium subsp. paratuberculosis
gccgugcucauggcggugcucgcgggcgugcggcucagaacugcagcgcgucgaaccgccaguccagcacggc

SEQ ID NO: 4237573 - RNA, 63 nt, Mycobacterium avium subsp. paratuberculosis
gccgugcggcgugaucuugucgaugggcgugcgcaccaguucgacguugucgcgcugcagggu

SEQ ID NO: 4237574 - RNA, 58 nt, Mycobacterium avium subsp. paratuberculosis
cuucgaguagcccugcugcccgucgccgucgccgacguagcuggggaucugcucgcgg

SEQ ID NO: 4237575 - RNA, 62 nt, Mycobacterium avium subsp. paratuberculosis
uugccgccgaucgcgccgggguagcgcugcagcagcucguccugguuggugaucggcugcag

SEQ ID NO: 4237576 - RNA, 68 nt, Mycobacterium avium subsp. paratuberculosis
guccuggucaccaaguucgccgccggggcguggaucgcccuguucgcgaugagcuugcuguucgggau

SEQ ID NO: 4237577 - RNA, 79 nt, Mycobacterium avium subsp. paratuberculosis
gucggugcugcugcuguccguggggcuggccggguucugcguccacgccacccugcugggcaugcuggccggcaccaac

SEQ ID NO: 4237578 - RNA, 86 nt, Mycobacterium avium subsp. paratuberculosis
cgggccaccgcgaacgccucgggcagcaggucgucgaggcucucgccgucggcgugccgcuucuugaacucgucggucuuggcccg

SEQ ID NO: 4237579 - RNA, 86 nt, Mycobacterium avium subsp. paratuberculosis
guccgccguugggcgagaucgcuucacgaaucgcgucgaacccauaggcugugcccucaggugaacgauucguucggcggccggac

SEQ ID NO: 4237580 - RNA, 75 nt, Mycobacterium avium subsp. paratuberculosis
cuggugucgacccgcagggcauugggcaggucgccgcggcgcugcucgauuucccugcgguugaucgacgcacag

SEQ ID NO: 4237581 - RNA, 63 nt, Mycobacterium avium subsp. paratuberculosis
gauauccacucgggaucggucacggagauuccgaugguguguucgugaggucccgguggcauc

SEQ ID NO: 4237582 - RNA, 55 nt, Mycobacterium avium subsp. paratuberculosis
gucgucgaucgcggcggccagcucgccggugggcuugucaccgccguccggcgac

SEQ ID NO: 4237583 - RNA, 129 nt, Mycobacterium avium subsp. paratuberculosis
ggugucggccgagcucggcggccgcgacgggcuggcccggcugucggcggcggcccgggcccgcggcaugggucuggucgucgacaucgugcccaaccacgucgggaucgacgcgccccggcagaaccc

SEQ ID NO: 4237584 - RNA, 63 nt, Mycobacterium avium subsp. paratuberculosis
cgccgaucaccugcccggcgcuguucaccaucgggccaccggagucgcccggcuugaucggcg

SEQ ID NO: 4237585 - RNA, 55 nt, Mycobacterium avium subsp. paratuberculosis
ucggcgacggugaaggcgaucucggcgacggucggaucguucucgucgcgcacga

SEQ ID NO: 4237586 - RNA, 120 nt, Mycobacterium avium subsp. paratuberculosis
gauccggcugggcgccgacgcccgcaccgacgggcaccacgcgguggugcgcgggcugccgcaauuguccagugcgcccgugugguguucggacauucgggccggcgccggccugguguu

SEQ ID NO: 4237587 - RNA, 61 nt, Mycobacterium avium subsp. paratuberculosis
ucgucacgcccgcgcugcaacgguucaccggcgcgauuccccagcgcgccagggugaucga

SEQ ID NO: 4237588 - RNA, 58 nt, Mycobacterium avium subsp. paratuberculosis
ggguggggccgagcuggcgcaggauggcguugauggagucccgcagcuggucccacuc

SEQ ID NO: 4237589 - RNA, 125 nt, Mycobacterium avium subsp. paratuberculosis
agcguguugcccucgaugcugauguccucgacgcccuugauccgccugagaucaccggggucaccggucauuucggccuugaucgaggugcggcucagaugccgcaucgagcucagcgaaccgcu

SEQ ID NO: 4237590 - RNA, 74 nt, Mycobacterium avium subsp. paratuberculosis
ggucggcgccggcgucgucgugacgcgacauccccaccccgcgguguucgaucaugaugacgucgagaccggcc

SEQ ID NO: 4237591 - RNA, 103 nt, Mycobacterium avium subsp. paratuberculosis
accgccagcaacucgccggcggcggugugcagcaccucggcgaccgcaccgacccgccggccgccgguggugcgcaccugcaggcccucgaguugauggucgu

SEQ ID NO: 4237592 - RNA, 129 nt, Mycobacterium bovis subsp bovis AF2122/97
guugaauaggccgguguuguagucaccggaguugccaaugccgguguugaccaggccgguguugaagaagccggaguuggugcugccgguguugccgaugccgguguuguagucaccggaguuuccgau

SEQ ID NO: 4237593 - RNA, 63 nt, Mycobacterium bovis subsp bovis AF2122/97
cgcccgagugugaaucgcacgacgcgacacgccggcgggcugucguaugauucacgcucggcg

SEQ ID NO: 4237594 - RNA, 62 nt, Mycobacterium bovis subsp bovis AF2122/97
cgggccgcaacuggcaacugagucgcuucggcagcugcgaccagucgucuggcagcggccug

SEQ ID NO: 4237595 - RNA, 112 nt, Mycobacterium bovis subsp bovis AF2122/97
gcgccgcggucggccgggcauuggcuggcggucgccgaggcgguggugcgcggaccgcugcagaucgccgucgcgugcgaccugccgcggucgucccugcuggccgacgcgc

SEQ ID NO: 4237596 - RNA, 69 nt, Mycobacterium bovis subsp bovis AF2122/97
gaugacaucaccgggaugcacgucgaguucgcgaagcagcaacuccagcaugcucucggucaugucguc

SEQ ID NO: 4237597 - RNA, 130 nt, Mycobacterium bovis subsp bovis AF2122/97
cauggugucgacgcgguguguggccgcagcuucgaugacuacgaccacgccaccgacaucggcuuugugcgggagaaauggucgaugaucaaggggcgcgaugccuacacugccgccuacgcggcgcccg

SEQ ID NO: 4237598 - RNA, 91 nt, Mycobacterium bovis subsp bovis AF2122/97
cgcucgcgaaugccuggcugacggcguggcggugcuggucgaggaacggguggaccugcgccgcgagcugucggcacugguggcgcguucg

SEQ ID NO: 4237599 - RNA, 59 nt, Mycobacterium bovis subsp bovis AF2122/97
cguccggcauuucugggguguaguucaucucgcacagcgcggagugcccggugccggcg

SEQ ID NO: 4237600 - RNA, 62 nt, Mycobacterium bovis subsp bovis AF2122/97
cgcgagcagacgcagagucgcaugaaaauccggauuucgaugcgauucugcgucugcucgcg

SEQ ID NO: 4237601 - RNA, 80 nt, Mycobacterium bovis subsp bovis AF2122/97
uccgguuccaccuucgacgacaucgacgccgucguggucggcaaggcgcccgacuucuucgaaggggugaugaugccgga

SEQ ID NO: 4237602 - RNA, 96 nt, Mycobacterium bovis subsp bovis AF2122/97
caccugccgcagccgcggugcuagaacgcagccgugaauuggauaucgaggaccaacuguuggcugcgcugcguaccgacgugcacgcgaugugug

SEQ ID NO: 4237603 - RNA, 57 nt, Mycobacterium bovis subsp bovis AF2122/97
cgaucgggcagcugccuggcguggugauuacaccgcaggccgagcugcucccgaccg

SEQ ID NO: 4237604 - RNA, 74 nt, Mycobacterium bovis subsp bovis AF2122/97
ugccagcugcgccgaaggcccagcgcggacggcaaacaccuuccguugcaacaccuucggaugcagcuuggacg

SEQ ID NO: 4237605 - RNA, 66 nt, Mycobacterium bovis subsp bovis AF2122/97
uccugagccuguuccgcagcgaagacgccgcccggucguucguugccgcuccgggacgggccauga

SEQ ID NO: 4237606 - RNA, 73 nt, Mycobacterium bovis subsp bovis AF2122/97
gaggucgauggcgaugcgcaccccgucgcgcaucgucacauagcacgaggaguagcgcaucccacgauaucuc

SEQ ID NO: 4237607 - RNA, 83 nt, Mycobacterium bovis subsp bovis AF2122/97
gcacgccggcgaggcgcuguucgaggcggucgacaagcugauccgucaacugcccgagucgcagcgcccgaagcuggucgugu

SEQ ID NO: 4237608 - RNA, 56 nt, Mycobacterium bovis subsp bovis AF2122/97
cgucgccaagauugucgaugcugguggcgaucaucgucggcucggucucggugacg

SEQ ID NO: 4237609 - RNA, 77 nt, Mycobacterium bovis subsp bovis AF2122/97
gcuggucguuggcagcugauugcguucgcggcgccgcugcucggcguguugugcucgaucagcuggcagcguccggu

SEQ ID NO: 4237610 - RNA, 94 nt, Mycobacterium bovis subsp bovis AF2122/97
gccgccgauucagacaaccggcugauguagugggcggcggcggcaucggugccgaccaccgcgaugcguuugccggccgggucgaaaucgcggu

SEQ ID NO: 4237611 - RNA, 61 nt, Mycobacterium bovis subsp bovis AF2122/97
ggcuccguagcagcguuggcuacgcggccauguugcugguggucacgcugauugccgggcc

SEQ ID NO: 4237612 - RNA, 69 nt, Mycobacterium bovis subsp bovis AF2122/97
cguugcaaccgagucgcgaggcguuccggggccgguaucuuccguaacgcgugcacuucggcggcgaug

SEQ ID NO: 4237613 - RNA, 67 nt, Mycobacterium bovis subsp bovis AF2122/97
cgucgcguucguuucaagcggaucgaucuuguguagcaggucgaugagcgauuggaacaacguguug

SEQ ID NO: 4237614 - RNA, 88 nt, Mycobacterium bovis subsp bovis AF2122/97
cgugcggaacugagcggcgaaggugagcuggggauccaccggcgccugaucgagccccagucgcuuugucucgagguugaucuccacg

SEQ ID NO: 4237615 - RNA, 56 nt, Mycobacterium bovis subsp bovis AF2122/97
ugggcuaccgaggucagggcgccguagccggcgccuugcugggaucggucagcuca

SEQ ID NO: 4237616 - RNA, 103 nt, Mycobacterium bovis subsp bovis AF2122/97
cgaugccguauccggagaccugggggguuuggcaggaggacgagggucgccagaucgucgccaacgccgucaagcucgccaaagaggcgguuggagcggaucg

SEQ ID NO: 4237617 - RNA, 69 nt, Mycobacterium bovis subsp bovis AF2122/97
gccacaguaaucauggccgcugggcgucagccggacgguauggugcccggggccuuggucacauguggu

SEQ ID NO: 4237618 - RNA, 59 nt, Mycobacterium bovis subsp bovis AF2122/97
gccaaaucgagccgagagugggcgacccggaagggcccacacuccuggcuggauucggc

SEQ ID NO: 4237619 - RNA, 89 nt, Mycobacterium bovis subsp bovis AF2122/97
cagcuccgaccugauauguucaauaaaucauuauguucaauaaaacugaacguacggauauacugaacgcauggaucagaucggggcug

SEQ ID NO: 4237620 - RNA, 60 nt, Mycobacterium bovis subsp bovis AF2122/97
auucucgcgcucgagugagcagagcccgcaccucgucgaguugcugcugcagcgcagaau

SEQ ID NO: 4237621 - RNA, 67 nt, Mycobacterium bovis subsp bovis AF2122/97
gugcggaucgccaucgugcugcaauugcgugaaucucaacgcugcgugcacgaacuggucgacgcac

SEQ ID NO: 4237622 - RNA, 58 nt, Mycobacterium bovis subsp bovis AF2122/97
cguccgguugggauugucgagguugacggauuuccgguuuuugauguuccgccggaug

SEQ ID NO: 4237623 - RNA, 107 nt, Mycobacterium bovis subsp bovis AF2122/97
gcuguucauggcacgagguccgccgagcguaacgucacugcgagauugcgauccgaauagcgcaguggcguuacgcucgcggaauccagcaucagugccagcgcagc

SEQ ID NO: 4237624 - RNA, 81 nt, Mycobacterium bovis subsp bovis AF2122/97
guggcgcggucgacaugaaggacauggugggcaugaugauugugguugcccgccaccuucgucaggccgcuaucgugccgc

SEQ ID NO: 4237625 - RNA, 65 nt, Mycobacterium bovis subsp bovis AF2122/97
augcauuggcgcugcaguacuuucacgcagcucccuggguugcguggucggaugcaggccagcgu

SEQ ID NO: 4237626 - RNA, 113 nt, Mycobacterium bovis subsp bovis AF2122/97
aacggcuuggcgucggccggcaguccgagcuuggccgccgccaccuguugcccuugcgcaaggaugucggggcgaagcuugacguugccgggcuuguagacgccaugcacguu

SEQ ID NO: 4237627 - RNA, 62 nt, Mycobacterium bovis subsp bovis AF2122/97
gucguucagauaacaacguggccacacaccaaccggugugcggccacguuguaauugacggc

SEQ ID NO: 4237628 - RNA, 76 nt, Mycobacterium bovis subsp bovis AF2122/97
ggauccggugguuacggcaucguguucggcccggaagccucucaggccgaauuggcggccguuagccaaaagaucc

SEQ ID NO: 4237629 - RNA, 60 nt, Mycobacterium bovis subsp bovis AF2122/97
gcgagcagacgcagaaucgcacgccgacgggcguggcggugcgauucugcgucugcucgc

SEQ ID NO: 4237630 - RNA, 67 nt, Mycobacterium bovis subsp bovis AF2122/97
gacgucgcgguugcuguuuaccgccacgccgccuggaccgauggugucggugaauggcaacgugguc

SEQ ID NO: 4237631 - RNA, 55 nt, Mycobacterium bovis subsp bovis AF2122/97
gcgccgccgcagaccgcgacccgcgacaccagcaggucgggauccccggcggcgc

SEQ ID NO: 4237632 - RNA, 126 nt, Mycobacterium bovis subsp bovis AF2122/97
cagcaucaucucaccgcuuggugggcgucgaguucgcgagcguaacgccaccgcgaaaauucgcaugggauuucgcagugccgucacgcucgcggaucaagacugacaccgcggauuugacugcug

SEQ ID NO: 4237633 - RNA, 98 nt, Mycobacterium bovis subsp bovis AF2122/97
cgccggcggccgaguuguucgccaucguugcugauccccggcgccaccgcgaacuggacggaucgggcacgguucgcggcaacaucaagguaccggcg

SEQ ID NO: 4237634 - RNA, 86 nt, Mycobacterium bovis subsp bovis AF2122/97
ggcggccagcaaucgaggcaacgccguuucggcgaucgcugcgucgaccagcagcgucucggcggcguugcagacgcugggccgcc

SEQ ID NO: 4237635 - RNA, 89 nt, Mycobacterium bovis subsp bovis AF2122/97
cggcgggcagccguuuagcuuggaugccagccuggacaccgucggugucgucgacggugaucuguugguguugcagccggugcccgccg

SEQ ID NO: 4237636 - RNA, 59 nt, Mycobacterium bovis subsp bovis AF2122/97
gcuguccuguggcgcccgcagccgggagggacgcgggcugcggguaccacggcggcggc

SEQ ID NO: 4237637 - RNA, 65 nt, Mycobacterium bovis subsp bovis AF2122/97
uugcggguuuucaccgauucagacgggaauuucgguaauccgcugggggugaucaacgccagcaa

SEQ ID NO: 4237638 - RNA, 66 nt, Mycobacterium bovis subsp bovis AF2122/97
ggccgggaugacagcgaggugcacucggcgauucgguuugcuguuguggccgcugucgucgggguc

SEQ ID NO: 4237639 - RNA, 62 nt, Mycobacterium bovis subsp bovis AF2122/97
cguccaggagaacaaguggcgugccgcccgcuacggccuggacgcggugaucaucuuggacg

SEQ ID NO: 4237640 - RNA, 91 nt, Mycobacterium bovis subsp bovis AF2122/97
gcggcggguuucgucguguccgauguggcggcggcgggccacccacacuuccgugaguucgccgccgagaucggugcggcgaucccgccgu

SEQ ID NO: 4237641 - RNA, 84 nt, Mycobacterium bovis subsp bovis AF2122/97
ccaccgagcgggugguggucgccaacgccgaccaacugcugaucguggucgcgcuggcagacccgccgccacgcaccggccugg

SEQ ID NO: 4237642 - RNA, 69 nt, Mycobacterium bovis subsp bovis AF2122/97
gucgcgaggcaacgucgugaucggauggccuuuuguuggguuguuggcgcuuggccuugucuacguggc

SEQ ID NO: 4237643 - RNA, 100 nt, Mycobacterium bovis subsp bovis AF2122/97
gccgacgucgacgaggaggaugcagccggcuuggacgguuccccgggcgaagucgacguccccggugucacggagcuggccccuacccguccacgucggc

SEQ ID NO: 4237644 - RNA, 71 nt, Mycobacterium bovis subsp bovis AF2122/97
ucgaugucaccgagcaucucagcgaccucaccgacgaccgaugcgcgcguuggugaugccggugaccaaga

SEQ ID NO: 4237645 - RNA, 86 nt, Mycobacterium bovis subsp bovis AF2122/97
gcuggccgagggccuacaagaguuugguggcuacugcgauugugagaucguaaugaaugucgaaccugaggcgaucuucggcuagu

SEQ ID NO: 4237646 - RNA, 96 nt, Mycobacterium bovis subsp bovis AF2122/97
ugaagggaacaaagcuggcuguugucgucggcaugacgguggcugccguuaguuuggcagcgccggcgcaggccgacgacuacgacgcccccuuca

SEQ ID NO: 4237647 - RNA, 67 nt, Mycobacterium bovis subsp bovis AF2122/97
guccgggcugggccugcgggucaucgcgcacgauccuuaccgcgacgacgccggccacagccuugac

SEQ ID NO: 4237648 - RNA, 94 nt, Mycobacterium bovis subsp bovis AF2122/97
gauucgcacgggugagaucguggaugucgccuuccuggcucagcacggcugagccgaaccacggcgacucuggugaacuuauggcgcucgaauc

SEQ ID NO: 4237649 - RNA, 68 nt, Mycobacterium bovis subsp bovis AF2122/97
ggcguggcgacaagagccguaaacugcugucccgcagucaaguucaaccucuugucggccgacccgcc

SEQ ID NO: 4237650 - RNA, 55 nt, Mycobacterium bovis subsp bovis AF2122/97
cuugccgggacuuuuuguguggcggcguuaccacccgucgcgucccucuggcaag

SEQ ID NO: 4237651 - RNA, 129 nt, Mycobacterium bovis subsp bovis AF2122/97
gacccgaccucugccguggaugcggucaucgaaugcggaauucaggaggugcugcgggaggcgaucgcggaucgcaccgcggucauuuucacccgccgccgauccaugcuuaccuuggccgaccggguc

SEQ ID NO: 4237652 - RNA, 84 nt, Mycobacterium bovis subsp bovis AF2122/97
ugcucgagcagcauuucggucggcucgucgacuacgacuucaccgcggcgauggaagacgagcucgacgagaucgccgccggca

SEQ ID NO: 4237653 - RNA, 58 nt, Mycobacterium bovis subsp bovis AF2122/97
acccggucgagcaccccgaugaucuucuguuugaccucaucgggcacaucgucgcggu

SEQ ID NO: 4237654 - RNA, 66 nt, Mycobacterium bovis subsp bovis AF2122/97
cacugguugucccaugggcgguggacugacggaugggacccacaccgcgccagcgacgaugcagug

SEQ ID NO: 4237655 - RNA, 93 nt, Mycobacterium bovis subsp bovis AF2122/97
gcgcuggccaacagguguuguucggcgaugcccgaaucgaacacccgaugcggguaucgccucgacagcgcgccuagaccagugggcagacgc

SEQ ID NO: 4237656 - RNA, 74 nt, Mycobacterium bovis subsp bovis AF2122/97
cucgccaccaugcccgguagcucguugcgcaguccuugguugugcaagucgaucugccggcgcgaccaaccgag

SEQ ID NO: 4237657 - RNA, 57 nt, Mycobacterium bovis subsp bovis AF2122/97
ggcgccgguguucacgucgccgguguuguagaagccgguguuguagucgccgguguu

SEQ ID NO: 4237658 - RNA, 68 nt, Mycobacterium bovis subsp bovis AF2122/97
gcguuggugaagugcaacacgaacguuggaucggcuucgaaccagcgaaugucguugccucggcgagc

SEQ ID NO: 4237659 - RNA, 124 nt, Mycobacterium bovis subsp bovis AF2122/97
gucgaucgcgcugacggccccggaagcgaccgcguagacggguguucccggaucgguggcgaagucgacaccgggauggaaaccacccgcgugcggaccguacccgcggccgaucgcgcgcggc

SEQ ID NO: 4237660 - RNA, 55 nt, Mycobacterium bovis subsp bovis AF2122/97
ucgaugucggagcgcacugcgucgaugucaccgcacagcgcagccccgaugucga

SEQ ID NO: 4237661 - RNA, 63 nt, Mycobacterium bovis subsp bovis AF2122/97
agcagcagcaaaccugagguggcugaggcuaauguuguuuuaguuaccaucguugcugauguu

SEQ ID NO: 4237662 - RNA, 86 nt, Mycobacterium bovis subsp bovis AF2122/97
cgcucugaguuacccccgcgagcagacgcaaaaagcccccaaaacgguuccguuuugggggcuuuacgucugcucgccacauggcg

SEQ ID NO: 4237663 - RNA, 105 nt, Mycobacterium bovis subsp bovis AF2122/97
guucaacuccggcgccggcaacgucggguucuucaacaccgggaccggcaacuucggguuguucaacuccggcagcuucaacaccggcgucggcaauagcggaac

SEQ ID NO: 4237664 - RNA, 128 nt, Mycobacterium bovis subsp bovis AF2122/97
guggucucgcucggugcgcccccacagucccugcgccgagaucgacguuagcgucacgccuuauggugauuuuccgcucuggcguggaucucggcgcaugucggguggcgaccaccaagccacgccac

SEQ ID NO: 4237665 - RNA, 129 nt, Mycobacterium bovis subsp bovis AF2122/97
cgccgucgguaaagcuggacgcacugugcccgccugaucuugccgcugguggugaugggaaucgacccgggcgacaccagaacgagaucggccacgcucagaccgugcgaaucaaauaucgccgcggcg

SEQ ID NO: 4237666 - RNA, 63 nt, Mycobacterium bovis subsp bovis AF2122/97
gucgcccgcggucugcaugacgaugggcggcaggccgcucaugucgccguagaccggggagau

SEQ ID NO: 4237667 - RNA, 91 nt, Mycobacterium bovis subsp bovis AF2122/97
ccagccagugcagccugggcauugaacgcgcgcugcaccgcugccgagaggggcagcgccaaacucaaguuccgccaggccgccucgcugg

SEQ ID NO: 4237668 - RNA, 98 nt, Mycobacterium bovis subsp bovis AF2122/97
guagccugucggucacacaagucgcgagcguaacgucacggucaaauaucgcguggaauuucgccgugacguuccgcucgcggacaaucaaggcauac

SEQ ID NO: 4237669 - RNA, 118 nt, Mycobacterium bovis subsp bovis AF2122/97
gcgggcgcucggcuucaccgucugaaccggcgcgucgccgaacgugaacugagggcggagaauccggcaaaauaccgccgugaguucacguucggcgggcggugcgagcgaaacccgc

SEQ ID NO: 4237670 - RNA, 65 nt, Mycobacterium bovis subsp bovis AF2122/97
uccgcgagcguaacgccacugcgcuauucggaucgcaaucucgcagugacguuacgcucggcgga

SEQ ID NO: 4237671 - RNA, 129 nt, Mycobacterium bovis subsp bovis AF2122/97
ccggggacaaccagacugggaucggcggcuugaacuccggugccggcaacaucggguuguucaacuccggcaccggcaacgucggguuguucaacuccgggaccgggaacuucggguuguucaacucgg

SEQ ID NO: 4237672 - RNA, 68 nt, Mycobacterium bovis subsp bovis AF2122/97
ccugaccagcagugcggccacggcggucggggcaaccgccgugggacccucacugccugcguuaaagg

SEQ ID NO: 4237673 - RNA, 100 nt, Mycobacterium bovis subsp bovis AF2122/97
ggcggacuucuguaucccggcguaguucaccgcggucagugccaccaccacggcgacggccaccgcgugcgcuugcgcgggccacacauagaagccgacc

SEQ ID NO: 4237674 - RNA, 59 nt, Mycobacterium bovis subsp bovis AF2122/97
cgcgcggaguucggugacgguaggccagucgugcucaccgacaccgucggcuuugugcg

SEQ ID NO: 4237675 - RNA, 58 nt, Mycobacterium bovis subsp bovis AF2122/97
cuggcaccggcugccugguggcggcaacugucguggcugccgcagcggccggugcugg

SEQ ID NO: 4237676 - RNA, 70 nt, Mycobacterium bovis subsp bovis AF2122/97
ggcggccgcggccgcguucugggcgaccaucgccgagccgauggucucgagcuugccggccgcagccgcc

SEQ ID NO: 4237677 - RNA, 67 nt, Mycobacterium bovis subsp bovis AF2122/97
cgcaagcauuggagccggacccgcgccggccaucagccgugcgguauuuagcuccgguggcauugcg

SEQ ID NO: 4237678 - RNA, 79 nt, Mycobacterium bovis subsp bovis AF2122/97
uccgcuccaguagcggcgaagcgggccacgcucucgugcagcaggggagugaucggcaccgcuuuggcggagggguggg

SEQ ID NO: 4237679 - RNA, 79 nt, Mycobacterium bovis subsp bovis AF2122/97
gccggccaaggcgcgggugcgugcacugggugucgccggagcguuccacaccgaguucauggcgcccgcacuugacggc

SEQ ID NO: 4237680 - RNA, 69 nt, Mycobacterium bovis subsp bovis AF2122/97
caauaguuggugugaacgccguguccaaggaguaacggccaugggaugguuuucagcgcccgaauauug

SEQ ID NO: 4237681 - RNA, 92 nt, Mycobacterium bovis subsp bovis AF2122/97
ucuccuggucggccuggucgucggcaauccagggugcccgcgguccuaccgcccacugacccuggauuaccggcuuaacccggucgcgguga

SEQ ID NO: 4237682 - RNA, 70 nt, Mycobacterium bovis subsp bovis AF2122/97
gcccuggugaccgucgccgcgucguugcuugccggacugcuggcacacguggccgaucgguuacuagggc

SEQ ID NO: 4237683 - RNA, 85 nt, Mycobacterium bovis subsp bovis AF2122/97
gcuggcggaaggugaucaccgccaccuugucccugcgcugguaggcgucgcgcagcagcgacaggguggcgccacugaccgcagc

SEQ ID NO: 4237684 - RNA, 62 nt, Mycobacterium bovis subsp bovis AF2122/97
ccagccggugcuaucgguuucgaacgugaugugcgcguccucgaaacccagccaccucuugg

SEQ ID NO: 4237685 - RNA, 63 nt, Mycobacterium bovis subsp bovis AF2122/97
cguugacucugcgcccaccacguguccuacucgcacuuuugcgugguggacgcagagucaacg

SEQ ID NO: 4237686 - RNA, 56 nt, Mycobacterium bovis subsp bovis AF2122/97
gaggacgggucuugaccgaggcaauuggagacgagccacucggcgaccacguccuu

SEQ ID NO: 4237687 - RNA, 57 nt, Mycobacterium bovis subsp bovis AF2122/97
cucgguguguuggucacccgcgggcaccugcagaccgacgacuaccagcucaccgag

SEQ ID NO: 4237688 - RNA, 62 nt, Mycobacterium bovis subsp bovis AF2122/97
cgccgagggugaaucucacgacgggucgucggcgugucgcgucgugcgauucacugucggcg

SEQ ID NO: 4237689 - RNA, 65 nt, Mycobacterium bovis subsp bovis AF2122/97
ucaucgaggcuguaguuggcgcacaaaacugcgaaugcggaccacgguaucuacagacucgguga

SEQ ID NO: 4237690 - RNA, 129 nt, Mycobacterium bovis subsp bovis AF2122/97
gccgaagcaauugucgccgaagggcauucggagguagcguucgucaucguggguuccgggccgcacggcgccgacccgcaucacggauauucggaccgcgaauugcgggagggugacaucguugucguc

SEQ ID NO: 4237691 - RNA, 57 nt, Mycobacterium bovis subsp bovis AF2122/97
gaccugguugacaccggcgaccugcacgaagccgcggucguucuccaggaucagguc

SEQ ID NO: 4237692 - RNA, 82 nt, Mycobacterium bovis subsp bovis AF2122/97
ugagguugggccggucggcggacacaucucagucggggcgaaagccacgcuccuaucaagucacgccggccgguccuucuca

SEQ ID NO: 4237693 - RNA, 92 nt, Mycobacterium bovis subsp bovis AF2122/97
cgauguggcgucgccgggaugucggugcggaaucguugugagugcucaugcugaccgugauuguuccgcaccgacgcuggccgcgcccgucg

SEQ ID NO: 4237694 - RNA, 78 nt, Mycobacterium bovis subsp bovis AF2122/97
guugagcgcgagcagacgcagagucgcacugcgccggccggcgcagugcgacucugcgucugcucaccagcggucagc

SEQ ID NO: 4237695 - RNA, 65 nt, Mycobacterium bovis subsp bovis AF2122/97
gugaaucgaaugaaagccguagguuuccagguaauaggggaaccggcuggagcauccgauaccgc

SEQ ID NO: 4237696 - RNA, 65 nt, Mycobacterium bovis subsp bovis AF2122/97
accaaguucgccgccgaugacauauugccgcuggaauacgcaccaccgaucggucccgagcuggu

SEQ ID NO: 4237697 - RNA, 65 nt, Mycobacterium bovis subsp bovis AF2122/97
gcguugacucugcguccaccacgcaaaagugcgaguaggacacguggugggcgcagagucaacgu

SEQ ID NO: 4237698 - RNA, 78 nt, Mycobacterium bovis subsp bovis AF2122/97
cccgauguacgcaacggcugucacacgaucguaaccacaccgucucggucugugaucucgccuugcgucaagccuggg

SEQ ID NO: 4237699 - RNA, 69 nt, Mycobacterium bovis subsp bovis AF2122/97
uggcgcgagcagacacagaaucgcacgggcgaggggcgccggaugcgagucugugucugcucgccgcua

SEQ ID NO: 4237700 - RNA, 58 nt, Mycobacterium bovis subsp bovis AF2122/97
ccggcgcuacuggcggugagagcgucggcaccggcgcuacuggcggcgagagcgucgg

SEQ ID NO: 4237701 - RNA, 57 nt, Mycobacterium bovis subsp bovis AF2122/97
gaucgugacgccacgggugcgggcggcaucggccagcuccgcgguggcuucacgguc

SEQ ID NO: 4237702 - RNA, 58 nt, Mycobacterium bovis subsp bovis AF2122/97
ucgaugugcuccaugaucccgccgauauagaccucggcgccaucacacagcgcgucga

SEQ ID NO: 4237703 - RNA, 73 nt, Mycobacterium bovis subsp bovis AF2122/97
gggccggaucuuguaggucaccgugaacgggugguuguuggucacgucggcggaaaccaacagggucgggucc

SEQ ID NO: 4237704 - RNA, 111 nt, Mycobacterium bovis subsp bovis AF2122/97
guuggguugccaagauuuuccguguuggccggguggucgagcccgcggcccccuuaccggcggcgauagccgaaccacccgccgggguacgggguucgcugcagauccgac

SEQ ID NO: 4237705 - RNA, 74 nt, Mycobacterium bovis subsp bovis AF2122/97
ccguccgcguacgacagcgccgcgcuggcguggcucgacuccacccagucgugcucgcucucggcacgagacgg

SEQ ID NO: 4237706 - RNA, 105 nt, Mycobacterium bovis subsp bovis AF2122/97
gccucacccgauccaccgguugagucagcggugcgaauggcugggcaccguugugguguccggucccguaccguacuguugaauccgcggauccccgccugaggu

SEQ ID NO: 4237707 - RNA, 58 nt, Mycobacterium bovis subsp bovis AF2122/97
uuggccgaccagcgcuucgauacggcugugcgcaacaccucgagcguuggcgcgccga

SEQ ID NO: 4237708 - RNA, 78 nt, Mycobacterium bovis subsp bovis AF2122/97
accccgccggcgcgcuggccggucacccugcacgugcuaccgaccguucgggaugccagcuagcgcgcguugcccggu

SEQ ID NO: 4237709 - RNA, 65 nt, Mycobacterium bovis subsp bovis AF2122/97
ggcuugaccggcgcgaccagcggcuugucgcaagugacuggcuuguucggugcggccggucuguc

SEQ ID NO: 4237710 - RNA, 59 nt, Mycobacterium bovis subsp bovis AF2122/97
auucggucgccugaucgguuccuaucgggguucgguauaccgccaucagccgaccgaau

SEQ ID NO: 4237711 - RNA, 80 nt, Mycobacterium bovis subsp bovis AF2122/97
gccccgcuggcgagcagacgcgaaaucccccgacacgccgaacgugcgguggcuuuugcgucugcucgcgccggugaggc

SEQ ID NO: 4237712 - RNA, 83 nt, Mycobacterium bovis subsp bovis AF2122/97
guuggcugggcggccgcggcucgcguagggcuuguguggauucacgagguucagcgucgagucgaggaaaguccggacuucac

SEQ ID NO: 4237713 - RNA, 104 nt, Mycobacterium bovis subsp bovis AF2122/97
ugguuugagcagcgcgauagggaauucggguuuccagaaccucggcucgcugcagucaggcugggcgaaccugggcaacuccguaucgggcuuuuucaacacca

SEQ ID NO: 4237714 - RNA, 58 nt, Mycobacterium bovis subsp bovis AF2122/97
gcgccagugcugcgcgugcacaauguuguuggcggucaaugcacuccaccgcuggcgc

SEQ ID NO: 4237715 - RNA, 68 nt, Mycobacterium bovis subsp bovis AF2122/97
cggcgccgagcgugaacugagggcgagauuccggccgauucuccgcccucaguucacguugggcgacg

SEQ ID NO: 4237716 - RNA, 61 nt, Mycobacterium bovis subsp bovis AF2122/97
guugacucugcauccaccacgcaauagugcgaguaacccgccugcuggacgcagagucagc

SEQ ID NO: 4237717 - RNA, 67 nt, Mycobacterium bovis subsp bovis AF2122/97
cgguucgcuggcuguaucgccccagggcgucggagacgacguucuccauauaugccaacagaucccg

SEQ ID NO: 4237718 - RNA, 100 nt, Mycobacterium bovis subsp bovis AF2122/97
cgugcccgcgaucgcguauugcgagccacgcagguugaaauucacgaucuccaggaauucaccggugcucuccgcgaucccggcgacgaacgcgggcacg

SEQ ID NO: 4237719 - RNA, 67 nt, Mycobacterium bovis subsp bovis AF2122/97
cgcggugucguggacggcacgagcgcugggcauggagucccacgccgcggcuguccucggugccgug

SEQ ID NO: 4237720 - RNA, 100 nt, Mycobacterium bovis subsp bovis AF2122/97
ggucgacuccgggagugccggcagcggugguggugcggcugcccggcaacgccgccucgaccucaucggccaucgcugcgggcacuucguaguugcgacc

SEQ ID NO: 4237721 - RNA, 89 nt, Mycobacterium bovis subsp bovis AF2122/97
cgcgcugggcacguugggagccguggccaccaacgccgagggcgccaacauggacgccggccugguggccgcgcucgccgcucaccgcg

SEQ ID NO: 4237722 - RNA, 81 nt, Mycobacterium bovis subsp bovis AF2122/97
uugcuaccuucccgacguuucguucggugucugugcgauagcggugaccccggcgcgcacgucgggaguguuggggggcag

SEQ ID NO: 4237723 - RNA, 62 nt, Mycobacterium bovis subsp bovis AF2122/97
gccuccggugccggcaguagucggggagccggguccaccggccgccaaauggcgccggaagc

SEQ ID NO: 4237724 - RNA, 56 nt, Mycobacterium bovis subsp bovis AF2122/97
ucagucuuucgucgcgguggcucccgacggcauggaccccugcgaccuacgacuga

SEQ ID NO: 4237725 - RNA, 69 nt, Mycobacterium bovis subsp bovis AF2122/97
gugcgccgaacgugcccugguggcggcgacacgccgggcggagccgccaugguugcacguucggcgugu

SEQ ID NO: 4237726 - RNA, 73 nt, Mycobacterium bovis subsp bovis AF2122/97
ggccagcauccaguuggcgcagcucgucgguuccggugaccgagaacugaacuccgccggcccgccgcuggcc

SEQ ID NO: 4237727 - RNA, 75 nt, Mycobacterium bovis subsp bovis AF2122/97
ggugguggcguaguuggucuggccgcgguugccggcgaugccggcgaucgacgacagcccgaucacccgaccacc

SEQ ID NO: 4237728 - RNA, 58 nt, Mycobacterium bovis subsp bovis AF2122/97
gccugccgaggacuucgcgggccagcucuuccagugcccggcgauccucggucagugc

SEQ ID NO: 4237729 - RNA, 116 nt, Mycobacterium bovis subsp bovis AF2122/97
ccccgagcagaccuggcaggcgcugcuggaaggccgcgacgggaucaccgaccugcccgacgggcgcuggucggaauuccucgaagagccgcggcuggccgcgcgggucgccgggg

SEQ ID NO: 4237730 - RNA, 67 nt, Mycobacterium bovis subsp bovis AF2122/97
cgaugucgccgccaugaaaccacuugauccacaagcgauucaaccgguauugguggcggcuucguug

SEQ ID NO: 4237731 - RNA, 78 nt, Mycobacterium bovis subsp bovis AF2122/97
gcuacggcgugagcagacgcaaaagcccccauuucgggcccgaaaugggggcuuuugcgucugcucggccaaccuagc

SEQ ID NO: 4237732 - RNA, 59 nt, Mycobacterium bovis subsp bovis AF2122/97
cgaguggucugggcucgaccgcgccagcgauaucggcgggugcgagccaggccggcucg

SEQ ID NO: 4237733 - RNA, 70 nt, Mycobacterium bovis subsp bovis AF2122/97
ccggcuggcugucgggcaacggcggcaccggcggaggcggcggcaccgccggcgccggcggccaaggcgg

SEQ ID NO: 4237734 - RNA, 99 nt, Mycobacterium bovis subsp bovis AF2122/97
gccggggcuaucggugccggcgucggcggucgccuaggcggcaauggccagaucggaguugccggccagggugccguuggcgcuggugucggcgcuggu

SEQ ID NO: 4237735 - RNA, 60 nt, Mycobacterium bovis subsp bovis AF2122/97
gucgcggacagucccauguuagcugcauguuuagcagacuggcuugccuccugccgcgac

SEQ ID NO: 4237736 - RNA, 70 nt, Mycobacterium bovis subsp bovis AF2122/97
gagguuggcgccggggugcagagcaucggcgcggacaccgagcaacucugcgaccucggcgcgaaugauc

SEQ ID NO: 4237737 - RNA, 64 nt, Mycobacterium bovis subsp bovis AF2122/97
gcgugcgggccugccgccgugacuagcgugcccgucaccagcaccgcggccagguucagcgcgc

SEQ ID NO: 4237738 - RNA, 77 nt, Mycobacterium bovis subsp bovis AF2122/97
cgccuuccaccuguugucgguagaaccgucggacaucgaccggcugaccggugugcuggcgaagguucgggacggcg

SEQ ID NO: 4237739 - RNA, 92 nt, Mycobacterium bovis subsp bovis AF2122/97
gaggccgcuggccgcgacagugaaauccacgacgugacacgccggaaacgcgucgugacauucacucucguggccagaagaaagacggcguc

SEQ ID NO: 4237740 - RNA, 79 nt, Mycobacterium bovis subsp bovis AF2122/97
uccucgaaucucaccgguccugcugcaucgucgcccacaaaccggcggcaugcagcuuggacacgucgacuuccaugga

SEQ ID NO: 4237741 - RNA, 81 nt, Mycobacterium bovis subsp bovis AF2122/97
ugcggcccgacccgcaccagcacgccucguugcggcccaggucgcggcgcggcugggcucggugccgcuccaggagccgca

SEQ ID NO: 4237742 - RNA, 73 nt, Mycobacterium bovis subsp bovis AF2122/97
ggccgccgagcgcagcccggcaugggugggguuggagucccaccgcgacagucggcgcgccaggugggcggcc

SEQ ID NO: 4237743 - RNA, 83 nt, Mycobacterium bovis subsp bovis AF2122/97
gucgguuguaaggcgguaccgguagcgccgguggaacccgcaugaccggcaccgccggcgccgccggugccgccguugccgac

SEQ ID NO: 4237744 - RNA, 70 nt, Mycobacterium bovis subsp bovis AF2122/97
cacaguaguagacgucgucgcagccggccaucgccucggccacgguggcggugucgaagacgucgccgug

SEQ ID NO: 4237745 - RNA, 81 nt, Mycobacterium bovis subsp bovis AF2122/97
cggccgcucgguuccaggaugugguggaucgcuggaacgccgagucgacgcggcucuaccacguccugcacgcgaucgccg

SEQ ID NO: 4237746 - RNA, 107 nt, Mycobacterium bovis subsp bovis AF2122/97
ccucuuuggugguaacccacagugcgauaucggcaccggcuugcaaggugcgcaacaccgccucgcugacgccaaaccggucugagaucgcggccauaccagagagg

SEQ ID NO: 4237747 - RNA, 75 nt, Mycobacterium bovis subsp bovis AF2122/97
ggucguugcggggugguggacgccgccggcgugggcgaucgggccgccggugguggacgccgccgcgcaaccgcc

SEQ ID NO: 4237748 - RNA, 55 nt, Mycobacterium bovis subsp bovis AF2122/97
ugcugcucguaguuguuggcgucgcgaaccagcccgucacgcaccccgugcagca

SEQ ID NO: 4237749 - RNA, 78 nt, Mycobacterium bovis subsp bovis AF2122/97
gcgggccgcugggcggcccgcaucgucgccgggcggggcugacugcccggcuccucagcgggccgcugggcggcccgc

SEQ ID NO: 4237750 - RNA, 123 nt, Mycobacterium bovis subsp bovis AF2122/97
cgcgggugaugaucaccgggcgaagcucguggucgagccggccgucuucucgcuuggacacgacgccaacccuagaccuagccggcucgccggacuucgaacgucucgucgcauaccaccgcg

SEQ ID NO: 4237751 - RNA, 81 nt, Mycobacterium bovis subsp bovis AF2122/97
gaugcugcccgugggcgugcguaggcugcgcaacuaucacucgacgcgcagcgcgcacuacugccucgcccgggucacguc

SEQ ID NO: 4237752 - RNA, 62 nt, Mycobacterium bovis subsp bovis AF2122/97
ggcacggcguguuugagugcgaguacuucgccgucaaccauuccacuccggacgcguuggcc

SEQ ID NO: 4237753 - RNA, 79 nt, Mycobacterium bovis subsp bovis AF2122/97
accgcgccguucgaccaguucauguugcggcucaaggucgggauggccgccggcauugugcuggcuugcccgguguggu

SEQ ID NO: 4237754 - RNA, 56 nt, Mycobacterium bovis subsp bovis AF2122/97
gcgguggucgcgaccggccccgguaccaacgcccuggccgccucgucgaccaucgc

SEQ ID NO: 4237755 - RNA, 57 nt, Mycobacterium bovis subsp bovis AF2122/97
ugggcaugaucuguggaucaggaacccgauacgggauuccacgguuuaucgugccca

SEQ ID NO: 4237756 - RNA, 58 nt, Mycobacterium bovis subsp bovis AF2122/97
cgagcagucgcaaaagcccccgacacgcgcggcgugcgggggcuuuugcgacugcucg

SEQ ID NO: 4237757 - RNA, 73 nt, Mycobacterium bovis subsp bovis AF2122/97
cgucuuccgcaucgagcgggcaugauugcgcaacguuucgcgccagucgccggcuucgauguacgggguagcg

SEQ ID NO: 4237758 - RNA, 67 nt, Mycobacterium bovis subsp bovis AF2122/97
cgcgucggcacgcccaacgagguggccaccgaagucagcgugaacaccgcguucggugugcggcgug

SEQ ID NO: 4237759 - RNA, 66 nt, Mycobacterium bovis subsp bovis AF2122/97
ggccggcgcuugauccuugcgccgggugaaugguguuagcgcaccgcguagucgugagugccggcc

SEQ ID NO: 4237760 - RNA, 80 nt, Mycobacterium bovis subsp bovis AF2122/97
cgccgccggagcagguggucgucgacgcgagugccaugguggaucuacuggcucgcacuagcgaucggugcucugcggug

SEQ ID NO: 4237761 - RNA, 111 nt, Mycobacterium bovis subsp bovis AF2122/97
gcgccacgccgcagcggcggcggccggcaccgacgucgagggugauggugcggccgaggcgcggguugcccgucgugcccuggacguggucccgacgcuguggcgcggcgc

SEQ ID NO: 4237762 - RNA, 60 nt, Mycobacterium bovis subsp bovis AF2122/97
gaucgcgcgcugcggccgagcggguugacgaacacccaauucagcacgcuggccgugauc

SEQ ID NO: 4237763 - RNA, 81 nt, Mycobacterium bovis subsp bovis AF2122/97
gccagcacaccaucaccgugaugaucagcacgccgauggcgcgggugagugacaacacggcgguggugugaucacccaggc

SEQ ID NO: 4237764 - RNA, 112 nt, Mycobacterium bovis subsp bovis AF2122/97
cagcacggcgcuagcuuaguuggccgagcagacgcaaaagcacccgauucuggucgaaauagggugguuuugugucuguucggcggcacaaguagcgugucgaccgugacug

SEQ ID NO: 4237765 - RNA, 56 nt, Mycobacterium bovis subsp bovis AF2122/97
cgguacgguccgcaguuggguguauggaaccaugcccgacagcaccaccgauaccg

SEQ ID NO: 4237766 - RNA, 109 nt, Mycobacterium bovis subsp bovis AF2122/97
gcgccauuguagauguuuuccuuuccguugggguaaguaaaguucgaaucaccgguggcgaaccgcugauccgcccagauuugccggaaauagugaggacauugagcgc

SEQ ID NO: 4237767 - RNA, 64 nt, Mycobacterium bovis subsp bovis AF2122/97
gcgcgagcagacguaaaagcccccgcacgcucggcgugucgggggcuuuuacgucugcucgcgc

SEQ ID NO: 4237768 - RNA, 72 nt, Mycobacterium bovis subsp bovis AF2122/97
gguccgguggucgggguguggcggcgggcaccguugcaggcgcuggcccgccuacacaugcuggcggccgcc

SEQ ID NO: 4237769 - RNA, 88 nt, Mycobacterium bovis subsp bovis AF2122/97
gggcagcuccaggugcuguggcucggcgccguggccauacagcacagcggguaucuugccggcgcgccgggcccgccgggacgcgccc

SEQ ID NO: 4237770 - RNA, 96 nt, Mycobacterium bovis subsp bovis AF2122/97
ggcgcgcgccguugccgaucgcugcgcugaucgcggucgggguggacagucccaccgcgcacgggcaugcgaucaacaacauggucaucgcgcgcc

SEQ ID NO: 4237771 - RNA, 67 nt, Mycobacterium bovis subsp bovis AF2122/97
ggcccggagcaccgccugcuuggcguuguccagcagcugcugggccuccugagcagcggcuugggcc

SEQ ID NO: 4237772 - RNA, 77 nt, Mycobacterium bovis subsp bovis AF2122/97
ggaucgaucuggucgacgaguggaugaccggcccggacgggucuucgugcaccacgucggccuugccacagaucacc

SEQ ID NO: 4237773 - RNA, 69 nt, Mycobacterium bovis subsp bovis AF2122/97
accgguaguagcgggucugaugcaggaucgcgggcagccuugcggcacucgucaggcccgcgggcaggu

SEQ ID NO: 4237774 - RNA, 55 nt, Mycobacterium bovis subsp bovis AF2122/97
gucuaccauuugggcgaucgucaccggcgacacacgacgcccaacgaacgugggc

SEQ ID NO: 4237775 - RNA, 67 nt, Mycobacterium bovis subsp bovis AF2122/97
gcggacugaccguuuucgaugugcgggucgaggccauggcaccguucgucgagggcggcgccaccgc

SEQ ID NO: 4237776 - RNA, 66 nt, Mycobacterium bovis subsp bovis AF2122/97
ccggcgagcagacacagaaucgcacgcgccgggccggcgcagugcgauucugugucugcucgcggg

SEQ ID NO: 4237777 - RNA, 86 nt, Mycobacterium bovis subsp bovis AF2122/97
gcgaaacauugcugauagccgggucgccaggugcuggucgggcauggccagcaccgccgcggccgcguagcccucggccaccucgc

SEQ ID NO: 4237778 - RNA, 96 nt, Mycobacterium bovis subsp bovis AF2122/97
gggcucggccaucgccgggauugguuacgcugcgcuggucgagcgcaaugcauucguccugcgcgaggugaccaugccagucuugacuccgggcuc

SEQ ID NO: 4237779 - RNA, 74 nt, Mycobacterium bovis subsp bovis AF2122/97
gccugcaaccgagcggccagcaccugcaacgcacgcgucuuguucugcagcugcgaccguucguucugacaggu

SEQ ID NO: 4237780 - RNA, 66 nt, Mycobacterium bovis subsp bovis AF2122/97
ggcggcuaccugaaggacaucaagggcuucgauucggaguucuucgcgguggccaagaccgaagcc

SEQ ID NO: 4237781 - RNA, 76 nt, Mycobacterium bovis subsp bovis AF2122/97
cggaguuggcgggucguugggaacuucccggcgguaaggucgccgccggcgaaaccgagcgcgccgcgcuggcccg

SEQ ID NO: 4237782 - RNA, 80 nt, Mycobacterium bovis subsp bovis AF2122/97
gguugacguaccgcggccggucggccaucaccuuacgcagcgaccccgcgcccggccgcuggucgcguacuagcucaucc

SEQ ID NO: 4237783 - RNA, 57 nt, Mycobacterium bovis subsp bovis AF2122/97
ugacucugcguccagcaggcggguuacucgcacuauugcgugguggaugcagaguca

SEQ ID NO: 4237784 - RNA, 60 nt, Mycobacterium bovis subsp bovis AF2122/97
gugagcgagcccggugaugcggugauuuucgggucagccgggugcgccgggcuugcccac

SEQ ID NO: 4237785 - RNA, 113 nt, Mycobacterium bovis subsp bovis AF2122/97
ucgacgcuggaccgcuucuugccgguguggaucgggucggcaauggccgccgggcuacuacugggccgguggauucccggccugcacaccgcccuagaagggguucagcucga

SEQ ID NO: 4237786 - RNA, 66 nt, Mycobacterium bovis subsp bovis AF2122/97
ccgcagucgucgggcucgucgucaccgauuuguucaccggaaucgaggaugcuggcucgacggcgg

SEQ ID NO: 4237787 - RNA, 60 nt, Mycobacterium bovis subsp bovis AF2122/97
gcgagcagacgcaaaagcccccauuucgacacgaaaaugggcgauuuugcgucugcucgc

SEQ ID NO: 4237788 - RNA, 64 nt, Mycobacterium bovis subsp bovis AF2122/97
ucgagccgggaagucgguagcccgcauacgaccgaaaugccggcugcgcgcauccuggcgacga

SEQ ID NO: 4237789 - RNA, 76 nt, Mycobacterium bovis subsp bovis AF2122/97
gugcguccgaacgcuugaaauugcggcgcgcgagccgaccgauggccuugcucgccgcuuuuucggucggguacac

SEQ ID NO: 4237790 - RNA, 60 nt, Mycobacterium bovis subsp bovis AF2122/97
ggcgacguuggcaccucggugcuguccuggcucagcgaucaucaggugcauaacguugcc

SEQ ID NO: 4237791 - RNA, 63 nt, Mycobacterium bovis subsp bovis AF2122/97
cguugacucugcguccaccgugugggcuacucgcacauucccgugguggacgcagagucagcg

SEQ ID NO: 4237792 - RNA, 107 nt, Mycobacterium bovis subsp bovis AF2122/97
ucugcagcaugcgaggugcgggugagccgauccaggaacgauucgagggugugucgagucagguacuccugcgucggugcgccggucccgcacuucgaggcaguaga

SEQ ID NO: 4237793 - RNA, 58 nt, Mycobacterium bovis subsp bovis AF2122/97
gcgcgacgacgaccccgaggacgccuuggcggacauguuccuggcggcguuguucggc

SEQ ID NO: 4237794 - RNA, 62 nt, Mycobacterium bovis subsp bovis AF2122/97
cgcugacugugaaucugacgacgcgacacgccgcugucgcgucgucagauucacaaucggcg

SEQ ID NO: 4237795 - RNA, 95 nt, Mycobacterium bovis subsp bovis AF2122/97
agccgcucccgcucgcgagcagacgcagaaucgcccauuucggcacgaaauugggcgauucugcgucugcucgcgcccuggaagcuggugcggcu

SEQ ID NO: 4237796 - RNA, 67 nt, Mycobacterium bovis subsp bovis AF2122/97
ggugggggucaacaucgagcugaucuccaccucggagaucaggaucucgguguugugccgcgacacc

SEQ ID NO: 4237797 - RNA, 85 nt, Mycobacterium bovis subsp bovis AF2122/97
gcugggauaguccgauucgcugauagucgcuccauccggccaccgcccaggacaggaugcugucggccuccaacugcaaccgugc

SEQ ID NO: 4237798 - RNA, 56 nt, Mycobacterium bovis subsp bovis AF2122/97
ccagcgauuggcggcgacuggcugugaaaucgaaacgcgcccgcuacggucgcugg

SEQ ID NO: 4237799 - RNA, 59 nt, Mycobacterium bovis subsp bovis AF2122/97
ggcgggcguuggucuguacguugcgcucguaggcgacaacgacaccgggcgccaacgcc

SEQ ID NO: 4237800 - RNA, 55 nt, Mycobacterium bovis subsp bovis AF2122/97
gacgaggccgucgccgcguugcgcgccgggguagcgcaacggcgacgggcucguc

SEQ ID NO: 4237801 - RNA, 81 nt, Mycobacterium bovis subsp bovis AF2122/97
gcgucuaggcccuuguugauggcguccugguggcuaccggagaacgcgguguaaaccaggucgccgccauaggggugacgu

SEQ ID NO: 4237802 - RNA, 92 nt, Mycobacterium bovis subsp bovis AF2122/97
ucgccgcggaucccggccucuauccccugcacggcggcggaugcgcccugcaccguggugaugcacgggauguugccggccaccgccgccga

SEQ ID NO: 4237803 - RNA, 130 nt, Mycobacterium bovis subsp bovis AF2122/97
uccgggaaacaugucacgguaggucgguauuccggcuaccggcugagcauugagcacgccggccagcaccgcacgagccaggcaaucagccgccgccgcaccgaccgcggugaccagcugagucuccgga

SEQ ID NO: 4237804 - RNA, 55 nt, Mycobacterium bovis subsp bovis AF2122/97
ccgcccgggugcgccguagcugaccgucaugggcccagcucgcgcagccgggcgg

SEQ ID NO: 4237805 - RNA, 61 nt, Mycobacterium bovis subsp bovis AF2122/97
ggcugcucacugcgaucgcgagcaaccccgagcgggccgccguguacuuccaggagcagcc

SEQ ID NO: 4237806 - RNA, 60 nt, Mycobacterium bovis subsp bovis AF2122/97
acggguugcgggugggaccguaagcggaguucuccgucgacgagcccaucgcgaacucgu

SEQ ID NO: 4237807 - RNA, 77 nt, Mycobacterium bovis subsp bovis AF2122/97
gccgccaaccgagcguugggccugccguagccgauccgcacggucagcggcguaccacccagcgcgucgcgagcggc

SEQ ID NO: 4237808 - RNA, 69 nt, Mycobacterium bovis subsp bovis AF2122/97
gcggccgucgauucgagagguaaccgaucgcccgccgacaauggguuacccaccgagacugauugccgc

SEQ ID NO: 4237809 - RNA, 123 nt, Mycobacterium bovis subsp bovis AF2122/97
cagcguacccaccggccgccaagggcccgcgagcagacgcaaaagcccccgaaaaugggcauuucgggggcauuuugcgucugcucgcccgaaacuagagcucgguggcugaaccgcccgcug

SEQ ID NO: 4237810 - RNA, 99 nt, Mycobacterium bovis subsp bovis AF2122/97
ugguuauucuccgggcaagggucgcagugggcagcgaugggcgccgaucugcugacgaacgaaucgguguucgccgcgaccguugcggagcuagagcca

SEQ ID NO: 4237811 - RNA, 57 nt, Mycobacterium bovis subsp bovis AF2122/97
acccggccagcacguagucggcgaugaagaucggcaccggcucaccguuggccgggu

SEQ ID NO: 4237812 - RNA, 67 nt, Mycobacterium bovis subsp bovis AF2122/97
cugccggugauaugggucgucucguccuugagguacagcucgacgucgacauccgugcaccaggcag

SEQ ID NO: 4237813 - RNA, 98 nt, Mycobacterium bovis subsp bovis AF2122/97
gcucaggccgguuucaccaucggcaucgggaucgugcuggacaccuuccugguccgcacggucacggugccggccuugaccacgaugauuggccgggc

SEQ ID NO: 4237814 - RNA, 92 nt, Mycobacterium bovis subsp bovis AF2122/97
ccucacauugcgcacgucguugucggcuccuuguguuucugauccuugacaagccagaaaccuuaagccacaacgacgugcgccuacucagg

SEQ ID NO: 4237815 - RNA, 57 nt, Mycobacterium bovis subsp bovis AF2122/97
uucgguaucgccuccgccuuuggccagcagcagccacagcgcgguucgcggaccgaa

SEQ ID NO: 4237816 - RNA, 81 nt, Mycobacterium bovis subsp bovis AF2122/97
gauguuggagcugccgauguugccgcugccgauguugccguugccgauguuggccgagccgagauugaaguucccgacauu

SEQ ID NO: 4237817 - RNA, 83 nt, Mycobacterium bovis subsp bovis AF2122/97
uugucggccggcgagcagacgcauaagcccccgcacgcucggcgugucgggggcuuaugcgacugcucgcccggggccgucag

SEQ ID NO: 4237818 - RNA, 60 nt, Mycobacterium bovis subsp bovis AF2122/97
gcggaguccuugcucaccaugaacggccagucgcuggacacggugagcagggucucgcgc

SEQ ID NO: 4237819 - RNA, 58 nt, Mycobacterium bovis subsp bovis AF2122/97
cccaaaccagccuccugcuucgcgcgcugagcagcgggaagcaggaggcggguuuggg

SEQ ID NO: 4237820 - RNA, 112 nt, Mycobacterium bovis subsp bovis AF2122/97
gucgcugccgauccaguaaggagcuuacguguucgccugguggggucgaacuguguaccgcuaccgguucaucguaaucggggucauggucgcucuaugccucggcggcggc

SEQ ID NO: 4237821 - RNA, 69 nt, Mycobacterium bovis subsp bovis AF2122/97
gucgcccuugaggaucagguucagcuggcugguuuccuucagcgccgaguccagguccuccaggcugau

SEQ ID NO: 4237822 - RNA, 83 nt, Mycobacterium bovis subsp bovis AF2122/97
ccgaccgggagaaugccgccgcacuuggcccagacgacgaagacguccccgacaccggugugcuggcggauuuucuggaacgg

SEQ ID NO: 4237823 - RNA, 69 nt, Mycobacterium bovis subsp bovis AF2122/97
guucguugacucugcguccaccacgcaaaagugcgaguaacccguccgguggacgcagagucaacagau

SEQ ID NO: 4237824 - RNA, 57 nt, Mycobacterium bovis subsp bovis AF2122/97
gggaccgauggugcguggcauggagaucacaucuucggucgcggacucgucgcaauc

SEQ ID NO: 4237825 - RNA, 74 nt, Mycobacterium bovis subsp bovis AF2122/97
gcagcccggccacugugaauggcacgacgcgacacgcggcggaggcgucgugagauucacagucgguggguugc

SEQ ID NO: 4237826 - RNA, 59 nt, Mycobacterium bovis subsp bovis AF2122/97
ugugggccgccgauguggccgcgauggugggcuaucacggcggggcaucggcggccgcg

SEQ ID NO: 4237827 - RNA, 104 nt, Mycobacterium bovis subsp bovis AF2122/97
ggcgcgguggcgccggaggagucggcggcagcagugagcacccgcaguaccccaaaguugugcuggugaccggugcuugccguuuccuaggcggcuaccugacc

SEQ ID NO: 4237828 - RNA, 79 nt, Mycobacterium bovis subsp bovis AF2122/97
ggucagccgggugaugccgacguggucggacuggucaugcucggccaguucgguauguuuggcggccacccggucggcc

SEQ ID NO: 4237829 - RNA, 92 nt, Mycobacterium bovis subsp bovis AF2122/97
acccgcgcuguucgacgagguguggucauggagcaccaaggcgcugaaguuaggugccgcaugacccgcgccggcgacgauacagugggggu

SEQ ID NO: 4237830 - RNA, 81 nt, Mycobacterium bovis subsp bovis AF2122/97
ggauugccgcccguacgcggagaucccggcgggggaucaccugaucgcccugcuggagaucugcgcggugcgcgccgaucc

SEQ ID NO: 4237831 - RNA, 111 nt, Mycobacterium bovis subsp bovis AF2122/97
ccucgccugccgcggggcuuuccgaucaucgacauucggccagcacggucucgccggcgaccgcgcgcuggccgacguugacgaucggcucugcgcccgcuggcagguagg

SEQ ID NO: 4237832 - RNA, 107 nt, Mycobacterium bovis subsp bovis AF2122/97
ggaccuguaugggcggggagaaccggcugaugcggugacgguggccgccgaacuggaucgccgugggcugcugcgccgcaucggcggugcucccuaccugcacaccc

SEQ ID NO: 4237833 - RNA, 56 nt, Mycobacterium bovis subsp bovis AF2122/97
gacuugcaugucggcggcgaguuuggcaugcgccuccucguccaggacggcaaguu

SEQ ID NO: 4237834 - RNA, 92 nt, Mycobacterium bovis subsp bovis AF2122/97
gcacgagccgcacgggcgcgagcagacgcaaaaggccccgaaauccguuggauucggggccuuuugcgucugcucgcgcccaacgugggugc

SEQ ID NO: 4237835 - RNA, 78 nt, Mycobacterium bovis subsp bovis AF2122/97
ggcgccggaagccaagagcggauauccggccacuccgauggggguuuacagccuggacuccgcuuuuggcaccgcgcc

SEQ ID NO: 4237836 - RNA, 55 nt, Mycobacterium bovis subsp bovis AF2122/97
gccgucuggaucugcgaacggauccagccaggucuguacgcggagccggacgugc

SEQ ID NO: 4237837 - RNA, 59 nt, Mycobacterium bovis subsp bovis AF2122/97
uucaugcugugugaaccgggauagaccgcguagccgucccaggugccauacgagcugaa

SEQ ID NO: 4237838 - RNA, 95 nt, Mycobacterium bovis subsp bovis AF2122/97
gccaauucggacgggcgguugcucgagcugacguugcauccgggcgugaugaccggcuacgcgcacggggagcuggccgaccgagugaaccuggc

SEQ ID NO: 4237839 - RNA, 87 nt, Mycobacterium bovis subsp bovis AF2122/97
ggccgcuguucgccucgauucuucugcuaguugaaguccugcaagcgcauugcgcggcgccugcuggcagucggugaacggucugcc

SEQ ID NO: 4237840 - RNA, 67 nt, Mycobacterium bovis subsp bovis AF2122/97
gucuucgauguggcggaucagggcugcgaucuugggcauuucggcccaggucacacacaucgcagac

SEQ ID NO: 4237841 - RNA, 56 nt, Mycobacterium bovis subsp bovis AF2122/97
ugugaucggguugcggaucgccgguggcgccaucgugugggcgacacccgaucaca

SEQ ID NO: 4237842 - RNA, 59 nt, Mycobacterium bovis subsp bovis AF2122/97
cgccaacugcucaaccauaccgcaggcugggauggucgcaaugggcaggacuuugggcg

SEQ ID NO: 4237843 - RNA, 64 nt, Mycobacterium bovis subsp bovis AF2122/97
cggccgcugcagcggcucguggguggugugcaggacccgcaucgcacguucugcugcagcgccg

SEQ ID NO: 4237844 - RNA, 57 nt, Mycobacterium bovis subsp bovis AF2122/97
gugcugguggucgucggcggagccaugaucguccucaaacgcugacaccaucagcau

SEQ ID NO: 4237845 - RNA, 80 nt, Mycobacterium bovis subsp bovis AF2122/97
gcggcaucgcuguuguucggcuacgucggcgccuucauguacgagggcgauacgccgcuggccgaacggcgcgccgccgc

SEQ ID NO: 4237846 - RNA, 60 nt, Mycobacterium bovis subsp bovis AF2122/97
ggugcugcagcgcggugagggccugaaccaggaccaggugcuggcggugcugcagcuacc

SEQ ID NO: 4237847 - RNA, 118 nt, Mycobacterium bovis subsp bovis AF2122/97
uuaccgcacagucugauugcccgggugauugaagaguugguucggcgcggcguccgggcgcuggaagcuuucggccggacaccagcggccaccgauuugcaaaacccgggcgcgguaa

SEQ ID NO: 4237848 - RNA, 84 nt, Mycobacterium bovis subsp bovis AF2122/97
gacccgcggcugccggucuucgaucugauugccgaaccauugcaggccaauggguucggcaagaacgagacucacgcgcggguc

SEQ ID NO: 4237849 - RNA, 65 nt, Mycobacterium bovis subsp bovis AF2122/97
gccgagugugagccugacagcccgacaccggcggcgugugucgcgucgccagguucacgcucggc

SEQ ID NO: 4237850 - RNA, 90 nt, Mycobacterium bovis subsp bovis AF2122/97
guuccuccucaaaugcgcgagcagacgcaaaagcgccacuuuugcgccgcaaaagggugcuuuugcgucugcucggcagacuaguggaac

SEQ ID NO: 4237851 - RNA, 56 nt, Mycobacterium bovis subsp bovis AF2122/97
cagacgcaaaagaacaugaugggcgcuggugcgcccaucauguucuuuugcgucug

SEQ ID NO: 4237852 - RNA, 72 nt, Mycobacterium bovis subsp bovis AF2122/97
gcgagagcgugccggggggcgcgccaucgacgcagacgauguguucgaugggcacaccgcuggcgcgaacgc

SEQ ID NO: 4237853 - RNA, 65 nt, Mycobacterium bovis subsp bovis AF2122/97
ggccgcggacgucgacauugauuugcuggccgucuucgaugccggcaucacugucgaucagcgcc

SEQ ID NO: 4237854 - RNA, 67 nt, Mycobacterium bovis subsp bovis AF2122/97
caccgagugcucgucguccugcucgacgaucuugaugacguugaucagcuuguugagcugcuuggug

SEQ ID NO: 4237855 - RNA, 87 nt, Mycobacterium bovis subsp bovis AF2122/97
gcaccagcagcauccgggaguugccgaggauguugggcuugacguagcucagguccaggaauucggcgaccccgaugucauaggagc

SEQ ID NO: 4237856 - RNA, 61 nt, Mycobacterium bovis subsp bovis AF2122/97
ggaacgucagaaucucgcugcgcgguugcucgaguccggcggcaaacgauucgacggcgcc

SEQ ID NO: 4237857 - RNA, 70 nt, Mycobacterium bovis subsp bovis AF2122/97
gauucgccgucauggguuggcuaccuccuguugaacccaaccgauauccgccaacucaggcggacgaauc

SEQ ID NO: 4237858 - RNA, 112 nt, Mycobacterium bovis subsp bovis AF2122/97
ggcgccggcggaccccucgaccgauagcuggccgauguaguccggccaguccaagcugucaagcgggcuggcguugcugaugucgccggugucgacggggaacguccgcgcc

SEQ ID NO: 4237859 - RNA, 91 nt, Mycobacterium bovis subsp bovis AF2122/97
cccgcuuggccgggcgaucgucgcggaagcucgucggcgugguaucgccauaccgcccgccaaggacuuccgcgcggucccgggcugcggg

SEQ ID NO: 4237860 - RNA, 95 nt, Mycobacterium bovis subsp bovis AF2122/97
guaccuccgaaagccuugacaaagcggggcgcgcguuccguauaguucggcuaagcggagcgcucgccccgcuuagucaaagcauagcgaggagc

SEQ ID NO: 4237861 - RNA, 65 nt, Mycobacterium bovis subsp bovis AF2122/97
cggcggcgcacucggauggggcugcgauccgcgacgacuaccucgcagcucgagugccgucguug

SEQ ID NO: 4237862 - RNA, 129 nt, Mycobacterium bovis subsp bovis AF2122/97
gugccggguacaccgauaucaacgccguccugccggcgaagcugauucugauggcgauugcguugauuugcgcggccgcaguguucucggcgaucgcccugcgggacuugcggauuccggcgaucggcc

SEQ ID NO: 4237863 - RNA, 55 nt, Mycobacterium bovis subsp bovis AF2122/97
ugaccgguaagcgcggcgauggcgucaaaguccuugucgacgugcaguaccguca

SEQ ID NO: 4237864 - RNA, 86 nt, Mycobacterium bovis subsp bovis AF2122/97
gcgccgagcccagcgccccccggagcgacgucgcgauggucaccucgguaaccgcauacgaugucgcugccgcgcucaaucggugc

SEQ ID NO: 4237865 - RNA, 79 nt, Mycobacterium bovis subsp bovis AF2122/97
ggcggggggcgcggucggugguguggggaucgccucggccgguccuaucgaccuacacagcggccgcgucagcccgauc

SEQ ID NO: 4237866 - RNA, 59 nt, Mycobacterium bovis subsp bovis AF2122/97
ggcgaaggucgcauggucaagcgccucaagaagguggccgacuaugucggcacuuuguc

SEQ ID NO: 4237867 - RNA, 78 nt, Mycobacterium bovis subsp bovis AF2122/97
acgccccggcauacgcggugaccguagccggauccgagccgaacgaccgguccccgaucaccgugucauccggggcgu

SEQ ID NO: 4237868 - RNA, 67 nt, Mycobacterium bovis subsp bovis AF2122/97
gcuugucuuugauccggugacgcacccgguccaucagguccgcguggucgaugcggucaaagcacgc

SEQ ID NO: 4237869 - RNA, 72 nt, Mycobacterium bovis subsp bovis AF2122/97
cuucgccgcuuuacgaggcgacccgguugagccagcacgcugggucggcgcgaaucuuucugaagcgagaag

SEQ ID NO: 4237870 - RNA, 60 nt, Mycobacterium bovis subsp bovis AF2122/97
ccggcugcccaccaacgagcagcgggacagggcgccgcugcugguggugacggcggccgg

SEQ ID NO: 4237871 - RNA, 59 nt, Mycobacterium bovis subsp bovis AF2122/97
gcaaccguugcucgaguccagacaccuggauguuguaggccucguagcaauccuguugc

SEQ ID NO: 4237872 - RNA, 58 nt, Mycobacterium bovis subsp bovis AF2122/97
acaccaagcgcccgcagcuugcccaacgguggcugggccaagcugacggccuuggugu

SEQ ID NO: 4237873 - RNA, 93 nt, Mycobacterium bovis subsp bovis AF2122/97
ggccguuucggcgccgucgcccagcgugaacugagggcggaaaaucggcuggcccgaaucucgcccccagugcacgcucggcgccguuuggcc

SEQ ID NO: 4237874 - RNA, 67 nt, Mycobacterium bovis subsp bovis AF2122/97
ucgagcagcugcagugcccgccggaugacgucgcucuugcgcucgccgcugcgcauugcggccuuga

SEQ ID NO: 4237875 - RNA, 78 nt, Mycobacterium bovis subsp bovis AF2122/97
gagcgccgaucuggagacuguugaauaggucgccaucgugguggcggcccgaacccacaucuccacguacucggccuc

SEQ ID NO: 4237876 - RNA, 85 nt, Mycobacterium bovis subsp bovis AF2122/97
agccaucgggaaauguccauggggucagucuugcgcagcggcauccuguugcgccagcgccucccgcaggauccguccgguggcu

SEQ ID NO: 4237877 - RNA, 72 nt, Mycobacterium bovis subsp bovis AF2122/97
ccgcgaacuggccagcccgcacaaccacuaugugggugcgcgcagcgguggcacgcuggucgguuacgccgg

SEQ ID NO: 4237878 - RNA, 69 nt, Mycobacterium bovis subsp bovis AF2122/97
ggaucauuaaccaucggagugagcagcuucacgacauccgaccagcgcucggcgcgguaguugaugacc

SEQ ID NO: 4237879 - RNA, 69 nt, Mycobacterium bovis subsp bovis AF2122/97
gagcagggcacgaucuuccucggcgguccgccacuggugaaggcggccaccggcgagaucgucucggcc

SEQ ID NO: 4237880 - RNA, 57 nt, Mycobacterium bovis subsp bovis AF2122/97
ucgucgggaucuccagcacguccgcauucauggccgcgacgcugaagagcccgacga

SEQ ID NO: 4237881 - RNA, 103 nt, Mycobacterium bovis subsp bovis AF2122/97
gcauugugguggaugaucggccuguuggucgccgccggcgugcugggucugauggugguguugccgaucgguggcgccgacaugccgguggucaucucgaugc

SEQ ID NO: 4237882 - RNA, 79 nt, Mycobacterium bovis subsp bovis AF2122/97
gcuucacgcagcagcuugaugggguucugaaguuuccacgcguugugcaggaacugcucgucgagcugcuccugagagu

SEQ ID NO: 4237883 - RNA, 62 nt, Mycobacterium bovis subsp bovis AF2122/97
ugcccgucgcgaaguacgacugaccgagcaaacgaacgaucgucguccuuuccgugggggua

SEQ ID NO: 4237884 - RNA, 55 nt, Mycobacterium bovis subsp bovis AF2122/97
cgcgggcaaggagacggucaccacgcugccgggugccgcauucuucagcucgucg

SEQ ID NO: 4237885 - RNA, 73 nt, Mycobacterium bovis subsp bovis AF2122/97
guugcuucccgacccuucguugagcgccgaugcaugagcggucagcacggucucggugcgugggguuuccgac

SEQ ID NO: 4237886 - RNA, 55 nt, Mycobacterium bovis subsp bovis AF2122/97
ggugcgguuguggggcgaucagacuuggagguccgcccccgagcaccgccgcauc

SEQ ID NO: 4237887 - RNA, 70 nt, Mycobacterium bovis subsp bovis AF2122/97
gcgguucggcguccuugccgcgugcaucgaucauucugaucgguccaccgacggcauaggagaucaacgc

SEQ ID NO: 4237888 - RNA, 98 nt, Mycobacterium bovis subsp bovis AF2122/97
uucgccuucugaaucgcgucguagagcgugggguugccggccggaucaccgccaccgacacgcgccgccaccucgauguucuugaucagccgggcgaa

SEQ ID NO: 4237889 - RNA, 59 nt, Mycobacterium bovis subsp bovis AF2122/97
cgaagaacugguugccgucgacccagccaucaaggggauguggacgguaccggucuucg

SEQ ID NO: 4237890 - RNA, 66 nt, Mycobacterium bovis subsp bovis AF2122/97
uucgacaagggaucgauggccacgguuucgagguuuucggcgguggccaagaucggucccguugag

SEQ ID NO: 4237891 - RNA, 70 nt, Mycobacterium bovis subsp bovis AF2122/97
ggcugcguucgguauguccucuccgucgaccguggcagacaagucgaucgagacgacgucgccgacggcc

SEQ ID NO: 4237892 - RNA, 92 nt, Mycobacterium bovis subsp bovis AF2122/97
gccgggccuaguugcuuaucgguggugguugcggcuggaaggguucauaccaccaccagucggcgcgcucgccggugggcccaggccacggc

SEQ ID NO: 4237893 - RNA, 72 nt, Mycobacterium bovis subsp bovis AF2122/97
ucggcgucauugggcccaacgggguaggcaagaccacacuguucaaaaccaucgucgggcucgagacgccgg

SEQ ID NO: 4237894 - RNA, 93 nt, Mycobacterium bovis subsp bovis AF2122/97
uuggucgcuuucauucguugcgcgcagaccggucuuuguaugacgaugaugggaaguucuaucugccgccaaaagcagaauggcaggacgcag

SEQ ID NO: 4237895 - RNA, 62 nt, Mycobacterium bovis subsp bovis AF2122/97
cgcgagcagacgcaaaagcucccaaauccgaccggauuugggagcuuuugcgucuuuucgcg

SEQ ID NO: 4237896 - RNA, 66 nt, Mycobacterium bovis subsp bovis AF2122/97
gucggucugaaaaugugcggcgagcuccucguaguuggcgaugcgccguacgucuucgaugcugac

SEQ ID NO: 4237897 - RNA, 67 nt, Mycobacterium bovis subsp bovis AF2122/97
gcccgcgcuaucagcggcugauguuguggaucaucggcagcgucuuccucuugcugaugguuccggc

SEQ ID NO: 4237898 - RNA, 93 nt, Mycobacterium bovis subsp bovis AF2122/97
cgggguccaccucgucaggugugcagccgauauugguuacuagguagucgauuagccaguggcgaaggucggcuucaccacugaugcuucccg

SEQ ID NO: 4237899 - RNA, 55 nt, Mycobacterium bovis subsp bovis AF2122/97
gauggacaagccggacgucgacuucaucgaggggcugucuccggcgguguccauc

SEQ ID NO: 4237900 - RNA, 101 nt, Mycobacterium bovis subsp bovis AF2122/97
gucuugagugcugacuguucguucgggaaguguccacgugcccgcaccgcccgccgguagcgcgcauugagacuuucaauugcguugguagaacacgggac

SEQ ID NO: 4237901 - RNA, 63 nt, Mycobacterium bovis subsp bovis AF2122/97
gacgcggcgucgaucagggcugugucggagcaaucgccgaacuaucgugacggcgccuucguc

SEQ ID NO: 4237902 - RNA, 79 nt, Mycobacterium bovis subsp bovis AF2122/97
gggcggucaggaacgcgacgucgcggugcuguucguggaucuggucggcuccacgcaacuggccgcgacacgaccgccc

SEQ ID NO: 4237903 - RNA, 56 nt, Mycobacterium bovis subsp bovis AF2122/97
cgagcguaacccggcugcgaaaagccgggcuggauuucgcaguggcguuacgcucg

SEQ ID NO: 4237904 - RNA, 57 nt, Mycobacterium bovis subsp bovis AF2122/97
caagucgaacgcuucgaggcccccagucugccgauggggcugagcggguuugaguug

SEQ ID NO: 4237905 - RNA, 117 nt, Mycobacterium bovis subsp bovis AF2122/97
ggcgccggugccgaaggugcccgcguuggccaacccgguguuggcaugcccgguguugaaccagccgguguugaugccgcccggguugaagccaccgguguuggugucgccggcguu

SEQ ID NO: 4237906 - RNA, 59 nt, Mycobacterium bovis subsp bovis AF2122/97
gggcggcgucaagcagaaucacccgcgccuuggucgagucgaugugccggaaugcgccc

SEQ ID NO: 4237907 - RNA, 62 nt, Mycobacterium bovis subsp bovis AF2122/97
cgugagcagacgcaaagucgcccaaaaucgccgguuuccgggugauuuugcgucugcucgcg

SEQ ID NO: 4237908 - RNA, 124 nt, Mycobacterium bovis subsp bovis AF2122/97
ucggcgaggaccgccggaucggcuucgccgaguucggcgccccgcagggucgugcggucuucuggcugcauggcaccccaggggcccggcggcagaucccgaccgaagcccgggucuacgccga

SEQ ID NO: 4237909 - RNA, 77 nt, Mycobacterium bovis subsp bovis AF2122/97
gcgcgucgucgugauugucaugcaaccagccgccuuucacgcugcugcuggugccgggcacaaucacggcggugugu

SEQ ID NO: 4237910 - RNA, 82 nt, Mycobacterium bovis subsp bovis AF2122/97
guugggagucacgagccacgcaaaggguuagcgugacgacggucgacgugcuaguccucugcgugccguucguaaucccaac

SEQ ID NO: 4237911 - RNA, 71 nt, Mycobacterium bovis subsp bovis AF2122/97
ggugggcgagaccuucgaccgauguucgaugaccgacuggucgucgacaacgcgucgaaaggucgccugcc

SEQ ID NO: 4237912 - RNA, 125 nt, Mycobacterium bovis subsp bovis AF2122/97
gcggccgaguccugagggcugcagugacccccggucgacucgaucggcgagcccgugccuuggugcacggggcucgcccguugguguagacacaaggacgugcagccaucgccggacucacccgc

SEQ ID NO: 4237913 - RNA, 79 nt, Mycobacterium bovis subsp bovis AF2122/97
ggcugacggccaucauggauggcgaggcguuguggucugcugcgaccgcggacgucuacgccguccucgaggcacggcu

SEQ ID NO: 4237914 - RNA, 57 nt, Mycobacterium bovis subsp bovis AF2122/97
ucaggaucgggguagcugagcggauuccgaaauucgcgcaccucccaacggucuugg

SEQ ID NO: 4237915 - RNA, 64 nt, Mycobacterium bovis subsp bovis AF2122/97
ucggugacagcugcguggugcucgagcuggagucgagagugaaccaccagcugcaggucaucga

SEQ ID NO: 4237916 - RNA, 70 nt, Mycobacterium bovis subsp bovis AF2122/97
gcccgcagaguuacggcaucgauccgugggagaucucguucggauuccacggacucgauucgcugcaggu

SEQ ID NO: 4237917 - RNA, 62 nt, Mycobacterium bovis subsp bovis AF2122/97
gcaggucgugcagauagcgcgggucgugaaaacgcauaccgcccgcacccugcacgaccggc

SEQ ID NO: 4237918 - RNA, 78 nt, Mycobacterium bovis subsp bovis AF2122/97
gggcggauacugcugggguggguaggccggcggauaggagccgcccugcgguuggccuccccaauacagguccugccc

SEQ ID NO: 4237919 - RNA, 87 nt, Mycobacterium bovis subsp bovis AF2122/97
ugucgugcaccgugauucgggaguagcgcuccuugagcgcguggaugucggugagcgccugcuucagggucuccucggugcggaaca

SEQ ID NO: 4237920 - RNA, 67 nt, Mycobacterium bovis subsp bovis AF2122/97
ggccgauauggaugguuucgaacugacccgcgaaaucauccgggucuaugucgagaccguggcggcc

SEQ ID NO: 4237921 - RNA, 71 nt, Mycobacterium bovis subsp bovis AF2122/97
cgccuucguggcggacuaccugccgggugaggccgcugcggcucgcucggccgugguggucugcaauggcg

SEQ ID NO: 4237922 - RNA, 56 nt, Mycobacterium bovis subsp bovis AF2122/97
ggucggucaaggucgcgugcacccgaagguaaccggacgugaccagaucaccgacc

SEQ ID NO: 4237923 - RNA, 67 nt, Mycobacterium bovis subsp bovis AF2122/97
cgcgccgagcgugaagucacggcggcuauuucgcggauuucucgcccugagaacacguucggcgucg

SEQ ID NO: 4237924 - RNA, 55 nt, Mycobacterium bovis subsp bovis AF2122/97
cgccgaugcgugcucgccggcaaggacgucaucguggccggccacuccgucggcg

SEQ ID NO: 4237925 - RNA, 106 nt, Mycobacterium bovis subsp bovis AF2122/97
ucgccugcugacacacgaugagggcagaaccccaggugcagugugcaccacguuccaccaauguuggugcgguuugcgccugcgcccaggcguggaacggcaggga

SEQ ID NO: 4237926 - RNA, 104 nt, Mycobacterium bovis subsp bovis AF2122/97
cggcguggucggcggcgucguuggcggcguggucaccggcguggucggcggcgucguuggcggcguggucaccggcguggucggcggcguggucggcggcgucg

SEQ ID NO: 4237927 - RNA, 74 nt, Mycobacterium bovis subsp bovis AF2122/97
ggaugaauccgaagaucaacaguggugcccacaggaucagcacugugaucaugaauugaucauuggagaguucc

SEQ ID NO: 4237928 - RNA, 62 nt, Mycobacterium bovis subsp bovis AF2122/97
gugaacaccgacagcaccaaccagacgaugccgaguuugauaguugugccugugguuuucau

SEQ ID NO: 4237929 - RNA, 77 nt, Mycobacterium bovis subsp bovis AF2122/97
gcgcuaccugcgcgcggugugaggcgccggcgcccugguuaaggccgcccgaugccuccgcugugcacgcccugcgc

SEQ ID NO: 4237930 - RNA, 64 nt, Mycobacterium bovis subsp bovis AF2122/97
gccaccgccagggcaauaucccaucgcacuauucggcaugugcggaucuugucccggcgguggc

SEQ ID NO: 4237931 - RNA, 57 nt, Mycobacterium bovis subsp bovis AF2122/97
guuuccgcaauccuucgucggcguggucaucgccacacuggugcuguugccggagac

SEQ ID NO: 4237932 - RNA, 58 nt, Mycobacterium bovis subsp bovis AF2122/97
cgcccaccgugagccggugcagagccggagcgggcgcccgcuccucaccggccaggcg

SEQ ID NO: 4237933 - RNA, 99 nt, Mycobacterium bovis subsp bovis AF2122/97
gcgaucaccacggcaagcugggcuggcuggaucguguggugucgcccgaaccggugcucaccacggagauccgccgguuggucgaugcgguggcggcgc

SEQ ID NO: 4237934 - RNA, 83 nt, Mycobacterium bovis subsp bovis AF2122/97
gcgggcuggcuuuugcaugccgaggguauccugcggcccgggucgguugaaccaggcgcggaccuaucgguguggccaccggc

SEQ ID NO: 4237935 - RNA, 70 nt, Mycobacterium bovis subsp bovis AF2122/97
gcaucagcagcgugguugccgcguuacgcgacuugggcuuuugaaacgccggcaccccguugcugaucgc

SEQ ID NO: 4237936 - RNA, 55 nt, Mycobacterium bovis subsp bovis AF2122/97
gcccgugcggauccaguccgguggcgauugucaccagccgcgacaccgcgcgggc

SEQ ID NO: 4237937 - RNA, 62 nt, Mycobacterium bovis subsp bovis AF2122/97
ggcugucguuguagaccggcccguagagcgcgcgcugugccgggcuggccauaauggcggcc

SEQ ID NO: 4237938 - RNA, 61 nt, Mycobacterium bovis subsp bovis AF2122/97
uggccggacugggugcggcgguggcccacgccgucggccaccgccacggccagcaccgccg

SEQ ID NO: 4237939 - RNA, 89 nt, Mycobacterium bovis subsp bovis AF2122/97
gcugccugcccugcaacgagugcuggguggcagcgacccggcauuggucgcggugcccacccagcaugaguccuugcugggcgcuuugc

SEQ ID NO: 4237940 - RNA, 84 nt, Mycobacterium bovis subsp bovis AF2122/97
gucgagcgcggcgucaccagcggucgucaggugcucggucuggcgcagggcuaccuggaaccgcugcagcgcgccgaggucgac

SEQ ID NO: 4237941 - RNA, 60 nt, Mycobacterium bovis subsp bovis AF2122/97
gcgagcagacacagaaucgcacugcgccggcccggcgcgugcgauucugugucugcucgc

SEQ ID NO: 4237942 - RNA, 83 nt, Mycobacterium bovis subsp bovis AF2122/97
cgucgaggguuugccaucggugaugacccaagagcugcucgaauucccgggcggaauccucggcgucgcccucaaccucgacg

SEQ ID NO: 4237943 - RNA, 64 nt, Mycobacterium bovis subsp bovis AF2122/97
gcgaguaggcgcaaaagaacaugaugggcaccagcgcccaucauguucuuucgcgucuacucgc

SEQ ID NO: 4237944 - RNA, 59 nt, Mycobacterium bovis subsp bovis AF2122/97
uucgucugauuggcgucgaucggcccggcaucggcgccucgacgccgcaucaguacgaa

SEQ ID NO: 4237945 - RNA, 66 nt, Mycobacterium bovis subsp bovis AF2122/97
gcacgucgaaccgcgaugagcccaucagcgacaugaccgcuaugguugcgccagguuugacggugc

SEQ ID NO: 4237946 - RNA, 97 nt, Mycobacterium bovis subsp bovis AF2122/97
cuagcgcuuggagcgcugacggaugcgaguggugaguucuuugacgugaucaaagaccucacggcgcucggccaucucggacaggaucuugcguugg

SEQ ID NO: 4237947 - RNA, 56 nt, Mycobacterium bovis subsp bovis AF2122/97
ggcugacacguuccgcccggcacggacccgccugccccgagcuggaagugucggcc

SEQ ID NO: 4237948 - RNA, 84 nt, Mycobacterium bovis subsp bovis AF2122/97
ccgggcagggccucgacguggugcgaguugguuuggcguccaccgaucagcuuuauuucgccucggggcuguuggacugcccgg

SEQ ID NO: 4237949 - RNA, 64 nt, Mycobacterium bovis subsp bovis AF2122/97
ucgcgcgucugcguugagaccagcaucccacgaucguggggguuggugauguagccgauaucga

SEQ ID NO: 4237950 - RNA, 106 nt, Mycobacterium bovis subsp bovis AF2122/97
gccaccccucggcggccuguucgucgaaggugcggucaaugcgcucgaaccugcggcggaucgaagcgcgcgaggccgcaugcggaaggacguagaggcgguuggc

SEQ ID NO: 4237951 - RNA, 56 nt, Mycobacterium bovis subsp bovis AF2122/97
cgacuguggauccugcgacgcgacacgccgauacggcgucgucagauucacggucg

SEQ ID NO: 4237952 - RNA, 113 nt, Mycobacterium bovis subsp bovis AF2122/97
gcagcguccccaccgacgacucaucgcugggcgcgcugucccgugaugccaugcccaccuuccggcagguguucuuggcuggcgcguccggcauggcguuggagcggcgcugc

SEQ ID NO: 4237953 - RNA, 111 nt, Mycobacterium bovis subsp bovis AF2122/97
ccuaccugccagcgggcgcagagccgaucgucaacgucggccagcgcgcggucgccggcgagaccgugcuggccgaaugucgaugaucggaaagccccgcggcaggcgagg

SEQ ID NO: 4237954 - RNA, 80 nt, Mycobacterium bovis subsp bovis AF2122/97
gcggcgacuugccaggcggcgaucaagcccgacuaguuggcguaggccaauagcggcgcugaucuccgacagcuugccgu

SEQ ID NO: 4237955 - RNA, 95 nt, Mycobacterium bovis subsp bovis AF2122/97
ccaccagcacgcugaccggcaggcagcucacgagaucaccuuccagaaguccaggaucgcgaugaugcugccccgcagcgaaccgcugaccuugg

SEQ ID NO: 4237956 - RNA, 67 nt, Mycobacterium bovis subsp bovis AF2122/97
uggaacaccgccgccgggcacuggccuaagcccuacgcugcagcagaugauccucggcggugaucca

SEQ ID NO: 4237957 - RNA, 85 nt, Mycobacterium bovis subsp bovis AF2122/97
gacggugaaugccagugcggucgaggcuccgagaucggucagcgucgccgucgucgagggcgucaccgccgcggugcccaucguc

SEQ ID NO: 4237958 - RNA, 72 nt, Mycobacterium bovis subsp bovis AF2122/97
gucguggugcaccugccgaucgcacagguuggcccacaaccggccgcuugaugcccggucggcaagcccggc

SEQ ID NO: 4237959 - RNA, 114 nt, Mycobacterium bovis subsp bovis AF2122/97
gcuaaggccagccgagguaccgcccgccgugucgauggccgcgcgcacagccgcguacucggggugcgugaagccuucgacggucagcgcgucgaacaccgggccggccaacgc

SEQ ID NO: 4237960 - RNA, 64 nt, Mycobacterium bovis subsp bovis AF2122/97
cgccgagcagacgcagaaucgcauugggcgggcugauuucgugcgauucugugucugcucggcg

SEQ ID NO: 4237961 - RNA, 70 nt, Mycobacterium bovis subsp bovis AF2122/97
cgcgcugcgacugugaaucucacgacgccuugucggcgugucgcgucgcaggauucccagucgcggcgcg

SEQ ID NO: 4237962 - RNA, 69 nt, Mycobacterium bovis subsp bovis AF2122/97
gcgugcaggcgguaguagaggucccgguagcgcugcgcguugcgggcauaguugcggcugaccauacgc

SEQ ID NO: 4237963 - RNA, 110 nt, Mycobacterium bovis subsp bovis AF2122/97
gcggugguccggaguggcuggcaagccugauguggugacggugcugcugggcggugacgucaugcucggccguggcgucgaucagauccugccucaucccggcaaaccgc

SEQ ID NO: 4237964 - RNA, 74 nt, Mycobacterium bovis subsp bovis AF2122/97
gccgguggccgggcggaugaugggucggcucggcugguaugucgagucgauguugucgccacggcuacaccggc

SEQ ID NO: 4237965 - RNA, 63 nt, Mycobacterium bovis subsp bovis AF2122/97
ucacguugaccgcgguggcgugcugcgcgguagucgucgcggccgcuacgcuggucggcgcga

SEQ ID NO: 4237966 - RNA, 104 nt, Mycobacterium bovis subsp bovis AF2122/97
gugacagcgccaucgacgaugcgguagcugcguagcucgugccggugcgggucgcggguggacaccagcacguagugcgcgucggguucgguggcaagcuucac

SEQ ID NO: 4237967 - RNA, 102 nt, Mycobacterium bovis subsp bovis AF2122/97
gcacaagccggcuaucgguguggcgccauggaaaugcuuugcacggcgaauaguuucccucgcugaugacagccuguguuuccgugaaaucgggucggcugc

SEQ ID NO: 4237968 - RNA, 76 nt, Mycobacterium bovis subsp bovis AF2122/97
acgaggaagcgaccaucgaaucggugaucgacagcaucucuccgcuggucgauggccuggucgaugaauugaucgu

SEQ ID NO: 4237969 - RNA, 65 nt, Mycobacterium bovis subsp bovis AF2122/97
agacgaugccgaugguggugaucaucguggccgacaccacgaucagcacgccucgggcgucgccu

SEQ ID NO: 4237970 - RNA, 61 nt, Mycobacterium bovis subsp bovis AF2122/97
cgcgcuggucaagggcaacgacuacgaccugucgucguuguuccuguuggccagcaccgcg

SEQ ID NO: 4237971 - RNA, 58 nt, Mycobacterium bovis subsp bovis AF2122/97
ggucaucucggcgaucaccgagcugggaucaacccggucguggccgccgagggugacc

SEQ ID NO: 4237972 - RNA, 96 nt, Mycobacterium bovis subsp bovis AF2122/97
ccgccuacccgagauaucgugggaugcgcuacuccucgugcuaugugacgaugcgcgacggggugcgcaucgccaucgaccucuaccugcccgcgg

SEQ ID NO: 4237973 - RNA, 78 nt, Mycobacterium bovis subsp bovis AF2122/97
gaggccgaguacguggagauguggguucgggccgccaccacgauggcgaccuauucaacagucuccagaucggcgcuc

SEQ ID NO: 4237974 - RNA, 64 nt, Mycobacterium bovis subsp bovis AF2122/97
gaauucccaggaacgggacgccgugugcaucggcgaccgccugcgcggcugccgucuccugguc

SEQ ID NO: 4237975 - RNA, 57 nt, Mycobacterium bovis subsp bovis AF2122/97
ccgacugugaaucucacgacgccuccgccgcgugucgcgucgugccauucacagugg

SEQ ID NO: 4237976 - RNA, 56 nt, Mycobacterium bovis subsp bovis AF2122/97
accgaaguugcggcgcggcggcacgagcucuuguuggccgcgcacgaggcuucggu

SEQ ID NO: 4237977 - RNA, 74 nt, Mycobacterium bovis subsp bovis AF2122/97
ggugcugccaagcagacgcagaaucgcacaaaccgggcgcgauuaaugcgauucugcgucugcuuggcggggcu

SEQ ID NO: 4237978 - RNA, 68 nt, Mycobacterium bovis subsp bovis AF2122/97
ccaaaacccguucggcuaagccgaugucaaggcaggaccgcuuaagaucgccuagccgcggcgggugg

SEQ ID NO: 4237979 - RNA, 59 nt, Mycobacterium bovis subsp bovis AF2122/97
cggcgagcaccgcauccaccgcgucgaguucgcugcgaccggugucgccgugcuugccg

SEQ ID NO: 4237980 - RNA, 94 nt, Mycobacterium bovis subsp bovis AF2122/97
gcguuggucgcgcuggcguguaugguguuggccgggugcacggucagcccgccgccggcaccccagagcacugauacgccgcgcagcacaccgc

SEQ ID NO: 4237981 - RNA, 82 nt, Mycobacterium bovis subsp bovis AF2122/97
agggccacacggucgacaccguugccgacggccgccaugcgguggcggccgucgacggcggugacuacgacgcgguggugcu

SEQ ID NO: 4237982 - RNA, 55 nt, Mycobacterium bovis subsp bovis AF2122/97
gucgcggacggggcagagcuagccgggcgaggcugccaugaccucguuugcgcac

SEQ ID NO: 4237983 - RNA, 64 nt, Mycobacterium bovis subsp bovis AF2122/97
gcaucgagauugagccggccccgaccggugucgaacucguucgggaaggcucgguucucgucgc

SEQ ID NO: 4237984 - RNA, 104 nt, Mycobacterium bovis subsp bovis AF2122/97
ucgccuacgacacuaccgacgagcgggugcgguauuggugcccggccugccagcgcugaaccgggcgaucaaagccagcaccuagucgcggccguggguagcga

SEQ ID NO: 4237985 - RNA, 70 nt, Mycobacterium bovis subsp bovis AF2122/97
ucugacgagcagacgcggaaucgcacgcgugagguccgcgcagugcgauuccgcgucugcucggcgugga

SEQ ID NO: 4237986 - RNA, 119 nt, Mycobacterium bovis subsp bovis AF2122/97
uugcaaucggacauggaccuaagugucuaagcugcgccagccacgccgucggaccuaucagcuaauucggcgcgcgucgcggcgcacuauucccgcgcgagggucuggccgggucgcgg

SEQ ID NO: 4237987 - RNA, 110 nt, Mycobacterium bovis subsp bovis AF2122/97
acgcgcgccggccggaguguccagaucggaucgaaugcguaccgcggcuucgaucucuugcugaagcucgugcagcgauucgccacccucgacagucuucagaugcgcgu

SEQ ID NO: 4237988 - RNA, 62 nt, Mycobacterium bovis subsp bovis AF2122/97
cgggucuauggguggaugcucgacggcguuccggugguggcgaugcaccgcaauaugaccug

SEQ ID NO: 4237989 - RNA, 61 nt, Mycobacterium bovis subsp bovis AF2122/97
uacagucuuggugaccguccgguacccgggcaugggacuggaacgaaccaagaaaccugug

SEQ ID NO: 4237990 - RNA, 63 nt, Mycobacterium bovis subsp bovis AF2122/97
cgccgaacgugcaaccauggcggcuccgcccggcgugucgccgccaccagggcacguucggcg

SEQ ID NO: 4237991 - RNA, 72 nt, Mycobacterium bovis subsp bovis AF2122/97
gucggcggaugcggugaguucggcguccuugcgugcuugacgcagggccuccgacucgucuucaucccagac

SEQ ID NO: 4237992 - RNA, 57 nt, Mycobacterium bovis subsp bovis AF2122/97
gccaugggugcgguaagcgcgucugcgcagacgcuguugucgcgcccguugaucggc

SEQ ID NO: 4237993 - RNA, 62 nt, Mycobacterium bovis subsp bovis AF2122/97
aucgcggcgguguugucgaugcggaugccgugcacccguuccaucgucaacacccgcucggu

SEQ ID NO: 4237994 - RNA, 129 nt, Mycobacterium bovis subsp bovis AF2122/97
ccgugccggcccgcgcaaccagugcaucggccgguacccaggugucgaugcagaccgcggcgguauccagcggucccgcaccgaccuugcgguagggggucugcacgcugacuugugcggccggcacgg

SEQ ID NO: 4237995 - RNA, 76 nt, Mycobacterium bovis subsp bovis AF2122/97
gcugugccagccggucggcgauggcccacaccaccggcggauuguggccguagccgauguggcugcugcgcaccgc

SEQ ID NO: 4237996 - RNA, 61 nt, Mycobacterium bovis subsp bovis AF2122/97
ucgucgucgcgguccugcugguggugaugcgccaccgcaaccggcggcgccgcgccgacga

SEQ ID NO: 4237997 - RNA, 61 nt, Mycobacterium bovis subsp bovis AF2122/97
ucgagcggauuuuucgcaccgggacguugauuaucgaguccgcgucacaagauccgcucga

SEQ ID NO: 4237998 - RNA, 72 nt, Mycobacterium bovis subsp bovis AF2122/97
cggcgccgagcgugcacugggggcgagauucgggccagccgauuuuccgcccucaguucacgcugggcgacg

SEQ ID NO: 4237999 - RNA, 128 nt, Mycobacterium bovis subsp bovis AF2122/97
gguccgcgccgccaucggccacgaucgcauuuggcgaguagacgcaaaagcccccgacacuccgugcgugcgggggcuuuugcgucuguucgccgcgcuagagcaguugagcaaaggcggugacgacc

SEQ ID NO: 4238000 - RNA, 58 nt, Mycobacterium bovis subsp bovis AF2122/97
gucggauggcgcgcgccgcgcuggccaucgccccggucguggugcacgccaugcuggc

SEQ ID NO: 4238001 - RNA, 59 nt, Mycobacterium bovis subsp bovis AF2122/97
uugacucugcgcuuaccacgcgggccacucgcacaauugccugguauccgcagagucaa

SEQ ID NO: 4238002 - RNA, 58 nt, Mycobacterium bovis subsp bovis AF2122/97
gcucgccguuggcgcuggcgcggcaggcgcuggccgugcugcccaaagaacagcgagc

SEQ ID NO: 4238003 - RNA, 77 nt, Mycobacterium bovis subsp bovis AF2122/97
cacgccgcugcgcggcgugcaucgucgccgagcuguguuggacugcucggcuccuccucacgccgcugcgcggcgug

SEQ ID NO: 4238004 - RNA, 129 nt, Mycobacterium bovis subsp bovis AF2122/97
gcuacucaacgggcagaagaucuggagcucgcgggcgccguucgccgacauggguuuugggcuguuccgcuccgaucccgcggucgaacggcaccgcgggcucacguauuucauguucgaccugaaagc

SEQ ID NO: 4238005 - RNA, 58 nt, Mycobacterium bovis subsp bovis AF2122/97
cggcaucgacaccggcgacccgccguacuguucgucgaucgccaggccguagaugccg

SEQ ID NO: 4238006 - RNA, 115 nt, Mycobacterium bovis subsp bovis AF2122/97
cagcgcaucggaguccagaaucucucgauggcgggucaucgcacccagccgaaccagguugggauuguugauuccgccgaccacgacguagccgaguucgggggccaggucguug

SEQ ID NO: 4238007 - RNA, 103 nt, Mycobacterium bovis subsp bovis AF2122/97
cggguggcgcauguguugucggucaaccuggcucguguucgggcgaacccugauccgcgcgcgcagucgaaguugaccggaaucgacaaaguggcggcaucug

SEQ ID NO: 4238008 - RNA, 81 nt, Mycobacterium bovis subsp bovis AF2122/97
gacaucgccgaacgcgucggugggaucggugccacccaccccgucgccgccgaucccgaaccggcgcucgcggaacccguc

SEQ ID NO: 4238009 - RNA, 69 nt, Mycobacterium bovis subsp bovis AF2122/97
gggccggucggcggacacaucucagucggggcgaaagccacgcuccuaucaagucacgccggccggucc

SEQ ID NO: 4238010 - RNA, 59 nt, Mycobacterium bovis subsp bovis AF2122/97
aagaguucgcgcagcgccucggcguagcugucaccgccgggcgcacuggcgagcugcuu

SEQ ID NO: 4238011 - RNA, 63 nt, Mycobacterium bovis subsp bovis AF2122/97
gcugcacccggcuggccauucaugccgucaccgccaacggcgaagagcgcagccggguguggc

SEQ ID NO: 4238012 - RNA, 56 nt, Mycobacterium bovis subsp bovis AF2122/97
gcucgaguaccagcggauacccagcuucccgcgcuuggugaacguggugaucgagu

SEQ ID NO: 4238013 - RNA, 60 nt, Mycobacterium bovis subsp bovis AF2122/97
gguguccuccgaucgggggaaggggcuuucgucaucguuucaggccgaucggaggacgcc

SEQ ID NO: 4238014 - RNA, 128 nt, Mycobacterium bovis subsp bovis AF2122/97
aucaacaagaugugccuguccggcaucgacgcaaucgcgcuggcugaucaacucauucgggccagagaguucgacguggugguggccggcggucaggagucgaugacgaaggcgccccaccuguugau

SEQ ID NO: 4238015 - RNA, 59 nt, Mycobacterium bovis subsp bovis AF2122/97
cgugauccaucucuaugagcgugacugcagugugcagcgucgccaucagaaggucaucg

SEQ ID NO: 4238016 - RNA, 86 nt, Mycobacterium bovis subsp bovis AF2122/97
ucggucgccgccgcgucgccggucucccagucgaagaugugauugucgcucuuucccuccagaucggugcggaugaccggcgccga

SEQ ID NO: 4238017 - RNA, 77 nt, Mycobacterium bovis subsp bovis AF2122/97
gccgucaccggcacaccguuuucagaggcggccuucagcaguugggcaaccucuucggggguggccggcuuggcggc

SEQ ID NO: 4238018 - RNA, 55 nt, Mycobacterium bovis subsp bovis AF2122/97
ccgcaacaucugcgcgaugugcaucagauugaacgucaugaaugugguguugcgg

SEQ ID NO: 4238019 - RNA, 92 nt, Mycobacterium bovis subsp bovis AF2122/97
gaguucgcguagaauagcgaaacacgggaucgggcgaguucgaccuuccgucggucucgcccuuucucguguuuauacguuugagcgcacuc

SEQ ID NO: 4238020 - RNA, 105 nt, Mycobacterium bovis subsp bovis AF2122/97
uaggcgacaagcuccccgccgcacugcagcgacggccgggcgugcaccccagcgucccccaaugugcacucgaccguccucagugugugagccgucggaaaccua

SEQ ID NO: 4238021 - RNA, 55 nt, Mycobacterium bovis subsp bovis AF2122/97
ggugagagcccauggcggucguugaugaccuagcgcccggcauggacuccucacc

SEQ ID NO: 4238022 - RNA, 89 nt, Mycobacterium bovis subsp bovis AF2122/97
gaggcguucgaaaaccacacugccguuggacgcgaagaccaagaccagcaccgcggagacggcggccugguugaugaacauuaagccuu

SEQ ID NO: 4238023 - RNA, 60 nt, Mycobacterium bovis subsp bovis AF2122/97
gcgagcagacgcauaagcgcccauuucgacacgaaauugggcgcuuaugcgucugcucgc

SEQ ID NO: 4238024 - RNA, 55 nt, Mycobacterium bovis subsp bovis AF2122/97
uucgucccaacuuggcgacgcugagcgcugaucugccgguugccggugggacgga

SEQ ID NO: 4238025 - RNA, 82 nt, Mycobacterium bovis subsp bovis AF2122/97
uggugacgaacggguugaccucgaugcggcgcagcgacugacggacguccucgacggcgucgggguacgacucgggcgacca

SEQ ID NO: 4238026 - RNA, 122 nt, Mycobacterium bovis subsp bovis AF2122/97
guccgaggacggcaggagcggccgggcucgcuggguggugggaaccgcuccagggcgggccaucccguucggcgcuuuccgccauuugaucagccugcccgccuccggagccgacauugggc

SEQ ID NO: 4238027 - RNA, 63 nt, Mycobacterium bovis subsp bovis AF2122/97
gccugggcgauccaucggggaugcgcaugcacgaacgcggcaugcccgaucggaucguucugc

SEQ ID NO: 4238028 - RNA, 70 nt, Mycobacterium bovis subsp bovis AF2122/97
uagcuugucgaccgugcggucgaauuccguuugaugcuugacggugguggccagcacgguguucaaguug

SEQ ID NO: 4238029 - RNA, 62 nt, Mycobacterium bovis subsp bovis AF2122/97
ggcgagcagacgcagaaucgcaucgcgcaggcauuucgcgugcgauucugcgucugcucgcc

SEQ ID NO: 4238030 - RNA, 80 nt, Mycobacterium bovis subsp bovis AF2122/97
ggcuccccuguugcccgagggugcgaccuuggucagucuggccaagggcaucgaguugggcacccugaugcggaugagcc

SEQ ID NO: 4238031 - RNA, 82 nt, Mycobacterium bovis subsp bovis AF2122/97
ggccaccaacgccgaugagaucaacgacgucguccggaacacauucguccagggcacccugucgaucgucuucguggugguc

SEQ ID NO: 4238032 - RNA, 87 nt, Mycobacterium bovis subsp bovis AF2122/97
gucggccgaccggaaaccuaccagcaggccuucuacgcccgcgaucucgccggaaccguugugcugguggguguuccgacgcccgac

SEQ ID NO: 4238033 - RNA, 61 nt, Mycobacterium bovis subsp bovis AF2122/97
ucgagcggaucuugugacgcggacucgauaaucaacgucccggugcgaaaaauccgcucga

SEQ ID NO: 4238034 - RNA, 78 nt, Mycobacterium bovis subsp bovis AF2122/97
gcuugccgcgcugaccgaugccggcgccgucgcgguccggcugggcccgacggugcugcggacaucgaccgcggccgc

SEQ ID NO: 4238035 - RNA, 60 nt, Mycobacterium bovis subsp bovis AF2122/97
gcgagcagacgcaaaaugcccccgaaaugcccauuuucgggggcuuuugcgucugcucgc

SEQ ID NO: 4238036 - RNA, 77 nt, Mycobacterium bovis subsp bovis AF2122/97
gcccaauaucgagucugcguccagggucuggauuuccccugaaacgacgcccugagcgcagacgcgaugcccggggc

SEQ ID NO: 4238037 - RNA, 69 nt, Mycobacterium bovis subsp bovis AF2122/97
ugcgaacgggcgcugcgugagcacguggaguggucgcugcucgacgugcugcgcggggcacccggcgca

SEQ ID NO: 4238038 - RNA, 57 nt, Mycobacterium bovis subsp bovis AF2122/97
ugcugggcuugaucgccggcaccguccagcccggugucggacgugucaagcgcggca

SEQ ID NO: 4238039 - RNA, 75 nt, Mycobacterium bovis subsp bovis AF2122/97
gguaccgauaccgggcgcaccgguaccaauccccggcggaccgguaccgauaccgggcgcaccgguaccgguacc

SEQ ID NO: 4238040 - RNA, 58 nt, Mycobacterium bovis subsp bovis AF2122/97
gcacggguucguugcugugcaugugcucgcaguaccggcgcagcaucucagccagugc

SEQ ID NO: 4238041 - RNA, 57 nt, Mycobacterium bovis subsp bovis AF2122/97
gcggcgcggugauacgccgggagagguuuaugaaccgcucgucguucuacugcccgc

SEQ ID NO: 4238042 - RNA, 60 nt, Mycobacterium bovis subsp bovis AF2122/97
cgaaaucgacagcagcgcgacaaaguucgacgagaagacaccgcgcuaaugucgauuucg

SEQ ID NO: 4238043 - RNA, 71 nt, Mycobacterium bovis subsp bovis AF2122/97
cgcccgccgaacgugaacucacggcgguauuuugccggauucuccgcccucaguucacguucggcgacgcg

SEQ ID NO: 4238044 - RNA, 71 nt, Mycobacterium bovis subsp bovis AF2122/97
ggugauggguucgaacguccagguggugugggagaaguucugccgcuacuucgacgucgaaccccguuacc

SEQ ID NO: 4238045 - RNA, 57 nt, Mycobacterium bovis subsp bovis AF2122/97
gccuucgacucggcgccgagcgguaccgccgaacuacggcgucacgauguugaaggc

SEQ ID NO: 4238046 - RNA, 72 nt, Mycobacterium bovis subsp bovis AF2122/97
gcuaccgggggccaugccgaggacacggugcggcuggccgccgcacugcgcccggcgcuggccucccgcggc

SEQ ID NO: 4238047 - RNA, 57 nt, Mycobacterium bovis subsp bovis AF2122/97
cgguggugauuggccuguauccgcacugggacaucagcgagcagggcaucaccgccg

SEQ ID NO: 4238048 - RNA, 55 nt, Mycobacterium bovis subsp bovis AF2122/97
agccgggcaucuggaaguggcucaaaaucaggugcagcgacuucauggccugguu

SEQ ID NO: 4238049 - RNA, 65 nt, Mycobacterium bovis subsp bovis AF2122/97
cgucgcggcccagcugggugcugccgcugucgacgacgacggcaugcccgcccagcugcgcgaug

SEQ ID NO: 4238050 - RNA, 84 nt, Mycobacterium bovis subsp bovis AF2122/97
ggugggcguuggcgaauccgugcgaguugaucgccgaucucagcaccggcacgaacaggcgggauucgccgaucaaugccugcc

SEQ ID NO: 4238051 - RNA, 55 nt, Mycobacterium bovis subsp bovis AF2122/97
gagaucaacauuuugcaggcaaggugcgaguagcggccugcagaacguugaucuc

SEQ ID NO: 4238052 - RNA, 130 nt, Mycobacterium bovis subsp bovis AF2122/97
gucgccgcccuccuugucgccgcggccuacccagcggcccgcggccauggcuccggccucggucacccggaccagcuccauggccagguugcgguccggggcuucccggcgcgauggccuggugugcgac

SEQ ID NO: 4238053 - RNA, 65 nt, Mycobacterium bovis subsp bovis AF2122/97
cugcugcuggcuaccuacucggaguugcgcucacgcgccaacaucacggugugcgucggcggcgg

SEQ ID NO: 4238054 - RNA, 56 nt, Mycobacterium bovis subsp bovis AF2122/97
gcagcugcucgacuugcucggacaccgcgcgguguacuggauccgccggcggcugc

SEQ ID NO: 4238055 - RNA, 58 nt, Mycobacterium bovis subsp bovis AF2122/97
gcgucgauugccuccgccucggccucggccaaaaagccgaugcggcccagauugacgc

SEQ ID NO: 4238056 - RNA, 59 nt, Mycobacterium bovis subsp bovis AF2122/97
gccgaggagguguaccggguagagggcgacggccucuaccuugugggcaccuccgaggu

SEQ ID NO: 4238057 - RNA, 69 nt, Mycobacterium bovis subsp bovis AF2122/97
gucgggugugucauuucucacgacuuucgcccccgccaaucgggcaggguggugagaaugacgcccgau

SEQ ID NO: 4238058 - RNA, 55 nt, Mycobacterium bovis subsp bovis AF2122/97
uccccgcggugcuggcgaugcugcuggugauggccgucgcggucaccgugcggga

SEQ ID NO: 4238059 - RNA, 89 nt, Mycobacterium bovis subsp bovis AF2122/97
acugcagacccacggccucgucgaaggucaggcguucccgggcgcgcucgcguaacgacuggcuuucggcaaggugaauggcgcgcagu

SEQ ID NO: 4238060 - RNA, 129 nt, Mycobacterium bovis subsp bovis AF2122/97
ucgcgcaaggguuugucaccgguauggaccuggauuggcgcgcugugguaggcgaggcgcaguuugucgaguugccgacguaugccuuccaacggcggcgguuuuggcuguccggugauggugucgcgg

SEQ ID NO: 4238061 - RNA, 55 nt, Mycobacterium bovis subsp bovis AF2122/97
ucgacgagcacgcguaggaccggaaacagauccggaauccguugcgccucgucga

SEQ ID NO: 4238062 - RNA, 55 nt, Mycobacterium bovis subsp bovis AF2122/97
gcggguaacggagguccgccgguuacucgucgcgccgugcugacccuguacccgc

SEQ ID NO: 4238063 - RNA, 79 nt, Mycobacterium bovis subsp bovis AF2122/97
gccgcggacugcccagcgauuucgaccgugccucgauaccaggcugggcauggucugacguucuggagcacuuccgggc

SEQ ID NO: 4238064 - RNA, 79 nt, Mycobacterium bovis subsp bovis AF2122/97
gguaggccggcgagcagacgcaaaagcccccuaaaccggcagguauuaggggcuuuugcgucugcucgccaggcaagcc

SEQ ID NO: 4238065 - RNA, 55 nt, Mycobacterium bovis subsp bovis AF2122/97
gaagacgagugaggccgcgcagauacucgggguaucgcggcagcaugucgucaac

SEQ ID NO: 4238066 - RNA, 76 nt, Mycobacterium bovis subsp bovis AF2122/97
cagcgagaucaacgugaagcgcgcccaagccgccgucgcgcaaaccggccugaccgagcgggugcgcuuccaccug

SEQ ID NO: 4238067 - RNA, 121 nt, Mycobacterium bovis subsp bovis AF2122/97
accaccaccgcccgcggccuugguugccgcacaccauccgacggcuuucguugccgaucuugcuguuuuggguggguguggccgccauaaccaaugccgccgugccgcaauuggagguggu

SEQ ID NO: 4238068 - RNA, 59 nt, Mycobacterium bovis subsp bovis AF2122/97
gugccguucgacugcccguagagcaccgugguggugaucugcggggacaggaacgacau

SEQ ID NO: 4238069 - RNA, 69 nt, Mycobacterium bovis subsp bovis AF2122/97
ccguaucaccggucgcugacaauagcggcguccaccaauucggcaaacaccucagcgaucggggugcgg

SEQ ID NO: 4238070 - RNA, 79 nt, Mycobacterium bovis subsp bovis AF2122/97
gguguauguggcgcugacacuccccucgggaucggggcccaccgcgauccaggaauugucagacguuaucgaccacacc

SEQ ID NO: 4238071 - RNA, 57 nt, Mycobacterium bovis subsp bovis AF2122/97
ugguggcugugucgaccgggaacggcaacuacgccgugaucguugauacagcgacca

SEQ ID NO: 4238072 - RNA, 65 nt, Mycobacterium bovis subsp bovis AF2122/97
ccgcgccuggucgcagguugccgagcggcauggcucacgcuccgcgaccgcaggaccaagcgcgg

SEQ ID NO: 4238073 - RNA, 63 nt, Mycobacterium bovis subsp bovis AF2122/97
gccgagaagacgcaaaagcuccuaaaucuggccgauuuagugggcuuuugcgucugcucgcgc

SEQ ID NO: 4238074 - RNA, 64 nt, Mycobacterium bovis subsp bovis AF2122/97
gaucuuguucgguaccgguggcaauggcgggaccggcgggauagccaccggugcuggagggauc

SEQ ID NO: 4238075 - RNA, 85 nt, Mycobacterium bovis subsp bovis AF2122/97
cgcguccaggucccggugcugcucgucggcggcuggcaggacaucuuccugcggcagacgcugcagcaguaccggcaccugcgcg

SEQ ID NO: 4238076 - RNA, 67 nt, Mycobacterium bovis subsp bovis AF2122/97
ggcuugggccaacacgugcgcggucgaauggcggaucacgcugcgaccgucgucgguguuggcggcc

SEQ ID NO: 4238077 - RNA, 116 nt, Mycobacterium bovis subsp bovis AF2122/97
gaguggcuccgaugagguaggggccgucggcgagaucgucgguguguaccgccaagcacgcaccgaaggagaucccgccgauggccuugccacagucugcccuguccgaguugcuc

SEQ ID NO: 4238078 - RNA, 62 nt, Mycobacterium bovis subsp bovis AF2122/97
gggccggugcgaauggugcaacgcgccuuucgucgaaggaaacgccguccgccaccgagccc

SEQ ID NO: 4238079 - RNA, 102 nt, Mycobacterium bovis subsp bovis AF2122/97
ucgcgcacguggucaucgugguggaggagaaccgcucgcaggccgccaucaucgguaacaagucggcucccuucaucaauucgcuggccgccaacggcgcga

SEQ ID NO: 4238080 - RNA, 88 nt, Mycobacterium bovis subsp bovis AF2122/97
gaccgucgcgcugaucgacaugacccucacgucggcggcgugcccgcugaccgaugucaucgaggaucagucgcgcagcgcgcugguc

SEQ ID NO: 4238081 - RNA, 68 nt, Mycobacterium bovis subsp bovis AF2122/97
ggcagcuccaagucgaauccuggucgagguugguccgggcggcagccugaccgguucggcuaugcgcc

SEQ ID NO: 4238082 - RNA, 129 nt, Mycobacterium bovis subsp bovis AF2122/97
gugcaccacacggaucgaauccaccgccucgagcaccgucgaauccgcggcuuuccgggccgcggcggccaucaggucgacggguucgauggacugcuucucggcgucgaugucgccucggugguugac

SEQ ID NO: 4238083 - RNA, 94 nt, Mycobacterium bovis subsp bovis AF2122/97
cauuccgucgaguuccucacaugcgcugaucggcggcaucgucggcgccacaauugccgccgucggccugcguggggugaucuggagcggagug

SEQ ID NO: 4238084 - RNA, 61 nt, Mycobacterium bovis subsp bovis AF2122/97
gcgacggcguugggugcaucggcggccaccucaacgaaccgcugguuguucagcucgucgc

SEQ ID NO: 4238085 - RNA, 66 nt, Mycobacterium bovis subsp bovis AF2122/97
ggucggcggugcacagugccacaucggcgggagaaucgucgaguaucgcuugcgcaccgauccacc

SEQ ID NO: 4238086 - RNA, 73 nt, Mycobacterium bovis subsp bovis AF2122/97
ggcgcccggugagcugaucuucgugaacggcaagcaguacaagaguuaucgcggcaugggaucacugggugcc

SEQ ID NO: 4238087 - RNA, 66 nt, Mycobacterium bovis subsp bovis AF2122/97
ugggcgcggcugcugagugaggucggcgccccggaccagcgcggccucgccgcacaguugcgguca

SEQ ID NO: 4238088 - RNA, 60 nt, Mycobacterium bovis subsp bovis AF2122/97
ucgagccgggcucggugaacaagaucgucgccgcguccgcggucaucgagcacggguuga

SEQ ID NO: 4238089 - RNA, 81 nt, Mycobacterium bovis subsp bovis AF2122/97
uggcugacauggucgccaucggccaacgcaucgcgcgggcggcccgcgccacgaaguuggcugacgcgacacacaucgcca

SEQ ID NO: 4238090 - RNA, 61 nt, Mycobacterium bovis subsp bovis AF2122/97
cgcggccucggccggucacacuggccgcgugcgacagcagggugucuuuggcggggccgcg

SEQ ID NO: 4238091 - RNA, 78 nt, Mycobacterium bovis subsp bovis AF2122/97
ucgcgcgugcagcggcgguguuugaccgcuggucggacuugacugcccagcgguucauugccgacggcauaccgccgg

SEQ ID NO: 4238092 - RNA, 59 nt, Mycobacterium bovis subsp bovis AF2122/97
caucaacacgcugcuguuguacauggaaaaucaccgugacgagcuggugguguuuggug

SEQ ID NO: 4238093 - RNA, 62 nt, Mycobacterium bovis subsp bovis AF2122/97
cgccgagcgugaacugagggcgagauuucggccgauucuccgcccucaguucacgcugggcg

SEQ ID NO: 4238094 - RNA, 91 nt, Mycobacterium bovis subsp bovis AF2122/97
ggugccugcaccucuggguccaggguggugcggaucagguacccgcccguggcgaccugcuccuugcugaucccggcccgagacagguacu

SEQ ID NO: 4238095 - RNA, 60 nt, Mycobacterium bovis subsp bovis AF2122/97
cggugggcgcgucaucgacgcuucgcugacgucccgagguggcagauguugcgcucgcug

SEQ ID NO: 4238096 - RNA, 69 nt, Mycobacterium bovis subsp bovis AF2122/97
ugccaauggaggagaugcuagaggcaacgaagucguggcaggaaucgggguuuaacgucuucuccggcg

SEQ ID NO: 4238097 - RNA, 82 nt, Mycobacterium bovis subsp bovis AF2122/97
uggcggcaguucgccaguggcgaguccccguuugugacgauguucucccuagccggacuugccgcugcggcgucggucguca

SEQ ID NO: 4238098 - RNA, 115 nt, Mycobacterium bovis subsp bovis AF2122/97
cccgcaggccgacuucggcguguccggugcccagcaccgaccagugccggccgccgagcucgauguggaugucggcuugcucgguguuggugcacaccgccuuggccccgucggg

SEQ ID NO: 4238099 - RNA, 76 nt, Mycobacterium bovis subsp bovis AF2122/97
ggccgccuuggccgccggcgaagccguugccgucuugggagagggcgccgcugucgccggccccgccgucgccgcc

SEQ ID NO: 4238100 - RNA, 61 nt, Mycobacterium bovis subsp bovis AF2122/97
ggcguugggcggcggccuggagaucgcgcuggcgugucaucaccggaucgccgccgacguc

SEQ ID NO: 4238101 - RNA, 58 nt, Mycobacterium bovis subsp bovis AF2122/97
gaucgccgauaucgacggccugcgcuaccuggacuggcuggcugcguacucggcgguc

SEQ ID NO: 4238102 - RNA, 127 nt, Mycobacterium bovis subsp bovis AF2122/97
aggccgcgcugcugcacgaggccgaacuccaacucgccgaguucaucggccucgacgaggucaaacgccaggugucgcggcugaagagcucaguggccauggaacugguccgcaagcagcgugggcu

SEQ ID NO: 4238103 - RNA, 64 nt, Mycobacterium bovis subsp bovis AF2122/97
cggucgccgcggucgugcugggugcgaugaucugguccgcacaccgcgaugacuccggcgagcg

SEQ ID NO: 4238104 - RNA, 84 nt, Mycobacterium bovis subsp bovis AF2122/97
gcucgcgcaucgcucgcuggaugagcagcucggugcggguaucgaccgagcuggucgccucguccaggaucaacagcugcgggc

SEQ ID NO: 4238105 - RNA, 63 nt, Mycobacterium bovis subsp bovis AF2122/97
gcacccuggacaagcuggaauccaucaccggguucaccgcgaaucuguccaaccagcgggugc

SEQ ID NO: 4238106 - RNA, 61 nt, Mycobacterium bovis subsp bovis AF2122/97
gccgguguggcagucgcugcggcaugccgacaccuggaucaugucgcugcuguacaucggc

SEQ ID NO: 4238107 - RNA, 56 nt, Mycobacterium bovis subsp bovis AF2122/97
gaggcauaugauggcgcguucugagggcaaucgcccacgccaucgcgcugugccuc

SEQ ID NO: 4238108 - RNA, 124 nt, Mycobacterium bovis subsp bovis AF2122/97
cacacugcgcgccgagcgugggcuggcugcgccgaaugugcacugguggcggcgacacgcccgggcgacgccgccgugguugcacguucggcguaggcagccccgugcgcuugccgggcaggug

SEQ ID NO: 4238109 - RNA, 114 nt, Mycobacterium bovis subsp bovis AF2122/97
gcgggcuuguucuaaagccggccgugggccgagugaaggugggguacaugcgcggaccgcgcgucugccccaccuucugcuugcugcuagcugguugagaugaacgugacaugc

SEQ ID NO: 4238110 - RNA, 66 nt, Mycobacterium bovis subsp bovis AF2122/97
cgcuuuccggcggugguguagcuucgaugggcaucacuucauggggcuauggcgcagcugguagcg

SEQ ID NO: 4238111 - RNA, 57 nt, Mycobacterium bovis subsp bovis AF2122/97
cuugggcguuugcguucgccgcgaccgcguugugcguaggcgaucgccucguccaag

SEQ ID NO: 4238112 - RNA, 90 nt, Mycobacterium bovis subsp bovis AF2122/97
gcggcauagcgauugaacuggccgugcucggcccgcuugucggaauggccguaaccgggcuggucgacggccagcacaugaaagugccgc

SEQ ID NO: 4238113 - RNA, 63 nt, Mycobacterium bovis subsp bovis AF2122/97
cggaagagaccggauuguugccugcggaauuauucgccgaggcaaucagucaggucgcuaucg

SEQ ID NO: 4238114 - RNA, 56 nt, Mycobacterium bovis subsp bovis AF2122/97
uccgucaaacguugaaucgacucggcggacuccaagcgauggucagcgcuugcgga

SEQ ID NO: 4238115 - RNA, 56 nt, Mycobacterium bovis subsp bovis AF2122/97
guuuuccucggugcgggcgcgcuggaagccgaguugcgccaccgccagaggauaac

SEQ ID NO: 4238116 - RNA, 63 nt, Mycobacterium bovis subsp bovis AF2122/97
guuggcgaggccgcgcaauacacggccacaguccaaucaccgguaaugucgauuuucgccgac

SEQ ID NO: 4238117 - RNA, 90 nt, Mycobacterium bovis subsp bovis AF2122/97
ccgggccauggcgucaucuggacgugcacgccaacggcauccgauuccacgucgucgaggcugugccguccggccagccggagggcccgg

SEQ ID NO: 4238118 - RNA, 93 nt, Mycobacterium bovis subsp bovis AF2122/97
gggugccaaccuaccgcgcgagcagacgcagaaucgcacugcgcggggucccgcgcaugcgauucugcgucugcucgccguacucaggcuucc

SEQ ID NO: 4238119 - RNA, 68 nt, Mycobacterium bovis subsp bovis AF2122/97
gccguuaacgauguugagcgggaccgcgccuacacccgaaggcauuuccggcccaacaucguugaggu

SEQ ID NO: 4238120 - RNA, 62 nt, Mycobacterium bovis subsp bovis AF2122/97
cccugaugaaaugcaugccgccggaccugcguucaccggccggcccggcauguucguccggg

SEQ ID NO: 4238121 - RNA, 63 nt, Mycobacterium bovis subsp bovis AF2122/97
gcggaggcggcaccgccggcgccacggccuuugcgauacguggcgucggcuugugcgcuccgu

SEQ ID NO: 4238122 - RNA, 57 nt, Mycobacterium bovis subsp bovis AF2122/97
gcuggcguaucgcucgcggccguucuuuguacccgacgagccgcagcgggacccggu

SEQ ID NO: 4238123 - RNA, 64 nt, Mycobacterium bovis subsp bovis AF2122/97
gcgaguagacgcgaaagaacaugaugggcgcuggugcccaucauguucuuuugcgccuacucgc

SEQ ID NO: 4238124 - RNA, 129 nt, Mycobacterium bovis subsp bovis AF2122/97
cuucgccuucgucgggcccuuucgcgcggauuuggcggccaucuaccagcuggccuuccggacaccgggcagguguccgucgugggccaguuggcggacccgcacacgggagagcccgaauuugcggag

SEQ ID NO: 4238125 - RNA, 58 nt, Mycobacterium bovis subsp bovis AF2122/97
guggucgaaaaagccgccguuuucgucguagcugacgaucagcgccgucuuuucccac

SEQ ID NO: 4238126 - RNA, 76 nt, Mycobacterium bovis subsp bovis AF2122/97
cgggguggagggacucgagaaugucaucgugaucggcgccuccaaccgagaggacaugaucgacccugccauccug

SEQ ID NO: 4238127 - RNA, 111 nt, Mycobacterium bovis subsp bovis AF2122/97
ggcugaggccauuuggaauucgauacgcuugccggacggcagcaccagcaccggaauuucggugcuggugcccaacgucucgaccuugucgaaauucagguagguccgguc

SEQ ID NO: 4238128 - RNA, 127 nt, Mycobacterium bovis subsp bovis AF2122/97
uacuucguuaccgacuucgauaaccagcaggcggugcucgaggacgcguugauccugcugcaccaagacaagaucagcucgcuucccgaucuguugccauugcuggaaaagguugcaggaacgggua

SEQ ID NO: 4238129 - RNA, 60 nt, Mycobacterium bovis subsp bovis AF2122/97
gacaccgacaccuauugccccgccugauauucggggcgggcgggacgcgguguacggugc

SEQ ID NO: 4238130 - RNA, 77 nt, Mycobacterium bovis subsp bovis AF2122/97
cgguugaccgugcagcgagcgcacuggccguugggaacauugcaacugacggccaucgcugcuugcugcgccccccg

SEQ ID NO: 4238131 - RNA, 61 nt, Mycobacterium bovis subsp bovis AF2122/97
ggugcgcucuggugccggagcugcucgcgucgcaggcgguuccgucaccgaagacgucgcc

SEQ ID NO: 4238132 - RNA, 79 nt, Mycobacterium bovis subsp bovis AF2122/97
cugguucgcggcacccagguguagucaggaucgggcacgaagcccggcggcaccaccugggucggcggagagucaccag

SEQ ID NO: 4238133 - RNA, 57 nt, Mycobacterium bovis subsp bovis AF2122/97
ggugaucacgagggccuguucagccuguucuacagccucgacgugccccggaucacc

SEQ ID NO: 4238134 - RNA, 62 nt, Mycobacterium bovis subsp bovis AF2122/97
gcggucguggugcccgagcgagagccacagccgggcggucucgaucagcaccgcaaggccgc

SEQ ID NO: 4238135 - RNA, 58 nt, Mycobacterium bovis subsp bovis AF2122/97
ucggcgaugccgcccgagccgcgcagaccucguucgacucgggcgugaagcucgccga

SEQ ID NO: 4238136 - RNA, 73 nt, Mycobacterium bovis subsp bovis AF2122/97
guagcacgucggcaggaaggaugcgaugaccgggccauauuuuccucagacgaucccguuccugcccagcuac

SEQ ID NO: 4238137 - RNA, 88 nt, Mycobacterium bovis subsp bovis AF2122/97
ucggcugggcgcuggcgcaaccccugacccgagaacuccggauguucccccucuccuucagcagguucgugcgagcccguucagccgg

SEQ ID NO: 4238138 - RNA, 65 nt, Mycobacterium bovis subsp bovis AF2122/97
gacagcagguagagcagcaucagcgcgucggcuugcuuggacgccugguaguuguucacgcuguc

SEQ ID NO: 4238139 - RNA, 97 nt, Mycobacterium bovis subsp bovis AF2122/97
ucugcgcgcucgggucggguucgccgucgacgacgacggugcccaacugcagggccuggccuucgacgguguaacccgccgcgauccgcugcgcggg

SEQ ID NO: 4238140 - RNA, 66 nt, Mycobacterium bovis subsp bovis AF2122/97
uguucgugaucgcgagcgcaaugcugccggucgcgauggaugcaauguagagcgcgaucacgucca

SEQ ID NO: 4238141 - RNA, 85 nt, Mycobacterium bovis subsp bovis AF2122/97
gcugauggugguggcggucuggcugcugggcgucggcacucucaaagaccuggcgcuggugcagcugaucggcaucaucaucggc

SEQ ID NO: 4238142 - RNA, 78 nt, Mycobacterium bovis subsp bovis AF2122/97
cgccgguugaugugauacacgccgacguuacucgccgcaugcauggcgagguggcgaccgacguugucgcggccggcg

SEQ ID NO: 4238143 - RNA, 63 nt, Mycobacterium bovis subsp bovis AF2122/97
ccgcgaauguaacgccacugcgaauuuccggcccggcuuuucgcagugccguuacgcucgugg

SEQ ID NO: 4238144 - RNA, 76 nt, Mycobacterium bovis subsp bovis AF2122/97
ccgcguugggggccgaugcggaacucgaucaggucaucuucgacgguuccucguucggcaccgccaccccaaccgg

SEQ ID NO: 4238145 - RNA, 82 nt, Mycobacterium bovis subsp bovis AF2122/97
gcucuguggccgaaaaccuugcugccgaggcggcggccuucguucgcggucgucgggccgagguuuucggcaucuccagggc

SEQ ID NO: 4238146 - RNA, 77 nt, Mycobacterium bovis subsp bovis AF2122/97
ggugucgguuuagcuugcagcgcaaggauuuuggugaccaucgcggugaccugagccuugucugcggaaccguugcc

SEQ ID NO: 4238147 - RNA, 61 nt, Mycobacterium bovis subsp bovis AF2122/97
uccgcguggcgggaauacccaguuucugcacaaagcgguggguguucuccgacacgcugga

SEQ ID NO: 4238148 - RNA, 76 nt, Mycobacterium bovis subsp bovis AF2122/97
ggccgccuaccggaucuggcuggagcagaacaagcagcgcuggcuggcguucuuccaggcagagggcggugcggcc

SEQ ID NO: 4238149 - RNA, 84 nt, Mycobacterium bovis subsp bovis AF2122/97
ugccgucacuggugucggccggcgccggacugaugcuggcaacgcuggcccauucggucggcuggccgauuccggugggcggca

SEQ ID NO: 4238150 - RNA, 55 nt, Mycobacterium bovis subsp bovis AF2122/97
ggggucagcgccaggcggugguggccauucgccaucgccggugaccgcugacccc

SEQ ID NO: 4238151 - RNA, 56 nt, Mycobacterium bovis subsp bovis AF2122/97
cggcccuggucgacgccggagccgacgcggugaaagucggcguggggccggggucg

SEQ ID NO: 4238152 - RNA, 91 nt, Mycobacterium bovis subsp bovis AF2122/97
acgugguggaugcguuugccgaccgcggcaucagcucgccguggucacaccaggcugaggccgccgaguuggcguacgccggccgccacgu

SEQ ID NO: 4238153 - RNA, 63 nt, Mycobacterium bovis subsp bovis AF2122/97
cgccacgugccggugcucgacgggaagaaacugaucggcaucguuagcaucggugacguggug

SEQ ID NO: 4238154 - RNA, 74 nt, Mycobacterium bovis subsp bovis AF2122/97
ggcgggggcugccacgacgggggccguagaucagagccguaagccggcagcggucccgcggggacagccgagcc

SEQ ID NO: 4238155 - RNA, 71 nt, Mycobacterium bovis subsp bovis AF2122/97
ccgcaccccggaugcccacgacgacgauaucgcugcggugucgaagaucgugggacaggccggcggugcgg

SEQ ID NO: 4238156 - RNA, 89 nt, Mycobacterium bovis subsp bovis AF2122/97
cggcgacacguaucgccgagugugaaucccgcgacgccgcaccggcgugucgcgucgccagauucacaaucggcauuaugcgauggccg

SEQ ID NO: 4238157 - RNA, 79 nt, Mycobacterium bovis subsp bovis AF2122/97
cucggcgauccgcucggugcugaccggccccugccgcaggacgcgugggguggcuccggucagaucgacgaucguggag

SEQ ID NO: 4238158 - RNA, 59 nt, Mycobacterium bovis subsp bovis AF2122/97
gggcuggacggugccggcgaucaagcccagcagggucgacuugccggcgccguuagccc

SEQ ID NO: 4238159 - RNA, 57 nt, Mycobacterium bovis subsp bovis AF2122/97
gcgacagugaugcccagucugcugcugaaccggaggcagagccgaucguccuguugc

SEQ ID NO: 4238160 - RNA, 96 nt, Mycobacterium bovis subsp bovis AF2122/97
ggcgacaaucaucuugugccggcggggguuugggcgcgggcgcuugcggagaagguaauacucaaggcuuggccggccacgagcccgaugggcgcc

SEQ ID NO: 4238161 - RNA, 57 nt, Mycobacterium bovis subsp bovis AF2122/97
gcugggccuuacgcaccugccgcucagcgacggccggcaggugcgcuaggucccggu

SEQ ID NO: 4238162 - RNA, 74 nt, Mycobacterium bovis subsp bovis AF2122/97
uguccaggauugccugggccuggaucucgucgaugucgagcagcucgaucaguccggcccgggcgauaucgacg

SEQ ID NO: 4238163 - RNA, 59 nt, Mycobacterium bovis subsp bovis AF2122/97
gcgagcguaacgccacggcgagcuugcgugcaccgaauucgccguggcguuacgcucgc

SEQ ID NO: 4238164 - RNA, 73 nt, Mycobacterium bovis subsp bovis AF2122/97
ggucggcgggcccgaaucgaggcggucaggaugcggcauccgaucaccgcccgucgggcgcgcuguugaugcc

SEQ ID NO: 4238165 - RNA, 76 nt, Mycobacterium bovis subsp bovis AF2122/97
gccacguucugggcguccguuuccgcgccggcaccguacucgauggcgguggugaacggaucgccggauucgcggu

SEQ ID NO: 4238166 - RNA, 81 nt, Mycobacterium bovis subsp bovis AF2122/97
cagggaacgcagcgcggucaggucgccggucuggauggcgauguccaagcucuggauggccugccgcaccugaucuuccug

SEQ ID NO: 4238167 - RNA, 56 nt, Mycobacterium bovis subsp bovis AF2122/97
gugguggccguggccgcgucguugaucugguggaccagcgacgcccgcgccaccau

SEQ ID NO: 4238168 - RNA, 61 nt, Mycobacterium bovis subsp bovis AF2122/97
guaggaggucuccagcagccgcaggcgguacagcccggcgcugcgaucgaagacguccugc

SEQ ID NO: 4238169 - RNA, 97 nt, Mycobacterium bovis subsp bovis AF2122/97
cacgaucucgguuucggacggcaucuccaugggucaugaggggaugcacuucucgcugguuucccgugaggugaucgccgacagcgucgaagucgug

SEQ ID NO: 4238170 - RNA, 57 nt, Mycobacterium bovis subsp bovis AF2122/97
gcugugguggcggaugauccgcuucgaauacgccuugcuggucaccgucgccacagc

SEQ ID NO: 4238171 - RNA, 111 nt, Mycobacterium bovis subsp bovis AF2122/97
cguuugguauggcuuuccagacuugcgaccgcggugcucgaucguggccguuccggguagguagcgcgcuaucgguuugagcgcccgguugauguacuugaccugcagacg

SEQ ID NO: 4238172 - RNA, 74 nt, Mycobacterium bovis subsp bovis AF2122/97
aacgcagcucccgugauacggaagcucgccgagugccccggcgcucggcggauucgguagcacuugaacucguu

SEQ ID NO: 4238173 - RNA, 67 nt, Mycobacterium bovis subsp bovis AF2122/97
cuugaagcgcucggguugcaacguaucaagacugacagugaugcguuucauacccgcagccuucagg

SEQ ID NO: 4238174 - RNA, 64 nt, Mycobacterium bovis subsp bovis AF2122/97
uuggcggcgaugaugcgcacugagcgguccaacaguugagugccgugcguguggucgccguugg

SEQ ID NO: 4238175 - RNA, 83 nt, Mycobacterium bovis subsp bovis AF2122/97
ucguucaccucguguaacgaccaaggcgauccgccuuaucagggcaccgucaggauggccuuucuguugcagggcgaucacga

SEQ ID NO: 4238176 - RNA, 126 nt, Mycobacterium bovis subsp bovis AF2122/97
guccacggccgcuguccgauguagggaccggucaucgccggcgaauccgguaccuggucgacgucgucgaugaucagguagugggugugcccggcaaagguccagcgggacagcucggccgcagac

SEQ ID NO: 4238177 - RNA, 90 nt, Mycobacterium bovis subsp bovis AF2122/97
cacgucgggugcuucgaagccgaacggcgccggguugccgauguugaguuugaggaugcggugaccuucggcuucgagccgcgcggcgug

SEQ ID NO: 4238178 - RNA, 70 nt, Mycobacterium bovis subsp bovis AF2122/97
cggggucgucgacgggcgcaacgucuggcgcaccgaccuggaggcggcguugggcacguuggcgacccug

SEQ ID NO: 4238179 - RNA, 82 nt, Mycobacterium bovis subsp bovis AF2122/97
gcuuaagccgcgcgagcagacgcuaaagcccccgcacgcucggcgugucgggggcuuuugcgucugcugaccggaguucagu

SEQ ID NO: 4238180 - RNA, 63 nt, Mycobacterium bovis subsp bovis AF2122/97
uguugacucugcguccaccggacggguuacucgcacuuuugcgugguggacgcagagucaacg

SEQ ID NO: 4238181 - RNA, 108 nt, Mycobacterium bovis subsp bovis AF2122/97
cgggcgaucgcaagcucggcgcuugucgccgggugcggcgggucgcccgcguuggauucagggcgaucgcaagcucggcgcuugucgccgggugcggcgggucgcccg

SEQ ID NO: 4238182 - RNA, 56 nt, Mycobacterium bovis subsp bovis AF2122/97
gcaguuggcuaucgaccgcgucaaagcgcucuuuggcgccgaauacgccaacgugc

SEQ ID NO: 4238183 - RNA, 69 nt, Mycobacterium bovis subsp bovis AF2122/97
gcucgacagcgauccgccggcgcgguuggacggauugccgaagaccgcgaccgcugcgacguugucugc

SEQ ID NO: 4238184 - RNA, 58 nt, Mycobacterium bovis subsp bovis AF2122/97
ggcgcugacggccugauagaucugggcgugugccgcgaacugagccgccgucagcgcc

SEQ ID NO: 4238185 - RNA, 73 nt, Mycobacterium bovis subsp bovis AF2122/97
cugaccugcugguagagagugccguacgcggugaacaacgacgccuguagcacugauaucucaucagcggcgg

SEQ ID NO: 4238186 - RNA, 105 nt, Mycobacterium bovis subsp bovis AF2122/97
gcuacgcggagcguacaaccuguuggugcaguuguccgaugaggaacuggccgcgggcgugguguguucuucugcgggcaaccacgcgcagggcuucgcguaugc

SEQ ID NO: 4238187 - RNA, 55 nt, Mycobacterium bovis subsp bovis AF2122/97
gugggcagaugggugauacgcaccgcggagucggugguauucacucccugcccgc

SEQ ID NO: 4238188 - RNA, 64 nt, Mycobacterium bovis subsp bovis AF2122/97
cgucgcguuuuauguguucgucuacacgcuuuggcucaagcgacgcacgucacagaacguggug

SEQ ID NO: 4238189 - RNA, 57 nt, Mycobacterium bovis subsp bovis AF2122/97
gaugcuggagguguugagcaccgcuucuaacgaucccgaugcgcgccgccagcuauc

SEQ ID NO: 4238190 - RNA, 67 nt, Mycobacterium bovis subsp bovis AF2122/97
gcuaggcgggaccugauuacccacccccugcugacgacgaccgucggcgaucagcgucacgccuagu

SEQ ID NO: 4238191 - RNA, 67 nt, Mycobacterium bovis subsp bovis AF2122/97
ucgaccgagaagucguaugcggugccgagcuucauguuccgcaccgcaucgccgaacuuccggguga

SEQ ID NO: 4238192 - RNA, 79 nt, Mycobacterium bovis subsp bovis AF2122/97
gcgaggccggcgacgaccgaugucugggugaucggccacagcacggugcgcaaccguugggcgaccgcacggccgccgc

SEQ ID NO: 4238193 - RNA, 58 nt, Mycobacterium bovis subsp bovis AF2122/97
ggcggucgagcggcggaugaaggcggguuccgacgucgucaucgugucuucgggcgcc

SEQ ID NO: 4238194 - RNA, 59 nt, Mycobacterium bovis subsp bovis AF2122/97
gcugcuccuggaaguacacggcggcccgcucgggguugcucgcgaucgcagugagcagc

SEQ ID NO: 4238195 - RNA, 56 nt, Mycobacterium bovis subsp bovis AF2122/97
ccaugagcacccggauggccuggcuuagcccggucaugucguccaccggcuuaugg

SEQ ID NO: 4238196 - RNA, 66 nt, Mycobacterium bovis subsp bovis AF2122/97
gacgucaagacgccggcgggcaaggucgacggcgcuaucgagcugccggccgagcuguucgacguc

SEQ ID NO: 4238197 - RNA, 60 nt, Mycobacterium bovis subsp bovis AF2122/97
gacauagauaaggaagauugcggugccauggauaucgcggggcgcagccuggucuauuuc

SEQ ID NO: 4238198 - RNA, 86 nt, Mycobacterium bovis subsp bovis AF2122/97
cgggcacgagaucguugauccagccggccagauacauguuccagugcugcggaugggucagcagauugaagaacuuguccagcccg

SEQ ID NO: 4238199 - RNA, 58 nt, Mycobacterium bovis subsp bovis AF2122/97
acaacggugaggagaucgcggccagcgagcugguccgauucgaacuccucgccggugu

SEQ ID NO: 4238200 - RNA, 100 nt, Mycobacterium bovis subsp bovis AF2122/97
gagaucggguccccgcgccgcgagcguaacgccacggcgaagucgggcacggauuuucagccgugacguuacgcucgucgcccagucgaccucaggucuu

SEQ ID NO: 4238201 - RNA, 65 nt, Mycobacterium bovis subsp bovis AF2122/97
cugcgcaucgaggccggcgacgagcgggcccgugcggccuugcaacgcuggucguugaugcgcag

SEQ ID NO: 4238202 - RNA, 94 nt, Mycobacterium bovis subsp bovis AF2122/97
uggguggucgagcacgguuuccgcggguugagcuugcguccguucaugauuggacggcccgcauccgaccccgccuacuucccuugcuacgcca

SEQ ID NO: 4238203 - RNA, 93 nt, Mycobacterium bovis subsp bovis AF2122/97
gguuucccuaaggacagucucgauaucgagggcuacgugcgcgcgcugggccgacgccgccccgauauugcagugacuauccugcggcuggcc

SEQ ID NO: 4238204 - RNA, 56 nt, Mycobacterium bovis subsp bovis AF2122/97
guugguccucgaggucggcagugguuaccucgcgccgcuguccuucgugauccagc

SEQ ID NO: 4238205 - RNA, 92 nt, Mycobacterium bovis subsp bovis AF2122/97
gucaacgccggaguggugaauucuugggugcugaucucuggcagggugaacccgucgaccgagauccccccgagggaccacgguuggaugac

SEQ ID NO: 4238206 - RNA, 100 nt, Mycobacterium bovis subsp bovis AF2122/97
gucgcugccgccggcgaucgacaucagcacgccuugcgcgcccuccaucgaggcuuccagcaacggcgaguugauggcgaucucggccgcuuugagcgac

SEQ ID NO: 4238207 - RNA, 78 nt, Mycobacterium bovis subsp bovis AF2122/97
ccgcggcggcgcaguacgucgagaccuucgauaugcgacgccgauccacgauguaucugacguacuggaccgccgggg

SEQ ID NO: 4238208 - RNA, 70 nt, Mycobacterium bovis subsp bovis AF2122/97
ucgcuggcgccuaugacgguccgcaggaucaccucaagggugaucucagacaucuugggcgccaccgcga

SEQ ID NO: 4238209 - RNA, 85 nt, Mycobacterium bovis subsp bovis AF2122/97
ccuagguacccgcgagcagacgcagaagcccccaaaccggcgguuuuggggugcuuucgcgucugcucgcgguaguuaacccagg

SEQ ID NO: 4238210 - RNA, 59 nt, Mycobacterium bovis subsp bovis AF2122/97
gcgcgcuagcuggcaucccgaacggucgguagcacgugcagggugaccggccagcgcgc

SEQ ID NO: 4238211 - RNA, 69 nt, Mycobacterium bovis subsp bovis AF2122/97
cgaauugcacgucggugaccagaugaucguuaaaccgggcgaacgccuggccaccgacggcaucauucg

SEQ ID NO: 4238212 - RNA, 60 nt, Mycobacterium bovis subsp bovis AF2122/97
acccgcacggcgauguucaucaaugcgguggagcgcaucgugaugggcccagucgugggu

SEQ ID NO: 4238213 - RNA, 94 nt, Mycobacterium bovis subsp bovis AF2122/97
acgucgguucggcuuucgaacgcggugucggcggccugcccacggaucaacucacggguggcuuccgaaaucgcgcgcagcgccgcaccgacgu

SEQ ID NO: 4238214 - RNA, 55 nt, Mycobacterium bovis subsp bovis AF2122/97
ugcggacagaauacgcugccgauuugucuaccuauuggcugccgauucgucccca

SEQ ID NO: 4238215 - RNA, 63 nt, Mycobacterium bovis subsp bovis AF2122/97
agucgguggucaccgcggcagggcaacggcaucgcuacgacacccuggugcuggccaccggcu

SEQ ID NO: 4238216 - RNA, 73 nt, Mycobacterium bovis subsp bovis AF2122/97
ggcgggauugcguggacugaugcgggugaucgauuccgagcauccgcaccugggugccaccgcaaucgacguc

SEQ ID NO: 4238217 - RNA, 56 nt, Mycobacterium bovis subsp bovis AF2122/97
cgccaacgauccggugcgagucaacgcgaaucaagugcgcgccaaggucauuggcg

SEQ ID NO: 4238218 - RNA, 65 nt, Mycobacterium bovis subsp bovis AF2122/97
cgaagccgaccguguuaaccgcgcgggagcgcagcaucgcgcgacgggcgcgcggaucggucucg

SEQ ID NO: 4238219 - RNA, 80 nt, Mycobacterium bovis subsp bovis AF2122/97
ugccgaucagcaccagcucgcggggcagcuugacgucguaggcgucggccagcgccgagagcuggcggccgaugucggca

SEQ ID NO: 4238220 - RNA, 88 nt, Mycobacterium bovis subsp bovis AF2122/97
agcagagcgcccucggcgaucugcccgauggcggccgcgccgaucgccgcgaccaccaucagcagaucgacaucuaggguccuucgcu

SEQ ID NO: 4238221 - RNA, 57 nt, Mycobacterium bovis subsp bovis AF2122/97
gguccucugauccgcaccgcaucggcguggccgcagagcgguccuugaucagggacc

SEQ ID NO: 4238222 - RNA, 81 nt, Mycobacterium bovis subsp bovis AF2122/97
gcuuccagggcgcgagcagacgcagaaucgcccaauuucgugccgaaaugggcgauucugcgucugcucgcgagcgggagc

SEQ ID NO: 4238223 - RNA, 126 nt, Mycobacterium bovis subsp bovis AF2122/97
gaagaccgagccggcggcgaauuuguagaugucgcguuugcgcaggggcaugucagcguaugugcucgacgcgacgaauccacugcgcuugacgaggcgguacgucgcgccggcgagugcggcuuc

SEQ ID NO: 4238224 - RNA, 57 nt, Mycobacterium bovis subsp bovis AF2122/97
gucgggguggccuguuacgccguugucgucgaacacgaguagcaggucugcuccggc

SEQ ID NO: 4238225 - RNA, 64 nt, Mycobacterium bovis subsp bovis AF2122/97
ugccgagcagacgcaaaaucgcccaaauucgggccgaaaugggcgauuuugcgucugcucggca

SEQ ID NO: 4238226 - RNA, 64 nt, Mycobacterium bovis subsp bovis AF2122/97
gacgccaucuaucugcucuacaccggcggcaccaccgguuuccccaagggugugauguggcguc

SEQ ID NO: 4238227 - RNA, 81 nt, Mycobacterium bovis subsp bovis AF2122/97
gccagcaccguaucgguggccuccucggccuguuuggccgcaaagcccaggccgaccagagccucgaccacgggacugcgc

SEQ ID NO: 4238228 - RNA, 118 nt, Mycobacterium bovis subsp bovis AF2122/97
cgacaggucccgggugugcgaauccgggugguccagcagcgcguacagcaucgauggcaccaacauggucgcuguaaugcguugcuccucaaugauucugaguaccucggccgggucg

SEQ ID NO: 4238229 - RNA, 78 nt, Mycobacterium bovis subsp bovis AF2122/97
ggcgcggugccaaaagcggaguccaggcuguaaacccccaucggaguggccggauauccgcucuuggcuuccggcgcc

SEQ ID NO: 4238230 - RNA, 57 nt, Mycobacterium bovis subsp bovis AF2122/97
ggcagccagccuuaccgcaggccgggcuguaccagucgcuguagaagcuggacugcc

SEQ ID NO: 4238231 - RNA, 110 nt, Mycobacterium bovis subsp bovis AF2122/97
ucgccgacgguguggugccgccggcccgugucgucgaccggccggcguggauucgcucggccgccgaaucgaugcgggcgaugacgcacggaagcgccaaaccgcggggg

SEQ ID NO: 4238232 - RNA, 57 nt, Mycobacterium bovis subsp bovis AF2122/97
cugcugcuaccgcggaucguggccagcgucuuugccaacgagccgcguugccggcgg

SEQ ID NO: 4238233 - RNA, 59 nt, Mycobacterium bovis subsp bovis AF2122/97
ccgagacugacguuuugcagugaaagugcgagagggcgucugcaaaacgucaaucucgg

SEQ ID NO: 4238234 - RNA, 69 nt, Mycobacterium bovis subsp bovis AF2122/97
gucgacgucgaagacgaucaggcguuuggugcgccaagccaagccguaguccucgacggccacaucgac

SEQ ID NO: 4238235 - RNA, 65 nt, Mycobacterium bovis subsp bovis AF2122/97
ccgccgauagugaauucggcgccggaacacgcccggguucuugucgccgaauucacuaucggcgg

SEQ ID NO: 4238236 - RNA, 72 nt, Mycobacterium bovis subsp bovis AF2122/97
ccggcgcgagcagacgcaaaagccaccgcacguucggcgugucgggggauuucgcgucugcucgccagcggg

SEQ ID NO: 4238237 - RNA, 76 nt, Mycobacterium bovis subsp bovis AF2122/97
aggucagccugcugggcgccgacgguuacuuugcacuggucaaucaggccgaacacgucggcgcgcugcagggccu

SEQ ID NO: 4238238 - RNA, 110 nt, Mycobacterium bovis subsp bovis AF2122/97
agucgauguacguauaugcagugcugucaggcugcuggucggcccucucuugcagcaaagagggcacugaacggucggucaccggcaucgccuuguacucccauucggcu

SEQ ID NO: 4238239 - RNA, 64 nt, Mycobacterium bovis subsp bovis AF2122/97
cagcaggcgagauguggcccgcagguacuucuuucgguauccaccggccagcauuuccucgcug

SEQ ID NO: 4238240 - RNA, 66 nt, Mycobacterium bovis subsp bovis AF2122/97
cgaugcggccggguccacccggcugaucuucacgcgccaggaaggucugucggaccuggccgcgcg

SEQ ID NO: 4238241 - RNA, 72 nt, Mycobacterium bovis subsp bovis AF2122/97
gcgccgguuggcugccgugguucgccgacaucgaccggcagauguacuucuucuacgcagcgaccauggcgc

SEQ ID NO: 4238242 - RNA, 74 nt, Mycobacterium bovis subsp bovis AF2122/97
ugauccgccgauugugaaucugacgacgcgacagcggcgugucgcgucgucagauucacagucagcgcauguca

SEQ ID NO: 4238243 - RNA, 69 nt, Mycobacterium bovis subsp bovis AF2122/97
cuggaccagcaccgcggcgaccgcaccggccucguugauggccaagugcgucagcagcggugcugccag

SEQ ID NO: 4238244 - RNA, 73 nt, Mycobacterium bovis subsp bovis AF2122/97
gcuggucgaaccgaacuuggaaguaaucgucaaucuggguuacggcgacccgagguucggcuauucgacgagc

SEQ ID NO: 4238245 - RNA, 60 nt, Mycobacterium bovis subsp bovis AF2122/97
gcgggcaucacuucggacggggcgagucgacgggucagccugcacgacggugaugcccgc

SEQ ID NO: 4238246 - RNA, 74 nt, Mycobacterium bovis subsp bovis AF2122/97
uguuggcgcgacgaggacgcaaaaucgcccgaaaccgauggcuuucgggcgauuuugcgucugcucgcgcuaca

SEQ ID NO: 4238247 - RNA, 65 nt, Mycobacterium bovis subsp bovis AF2122/97
guccgcgagcggaacgucacggcgaaauuccacgcgauauuugaccgugacguuacgcucgcgac

SEQ ID NO: 4238248 - RNA, 65 nt, Mycobacterium bovis subsp bovis AF2122/97
uucacauccggguucagcuugcccgacagagccgaggucaggguacugagcaucggguuguugga

SEQ ID NO: 4238249 - RNA, 58 nt, Mycobacterium bovis subsp bovis AF2122/97
gcgagcagacgcaaaaucgcccgaaagccaucgguuucgggcgauuuugcguccucgu

SEQ ID NO: 4238250 - RNA, 74 nt, Mycobacterium bovis subsp bovis AF2122/97
ugaccgcuggugagcagacgcagagucgcacugcgccggccggcgcagugcgacucugcgucugcucgcgcuca

SEQ ID NO: 4238251 - RNA, 119 nt, Mycobacterium bovis subsp bovis AF2122/97
cgccgucgcugcaccuguccgauuccgcggcugcguccgucuuccgggccgugcguuugcgugguccggucggucgggacguaauugcuggaucuacgucgcugagcaucgcgacggug

SEQ ID NO: 4238252 - RNA, 73 nt, Mycobacterium bovis subsp bovis AF2122/97
ugugccugccguguuggcuccguuggugcgaaccccguauaugaucgccgccgucauagccgacaccagcgcg

SEQ ID NO: 4238253 - RNA, 65 nt, Mycobacterium bovis subsp bovis AF2122/97
gccucgcuggucgacgcguucggucgcgacauccugcuugcagacggagcgcuggaccggcaggc

SEQ ID NO: 4238254 - RNA, 71 nt, Mycobacterium bovis subsp bovis AF2122/97
cgaaccgcagcggguugcgggcaugguagucggccacggcgucgucggugaccgcgacccgcgcggugacg

SEQ ID NO: 4238255 - RNA, 66 nt, Mycobacterium bovis subsp bovis AF2122/97
gguggaucggugcgcaagcgauacucgacgauucucccgccgauguggcacugugcaccgccgacc

SEQ ID NO: 4238256 - RNA, 74 nt, Mycobacterium bovis subsp bovis AF2122/97
cugcucgauuucgguugcggugccagccaaccgggguaucacuucgguggcggcgaaccgcagcaccgcggcgg

SEQ ID NO: 4238257 - RNA, 104 nt, Mycobacterium bovis subsp bovis AF2122/97
cccgacgaggcgccgcgccaucccggguaucggcugcaccccgugguauuggaugcggcauugcaaagcgugggugccgcgauacccgacggcgagaucgcggg

SEQ ID NO: 4238258 - RNA, 65 nt, Mycobacterium bovis subsp bovis AF2122/97
ccaccucgacgagcaccauccggucccgccgugccgcggcgacggugagggcgucgucgaguugg

SEQ ID NO: 4238259 - RNA, 58 nt, Mycobacterium bovis subsp bovis AF2122/97
gccaggucaucgagcgaauccaccccgaucacggcgagcauggucgcgacggccuggc

SEQ ID NO: 4238260 - RNA, 90 nt, Mycobacterium bovis subsp bovis AF2122/97
ggugugcuggaagccauggguguucuccucgaccuugucgaacacgaugacggugucauagagcgagaacccgagaauggucagcaggcc

SEQ ID NO: 4238261 - RNA, 58 nt, Mycobacterium bovis subsp bovis AF2122/97
gucggcugaguuuagucaagcgcguggcuugccaugucguuaugagaacaucgccggc

SEQ ID NO: 4238262 - RNA, 66 nt, Mycobacterium bovis subsp bovis AF2122/97
ggcggcgcguugaucgcacucaaucacacgagcuacguggacuggguuccggcaucgaucgccgcc

SEQ ID NO: 4238263 - RNA, 56 nt, Mycobacterium bovis subsp bovis AF2122/97
cgcuugcgguugguggauucgggcuuugcggcauccccgaagcacugaucgcagcg

SEQ ID NO: 4238264 - RNA, 78 nt, Mycobacterium bovis subsp bovis AF2122/97
ccgaagcggcgcccaucgacuugcugcagcuggccgacggcggccagcucaaaaaguacgguucggcgcugcuggcgg

SEQ ID NO: 4238265 - RNA, 72 nt, Mycobacterium bovis subsp bovis AF2122/97
cagcgaggucggccucccaugcggcgaucucauuguuggggcgcaggucggcguaugggaaguacccuccug

SEQ ID NO: 4238266 - RNA, 77 nt, Mycobacterium bovis subsp bovis AF2122/97
cguugggcgcgagcagacgcaaaaggccccgaauccaacggauuucggggccuuuugcgucugcucgcgcccgugcg

SEQ ID NO: 4238267 - RNA, 65 nt, Mycobacterium bovis subsp bovis AF2122/97
ggcaccucggugaacccgguggcgggcgucgagcaugugcucgucaccgcgggcaccggggugcc

SEQ ID NO: 4238268 - RNA, 121 nt, Mycobacterium bovis subsp bovis AF2122/97
gcgugcucgccugauucgccgacauccgacuuucgccgagaucaacguucugcaggccgcuacucgcaccuugccugcaaaauguugaucucacggaugucggugcggagugccagcaugu

SEQ ID NO: 4238269 - RNA, 63 nt, Mycobacterium bovis subsp bovis AF2122/97
gucggcuugucgacggccucgguguacccguugcgggccgaggccgcguucgaguacgccgac

SEQ ID NO: 4238270 - RNA, 85 nt, Mycobacterium bovis subsp bovis AF2122/97
uggcucccccgccgcgcucgaucauccgcggugccgcaugcuuggugcacagccaggcgccgcggagauugaucgcgaugacccg

SEQ ID NO: 4238271 - RNA, 71 nt, Mycobacterium bovis subsp bovis AF2122/97
gcaaccggcuacgcugcuguucacgccaaugaacuaaaggguuggcgugaagcgugggggucggugggugc

SEQ ID NO: 4238272 - RNA, 127 nt, Mycobacterium bovis subsp bovis AF2122/97
augcccuucggaucgguauugguguuggcgaucaggucgaacgucucgugcuugggugggugaauggcucacccuaucuggucgcacgaggcgugccgguacaucgacacgccgguacugguggcau

SEQ ID NO: 4238273 - RNA, 56 nt, Mycobacterium bovis subsp bovis AF2122/97
cagacgcaaaagaacaugaugggcgcaccagcgcccaucauguucuuuugcgucug

SEQ ID NO: 4238274 - RNA, 72 nt, Mycobacterium bovis subsp bovis AF2122/97
cacgucggcgugggcuuuggaaacgccagccgcaaccgucccuaccccguuuucggagaccagcuugacgug

SEQ ID NO: 4238275 - RNA, 92 nt, Mycobacterium bovis subsp bovis AF2122/97
gcgcgaggguauucgucccggacggauuagccggacucaugcgggggucccgguggucgggccgguccgucgcggucggugcccucgucggc

SEQ ID NO: 4238276 - RNA, 56 nt, Mycobacterium bovis subsp bovis AF2122/97
gagcagacgcagaagucgccgauuucaccggaaaucggggacuucugcgucugcuc

SEQ ID NO: 4238277 - RNA, 73 nt, Mycobacterium bovis subsp bovis AF2122/97
gggcucgguguugucggcggccgggguguggucgucgcugagcgccgaauacgccgcggucgccgacgagcuc

SEQ ID NO: 4238278 - RNA, 73 nt, Mycobacterium bovis subsp bovis AF2122/97
caccgcggugcgccgcggcggccgggccaucgugcuguccggcgaucgguccaccccgcaggcgcuggcggug

SEQ ID NO: 4238279 - RNA, 59 nt, Mycobacterium bovis subsp bovis AF2122/97
gcgacgucugccucggcgcgcgccaucuggucacgggugccgccgagaugcagggucgc

SEQ ID NO: 4238280 - RNA, 55 nt, Mycobacterium bovis subsp bovis AF2122/97
caccuggcacugggugguggccugccuggcgauccaccacgccggcgccgcggug

SEQ ID NO: 4238281 - RNA, 60 nt, Mycobacterium bovis subsp bovis AF2122/97
ucgagcucacccaggguggccgcacagcggugcacgccguggucacccugggugagccgg

SEQ ID NO: 4238282 - RNA, 88 nt, Mycobacterium bovis subsp bovis AF2122/97
ggucggcagggcuugugcggcuaccccggcguccugcugcuccugauaccacagcggacggcucagguagucguucaagucggccgcc

SEQ ID NO: 4238283 - RNA, 92 nt, Mycobacterium bovis subsp bovis AF2122/97
cggccugcgcaucgaagaugguuugcugaagaagcugggugccgaggcgguggcucagcgggucaacgaggcgcugcacaaugcgcaggccg

SEQ ID NO: 4238284 - RNA, 56 nt, Mycobacterium bovis subsp bovis AF2122/97
uuggugcgguauccggggaagaguuugucgaacuccuccugcgccuggcgcaccga

SEQ ID NO: 4238285 - RNA, 67 nt, Mycobacterium bovis subsp bovis AF2122/97
caccagcucaucgccguagcugaggaccgcgaccccggugcucagcugcagugcggugggcgggaug

SEQ ID NO: 4238286 - RNA, 78 nt, Mycobacterium bovis subsp bovis AF2122/97
cggugaccguugucgacgaagugcacggcuuccgguuuuucgacaaccgugaucugcugggcuuugucgauggcaccg

SEQ ID NO: 4238287 - RNA, 90 nt, Mycobacterium bovis subsp bovis AF2122/97
gccgacuauccuugccaugugacugcggccgacaagcaccucuacgacaccgaucugcucgacgucuugucgcagcgagugauggucggc

SEQ ID NO: 4238288 - RNA, 70 nt, Mycobacterium bovis subsp bovis AF2122/97
gccggccauagcggccauggaauccaccuacgagcagaugugggcacaagacguggcggugauggccggc

SEQ ID NO: 4238289 - RNA, 61 nt, Mycobacterium bovis subsp bovis AF2122/97
gcggguucgggugcuagaugccgcauauuccgguaucggcuuucccgccgcccgaguucgc

SEQ ID NO: 4238290 - RNA, 64 nt, Mycobacterium bovis subsp bovis AF2122/97
gcuggugacccaggcgccggucggugugauggugggucaucugcagguuccuggguugaccggc

SEQ ID NO: 4238291 - RNA, 56 nt, Mycobacterium bovis subsp bovis AF2122/97
ugcgccgcgguugccgucgggaccgugccugggccccggccacgaccguggcggca

SEQ ID NO: 4238292 - RNA, 113 nt, Mycobacterium bovis subsp bovis AF2122/97
gcguucagcuucuccgggcucaagacggccgucgcgcgguauguggaaagccacgcggcugacccgggcuuccguaccgccgacauugccgccggauuccaggaggccgucgc

SEQ ID NO: 4238293 - RNA, 103 nt, Mycobacterium bovis subsp bovis AF2122/97
ccuuccauccgucggcuccggcaugagucgaagccucaacggaauacaccacaccgucgggugcuacgacuuugccgcucugcacgucguaaaugguuguagg

SEQ ID NO: 4238294 - RNA, 73 nt, Mycobacterium bovis subsp bovis AF2122/97
ggcgggcaauccggccugugucgggucgucccagcacguaacggacggcccgacacgggcucggccgcuagcu

SEQ ID NO: 4238295 - RNA, 87 nt, Mycobacterium bovis subsp bovis AF2122/97
gaaaggauauggcgaaugcgcacgaauugcugguggcgguuguccggcuaugucaugcggcaucggcgcgaucugcuguugggauuc

SEQ ID NO: 4238296 - RNA, 104 nt, Mycobacterium bovis subsp bovis AF2122/97
gcggcccgucacuugcgccgaaggugaacucacggcgagguuucgcggcgcucgcgaauucaugcccucaguucacguucgacguucgugaucaacggugccgc

SEQ ID NO: 4238297 - RNA, 65 nt, Mycobacterium bovis subsp bovis AF2122/97
cgauuguguaucgcaccgacuugaucguugacccugauguuuuggcggcgguggaugcgcaguug

SEQ ID NO: 4238298 - RNA, 95 nt, Mycobacterium bovis subsp bovis AF2122/97
gcagaaaggcaugcagguccuuaccgucgcugaccuuuuggcgucggauccgaucggccccaucgaggucggcgaggacgaccuggcguugaugc

SEQ ID NO: 4238299 - RNA, 79 nt, Mycobacterium bovis subsp bovis AF2122/97
gcggcuaccggaugcggugcgcgacggugaucgugugcuggcgaucguucguggcaccgcagccaaccaggauggccgc

SEQ ID NO: 4238300 - RNA, 61 nt, Mycobacterium bovis subsp bovis AF2122/97
uuguguaauuccugaaagcuuguugccaguagucugcuaacagucugccaggaaucgccaa

SEQ ID NO: 4238301 - RNA, 105 nt, Mycobacterium bovis subsp bovis AF2122/97
gaucggcccgcgugagcagcucggccuggcugcccagcccggccaccgcccagggcggcaccgucaggucggcuccgcucaaacgcgacaccaccaggcgcgauc

SEQ ID NO: 4238302 - RNA, 62 nt, Mycobacterium bovis subsp bovis AF2122/97
agaugugcggaucaucgagaucggcgccgcggucagcgugcugaucauccugauccucgucu

SEQ ID NO: 4238303 - RNA, 129 nt, Mycobacterium bovis subsp bovis AF2122/97
gaugaccggguguucgcuucgacggcucugaccgagagcgcggugauggccacccgcuggaacagggugcugggcgccuggcccaucaccgcggccuuuccgggcggggacgaauagcuacccggugac

SEQ ID NO: 4238304 - RNA, 102 nt, Mycobacterium bovis subsp bovis AF2122/97
gccagaauguacguggugacccgagccgggcaaccauuacacaguuggccagcacugaccaacuucauuuguagcgguuacccucaccuguacucauucggc

SEQ ID NO: 4238305 - RNA, 56 nt, Mycobacterium bovis subsp bovis AF2122/97
cucucggcgaaagucgacgacgugcggcggaucguacucgcagacgacgccgaggg

SEQ ID NO: 4238306 - RNA, 65 nt, Mycobacterium bovis subsp bovis AF2122/97
gcgccgagcagacgcagaaucgcccaauuucgugccgaaaugggcgauucugugucugcucgcgc

SEQ ID NO: 4238307 - RNA, 77 nt, Mycobacterium bovis subsp bovis AF2122/97
augcucgucgaggaaguagggucggcacaccucaaccuggauggucugacggugccaacccuggugaucggcggcgu

SEQ ID NO: 4238308 - RNA, 65 nt, Mycobacterium bovis subsp bovis AF2122/97
cggcgaguugguguuuccgcugcagguggugaucaaccugagcgauccggaaaccgacuacaccg

SEQ ID NO: 4238309 - RNA, 60 nt, Mycobacterium bovis subsp bovis AF2122/97
caaaggccuuuccugcugggcuguguugaggucgcaaacccagccaggguaaggccuuug

SEQ ID NO: 4238310 - RNA, 84 nt, Mycobacterium bovis subsp bovis AF2122/97
ggccugcucgaugauguugaccaucacccgcagcccgaucgccagggcucgcucgucgaugucgaacgucggcugaugcagguc

SEQ ID NO: 4238311 - RNA, 108 nt, Mycobacterium bovis subsp bovis AF2122/97
guuggagcaguugcacgcggauuaucuagugcaugccgugcguggcguggcuugacgauggauagguaaccacacaugccgcagggcaauccgcucgcagugcccaac

SEQ ID NO: 4238312 - RNA, 83 nt, Mycobacterium bovis subsp bovis AF2122/97
gucccccgcacgcgggugguacccccacugcaucgucgcuggcgcggugugggucccauccgucaguccaccgcccaugggac

SEQ ID NO: 4238313 - RNA, 122 nt, Mycobacterium bovis subsp bovis AF2122/97
caacgcgcguguggagcuggcggcguucaacgcggcggucaccgauugggagaggauacguggauuugagcgccucuagguccgaugguggcgacccgcugcgcccggcuucgccgcgcuug

SEQ ID NO: 4238314 - RNA, 95 nt, Mycobacterium bovis subsp bovis AF2122/97
ccaguucccggucggcgaucaucugccggacaugcgggugaguggugcgagcggugaccgcccaguccauccggcggacaucgucaccgggcugg

SEQ ID NO: 4238315 - RNA, 64 nt, Mycobacterium bovis subsp bovis AF2122/97
cgccgagcagacacagaaucgcacgaaaucagcccgcccaaugcgauucugcgucugcucggcg

SEQ ID NO: 4238316 - RNA, 104 nt, Mycobacterium bovis subsp bovis AF2122/97
cuggucgggucggugguggcggcgaccaccgucaauacgauguugcugcgcgucggggcgcgcucgucguaucugaugggguuggccgucuucggucuggccag

SEQ ID NO: 4238317 - RNA, 66 nt, Mycobacterium bovis subsp bovis AF2122/97
gugauagucgacgccggacgcgaggauggccggcggaaucaccggccgcgauccggcggcuaucac

SEQ ID NO: 4238318 - RNA, 88 nt, Mycobacterium bovis subsp bovis AF2122/97
ucgccgucggccacgguggcguugcgcgcgacggcgguuuugaugccgccgggaugcacgcacgucaccuugaccggaugccuggcga

SEQ ID NO: 4238319 - RNA, 56 nt, Mycobacterium bovis subsp bovis AF2122/97
gcgcgacaucgaacuggcguagcccuucuucggcuauggcggcgaucaguccgcgc

SEQ ID NO: 4238320 - RNA, 65 nt, Mycobacterium bovis subsp bovis AF2122/97
cggccauccgcuagccaacguuaauaaccgacccaccgguuguuagcuuggaaggugcuuggccg

SEQ ID NO: 4238321 - RNA, 57 nt, Mycobacterium bovis subsp bovis AF2122/97
gggucgaccaugggugcggugcccgcguugcugcggguccguuucccguggccgccc

SEQ ID NO: 4238322 - RNA, 57 nt, Mycobacterium bovis subsp bovis AF2122/97
ggagccguguucgcgauucugcccagggugacgugggccggaaucgaagcacgcucc

SEQ ID NO: 4238323 - RNA, 88 nt, Mycobacterium bovis subsp bovis AF2122/97
uggcucguggcacuuuccgccgcggucaucgcggccagcaccuggaugccuuggcugacgacgaccgucggcgguggaggcuggguca

SEQ ID NO: 4238324 - RNA, 93 nt, Mycobacterium bovis subsp bovis AF2122/97
gccggcggcaccggugggcccggcggauucggcaucuuuggcggcggcgccggcggggauggcggcucuggcgggcuguucggcgccggcggc

SEQ ID NO: 4238325 - RNA, 84 nt, Mycobacterium bovis subsp bovis AF2122/97
uggugugucaccaggccgccauggugggugccggcgucaacgccgccgacgcacccgccuauggcggccacaacgauuucgcca

SEQ ID NO: 4238326 - RNA, 55 nt, Mycobacterium bovis subsp bovis AF2122/97
gcagcggguuaggcagugcugcggugaguuccauugcggccacggcaaccugugc

SEQ ID NO: 4238327 - RNA, 55 nt, Mycobacterium bovis subsp bovis AF2122/97
cucguggcuaccgcaucgcugcucgacccggcgcggugacacggcgggccgcgag

SEQ ID NO: 4238328 - RNA, 129 nt, Mycobacterium bovis subsp bovis AF2122/97
ccgguguuguagcugcccgcguuggcgacaccgguguugacgaugccgguguugaagaagcccguguuagugcugccgguguugccgaugccgguguugccgcugccggaguugccgauaccccaguug

SEQ ID NO: 4238329 - RNA, 69 nt, Mycobacterium bovis subsp bovis AF2122/97
gacguaugcgcggacgaaguccucggcguucuccucgaggacgucgucgauuucgucgagcagaucguc

SEQ ID NO: 4238330 - RNA, 65 nt, Mycobacterium bovis subsp bovis AF2122/97
ucgccagccguuggcguggaaaagcguugcacccucgcggcccauuccacugccggcgccgguga

SEQ ID NO: 4238331 - RNA, 109 nt, Mycobacterium bovis subsp bovis AF2122/97
ccgcgccgagcgugggcuggcugcgccgaaugugcacugguggcggagacacacccaggcgaugccgcccugguugcacguucggcgugucagcuugugacggaugugg

SEQ ID NO: 4238332 - RNA, 90 nt, Mycobacterium bovis subsp bovis AF2122/97
gcuuguuggacaacgucgauggugcgcuggcgcaucgcgucgauuccgaucugcggaugcggcaguucaucaccgacgccagccacgagc

SEQ ID NO: 4238333 - RNA, 60 nt, Mycobacterium bovis subsp bovis AF2122/97
cggcgcggugucgguguugaccgaggccagggaguggucgguugacgggcguccgcgccg

SEQ ID NO: 4238334 - RNA, 57 nt, Mycobacterium bovis subsp bovis AF2122/97
ugcuggccgcgcuggcgugggugugcgccgaugccauccugcuggugcggaccggca

SEQ ID NO: 4238335 - RNA, 86 nt, Mycobacterium bovis subsp bovis AF2122/97
guaagccuccucgcgccgcgacugggaauccugcgacgcgacacgccgacaaggcgucgugagauucacagucgcagcgcggcuuc

SEQ ID NO: 4238336 - RNA, 70 nt, Mycobacterium bovis subsp bovis AF2122/97
cgugcugcgugccgacgacgugguguucagcguugaggcgcugaaugccuauaucgcggccaacaccacg

SEQ ID NO: 4238337 - RNA, 111 nt, Mycobacterium bovis subsp bovis AF2122/97
ggugccgguggugcugcugggauguucggcaccggcggcgccggugggaccggcggggacggcggcgccggcggugccggcgacaguccuaacagcggugccaacggcgcc

SEQ ID NO: 4238338 - RNA, 94 nt, Mycobacterium bovis subsp bovis AF2122/97
gcaacucggccaacucagggagcagugccgugcggcaaaggaacgacuguccaccgacguugccacggaauuguucgcugagcuugccgggugc

SEQ ID NO: 4238339 - RNA, 77 nt, Mycobacterium bovis subsp bovis AF2122/97
uccgcgccuggaagcugcaugacgaacucggccugaacauugucaugccgguucuuccgaugcaugguccccgcggg

SEQ ID NO: 4238340 - RNA, 86 nt, Mycobacterium bovis subsp bovis AF2122/97
gcguugugguguguugccaagaucguugauccccagugcuugugccaaucgcuuggcugggucaaucgucaaaacgaccacagugc

SEQ ID NO: 4238341 - RNA, 77 nt, Mycobacterium bovis subsp bovis AF2122/97
gccgucggguaucgcggcacccacgcuuugcaaugccgcauccaauaccacggggugcagccgauacccgggauggc

SEQ ID NO: 4238342 - RNA, 75 nt, Mycobacterium bovis subsp bovis AF2122/97
auucggugcgcuggcggcgcagcguguugcguucggugaucucguaguacgacaucgccgucagcggcggcgagu

SEQ ID NO: 4238343 - RNA, 62 nt, Mycobacterium bovis subsp bovis AF2122/97
cgcgaaaagacgcaaaagcucccaaauccggucggauuugggagcuuuugcgucugcucgcg

SEQ ID NO: 4238344 - RNA, 90 nt, Mycobacterium bovis subsp bovis AF2122/97
gcaccggcgcggugcuggcggucggugccgucgaugcccugugcgaacagaucguggccggcgccgaccgcgacggcgacguguuggugc

SEQ ID NO: 4238345 - RNA, 110 nt, Mycobacterium bovis subsp bovis AF2122/97
cggugggcccguuggacgcgugguggucgaaguaggccagcacaucguggcggcagcgccacagggugcggccuaguuuggccaguuccucuaguacgacagggacaccg

SEQ ID NO: 4238346 - RNA, 63 nt, Mycobacterium bovis subsp bovis AF2122/97
gugaucgauguugaccgagaugccgccgaggucgaucuugucgccgucucgguccagcuccac

SEQ ID NO: 4238347 - RNA, 56 nt, Mycobacterium bovis subsp bovis AF2122/97
gcgccgaugccgacgacaccaguuggcugcuggugucguccaugauucggccgagc

SEQ ID NO: 4238348 - RNA, 57 nt, Mycobacterium bovis subsp bovis AF2122/97
cgaucgccugcuggggcgccaucuggcggaguccagaccgcucgacgcgggcgaucg

SEQ ID NO: 4238349 - RNA, 60 nt, Mycobacterium bovis subsp bovis AF2122/97
gccaccgguggucgccgagccaccgacccggggucgguauucgagccgucaccguugugc

SEQ ID NO: 4238350 - RNA, 56 nt, Mycobacterium bovis subsp bovis AF2122/97
gagcagacgcagaaguccccgauuuccggugaaaucggcgacuucugcgucugcuc

SEQ ID NO: 4238351 - RNA, 69 nt, Mycobacterium bovis subsp bovis AF2122/97
ggcuucgcgagcguaaccggacugcgaaaauccgugccgaaaaucgcagccacguuacgcucgcgggcc

SEQ ID NO: 4238352 - RNA, 94 nt, Mycobacterium bovis subsp bovis AF2122/97
gugcgaacacgguaccgggaucggcgccagguccgaucgccgaugugaugcggcgguggaucucggcgccgauucggucgcgcaccgcacgcac

SEQ ID NO: 4238353 - RNA, 78 nt, Mycobacterium bovis subsp bovis AF2122/97
ucccagucgugguagagcaccugggcgagcuugcugucgugccgagcugcggccaccugcucggccguggcaugugga

SEQ ID NO: 4238354 - RNA, 86 nt, Mycobacterium bovis subsp bovis AF2122/97
gcggugagcacgagauugccgucauggcugugguuggagcggcgaaaaucacagcccugaacgcaaucugggcgcggcuuauccgc

SEQ ID NO: 4238355 - RNA, 66 nt, Mycobacterium bovis subsp bovis AF2122/97
cgccgaguaccgcgcgauguuccucgacccucugaucgacgaccugcacaccgcgcugcucgcgcg

SEQ ID NO: 4238356 - RNA, 65 nt, Mycobacterium bovis subsp bovis AF2122/97
gcgccgagcagacgcagaaucgcacgcggaagccuuuccgcgugcgauucugcgucugcucgcgc

SEQ ID NO: 4238357 - RNA, 113 nt, Mycobacterium bovis subsp bovis AF2122/97
ccucgacgacgaagcgcuggccgaugugaugcgcaucgccgccgugcacacaaagaaggaagccgugaaccucgcgaugcgcgauuacgucgaacgguuucggcgcaucgagg

SEQ ID NO: 4238358 - RNA, 75 nt, Mycobacterium bovis subsp bovis AF2122/97
ggcgccgaucauuucggugauuccggcauucaccgcuuucgcguucaucccguuuggucccgaggugucgguguu

SEQ ID NO: 4238359 - RNA, 96 nt, Mycobacterium bovis subsp bovis AF2122/97
cccgguagcguguagcgccgagauugacguuuugcagacgcccucucgcacuuucacugcaaaacgucagucucggugaaagucaguccacccggg

SEQ ID NO: 4238360 - RNA, 84 nt, Mycobacterium bovis subsp bovis AF2122/97
ccucccaguuguuugacuuauaucaaaauggcgccgaacccagugugcaacaucucuuugauauaugucaagguaucuggcagg

SEQ ID NO: 4238361 - RNA, 88 nt, Mycobacterium bovis subsp bovis AF2122/97
caucuguugggggccgcgcgccgccgcgccuuccggguguggcuggacgcgcgccggaacgcccugguggugcuggcccccggcuaug

SEQ ID NO: 4238362 - RNA, 69 nt, Mycobacterium bovis subsp bovis AF2122/97
ugcgcugacucugcguccaccacgggaaugugcgaguagcccacacgguggacgcagagucaacgugua

SEQ ID NO: 4238363 - RNA, 113 nt, Mycobacterium bovis subsp bovis AF2122/97
uggcgccgguaccggcggcagcgguggugucggcggcaacgccgugcugaucggcaacggcggcaacggcggcaacgccggcaaagccggggccacgcccggugccggcggca

SEQ ID NO: 4238364 - RNA, 66 nt, Mycobacterium bovis subsp bovis AF2122/97
ugaaaugccagcgcgaagaccgccaggucauagcuguggccguggccgucgauugcgguggcgucg

SEQ ID NO: 4238365 - RNA, 69 nt, Mycobacterium bovis subsp bovis AF2122/97
gcggcguggaaugcaugaucgucgccaacgacccgacggucaagggcggcaccagcaauccguggacgc

SEQ ID NO: 4238366 - RNA, 70 nt, Mycobacterium bovis subsp bovis AF2122/97
ggcgacggcgagcagacgcaaaaucgcccaacacgcccgcaaaaugggcgauuuugcgucugcucgcgcc

SEQ ID NO: 4238367 - RNA, 66 nt, Mycobacterium bovis subsp bovis AF2122/97
cggcgagcagacgcaaaacccccuucucgucggcgugucgagggacuuaugcgucugcuagcgccg

SEQ ID NO: 4238368 - RNA, 61 nt, Mycobacterium bovis subsp bovis AF2122/97
ggucaccgucacgcucgagccgcagggcgcggaccggcucucgauugcggcgacggugacc

SEQ ID NO: 4238369 - RNA, 110 nt, Mycobacterium bovis subsp bovis AF2122/97
ccucgcguuucuucuugcccauggccuugcguagaaugucggcgcgggccaacgaguagcucgccaccuucugcgcgaugcgcaugaucugcucuugauagacgaugagg

SEQ ID NO: 4238370 - RNA, 84 nt, Mycobacterium bovis subsp bovis AF2122/97
gcgggguccacccggccgaacugacgugcuucggcggcgccgucggcaucggugagggcaucgucggucgccggggacagccgc

SEQ ID NO: 4238371 - RNA, 89 nt, Mycobacterium bovis subsp bovis AF2122/97
gccggaucuggccaaggcuggagcgcacagcgcgggcggcccggagccggccgcgcgguagcggucuagguccaucggccguauuaggc

SEQ ID NO: 4238372 - RNA, 68 nt, Mycobacterium bovis subsp bovis AF2122/97
cggccugauagacgucggcucgcugcaacuggaaagcggggcggugaucgacgaugucuguaucgccg

SEQ ID NO: 4238373 - RNA, 60 nt, Mycobacterium bovis subsp bovis AF2122/97
gcgagcagacgcaaaaucgcccauuuucaugacgaaaagggcgauuuugcgucugcucgc

SEQ ID NO: 4238374 - RNA, 84 nt, Mycobacterium bovis subsp bovis AF2122/97
guugcacgucggugccgacggccuagagaccgcaacuacggcgcgcgccguggcggucgcuagguccggaauggauuguguggc

SEQ ID NO: 4238375 - RNA, 56 nt, Mycobacterium bovis subsp bovis AF2122/97
cgcgcccaacaagucgacguccggcgcuaagccagccgcgguggcucgugggcgcg

SEQ ID NO: 4238376 - RNA, 82 nt, Mycobacterium bovis subsp bovis AF2122/97
gcggacgacuuggucacgguguucgguguggccgucgacccggucgacguucggguccggcgcuggaucgaggcgaugccgc

SEQ ID NO: 4238377 - RNA, 73 nt, Mycobacterium bovis subsp bovis AF2122/97
ggcggcucagcaaauacuggagauagcuaaccuaacggauagguaaauaaauccguguuugccgauggucgcu

SEQ ID NO: 4238378 - RNA, 102 nt, Mycobacterium bovis subsp bovis AF2122/97
gccgggucaccgacgccucgguggucgucggggcggcggccgcgcacuucggcuggggccgcaccgacuaccaccgacuggccggcgccgugguggccgggc

SEQ ID NO: 4238379 - RNA, 87 nt, Mycobacterium bovis subsp bovis AF2122/97
gcaggucggcgaugcguuggagauuggagacgucggccgcgucacguuugacgacgcggucgacguuccuagcuuucgccgauucgc

SEQ ID NO: 4238380 - RNA, 69 nt, Mycobacterium bovis subsp bovis AF2122/97
ccgccgagguaggucagggcguauuugucguagcggguugcgaugccgcgccacugcuugagucgaugg

SEQ ID NO: 4238381 - RNA, 57 nt, Mycobacterium bovis subsp bovis AF2122/97
cagcguaugggcgggcaggcgacccaaccgguguuccagcccgacucauacccgcug

SEQ ID NO: 4238382 - RNA, 63 nt, Mycobacterium bovis subsp bovis AF2122/97
ccgggcgccaccgcgauggcgucauuggauccaaugcuuugacgaccgcggugagcgcagcgg

SEQ ID NO: 4238383 - RNA, 82 nt, Mycobacterium bovis subsp bovis AF2122/97
agcccccgcccgccccgguguugaagaagcccgacgacggaacgguggugguguucccaaugcccggggugggcgggauguu

SEQ ID NO: 4238384 - RNA, 56 nt, Mycobacterium bovis subsp bovis AF2122/97
cgagcguaaccuggcugcgauuuccggcgcggauuuucgcagugcgguuacgcucg

SEQ ID NO: 4238385 - RNA, 70 nt, Mycobacterium bovis subsp bovis AF2122/97
ggaugcaucagccacaccagcccuuaugcgguugcaucgggauuaugacgacugcagguugguggcaucc

SEQ ID NO: 4238386 - RNA, 59 nt, Mycobacterium bovis subsp bovis AF2122/97
ggugacggucgucgcggcggcaguggcgacgccggcgacggccaccgcgaaccgucgcc

SEQ ID NO: 4238387 - RNA, 58 nt, Mycobacterium bovis subsp bovis AF2122/97
guuggccuggcagcggcgcgggugugauuggccgcgcaaccgcgacgcucaggccagc

SEQ ID NO: 4238388 - RNA, 65 nt, Mycobacterium bovis subsp bovis AF2122/97
ucgccgagccuguaauuuugcaggcccccacucgcacuuugccugcagaguuacagccucagcga

SEQ ID NO: 4238389 - RNA, 62 nt, Mycobacterium bovis subsp bovis AF2122/97
cgcgagcagacgcaaaaucgcccuuuucgucaugaaaaugggcgauuuugcgucugcucgcg

SEQ ID NO: 4238390 - RNA, 60 nt, Mycobacterium bovis subsp bovis AF2122/97
auucacuggauagccacacuauggugccgacacugaccauguugggccgauucagcgaau

SEQ ID NO: 4238391 - RNA, 76 nt, Mycobacterium bovis subsp bovis AF2122/97
ggacgcgaucaccaucgggaaauuccauggcgugaucacaccgaccacgcccaucgguucguugaaagugacgucc

SEQ ID NO: 4238392 - RNA, 129 nt, Mycobacterium bovis subsp bovis AF2122/97
gauggcgacggugccgaccaccguggccuggggcagcugcaacaucaaaccgacuccguucuugaagcuagggaacgggacggggucgguauagaugucggucuuccaggaaguggccggauugccguc

SEQ ID NO: 4238393 - RNA, 71 nt, Mycobacterium bovis subsp bovis AF2122/97
ggugccgguacugcugcagcgucugccgcaggaagauguccugccagccgccgacgagcagcaccgggacc

SEQ ID NO: 4238394 - RNA, 77 nt, Mycobacterium bovis subsp bovis AF2122/97
ucagcauucccggggugcagaagccgcauugcagcccguggcagcgcaugaacccuuccugcaccgggucgagcugg

SEQ ID NO: 4238395 - RNA, 103 nt, Mycobacterium bovis subsp bovis AF2122/97
agucggcccauggagcauguggcugcggagaucuaccagcucgaccggcucagagcggucggcgaaggugaucucgcuggccaggucgcauaccgguacgacu

SEQ ID NO: 4238396 - RNA, 102 nt, Mycobacterium bovis subsp bovis AF2122/97
gugcugccauugccgcaugcucagcaucgucgaauccucgcgaaaccgccgucccggcucgagcucggcgaugcugagccggucauagucgaauggcaacac

SEQ ID NO: 4238397 - RNA, 57 nt, Mycobacterium bovis subsp bovis AF2122/97
gucggcgcgguugucccgguucgucggauaacggcgagcgguauggccggcgcugac

SEQ ID NO: 4238398 - RNA, 126 nt, Mycobacterium bovis subsp bovis AF2122/97
cggugaugcugugacggaucggcgggccaacacgaggaauucgcacccgcugccggcgugaccaacgccacgcuggcagcaaucggguauccgaucgcguuggccagcaagcuguuggcgauaucg

SEQ ID NO: 4238399 - RNA, 129 nt, Mycobacterium bovis subsp bovis AF2122/97
gcccagguuucggcgugaccccaaauacgugguggcgaucgguugucccgcgacaagcucgcggaccgggcugucgccgcaaccgucguuaucgaccacgaucaggugguccgguaaccgggucugggc

SEQ ID NO: 4238400 - RNA, 56 nt, Mycobacterium bovis subsp bovis AF2122/97
gcuccggcgucugguggcgguggcugggucucggccggugcugccgacgcuggcgc

SEQ ID NO: 4238401 - RNA, 93 nt, Mycobacterium bovis subsp bovis AF2122/97
ccgagaguccauggaagucgacguguccaagcugcaugccgccgguuugugggcgacgaugcagcaggaccggugagauucgaggauauucgg

SEQ ID NO: 4238402 - RNA, 103 nt, Mycobacterium bovis subsp bovis AF2122/97
ccgccgaucucccgcagcugccgcauggccgccgacgccaggucgucauaggaguggucgagcuuggcccggccggccgcggucagccgguagcgcuuggcgg

SEQ ID NO: 4238403 - RNA, 58 nt, Mycobacterium bovis subsp bovis AF2122/97
guuggcgauguucucguugucgcaguggcaggaagcgaucuacgcgcgcaucgucgac

SEQ ID NO: 4238404 - RNA, 55 nt, Mycobacterium bovis subsp bovis AF2122/97
ugccgguccuccgaacggaugucacguucacccgucaucgguucucgggccagca

SEQ ID NO: 4238405 - RNA, 74 nt, Mycobacterium bovis subsp bovis AF2122/97
gaggggaauggcguguaccgaggccagcgccagcacgaacagcgcgguggccucgaggaacacgacaaccucuc

SEQ ID NO: 4238406 - RNA, 75 nt, Mycobacterium bovis subsp bovis AF2122/97
accgccccuucgcgagcagacgcggaaucgcaucggcggggcccacacggugcgauuccgcgucugcucggcggu

SEQ ID NO: 4238407 - RNA, 71 nt, Mycobacterium bovis subsp bovis AF2122/97
gaaccuguuagcgcccggccacuggccaaugauggucuuccggauuggccaugcgcgggcgccgucaguuc

SEQ ID NO: 4238408 - RNA, 62 nt, Mycobacterium bovis subsp bovis AF2122/97
ggcgcgugucggagagcccacggaugcggcggguacguauccagggcaugcugaccgucgcc

SEQ ID NO: 4238409 - RNA, 63 nt, Mycobacterium bovis subsp bovis AF2122/97
ggucauugcgucauuuccuucgauugacuuuugcuggucguuucgaaggaucacgcgaugacc

SEQ ID NO: 4238410 - RNA, 63 nt, Mycobacterium bovis subsp bovis AF2122/97
gccgagcagacgcaaaagcccccaauucgggcacgaaaugggggcuuuuacgucugcucgcgc

SEQ ID NO: 4238411 - RNA, 83 nt, Mycobacterium bovis subsp bovis AF2122/97
ggcguuugcggguuuucggcuccgugcgagcgggauagcgacacaggucacgucgcgaucgcuggagcagaacccgcuaaguc

SEQ ID NO: 4238412 - RNA, 57 nt, Mycobacterium bovis subsp bovis AF2122/97
uggucugguuggcgucgccgacgacggucaggucgucccgaucacccaaccaggccg

SEQ ID NO: 4238413 - RNA, 130 nt, Mycobacterium bovis subsp bovis AF2122/97
ggcaaugguuucggcggcuaccacgccuugugccucggcgacgugcgccagcugcaguaauccauugacaucgccgauagcguagauguggcccacguugguacgcauguagucgucgacaccgauagcc

SEQ ID NO: 4238414 - RNA, 59 nt, Mycobacterium bovis subsp bovis AF2122/97
cuaccgcgcugaccgacguuuggcgcgcgcugcgcgccaguaugcggucggugcuggag

SEQ ID NO: 4238415 - RNA, 73 nt, Mycobacterium bovis subsp bovis AF2122/97
gguggccgucggugucgucuccgugcugagccuaagcggcuaugucaccgcgaugaacgacgccgagcuaguc

SEQ ID NO: 4238416 - RNA, 84 nt, Mycobacterium bovis subsp bovis AF2122/97
gacccgcgcgugagucucguucuugccgaacccauuggccugcaaugguucggcaaucagaucgaagaccggcagccgcggguc

SEQ ID NO: 4238417 - RNA, 116 nt, Mycobacterium bovis subsp bovis AF2122/97
caucacuucccgcagcacguaggaccuccguccggcgagcagucgcauaagcccccgcacgcacggcgugucgggggcuuuagcgacugcucgcggagguugcgcugggguugaug

SEQ ID NO: 4238418 - RNA, 63 nt, Mycobacterium bovis subsp bovis AF2122/97
gcgcuguggcucacgacgacgaugucgccgucccagucaccgucgucgagguaacgcaugcgc

SEQ ID NO: 4238419 - RNA, 102 nt, Mycobacterium bovis subsp bovis AF2122/97
ggucgguggggaugaggcguggguugugaacggaaccgccgggacuguaugagucugugcgcgguuugugcacagcgacacucacagccaaucucugugacu

SEQ ID NO: 4238420 - RNA, 56 nt, Mycobacterium bovis subsp bovis AF2122/97
ggacgauguggucguggucuccgugccaccagcggacggggacuuucaccucgucc

SEQ ID NO: 4238421 - RNA, 56 nt, Mycobacterium bovis subsp bovis AF2122/97
ugauuccgcucggcucgugcacgaugaaacucaacgccgccgccgagauggagucg

SEQ ID NO: 4238422 - RNA, 74 nt, Mycobacterium bovis subsp bovis AF2122/97
gcggcagguuugcgccccgacgguucgguugccgaucgcuccagcaggauuuggugaaucgucggaaccgccgu

SEQ ID NO: 4238423 - RNA, 109 nt, Mycobacterium bovis subsp bovis AF2122/97
cgcgcuugaugcgggcgguucggagacguuguauggcgagaucgagcguuucgauaccucggucuugcucgacguucgcgcaaaagccgcccugagguaugcagaugcg

SEQ ID NO: 4238424 - RNA, 65 nt, Mycobacterium bovis subsp bovis AF2122/97
gucuggccgagcuggucaacggcgccggcaucgacgacgccgccgucgugaccugccggccggac

SEQ ID NO: 4238425 - RNA, 59 nt, Mycobacterium bovis subsp bovis AF2122/97
ucucgccgagguuagcggcauccgucggauccgcaagggugccgcggcugcggugauga

SEQ ID NO: 4238426 - RNA, 79 nt, Mycobacterium bovis subsp bovis AF2122/97
cccaagcugcgacgggccgggcuggacuaccacgaccuggccucggucaccguucaugccucgcucgcgcacgccuggg

SEQ ID NO: 4238427 - RNA, 73 nt, Mycobacterium bovis subsp bovis AF2122/97
cuggccuaaguuuggaugcugccgucucggagaucaggaugacguccggaagcagcuccggauucaaggucag

SEQ ID NO: 4238428 - RNA, 76 nt, Mycobacterium bovis subsp bovis AF2122/97
cgccgccauccgcgcgacgaacuugucgacgaaaucgucguaaaugucggcguggacgaugaaccgcuuggcggcg

SEQ ID NO: 4238429 - RNA, 55 nt, Mycobacterium bovis subsp bovis AF2122/97
gcgccgccggggaucccgaccugcuggugucgcgggucgcggucugcggcggcgc

SEQ ID NO: 4238430 - RNA, 117 nt, Mycobacterium bovis subsp bovis AF2122/97
cgcagcugggacgcggcggcgcacugagugccgagcgugcaucuggggcgggaauucggcgauuuuuccgcccugaguucacgcucggcgcaaucgggaccgaguuuguccagcgug

SEQ ID NO: 4238431 - RNA, 89 nt, Mycobacterium bovis subsp bovis AF2122/97
gcuuuucgucuuccuacuucgguuugugcugacuaguucggguucagucgggcagucgugccucggccgcagcuagacgagacgagagc

SEQ ID NO: 4238432 - RNA, 97 nt, Mycobacterium bovis subsp bovis AF2122/97
cugugaugguguucgugugugccgagauauccagcgguacugcugaauuagcggccaguacggccccguguccggcucgcaggagccagccguccag

SEQ ID NO: 4238433 - RNA, 90 nt, Mycobacterium bovis subsp bovis AF2122/97
gcccggcuagguagucggccagguacggcaucagcauguagaagccgauguugaugccgaacugguugaucaucaacacccggcucgggc

SEQ ID NO: 4238434 - RNA, 70 nt, Mycobacterium bovis subsp bovis AF2122/97
ggcugcgcgagacgcaaaaucgcccaaaaccacugguuuucgggcgauuuugcgucucgucgcgcaagcc

SEQ ID NO: 4238435 - RNA, 99 nt, Mycobacterium bovis subsp bovis AF2122/97
gugccgcacgccgagcguuguccgcauucgcagcgacgguaaaggacuugcgggccaauccuuuccgucgaugcggaagcgaacgaacgcuagcggcgc

SEQ ID NO: 4238436 - RNA, 66 nt, Mycobacterium bovis subsp bovis AF2122/97
gcguuugacucugcggauaccaggcaauugugcgaguggcccgcgugguaagcgcagagucaacgc

SEQ ID NO: 4238437 - RNA, 91 nt, Mycobacterium bovis subsp bovis AF2122/97
gacggacccaaucaccgugccggucgccuaagccccgggucggccgaaaacgcacccgcggccaaggcgucggucauugcuucggcccguc

SEQ ID NO: 4238438 - RNA, 66 nt, Mycobacterium bovis subsp bovis AF2122/97
ggcggcuuucaucaguuggucgagguugaccccggcgucgaugucgaccagcuuggugucggcguc

SEQ ID NO: 4238439 - RNA, 81 nt, Mycobacterium bovis subsp bovis AF2122/97
ucuaugccggucgcggucgggaguacaugccguuccuggacgagguaguggcgguggcacccggccgggucacgguguggg

SEQ ID NO: 4238440 - RNA, 86 nt, Mycobacterium bovis subsp bovis AF2122/97
ggacaccgucacccugcgacugguggcccgcacccuacccggcaagcaguucgaggcgggccggcaguugcgggugcuggugaucc

SEQ ID NO: 4238441 - RNA, 83 nt, Mycobacterium bovis subsp bovis AF2122/97
cggacgcgguaccgauauuggccaagaagcugaagcccauccggucaacacaguccugggccaacugccgguagaccuguucg

SEQ ID NO: 4238442 - RNA, 55 nt, Mycobacterium bovis subsp bovis AF2122/97
cgccggcggcaguaccggcccgagcccgacgcugggccggcacugcugucgugcg

SEQ ID NO: 4238443 - RNA, 87 nt, Mycobacterium bovis subsp bovis AF2122/97
gccuagcguuccccuggcgagcagacgcaaaaucgcccaauucggcacgaaauugggcgauuuugcgucugcucgccaggccuaggc

SEQ ID NO: 4238444 - RNA, 93 nt, Mycobacterium bovis subsp bovis AF2122/97
ggaagccugaguacggcgagcagacgcagaaucgcaugcgcgggaccccgcgcagugcgauucugcgucugcucgcgcgguagguuggcaccc

SEQ ID NO: 4238445 - RNA, 58 nt, Mycobacterium bovis subsp bovis AF2122/97
gcuucucgucgggaauguugagguccuucuggaacuucagcaccaccgacgcgaacgc

SEQ ID NO: 4238446 - RNA, 77 nt, Mycobacterium bovis subsp bovis AF2122/97
cagugcgcgagcagacgcaaaagcaccccaagucgggcgauuuugggggcuuuugcgucugcucgcgggacgcgcug

SEQ ID NO: 4238447 - RNA, 79 nt, Mycobacterium bovis subsp bovis AF2122/97
gugcagaaacugccgacgucgauggugguuucacgggcccggcuccaacucgccaucgcgugggcgaacauucugcugc

SEQ ID NO: 4238448 - RNA, 72 nt, Mycobacterium bovis subsp bovis AF2122/97
cggcgaccaccaccggguuggcguccagcgcggugugcgccagcaccgcgucggccucagccggaaacgccg

SEQ ID NO: 4238449 - RNA, 77 nt, Mycobacterium bovis subsp bovis AF2122/97
ccucccgggacgaccgcaggucggcaacgucggugauccccagccggcgcagcguugcccggccggcgucgucgagg

SEQ ID NO: 4238450 - RNA, 81 nt, Mycobacterium bovis subsp bovis AF2122/97
gacgacguccugugcacggcgaugcggucuggcaagugucggcgcugccaguaccucucgaugccaacaggaucgucgguc

SEQ ID NO: 4238451 - RNA, 63 nt, Mycobacterium bovis subsp bovis AF2122/97
ccagcguggacguacugucgucgcccugacacaacaccggcguggacagccguucgcgcaugg

SEQ ID NO: 4238452 - RNA, 90 nt, Mycobacterium bovis subsp bovis AF2122/97
ccgguggugcucgucggugucgguucggucggccugcgaacacgcgaugaugaguucgcgcaucaacggauugaccgcgagcaccgucgg

SEQ ID NO: 4238453 - RNA, 61 nt, Mycobacterium bovis subsp bovis AF2122/97
cgccuugggaugcuaacagcgccagcggguugaguucgcugccucgcugggcgcccaggcg

SEQ ID NO: 4238454 - RNA, 69 nt, Mycobacterium bovis subsp bovis AF2122/97
gacgcauggccaaccucccgacugguacccgcgccggcucgguuacgccgguugugguuggccgugcuc

SEQ ID NO: 4238455 - RNA, 68 nt, Mycobacterium bovis subsp bovis AF2122/97
augcuccggcucacccagggugaccacggcgugcaccgcugugcggccacccugggugagcucgacau

SEQ ID NO: 4238456 - RNA, 63 nt, Mycobacterium bovis subsp bovis AF2122/97
guggugagguuguguccaacgguggcgaucacccgucguccaaugaaccacaaccccgcgcac

SEQ ID NO: 4238457 - RNA, 71 nt, Mycobacterium bovis subsp bovis AF2122/97
cugcacacagguacgcgggucggugucuugcgcacaagcaucacgcagcaucguccagcugcuuugugcgg

SEQ ID NO: 4238458 - RNA, 59 nt, Mycobacterium bovis subsp bovis AF2122/97
gcccaucgagauucgcggacugaccaagcacuucgggucggugcgggcgcucgacgggc

SEQ ID NO: 4238459 - RNA, 79 nt, Mycobacterium bovis subsp bovis AF2122/97
ggacauuccgcugcgcguuaaggccgccgcgguggggcuggccgccgacgaguaccacgcgcaggacgucguugugucc

SEQ ID NO: 4238460 - RNA, 61 nt, Mycobacterium bovis subsp bovis AF2122/97
ugcugcggcucgucuacggcgggcagagguugagauugcccgccgcggcgagccgguagca

SEQ ID NO: 4238461 - RNA, 75 nt, Mycobacterium bovis subsp bovis AF2122/97
gcccgccauggcucgcccagcugcgccgccgucugcggaucggcguacagcucggcagccggguuguccucgagc

SEQ ID NO: 4238462 - RNA, 55 nt, Mycobacterium bovis subsp bovis AF2122/97
gccggugcuggcgaguuggcgguccgacaggcccagcucggccaaaagcgccggc

SEQ ID NO: 4238463 - RNA, 55 nt, Mycobacterium bovis subsp bovis AF2122/97
ggccugguugggugaucgggacgaccugaccgucgucggcgacgccaaccagacc

SEQ ID NO: 4238464 - RNA, 61 nt, Mycobacterium bovis subsp bovis AF2122/97
ucggcaggcugcgccagcugccgcaacccccgcacaccccggcgcugucccggccugcugg

SEQ ID NO: 4238465 - RNA, 56 nt, Mycobacterium bovis subsp bovis AF2122/97
cgagcaucugaacgccugggugucggccaucgaaacguccggcguucuggugcucg

SEQ ID NO: 4238466 - RNA, 78 nt, Mycobacterium bovis subsp bovis AF2122/97
gcgacgcgaggugaugagggcggcgaguaaggucgagcccgugccggugcuagcggcccucauucaaaccggcgucgc

SEQ ID NO: 4238467 - RNA, 80 nt, Mycobacterium bovis subsp bovis AF2122/97
gcaucguguugacucugcguccaccaggcggguuacucgcacuuuugcgugguggacgcagagucaacggauaacggugc

SEQ ID NO: 4238468 - RNA, 85 nt, Mycobacterium bovis subsp bovis AF2122/97
cgggggucuuugcgucgagaucgacggcagcgcccccgcgagagagagcaucgcgcugacgucgaucucgaugcgucaacacccg

SEQ ID NO: 4238469 - RNA, 99 nt, Mycobacterium bovis subsp bovis AF2122/97
ccagcaagaucguuaaggggggcggcucgggcauccugaugaacguugugaucggcgucgucggggcauucggcgccggcuugguccuuaacgcgcugg

SEQ ID NO: 4238470 - RNA, 69 nt, Mycobacterium bovis subsp bovis AF2122/97
agaucuccgagaaggaagaagccgaccgcaagaacaagguccgcggcggcgacgucuucucgccggucu

SEQ ID NO: 4238471 - RNA, 91 nt, Mycobacterium bovis subsp bovis AF2122/97
guggcgacggucugauagaacugguuguccagaaucgauugcgcccguucggguccagaguauugcauaaccauuucgucaaacgugcggc

SEQ ID NO: 4238472 - RNA, 68 nt, Mycobacterium bovis subsp bovis AF2122/97
gcaguucacggccaugaugcaguucuacgacgacggcguuguacagcuggaucgugcugcacucacgc

SEQ ID NO: 4238473 - RNA, 60 nt, Mycobacterium bovis subsp bovis AF2122/97
uccgguagagccgguuucgccgacgaacccuaggucgucggcaagcccgggcucgccgga

SEQ ID NO: 4238474 - RNA, 57 nt, Mycobacterium bovis subsp bovis AF2122/97
cgcgacaccaacaccggugccgaaaccacccugccgguaaccgguguuuucgucgcg

SEQ ID NO: 4238475 - RNA, 64 nt, Mycobacterium bovis subsp bovis AF2122/97
gcgccgaacgugaacugacggcgggauuuucccgaaauucucgcccugacgucacguucggcgc

SEQ ID NO: 4238476 - RNA, 60 nt, Mycobacterium bovis subsp bovis AF2122/97
ugcaauguuucgacgggcaccaaauccggauuuccguuugacuccacgcgaaacacagua

SEQ ID NO: 4238477 - RNA, 72 nt, Mycobacterium bovis subsp bovis AF2122/97
aggccuaccgcaucaaggaauugguuggcgacgucgugggcguccucgacuccuauggugcggagcaggcuu

SEQ ID NO: 4238478 - RNA, 95 nt, Mycobacterium bovis subsp bovis AF2122/97
ggcgcuuccgcuggguggccgcuuuucgauggugucgcgcaaaauaugcaguaucgaggccgacgaaagguugccgaucucgcccagcgagcgcc

SEQ ID NO: 4238479 - RNA, 80 nt, Mycobacterium bovis subsp bovis AF2122/97
cgcgugcugggcgagcagacacagagucgcaucaaaaccgccgauuuugugcgacucugugucugcucgcggggugcgcg

SEQ ID NO: 4238480 - RNA, 97 nt, Mycobacterium bovis subsp bovis AF2122/97
ccgcgcuagcacgggccggcgagcagacgcaaaaucgcacgguuugcgguugauucgugcgauuuugugucugcucgccgaggccuaccaggcgcgg

SEQ ID NO: 4238481 - RNA, 117 nt, Mycobacterium bovis subsp bovis AF2122/97
ccuccccguucaucuggcuuucgccguagucgugcacgcuggcgaugcccggaugguucagcaucgcgguggugcgcgcuucggcccggaaccguucgaugaacuccggaucggagg

SEQ ID NO: 4238482 - RNA, 57 nt, Mycobacterium bovis subsp bovis AF2122/97
gaaaucagcgacaacgcaucgguauuggugucggugcgggugacggucgccgauauc

SEQ ID NO: 4238483 - RNA, 59 nt, Mycobacterium bovis subsp bovis AF2122/97
guuuggcaagccuggaggaucugcaugacauucauggaugcucaagcuagcuuccagac

SEQ ID NO: 4238484 - RNA, 106 nt, Mycobacterium bovis subsp bovis AF2122/97
cgcagccguccacggcgaguucgcgcacuggguggcggccggagugcaccagcuuccagacacccuugucgccgugcagucgcgcgaguucgccgaacacggugcg

SEQ ID NO: 4238485 - RNA, 61 nt, Mycobacterium bovis subsp bovis AF2122/97
uccagcgugucggagaacacccaccgcuuugugcagaaacuggguauucccgccacgcgga

SEQ ID NO: 4238486 - RNA, 62 nt, Mycobacterium bovis subsp bovis AF2122/97
gguggucccagcuucuguugugcugcacacaauccuuuccgcugcaacagaauugggcuacu

SEQ ID NO: 4238487 - RNA, 74 nt, Mycobacterium bovis subsp bovis AF2122/97
gccguuccggugguggucuccagcgcgcucgauuccgccgucggaaucgccgccggccugaccgccgccgcggc

SEQ ID NO: 4238488 - RNA, 60 nt, Mycobacterium bovis subsp bovis AF2122/97
cgcucugcuggucgauaagaucgauauucgauauguuugacaguguggaccagcugagcg

SEQ ID NO: 4238489 - RNA, 66 nt, Mycobacterium bovis subsp bovis AF2122/97
gccaaggcgagcgacgucuuucccgcgcuggauccgccguugaggaggaugaguuugcccucuggc

SEQ ID NO: 4238490 - RNA, 63 nt, Mycobacterium bovis subsp bovis AF2122/97
gagaucgaccgggaaggugaucggcagccggcccgaaggauucaccugcccggucacaaucuc

SEQ ID NO: 4238491 - RNA, 75 nt, Mycobacterium bovis subsp bovis AF2122/97
ggccggccagcgucguggucuugaagucgaucaccugcggcugaucgacuucgaagacgauggugccggcuggcc

SEQ ID NO: 4238492 - RNA, 74 nt, Mycobacterium bovis subsp bovis AF2122/97
ccgcacacgggugaacugcacgcgguguccuacucguucgcccgcggacacagagugcaguacucggugaucgg

SEQ ID NO: 4238493 - RNA, 96 nt, Mycobacterium bovis subsp bovis AF2122/97
uggccgucgugccguggcggcaguucgccaguggcgaguccccguuugugacgauguucucccuagccggacuugccgcugcggcgucggucguca

SEQ ID NO: 4238494 - RNA, 85 nt, Mycobacterium bovis subsp bovis AF2122/97
ggcgccggccagucggugguagucggugcggccccagccgaagugcgcggccgccgccccgacgaccaccgaggcgucggugacc

SEQ ID NO: 4238495 - RNA, 63 nt, Mycobacterium bovis subsp bovis AF2122/97
aucggcgggcaugaggccaucgaagucgucgucgaggacuucuauguucgugugcuugccgau

SEQ ID NO: 4238496 - RNA, 80 nt, Mycobacterium bovis subsp bovis AF2122/97
ucugguggccgcuggcgguuuggcugcuguugauugugaugaacgucgacgcgggaacaccguugggcggaccuaucgga

SEQ ID NO: 4238497 - RNA, 61 nt, Mycobacterium bovis subsp bovis AF2122/97
ucgugcucgauccgacgcggcucacccuguuuaucggggcgaccgggaugaacggguacga

SEQ ID NO: 4238498 - RNA, 82 nt, Mycobacterium bovis subsp bovis AF2122/97
ccgcauggcugggucaaccugcacuucucgcugcugccggccuggcguggcgcggcgccggugcaggccgccaucgccgcgg

SEQ ID NO: 4238499 - RNA, 87 nt, Mycobacterium bovis subsp bovis AF2122/97
gccgugaccccggcgaccgccgucuggaccgacaugcucggaacaccgagguugugauccagugcggcgacgcugggcaggcacggc

SEQ ID NO: 4238500 - RNA, 68 nt, Mycobacterium bovis subsp bovis AF2122/97
cgcuggaccgguugcccgccguggaucgcgccauucugcgcgucucgguaugggagcugcuccacgcg

SEQ ID NO: 4238501 - RNA, 89 nt, Mycobacterium bovis subsp bovis AF2122/97
ggugcccgagcccgccgguggccaggaucaccgacggagcgcugauaaugccgcauccguccggucugaccacuaauagcccggucacc

SEQ ID NO: 4238502 - RNA, 110 nt, Mycobacterium bovis subsp bovis AF2122/97
caucgccgcgcgaacucgcaaagguagacgugucccgcauggggcggcaugaacuugccgagcaccauuccgugugucacgacgucgccucagcgauucggccggcgaug

SEQ ID NO: 4238503 - RNA, 120 nt, Mycobacterium bovis subsp bovis AF2122/97
gccgagcugcgggccgcucugccacgcggcggcgccgauguggaagccgugcugccgacgguacggcccauuguggcggccgucgccgagcgcggggccgaggccgcgcuggacuucggc

SEQ ID NO: 4238504 - RNA, 56 nt, Mycobacterium bovis subsp bovis AF2122/97
cgagcggguguugacgauggaacgggugcacggcauccgcaucgacaacaccgccg

SEQ ID NO: 4238505 - RNA, 80 nt, Mycobacterium bovis subsp bovis AF2122/97
ugccgacaucggccgccagcucucggcgcuggccgacgccuacgacgucaagcugccccgcgagcuggugcugaucggca

SEQ ID NO: 4238506 - RNA, 90 nt, Mycobacterium bovis subsp bovis AF2122/97
ggaaugcccggucgaggccgacuuggugauuggugugccggaauccggcacacccgccgcggucggcuacgcgcaggaguccggcguucc

SEQ ID NO: 4238507 - RNA, 109 nt, Mycobacterium bovis subsp bovis AF2122/97
ggcucacggugcugcacuggcuagagucgcugcaggggcugccgagcgcgagcgcgcuggccaagcucgucgcgcccuacaccgaccggccgguguucaucugugggcc

SEQ ID NO: 4238508 - RNA, 78 nt, Mycobacterium bovis subsp bovis AF2122/97
cuugugccgccgaacagacacaaaaccacccuauuucgaccagaaucgggugcuuuugcgucugcucggccaacuaag

SEQ ID NO: 4238509 - RNA, 80 nt, Mycobacterium bovis subsp bovis AF2122/97
gugauccuggaaggccgagcggaucugacaucgguauccgaucccgacgccgacgucgaguugaccgucgccuuccccgc

SEQ ID NO: 4238510 - RNA, 89 nt, Mycobacterium bovis subsp bovis AF2122/97
cgcugagggcuugcgcgacgagacgcaaaaucgcccgaaaaccagugguuuugggcgauuuugcgucucgcgcagccgggucuacagcg

SEQ ID NO: 4238511 - RNA, 96 nt, Mycobacterium bovis subsp bovis AF2122/97
uggaucagcuguucuucggugagaucucuggugcgcagaucccggucaaugccgguggccgccaggauuucguucgagcggguacggccgaugcca

SEQ ID NO: 4238512 - RNA, 90 nt, Mycobacterium bovis subsp bovis AF2122/97
cggcggcaaucgccgacggcgcucggaucaucaucuuguccgaccgcgaguccgacgaggaaauggcuccgauaccgucgcugcucgccg

SEQ ID NO: 4238513 - RNA, 57 nt, Mycobacterium bovis subsp bovis AF2122/97
ggcgggggcaccguugcugcgaacgcggcuucguacgcugcagcggcagccuccgcc

SEQ ID NO: 4238514 - RNA, 76 nt, Mycobacterium bovis subsp bovis AF2122/97
gcucaccggggccgucggcaauacuccgcugacgaagcacaguucguugcaauacacguugccgaucccggcgagc

SEQ ID NO: 4238515 - RNA, 63 nt, Mycobacterium bovis subsp bovis AF2122/97
ggcagauugugcggucgaaacagcgucgccggccaaccgcgucuuuugcccagcacgaucgcc

SEQ ID NO: 4238516 - RNA, 64 nt, Mycobacterium bovis subsp bovis AF2122/97
auucgucgagcaauugcugguaugccgccgcuucuucuaacggauucagcuguacucgaugaau

SEQ ID NO: 4238517 - RNA, 72 nt, Mycobacterium bovis subsp bovis AF2122/97
ccgacgaguugcacgaauuacuggaugugccauuucggacagccaacgaguucgucgacaccacccuugcgg

SEQ ID NO: 4238518 - RNA, 57 nt, Mycobacterium bovis subsp bovis AF2122/97
ggcucgguuaucaguugauaacauacccuccauguuaucgacugauaaccgauuguc

SEQ ID NO: 4238519 - RNA, 96 nt, Mycobacterium bovis subsp bovis AF2122/97
cgcgaguagccacggccgccgccgauucgggauugucaccggucaacagcauggugcgcagaccacgaucggccagggcggccacggcgucucgcg

SEQ ID NO: 4238520 - RNA, 60 nt, Mycobacterium bovis subsp bovis AF2122/97
gcgagcagacgcauaagcgcccaauuucgugucgaaaugggcgcuuaugcgucugcucgc

SEQ ID NO: 4238521 - RNA, 55 nt, Mycobacterium bovis subsp bovis AF2122/97
ucgacgaggcgcaacggauuccggaucuguuuccgguccuacgcgugcucgucga

SEQ ID NO: 4238522 - RNA, 55 nt, Mycobacterium bovis subsp bovis AF2122/97
gcggcggaccuuggugcgcaggcacugagccucaaggcgcgcaaggcgucccugc

SEQ ID NO: 4238523 - RNA, 82 nt, Mycobacterium bovis subsp bovis AF2122/97
ggcaacgcugggucuugggguggugccgcugcucgagcuggcauccgccgagcaacaggaccgcuuccuggccgggguggcc

SEQ ID NO: 4238524 - RNA, 77 nt, Mycobacterium bovis subsp bovis AF2122/97
gcauaucggcgacagcggagucgaugccgaccugcgccgccaccgcgucggcggcggcccgauugucgccggugagc

SEQ ID NO: 4238525 - RNA, 94 nt, Mycobacterium bovis subsp bovis AF2122/97
ccgaacagacgcugugugccacggugcaauggucgcaugcucuguugaguggaccugagcgugcguuguugcaccgguuggcagucuucgccgg

SEQ ID NO: 4238526 - RNA, 86 nt, Mycobacterium bovis subsp bovis AF2122/97
cggcgaucaccagccggcgcauggucaaagcgccgcuccuucuggucgcucugcucugcaucgucgccggcgcggucaaagcgccg

SEQ ID NO: 4238527 - RNA, 71 nt, Mycobacterium bovis subsp bovis AF2122/97
gcgcgcugggcgcgcucaucgaccggggcuuggguugauuggccccggcucucuucgcgcgcugggcgcgc

SEQ ID NO: 4238528 - RNA, 60 nt, Mycobacterium bovis subsp bovis AF2122/97
gccggucguggguacgggccucgcugggccggcccgucaccgcccgaacccacggccggc

SEQ ID NO: 4238529 - RNA, 70 nt, Mycobacterium bovis subsp bovis AF2122/97
gggcgcgucaucaugccgggcacacguaugcuuucgaugacacgguggccuggcuggcgguggcguguuc

SEQ ID NO: 4238530 - RNA, 98 nt, Mycobacterium bovis subsp bovis AF2122/97
ugaucccugcgaucccugcgcgagcagacgcagaaucgcaucaaaaucgcugauuuugugcgauucugcgucugcucgcgccaugggagccgccguca

SEQ ID NO: 4238531 - RNA, 57 nt, Mycobacterium bovis subsp bovis AF2122/97
cggugacuauuucggcgccguggcgggcagcugccguggccagggccgaggucaccg

SEQ ID NO: 4238532 - RNA, 61 nt, Mycobacterium bovis subsp bovis AF2122/97
ucccgguucuucaagaaacacuaugugaccgagucccacgcguuuuuugagaaguacggga

SEQ ID NO: 4238533 - RNA, 65 nt, Mycobacterium bovis subsp bovis AF2122/97
gcgccgucgauccuagccgcugauuucgccagacucgcggacgaagcggccgcggucaacggcgc

SEQ ID NO: 4238534 - RNA, 69 nt, Mycobacterium bovis subsp bovis AF2122/97
gugcacgugcucaugaccggccaaugcguugaauuccucgaugcgggccuugacaucguggcgcagcac

SEQ ID NO: 4238535 - RNA, 75 nt, Mycobacterium bovis subsp bovis AF2122/97
ccagcuacucggcggacaucggaugcguccggcugaccgaacgcuguuugcacuccgacccgccgacguugcagg

SEQ ID NO: 4238536 - RNA, 63 nt, Mycobacterium bovis subsp bovis AF2122/97
guugacugcgcggcccgguaccaccaccgcgaucgucggcaguaccgguucgggcaagucgac

SEQ ID NO: 4238537 - RNA, 123 nt, Mycobacterium bovis subsp bovis AF2122/97
augucgcuucgcucggugccgacguggugcuuccgcugaccgagggcugggcucagcaggugcgugaccacaccuacggucaggggguggacaucgucgucgaucccaucggcggaccgacau

SEQ ID NO: 4238538 - RNA, 81 nt, Mycobacterium bovis subsp bovis AF2122/97
agcgccgucgcccagcgugaacugagggcggagaaucggccggaaucucgcccucagugcacgcucggcgccguuuggccu

SEQ ID NO: 4238539 - RNA, 78 nt, Mycobacterium bovis subsp bovis AF2122/97
gcggcgacgcaucgugcggugacggcgaugugcaaucgggcaucgggugcacccgcgauaucgcaguuacgucgccgc

SEQ ID NO: 4238540 - RNA, 66 nt, Mycobacterium bovis subsp bovis AF2122/97
ggcgagagggagggccaugugguacuaccuguucaaguacauuuucauggguccgcucuuuacguu

SEQ ID NO: 4238541 - RNA, 63 nt, Mycobacterium bovis subsp bovis AF2122/97
gcgcgagcagacacagaaucgcccauuucggcacgaaauugggcgauucugcgucugcucggc

SEQ ID NO: 4238542 - RNA, 111 nt, Mycobacterium bovis subsp bovis AF2122/97
ccguguugcgugccaccgaaauguugacuucccggggguugcgggugcuggcaaccgggaugggugccggcgccggcacucccgacgacuucgacgaaaacgugauaccgg

SEQ ID NO: 4238543 - RNA, 85 nt, Mycobacterium bovis subsp bovis AF2122/97
cgaggugcacaagcucuucgucgaggaacucggcgacgagccggcccggcuguucgccuccuucgaggaagagccguucgcgucg

SEQ ID NO: 4238544 - RNA, 62 nt, Mycobacterium bovis subsp bovis AF2122/97
gcacgucgucgcgggacagguaccgcgcccgcagcgcggcgauuugcaacgcaacggcgugc

SEQ ID NO: 4238545 - RNA, 63 nt, Mycobacterium bovis subsp bovis AF2122/97
ucggcacggucuuggccugggugaguccggcgggguucacgacggugccgaugacggugucga

SEQ ID NO: 4238546 - RNA, 60 nt, Mycobacterium bovis subsp bovis AF2122/97
gcgagcagacgcagaaucgcaucgaaauccggauuuucaugcgacucugcgucugcucgc

SEQ ID NO: 4238547 - RNA, 61 nt, Mycobacterium bovis subsp bovis AF2122/97
ggaccaugcaucggaagaaccggcaugacaauguucaggccgaguucgucaugcagcuucc

SEQ ID NO: 4238548 - RNA, 66 nt, Mycobacterium bovis subsp bovis AF2122/97
ccggcagcggcacgucgacgcuggcgauggcgaaggccgaaccccaugucgacgugaucgcugugg

SEQ ID NO: 4238549 - RNA, 64 nt, Mycobacterium bovis subsp bovis AF2122/97
ugcgggaguugcgggauugaugaccgguuugcugcuugccgcgauccucgcaccgcucgccgcg

SEQ ID NO: 4238550 - RNA, 85 nt, Mycobacterium bovis subsp bovis AF2122/97
ccuggguuaacuaccgcgagcagacgcgaaagcaccccaaaaccgccgguuugggggcuucugcgucugcucgcggguaccuagg

SEQ ID NO: 4238551 - RNA, 130 nt, Mycobacterium bovis subsp bovis AF2122/97
gccuggauccugccggucggccuucccggcgaccuggguucgacccaguccaagcaggcguacgcccgcgucgcugacaucgucgaacaccaggucgcaggcucgacacugacggcuaaccugaccgggc

SEQ ID NO: 4238552 - RNA, 81 nt, Mycobacterium bovis subsp bovis AF2122/97
gacggcgucgucggcggcuaucacaccggcgauugcguaggccgcgauuucgccgacggaguggccggccacgaugacguc

SEQ ID NO: 4238553 - RNA, 55 nt, Mycobacterium bovis subsp bovis AF2122/97
gaccuguuucgaguucuucacguugucuuggcaacugcaccggcucaggcagauc

SEQ ID NO: 4238554 - RNA, 92 nt, Mycobacterium bovis subsp bovis AF2122/97
ugggaggugcaccggcguggccgaccccgcggucaacgccaccacgcgauuguggccgcugucggucacguagacggugccagcaccgucca

SEQ ID NO: 4238555 - RNA, 95 nt, Mycobacterium bovis subsp bovis AF2122/97
gcgacacugcugaucuacggcauggucuuucugcugcccggugacccaguugccgcgcuggcgggcgaccguccguugacucccgcgguggccgc

SEQ ID NO: 4238556 - RNA, 124 nt, Mycobacterium bovis subsp bovis AF2122/97
aggucgccuccggugcgcacgaucgacuccggaagaaacgucugguugcucgguuggcggucgauggucaggccgucgauguacuucaggcgguuccgcccggaugcgcccggcgcggugaucu

SEQ ID NO: 4238557 - RNA, 83 nt, Mycobacterium bovis subsp bovis AF2122/97
gcgaccgauggugguuugguugccuaccgcgugggcgcgcaccaccacgcguccgcgcaccacgaccgaaccggcgugcacgc

SEQ ID NO: 4238558 - RNA, 66 nt, Mycobacterium bovis subsp bovis AF2122/97
acggguugccggcacaucgcgccggcgcggccuacgccgaacucgcgcugcugcguggcgauccgu

SEQ ID NO: 4238559 - RNA, 57 nt, Mycobacterium bovis subsp bovis AF2122/97
aacgauguugggccggaaaugccuucggguguaggcgcggucccgcucaacaucguu

SEQ ID NO: 4238560 - RNA, 72 nt, Mycobacterium bovis subsp bovis AF2122/97
cgguucagguacgcgucagcagauugcaucgacaccgcuagucguucgcgucugcugccgcgagccgacucg

SEQ ID NO: 4238561 - RNA, 102 nt, Mycobacterium bovis subsp bovis AF2122/97
ccccagcgcaaccuccgcgagcagucgcuaaagcccccgacacgccgugcgugcgggggcuuaugcgacugcucgccggacggagguccuacgugcugcggg

SEQ ID NO: 4238562 - RNA, 59 nt, Mycobacterium bovis subsp bovis AF2122/97
ggcgguggcauagguaguugcucggcuucccuaggcuccaacuccaagaugccgccccc

SEQ ID NO: 4238563 - RNA, 58 nt, Mycobacterium bovis subsp bovis AF2122/97
cgaacagacacagaaucgcacgcggcaggcuccucggaugcgauugugugucugcucg

SEQ ID NO: 4238564 - RNA, 65 nt, Mycobacterium bovis subsp bovis AF2122/97
cgcgugagcagacgcaaaagaacccgauucuggucgaaauugggugccguugcgucugcucggcg

SEQ ID NO: 4238565 - RNA, 94 nt, Mycobacterium bovis subsp bovis AF2122/97
guggcgcacugguggccgucggcgccgacuuguuggcgcugacgcugaucgcgccgcccggagagaucggcgcugacgucgccuuuggcaccac

SEQ ID NO: 4238566 - RNA, 88 nt, Mycobacterium bovis subsp bovis AF2122/97
ucgaggccgccgaggucagcaccgaccaugccgaacgggagcggcgccugacguucgucgucgucggcgcugggccgaccggcgucga

SEQ ID NO: 4238567 - RNA, 63 nt, Mycobacterium bovis subsp bovis AF2122/97
gaucugguguguuggcgcgccgauggccaguuggaguuccuggggcgcaccgacgaucagguc

SEQ ID NO: 4238568 - RNA, 71 nt, Mycobacterium bovis subsp bovis AF2122/97
gggcaacggaauggagccguauugguccaggccuucuuggccuggaccaaucgcggcuugcauaaacgccc

SEQ ID NO: 4238569 - RNA, 66 nt, Mycobacterium bovis subsp bovis AF2122/97
ccgcgcacgagucgcuggugguggccgucgaccgggccgacgucgccgaccugcgcacugucgcgg

SEQ ID NO: 4238570 - RNA, 63 nt, Mycobacterium bovis subsp bovis AF2122/97
ggugguuugcuccgagacggaggucugccacaccuggcagacucuuggucaugggcugcuccc

SEQ ID NO: 4238571 - RNA, 59 nt, Mycobacterium bovis subsp bovis AF2122/97
gaucgucuggugcagggauucuucggcaacacguugaucgaacaucugcccagaggguu

SEQ ID NO: 4238572 - RNA, 71 nt, Mycobacterium bovis subsp bovis AF2122/97
cggccaguuugaggauuguuuauuggagggacagcccgaaguuacagucgaugacuaucugcggauggccg

SEQ ID NO: 4238573 - RNA, 59 nt, Mycobacterium bovis subsp bovis AF2122/97
augaucgcccagauuuucgccgcgcgauucgcgcagcggacgaaaacccuggcggucau

SEQ ID NO: 4238574 - RNA, 56 nt, Mycobacterium bovis subsp bovis AF2122/97
ggcggggcuggcggggcuggcggccccggcggggccggcggccugaucagccugcu

SEQ ID NO: 4238575 - RNA, 71 nt, Mycobacterium bovis subsp bovis AF2122/97
gagucucuugucgucgccgucccaggugaaccaauccaguugggcgccuucgacgugacguugguggaguc

SEQ ID NO: 4238576 - RNA, 81 nt, Mycobacterium bovis subsp bovis AF2122/97
gggccggucgcuugcguucaccgcgaccgcguugugcauaugcgaucgccucgucgguggacaaggcggcccccucggccc

SEQ ID NO: 4238577 - RNA, 65 nt, Mycobacterium bovis subsp bovis AF2122/97
ggcacagccggcuggugaccacgaucagccagccacgcucgucgucgaugucgccgaccggagcc

SEQ ID NO: 4238578 - RNA, 56 nt, Mycobacterium bovis subsp bovis AF2122/97
uuggagguggccgccagcacgaacaccccucggccgugggcggccgcgaccucuag

SEQ ID NO: 4238579 - RNA, 65 nt, Mycobacterium bovis subsp bovis AF2122/97
gcgaaauggaaccaccaucggucgucgagcaaaacgacgucgggcacgucgguuccgaugagcgc

SEQ ID NO: 4238580 - RNA, 86 nt, Mycobacterium bovis subsp bovis AF2122/97
gcggucgcgucgcugugucuggcggcggugacacugcggcgacggacgucauagcguggcggcgccggacaacagccgcagacggc

SEQ ID NO: 4238581 - RNA, 84 nt, Mycobacterium bovis subsp bovis AF2122/97
gaccccgccggucccgccguggccgaucagcccggcggcgccgccggccccgccggccugcccggccgcacccgacccgccguu

SEQ ID NO: 4238582 - RNA, 56 nt, Mycobacterium bovis subsp bovis AF2122/97
ugguguaacggucuugcauucgugggcugucggcggaucacgggaucguuaugccg

SEQ ID NO: 4238583 - RNA, 65 nt, Mycobacterium bovis subsp bovis AF2122/97
ccgguggcggugaugcugucguucggggaccccgcgguuuucgcugacgccaucaaguccgccgg

SEQ ID NO: 4238584 - RNA, 67 nt, Mycobacterium bovis subsp bovis AF2122/97
gguguugggcuucugggacaucgcggugccgaucgucggcgccccgauggccggcggcccgagcacc

SEQ ID NO: 4238585 - RNA, 89 nt, Mycobacterium bovis subsp bovis AF2122/97
accaugcgguucaaccacucggcggugacguugggcuccgcaucgcgagcggggccggccucacugccguuaaggcugaccgcgauggu

SEQ ID NO: 4238586 - RNA, 91 nt, Mycobacterium bovis subsp bovis AF2122/97
gucgagcuggcuagggccaaagcggucaaggacgcguucggcgucaagcucaacgacgucgucuuggcgcugguggccggggcggcccggc

SEQ ID NO: 4238587 - RNA, 62 nt, Mycobacterium bovis subsp bovis AF2122/97
cgccgagcgugaacucagggcgagauuucggccguuuucucgcccuggcuucacguucggcg

SEQ ID NO: 4238588 - RNA, 66 nt, Mycobacterium bovis subsp bovis AF2122/97
guuggacgcggugcagcggcagcgccacgaggccggacugcggcgcugccugcggccgcgucccgc

SEQ ID NO: 4238589 - RNA, 59 nt, Mycobacterium bovis subsp bovis AF2122/97
ccggcggacgacgucgggucccuuguggucugccagcacccugaugugaguccagccgg

SEQ ID NO: 4238590 - RNA, 76 nt, Mycobacterium bovis subsp bovis AF2122/97
cgaggcagcggucggccugucgcgcgaggugaucggcgaguccgacgccgcgcacgacaugguuagcagcugcgcg

SEQ ID NO: 4238591 - RNA, 79 nt, Mycobacterium bovis subsp bovis AF2122/97
cggcggcgcgguaguuggccuaggcgucggaaaagucggcucgguaggucccgacccuggcgaagcgaccggccugccg

SEQ ID NO: 4238592 - RNA, 55 nt, Mycobacterium bovis subsp bovis AF2122/97
ggucuugacguugccguuggcggugguggugcugcucaagggcaagguuuggacc

SEQ ID NO: 4238593 - RNA, 69 nt, Mycobacterium bovis subsp bovis AF2122/97
agcgcuggugccggacgacgucgcagagcagguccgcaccgaccugcggcagucgcuggcccgcgcgcu

SEQ ID NO: 4238594 - RNA, 65 nt, Mycobacterium bovis subsp bovis AF2122/97
gcucugcugcgggaguacgggcgccggcugaccgaggccggcgucuucgacaccccggacgaugu

SEQ ID NO: 4238595 - RNA, 128 nt, Mycobacterium bovis subsp bovis AF2122/97
cgucgcggccguugaucgugaugguuccgguguccgguuggucgaggccggcuauggugcgcaacagcgucgacuugcccgaaccgcuggggcccaacaaugcggucagcgaaccggucgguacgacg

SEQ ID NO: 4238596 - RNA, 81 nt, Mycobacterium bovis subsp bovis AF2122/97
gcggguaccgguaccggugcgcccgguaucgguaccgguccgccggggauugguaccggugcgcccgguaucgguaccggu

SEQ ID NO: 4238597 - RNA, 81 nt, Mycobacterium bovis subsp bovis AF2122/97
gccggagaugaaagcgccgguguugauauugccgguguucgccaugccgguguuguagucgccgguguugaaguagccggu

SEQ ID NO: 4238598 - RNA, 68 nt, Mycobacterium bovis subsp bovis AF2122/97
cgggcgcgccgcugcggcugcgggucgcgcagcugcgcgucgaccaggcaauccagcaggugugccug

SEQ ID NO: 4238599 - RNA, 65 nt, Mycobacterium bovis subsp bovis AF2122/97
ggugaggguaaccgcuacaaaugaaguuggucagugcuggccaacuguguaaugguugcccggcu

SEQ ID NO: 4238600 - RNA, 58 nt, Mycobacterium bovis subsp bovis AF2122/97
cgagcagacgcggaaucgcacugcgcggaccucacgcgugcgauuccgcgucugcucg

SEQ ID NO: 4238601 - RNA, 101 nt, Mycobacterium bovis subsp bovis AF2122/97
gcugcgcgcgcuuaccucgcucggcgggccagucuuucggagucagagaucagcacacucuugcccucaaggcggauccagccgcggugagcgaaaucagc

SEQ ID NO: 4238602 - RNA, 56 nt, Mycobacterium bovis subsp bovis AF2122/97
gugacggcgagccgccaguugacccgcacgugggcacaacggcgagcuucccgcac

SEQ ID NO: 4238603 - RNA, 65 nt, Mycobacterium bovis subsp bovis AF2122/97
ggaucgucgacggggcacagucgucgagcaccgcguguaaccgaccgacgugccccggcucggcc

SEQ ID NO: 4238604 - RNA, 69 nt, Mycobacterium bovis subsp bovis AF2122/97
cggucaaggugacgugcgugcaucccggcggcaucaaaaccgccgucgcgcgcaacgccaccguggccg

SEQ ID NO: 4238605 - RNA, 64 nt, Mycobacterium bovis subsp bovis AF2122/97
cagcggcgggucaacgacccagacgaaugcccacgcaucggggucaaucaggcccagccgguug

SEQ ID NO: 4238606 - RNA, 80 nt, Mycobacterium bovis subsp bovis AF2122/97
cccggccggccaguaucagcaucaagguggucuucccugauccguuggccccgaugaucgcuaggugcucgccggcccgg

SEQ ID NO: 4238607 - RNA, 79 nt, Mycobacterium bovis subsp bovis AF2122/97
ucggcgcgcacauugaaaccgaugaucaccgcaucggaagccgacgccagguugacguugguuucgguaaugccgccga

SEQ ID NO: 4238608 - RNA, 78 nt, Mycobacterium bovis subsp bovis AF2122/97
acgucgcacccacuggcgggcgauccgcggagaggacuucaaauggguugucccgcacucgauccgcaaguccgucgu

SEQ ID NO: 4238609 - RNA, 55 nt, Mycobacterium bovis subsp bovis AF2122/97
uggcggccaagguggugcccagugucgucauguuggaaaccgaucugggccgcca

SEQ ID NO: 4238610 - RNA, 88 nt, Mycobacterium bovis subsp bovis AF2122/97
gaccagcgcgcugcgcgacugauccucgaugacaucggucagcgggcacgccgccgacgugagggucaugucgaucagcgcgacgguc

SEQ ID NO: 4238611 - RNA, 98 nt, Mycobacterium bovis subsp bovis AF2122/97
ugggcguugacggcuucgacgaaugcgaaugcauccgcucguggugacggaaucucgaagaugcgucgauucguuguuagccggaggaacgacgccca

SEQ ID NO: 4238612 - RNA, 130 nt, Mycobacterium bovis subsp bovis AF2122/97
ccgagcaacgugaucucaagcauggcccuauccugacaagcucgauggauccagcggccccgaucgaccgauucggcugauggccaacgaguuuuagccucgaggaugcggccgacaugggcguugucgg

SEQ ID NO: 4238613 - RNA, 57 nt, Mycobacterium bovis subsp bovis AF2122/97
ggcccagcgacucgccgagcuccaggugguccuugggguucucgagguagcugggcu

SEQ ID NO: 4238614 - RNA, 80 nt, Mycobacterium bovis subsp bovis AF2122/97
auaucgcugcagucaauggugucucgucggucgugcuggccggcgagacggaugccgugacggagcugaugcagcgaugu

SEQ ID NO: 4238615 - RNA, 65 nt, Mycobacterium bovis subsp bovis AF2122/97
ggaucuugcugguaugccgggccaccgaaaccaugggcaccgguggcagcggguccggcgacucc

SEQ ID NO: 4238616 - RNA, 59 nt, Mycobacterium bovis subsp bovis AF2122/97
uuuccccgcaagcgggucggccccggucaucugcgggagcucccgaucucccggggaga

SEQ ID NO: 4238617 - RNA, 62 nt, Mycobacterium bovis subsp bovis AF2122/97
ggcgagcagucgcaaaagcccccgcacgccgcgcgugucgggggcuuuugcgacugcucguc

SEQ ID NO: 4238618 - RNA, 62 nt, Mycobacterium bovis subsp bovis AF2122/97
ggauguaggggugcaccgauccgcccuggaugggcccggggcggaucagcgccaccuccacc

SEQ ID NO: 4238619 - RNA, 88 nt, Mycobacterium bovis subsp bovis AF2122/97
gugcuggcuugccuggcgagcagacgcaaaagccccuaauaccugccgguuuagggggcuuuugcgucugcucgccggccuaccgcgc

SEQ ID NO: 4238620 - RNA, 65 nt, Mycobacterium bovis subsp bovis AF2122/97
guacugcgcuacggauuucgcccgucgaagauugcguuuuuggccuggcaugcguggaacgaugc

SEQ ID NO: 4238621 - RNA, 57 nt, Mycobacterium bovis subsp bovis AF2122/97
cgcguugaacugauaggugcggcccggcucgagcaggccggccauuuguucgaugcg

SEQ ID NO: 4238622 - RNA, 64 nt, Mycobacterium bovis subsp bovis AF2122/97
ggugggcaggugauccucgccggcgucgagcagacccaggcuggccaguucgcccugaccuacc

SEQ ID NO: 4238623 - RNA, 64 nt, Mycobacterium bovis subsp bovis AF2122/97
gggcccugguugaugaucacguucaccugcucgaucagcaccucguuuucuucggccagggccc

SEQ ID NO: 4238624 - RNA, 89 nt, Mycobacterium bovis subsp bovis AF2122/97
ccucgcuaugcuuugacuaagcggggcgagcgcuccgcuuagccgaacuauacggaacgcgcgccccgcuuugucaaggcuuucggagg

SEQ ID NO: 4238625 - RNA, 103 nt, Mycobacterium bovis subsp bovis AF2122/97
cgugccgccugcgccugacgacgagcuguuggugccaccgccgcaugcugucaacaccagugugccggcggccaacaggcuuaccgcugcgccggaucgggcg

SEQ ID NO: 4238626 - RNA, 58 nt, Mycobacterium bovis subsp bovis AF2122/97
ggugaugguggaggcagccgacgagggcgucgcccagcggcuggcggccacggucgcc

SEQ ID NO: 4238627 - RNA, 80 nt, Mycobacterium bovis subsp bovis AF2122/97
agcacgggcugaugaacgccgacgguuggggugucggcuucuucgacggugccauuccccggcguuggcgcagcccggcu

SEQ ID NO: 4238628 - RNA, 79 nt, Mycobacterium bovis subsp bovis AF2122/97
auugugcgacauccgacgccgaagccacgcuagugcucugggcaccaacggcauucaacgcgucggcgaguugcgcggu

SEQ ID NO: 4238629 - RNA, 87 nt, Mycobacterium bovis subsp bovis AF2122/97
ccagcgcggcggcggcggugcugaucgccgugcgggugcuggccagugagcagauggcgcggcggacggcaccauucgucgcggugg

SEQ ID NO: 4238630 - RNA, 63 nt, Mycobacterium bovis subsp bovis AF2122/97
cggucuucggagugaaggccggugacgcgacgaugacggccggcaauucgacuccgcugaccg

SEQ ID NO: 4238631 - RNA, 75 nt, Mycobacterium bovis subsp bovis AF2122/97
ugaucgcgccccgagugugaacugcgcaacggguuagcgugucgcguagugcauuucacagucggauugcuguca

SEQ ID NO: 4238632 - RNA, 60 nt, Mycobacterium bovis subsp bovis AF2122/97
gcgagcagacguaaagcccccaaaacggaaccguuuugggggcuuuuugcgucugcucgc

SEQ ID NO: 4238633 - RNA, 76 nt, Mycobacterium bovis subsp bovis AF2122/97
agccauacaaaaggaggugacucgaugcuggagcucgccauccugggucuguugaucgagucaccgaugcauggcu

SEQ ID NO: 4238634 - RNA, 86 nt, Mycobacterium bovis subsp bovis AF2122/97
ggccaguuagcgggcgcgagcagacgcaaaaucgcccauuucggcacgaaauugggcgauuuugcgucugcucgcccuaauuggcc

SEQ ID NO: 4238635 - RNA, 72 nt, Mycobacterium bovis subsp bovis AF2122/97
cgcuggaucccgagggacacaucugugcgcgcaccaacgguuaccggcgcgaugugcugcucgggucuggcg

SEQ ID NO: 4238636 - RNA, 65 nt, Mycobacterium bovis subsp bovis AF2122/97
ggcccuguacgugugccuggcgaccuagcugguaccagggaaagguugccgaugcguaugguguc

SEQ ID NO: 4238637 - RNA, 65 nt, Mycobacterium bovis subsp bovis AF2122/97
ccgucgagaucgacgucagcgcgaugcucacugggguuuuuccgcgcuggugucgaugucgacgg

SEQ ID NO: 4238638 - RNA, 83 nt, Mycobacterium bovis subsp bovis AF2122/97
uggggcgcgcaaagucucggugccccugggguagcgcaucgcgucgacauacaccgucagggcaucaccgaggcggcgcucca

SEQ ID NO: 4238639 - RNA, 65 nt, Mycobacterium bovis subsp bovis AF2122/97
cggcgagcggacacauaagcccccgccacgccgaaggauuuggagcuuuuugcgucuguucgccg

SEQ ID NO: 4238640 - RNA, 125 nt, Mycobacterium bovis subsp bovis AF2122/97
ccgccgcggccgccgaugcggaacccgacgaauuccucuauuacgacgacgguuucaagaagaagaagaucgucgacgugcugcgggagucgcuauacaacgugccgcaccgaucgccgcgccgg

SEQ ID NO: 4238641 - RNA, 60 nt, Mycobacterium bovis subsp bovis AF2122/97
guagccgacaucgccggcgccuucacguaccgcgacgucgacggccuggccugucggcgc

SEQ ID NO: 4238642 - RNA, 64 nt, Mycobacterium bovis subsp bovis AF2122/97
cgucggccgcguguucgacugggugguggccgagcuggucgccaccacucaggccgcggucacg

SEQ ID NO: 4238643 - RNA, 89 nt, Mycobacterium bovis subsp bovis AF2122/97
guauuuggagccggcgaccaucgagccgagaucgagcgcgacgauggucuugucgcgcaagcucuccggcacgucgccggccacgaugc

SEQ ID NO: 4238644 - RNA, 65 nt, Mycobacterium bovis subsp bovis AF2122/97
cuguggugucgacggacaugcuggugcaagauagucacuuccggcuggacuggucgacaccgcag

SEQ ID NO: 4238645 - RNA, 57 nt, Mycobacterium bovis subsp bovis AF2122/97
cgcggucgcugaugcuggaugugaucgucaaggucauauucggggucgacgaccccg

SEQ ID NO: 4238646 - RNA, 72 nt, Mycobacterium bovis subsp bovis AF2122/97
ccagguugugcagguucguacuggcaugccgaaucaccugggcgugcaccugcggaccaugcaucaggaugg

SEQ ID NO: 4238647 - RNA, 71 nt, Mycobacterium bovis subsp bovis AF2122/97
cgaagaaguccagcagaucgaucucgccggccucaccccagucggcgaucauccgucggacuugaucuucg

SEQ ID NO: 4238648 - RNA, 85 nt, Mycobacterium bovis subsp bovis AF2122/97
gcgguuggcgagguuucgcugucgcuggccguguccucccgccagacccacacggcaaagaucaggaaugcgaucgccgauacgc

SEQ ID NO: 4238649 - RNA, 65 nt, Mycobacterium bovis subsp bovis AF2122/97
cggcaagacgcggucgacgacgcccucacaacgauugcgaagggcaccggcgaucguguccaccg

SEQ ID NO: 4238650 - RNA, 93 nt, Mycobacterium bovis subsp bovis AF2122/97
guccgcggagaacguugucaugugcauggugaccgggugccgcucgaugagcgcacgugcggucaccaucucgcagacauacaguccgcugac

SEQ ID NO: 4238651 - RNA, 57 nt, Mycobacterium bovis subsp bovis AF2122/97
gaagcugcugggccaguucguggauucgcuagaagccgagcucgcggcccagaguuc

SEQ ID NO: 4238652 - RNA, 78 nt, Mycobacterium bovis subsp bovis AF2122/97
gcgcgucccgcgagcagacgcaaaagcccccaaaaucgcccgacuuggggugcuuuugcgucugcucgcgcacugugu

SEQ ID NO: 4238653 - RNA, 86 nt, Mycobacterium bovis subsp bovis AF2122/97
gccgcaagggcgcgagcagacgcagaaucgcaugauuugagcucaaaucaugcgauucugcguccugcucgcgaggcucgcguggc

SEQ ID NO: 4238654 - RNA, 63 nt, Mycobacterium bovis subsp bovis AF2122/97
cggcugcagugcgacgacgagaaaccggcggcaauaguggccaucucuccguugcugcagcug

SEQ ID NO: 4238655 - RNA, 94 nt, Mycobacterium bovis subsp bovis AF2122/97
ggcgcuggccgcguuccaggcgccgcuggccaucggauccgacaccggggggucgauccgccagccggccgcgcugaccgcgaccgucggcguc

SEQ ID NO: 4238656 - RNA, 78 nt, Mycobacterium bovis subsp bovis AF2122/97
gccggccggcgcgcgcuaugaggcgcuggccaccgagaucgaucgugggcugcgguucaugagugccugugggguggc

SEQ ID NO: 4238657 - RNA, 94 nt, Mycobacterium bovis subsp bovis AF2122/97
gcgacaccgacgcaacgccugggaucgguuggaguggcgggaccgcggcggucgcuaugcugacugauuccgcggugagcaucagcgugaucgc

SEQ ID NO: 4238658 - RNA, 76 nt, Mycobacterium bovis subsp bovis AF2122/97
cuucuggccacgagagugaaugucacgacgcguuuccggcgugucacgucguggauuucacugucgcggccagcgg

SEQ ID NO: 4238659 - RNA, 84 nt, Mycobacterium bovis subsp bovis AF2122/97
gccagcggcacugugucgggcgcgagcucagccacgucagucgacgguccaagugucgcgcccgugcaacagugacugcagugc

SEQ ID NO: 4238660 - RNA, 61 nt, Mycobacterium bovis subsp bovis AF2122/97
ccacgaugcugugcuacuggccguuaucuugcucacgguaguggcucuggccagcaugugg

SEQ ID NO: 4238661 - RNA, 60 nt, Mycobacterium bovis subsp bovis AF2122/97
uuguuccugagcgagugguuccggagacuuucguuccgcaagccuuuguuccggaagcag

SEQ ID NO: 4238662 - RNA, 108 nt, Mycobacterium bovis subsp bovis AF2122/97
auccaggucggcgagcaccucgucggagauguucgggaugucgcgggugaucuccuccgcacccagcuuggugucgcgagcaucgaucucaugcuccucgauguggau

SEQ ID NO: 4238663 - RNA, 57 nt, Mycobacterium bovis subsp bovis AF2122/97
gguaccggucuugccggccaucugauagccgggcaccccggccgucggcccgguacc

SEQ ID NO: 4238664 - RNA, 60 nt, Mycobacterium bovis subsp bovis AF2122/97
caaaggccuuacccuggcuggguuugcgaccucaacacagcccagcaggaaaggccuuug

SEQ ID NO: 4238665 - RNA, 96 nt, Mycobacterium bovis subsp bovis AF2122/97
cguugcucggcgaggcggauaccgcggagcaugggcacgaugacgaguacgacgaguucagcgaucccaaugccuggguuccgcggcggagccgcg

SEQ ID NO: 4238666 - RNA, 84 nt, Mycobacterium bovis subsp bovis AF2122/97
guccaaggugaucgugccggccgugguagccgcgcugcuggccacgcuggucggagcagucggcaccuggcuggucuaccggac

SEQ ID NO: 4238667 - RNA, 77 nt, Mycobacterium bovis subsp bovis AF2122/97
uggagggcacugucagccuguccucacuaacucccuuuagaaaggccgcgugagccauagguugucgguggacucca

SEQ ID NO: 4238668 - RNA, 56 nt, Mycobacterium bovis subsp bovis AF2122/97
ccguucuugaucagcggaccacccgccacggcgguauagcguuggucggugaaugg

SEQ ID NO: 4238669 - RNA, 69 nt, Mycobacterium bovis subsp bovis AF2122/97
ggccguugauucugcguccaccaggcugaccacucgcacuuuugcgugguagacgcaggaucaacggcu

SEQ ID NO: 4238670 - RNA, 78 nt, Mycobacterium bovis subsp bovis AF2122/97
gcagcugggaaucuuuggugcgcaaccgguuagcggcggcuaacgucgaagcgcggugcgcuccaagguaaaggcugc

SEQ ID NO: 4238671 - RNA, 84 nt, Mycobacterium bovis subsp bovis AF2122/97
ggucgacugggcgacgagcguaacgucacggcugaaaauccgugcccgacuucgccguggcguuacgcucgcggcgcggggacc

SEQ ID NO: 4238672 - RNA, 104 nt, Mycobacterium bovis subsp bovis AF2122/97
gcugugguaucucaagguugucgggucccagcccgauuuccucggugaauggcugcccggccagauacugcagggaaucggggugggcgcuaccuucccgcugc

SEQ ID NO: 4238673 - RNA, 79 nt, Mycobacterium bovis subsp bovis AF2122/97
gagcacgccggagcagaccguguugucgcugguggugcaucacaucgccggcgaccacuggucggcugggguguuguuc

SEQ ID NO: 4238674 - RNA, 56 nt, Mycobacterium bovis subsp bovis AF2122/97
cgcgcccacgagccaccgcggcuggcuuagcgccggacgucgacuuguugggcgcg

SEQ ID NO: 4238675 - RNA, 62 nt, Mycobacterium bovis subsp bovis AF2122/97
uguugaucucacccgaaguuguguccgccgccgccggggaucuagcgaacgugggaucgaca

SEQ ID NO: 4238676 - RNA, 130 nt, Mycobacterium bovis subsp bovis AF2122/97
ggcaaccgcaacgccuuggguggccaguccggccgcguugguggucggcggcggugcagcaaauggcgucaccugggucgccaccgacgacgagccggcauagccauacaucgcggcugcgucuugcgcc

SEQ ID NO: 4238677 - RNA, 64 nt, Mycobacterium bovis subsp bovis AF2122/97
gcgccgaacgugaacucacggcggagauucggccgauauuccgcccucaguucacguucggcgu

SEQ ID NO: 4238678 - RNA, 65 nt, Mycobacterium bovis subsp bovis AF2122/97
ggcaugugcggcugguaugccgcucgaacgcuguugcgcaccgaguucggcaucacccgcaugcc

SEQ ID NO: 4238679 - RNA, 55 nt, Mycobacterium bovis subsp bovis AF2122/97
ugcuccggcacguuggucgagauugacgcauaggcucuggccaaggugucgagca

SEQ ID NO: 4238680 - RNA, 89 nt, Mycobacterium bovis subsp bovis AF2122/97
cgaauaugggcccgaugggcagcggcguggcgagggcauggaggucuucguguccagccacgcgccgcgcccgcggaugcugguguucg

SEQ ID NO: 4238681 - RNA, 61 nt, Mycobacterium bovis subsp bovis AF2122/97
gaugcugcucggacccagcggcugcggcaagacgacacugcuuuccugucugggcggcauu

SEQ ID NO: 4238682 - RNA, 75 nt, Mycobacterium bovis subsp bovis AF2122/97
cgaggcggacgaucgccagaguggucgacacggggccacagacuacccuugaccgcgugucugggacgcgccucg

SEQ ID NO: 4238683 - RNA, 65 nt, Mycobacterium bovis subsp bovis AF2122/97
ccggucccuuaaacccgaaugccgacacguaggcccgugacggcacuucgguuugaccgaccugg

SEQ ID NO: 4238684 - RNA, 55 nt, Mycobacterium bovis subsp bovis AF2122/97
cgggcagcgucgggauaaucggcagucugcugaccguauugugcguggcuguccg

SEQ ID NO: 4238685 - RNA, 74 nt, Mycobacterium bovis subsp bovis AF2122/97
gccgugaucuaucugcuggccagucccgacgccgaucuggucggcaucgccucgaccggcggaaacaucgcggu

SEQ ID NO: 4238686 - RNA, 80 nt, Mycobacterium bovis subsp bovis AF2122/97
gguguugacgcaucgagaucgacgucagcgcgaugcucucucucgcgggggcgcugccgucgaucucgacgcaaagaccc

SEQ ID NO: 4238687 - RNA, 65 nt, Mycobacterium bovis subsp bovis AF2122/97
gucauccuggccuauuccggcggucuggacaccucgguggcgaucagcuggauaggcaaggagac

SEQ ID NO: 4238688 - RNA, 100 nt, Mycobacterium bovis subsp bovis AF2122/97
gccaggcgcgccacaccggcaaggucgucaugcugaugcccggcucgugggcggcgggcacgguguugaucaccgguggcaccgggauggcggguucggc

SEQ ID NO: 4238689 - RNA, 62 nt, Mycobacterium bovis subsp bovis AF2122/97
gacaugcucuuguccagugcggcgccguaggcaucgacggcaccuaccgacaggacguaauc

SEQ ID NO: 4238690 - RNA, 84 nt, Mycobacterium bovis subsp bovis AF2122/97
aucaagacuaauggugaugcgccgcaugcccgccgauuuuaacuuucuggccugguccgcgagcagcacgccauuaguugugau

SEQ ID NO: 4238691 - RNA, 67 nt, Mycobacterium bovis subsp bovis AF2122/97
accgucgacaucgacaccagcgcggaaaaaccccagugagcaucgcgcugacgucgaucucgacggu

SEQ ID NO: 4238692 - RNA, 63 nt, Mycobacterium bovis subsp bovis AF2122/97
gccgacugcgaucgaagagaucgugagguggacgucgccgucaccaucgaagcggcgcacggc

SEQ ID NO: 4238693 - RNA, 63 nt, Mycobacterium bovis subsp bovis AF2122/97
gcaacggccuggcggccgcgucgacguaccaggcggugaucgacgccgaacgucaacccgagc

SEQ ID NO: 4238694 - RNA, 76 nt, Mycobacterium bovis subsp bovis AF2122/97
guagcccgccgagcagacgcaaaaucgcccauuucgugccgaaaugaggcgauuuugcgucugcucgccgggcuac

SEQ ID NO: 4238695 - RNA, 75 nt, Mycobacterium bovis subsp bovis AF2122/97
cggccccgggcgagcagucgcauaagcccccgacacgccgagcgugcgggggcuuaugcgucugcucgccggccg

SEQ ID NO: 4238696 - RNA, 61 nt, Mycobacterium bovis subsp bovis AF2122/97
uggugugauauaucaccuuugccugacagcgacuucacggcacgauggaaugucgcaacca

SEQ ID NO: 4238697 - RNA, 58 nt, Mycobacterium bovis subsp bovis AF2122/97
ucgacgagguugacuucgacguccccguguacggccaggacgucgacagcuucgacgg

SEQ ID NO: 4238698 - RNA, 56 nt, Mycobacterium bovis subsp bovis AF2122/97
cccuggcgcuguugggacgcccguugaucggcgacggcaccgaugcggcgccgggg

SEQ ID NO: 4238699 - RNA, 93 nt, Mycobacterium bovis subsp bovis AF2122/97
guggcguucgucgcgggucgaucggucggucaaggucgcgugcacccgaagguaaccggacgugaccagaucaccgaccagcacacgcgccac

SEQ ID NO: 4238700 - RNA, 101 nt, Mycobacterium bovis subsp bovis AF2122/97
ggcgggccacauguggauuaccggcacggguaagcacgcgguucagcucuaugucgggguugaucccgcugcuuacccggcggaacaccuugaggauagcc

SEQ ID NO: 4238701 - RNA, 60 nt, Mycobacterium bovis subsp bovis AF2122/97
cggucucguccgaaggcaucggcgagucgcgcggcggcuugucgguacucggaccgacug

SEQ ID NO: 4238702 - RNA, 72 nt, Mycobacterium bovis subsp bovis AF2122/97
gccagccuggccaucgagggcaucgggccuagccgaagcgcccggagauguaguccucgguggccuucuggu

SEQ ID NO: 4238703 - RNA, 82 nt, Mycobacterium bovis subsp bovis AF2122/97
guccccggcgguccaguacgucagauacaucguggaucggcgucgcauaucgaaggucucgacguacugcgccgccgcggcc

SEQ ID NO: 4238704 - RNA, 63 nt, Mycobacterium bovis subsp bovis AF2122/97
uggcgcgcaacgcaucagugccggcgccgagucacucgcccgugccgcugaucguugccguca

SEQ ID NO: 4238705 - RNA, 56 nt, Mycobacterium bovis subsp bovis AF2122/97
cgagcguaaccgcacugcgaaaauccgcgccggaaaucgcagccagguuacgcucg

SEQ ID NO: 4238706 - RNA, 100 nt, Mycobacterium bovis subsp bovis AF2122/97
ccgauuucaugaagcucacgccggaucgcuucauccaugagcugcucgucgagcaccuacaugugguggaggucgucgucggcgagaacuucaccuucgg

SEQ ID NO: 4238707 - RNA, 91 nt, Mycobacterium bovis subsp bovis AF2122/97
gaccugaagcgccugggugccgaucgagccgguacugcccagcaccaccacccgcaaccggccgucagcgcgcccgucggucgaguugguc

SEQ ID NO: 4238708 - RNA, 57 nt, Mycobacterium bovis subsp bovis AF2122/97
ggugcgcgcauguacucgaagcccagaacguuucuccccuuugagcauggccgcgcc

SEQ ID NO: 4238709 - RNA, 62 nt, Mycobacterium bovis subsp bovis AF2122/97
gcgguggacgaagacggguucuugacgaucaccggccgcaagaaagaaauuaucgucaccgc

SEQ ID NO: 4238710 - RNA, 113 nt, Mycobacterium bovis subsp bovis AF2122/97
guugaggcugccgguguuguaggagccggcauuggccagaccgguguugaaguuccccgcguugaacaacccggugcuggccgugcccgcauuccccacaccggugcuguaac

SEQ ID NO: 4238711 - RNA, 71 nt, Mycobacterium bovis subsp bovis AF2122/97
agcgggaaccuguugggggccaccggugcgguucugcaggcuccgggcaacgccgucaacgguuucuuguu

SEQ ID NO: 4238712 - RNA, 70 nt, Mycobacterium bovis subsp bovis AF2122/97
gugagcugcagcgccccgauccugucgugcgcgcugaccgugcggcccggucgguugcgcuguacuacac

SEQ ID NO: 4238713 - RNA, 88 nt, Mycobacterium bovis subsp bovis AF2122/97
cuggccaccgggcugcaagcccagaucggugcguuucacccacaucgcaagcucgagacgcccgucguccucuugcacgcucagccag

SEQ ID NO: 4238714 - RNA, 58 nt, Mycobacterium bovis subsp bovis AF2122/97
ucgacgugaucaaugcugaucggggugaugacggcgaccggugcguugaucacguugg

SEQ ID NO: 4238715 - RNA, 73 nt, Mycobacterium bovis subsp bovis AF2122/97
cauucaucuugcggcagcgaaaggagcuccaugcggaauuugcuugggccccuugaccgcugcccaguggaug

SEQ ID NO: 4238716 - RNA, 58 nt, Mycobacterium bovis subsp bovis AF2122/97
ggauucgggucuuggugagccgcaugcgguccugcgcggcuucccagacuucggauuc

SEQ ID NO: 4238717 - RNA, 129 nt, Mycobacterium bovis subsp bovis AF2122/97
gugucagggcuuccacggcgccuaucccacucgucuuugguacggaacguaggcagauaacucuauguguagacguuucguaucgaugccugaggaaaucgggaacaggccccgcgggcgcauggcuau

SEQ ID NO: 4238718 - RNA, 60 nt, Mycobacterium bovis subsp bovis AF2122/97
ccccuucgaagaagucgggcgccuugccgaccacgacggcgucgaugucgucgaaggugg

SEQ ID NO: 4238719 - RNA, 59 nt, Mycobacterium bovis subsp bovis AF2122/97
gugagguucuugaucacgaccaccggguagagcccuuggggcgugacgagcgccugcgc

SEQ ID NO: 4238720 - RNA, 76 nt, Mycobacterium bovis subsp bovis AF2122/97
acgucgcggccaugguguucgagcaugaacgugacgaucccgacuacgucaucuaucaacgccugaucgacggcgu

SEQ ID NO: 4238721 - RNA, 80 nt, Mycobacterium bovis subsp bovis AF2122/97
uuagguugcgcgagcagacguaaaagcccccgacacgccgagcgugcgggggcuuuuacgucugcucgcgcucagcuuag

SEQ ID NO: 4238722 - RNA, 122 nt, Mycobacterium bovis subsp bovis AF2122/97
gcaucgucgccgugcggcgcaguugcucccgcucccguucgcucggcacucguucggcgucgaugaugaugucgugaacggugaacccgggcgcguguugggcuagcacgugcagaugacgc

SEQ ID NO: 4238723 - RNA, 86 nt, Mycobacterium bovis subsp bovis AF2122/97
ggccaauuagggcgagcagacgcaaaaucgcccaauuucgugccgaaaugggcgauuuugcgucugcucgcgcccgcuaacuggcc

SEQ ID NO: 4238724 - RNA, 55 nt, Mycobacterium bovis subsp bovis AF2122/97
ggcggaguccggcagcgucaacggggacagccgcacggucgcugccgacgccgcc

SEQ ID NO: 4238725 - RNA, 55 nt, Mycobacterium bovis subsp bovis AF2122/97
ugguaggcaacaaacggcgggucagcuuugcugcgcugcgcuaugguugucacca

SEQ ID NO: 4238726 - RNA, 114 nt, Mycobacterium bovis subsp bovis AF2122/97
ggaacuugcgaccgcggccgucgcgcaucggaucacauugcgcccggagaugugggugcgcaagauugcgggcgcugauguggucucagagcuguugcggcgucugccuguucc

SEQ ID NO: 4238727 - RNA, 88 nt, Mycobacterium bovis subsp bovis AF2122/97
cugcgaguugauguccucaagccggcguuccagcucgggcaccaaaugcugugcucgaacccggguuucggcgaaugacaacuugcag

SEQ ID NO: 4238728 - RNA, 58 nt, Mycobacterium bovis subsp bovis AF2122/97
cgagacgagccacggcuucgccgcgggacagauggcggccgaggucguaugccguccg

SEQ ID NO: 4238729 - RNA, 78 nt, Mycobacterium bovis subsp bovis AF2122/97
gguugugcuguuuugggccucggcgagccgacacgccucggcguucucagcuaagcgcugccuaaaccaugccuaacc

SEQ ID NO: 4238730 - RNA, 69 nt, Mycobacterium bovis subsp bovis AF2122/97
ccgcuucaucgucguggcagguguugggcugauuuuggucaacccagcaccugccaggacgggcuacgg

SEQ ID NO: 4238731 - RNA, 81 nt, Mycobacterium bovis subsp bovis AF2122/97
uccacgucggccauggcgcgcuggacaucacccuguaccgcgacgaucugaugaucaagccgccgcggcccuuggcgucga

SEQ ID NO: 4238732 - RNA, 56 nt, Mycobacterium bovis subsp bovis AF2122/97
gacgcgaguuggccguccuccugguaaagcccuagcagcagugagccgaucgcguc

SEQ ID NO: 4238733 - RNA, 123 nt, Mycobacterium bovis subsp bovis AF2122/97
gguggaccccagcgggaucacuaucgacggcgacgugcuugguagcuggcucgacgucgcacucccgaguuccccgacuaccggcacucgccgaugguaggacgaauucaccuggcgugcacc

SEQ ID NO: 4238734 - RNA, 55 nt, Mycobacterium bovis subsp bovis AF2122/97
guugggcagcgucacggucgucggagccugcgguggcgauucugauuugcccagc

SEQ ID NO: 4238735 - RNA, 60 nt, Mycobacterium bovis subsp bovis AF2122/97
gccaacccgucgauguucgagccggugcauggcagcgcgccggacaucgccggucagggc

SEQ ID NO: 4238736 - RNA, 84 nt, Mycobacterium bovis subsp bovis AF2122/97
ugcucgcgcgaggcccgucgguuggcgauggugucccacggccgccgugccuccccggcgaguccccguucguuugcgcgagca

SEQ ID NO: 4238737 - RNA, 58 nt, Mycobacterium bovis subsp bovis AF2122/97
ugcggguacuggucggcaauggugcgaaggcguugaccauugucgagccgguuccgca

SEQ ID NO: 4238738 - RNA, 63 nt, Mycobacterium bovis subsp bovis AF2122/97
gcgcgagcagacguaaaagcccccauuucgugcccgaauugggggcuuuugcgucugcucggc

SEQ ID NO: 4238739 - RNA, 93 nt, Mycobacterium bovis subsp bovis AF2122/97
gcugacggcuuuggcccgcgagcguaacguggcugcgauuuucggcacggauuuucgcaguccgguuacgcucgcgaagccgguucgcccagc

SEQ ID NO: 4238740 - RNA, 88 nt, Mycobacterium bovis subsp bovis AF2122/97
gauugccgccaacuuccgcgacgucaugaucgcgcugggucuguaucccgauccggacgcggucaugggcguugaggccugcggcguc

SEQ ID NO: 4238741 - RNA, 66 nt, Mycobacterium bovis subsp bovis AF2122/97
ggcggcgggcggucgugcgacgaaguuggggcggaagccauacuggggcacggcacgcccgaagcc

SEQ ID NO: 4238742 - RNA, 88 nt, Mycobacterium bovis subsp bovis AF2122/97
uggaccguacggcauucggcacacguugugcggguuuggguuucgacgacuaugccaccgacaaccuguggcgacugcuggacgacca

SEQ ID NO: 4238743 - RNA, 69 nt, Mycobacterium bovis subsp bovis AF2122/97
gacgacaugaccgagagcaugcuggaguugcugcuucgcgaacucgacgugcaucccggugaugucauc

SEQ ID NO: 4238744 - RNA, 71 nt, Mycobacterium bovis subsp bovis AF2122/97
ccgcacagcgggcgcucgagguguccggucggcuacugcuggcuggcagcucacgacgccucgccuggugg

SEQ ID NO: 4238745 - RNA, 63 nt, Mycobacterium bovis subsp bovis AF2122/97
ggcucaucguguuggucgagccgguggaagccaucgucgaucggaucgacuacaucgugagcc

SEQ ID NO: 4238746 - RNA, 78 nt, Mycobacterium bovis subsp bovis AF2122/97
cucgacgccggauucgugguggacagcucccggcgggagugggcauuucccgccugggugccgcuaccggugucagag

SEQ ID NO: 4238747 - RNA, 73 nt, Mycobacterium bovis subsp bovis AF2122/97
cgguaguuugucgggaucuugaccaagggagaaggucagacaaccuugcggauccagaucgacgagcagcacg

SEQ ID NO: 4238748 - RNA, 85 nt, Mycobacterium bovis subsp bovis AF2122/97
aucggcaggucuuuccauccgccuuaacgaagucggggucaaacuuggccgcgucgucauuggagguggaaaacgucugcugcau

SEQ ID NO: 4238749 - RNA, 73 nt, Mycobacterium bovis subsp bovis AF2122/97
ggugaacgggaccccgcgcaucgaaggccguuguagugucgacagccggugggcgauggucucguagcucacc

SEQ ID NO: 4238750 - RNA, 76 nt, Mycobacterium bovis subsp bovis AF2122/97
uucagccgugccgcgaucgcgucuggagugccguaggcgaccacggcgucaaccaggcggucgcugcccggccggg

SEQ ID NO: 4238751 - RNA, 80 nt, Mycobacterium bovis subsp bovis AF2122/97
guacggggugggcggugaacgcagccuggucgaagcggagcugcaccauuuguccggcuacgaucaugcccgcccggugc

SEQ ID NO: 4238752 - RNA, 55 nt, Mycobacterium bovis subsp bovis AF2122/97
gucgcgguuccaacuugagcgcgguccgcaacugauucaccguggcaaccccggc

SEQ ID NO: 4238753 - RNA, 65 nt, Mycobacterium bovis subsp bovis AF2122/97
gccaaccggugcaacaacgcacgcucagguccacucaacagagcaugcgaccauugcaccguggc

SEQ ID NO: 4238754 - RNA, 101 nt, Mycobacterium bovis subsp bovis AF2122/97
ggccgcgccugguaggccucggcgagcagacacaaaaucgcacgaaucaaccgcaaaccgugcgauuuugcgucugcucgccggcccgugcuagcgcgguu

SEQ ID NO: 4238755 - RNA, 78 nt, Mycobacterium bovis subsp bovis AF2122/97
ccgccgccugcuugcccuugucgagguugcgcacagccagcaccacgugugcaccaugggcggcaagcgcugcggcgg

SEQ ID NO: 4238756 - RNA, 78 nt, Mycobacterium bovis subsp bovis AF2122/97
cggcacgaaugaugccgucgguggccaggcguucgcccgguuuaacgaucaucuggucaccgacgugcaauucgguug

SEQ ID NO: 4238757 - RNA, 69 nt, Mycobacterium bovis subsp bovis AF2122/97
cggucgcauugcucagcaucgggcuggcuggguuuugccuacacgccacccugcugggcaugcuggccg

SEQ ID NO: 4238758 - RNA, 63 nt, Mycobacterium bovis subsp bovis AF2122/97
cgccgagcagacgcggaaucgcaccgugugggccccgccgaugcgauuccgcgucugcucgcg

SEQ ID NO: 4238759 - RNA, 80 nt, Mycobacterium bovis subsp bovis AF2122/97
acugggucggcaccaagaugacccuaccggugcuagugcggcucaguaccauguaggaguuagucucgaaccgccccagu

SEQ ID NO: 4238760 - RNA, 56 nt, Mycobacterium bovis subsp bovis AF2122/97
gcagucgacagcguugcuaccgggaugcacggcgguaccgacgaucggucggcugc

SEQ ID NO: 4238761 - RNA, 64 nt, Mycobacterium bovis subsp bovis AF2122/97
augcggucccugaucaaggaccgcucugcggccacgccgaugcggugcggaucagaggacccgu

SEQ ID NO: 4238762 - RNA, 56 nt, Mycobacterium bovis subsp bovis AF2122/97
ggcaggcugucggcucucaccgacagggagcuguccgagagguugacggcacugcc

SEQ ID NO: 4238763 - RNA, 76 nt, Mycobacterium bovis subsp bovis AF2122/97
acggcuggucgcgcucgucgacgucggaggugaucagcguggccgccucggcgucgguacgggcgaucaccaccgu

SEQ ID NO: 4238764 - RNA, 59 nt, Mycobacterium bovis subsp bovis AF2122/97
ccaggcgaaaccugucgguagcggccaaaaccaccgucucaccgaggauuucgacccgg

SEQ ID NO: 4238765 - RNA, 59 nt, Mycobacterium bovis subsp bovis AF2122/97
ggacaugaccgaacacgguugggcgaccgacgaauggcccgcccuguaucggcgugucc

SEQ ID NO: 4238766 - RNA, 75 nt, Mycobacterium bovis subsp bovis AF2122/97
gacugauagacguccauaucgccaugccuggccugcagaucgaccgccagagcaugggcguggacguugucgguc

SEQ ID NO: 4238767 - RNA, 60 nt, Mycobacterium bovis subsp bovis AF2122/97
gcggcaggcguuggcgugggcgaugucgguggcuggcaaacgcgccaacgcccugcucgc

SEQ ID NO: 4238768 - RNA, 55 nt, Mycobacterium bovis subsp bovis AF2122/97
gucggugaccgugcccggagggucggccugcgcccugauggcgucgaucaccggc

SEQ ID NO: 4238769 - RNA, 63 nt, Mycobacterium bovis subsp bovis AF2122/97
cggcggccccguggaccuggauugcgcggucgaugacaucgcaggccacccgcggggccaccg

SEQ ID NO: 4238770 - RNA, 72 nt, Mycobacterium bovis subsp bovis AF2122/97
gcguguuguugcuuucgguagugcuggcagugcgccugaaugugcuauucagcuaccaaggcaacgacaugu

SEQ ID NO: 4238771 - RNA, 55 nt, Mycobacterium bovis subsp bovis AF2122/97
ugggcugaacaggacggccgccaguggaggauaggugaacgggagguucagcccg

SEQ ID NO: 4238772 - RNA, 60 nt, Mycobacterium bovis subsp bovis AF2122/97
gcgagcagacgcagaaucgcaccgccacgcccgucggcgugcgauucugcgucugcucgc

SEQ ID NO: 4238773 - RNA, 89 nt, Mycobacterium bovis subsp bovis AF2122/97
ggugaccgggcuauuaguggucagaccggacggaugcggcauuaucagcgcuccgucggugauccuggccaccggcgggcucgggcacc

SEQ ID NO: 4238774 - RNA, 56 nt, Mycobacterium bovis subsp bovis AF2122/97
auggcguucgucggcugcggcgucauaagacggauuguccgggaccgcgaacccgu

SEQ ID NO: 4238775 - RNA, 89 nt, Mycobacterium bovis subsp bovis AF2122/97
cggccaucgcauaaugccgauugugaaucuggcgacgcgacacgccggugcggcgucgcgggauucacacucggcgauacgugucgccg

SEQ ID NO: 4238776 - RNA, 88 nt, Mycobacterium bovis subsp bovis AF2122/97
caacuccgggacugccaacuucggguuguucaacuccggcagcuacaacaccgguaucggcaacuccgggguggccagcaccggguug

SEQ ID NO: 4238777 - RNA, 91 nt, Mycobacterium bovis subsp bovis AF2122/97
gcggccauuguggaggcugaaagcugguucuugaagcguggucugcccucggugcugaccaugcggggccggugccgucggcuguggccgc

SEQ ID NO: 4238778 - RNA, 63 nt, Mycobacterium bovis subsp bovis AF2122/97
ggucaucgcgugauccuucgaaacgaccagcaaaagucaaucgaaggaaaugacgcaaugacc

SEQ ID NO: 4238779 - RNA, 56 nt, Mycobacterium bovis subsp bovis AF2122/97
gugauugcgugugacgccgcgcugagcccugcggcuugccggcgcaucgcgauugc

SEQ ID NO: 4238780 - RNA, 114 nt, Mycobacterium bovis subsp bovis AF2122/97
ccgaugcgaaggguuucacgacgacgacaggaccguuucgauuuugacagcaucgaaccaugaugacaauauauugucaaaguuggaggcgggauguccgaugagaucgcucgg

SEQ ID NO: 4238781 - RNA, 95 nt, Mycobacterium bovis subsp bovis AF2122/97
cuccuaacgucccuggaucgggcgugguacggugguguaccguggcuuguccaguacgguacucuuugguaccaaaccugacaagggauagguag

SEQ ID NO: 4238782 - RNA, 102 nt, Mycobacterium bovis subsp bovis AF2122/97
gcccgguuccuucccgggucgugccgacccgggucgucgccgggcugugcuugauuugcccgguuccuucccgggucgugccgacccgggucgucgccgggc

SEQ ID NO: 4238783 - RNA, 69 nt, Mycobacterium bovis subsp bovis AF2122/97
ggcggaugcccgcacccgcuggucgugguagccggcgccgcgacucgcuggguguggguaaaagacgcc

SEQ ID NO: 4238784 - RNA, 89 nt, Mycobacterium bovis subsp bovis AF2122/97
cgcguccauugccggcgaccaucgucaugcgcgccggagagcagacgcaguucagggugcaugugaccgauggcgcuccggccgacgug

SEQ ID NO: 4238785 - RNA, 66 nt, Mycobacterium bovis subsp bovis AF2122/97
cgggcagaucuuccugcagcuuggucaggcgagcacggcucuccucgacccggcugcggguguccg

SEQ ID NO: 4238786 - RNA, 58 nt, Mycobacterium bovis subsp bovis AF2122/97
guaugggucgauucggcggugcccaucggugaugugguggcgcaauucgaccaggugc

SEQ ID NO: 4238787 - RNA, 79 nt, Mycobacterium bovis subsp bovis AF2122/97
ggcgaugauguccgucgggaaggugaucgccgcguccgcggcaacggucggaaucaccuuccucggcaugagauucgcc

SEQ ID NO: 4238788 - RNA, 118 nt, Mycobacterium bovis subsp bovis AF2122/97
gaugaccgcccaaccgcauacggcucccggauggaucaaugucgaggauuucauccagcguuacgugcuuggugaacggcacucggcauauccgguugccgaucgggacggaucgauc

SEQ ID NO: 4238789 - RNA, 81 nt, Mycobacterium bovis subsp bovis AF2122/97
cgcuucgagccgggcauuacggccgucguugggcccaacggcuccggcaaauccaauguggucgaugcccuggcgugggug

SEQ ID NO: 4238790 - RNA, 83 nt, Mycobacterium bovis subsp bovis AF2122/97
cuugcuacgccgcguuggcggugugcgccgcccucgccugcaccaccgggcagccggccgcccgcgccgccgacgggcgcgag

SEQ ID NO: 4238791 - RNA, 107 nt, Mycobacterium bovis subsp bovis AF2122/97
ggccaacgucucgggcauguucaacaucggcagcaaccucgcgggguucuuccacgaccaggcgaccgggaugucgauguucaaccucggccugggaaacaucggcc

SEQ ID NO: 4238792 - RNA, 63 nt, Mycobacterium bovis subsp bovis AF2122/97
cugcgcgucauuggcgcggguuaugguuccaauccgaaccuucccggacaaguggcgcaccag

SEQ ID NO: 4238793 - RNA, 119 nt, Mycobacterium bovis subsp bovis AF2122/97
ucgucaucuccgcacgcgcggaacccauccgccgccugcucggcggccugaaugaaacgguguucaggcuacgguagcggugcgcacggggacaaacgcgacgugggcggaggucacgg

SEQ ID NO: 4238794 - RNA, 66 nt, Mycobacterium bovis subsp bovis AF2122/97
agcgccgagcguaacgccacugcgaaauuucgggcagaaaaucgcaguggcguuacgcucgcggcu

SEQ ID NO: 4238795 - RNA, 74 nt, Mycobacterium bovis subsp bovis AF2122/97
cuccaagggcaagccgauggccgcggacgccgaccucgacggacuggccaagcggaccgucggcaugaccggag

SEQ ID NO: 4238796 - RNA, 91 nt, Mycobacterium bovis subsp bovis AF2122/97
gcaugaggaacacgaauaccgcgaucgcuuuggccgccaccagccaccaggugucguggccgaacguggucauggccgccacuccuugcgc

SEQ ID NO: 4238797 - RNA, 60 nt, Mycobacterium bovis subsp bovis AF2122/97
ugagugccgcguucaugucggcaugcgccggcggcgaugucgagucgaacucggcgcucg

SEQ ID NO: 4238798 - RNA, 62 nt, Mycobacterium bovis subsp bovis AF2122/97
gugugcuugccgcgcuggggcgcaucgacuacugguucgucaccgacggccggcgggugcac

SEQ ID NO: 4238799 - RNA, 56 nt, Mycobacterium bovis subsp bovis AF2122/97
gaucaccgaauugguagaugacagcgucagcugcgcaucgacacaaucgguggauc

SEQ ID NO: 4238800 - RNA, 105 nt, Mycobacterium bovis subsp bovis AF2122/97
cgcgccauugguguuggaggaauggucaugucgcugaugguggcgccggagcugguggcggcggccgcggcggacuugaccgggauugggcaggccaucagcgcg

SEQ ID NO: 4238801 - RNA, 76 nt, Mycobacterium bovis subsp bovis AF2122/97
cagccgccgcggcagggaaaggccguggucggucuucaugauguaggccacgccgcccuugccggacugcgaguug

SEQ ID NO: 4238802 - RNA, 66 nt, Mycobacterium bovis subsp bovis AF2122/97
uaccacccacuuaacgccuacucggagugccggaacggcgcugaggugcugguguuggacguggug

SEQ ID NO: 4238803 - RNA, 77 nt, Mycobacterium bovis subsp bovis AF2122/97
cuaguggcgcgagcagacgcaaaaucgcccauuuugcgggcguguugggcgauuuugcgucugcucgccgucgccgg

SEQ ID NO: 4238804 - RNA, 79 nt, Mycobacterium bovis subsp bovis AF2122/97
ugggugagguuggugccgccacgcuugagccgauccuugagcucugcucgcgcucgacgugcggcagcagccuucucca

SEQ ID NO: 4238805 - RNA, 63 nt, Mycobacterium bovis subsp bovis AF2122/97
ccgcucgaugccggccucgaucuggcgggcauauccgcugaacuccuggccgagugucaccgg

SEQ ID NO: 4238806 - RNA, 65 nt, Mycobacterium bovis subsp bovis AF2122/97
ggcaugcgggugaugccgaacucggugcgcaacagcguucgagcggcauaccagccgcacaugcc

SEQ ID NO: 4238807 - RNA, 78 nt, Mycobacterium bovis subsp bovis AF2122/97
uggccgccgcuucggucacuuccucgucgcgcaccgagccaccgggguggacgaccgcggugacccccgcggcggcca

SEQ ID NO: 4238808 - RNA, 56 nt, Mycobacterium bovis subsp bovis AF2122/97
gcgcugaccgcggcucaguuugcugcgcacgcgcagauguaccaaacggucagcgc

SEQ ID NO: 4238809 - RNA, 118 nt, Mycobacterium bovis subsp bovis AF2122/97
acgcaugggacuacagguucugugagcggugcggcucgccgaucggcguggugcccuggccgucggaggaaucaggcacacgccagacggcgcccgcgcgauccuucgucccccucgu

SEQ ID NO: 4238810 - RNA, 72 nt, Mycobacterium bovis subsp bovis AF2122/97
gguguugcgcucgaugagccuggucaucaccccgcccuuggucucgauacccaggcucagcgggguaacauc

SEQ ID NO: 4238811 - RNA, 55 nt, Mycobacterium bovis subsp bovis AF2122/97
cggcugauccccaucgagggcagccgucgccuggucgaaugugugggaucggccg

SEQ ID NO: 4238812 - RNA, 75 nt, Mycobacterium bovis subsp bovis AF2122/97
ccucggccacggcgaugggcuggagcccguucuauccacaauucgaucgguccagucucgaugucgccgacgagg

SEQ ID NO: 4238813 - RNA, 68 nt, Mycobacterium bovis subsp bovis AF2122/97
uggagucggggcgcugagcguggaguucggcaguucggccgagcgcagcucgggcuucggcaacuccg

SEQ ID NO: 4238814 - RNA, 111 nt, Mycobacterium bovis subsp bovis AF2122/97
ccugaucgaccggcaccaggagcucuuggccgucgacaagcagcguggcuuccuuggcgcccagcuccagcagcuugcugaucgccucggacgcuuuuccgguugcucugg

SEQ ID NO: 4238815 - RNA, 65 nt, Mycobacterium bovis subsp bovis AF2122/97
ccgcgagcagacgcagaaucgcccauuugggcuaccaaaugggcgauucugcgucugcucggcgg

SEQ ID NO: 4238816 - RNA, 57 nt, Mycobacterium bovis subsp bovis AF2122/97
gccuuggaugcaggcuaucgccgacgcgaccggccggccgguggagguguccagggu

SEQ ID NO: 4238817 - RNA, 80 nt, Mycobacterium bovis subsp bovis AF2122/97
ggccggcggccuguacgugcugggcaccgagcgccacgagucgcggcggaucgacaaccaguugcguggccgguccggcc

SEQ ID NO: 4238818 - RNA, 64 nt, Mycobacterium bovis subsp bovis AF2122/97
cguauuuccagcggcacgcauucggcgugggugccgggcgccgaguugcgucgcugggaucacg

SEQ ID NO: 4238819 - RNA, 64 nt, Mycobacterium bovis subsp bovis AF2122/97
augcccgucguacggcuggaucugggcggugucgaucgcccgguuguccagauacgacgugcgu

SEQ ID NO: 4238820 - RNA, 129 nt, Mycobacterium bovis subsp bovis AF2122/97
guaggaggccagcuugcgcgccuuggugggcgacucgacgaugaccagucgccggccgcugccauugccgccgcugccacggcccuucguuuucgggucagccaacugcgcccacgcuccaucucuuau

SEQ ID NO: 4238821 - RNA, 63 nt, Mycobacterium bovis subsp bovis AF2122/97
uucacccagcgcgacgccgucggggguccgcagcgacacgucgacggcaacccgcugugugaa

SEQ ID NO: 4238822 - RNA, 56 nt, Mycobacterium bovis subsp bovis AF2122/97
gagcagacgcaaaaucgcccuggaacgcacgguucagggcgauuuugcgucugcuc

SEQ ID NO: 4238823 - RNA, 78 nt, Mycobacterium bovis subsp bovis AF2122/97
ugcugcgcugccggcguuggcugccuuggguaucguugagugguggucaaccgggcauugcuggcgagcgucgacgca

SEQ ID NO: 4238824 - RNA, 72 nt, Mycobacterium bovis subsp bovis AF2122/97
ccgccggguugguggcggccagcagcaacgagugaccgucggcguguugcaggcccucaccggucagggugg

SEQ ID NO: 4238825 - RNA, 58 nt, Mycobacterium bovis subsp bovis AF2122/97
cgagcagacgcaaaaucgcccaauucggcacgaaauugggcgauuuugcgucugcucg

SEQ ID NO: 4238826 - RNA, 85 nt, Mycobacterium bovis subsp bovis AF2122/97
cuuggcuaccuggaaacggcugugcgaucccauggcccagcagaucuccacggucugggcgucgucgcugccggaagaggccaag

SEQ ID NO: 4238827 - RNA, 129 nt, Mycobacterium bovis subsp bovis AF2122/97
gggcuggcggucgucauacuuuccggggucgcggcggcggccaacgaggcagcggcggcccuccucggcuucccgcugcugcucgugguuggggugucgcuggccuauuuguaugucguccugcuguuc

SEQ ID NO: 4238828 - RNA, 85 nt, Mycobacterium bovis subsp bovis AF2122/97
ggcgagcgacgccgaaucggcacuguugcagcgggucgaacggaucgagacccgguuggacaugucgaucccggcgccgcaagcc

SEQ ID NO: 4238829 - RNA, 76 nt, Mycobacterium bovis subsp bovis AF2122/97
gggguaaucguguggggucucaucuucugguccgcgguauuucaccggaagaagaacaccgacacugaguugcccc

SEQ ID NO: 4238830 - RNA, 78 nt, Mycobacterium bovis subsp bovis AF2122/97
cggguggguaucggugacgcgcgaccggaagcuggcgagcacaucaccaucgucgacgugaucaccgauacguauucg

SEQ ID NO: 4238831 - RNA, 65 nt, Mycobacterium bovis subsp bovis AF2122/97
ggccaucggcgggaucuccuucggugcgugcuuggcgguacacaccgacgaucucgccgacggcc

SEQ ID NO: 4238832 - RNA, 82 nt, Mycobacterium bovis subsp bovis AF2122/97
cgugucaggccgaccguucgaagauguggaauccgaucuugcgcuugcuuuuucgcgugacugagcggucugcugugacgcg

SEQ ID NO: 4238833 - RNA, 60 nt, Mycobacterium bovis subsp bovis AF2122/97
cuuguuggggcuguccgguccggucacccacucggcgagggaugugguagccccggcgag

SEQ ID NO: 4238834 - RNA, 58 nt, Mycobacterium bovis subsp bovis AF2122/97
gggcaucgugcugggcggaucgggcaacggggagcagaucgccgccaacaaggugccc

SEQ ID NO: 4238835 - RNA, 74 nt, Mycobacterium bovis subsp bovis AF2122/97
caugccgaaguccguguccacuggggucuuucgucacuucacuggcccacaaagccccggggaccgucgaugug

SEQ ID NO: 4238836 - RNA, 55 nt, Mycobacterium bovis subsp bovis AF2122/97
ucgggguggugcaggauggcgucgacggccuccuugucgccgugcaccaccugga

SEQ ID NO: 4238837 - RNA, 65 nt, Mycobacterium bovis subsp bovis AF2122/97
cgccgugauugugcccggcaccagcagcagcgugaaaggcggcugguugcaugacaaucacgacg

SEQ ID NO: 4238838 - RNA, 72 nt, Mycobacterium bovis subsp bovis AF2122/97
uggccgaaguaauuucgcggcuggcuggguagucgccgcuuccagccggagucaccgaaaucacuugcgcca

SEQ ID NO: 4238839 - RNA, 56 nt, Mycobacterium bovis subsp bovis AF2122/97
gaccauugcacgccuuugagguugucgcuacccgacaccucgcgccgcacaugguc

SEQ ID NO: 4238840 - RNA, 73 nt, Mycobacterium bovis subsp bovis AF2122/97
gggugcuggcgaucaccgugcgccgcaacggcacccgccuggaugcgagcgugcgggugcucguccaacgccc

SEQ ID NO: 4238841 - RNA, 60 nt, Mycobacterium bovis subsp bovis AF2122/97
uccaucagggcgaagguguggcugccggcaagcgggaccagcgcgacuucacuuugugga

SEQ ID NO: 4238842 - RNA, 77 nt, Mycobacterium bovis subsp bovis AF2122/97
cuagucugccgagcagacgcaaaagcacccuuuugcggcgcaaaaguggcgcuuuugcgucugcucgcgcauuugag

SEQ ID NO: 4238843 - RNA, 58 nt, Mycobacterium bovis subsp bovis AF2122/97
gcguggagaccgagaucagcggguccgguaacgguccguuggccgcguucguccaugc

SEQ ID NO: 4238844 - RNA, 74 nt, Mycobacterium bovis subsp bovis AF2122/97
gcgcacgucguugucggcuccuuguguuucugauccuugacaagccagaaaccuuaagccacaacgacgugcgc

SEQ ID NO: 4238845 - RNA, 64 nt, Mycobacterium bovis subsp bovis AF2122/97
gaugcggcgcggguugucgacgagcauggugugcagcugcucgucggugacgccgugcugcuuc

SEQ ID NO: 4238846 - RNA, 58 nt, Mycobacterium bovis subsp bovis AF2122/97
gcccgcggcgugcugguggucaacgccccgacgucgaacauccacagcgccgcggagc

SEQ ID NO: 4238847 - RNA, 59 nt, Mycobacterium bovis subsp bovis AF2122/97
cgccgaacaaugugcggaucucguaaagcuccuuggccgagcauucgaugaugucggug

SEQ ID NO: 4238848 - RNA, 108 nt, Mycobacterium bovis subsp bovis AF2122/97
gccgauggcaguccggucaguaucgagggcaccggccuguucgcgcggaugcugcagcacgaaaccgggcaccuugauggauuccuguaccuggaccgccucaucggc

SEQ ID NO: 4238849 - RNA, 67 nt, Mycobacterium bovis subsp bovis AF2122/97
guagggcugcacgacagcgucgaagucgguguugaguugaccgaccguuccgucgugcagucgcugc

SEQ ID NO: 4238850 - RNA, 58 nt, Mycobacterium bovis subsp bovis AF2122/97
cugggcgaugaagcgcugggucaccgcgcccagcggcccggcggcuuugcucgcccag

SEQ ID NO: 4238851 - RNA, 66 nt, Mycobacterium bovis subsp bovis AF2122/97
uucgaugcggugcucucgaccaucggggugauguucgccccgcgucaucagcgcaccgccgacgaa

SEQ ID NO: 4238852 - RNA, 129 nt, Mycobacterium bovis subsp bovis AF2122/97
guuccgguccuuguaauaggcgaucugccgcagcgcuguuaccggguccauuaucgggcucacaccaguugcccgaagacgaccccggugacaaccaccgcgaagccggccauuucgccgaggaugagc

SEQ ID NO: 4238853 - RNA, 55 nt, Mycobacterium bovis subsp bovis AF2122/97
gggcucgggcaaugucagcgcgcuagauaccuugcgcgccauggcaacccggccc

SEQ ID NO: 4238854 - RNA, 98 nt, Mycobacterium bovis subsp bovis AF2122/97
gcucggacacgaggccgcgggcaucaucgaggccgucgggccggguguaaccgcagucgagcccggcgacuucgugauccugaacuggcgugccgugu

SEQ ID NO: 4238855 - RNA, 70 nt, Mycobacterium bovis subsp bovis AF2122/97
ggccacguugcuggacauggugcgggaccacuuugugcuggcgcccgacgccgaagucagcaccgaggcc

SEQ ID NO: 4238856 - RNA, 69 nt, Mycobacterium bovis subsp bovis AF2122/97
gggcggcuuauggcucgucggugcugcucgaucacgugcugaccggcuucgacggccguagcgccgccc

SEQ ID NO: 4238857 - RNA, 62 nt, Mycobacterium bovis subsp bovis AF2122/97
ggcgaacagacgcaaaagcccccgcacgcacggagugucgggggcuuuugcgucuacucgcc

SEQ ID NO: 4238858 - RNA, 68 nt, Mycobacterium bovis subsp bovis AF2122/97
cuucgccgaacgugaagccagggcgagaaaacggccgaaaucucgcccugaguucacgcucggcgcag

SEQ ID NO: 4238859 - RNA, 71 nt, Mycobacterium bovis subsp bovis AF2122/97
gccgugccggccugaugaugguguugcucgaugaagacgagcgagccagucagcaggccuuccuguucggc

SEQ ID NO: 4238860 - RNA, 86 nt, Mycobacterium bovis subsp bovis AF2122/97
cucaacgucaccgccggccuggauucgauaugggugacguaggccucgaccgccugacgaaucuggucgugccagucggcguuugg

SEQ ID NO: 4238861 - RNA, 57 nt, Mycobacterium bovis subsp bovis AF2122/97
ucgggcggcaaacccccggagccugccgacucgucuuccguggugaugaccgcccga

SEQ ID NO: 4238862 - RNA, 64 nt, Mycobacterium bovis subsp bovis AF2122/97
ccgagcgugaacugagggcggagaaucagagccccccgauuuuccgcccgcagaacacguuggg

SEQ ID NO: 4238863 - RNA, 102 nt, Mycobacterium bovis subsp bovis AF2122/97
gcucucgcgacucggcugauaagaacagcgcaucgaucggugacaucaguuccauggcgugcuccuggugaugcgcuucaccgucagccggcucgccgaagc

SEQ ID NO: 4238864 - RNA, 56 nt, Mycobacterium bovis subsp bovis AF2122/97
gcuggacguuugagacggugaucgggccgaaccugaauuguccgguaaugcccagc

SEQ ID NO: 4238865 - RNA, 64 nt, Mycobacterium bovis subsp bovis AF2122/97
ccgacacugagacgcaaagggcccccauuucgugccgaaauggggugcuuuugcgucugcucgg

SEQ ID NO: 4238866 - RNA, 66 nt, Mycobacterium bovis subsp bovis AF2122/97
ccgcgacagugcgcaggucggcgacgucggcccggucgacggccaccaccagcgacucgugcgcgg

SEQ ID NO: 4238867 - RNA, 99 nt, Mycobacterium bovis subsp bovis AF2122/97
guuggggucgcguggcguggaaccuggcacggcgggcugcaauucaccacgaagugcugugcaccgaugucgguucccaucggcacccagaccuugcac

SEQ ID NO: 4238868 - RNA, 60 nt, Mycobacterium bovis subsp bovis AF2122/97
cgaaaucgacauuagcgcggugucuucucgucgaacuuugucgcgcugcugucgauuucg

SEQ ID NO: 4238869 - RNA, 98 nt, Mycobacterium bovis subsp bovis AF2122/97
gcagcgcucaacuagccccgccaagcagacgcagaaucgcauuaaucgcgcccgguuugugcgauucugcgucugcuuggcagcaccucaggcgccgc

SEQ ID NO: 4238870 - RNA, 79 nt, Mycobacterium bovis subsp bovis AF2122/97
gcgccggcggucagcacgcaugugcgguggccgacgcccucggcauccgcacggugcugaucccaccaauggccggcgu

SEQ ID NO: 4238871 - RNA, 58 nt, Mycobacterium bovis subsp bovis AF2122/97
gaauaccauugcccccgcggugcgucuagggaccucacuguuggccgcggagguauuc

SEQ ID NO: 4238872 - RNA, 61 nt, Mycobacterium bovis subsp bovis AF2122/97
uugucaacgucggcgacaucaaccggcuguuuccgcaggguggugccgucggcguggacga

SEQ ID NO: 4238873 - RNA, 96 nt, Mycobacterium bovis subsp bovis AF2122/97
ugcacaugccggcaggcauggcagguuuucgacgaugggcccaaaccaaugauccgaccgcccacgccgagagccuugccauccgugccgcgugca

SEQ ID NO: 4238874 - RNA, 96 nt, Mycobacterium bovis subsp bovis AF2122/97
ugaucggcgcgacaagaucgcagcgcucguguucgaugcggccaucgccuuugcggccguggucacagacgaucacgauguuguggugccggcuca

SEQ ID NO: 4238875 - RNA, 59 nt, Mycobacterium bovis subsp bovis AF2122/97
ccucggcggcuucgaugacacggucguuggcggcgaucuugucgucgaaggcgccuagg

SEQ ID NO: 4238876 - RNA, 80 nt, Mycobacterium bovis subsp bovis AF2122/97
ggggcaacaacaggguggugaaguuggcggccggauccaagacccagaccgugcugccguucaccggccucaacgacccc

SEQ ID NO: 4238877 - RNA, 65 nt, Mycobacterium bovis subsp bovis AF2122/97
gcggcgagcagacacagacucgcauccggcgccccucgcccgugcgauucugugucugcucgcgc

SEQ ID NO: 4238878 - RNA, 69 nt, Mycobacterium bovis subsp bovis AF2122/97
ccggucgauauggcggugucgcacaacaucuuccagagucugguguucggcgccuucgcugucgaccgg

SEQ ID NO: 4238879 - RNA, 61 nt, Mycobacterium bovis subsp bovis AF2122/97
cgcaaucucgguggucaugaugaagacgugcucgugcaucagcgugacgccgagaucagcg

SEQ ID NO: 4238880 - RNA, 68 nt, Mycobacterium bovis subsp bovis AF2122/97
cccggcgagcagacgcauaagcccccgcacgcacggcgugucgggggcuuaugcgucugcucgccggg

SEQ ID NO: 4238881 - RNA, 96 nt, Mycobacterium bovis subsp bovis AF2122/97
gucguagaggugcuugucggccgcagucacauggcaaggauagucggccuaugaaauuuccucagucguugacagcgcucugccagguaccgcgac

SEQ ID NO: 4238882 - RNA, 118 nt, Mycobacterium bovis subsp bovis AF2122/97
aacuccgucacccuggucaccuaaggccgccgagcagacgcaaaauccccucgacacgccgguugcgaggggauuuugcgucugcucacgcgggucguuaccaggcguggacgcgguu

SEQ ID NO: 4238883 - RNA, 57 nt, Mycobacterium bovis subsp bovis AF2122/97
ccggaucagcggggacuugguuucggucagcgccgcgaucuccuccucgcugagcgg

SEQ ID NO: 4238884 - RNA, 104 nt, Mycobacterium bovis subsp bovis AF2122/97
gcgcagcggcaccguuauccguugacucugcguccaccacgcaaaagugcgaguaacccgccugguggacgcagagucaacacgaugcgacgucggaccugcgc

SEQ ID NO: 4238885 - RNA, 77 nt, Mycobacterium bovis subsp bovis AF2122/97
cggcgggaacggcggacuguucggagccggcggcaccggcggcgccgccggcucgggaggguccgggaucaccaccg

SEQ ID NO: 4238886 - RNA, 89 nt, Mycobacterium bovis subsp bovis AF2122/97
guaucgauucgcugaugauccagcgcggcugcgguggcgucaccgccauauaacccacaccgcgaacggugucgaucaucgauucgugc

SEQ ID NO: 4238887 - RNA, 57 nt, Mycobacterium bovis subsp bovis AF2122/97
ugcccgcucucggcgacucguuggaacacagacuucagcguugccagguagcgggca

SEQ ID NO: 4238888 - RNA, 59 nt, Mycobacterium bovis subsp bovis AF2122/97
cguuugcacgagcgggucaacacgcuuuguucggcguagcccaguucacgugccaaaug

SEQ ID NO: 4238889 - RNA, 59 nt, Mycobacterium bovis subsp bovis AF2122/97
gacgagugccguugcggcgcaccgagaucgccaauacucgcgcccgaccggccuugauc

SEQ ID NO: 4238890 - RNA, 58 nt, Mycobacterium bovis subsp bovis AF2122/97
cgagcagacgcaaaaucgcccaauuucgugccgaauugggcgauuuugcgucugcucg

SEQ ID NO: 4238891 - RNA, 116 nt, Mycobacterium bovis subsp bovis AF2122/97
cgguucgcagaucuucgacguggacggcuucgaacucgccgcgcaccgugucaucggccugcuacgcgacgucgucggcgaguucggucccgaaaagacggcacagaucgcgaccg

SEQ ID NO: 4238892 - RNA, 102 nt, Mycobacterium bovis subsp bovis AF2122/97
gcgcacggggcugccuacgccgaacgugcaaccacggcggcgucgcccgggcgugucgccgccaccagugcacauucggcgcagccagcccacgcucggcgc

SEQ ID NO: 4238893 - RNA, 66 nt, Mycobacterium bovis subsp bovis AF2122/97
guugccgaacucgucgaaccgcagcgcguggccugccaacgugggcgccucggcggguucggcggc

SEQ ID NO: 4238894 - RNA, 65 nt, Mycobacterium bovis subsp bovis AF2122/97
gcggaggagcgugcuucgauuccggcccacgucacccugggcagaaucgcgaacacggcucccgc

SEQ ID NO: 4238895 - RNA, 68 nt, Mycobacterium bovis subsp bovis AF2122/97
gcagcggaaccgcgauacguccggccugcaacgcgccgagaaauccaacgacguauucgauucccugc

SEQ ID NO: 4238896 - RNA, 86 nt, Mycobacterium bovis subsp bovis AF2122/97
gcgcgaguuugcgccgcgagcguaacgccacggcgaauucggugcacgcaagcucgccguggcguuacgcucgcggcggcuggcgc

SEQ ID NO: 4238897 - RNA, 65 nt, Mycobacterium bovis subsp bovis AF2122/97
ggugcuggggguccgcuggcggucagcuggucgacgucagcccaaggaaugcccccagguccacc

SEQ ID NO: 4238898 - RNA, 57 nt, Mycobacterium bovis subsp bovis AF2122/97
ccgggcugguucuggaucggcggacgcgcggcggcgcugaccgggacgccggccugg

SEQ ID NO: 4238899 - RNA, 56 nt, Mycobacterium bovis subsp bovis AF2122/97
aucgcagccacggaguucgauuaccuggagaugugggcucaggauguggcugcgau

SEQ ID NO: 4238900 - RNA, 76 nt, Mycobacterium bovis subsp bovis AF2122/97
gcauaggcuuccggcgcgaccggucugaucggcuucuucuucuugaccgcggacacgaucgcgucggcuaccuugu

SEQ ID NO: 4238901 - RNA, 83 nt, Mycobacterium bovis subsp bovis AF2122/97
gcguugccgccgacugcgaccggugugcgcgccgccggggaucccgaccugcuggugucgcgggucgcggucugcggcggcgc

SEQ ID NO: 4238902 - RNA, 64 nt, Mycobacterium bovis subsp bovis AF2122/97
gggccugcagcugguuuccgucggcuccagucggagccuugcggacggcacagcugccgugcuc

SEQ ID NO: 4238903 - RNA, 75 nt, Mycobacterium bovis subsp bovis AF2122/97
ggcacgugacuauaucaccguuaucggagcgaucguguuaccgauucucuucauggugguguugaacauugugcu

SEQ ID NO: 4238904 - RNA, 94 nt, Mycobacterium bovis subsp bovis AF2122/97
ggcuagcuuccgccgcgagcagacgcaaaaucacccggaaaccggcgauuuugggcgacuuugcgucugcucacgcaagguggacccgcuagcc

SEQ ID NO: 4238905 - RNA, 74 nt, Mycobacterium bovis subsp bovis AF2122/97
gcgcacgucguuguggcuuaagguuucuggcuugucaaggaucagaaacacaaggagccgacaacgacgugcgc

SEQ ID NO: 4238906 - RNA, 93 nt, Mycobacterium bovis subsp bovis AF2122/97
ugcgcuggggcgccuuuggauguagcggggcuaccgcgguuggccgccgguacccaggcugcaaucauucacgguauggcgcaaccaccguca

SEQ ID NO: 4238907 - RNA, 88 nt, Mycobacterium bovis subsp bovis AF2122/97
ggccuugggauagaucucccggugcaccgccaccaacggcucgagcaccggauugguggugcugcgcugggcggucauccgccgggcc

SEQ ID NO: 4238908 - RNA, 57 nt, Mycobacterium bovis subsp bovis AF2122/97
ggcgguagguccgagcuauccugacgugucaguucggcauagcccuggaucgccgcc

SEQ ID NO: 4238909 - RNA, 90 nt, Mycobacterium bovis subsp bovis AF2122/97
gcucgcggcgcacccguugaccaccgggcugcaugucgcggcggcggugucgcaugcgcugcggcccggugaccagcuggugcucggggc

SEQ ID NO: 4238910 - RNA, 64 nt, Mycobacterium bovis subsp bovis AF2122/97
gggcgagcagacgcauaagcccccgcacgcacggcgugucgagggcuuuagugucugcucgcgc

SEQ ID NO: 4238911 - RNA, 110 nt, Mycobacterium bovis subsp bovis AF2122/97
ucgcggaucaccgaccgggucaucgaggagaugcaggcguggugguccaggccgcuggagaaggucuacgccgcgguguucaucgacgcgaucauggucaagauccgcga

SEQ ID NO: 4238912 - RNA, 84 nt, Mycobacterium bovis subsp bovis AF2122/97
gcggguauagcugaccgggucgcucaugcucucgauugaaucagaucagcauugggggaucuugugcgcccgcaguuagccugc

SEQ ID NO: 4238913 - RNA, 94 nt, Mycobacterium bovis subsp bovis AF2122/97
cgugcgcagccagcggcuuucgguguucgaacugcaggcccgggcgacccugggucuggcgguggacacccugaugaucucgccgggugccgcg

SEQ ID NO: 4238914 - RNA, 72 nt, Mycobacterium bovis subsp bovis AF2122/97
ugguguuguucuccaccacccaguaguagauguggccggccgcgucuccgacguacuggauggugagcacca

SEQ ID NO: 4238915 - RNA, 84 nt, Mycobacterium bovis subsp bovis AF2122/97
gcggcgccgucgacggcaucggccccggcgugccaagcggccacauagcuggcgagcuggccacccggugugucgugggugugc

SEQ ID NO: 4238916 - RNA, 104 nt, Mycobacterium bovis subsp bovis AF2122/97
cgaaaugcucgaagauggccgcuacgucggaucugucggccgcggcggccgucccaagcuguagcggucgcgauaccguguagcaggcggucuugagcgucgcg

SEQ ID NO: 4238917 - RNA, 105 nt, Mycobacterium bovis subsp bovis AF2122/97
gcccgggccgucgucgccgacgccugccacgcgcccacacccaccaacgccgccaccgcgcggcuggccgccagcgaggcguugagcaccgcggcggccgagggc

SEQ ID NO: 4238918 - RNA, 59 nt, Mycobacterium bovis subsp bovis AF2122/97
gcguggcgguggggucggcgguugcgauguuggccgcggccgccgcaaagccgucaagu

SEQ ID NO: 4238919 - RNA, 66 nt, Mycobacterium bovis subsp bovis AF2122/97
gggcgggcagacgcguaagcgcccaaugucgugccgaaaugggcgcuuaugcgucugcucgcgccc

SEQ ID NO: 4238920 - RNA, 62 nt, Mycobacterium bovis subsp bovis AF2122/97
guuuguggcacaagucgcaucaaacacgcugaucacgcgguuugcggcggcuguccgcagac

SEQ ID NO: 4238921 - RNA, 60 nt, Mycobacterium bovis subsp bovis AF2122/97
ggugaggucguagccgguggacaccuuggccauccugccgccgguucggaugaucucgcc

SEQ ID NO: 4238922 - RNA, 82 nt, Mycobacterium bovis subsp bovis AF2122/97
cgcgcgcaccccgcgagcagacacagagucgcacaaaaucggcgguuuugaugcgacucugugucugcucgcccagcacgcg

SEQ ID NO: 4238923 - RNA, 80 nt, Mycobacterium bovis subsp bovis AF2122/97
cuugaacgccgggauguguuugguggucgggaugugcgguccgcggcacaggucgccccagacgcgcucgcgggugcggg

SEQ ID NO: 4238924 - RNA, 65 nt, Mycobacterium bovis subsp bovis AF2122/97
gcgcgagcagacgcagaaucgcacgcggaaaggcuuccgcgugcgauucugcgucugcucggcgc

SEQ ID NO: 4238925 - RNA, 57 nt, Mycobacterium bovis subsp bovis AF2122/97
gaugggugccacggugaaugguugaaguauggagaccucgcccccgggcaugccguc

SEQ ID NO: 4238926 - RNA, 57 nt, Mycobacterium bovis subsp bovis AF2122/97
gcaugugccgcucaucgcccgguggauugacauccaccggcgccggcggcaacaagu

SEQ ID NO: 4238927 - RNA, 92 nt, Mycobacterium bovis subsp bovis AF2122/97
gcguugacggccugaaggcugcggguaugaaacgcaucacugucagucuugauacguugcaacccgagcgcuucaaggcgauaagucagcgu

SEQ ID NO: 4238928 - RNA, 76 nt, Mycobacterium bovis subsp bovis AF2122/97
ggcugucacgucugcuggucgaugcgggacuggccuaacucgcggccggccguaucgucgugcagaucuugcagcc

SEQ ID NO: 4238929 - RNA, 58 nt, Mycobacterium bovis subsp bovis AF2122/97
guugugaagacgccauucgcagaguuagcaagcgugcugcgauugguguuuccgccac

SEQ ID NO: 4238930 - RNA, 56 nt, Mycobacterium bovis subsp bovis AF2122/97
gccaacaccgacgacggucgcagcgugauccgccauucgaccgcgcacguguuggc

SEQ ID NO: 4238931 - RNA, 124 nt, Mycobacterium bovis subsp bovis AF2122/97
ggugcguaucgggaucggccgcccgcccggccgcaaggacccggcggcguuuguguuggagaacuuuaccccggccgagcgcgccgagguccccacgaucugcgagcaggccgccgaugccacc

SEQ ID NO: 4238932 - RNA, 61 nt, Mycobacterium bovis subsp bovis AF2122/97
gccggugccgaucuugcucggucaugaagccgcuggaaucgucgagcaggucggcgacggc

SEQ ID NO: 4238933 - RNA, 56 nt, Mycobacterium bovis subsp bovis AF2122/97
gagcagacgcaaaagcccccauuucgggcccgaaaugggggcuuuugcgucugcuc

SEQ ID NO: 4238934 - RNA, 96 nt, Mycobacterium bovis subsp bovis AF2122/97
ggccggugacgugcgggacaaugggaugaguccaccuggcggcagcagaucguuggcccccuugcccucaccccguuugagcuccacguaccgguu

SEQ ID NO: 4238935 - RNA, 102 nt, Mycobacterium bovis subsp bovis AF2122/97
gcccggcgacgacccgggucggcacgacccgggaaggaaccgggcaaaucaagcacagcccggcgacgacccgggucggcacgacccgggaaggaaccgggc

SEQ ID NO: 4238936 - RNA, 130 nt, Mycobacterium bovis subsp bovis AF2122/97
gcgauggaucguguuguugaagggggcgucguagucgucggccugcgccggcgcugccaaacuaacggcagccaccgucaugccgacgacaacagccagcuuuguucccuucauuagccggacuauacgc

SEQ ID NO: 4238937 - RNA, 62 nt, Mycobacterium bovis subsp bovis AF2122/97
cggccggcuguaugccggugaugaucggcuggucggccaucaccggcaccauagccuggccg

SEQ ID NO: 4238938 - RNA, 70 nt, Mycobacterium bovis subsp bovis AF2122/97
ggcguacagcgagaccagcucgcccgcgaucucgcgcaccgcgcggcgcgccuuggucuugguguuggcc

SEQ ID NO: 4238939 - RNA, 62 nt, Mycobacterium bovis subsp bovis AF2122/97
ggacggucgggcgccaucgacgccggacgaggucgcggugucgagcacgcugggccgaaacc

SEQ ID NO: 4238940 - RNA, 57 nt, Mycobacterium bovis subsp bovis AF2122/97
guuaucggcggugaccgugggauuguucggguuggcgccgcgguucacgccgguggc

SEQ ID NO: 4238941 - RNA, 97 nt, Mycobacterium bovis subsp bovis AF2122/97
gcgaacuccgcguuaucggacaggucggcaccaccaucgggcucggucuacuuuucgauacccuggugguccgaucguucaugacgccauccaucgc

SEQ ID NO: 4238942 - RNA, 89 nt, Mycobacterium bovis subsp bovis AF2122/97
cggaugacugccacgcugagccguggcgaauugaucaccacggaggacgcuuuggaguucgcccacggcugugugucgugcacaauccg

SEQ ID NO: 4238943 - RNA, 55 nt, Mycobacterium bovis subsp bovis AF2122/97
ggaaccgcugcgagugugcgccggugucgaaaucgggcacaaacggcucgguucc

SEQ ID NO: 4238944 - RNA, 113 nt, Mycobacterium bovis subsp bovis AF2122/97
cgcccccaguucgccaccggcggccagccuggucaccgugccgaaggucugcagccgguaggccugcgccuugauccaggcgucggcgacccggucggcgaacuccgggggcg

SEQ ID NO: 4238945 - RNA, 77 nt, Mycobacterium bovis subsp bovis AF2122/97
gcuaggcgagcgccggcgcguacugcugcagcucaggcgagaaccacugcauagacccgcggcgcuguagcgccagc

SEQ ID NO: 4238946 - RNA, 76 nt, Mycobacterium bovis subsp bovis AF2122/97
ucgccgcgcgccucggcggugaucuugccuacuucgacugugaccagugucgcgagguccugcuggugugcgguga

SEQ ID NO: 4238947 - RNA, 75 nt, Mycobacterium bovis subsp bovis AF2122/97
uguccgcgaugaccuugaucggugcggguccgcggccgcugccgcaugcgacggcaccgaucaucacggcgguca

SEQ ID NO: 4238948 - RNA, 129 nt, Mycobacterium bovis subsp bovis AF2122/97
guuggguuggucgagcaaugcuuguaguucgcgggugaccucguugaaacgagucgacggguuggguuggucgaccgugacggcaggggcguucgccagcuggaugucgagguguucggccaacucggc

SEQ ID NO: 4238949 - RNA, 75 nt, Mycobacterium bovis subsp bovis AF2122/97
gucguuggugaguacccggucgguguucgaccaucgcgcggugguggugggcgcugaucgggggcgucugauggc

SEQ ID NO: 4238950 - RNA, 78 nt, Mycobacterium bovis subsp bovis AF2122/97
acucggaauucaacgagguguucuucaacgaugucuucguccccgaugaggacguugucggggcgccgaacuccgggu

SEQ ID NO: 4238951 - RNA, 60 nt, Mycobacterium bovis subsp bovis AF2122/97
cgggugaucaccgcggcagcguuggugauguccaugucguucgccgcguugaucgcugcg

SEQ ID NO: 4238952 - RNA, 123 nt, Mycobacterium bovis subsp bovis AF2122/97
gcgcuacguucuaucguuccgucaaucugccgugguugucgagcaucaucgccgaccagcaucucggcgguggaauugcuuggagccuaacggaauugccggucaucauggucaucguggcgc

SEQ ID NO: 4238953 - RNA, 95 nt, Mycobacterium bovis subsp bovis AF2122/97
ggugcaggucgagucguggucgcaugaguggcgagcuaauuggaagguggcggcggaaaauggucaugagaacuaccacgugcucggccugcauc

SEQ ID NO: 4238954 - RNA, 95 nt, Mycobacterium bovis subsp bovis AF2122/97
gagccgcugucuucgccgagccuuuaguuaucgugcucggcggcacucgccguuugucgcgguaucuacaggcucggcgaugcgggccugcgcuc

SEQ ID NO: 4238955 - RNA, 62 nt, Mycobacterium bovis subsp bovis AF2122/97
gcgcgcggacgucgaugucgagcuguugggccaacgacagcugcugguuugagucugcgugc

SEQ ID NO: 4238956 - RNA, 59 nt, Mycobacterium bovis subsp bovis AF2122/97
cacccguaugaucgcugcggccacugcgucgcguugccagccagcgagcaugccgggug

SEQ ID NO: 4238957 - RNA, 130 nt, Mycobacterium bovis subsp bovis AF2122/97
cggcgcugcugccggcggcaaaccaagagcccgagcauggcugaacgggcgccacgcggcgaagucgccgugaugguggccgugcagucggcgcuggucgaccguccggggaugcuggccacugcgcgcg

SEQ ID NO: 4238958 - RNA, 63 nt, Mycobacterium bovis subsp bovis AF2122/97
cugcucaagggcgaguacaccgagggugccggccccggcaucgacgucuauucgcugcggcag

SEQ ID NO: 4238959 - RNA, 70 nt, Mycobacterium bovis subsp bovis AF2122/97
gugcgccgguugcuggcccgauugcccgacgacgccgguaucgggaucgacguaggcagccgguucgcgc

SEQ ID NO: 4238960 - RNA, 57 nt, Mycobacterium bovis subsp bovis AF2122/97
cgcuugcgggggagaggaggcggaacaaucaugaucguaucucccugucccgcaacg

SEQ ID NO: 4238961 - RNA, 116 nt, Mycobacterium bovis subsp bovis AF2122/97
ccgcggcccggucggcgguaucggcggugcggguggggucggcggugccgguggggccgccggcgccgucaccaccaucacccacgccagcuucaacgauccgcacgggguggcgg

SEQ ID NO: 4238962 - RNA, 83 nt, Mycobacterium bovis subsp bovis AF2122/97
gcuggagcccgaacgcaucggugugacguuauccgaggaauuacagcugcaucccgaacagucgaccgacgcguucguccugc

SEQ ID NO: 4238963 - RNA, 116 nt, Mycobacterium bovis subsp bovis AF2122/97
gccucgcugugcgccauguccggcgagcgguucgugcuggggguggguuucggguggaacguggaggagcucgccgaccacggcgugccguucgccgaccggaucgcggugacggu

SEQ ID NO: 4238964 - RNA, 108 nt, Mycobacterium bovis subsp bovis AF2122/97
cguccacgccugguaacgacccgcgugagcagacgcaaaauccccucgcaaccggcgugucgaggggauuuugcgucugcucggcggccuuaggugaccagggugacg

SEQ ID NO: 4238965 - RNA, 64 nt, Mycobacterium bovis subsp bovis AF2122/97
uuggcgaccgccaggccgcggcgggccgccucggcacggaucugccgcuucggcgugucgccga

SEQ ID NO: 4238966 - RNA, 65 nt, Mycobacterium bovis subsp bovis AF2122/97
ucaccugucgucggucacucaagccgcggcccgggccgcgcugcggcacuccgacgacaccuuga

SEQ ID NO: 4238967 - RNA, 71 nt, Mycobacterium bovis subsp bovis AF2122/97
caagccacgaucgucgcccaggccgcgaugacucccgucgcggcgauguggagcacgaucucgaaggcuug

SEQ ID NO: 4238968 - RNA, 61 nt, Mycobacterium bovis subsp bovis AF2122/97
cacuugauuuaggaacgggcuucggucagugacaguacgaaacccguuccaaacucaagug

SEQ ID NO: 4238969 - RNA, 111 nt, Mycobacterium bovis subsp bovis AF2122/97
cgguucguuggcaaccaagguucgccgagcguaacgccacugcgaaaaaccgcgcggagauucgcagugccguuacguucgugacgcggguccgucggccagcagucuccg

SEQ ID NO: 4238970 - RNA, 87 nt, Mycobacterium bovis subsp bovis AF2122/97
ggugaucacugcgcgaccgugaaucuggcgacgccgcaccggcgugucgcgucgccagacucacagucgcggcaaucucugaccgcc

SEQ ID NO: 4238971 - RNA, 58 nt, Mycobacterium bovis subsp bovis AF2122/97
gcugaucgaucaggaacuggccgcggccaagguugagcgcccggaccuggugaucggc

SEQ ID NO: 4238972 - RNA, 118 nt, Mycobacterium bovis subsp bovis AF2122/97
ggucaccagcagcagcgccugacgauccgugcgguuguguaucgaucgcaguucgccuuuggcgaggugcacgcugucgagccagcccaacacgguuucggcgccgucgacggugacc

SEQ ID NO: 4238973 - RNA, 62 nt, Mycobacterium bovis subsp bovis AF2122/97
cgccgagcgugcacugagggcgagauuccggccgauucuccgcccucaguucacgcugggcg

SEQ ID NO: 4238974 - RNA, 62 nt, Mycobacterium bovis subsp bovis AF2122/97
aaccggcuguccagggccaucucacgggcaacguccugggaggcgcuggcagcggcccgguu

SEQ ID NO: 4238975 - RNA, 86 nt, Mycobacterium bovis subsp bovis AF2122/97
ccccugagcagguccgugauggaaacgccgauccucgaagcgacgucuacucugucggcguucuggucuacgagcugcuaacgggg

SEQ ID NO: 4238976 - RNA, 124 nt, Mycobacterium bovis subsp bovis AF2122/97
ggcggcgacgguggcuucggcggcggggccggggccggcggcgguggcuugaccgcuggcgccaacggcaccggcgggcaaggcggcgccggcggcgauggcggcaacggggccaucggcggcc

SEQ ID NO: 4238977 - RNA, 72 nt, Mycobacterium bovis subsp bovis AF2122/97
cacggccggguucggcgguugguggaccucggcgugauccggggguucuacaccgacaucgacccggucgcg

SEQ ID NO: 4238978 - RNA, 84 nt, Mycobacterium bovis subsp bovis AF2122/97
gcgagcccagcgggcggcguucgaggccauccgcccaggggugacagcggagcagguggacgccgccgcgcgugacgugcucgc

SEQ ID NO: 4238979 - RNA, 89 nt, Mycobacterium bovis subsp bovis AF2122/97
gggucugucgcgguucaccgacgccgccgagucccgcgccgugaucgacggccuggccgacgggucgguggacaucgugaucggcaccc

SEQ ID NO: 4238980 - RNA, 65 nt, Mycobacterium bovis subsp bovis AF2122/97
ccgccgauagugaauucggcgacaagaacccgggcguguuccggcgccgaauucacuaucggcgg

SEQ ID NO: 4238981 - RNA, 85 nt, Mycobacterium bovis subsp bovis AF2122/97
cgaccuucccgccgugccgggguucgggaauacgaccggugcuccgucgucggguuucuucaacuccggugcggguggggugucg

SEQ ID NO: 4238982 - RNA, 88 nt, Mycobacterium bovis subsp bovis AF2122/97
agccauggcggcuacgggaucaccgcccaauggaaugacgacauccaucacgccauccauaccgcgguauccggugagcggcaaggcu

SEQ ID NO: 4238983 - RNA, 71 nt, Mycobacterium bovis subsp bovis AF2122/97
gaacugacggcgcccgcgcauggccaauccggaagaccaucauuggccaguggccgggcgcuaacagguuc

SEQ ID NO: 4238984 - RNA, 106 nt, Mycobacterium bovis subsp bovis AF2122/97
ugggcacaaccgggcgguguaccacuggucguugcgccaggcggucucauccucgccgcuggccgccagcagcugacgcgccaccgacuccgcgccggucugcuca

SEQ ID NO: 4238985 - RNA, 69 nt, Mycobacterium bovis subsp bovis AF2122/97
cuggcagcaccgcugcugacgcacuuggccaucaacgaggccggugcggucgccgcggugcugguccag

SEQ ID NO: 4238986 - RNA, 67 nt, Mycobacterium bovis subsp bovis AF2122/97
caucgucucgggcauggucagcacgcaccgguagccgcgugccgcgcaaaccauggccagggcgaug

SEQ ID NO: 4238987 - RNA, 84 nt, Mycobacterium bovis subsp bovis AF2122/97
gcccgaacccggagucagccgcgguauggcgcacgaccgcuagcgccgugcguuaucccacggcagauagccgggcaaucgggc

SEQ ID NO: 4238988 - RNA, 61 nt, Mycobacterium bovis subsp bovis AF2122/97
gggcgucgcuggugggaucgcagcgccauuccaagacguugcgcucgaucacuagcgcccc

SEQ ID NO: 4238989 - RNA, 76 nt, Mycobacterium bovis subsp bovis AF2122/97
ucccauggcgcgagcagacgcagaaucgcacaaaaucagcgauuuugaugcgauucugcgucugcucgcgcaggga

SEQ ID NO: 4238990 - RNA, 55 nt, Mycobacterium bovis subsp bovis AF2122/97
ugcuggcccgagaaccgaugacgggugaacgugacauccguucggaggaccggca

SEQ ID NO: 4238991 - RNA, 79 nt, Mycobacterium bovis subsp bovis AF2122/97
uccccgucauugagcucggugagguugcgcaccaaccgguuuggguaaaugugcaccuccaccggccagcgugcggcga

SEQ ID NO: 4238992 - RNA, 91 nt, Mycobacterium bovis subsp bovis AF2122/97
cggcuucguggacgcugaucgaguugaugcgccaucgcgacgccuacgcggccgugaucgacgaacucgacgagcuguacggcgacggccg

SEQ ID NO: 4238993 - RNA, 96 nt, Mycobacterium bovis subsp bovis AF2122/97
gccuacggcgaauggaagggcggcugggucgacuuugacggcauccaccugcaggucggguccgcccgcgccgacccgggcccguucgucuacggc

SEQ ID NO: 4238994 - RNA, 62 nt, Mycobacterium bovis subsp bovis AF2122/97
cgucaucggcgaguagccgucgcacaucgguaucgguguagcgagcgaucuugucgaugucg

SEQ ID NO: 4238995 - RNA, 75 nt, Mycobacterium bovis subsp bovis AF2122/97
ggcaaagucacggugagcccggugcgaaaggccggaaugacgccguucgugacuaggaucaucgaauacugagcc

SEQ ID NO: 4238996 - RNA, 67 nt, Mycobacterium bovis subsp bovis AF2122/97
gcgugcuuugaccgcaucgaccacgcggaccugauggaccgggugcgucaccggaucaaagacaagc

SEQ ID NO: 4238997 - RNA, 75 nt, Mycobacterium bovis subsp bovis AF2122/97
gagcccgcgggccgcagcgugcucgcugucggcgaacaccgcauggucgagaagcguugccgcccaacggaaauc

SEQ ID NO: 4238998 - RNA, 96 nt, Mycobacterium bovis subsp bovis AF2122/97
ccggcggucagagauugccgcgacugugagucuggcgacgcgacacgccggugcggcgucgccagauucacggucgcgcagugaucacccggccgg

SEQ ID NO: 4238999 - RNA, 74 nt, Mycobacterium bovis subsp bovis AF2122/97
cgccugaugccgcgguuuguccgggaguucccguucaaccugaugcucugggaccuggaccggcggaugaggcg

SEQ ID NO: 4239000 - RNA, 91 nt, Mycobacterium bovis subsp bovis AF2122/97
cccgcagcccgggaccgcgcggaaguccuuggcgggcgguauggcgauaccacgccgacgagcuuccgcgacgaucgcccggccaagcggg

SEQ ID NO: 4239001 - RNA, 60 nt, Mycobacterium bovis subsp bovis AF2122/97
cgcgagcgugacggcacugcgaaaucccaugcgaauuuucgcgguggcguuacgcucgcg

SEQ ID NO: 4239002 - RNA, 83 nt, Mycobacterium bovis subsp bovis AF2122/97
agccaaggucacccaggacgacaccggcaccuaucgcaucgacgguccguugucguuccuguccgucgacgguguauuuggcu

SEQ ID NO: 4239003 - RNA, 59 nt, Mycobacterium bovis subsp bovis AF2122/97
gccucgugauaaggaugcuccaggaucagcuccucgagcucgcugaucacugaaucggc

SEQ ID NO: 4239004 - RNA, 62 nt, Mycobacterium bovis subsp bovis AF2122/97
cgaggauuucgucgcgcggcugaagcaagagaccgaugguagcggcgcugacaucauccucg

SEQ ID NO: 4239005 - RNA, 78 nt, Mycobacterium bovis subsp bovis AF2122/97
gugagcuguuggaugguugguggugcauaucgucggucugucgaucgagaccacagcaccgaccgacuccgcgauuac

SEQ ID NO: 4239006 - RNA, 65 nt, Mycobacterium bovis subsp bovis AF2122/97
accgcgaccaggucaacacucgccauuaucuguccacuucgaugcgcguggcacuggaucgcggu

SEQ ID NO: 4239007 - RNA, 78 nt, Mycobacterium bovis subsp bovis AF2122/97
accgcuaggugggcgagcagacgcagaaucgcacgcgaaaugccugcgcgaugcgauucugcgucugcucgccguggu

SEQ ID NO: 4239008 - RNA, 62 nt, Mycobacterium bovis subsp bovis AF2122/97
ggcguaucggcacggcgagacggccgaugacuucgucggcuccguacuugccgugcugcgcc

SEQ ID NO: 4239009 - RNA, 59 nt, Mycobacterium bovis subsp bovis AF2122/97
auacuucgugcagcagcugcgcccgagugaacacccggccggcaugcugcgccagguau

SEQ ID NO: 4239010 - RNA, 130 nt, Mycobacterium bovis subsp bovis AF2122/97
cgcacgauccggcuuaaggccgcgaacgccggaccaugguguuggccgguuuggcggagcagggcauaaaaaucggccggcgacacuguugucccgguggcgggaccuugggcuuccgggugcgcgugcg

SEQ ID NO: 4239011 - RNA, 58 nt, Mycobacterium bovis subsp bovis AF2122/97
uuggcgcccaacuuggcggccugugcacgcagcgcggccgccuugcguucggcguuag

SEQ ID NO: 4239012 - RNA, 59 nt, Mycobacterium bovis subsp bovis AF2122/97
ccugggacagcuggaaguuaucggacgcggccguguucauaccgaccaccuguccuagg

SEQ ID NO: 4239013 - RNA, 79 nt, Mycobacterium bovis subsp bovis AF2122/97
ccucaccgcgcggccgcguucgacgccgcucgcaugugcaucgagcggcucaaacaggaugugccgauauggaagaagg

SEQ ID NO: 4239014 - RNA, 78 nt, Mycobacterium bovis subsp bovis AF2122/97
agucuacugccgagcagacacacaaucgcauccgaggagccugccgcgugcgauucugugucuguucgcgggggaacu

SEQ ID NO: 4239015 - RNA, 70 nt, Mycobacterium bovis subsp bovis AF2122/97
gggcaacgcggcggcgggcggguccgcccguucgacgaccggguggagcuggcugccgcgcuagaggccc

SEQ ID NO: 4239016 - RNA, 74 nt, Mycobacterium bovis subsp bovis AF2122/97
gguggcccggcuguugguccgacugguccgggucccaccaccgcgccggcgcgccccuagcggccgggcgcacc

SEQ ID NO: 4239017 - RNA, 58 nt, Mycobacterium bovis subsp bovis AF2122/97
cgagcagacgcaaaaucgcccauuucgagacgaaauugggcgauuuugcgucugcucg

SEQ ID NO: 4239018 - RNA, 58 nt, Mycobacterium bovis subsp bovis AF2122/97
ugccgcuggauccggaagccguugcgcaacuuggucgacgacggguucuccggcggca

SEQ ID NO: 4239019 - RNA, 75 nt, Mycobacterium bovis subsp bovis AF2122/97
ggccgucgcugcgggaucagaucggcagucgaaucgaguuacggcuggcggaucccgcggauuccgaauuggacc

SEQ ID NO: 4239020 - RNA, 83 nt, Mycobacterium bovis subsp bovis AF2122/97
guucgccgauuccaucaccaaugcgcugggcgguccgggaaucgagcuguuccgccgacuggucgaggaguaugaacgcgagc

SEQ ID NO: 4239021 - RNA, 67 nt, Mycobacterium bovis subsp bovis AF2122/97
cgcgccgucgccgaucaaugggcgcccggucagcgacugaacgggugcguugaucgcaucgagcacg

SEQ ID NO: 4239022 - RNA, 59 nt, Mycobacterium bovis subsp bovis AF2122/97
gggcaggacgguuagugcugaugggcccggggggccugaguaucaaccuguuugcgccc

SEQ ID NO: 4239023 - RNA, 82 nt, Mycobacterium bovis subsp bovis AF2122/97
guugggauuacgaacggcacgcagaggacuagcacgucgaccgucgucacgcuaacccuuugcguggcucgugacucccaac

SEQ ID NO: 4239024 - RNA, 70 nt, Mycobacterium bovis subsp bovis AF2122/97
acgaggcguucgcgucgguggugcugaaguuccagaaggaccucaacauucccgacgagaagcucaacgu

SEQ ID NO: 4239025 - RNA, 55 nt, Mycobacterium bovis subsp bovis AF2122/97
uaugcguuccugugcgccacggccuugauggugguucgcaucgaggagcggcaua

SEQ ID NO: 4239026 - RNA, 59 nt, Mycobacterium bovis subsp bovis AF2122/97
cggcuggccagggcguuuccgcucuacgacgggcucgaggaguggagucuggucggccg

SEQ ID NO: 4239027 - RNA, 99 nt, Mycobacterium bovis subsp bovis AF2122/97
gccgugcuggacggcgcuauccaguacgucagcuccggcgcaacggaauuuggcgccgaagccaagacagugcuggaacucggcgaacguuaucccggc

SEQ ID NO: 4239028 - RNA, 73 nt, Mycobacterium bovis subsp bovis AF2122/97
gacgaugccgugacgaauggcggggcucgcccaaacaacgaagagugggcgcguuucguugcggcgugcgauc

SEQ ID NO: 4239029 - RNA, 71 nt, Mycobacterium bovis subsp bovis AF2122/97
cgccgaccggcucggcaagccgcugcugguggaaggccccgccggggucggcaagaccgagcuggcgcgcg

SEQ ID NO: 4239030 - RNA, 99 nt, Mycobacterium bovis subsp bovis AF2122/97
ggcacgcgccugacgguagagaccggcacgccggugaccuggaccgaggagcagaccuacuucuuccggcugucggccuauaccgacaagcugcuggcc

SEQ ID NO: 4239031 - RNA, 68 nt, Mycobacterium bovis subsp bovis AF2122/97
cccggcgagcagacgcauaagcccccgacacgccgugcgugcgggggcuuaugcgucugcucgccggg

SEQ ID NO: 4239032 - RNA, 86 nt, Mycobacterium bovis subsp bovis AF2122/97
gccgcgacaccgaacugaugcuggacgcgcugcagacccugggccugcgcgucgacgguguggguucggaacugacggucagcggc

SEQ ID NO: 4239033 - RNA, 57 nt, Mycobacterium bovis subsp bovis AF2122/97
ucgaacgugaacggcuggaguccaagaagaucuccaagacccaggccgucacuucga

SEQ ID NO: 4239034 - RNA, 87 nt, Mycobacterium bovis subsp bovis AF2122/97
gucggcgccgauaucgggugcagcggucagcaguccgacguccucguagagucgugcugucuugcuguuguaauugccggugccgac

SEQ ID NO: 4239035 - RNA, 62 nt, Mycobacterium bovis subsp bovis AF2122/97
ggcgcgaccgguaucccggcgccgcggcuuugcugcggcccgccgaugugcuggucgacggc

SEQ ID NO: 4239036 - RNA, 74 nt, Mycobacterium bovis subsp bovis AF2122/97
cgaaacuggucuguaaucggugcccggucaccacagagugccucagcugggcacugaauaccggccaggacucg

SEQ ID NO: 4239037 - RNA, 70 nt, Mycobacterium bovis subsp bovis AF2122/97
ggaauuugccgaccugcugaccugguugcaggagacguugagcgaucacgucaaggaggugcggcugucc

SEQ ID NO: 4239038 - RNA, 67 nt, Mycobacterium bovis subsp bovis AF2122/97
ugcgggauuugcagguucucgcugucggccgugcugaacgggcacugggacuucugacagaccugca

SEQ ID NO: 4239039 - RNA, 74 nt, Mycobacterium bovis subsp bovis AF2122/97
ggauuugguugauuugcugauugccggauugugcgaucucggucagccgaucccgcaaauaguucaccgcaucc

SEQ ID NO: 4239040 - RNA, 58 nt, Mycobacterium bovis subsp bovis AF2122/97
cgagcagacgcaaaagcccacuaaaucggccagauuuaggagcuuuugcgucuucucg

SEQ ID NO: 4239041 - RNA, 75 nt, Mycobacterium bovis subsp bovis AF2122/97
caguccgcugaugcugccggcauugaccacaucgacgacgguggauggguuagguuuggcggccgcggcggucug

SEQ ID NO: 4239042 - RNA, 84 nt, Mycobacterium bovis subsp bovis AF2122/97
ggcgcccaaggucuguaguaggugcggcucaucgagggcaagcuugagccauucggugagcuuggcagccugcggcugggcgcc

SEQ ID NO: 4239043 - RNA, 73 nt, Mycobacterium bovis subsp bovis AF2122/97
cucguucaucucggcggcucgcggaggcaucaagaccaacugggugaucuccaugccgcccggccagagcggg

SEQ ID NO: 4239044 - RNA, 64 nt, Mycobacterium bovis subsp bovis AF2122/97
gccgccggagcgaccgguugucauuccggccgugcccgcuccgcaggccaccggucccggcugc

SEQ ID NO: 4239045 - RNA, 69 nt, Mycobacterium bovis subsp bovis AF2122/97
ggcgccgauguugcuguacucgccgaugucggcgucgccgacguaggucaggugcggcaccuuggugcc

SEQ ID NO: 4239046 - RNA, 102 nt, Mycobacterium bovis subsp bovis AF2122/97
gcgccgcgugcuuggcgucgauugcgaggugcgggccucggccccggucucagguggcugggccggacccgagcaccuugaugcguucgccgacguggucgc

SEQ ID NO: 4239047 - RNA, 58 nt, Mycobacterium bovis subsp bovis AF2122/97
ccgccgacggucgucgucagccaaggcauccaggugcuggccgcgaugaccgcggcgg

SEQ ID NO: 4239048 - RNA, 106 nt, Mycobacterium bovis subsp bovis AF2122/97
accaguuggaggcguacccgucggcgguucguuugaccgugaccgccaaggcgucgucgguguagggcgaacugcacaacgaguagcagcgcgccaccgaaccggu

SEQ ID NO: 4239049 - RNA, 64 nt, Mycobacterium bovis subsp bovis AF2122/97
ggguaaaacgguguuguuccugggucgcuacgacgagccccgcaagggcauggccguuuugcuc

SEQ ID NO: 4239050 - RNA, 71 nt, Mycobacterium bovis subsp bovis AF2122/97
gcgaccagucagagucucgggcauguacguaauguagacguacuucgucgacgucugaucgguguugaugc

SEQ ID NO: 4239051 - RNA, 82 nt, Mycobacterium bovis subsp bovis AF2122/97
cgcacgcugucgccgaucacgucgguggccgggcgcaagggcuaccugcguggccaguugaugcgugaucaggacagcggcg

SEQ ID NO: 4239052 - RNA, 97 nt, Mycobacterium bovis subsp bovis AF2122/97
gggggcgaucgccgaggccaugccgaccgcggcgaucggggccagccugcugggcgccgugguggccgggaucggcauggcccccacggucgcgccc

SEQ ID NO: 4239053 - RNA, 58 nt, Mycobacterium bovis subsp bovis AF2122/97
ucgagugaguuccgggcaccacgcuugacugcggcgucggagucggggcucggcucgg

SEQ ID NO: 4239054 - RNA, 104 nt, Mycobacterium bovis subsp bovis AF2122/97
uguguugccauucgacuaugaccggcucagcaucgccgagcucgagccgggacggcgguuucgcgaggauucgacgaugcugagcaugcggcaauggcagcacg

SEQ ID NO: 4239055 - RNA, 89 nt, Mycobacterium bovis subsp bovis AF2122/97
ccgagccgccgccgcggacugucccgagcgcaccaggaaucgaaccaggcuuccuugugucaucgggcaggucgcaaauccggugucgg

SEQ ID NO: 4239056 - RNA, 59 nt, Mycobacterium bovis subsp bovis AF2122/97
ggcgacgguucgcgguggccgucgccggcgucgccacugccgccgcgacgaccgucacc

SEQ ID NO: 4239057 - RNA, 66 nt, Mycobacterium bovis subsp bovis AF2122/97
gaugugggcugccgauguggcggcgaugguggguuaucacgguggggcaucggcggcggcggcguu

SEQ ID NO: 4239058 - RNA, 71 nt, Mycobacterium bovis subsp bovis AF2122/97
gcguuuucacccgaucaaacuggccuggaucaccgcggugguugccggccugauggucgguguggcaacgc

SEQ ID NO: 4239059 - RNA, 59 nt, Mycobacterium bovis subsp bovis AF2122/97
gccgaauccagccaggagugugggcccuuccgggucgcccacucucggcucgauuuggc

SEQ ID NO: 4239060 - RNA, 68 nt, Mycobacterium bovis subsp bovis AF2122/97
gguguucacggcgcacguagccgaucagguaacaaccgaccggagccgcuaccgcgcccgugagcgcc

SEQ ID NO: 4239061 - RNA, 78 nt, Mycobacterium bovis subsp bovis AF2122/97
ugccuguccacgagcgacaaagccagcgcgccaaggauucccgauggcagccaucacuuugucgcgcugaggcgggca

SEQ ID NO: 4239062 - RNA, 75 nt, Mycobacterium bovis subsp bovis AF2122/97
ccuauguacugcuggccagcguugcgcuguuguugcuguacuggcaauggcgaacgaugccggcggucaucuggg

SEQ ID NO: 4239063 - RNA, 62 nt, Mycobacterium bovis subsp bovis AF2122/97
gcggugacgauaauuucuuucuugcggccggugaucgucaagaacccgucuucguccaccgc

SEQ ID NO: 4239064 - RNA, 90 nt, Mycobacterium bovis subsp bovis AF2122/97
gcgcgcuguucgcugaggcuguaacucugcaggcaaagugcgagugggggccugcaaaauuacaggcucggcgacccaaacgguacgcgc

SEQ ID NO: 4239065 - RNA, 68 nt, Mycobacterium bovis subsp bovis AF2122/97
guugucccccuucaaggggaccggagguucaaauccucucgccuccgcaguccuuuaggggacacaac

SEQ ID NO: 4239066 - RNA, 63 nt, Mycobacterium bovis subsp bovis AF2122/97
gucgugugugcggaacggccaucgggacggugcccaggccgauggucugccguacacccaggc

SEQ ID NO: 4239067 - RNA, 78 nt, Mycobacterium bovis subsp bovis AF2122/97
gcugaacacucgccgaacgugcaacagcugcgaacaauuggccgaaucuucgcagugcgugcacguucggcggcuagc

SEQ ID NO: 4239068 - RNA, 55 nt, Mycobacterium bovis subsp bovis AF2122/97
gcuguuuuacgucgacacacugcccgacaccggugcgguggcggucguagacggc

SEQ ID NO: 4239069 - RNA, 64 nt, Mycobacterium bovis subsp bovis AF2122/97
ggugacguagagcguggugcggaaccgggccugaucggcuucggacucgcucuugcgcaguacc

SEQ ID NO: 4239070 - RNA, 100 nt, Mycobacterium bovis subsp bovis AF2122/97
gaacugguguggaucgacugcgagaugaccgggcucgaucuggguucggacaagcugaucgagauagccgcccuggucaccgaugccgaucugaacauuc

SEQ ID NO: 4239071 - RNA, 63 nt, Mycobacterium bovis subsp bovis AF2122/97
gggcggugaggaguccaugccgggcgcuaggucaucaacgaccgccaugggcucucaccuccu

SEQ ID NO: 4239072 - RNA, 88 nt, Mycobacterium bovis subsp bovis AF2122/97
uccccgacgguguguagcccaccggugcuguaggcgaaggugcaggcaaagaucgccagcaccaccugguugggcacaucgcgcagga

SEQ ID NO: 4239073 - RNA, 66 nt, Mycobacterium bovis subsp bovis AF2122/97
gcaaagucugguccgaaggcuucggcaagccgccgggcggcuugucggaacucggccccacugagc

SEQ ID NO: 4239074 - RNA, 91 nt, Mycobacterium bovis subsp bovis AF2122/97
cccaggcguacggcuggucggauucgaggcagccggcgacggcguugagaccggccggcaugccgcgacauucaccgcugguucgcccggg

SEQ ID NO: 4239075 - RNA, 130 nt, Mycobacterium bovis subsp bovis AF2122/97
gcaccacgucacaggcgccccggguugacgagggccgcgccgaggcgcucuacgaacucgagaucgcguucgccgagauccuccggcugucgccgucguccgggggcggccggccccaaccgugggugac

SEQ ID NO: 4239076 - RNA, 113 nt, Mycobacterium bovis subsp bovis AF2122/97
gccgccgaugggaccgcguuugccgagggcgccggggugcucgugcuggcgcgguuggcugacgcgcgccgguuggggcauccggugcuggcgcuggugcgcggaucggcggu

SEQ ID NO: 4239077 - RNA, 65 nt, Mycobacterium bovis subsp bovis AF2122/97
ggugauccagcuguccgcgcgcacaccaacggccugugcgauggccgcgcugacacuggaccauc

SEQ ID NO: 4239078 - RNA, 63 nt, Mycobacterium bovis subsp bovis AF2122/97
guguauggcguguucacccccggcuacgucgacgccggcaagguggcgcacaucgccgugcac

SEQ ID NO: 4239079 - RNA, 82 nt, Mycobacterium bovis subsp bovis AF2122/97
agccuaauucgccgagcagacgcaaaagcgcccaggucugcccgaaaaggggagcuuuuaugacugcucggcgggaaggguu

SEQ ID NO: 4239080 - RNA, 96 nt, Mycobacterium bovis subsp bovis AF2122/97
ggcgcgcgaugaccauguuguugaucgcaugcccgugcgcggugggacuguccaccccgaccgcgaucagcgcagcgaucggcaacggcgcgcgcc

SEQ ID NO: 4239081 - RNA, 56 nt, Mycobacterium bovis subsp bovis AF2122/97
gcgaucagguucgacgcgcaucgcuccggucgugaaugucacgcgguccugaucgc

SEQ ID NO: 4239082 - RNA, 58 nt, Mycobacterium bovis subsp bovis AF2122/97
guggguggaacacggcuaggugacagaucaucgccgucaucaggccggcugcccccgc

SEQ ID NO: 4239083 - RNA, 63 nt, Mycobacterium bovis subsp bovis AF2122/97
gaccuccuucgauacuggugcggaucuggcuaaagugccguucgaacgggucgucgaauuguc

SEQ ID NO: 4239084 - RNA, 62 nt, Mycobacterium bovis subsp bovis AF2122/97
guguugcgcauacccgacgugcugccccuggauguggcggcgccgcuguugugcgcgggcau

SEQ ID NO: 4239085 - RNA, 95 nt, Mycobacterium bovis subsp bovis AF2122/97
cggucaagccgaaggcccgcuguugccguugguccagcucggcgguguggcgcugcugucaacggggguagcgcuggucggaugcggcuugaccg

SEQ ID NO: 4239086 - RNA, 81 nt, Mycobacterium bovis subsp bovis AF2122/97
ccgccgagccggagaagaucaugccgcgggcgaucaauucgguggucgcucgcaucgcgaucuuuuaugucgggucggugg

SEQ ID NO: 4239087 - RNA, 71 nt, Mycobacterium bovis subsp bovis AF2122/97
ccagcuuacggccggaguccagccagucgcgcagcucgcgcggcgugaugguggaaccuuuggccgccugg

SEQ ID NO: 4239088 - RNA, 103 nt, Mycobacterium bovis subsp bovis AF2122/97
gacgacggcgaucugauacgacccgcggggauugcggcggacucgagcgugcagguccagcucguacuucucgucgggugacaggcccagguugauucgcguc

SEQ ID NO: 4239089 - RNA, 58 nt, Mycobacterium bovis subsp bovis AF2122/97
cgaugcaggacggcgagggcuccggagucgcgccgacggaugcccugucgcuguaucg

SEQ ID NO: 4239090 - RNA, 55 nt, Mycobacterium bovis subsp bovis AF2122/97
gggugaccgucauggaccacgggauguacacauugugcuguguccgucggcgccc

SEQ ID NO: 4239091 - RNA, 83 nt, Mycobacterium bovis subsp bovis AF2122/97
cgucgguaucgaguagccggucgucuaaaccaccgaacccgucgaagucaaccaguggaccaccggugugcucgacgccgucg

SEQ ID NO: 4239092 - RNA, 79 nt, Mycobacterium bovis subsp bovis AF2122/97
ucccuugucagguuugguaccaaagaguaccguacuggacaagccacgguacaccaccguaccacgcccgauccaggga

SEQ ID NO: 4239093 - RNA, 86 nt, Mycobacterium bovis subsp bovis AF2122/97
ccaucucgguguggaagucggcucgagcaacaccgugcaugccgaaaucgcccgguugaccgaagccggacuggucaccgagaagg

SEQ ID NO: 4239094 - RNA, 62 nt, Mycobacterium bovis subsp bovis AF2122/97
ccgccagcgugacgccacugcgagaaucagcgacgaauuucgccgugacguuacgcuggcgg

SEQ ID NO: 4239095 - RNA, 83 nt, Mycobacterium bovis subsp bovis AF2122/97
gcccccuggguggucagcgucgaugaccaugucgaccccacgguguggucgauggugaugacgcuggcgcuggacugcggggc

SEQ ID NO: 4239096 - RNA, 130 nt, Mycobacterium bovis subsp bovis AF2122/97
uaggcgggucagaaaaaaugucguacuggcccacgauauugauugugucguacuggcuuuccacuggggccggaacgguguagucgaugaucggcacguggguucccggccuaaacgcccgccaaagaag

SEQ ID NO: 4239097 - RNA, 61 nt, Mycobacterium bovis subsp bovis AF2122/97
uugaugucggcgacuacaucuuccagguggaggugcccaccgaagaggucaccgagaucaa

SEQ ID NO: 4239098 - RNA, 59 nt, Mycobacterium bovis subsp bovis AF2122/97
gauccgcccaggcucccgcucgacgacggcaccgucgugaucgugugccucggcugguc

SEQ ID NO: 4239099 - RNA, 65 nt, Mycobacterium bovis subsp bovis AF2122/97
gucacgagcguaaccccagugcgaaaguucccgccggaaaucgcagccacguuacgcucguggac

SEQ ID NO: 4239100 - RNA, 60 nt, Mycobacterium bovis subsp bovis AF2122/97
gcgggcaucaccgucgugcaggcugacccgucgacucgccccguccgaagugaugcccgc

SEQ ID NO: 4239101 - RNA, 83 nt, Mycobacterium bovis subsp bovis AF2122/97
cgggaauugagauggccuggagcgagggccgcgaccugugguggcaccaugucgucggcucagcuucaccggcacacaccccg

SEQ ID NO: 4239102 - RNA, 58 nt, Mycobacterium bovis subsp bovis AF2122/97
gccgugcuggauuuggccggcggccuggcacagcacuauccggcuagccgaguacggc

SEQ ID NO: 4239103 - RNA, 91 nt, Mycobacterium bovis subsp bovis AF2122/97
gauuacgguuugguuacagcaaaagccauucauuucuaauuggcuugugcccaauaggaacuggcuugugcccaauagccggaucccgguc

SEQ ID NO: 4239104 - RNA, 97 nt, Mycobacterium bovis subsp bovis AF2122/97
ggugcccaagcucaccgcgucggucaccgacggcgccgucggcgucaccguggaugcaccggugucggugaccgccgccgacggugugcuggcggcc

SEQ ID NO: 4239105 - RNA, 59 nt, Mycobacterium bovis subsp bovis AF2122/97
cagcgaucacgucgacaugggguucggccuucgccaucgccagcgucgacgugccgcug

SEQ ID NO: 4239106 - RNA, 70 nt, Mycobacterium bovis subsp bovis AF2122/97
ccgaaccgacugaugagcgcgucagcaagcccacgauauggucgguucggcgacacauccgucgguccgg

SEQ ID NO: 4239107 - RNA, 59 nt, Mycobacterium bovis subsp bovis AF2122/97
uugucgucgucggugccaaaaucgucgagacccaccaguuugguagccgaugcgugcag

SEQ ID NO: 4239108 - RNA, 63 nt, Mycobacterium bovis subsp bovis AF2122/97
uuccgggcgguugagcgugaugguggccaccggcccggccgucguguacagcagcgucuggaa

SEQ ID NO: 4239109 - RNA, 69 nt, Mycobacterium bovis subsp bovis AF2122/97
cgcauccgggugcugaucgccgguaguugguuuccccgcuaugcgcgaaaccucggcaccccggaaccg

SEQ ID NO: 4239110 - RNA, 60 nt, Mycobacterium bovis subsp bovis AF2122/97
gcgagcagacgcaaaaucgcccauuuucgugucgaaaugggggcuuuugcgucugcucgc

SEQ ID NO: 4239111 - RNA, 58 nt, Mycobacterium bovis subsp bovis AF2122/97
cccuccguuggccccggugccgggagcaccguuagccccguuaccgaucagcggacgg

SEQ ID NO: 4239112 - RNA, 56 nt, Mycobacterium bovis subsp bovis AF2122/97
cgaacguaacggcacugcgaaucuccgcgcgguuuuucgcaguggcguuacgcucg

SEQ ID NO: 4239113 - RNA, 61 nt, Mycobacterium bovis subsp bovis AF2122/97
ugguccagugucagcgcggccaucgcacaggccguuggugugcgcgcggacagcuggauca

SEQ ID NO: 4239114 - RNA, 90 nt, Mycobacterium bovis subsp bovis AF2122/97
cggcugagaaaccgcacguggccugaucgcgucaucgaucgugcgccgcuguggugcgcggucgacuuacgcgauggcaaccaggcgcug

SEQ ID NO: 4239115 - RNA, 57 nt, Mycobacterium bovis subsp bovis AF2122/97
gucggccagcguaaccggcagccguucgacaucggcgccuugguaggcguugccgac

SEQ ID NO: 4239116 - RNA, 55 nt, Mycobacterium bovis subsp bovis AF2122/97
acggucgccaaccuggcgagcaucggcaauaccuggcuugccgacccggcgccgu

SEQ ID NO: 4239117 - RNA, 92 nt, Mycobacterium bovis subsp bovis AF2122/97
ucucggcgaguccgacaacacguugguguucuacaucuggggcgacaauggcgccagcauggagggcaccaacaccgguucguucaaugaga

SEQ ID NO: 4239118 - RNA, 78 nt, Mycobacterium bovis subsp bovis AF2122/97
ggccagcagguugcguggauccgucagguggauggucagcagaccgucaccacugccaagaucaccgaauuguuggcc

SEQ ID NO: 4239119 - RNA, 55 nt, Mycobacterium bovis subsp bovis AF2122/97
ggcggucaccaacguuggcgccgggcggcccggcaccagcgcgguggugaucacc

SEQ ID NO: 4239120 - RNA, 88 nt, Mycobacterium bovis subsp bovis AF2122/97
ggugauggacgucgauuuuugggguguggucaacggcaccaaggcguuccugccgcauuugaucgccuccggggacggccacgucauc

SEQ ID NO: 4239121 - RNA, 66 nt, Mycobacterium bovis subsp bovis AF2122/97
cgggcccgauaccgauggccgccguaagcccgagucacucuacggugcggccacgaucugggaucg

SEQ ID NO: 4239122 - RNA, 72 nt, Mycobacterium bovis subsp bovis AF2122/97
ucggcaucggcgugcaagcgguguccgauccagcgcauccgcacgcugcguaccgccugcacgccgggccgg

SEQ ID NO: 4239123 - RNA, 56 nt, Mycobacterium bovis subsp bovis AF2122/97
caggggcucgauccggccgggccggcugcggcgcugguggaauucgagcgcuccug

SEQ ID NO: 4239124 - RNA, 79 nt, Mycobacterium bovis subsp bovis AF2122/97
ugaugcugcaguuucugcgcacgggaucgggggccacaagacccgcccugcaacugucgcgagcgcugcuaggcaauca

SEQ ID NO: 4239125 - RNA, 63 nt, Mycobacterium bovis subsp bovis AF2122/97
cgaugcgcuugcccuugccgaguuuggaaaugugcaccagaccgucgcggccaggcagcaacg

SEQ ID NO: 4239126 - RNA, 70 nt, Mycobacterium bovis subsp bovis AF2122/97
gucgguacggaccgaucaugacgaugcccauucucagccugggugacguugcgaucguguccgacucggc

SEQ ID NO: 4239127 - RNA, 62 nt, Mycobacterium bovis subsp bovis AF2122/97
cgccgaacgugaacugagggcggaauaucggccgaaucuccgccgugaguucacguucggcg

SEQ ID NO: 4239128 - RNA, 55 nt, Mycobacterium bovis subsp bovis AF2122/97
ugcuguucguaguuguuggcgucgcgaaccagcccgucacgcaccccgugcagca

SEQ ID NO: 4239129 - RNA, 85 nt, Mycobacterium bovis subsp bovis AF2122/97
agacugguauugacaaccguucugaugccgcgucagacuucccaccacgccacggaccguccaacgccagaacucaauaccgucu

SEQ ID NO: 4239130 - RNA, 60 nt, Mycobacterium bovis subsp bovis AF2122/97
gccgagcgugaacucagggcggaaaaaucgccgaauucccgccccagaugcacgcucggc

SEQ ID NO: 4239131 - RNA, 103 nt, Mycobacterium bovis subsp bovis AF2122/97
gccagcuuguucggcuagccgccgaacgugcacgcacugcgaagauucggccaauuguucgcagcuguugcacguucggcgaguguucagcucucagguuggu

SEQ ID NO: 4239132 - RNA, 71 nt, Mycobacterium bovis subsp bovis AF2122/97
cgcuugccgagcagacgcaaaaucgcccauuucggcccgaauuugggcgauuuugcgucugcucggcaucg

SEQ ID NO: 4239133 - RNA, 75 nt, Mycobacterium bovis subsp bovis AF2122/97
gaugcccagcacgucgcccagcgagugcgccuggucgguggauaccaccaacacucgcuggccggccccggcauc

SEQ ID NO: 4239134 - RNA, 62 nt, Mycobacterium bovis subsp bovis AF2122/97
ccacgacgagcucgugcugccggugggccaggaacucgagcacgcgacaagcucguuugugg

SEQ ID NO: 4239135 - RNA, 59 nt, Mycobacterium bovis subsp bovis AF2122/97
accugagcucggucagaucagcagcacggcggcaccggcgaugcggccggcgcucaggu

SEQ ID NO: 4239136 - RNA, 59 nt, Mycobacterium bovis subsp bovis AF2122/97
uugcugcugcuggccggccagcccgaggaguccuuggcuggucggaccgucagcgacga

SEQ ID NO: 4239137 - RNA, 76 nt, Mycobacterium bovis subsp bovis AF2122/97
accgcuaggcgccgagcgugaacugagggcgagauuucggccgauuuuccgcccucaguucacguuggacggcggu

SEQ ID NO: 4239138 - RNA, 64 nt, Mycobacterium bovis subsp bovis AF2122/97
gguugccagcgaaccggaaugggguggcgcugacgagccggaucgcccgguggugcugguagcc

SEQ ID NO: 4239139 - RNA, 86 nt, Mycobacterium bovis subsp bovis AF2122/97
cccggacgacggcgacagccggaggaucucggcgaacgcgaucucgaguucguagagcgccucggcgcggcccucgucaacccggg

SEQ ID NO: 4239140 - RNA, 61 nt, Mycobacterium bovis subsp bovis AF2122/97
gccggaucuugccgcugguggugaugggaaucgaaccaggugacaccagaacgagaucggc

SEQ ID NO: 4239141 - RNA, 85 nt, Mycobacterium bovis subsp bovis AF2122/97
ggccguguucgggggcuuuuaccugggguucuugcugaucgccgcggugacagcgcugauccugguguuggccgcuaacaccgcc

SEQ ID NO: 4239142 - RNA, 80 nt, Mycobacterium bovis subsp bovis AF2122/97
guacauccguagcccguccuggcaggugcuggguugaccaaaaucagcccaacaccugccacgacgaugaagcggguugc

SEQ ID NO: 4239143 - RNA, 58 nt, Mycobacterium bovis subsp bovis AF2122/97
cgagcagacgcaaaaucgcccugaaccgugcguuccagggcgauuuugcgucugcucg

SEQ ID NO: 4239144 - RNA, 79 nt, Mycobacterium bovis subsp bovis AF2122/97
gcgcuugcuggaccggcgccuguuggaccggcgccuguuggacgggcgccuguuggacgggcgcuugcuggacgggcgc

SEQ ID NO: 4239145 - RNA, 56 nt, Mycobacterium bovis subsp bovis AF2122/97
cccgauccacggugaccaggggugccuugaucaacugcuggugcaccuuguuuggg

SEQ ID NO: 4239146 - RNA, 56 nt, Mycobacterium bovis subsp bovis AF2122/97
gcaaugcggcgccgcugcgcgugcgaggagggcgacgcagcagcacguccauuagc

SEQ ID NO: 4239147 - RNA, 70 nt, Mycobacterium bovis subsp bovis AF2122/97
accugcaugcgguggucggggaguggcagcuccuugccgacuugucguuugccgauuaccugaugugggu

SEQ ID NO: 4239148 - RNA, 73 nt, Mycobacterium bovis subsp bovis AF2122/97
cuggucauuggugggauccagccccagccacucgaaccgcccgggcugcugcggaguccacaccgaggcccag

SEQ ID NO: 4239149 - RNA, 129 nt, Mycobacterium bovis subsp bovis AF2122/97
ccccagcuaccacggcgugguguucgccgagcuggguccaccggcguuugcgcucaaagcucgagugcagcugcuccgugacuacggcucggcggcuucgccguucaacgcguucuugguggcgcaggg

SEQ ID NO: 4239150 - RNA, 59 nt, Mycobacterium bovis subsp bovis AF2122/97
cauggugggcgcgggccagcaccggcggcgcuccgaacgucuggcccgagcccaugaug

SEQ ID NO: 4239151 - RNA, 77 nt, Mycobacterium bovis subsp bovis AF2122/97
ggagggucgccugcgucggcaacucgcccaggcuacacgagagcccucgacugcgaaaaugccgaccaggcaccacc

SEQ ID NO: 4239152 - RNA, 79 nt, Mycobacterium bovis subsp bovis AF2122/97
gccaagaugguuucguacugaugcggcgucgaggcgccgaugccgggccgaucgacgccaaucagacgaauauuguggu

SEQ ID NO: 4239153 - RNA, 56 nt, Mycobacterium bovis subsp bovis AF2122/97
ggucguucguggucgcgaugaucacgaugucggccaucaucgccgguuacgaagcc

SEQ ID NO: 4239154 - RNA, 84 nt, Mycobacterium bovis subsp bovis AF2122/97
ugcaggugcacuacgucggugauuugguugcggcgcaccaacguucgaagcaucgacauuaccggcguaauccccgacccggca

SEQ ID NO: 4239155 - RNA, 111 nt, Mycobacterium bovis subsp bovis AF2122/97
cuggcacaagcacgugcccgccgccauccgccgagcagacgcagaaucgcccauuugguagcccaaaugggcgauucugcgucugcucgcggggucuuagccuaguuccag

SEQ ID NO: 4239156 - RNA, 56 nt, Mycobacterium bovis subsp bovis AF2122/97
ggccgacacuuccagcucggggcaggcggguccgugccgggcggaacgugucagcc

SEQ ID NO: 4239157 - RNA, 92 nt, Mycobacterium bovis subsp bovis AF2122/97
gccccugcaccgaggucccuguccgaagacacgaaccuggcguuggggaaguacgccagggucgcuucgggcagagaccacggugcacgggu

SEQ ID NO: 4239158 - RNA, 57 nt, Mycobacterium bovis subsp bovis AF2122/97
gugagguugcgaucguggaauucagugcccgccgcccguuucacccgcaacgucugc

SEQ ID NO: 4239159 - RNA, 91 nt, Mycobacterium bovis subsp bovis AF2122/97
cgguuggggcagucaucgcguccugcgcggaaucggccgcgaaguucgaugguucggggucguucagggcacgauuacgcugccccuaccg

SEQ ID NO: 4239160 - RNA, 77 nt, Mycobacterium bovis subsp bovis AF2122/97
gccaauugugccagaacgugaugcuggggcaguaauucgcccagcgggcuucacaucauuuucuggaagcacuuggu

SEQ ID NO: 4239161 - RNA, 79 nt, Mycobacterium bovis subsp bovis AF2122/97
gucgguacccaacgucgccaggauggucgcgaccgcguugccgccgcccucgucguccuugggucgcacguugaccggc

SEQ ID NO: 4239162 - RNA, 73 nt, Mycobacterium bovis subsp bovis AF2122/97
ggcuggggugguugcuggucggccggaggcugggguggucugcgguguuggcaagccggcgggcaagacggcu

SEQ ID NO: 4239163 - RNA, 78 nt, Mycobacterium bovis subsp bovis AF2122/97
gcggccugcagaucggaaucgucgucgacgagcaccuggcggugccgggucagggcgacuuuuugauccgcgggcugc

SEQ ID NO: 4239164 - RNA, 78 nt, Mycobacterium bovis subsp bovis AF2122/97
acgccccggaugacacggugaucggggaccggucguucggcucggauccggcuacggucaccgcguaugccggggcgu

SEQ ID NO: 4239165 - RNA, 65 nt, Mycobacterium bovis subsp bovis AF2122/97
gagggccaggccgcggugcagcgaucguugcgggcccgcaacuucgacgcugacggcuagcccuc

SEQ ID NO: 4239166 - RNA, 121 nt, Mycobacterium bovis subsp bovis AF2122/97
cgccgacagcgcguugccgcucgccgaaauacgcggucagcuucaggcauugcucguucauaucugggcgauccacugaccgaguagcgccgcggcuagaccgagcacaacgcugacgacg

SEQ ID NO: 4239167 - RNA, 99 nt, Mycobacterium bovis subsp bovis AF2122/97
gcgucgacgugggagcgucgccgccagcguaacgucacggcgaaauucgucgcugauucucgcaguggcgucacgcuggcggggcuacccgcaucgcgu

SEQ ID NO: 4239168 - RNA, 74 nt, Mycobacterium bovis subsp bovis AF2122/97
acuucgugcaguucgugauggaggaugccguccggcaacgcuacgauguuccgccacgccgagcugugcgacgu

SEQ ID NO: 4239169 - RNA, 56 nt, Mycobacterium bovis subsp bovis AF2122/97
gucggaucgucgacgacgacaggcagauauaggccguggucgccuugaagaccgac

SEQ ID NO: 4239170 - RNA, 66 nt, Mycobacterium bovis subsp bovis AF2122/97
gggcgcgagcagacgcauaagcgcccauuucggcacgacauugggcgcuuacgcgucugcccgccc

SEQ ID NO: 4239171 - RNA, 73 nt, Mycobacterium bovis subsp bovis AF2122/97
guuggucauagccgagcaggugcgcuuccucgacgaccacgacgggggugcguccgcgcucggcuuguucggc

SEQ ID NO: 4239172 - RNA, 106 nt, Mycobacterium bovis subsp bovis AF2122/97
gcuggcggcauucggggugggcgcgaugcugcuggccgacaugcucggucgcgaugggcucgagcgcgcgauccaucagcagguguucaccuggauacccgccggc

SEQ ID NO: 4239173 - RNA, 76 nt, Mycobacterium bovis subsp bovis AF2122/97
gcgcuggagaaugcucggggcccggugaucgcggugucggacuggaugcgcgcgguccccgagcagauccgaccgu

SEQ ID NO: 4239174 - RNA, 56 nt, Mycobacterium bovis subsp bovis AF2122/97
cgagcguaacgccacugcgauuuucugcccgaaauuucgcaguggcguuacgcucg

SEQ ID NO: 4239175 - RNA, 70 nt, Mycobacterium bovis subsp bovis AF2122/97
guaagugcguucggggcgacaccggcgacgacggugcgcccgucgucgccgguguaguccagcccaaagc

SEQ ID NO: 4239176 - RNA, 55 nt, Mycobacterium bovis subsp bovis AF2122/97
guucagggcaucgguccgugccgcauacggcggacuugcgaaucgaagccugggc

SEQ ID NO: 4239177 - RNA, 60 nt, Mycobacterium bovis subsp bovis AF2122/97
gcuggugagugcggcgaccgcuaccgggcuuccgcugcgcggugugcugcacucggcggc

SEQ ID NO: 4239178 - RNA, 62 nt, Mycobacterium bovis subsp bovis AF2122/97
cgccgagcgugaacucagugcaagaacgcacgcgaaaaaucgcacuggguacacgcucggcg

SEQ ID NO: 4239179 - RNA, 60 nt, Mycobacterium bovis subsp bovis AF2122/97
acugcguugcaugaccgacgguguuccggcccgcgggucacuucgaucacgcggcgcggu

SEQ ID NO: 4239180 - RNA, 66 nt, Mycobacterium bovis subsp bovis AF2122/97
gcaggccgauguugguaccgcaaccuugcccugguugggcgaucaccggauacacaacguggcugc

SEQ ID NO: 4239181 - RNA, 57 nt, Mycobacterium bovis subsp bovis AF2122/97
ugaucgagacggcgaagcggcugggagcaaaccccggucgcuguguggucaucgaca

SEQ ID NO: 4239182 - RNA, 81 nt, Mycobacterium bovis subsp bovis AF2122/97
guggauugaccccgcuuggggugacacgggguucacaucguugccagugaaucuggugaaugcaccccauagcggguccgc

SEQ ID NO: 4239183 - RNA, 73 nt, Mycobacterium bovis subsp bovis AF2122/97
cgcgauggccgcgugugcaaguagcggcuugaucagcaaggcgccugcucccagcgcggcuauguagcccgcg

SEQ ID NO: 4239184 - RNA, 74 nt, Mycobacterium bovis subsp bovis AF2122/97
gggcgucguagguguggcccuccgacagcgccuucugaaagaucgacggguugguggucaccccgacgacgcuc

SEQ ID NO: 4239185 - RNA, 108 nt, Mycobacterium bovis subsp bovis AF2122/97
gaugcacaagucaaaaccgcguuggcguuuguccaaguaguaggcgagaucaccggcgauauaugccgguuugccgucgcucuugaucacgacgcgguccuugucguc

SEQ ID NO: 4239186 - RNA, 67 nt, Mycobacterium bovis subsp bovis AF2122/97
gucuggcggagacgcuggcccgcgaggucaccgccgacggcauuggggugucggugcucugcccgau

SEQ ID NO: 4239187 - RNA, 128 nt, Mycobacterium bovis subsp bovis AF2122/97
gcuugcagugucuggcguggcugguugcucggccgacaccggcgaucgccacccggaguugguggucggauccacgccggacuccgaggcgaugcugcuggccgccaucuacgucgcggcgcugcggu

SEQ ID NO: 4239188 - RNA, 57 nt, Mycobacterium bovis subsp bovis AF2122/97
uugggaccaugccgcugggguggcguugguacgagccgccgguggcguggucaccga

SEQ ID NO: 4239189 - RNA, 60 nt, Mycobacterium bovis subsp bovis AF2122/97
ggcggcgucguuggcggcguggucaccggcguggucggcggcgucguuggcggcgugguc

SEQ ID NO: 4239190 - RNA, 90 nt, Mycobacterium bovis subsp bovis AF2122/97
gucgagcugugugccgagcggcugcccggcgcggugcuggccauaggcaacgcgcccaccgcgcuguuucggcugcucgaacuggucgac

SEQ ID NO: 4239191 - RNA, 80 nt, Mycobacterium bovis subsp bovis AF2122/97
ccaacccucgccggucagcgugcagguagguauagccgguugucgcagcgcacacuaccgccgcgaccgcgagcaucugg

SEQ ID NO: 4239192 - RNA, 63 nt, Mycobacterium bovis subsp bovis AF2122/97
ggcggccgugcgcgugaucgacucggugauucgauacgccuguucgaucucggucaugccguc

SEQ ID NO: 4239193 - RNA, 75 nt, Mycobacterium bovis subsp bovis AF2122/97
gggugcggugauuaucgccggaggcgagcgcgccgaacuaggcggcgaccuguccggcgguuauuacaugcagcc

SEQ ID NO: 4239194 - RNA, 62 nt, Mycobacterium bovis subsp bovis AF2122/97
gccuggaggaccuggacucggcgcugaaggaaaccagccagcugaaccugauccucaagggc

SEQ ID NO: 4239195 - RNA, 81 nt, Mycobacterium bovis subsp bovis AF2122/97
gacggcacucgccgggccaucguggagcggcuggcgcacggcccgcuggccgucggcgaguuggcccgcgaccugcccguc

SEQ ID NO: 4239196 - RNA, 68 nt, Mycobacterium bovis subsp bovis AF2122/97
guucgggauccaccgauugugucgaugcgcagcugacgcugucaucuaccaauucggugaucgugggc

SEQ ID NO: 4239197 - RNA, 79 nt, Mycobacterium bovis subsp bovis AF2122/97
gaucugcucgaagggggaaagguguugccggcgaugcucaagcgccaacuucagcugcuucuccccuuggucgaagauc

SEQ ID NO: 4239198 - RNA, 71 nt, Mycobacterium bovis subsp bovis AF2122/97
gccgcguucgacgaucuggccggucuggaccaccaggauguggucggcaucgcgaaucgucgaaagucggu

SEQ ID NO: 4239199 - RNA, 74 nt, Mycobacterium bovis subsp bovis AF2122/97
gcucgucaaggcuguggccggcgucgucgcgguaaggaucgugcgcgaugacccgcaggcccagcccggacagc

SEQ ID NO: 4239200 - RNA, 87 nt, Mycobacterium bovis subsp bovis AF2122/97
ggcacgccgagugcggucggauuuugcgauuaaugccgauaccgcggugacggucggggaaaucugccgacgcuuggacggugugcc

SEQ ID NO: 4239201 - RNA, 63 nt, Mycobacterium bovis subsp bovis AF2122/97
ggaguucaaugccacggcgucguuguagcugcgcagguaguggacgccggcggcaucggaucc

SEQ ID NO: 4239202 - RNA, 108 nt, Mycobacterium bovis subsp bovis AF2122/97
ggcugccgcgggcgguucgucgugccuggacccgauggaaguacccggcaagggcuucaugagccuggcggucgauccgucgggugcggccuucggccuguggcagcc

SEQ ID NO: 4239203 - RNA, 74 nt, Mycobacterium bovis subsp bovis AF2122/97
ggcgucagcugacggacgacgagugcaucggugagcgcaucgagguaucgccgcgccgucgucugagcaacguc

SEQ ID NO: 4239204 - RNA, 89 nt, Mycobacterium bovis subsp bovis AF2122/97
cgucagugaucagcccccacucaaagcggguucucagccgguccucgaggguggcgagcugcuugggugggcggucagaugagaugacg

SEQ ID NO: 4239205 - RNA, 57 nt, Mycobacterium bovis subsp bovis AF2122/97
ggugccgccguggcugacagccaagcugacgaggaugauucggccgcgacggcugcc

SEQ ID NO: 4239206 - RNA, 62 nt, Mycobacterium bovis subsp bovis AF2122/97
cggucgaaauggucaaagagcgguucgccgggcugugauucggugugcuguuuggccagccg

SEQ ID NO: 4239207 - RNA, 81 nt, Mycobacterium bovis subsp bovis AF2122/97
gcgggaguucacgcgcggcuccggugcuugucgaugauucgaugccucacccagguacacgucgaugcugcgcacuuccgc

SEQ ID NO: 4239208 - RNA, 60 nt, Mycobacterium bovis subsp bovis AF2122/97
uccggcgagcccgggcuugccgacgaccuaggguucgucggcgaaaccggcucuaccgga

SEQ ID NO: 4239209 - RNA, 80 nt, Mycobacterium bovis subsp bovis AF2122/97
cgacgacgaguacaccaaggccgucagcuuggcccagccaccguugggcaagcugcgggcgcuuggugucaaucccgacg

SEQ ID NO: 4239210 - RNA, 75 nt, Mycobacterium bovis subsp bovis AF2122/97
cugucgucgucgacgauccgacugagccaggccacuacgacgccgaauggaucaucauccucgacgauuggacgg

SEQ ID NO: 4239211 - RNA, 72 nt, Mycobacterium bovis subsp bovis AF2122/97
gccugggguucgacggggaucucagacuuggggggauugggaggugaugagacccccgucgaagucuagugc

SEQ ID NO: 4239212 - RNA, 83 nt, Mycobacterium bovis subsp bovis AF2122/97
gucugccgcuggauggcaccggcggugcuccgcgccaaacaauagugucucgguaaccgccgguccguucaugccgugcgcac

SEQ ID NO: 4239213 - RNA, 104 nt, Mycobacterium bovis subsp bovis AF2122/97
gcacgaaaugcagcuggcucccggugagauuguucuggaugaucguggugaucaccaacacgaccagccaggcauaggucaacggggcguugcugacgaagugc

SEQ ID NO: 4239214 - RNA, 91 nt, Mycobacterium bovis subsp bovis AF2122/97
gcgucgcguccggaacggucugcgguugccagucgaucguguguacgaaauugguggcaucacaguaggccucgaccggaccggucgacgc

SEQ ID NO: 4239215 - RNA, 69 nt, Mycobacterium bovis subsp bovis AF2122/97
ugcgcccggguuugaccacgaugcugaacgucacguccagcguugucucggcgaacaccugcaggcgca

SEQ ID NO: 4239216 - RNA, 82 nt, Mycobacterium bovis subsp bovis AF2122/97
cgccguucgaccucgagucgcugcaaacaggccagcaauuccgggguggucaacgcaucgcacuugagaucgagcacccgcg

SEQ ID NO: 4239217 - RNA, 56 nt, Mycobacterium bovis subsp bovis AF2122/97
gucggucuucaaggcgaccacggccuauaucugccugucgucgucgacgauccgac

SEQ ID NO: 4239218 - RNA, 78 nt, Mycobacterium bovis subsp bovis AF2122/97
cuggcgcggcugucgucgacgguggcgguggugcccgaacugcgggaguacgcgccaacgaucgaacagcaauuccag

SEQ ID NO: 4239219 - RNA, 107 nt, Mycobacterium bovis subsp bovis AF2122/97
uggucaggccggcgccgcuggcggcgccggguugggcuucggagcggucgggcacccgacuccucagccggcggcccugggcgcggcuggcgugguggccaagaccg

SEQ ID NO: 4239220 - RNA, 66 nt, Mycobacterium bovis subsp bovis AF2122/97
gucggucaacagguucguggcgcgcgaggccggcaaguacggugugcguucgaaucucguugccgc

SEQ ID NO: 4239221 - RNA, 71 nt, Mycobacterium bovis subsp bovis AF2122/97
gucccggcggccgcaauuagcgagggcagucugcucagccagauggcccuggcgaguguggccggaggggc

SEQ ID NO: 4239222 - RNA, 56 nt, Mycobacterium bovis subsp bovis AF2122/97
gucgccggcaucaccccaugacgcaucgccugcaccaucuugaucaccccggcgac

SEQ ID NO: 4239223 - RNA, 83 nt, Mycobacterium bovis subsp bovis AF2122/97
gccaccagcgaccaaucgaggaaugcgccgcguacggguccucgucaucguccucgucgcgcacgcgcuucuugagggguggu

SEQ ID NO: 4239224 - RNA, 124 nt, Mycobacterium bovis subsp bovis AF2122/97
cuggagucguugcagugcaccagaucgaugcggccgguaauugcuuugauccgaucgacggcaucggucagcgccucgccggccgcccagguguggcagguguccaggcaaaacccgauuccgg

SEQ ID NO: 4239225 - RNA, 71 nt, Mycobacterium bovis subsp bovis AF2122/97
cggcucaccggggcucagcucgccgaugacggcgucgaaaucgucggcgaaaugggccaugguguaggccg

SEQ ID NO: 4239226 - RNA, 62 nt, Mycobacterium bovis subsp bovis AF2122/97
cugugacgccaaccucgcggucacgcugccgcccggcuugaccgaugagcaggcgaucacgg

SEQ ID NO: 4239227 - RNA, 61 nt, Mycobacterium bovis subsp bovis AF2122/97
guugauuuccggucacuagucgacggaggugugcauaacacccugguggaccgcuaucggc

SEQ ID NO: 4239228 - RNA, 60 nt, Mycobacterium bovis subsp bovis AF2122/97
gcugugccgagggcuucgcuggccgccgccaaggcgaucucggcgaaccccgcggccggc

SEQ ID NO: 4239229 - RNA, 73 nt, Mycobacterium bovis subsp bovis AF2122/97
ccggugucgaaacugcaaccacgcaccgaugcgucggcgugucuugugcgugguugcagugucgcgaagccgg

SEQ ID NO: 4239230 - RNA, 91 nt, Mycobacterium bovis subsp bovis AF2122/97
ucgcguuggccgggcacuggcgauaucagacguucgaccgugccgacggucuggacuucgacgucgccccacugcccaucgguccgcgcgg

SEQ ID NO: 4239231 - RNA, 66 nt, Mycobacterium bovis subsp bovis AF2122/97
gccgagcagacgcaaaagcaccccauuucggcacgaaaugggggcccuuugcgucucagugucggu

SEQ ID NO: 4239232 - RNA, 67 nt, Mycobacterium bovis subsp bovis AF2122/97
gcccacgcgugugacgcugcggcgaauccaagcgcgauuucuugccgcgccauuacgcucgccgggc

SEQ ID NO: 4239233 - RNA, 106 nt, Mycobacterium bovis subsp bovis AF2122/97
gcuggguaaugaaaugcaagcggccgcggugagccuggacccggcgcuggcucgugcguuacgcgccgguguggaggccggcgcgcucgcaggcaucguguccggu

SEQ ID NO: 4239234 - RNA, 74 nt, Mycobacterium bovis subsp bovis AF2122/97
ccuguucccacucuuugugauguuugugaucacggcgaucaccaugcaacgcgaaagggcuucgggaacgcugg

SEQ ID NO: 4239235 - RNA, 82 nt, Mycobacterium bovis subsp bovis AF2122/97
ggcgguggccgcggugcugacucgguuuggugcgacgccgacggugugcgacgacgauccggucaugcugcgaccgcacgcc

SEQ ID NO: 4239236 - RNA, 104 nt, Mycobacterium bovis subsp bovis AF2122/97
cauccgcccgggccugauccguacagaucugguugugcccgucacagagucgccggagcugagcgcggacuaccgggucugcacgccauuaccgcgggugggug

SEQ ID NO: 4239237 - RNA, 130 nt, Mycobacterium bovis subsp bovis AF2122/97
cccuuuccgugccgaugcgaccaggugacgccgcgcucgucgcgacgaaccguccauccgccggcuucaagaagccccggaucgguggcgugcagauguaaggugucgucgucuucgagcgguaauggcg

SEQ ID NO: 4239238 - RNA, 71 nt, Mycobacterium bovis subsp bovis AF2122/97
acgucguucuacgacugguacgccgaccugccgguggccuccccgcagguguucggcgaccagaccgacgu

SEQ ID NO: 4239239 - RNA, 109 nt, Mycobacterium bovis subsp bovis AF2122/97
ccgguguuguagcugcccgcguuggcgacaccgguguugacgaugccgguguugaagaagcccguguuagugcugccgguguugccgaugccgguguugccgcugccgg

SEQ ID NO: 4239240 - RNA, 55 nt, Mycobacterium bovis subsp bovis AF2122/97
ggaucgggugcuugcggugaucugcgguucugcggucacccaggacggccgaucc

SEQ ID NO: 4239241 - RNA, 95 nt, Mycobacterium leprae
ggggccacguucucgaucuuacuuaccggcagaguugaaaaccaagagcugggauuucgacuuaguggcagguguugaucaucgucgcggcgcuc

SEQ ID NO: 4239242 - RNA, 84 nt, Mycobacterium leprae
cuggaucgucgccucgaugucauccggauagugguuggacccauccacgaccaagagauccuugauacgacccgugaugaacag

SEQ ID NO: 4239243 - RNA, 66 nt, Mycobacterium leprae
ggcacccucuugccgguccaccgguaugugucgcaggcggcgcauaaucgguccgguaauuuugcc

SEQ ID NO: 4239244 - RNA, 72 nt, Mycobacterium leprae
gcuuguaaacgcgguuguccaacacacacauauggucuauauagugugguccggggucggcuagcagcaagu

SEQ ID NO: 4239245 - RNA, 68 nt, Mycobacterium leprae
ccgcugugggcauuguugauugcaguuugcguuggucgaggccguagucgacgacgccgagcggccgg

SEQ ID NO: 4239246 - RNA, 55 nt, Mycobacterium leprae
aucgggcaguggcgagucguagacccguucgggaaucuggacgaccacguuuggu

SEQ ID NO: 4239247 - RNA, 58 nt, Mycobacterium leprae
gggugaaaccgaguguuaguauuaagcauauuuauguuguaguaaccaucggucaccc

SEQ ID NO: 4239248 - RNA, 55 nt, Mycobacterium leprae
augccggugacccgcuuugcggucaacaguacauaucgcaguagcacaccggcgu

SEQ ID NO: 4239249 - RNA, 60 nt, Mycobacterium leprae
aaggaucugcagaggcugcugaacgacaccgucaaagcccggcgccucugucggcuucuu

SEQ ID NO: 4239250 - RNA, 58 nt, Mycobacterium leprae
ucgucgccuacgcuggguuauccagccacgcugaauggucgcccgcgugggacgaugg

SEQ ID NO: 4239251 - RNA, 66 nt, Mycobacterium leprae
ggguacgacgucgagauugucgcggaccaagaugaugucggcggcaccaaucgcgacgucgguccc

SEQ ID NO: 4239252 - RNA, 72 nt, Mycobacterium leprae
gaaaaugacgaugucgccgggcuagaugucaggugcgacuuucuccgaauccucggcgacguagugauuuuc

SEQ ID NO: 4239253 - RNA, 104 nt, Mycobacterium leprae
guugccgcggugcuaguggcuccgauggcgcugucgcggauagugcugggggugcacuaucccagugauguggccuucggugucgugcucggugccgcggucgc

SEQ ID NO: 4239254 - RNA, 56 nt, Mycobacterium leprae
gcgcagucguugaagccguuggcgacggguagcggaacggcuucgaauuauugugc

SEQ ID NO: 4239255 - RNA, 71 nt, Mycobacterium leprae
gauguacucguggacggcaucgcgguauucgaguugcgcugcucgaucgcuggcgaugucguugggucauu

SEQ ID NO: 4239256 - RNA, 61 nt, Mycobacterium leprae
gcgaccuggucuuugacacugugaucacccguacgguccgguuuccugagaccagugucgc

SEQ ID NO: 4239257 - RNA, 105 nt, Mycobacterium leprae
gcgcgugauugguccgcuggggucagcugaggauucgcaugccgugguugagugggcagguaaucccggacugaccgcagugcgcaagaugaucaaugaucgcgu

SEQ ID NO: 4239258 - RNA, 123 nt, Mycobacterium leprae
cuggccgauuggguugaggggcccggugcugaaguggcguuggcugauguggcccauacauugaaucaucaccggucgcggcacgccaaguucggcaccgugguugcccgugaucggauccag

SEQ ID NO: 4239259 - RNA, 70 nt, Mycobacterium leprae
ucggauucagugcggauccgccauugcugcacgaccuuugcaugcuccuuggauccggacagcaauccga

SEQ ID NO: 4239260 - RNA, 56 nt, Mycobacterium leprae
guugcgcuuccaccucgguaccggccccuggccacaccgagggcggcaagcgcagc

SEQ ID NO: 4239261 - RNA, 64 nt, Mycobacterium leprae
uguuggugagcgaaaaaggcaccgguacggccuauuccggucugcacuucgucgauuaccagca

SEQ ID NO: 4239262 - RNA, 82 nt, Mycobacterium leprae
aucuguuggaagccaaccugcggcuggugguuucgcuggccaagcgcuacaccggccgcgggauggcguuccucgaccugau

SEQ ID NO: 4239263 - RNA, 83 nt, Mycobacterium leprae
gcucgucuccgcuaaccggucgcggcaauccuuucgaugaauccgcguucaaggcuuccugugauucggggcgggagacgggu

SEQ ID NO: 4239264 - RNA, 58 nt, Mycobacterium leprae
agaugugcagcgucgaauuaugggaaucgaaaccgaguucggugucaccugcacauuu

SEQ ID NO: 4239265 - RNA, 83 nt, Mycobacterium leprae
gucgaguuugcgacggcaccuaucauaaucucauaaucauaacuuugcuaccagauuaugguuggguguuugccgcacuggac

SEQ ID NO: 4239266 - RNA, 63 nt, Mycobacterium leprae
caaugacgguuacguuggugucuauggguguggcgaacucagcgcaaagcuagccguccugug

SEQ ID NO: 4239267 - RNA, 55 nt, Mycobacterium leprae
gacagaaaguugaucgugggcaaucgugauaucgcccaugaugacguaccuaguc

SEQ ID NO: 4239268 - RNA, 59 nt, Mycobacterium leprae
ggggcuagcuaggcugauaacaaucuggcaaguaggaugccaucagcacuaagaguccc

SEQ ID NO: 4239269 - RNA, 66 nt, Mycobacterium leprae
ugguggccaucaucaccccggcguuguugaucagcaagucgaugcguggguagguggugcacagua

SEQ ID NO: 4239270 - RNA, 62 nt, Mycobacterium leprae
gcggggagcucagaaauuuuuguugcccaguaagaucgaggcaacacugagaauucuaccgc

SEQ ID NO: 4239271 - RNA, 67 nt, Mycobacterium leprae
aucaccgcucccuuaagcacggugaccaacagcagauccuggucacuagcaggcgaacggucacgau

SEQ ID NO: 4239272 - RNA, 57 nt, Mycobacterium leprae
acggcgaugaggaagcgcugcggauugugcaugccaucccggccaccuucgucccgu

SEQ ID NO: 4239273 - RNA, 64 nt, Mycobacterium leprae
caacauuuaccaccgcaagguucgacgggcguaacuggaccauaucuucgcgguggugcuguug

SEQ ID NO: 4239274 - RNA, 71 nt, Mycobacterium leprae
ggcugugacgucggcgcggauucgccaugaacugacuucagucagcauggacgaauccugagaugccagcc

SEQ ID NO: 4239275 - RNA, 64 nt, Mycobacterium leprae
ugcgggcggugcgguugcgggauggcgugcaguggagccgcauccgguuagcugaccgcgcgua

SEQ ID NO: 4239276 - RNA, 65 nt, Mycobacterium leprae
gauuccgguagcauguugugcuggagcaauuuuuccgacuccagcggggcgugcaacgcgguauc

SEQ ID NO: 4239277 - RNA, 70 nt, Mycobacterium leprae
gcgguggcugggagcggauaucgagcagcgccaguucuaucgggugcucgauaucguguucaguuccugc

SEQ ID NO: 4239278 - RNA, 88 nt, Mycobacterium leprae
gcggugcucuacgagacgcguggugaugacggccccgguggcccaguugacgccgaggcgcccacaccgcgguuacgucaggcgcugc

SEQ ID NO: 4239279 - RNA, 109 nt, Mycobacterium leprae
gugguaacgcgcugcgcgguugcguugacgcaguguuagucgaucuuuaugguuacaucaucgugauggauuggaugaccggugagucgccgcgcggggcggaggccau

SEQ ID NO: 4239280 - RNA, 64 nt, Mycobacterium leprae
aggaucgucaggucccccgacggcagccgagaccgcggugugcaguuggcggucugacgucucu

SEQ ID NO: 4239281 - RNA, 80 nt, Mycobacterium leprae
gaagcuggcggcggucuccgacauguccugcuacggugcuucauacuagcgacaccgucggggucgccgaagaauauguc

SEQ ID NO: 4239282 - RNA, 57 nt, Mycobacterium leprae
gucgaggguguagggaccaccaucgcggccgcgguuaccgagugguucaccgucgac

SEQ ID NO: 4239283 - RNA, 79 nt, Mycobacterium leprae
gcggcgcuggccgacgggucggaauaccgcggacgcuacggccuguccgucgcagcucuggcccgauggcaucgcccgc

SEQ ID NO: 4239284 - RNA, 60 nt, Mycobacterium leprae
ugaauguguucaacgggcggcauuacuccgaugugggucuguuaucggugaacaugauca

SEQ ID NO: 4239285 - RNA, 61 nt, Mycobacterium leprae
agcgcaucacuucagcgacaggcagcugcagucgauuagccgguccuuggacagaugagcu

SEQ ID NO: 4239286 - RNA, 61 nt, Mycobacterium leprae
ccgaugucgacgacauccuguggcaaguaccguaccugccgaucgacccgcgcgacgucgg

SEQ ID NO: 4239287 - RNA, 56 nt, Mycobacterium leprae
acggccggucggugaauaugguggcugacgcagucaccgaguuacugaccgaucgu

SEQ ID NO: 4239288 - RNA, 73 nt, Mycobacterium leprae
gcgacagucuucuggacguaccguucuuucgcgacaucgcgaaggaaugcaggcuucagucgcuauuguucgc

SEQ ID NO: 4239289 - RNA, 59 nt, Mycobacterium leprae
cgauggguuuacggugcauacccaaauagcccgcgguccaugcuucgaauagcucaucg

SEQ ID NO: 4239290 - RNA, 62 nt, Mycobacterium leprae
gaguuagucaccggcuagcaguucugugcgcaguccagcgcugucagcgguuacuucgacuc

SEQ ID NO: 4239291 - RNA, 63 nt, Mycobacterium leprae
gucgcguugagccucucaaugggcugcgagcgugcggguguauucuauuaagauuaacguggc

SEQ ID NO: 4239292 - RNA, 77 nt, Mycobacterium leprae
gcccuauaggaaaugacucucccggaaccgauaagcaaccuucguugucgguauccgggucgggcauuguuucgggu

SEQ ID NO: 4239293 - RNA, 129 nt, Mycobacterium leprae
cucgaauucggugcgacugguugagguggcaauggguagcggcgcuggugccgcguaccugguugacugggccaaggauaucgacccggcguggcuggccggggucacgacagugggugucaccucggg

SEQ ID NO: 4239294 - RNA, 59 nt, Mycobacterium leprae
aucgacgaccugauuggcgaaauccgcaaacgcgccaacgccgaccaacgggucuuggu

SEQ ID NO: 4239295 - RNA, 55 nt, Mycobacterium leprae
ccgcagucguucgacaccguuuccaaggcacggaaaccacugucgaccacugcgg

SEQ ID NO: 4239296 - RNA, 62 nt, Mycobacterium leprae
uugcugacgaauugguggcguugggcgugcucaccucggcucuauaccgguuugucaggcag

SEQ ID NO: 4239297 - RNA, 83 nt, Mycobacterium leprae
augguugcacaacuguucuuuuagugccaagcuaccgcugucguacucggcacguaaguugaacaggaacauuguguggucau

SEQ ID NO: 4239298 - RNA, 60 nt, Mycobacterium leprae
accgcggaccgaccuggauugcuccaacaccccgguagccaguucggggucugucgcggu

SEQ ID NO: 4239299 - RNA, 107 nt, Mycobacterium leprae
gcuguggcggccaacagcaagcacgacaucgccgaagcggaacgauggaaccugccgaucauucugaucguccugcucgcgguauuugguucgcuggccgccgcggc

SEQ ID NO: 4239300 - RNA, 60 nt, Mycobacterium leprae
agggcgccaaauugggcgugccguucaaaccuaaugcgucacgaacguccuuggugucuu

SEQ ID NO: 4239301 - RNA, 129 nt, Mycobacterium leprae
ucgguugucgcgucaaagugcguggcaaguucugcaagaugcugcugaacaugccgguaucacuucgggugugucgccgcacauguugcggcauuccuuugccacccacuuacucgaagguggcgccga

SEQ ID NO: 4239302 - RNA, 63 nt, Mycobacterium leprae
aucuuggagaacccggccugguauacucccuauacgccguaccagcccgaaaucagucagggu

SEQ ID NO: 4239303 - RNA, 59 nt, Mycobacterium leprae
ucgaggcgcucaauccggagauggaaacgcgcauccuaaucaccuguagaguguuuuga

SEQ ID NO: 4239304 - RNA, 84 nt, Mycobacterium leprae
cggccgcccaggaucggccggaacucgucggauccacagggauguagguagauugucuccaggcaggucccgaauggcaggccg

SEQ ID NO: 4239305 - RNA, 56 nt, Mycobacterium leprae
uugugguugcugacagcacugaugaacccauucgucgggcagaugcacaaccucga

SEQ ID NO: 4239306 - RNA, 57 nt, Mycobacterium leprae
gcagcagcugaugcuuacgugcuaggucgacuauuugguuaaggauuucguugcugu

SEQ ID NO: 4239307 - RNA, 60 nt, Mycobacterium leprae
gggaaucggaugcgaagguuauuuggcauggacaacuaccgcggugauuuuugcaccccc

SEQ ID NO: 4239308 - RNA, 92 nt, Mycobacterium leprae
gcgcgcgcaaucagggccucggugcggguaucgauugagcugguugcuucguccaggaucaauagcuguggccgggccaggaaugcgcgugc

SEQ ID NO: 4239309 - RNA, 119 nt, Mycobacterium leprae
gcgaucgcgguucugggugcguuguuggcaaucucggagaugaucaauaugcccgccggcuucucgaucgguugggcuaugugguucauucugguuugcagcgugcuccaagcgauugc

SEQ ID NO: 4239310 - RNA, 129 nt, Mycobacterium leprae
uaaugcaggaggugcagacuuugagcuguugcuuguugccgccgggacgcgucaccaugugcacaguuugcacauugggaucccaccggcggcuggugcggcggugggagugugauaccgacuugccga

SEQ ID NO: 4239311 - RNA, 56 nt, Mycobacterium leprae
cgagcugcgacuagcugaugccugggugugggacauguaccggccagcgcgguucg

SEQ ID NO: 4239312 - RNA, 76 nt, Mycobacterium leprae
gcacucgacaaacugacguugacaaauugguugugccaugucaaucaggucaaccgagucggucgcgucacggugc

SEQ ID NO: 4239313 - RNA, 61 nt, Mycobacterium leprae
gucugauuaguggcgauccuaacgcucggcgucgccguguuugcgaucgccacuaguugac

SEQ ID NO: 4239314 - RNA, 73 nt, Mycobacterium leprae
gucgucgaucgccugauagcggcuuuuagcaauaugcaugaugcucagaacccgcuaauuagcucgguccggc

SEQ ID NO: 4239315 - RNA, 77 nt, Mycobacterium leprae
gcagguuucggcuuuaucacccgaagcgcuugcacuccauggagugcgccuagauguggugaugaccccgcugccgc

SEQ ID NO: 4239316 - RNA, 64 nt, Mycobacterium leprae
cuucgggguguucuuuggcaugcucgucgucuacaagaccggagccauccgggucaccccgaag

SEQ ID NO: 4239317 - RNA, 78 nt, Mycobacterium leprae
gcgcgacgccgccucgaguauggcgauccgggugagaaaucgcgaccuuguccaaacucgaggcgaucacguugaugc

SEQ ID NO: 4239318 - RNA, 113 nt, Mycobacterium leprae
cuggcggugcgcuuaggugaugcucacacacggcaauuauaucaagcacugcuggucgccaccggcgugcuuaccguggugcugaugguggcgacaucauggugugccgucgg

SEQ ID NO: 4239319 - RNA, 79 nt, Mycobacterium leprae
gccguuccaguauuucuacgagucugcuagaaaugcauuucaggugcucccaggagacuucgugacuacugaugacggc

SEQ ID NO: 4239320 - RNA, 57 nt, Mycobacterium leprae
uagccagugaucgccgcccugaauaucuuaauuacucagcucgagggcuauuggcua

SEQ ID NO: 4239321 - RNA, 76 nt, Mycobacterium leprae
gugcgguguguaccggugagucggucaguacucucagugccggccgccucagccggugcgcacuugacgaccgcgc

SEQ ID NO: 4239322 - RNA, 127 nt, Mycobacterium leprae
cgguaucgaagcacgcucaucugccuugucaguggccgcggccauguggcugaccguguugcucguggccucgguacagcgcaacaggccgcggcuauggcugugcuaugcgcugacauugaugcug

SEQ ID NO: 4239323 - RNA, 61 nt, Mycobacterium leprae
ucgaugaacaacguuacugcggcgcccccgaccagcugcugacagcggugcuguucaucga

SEQ ID NO: 4239324 - RNA, 59 nt, Mycobacterium leprae
gccugguucgccgacgaagcaccggugcgcuugguggcugcguugccggcgaaccaggc

SEQ ID NO: 4239325 - RNA, 130 nt, Mycobacterium leprae
acauguacaaccccugcccagggaauugcuuucucaauguggugauagcauuucgggcauguaucccacuaccuccgaagacgcuagaauauacuugagagcuaaguaucgcgcauggugguuauaaugu

SEQ ID NO: 4239326 - RNA, 84 nt, Mycobacterium leprae
acagcucggcugguguuauuuggccaacuugaccaucauuuuccaaugacaaugauggucguugccgauaacaagcuauguugu

SEQ ID NO: 4239327 - RNA, 85 nt, Mycobacterium leprae
ggaucugaucacugugugcgccgggaugaacgauguuauccagccgggacgaucguucgcccgugcgcuugccgaucuugaaucc

SEQ ID NO: 4239328 - RNA, 130 nt, Mycobacterium leprae
ugccuccaguggcaaggccaucgguggauccucuucauaggcccaguugaugaacauaauuucgucggugccgagcuuaugcgucauuagcggguaccagaaccuccaaacccucuuguacauggaggua

SEQ ID NO: 4239329 - RNA, 59 nt, Mycobacterium leprae
gguugcaguagccggucguuaccaguuaucugaagugguggaaguugguuacggcgauc

SEQ ID NO: 4239330 - RNA, 66 nt, Mycobacterium leprae
acccuccgggucguauccgggucagugucgauaguugcgcuaaucugguagacgacuuggucaggu

SEQ ID NO: 4239331 - RNA, 56 nt, Mycobacterium leprae
gcgcggagggacgcugggaugaucgagauguuggucaccccggaguccccuccggc

SEQ ID NO: 4239332 - RNA, 88 nt, Mycobacterium leprae
agguaacggaguggcgcgucaacacaccggauauaugucaacaauguugacauauauccgguguguugacgcauuuuuugcguuaccu

SEQ ID NO: 4239333 - RNA, 75 nt, Mycobacterium leprae
ucgacacguuuugcggcgucagcugacaaaggccaacgaccuuggcuuuucuugcuacguccaucccgaaaucga

SEQ ID NO: 4239334 - RNA, 124 nt, Mycobacterium leprae
gggggggaacgagaucaccaccaugcguuugcgguuugccaggauguucaucagcaucacgguguccgaccguaugcugucgacgucuucgguguaguuugcgcccauguuggcguucgccccu

SEQ ID NO: 4239335 - RNA, 67 nt, Mycobacterium leprae
cgcggcggcugcugggcgcgauaccacgaccagaggucgggugauuaugcuuagcaggaucgucgcg

SEQ ID NO: 4239336 - RNA, 77 nt, Mycobacterium leprae
acacuggcgcucacagguacugaaccuuuucaaugccuucgaaggcauugaaguagaacuugucgggauccagucgu

SEQ ID NO: 4239337 - RNA, 66 nt, Mycobacterium leprae
gcuagcugaacugacuacgcucagagcguaucauacaugacaugccucugccgucaguuugcuggc

SEQ ID NO: 4239338 - RNA, 60 nt, Mycobacterium leprae
gcuggcggccaagcugggcgcuaucgugagcaacgagucagccgccguggggcugccggu

SEQ ID NO: 4239339 - RNA, 114 nt, Mycobacterium leprae
ucacagcgccgaguacacugcccccgaucgcugcgguugguauugucgcagcgacugugacuggccuggucguagcgucgaggacggcacaccaaacuauugcuggcguuguga

SEQ ID NO: 4239340 - RNA, 73 nt, Mycobacterium leprae
gggugcaggguuucucgcggcugccucaucgaugccgaaauuggcguaggugaccaccgcgaucccuugaucc

SEQ ID NO: 4239341 - RNA, 64 nt, Mycobacterium leprae
ggaaaugaccuuguuggaacuuucggacuucgucaaaaaguucgaggagaccuucgaggucacc

SEQ ID NO: 4239342 - RNA, 65 nt, Mycobacterium leprae
ugcagaugacgaugguggugcgguggaugccuaagaucaagcaccaagcccaucgucaguuugcg

SEQ ID NO: 4239343 - RNA, 67 nt, Mycobacterium leprae
gauagcuuuagcguaagacaacgccagcgccucgccggugccggucgggucuugguuaacggcgauc

SEQ ID NO: 4239344 - RNA, 100 nt, Mycobacterium leprae
gugcggucaggcgaaaagccugggcaccaggccgucgucggcguggauuggcgaaccucguugaccgaugcugcugcccgaguggaacccuguaccgcgc

SEQ ID NO: 4239345 - RNA, 67 nt, Mycobacterium leprae
uggaguugcgcgguuugauaguucguggacgacacggugucuacgaggucgagcgcgccaacggaca

SEQ ID NO: 4239346 - RNA, 130 nt, Mycobacterium leprae
ggccaguacggcucgccuggccaguacggcccgccuggccaguacggcccgccuggccaguacggcccgccuggccaguacggcccgccuggccaguacggcccgccuggccaguacggcccgccuggcc

SEQ ID NO: 4239347 - RNA, 62 nt, Mycobacterium leprae
gguacuuuggcugggaauguggucgcuggaaagccagcgaucacaccuucgugccgaugacc

SEQ ID NO: 4239348 - RNA, 61 nt, Mycobacterium leprae
ggaggaucuuaugucagcagcugacucgaucuauccgcuguuugacgccaaagaucacuuc

SEQ ID NO: 4239349 - RNA, 121 nt, Mycobacterium leprae
gcguuccucgaugauccggguguacggcuggucggguucgaggcagcuggcgauggcgucgagacuggcaggcaugcagcgacauugaccggcggcuugcccggagcguuccagggaacgu

SEQ ID NO: 4239350 - RNA, 70 nt, Mycobacterium leprae
guugcccgcggucguaucagccgguuuuaccguugaucauuccgaggccggcuuguaccugugggccagc

SEQ ID NO: 4239351 - RNA, 63 nt, Mycobacterium leprae
uggccggaccgugcgagcuacgcggccuggguucugggauggcccguggcggccguccgguca

SEQ ID NO: 4239352 - RNA, 74 nt, Mycobacterium leprae
gcauccgucccguuuacccaguacggugacgguuccuuuggaguggccggucacggucugggugccggcgaugc

SEQ ID NO: 4239353 - RNA, 75 nt, Mycobacterium leprae
gcaugagucagcgacaacccgguagcaagcuugccuacggcgaccgcggcgccgacggugucguuguugccaugc

SEQ ID NO: 4239354 - RNA, 60 nt, Mycobacterium leprae
ggcuugcgaucgucaacgguguaccuacacgacaagcugcccgacaucgaucugcaagcu

SEQ ID NO: 4239355 - RNA, 64 nt, Mycobacterium leprae
ucggcguggugagcaaucugguugagugccuccgacaucaaaccuuugcaccaccaccgaccga

SEQ ID NO: 4239356 - RNA, 56 nt, Mycobacterium leprae
gccgcggcugcgcgaguucgcgcuacacgaaggccuggaugacgcguggcugcggc

SEQ ID NO: 4239357 - RNA, 99 nt, Mycobacterium leprae
cacgucgucgaaaccacccaucgcggcaagacccucgaaggcgggcuucagcuuggccaggcccuccuuggaggugucgggccgcaugugcucgucgug

SEQ ID NO: 4239358 - RNA, 72 nt, Mycobacterium leprae
gucgaauacugugaucucacccaggcccacgaauucgacgaaggccaauugguggugaucaccgauuacgac

SEQ ID NO: 4239359 - RNA, 68 nt, Mycobacterium leprae
gucgcugcaccgugccuggcagcaugcgcuccaguccccaaugggaucugccgcacuaggugcucgac

SEQ ID NO: 4239360 - RNA, 108 nt, Mycobacterium leprae
accucugucggcgacgcauaucggcggccucugguggauacucaacuguuuaaugcauggaggguuauguaucaccggcggugagcacacgucgucguuaacggaggu

SEQ ID NO: 4239361 - RNA, 58 nt, Mycobacterium leprae
gcuugcuucagcgccgaccgcaucugcgccaccaugugcggugcuucguugaaggagc

SEQ ID NO: 4239362 - RNA, 97 nt, Mycobacterium leprae
gugaaccgccgguaaucaguccccgguggucugguugaucgauuguggugcccuugaucaccaaccagucaccgcccuuuaccuccaggcgauucau

SEQ ID NO: 4239363 - RNA, 79 nt, Mycobacterium leprae
cgcuacguacgcggccagguaucaggaaagcaucgcuggagcugugauuauucuugacuugcuugcgcguauauggacg

SEQ ID NO: 4239364 - RNA, 70 nt, Mycobacterium leprae
gguaaugauugcguaacaaccacuuccauaauccauaaccgguaagaaacuguuccacgcaguuauugcu

SEQ ID NO: 4239365 - RNA, 57 nt, Mycobacterium leprae
acggugggcaaaccgacgcucuacaccgccugaggcagagucgauuagcaccgcugu

SEQ ID NO: 4239366 - RNA, 56 nt, Mycobacterium leprae
gucggucgccgauuugauggcgcggcuaggggccgagucgaccgaugguggccggc

SEQ ID NO: 4239367 - RNA, 122 nt, Mycobacterium leprae
ucucgccucaaaauguugagguaacgcaaaaaaugcgucaacacaccggauauaugucaacauuguugacauauauccgguguguugacgcgccacuccguuaccuacccucucgggcggga

SEQ ID NO: 4239368 - RNA, 71 nt, Mycobacterium leprae
augcucgucgccguuaguacucgucgagguccucgacguaggccuugagaaauaaugucgggagugagcau

SEQ ID NO: 4239369 - RNA, 74 nt, Mycobacterium leprae
ucacgcugagacgucgguaauuggcaucggguuaacggccucuuaccuugguguugaugccgauucucgguuga

SEQ ID NO: 4239370 - RNA, 65 nt, Mycobacterium leprae
cucaagaccgaggucaucgggcggcgugauguugaucucgcccggugucaaucgcgguccgcggg

SEQ ID NO: 4239371 - RNA, 57 nt, Mycobacterium leprae
cgccagcugcgcgaggugccgggggucgaucuugaggcaccccacggcaagcuggcg

SEQ ID NO: 4239372 - RNA, 99 nt, Mycobacterium leprae
gcugcacaugguguccugggggugugcagauugugggcgauccguuguauuccaauaucguuuacgucucugcugacgauugcagugcaccguugcagu

SEQ ID NO: 4239373 - RNA, 89 nt, Mycobacterium leprae
uuugccgagcuuggcgccaucggcagcggucaccagcgggacugugagcgcaugcacuguggcgccgagcuuuugucgcaccaggcgaa

SEQ ID NO: 4239374 - RNA, 78 nt, Mycobacterium leprae
ccgagcacaacgccugcaauccggugacagccagcaucacuaugccgagccugacgaugauugcgguguugccuuugg

SEQ ID NO: 4239375 - RNA, 78 nt, Mycobacterium leprae
ggcugccccagugacuagugcgcgcaccggcucaccauacauaggaguagccgucgcaguauugaucgcgcugcagcu

SEQ ID NO: 4239376 - RNA, 115 nt, Mycobacterium leprae
gucucggcauagggcugcagcgcucggcaucggucugcuccccuuggcgaucgccuuuagugcgcucgguggagagguaucgaugcucgauguaccaugccuugccuuuacugac

SEQ ID NO: 4239377 - RNA, 77 nt, Mycobacterium leprae
augccucgguggaucagcauaugcuaggucuuggcgaacuugucggccaauuccuacgaugcuccaaccagcagcgu

SEQ ID NO: 4239378 - RNA, 55 nt, Mycobacterium leprae
caacgugcuugcgguggccaacgauuaccacgguugcaccagcgcgugcacguug

SEQ ID NO: 4239379 - RNA, 63 nt, Mycobacterium leprae
cggcuguaaacucacagcuuuagcugcucuaagugcucuaaggguuugaaguuuggguggcug

SEQ ID NO: 4239380 - RNA, 67 nt, Mycobacterium leprae
gaaugaucggccaguucggcuaugguaguuaugccgacauuaaguagcuugcugcgcuggcuuauuc

SEQ ID NO: 4239381 - RNA, 63 nt, Mycobacterium leprae
cggccaacagcuucgugggcggggucaccggcugccccauuguucacgaccaguguugugccg

SEQ ID NO: 4239382 - RNA, 60 nt, Mycobacterium leprae
gcgcacuaccagcaccgacggcagucggcucgccgacugccgucggugcuggugcauugu

SEQ ID NO: 4239383 - RNA, 90 nt, Mycobacterium leprae
gguggccgucggccaugugccacgugcgacggaucacgcaguuuagugugacgugucgcgcgugucgccugguuugucggaacggccacu

SEQ ID NO: 4239384 - RNA, 108 nt, Mycobacterium leprae
cgcgagcagaaucggcgaacgcccagucagccggguaaacuucgucgagagcuugauccugccgucgggaaguuggacuacgguuggggcguagcucaaccaagcgcg

SEQ ID NO: 4239385 - RNA, 59 nt, Mycobacterium leprae
guguauccuuuccaguacgcagugauguucccagcguugccgaccggaagggcaugcac

SEQ ID NO: 4239386 - RNA, 61 nt, Mycobacterium leprae
gcgcuuuacccgccuaagcgauuccucggcgccgcucgcaacaucgaggaaggugggucgc

SEQ ID NO: 4239387 - RNA, 80 nt, Mycobacterium leprae
gcugugucaacgucuuggcuagcugagucacugugaaccuauucgccaaguuagcucgguuaguuugucaguugcgcagc

SEQ ID NO: 4239388 - RNA, 56 nt, Mycobacterium leprae
gagcaugcgcgaaccggucggcaucgucgaagauggcgauggcaucgucgcggcuc

SEQ ID NO: 4239389 - RNA, 77 nt, Mycobacterium leprae
cgacgcgcucauguugucugaggaaacgucgguggggaaguacccauuggcagccgugaagacgaugucgcgcauug

SEQ ID NO: 4239390 - RNA, 89 nt, Mycobacterium leprae
gugccaucguaguugacgaauacgcuggacgcgccgauguugcugugcucgccgauaucggcgucgccgacguaggucaaaugcggcac

SEQ ID NO: 4239391 - RNA, 90 nt, Mycobacterium leprae
gcgacgccccaucggcggcggugguugaguuguuagagcgcaucagcaccagcguugagcggcuuggugcauugcugacugaugguucgc

SEQ ID NO: 4239392 - RNA, 63 nt, Mycobacterium leprae
cggcgagauuugucguugcgagugugauagcugcgaguugcgcugcgucgacggguguugccg

SEQ ID NO: 4239393 - RNA, 83 nt, Mycobacterium leprae
gcggucuggauucagcgguggucggcgagcagcaggugcugggucaggugcgucgcgcguaugccgccgcugaggcuaaucgc

SEQ ID NO: 4239394 - RNA, 57 nt, Mycobacterium leprae
guguaaccggauuuccuccgguucugugggcccaccaaaccaccgagauccggucau

SEQ ID NO: 4239395 - RNA, 103 nt, Mycobacterium leprae
acccgaugggccguuaguugucgcgagggcgcgugucuguacaacgacacgccgugugcuguacaacugcgagccuuugcgagcauugccuggauggccgggu

SEQ ID NO: 4239396 - RNA, 58 nt, Mycobacterium leprae
ucgaucucgucgaacgaguccgggucgagucguuccgggugcggcguucugagauuga

SEQ ID NO: 4239397 - RNA, 55 nt, Mycobacterium leprae
gccauacgccacgguggcgaucgguguugugugcuggucgcucucgguguguggu

SEQ ID NO: 4239398 - RNA, 73 nt, Mycobacterium leprae
ccagaucagcgacaccauagccgccaugacgaccgugaucgucauggcggcuauggugucggccuugguccgg

SEQ ID NO: 4239399 - RNA, 82 nt, Mycobacterium leprae
cgcggugcgggugacuggaucuaccgugaugucgcgcaucuuuuccgucgacagcacgaucccgucauccagugcaguagcg

SEQ ID NO: 4239400 - RNA, 56 nt, Mycobacterium leprae
ucgauuucgcugaaucuggcaauuaaugacggaauguuaggucuagcggacauuga

SEQ ID NO: 4239401 - RNA, 55 nt, Mycobacterium leprae
guugauccuggcugauccaauccggcagcugguccgguuccggaagccgaucgau

SEQ ID NO: 4239402 - RNA, 81 nt, Mycobacterium leprae
ccauggugauuuagggauugugggucucgaagucuuggauuauuuucaggaucgauucgccacaaucugagucggcauagg

SEQ ID NO: 4239403 - RNA, 62 nt, Mycobacterium leprae
gcggugacgaugaucuccuucuuacggccagugauggucaagaagccgucuucgucgauagc

SEQ ID NO: 4239404 - RNA, 86 nt, Mycobacterium leprae
ugcaucgcucaugugugaauuuaacauguugacaagcgaauccguaguucacguguuagaauuaccggagggcuaaaucagaugua

SEQ ID NO: 4239405 - RNA, 90 nt, Mycobacterium leprae
aacuguacacccacguggcggucucacggcugcguguggugcacgaccaggcucacccgcgggcgugaugcugucaaugguucagcgguu

SEQ ID NO: 4239406 - RNA, 81 nt, Mycobacterium leprae
gaccguucuuuuguucguggccgaccgccuccgcaguggccauugcggaggcgguuggccacgaacuugccuccaccgguu

SEQ ID NO: 4239407 - RNA, 61 nt, Mycobacterium leprae
cgcuguggcaucagcuacccgaagcccacggucgauuacuucgcggugacugaucgcggug

SEQ ID NO: 4239408 - RNA, 92 nt, Mycobacterium leprae
cgagugugucggcuacgugacagccauaggagacgacguugacucugucgagguuggucagcguguuaucgccuuuggccccggcacauucg

SEQ ID NO: 4239409 - RNA, 56 nt, Mycobacterium leprae
cuuccgcaaggggggccaugucgugguugcuguugacgugcuguucuggcgagagg

SEQ ID NO: 4239410 - RNA, 63 nt, Mycobacterium leprae
caaaugcuaugauaauuuggcugauaauaucgcuuaucaugcauccuccuaucguggcagcug

SEQ ID NO: 4239411 - RNA, 92 nt, Mycobacterium leprae
gcguugcuacugugucggagucguuaguccagucgaaaggaauuacaucccaaaggauuucggcuugaccauagcggccggcaaccugacgc

SEQ ID NO: 4239412 - RNA, 82 nt, Mycobacterium leprae
uuccugaugauuacgacgucggcggggcagccucuccaacccgaauccgacagcugacuucgcaagcgcguaucgagaggaa

SEQ ID NO: 4239413 - RNA, 73 nt, Mycobacterium leprae
gcgaugugucgguuggauauucggucgauugcuguauccguagaugauaccgauguccgagcucgacacaugc

SEQ ID NO: 4239414 - RNA, 69 nt, Mycobacterium leprae
gacccauacagcgcgugguauacuccgccggcaaacucuucuggcaucacaccgcguagcgaguggguc

SEQ ID NO: 4239415 - RNA, 58 nt, Mycobacterium leprae
guggugcugcuagucgacgauuggcacaugaucgucagcgcggccggcagugcaccgc

SEQ ID NO: 4239416 - RNA, 84 nt, Mycobacterium leprae
ggucaacucggagagcuggucggggucuaucuggaugccgguccguccgcgcagcaggccgccucgacuaucgucgacuugacc

SEQ ID NO: 4239417 - RNA, 59 nt, Mycobacterium leprae
gggucggcauaggcuaccggugagcucauauucgcguccaccgaaagugugcucgaccc

SEQ ID NO: 4239418 - RNA, 63 nt, Mycobacterium leprae
uggugacagugcgaggucugggcuacaaacuggagaguuagccugugcaccgcacugugacca

SEQ ID NO: 4239419 - RNA, 77 nt, Mycobacterium leprae
caccuaugaaaccaaccgaacaacucaccgccacagacacaaacacgacagcuugacaucgggugguuucaacggug

SEQ ID NO: 4239420 - RNA, 66 nt, Mycobacterium leprae
uacucugccaaguuguccaggcugcgggaccauucgaaucgcagauugcccacuuuggcacgagua

SEQ ID NO: 4239421 - RNA, 63 nt, Mycobacterium leprae
guucgucgucggccaggugaccguagaugggucagcccaacgcuuacccggccggcggugaac

SEQ ID NO: 4239422 - RNA, 57 nt, Mycobacterium leprae
ggacugcgcacccgucgaccgagaccccaacggcucggucgacgggugcgccagcuc

SEQ ID NO: 4239423 - RNA, 79 nt, Mycobacterium leprae
ggcugggguggcguaacuucgacaucgucuuagacucgaucugacggaugcguucgcggguuacgccguagaccuggcc

SEQ ID NO: 4239424 - RNA, 84 nt, Mycobacterium leprae
aucggcgaucacugaguggucaaucaccaagucaacccgcgccaguggguugacuuuuuccggguugccgccgagauccccgau

SEQ ID NO: 4239425 - RNA, 63 nt, Mycobacterium leprae
gaaggcacugucggcggcggccgccgucgacaaggcgguggccgcuggcggacaguugucguc

SEQ ID NO: 4239426 - RNA, 101 nt, Mycobacterium leprae
gugcugucagcgcguuggucggguaguuacggcgacgacgccggcaacaccgcgcuauugcuggcucaauugugugaugugccugacgagcggcgcagcgc

SEQ ID NO: 4239427 - RNA, 82 nt, Mycobacterium leprae
cugguagaauuuaugaugucuguaacauuucuguaacauugaaguaauggcguuacagaauuuuuuagucguuauuuacgag

SEQ ID NO: 4239428 - RNA, 62 nt, Mycobacterium leprae
agcugcauguaccggggucgacagacuugaaacaccgccaucggccucagacaucagcagcu

SEQ ID NO: 4239429 - RNA, 64 nt, Mycobacterium leprae
cgccggcugcggucaagucgacgagauauccguacgcggucgggucggcugugacuagccggcg

SEQ ID NO: 4239430 - RNA, 91 nt, Mycobacterium leprae
cucgacgccggaaucgguacuacaagcgacgcugccuuagcgauggaauuaggcugcgacgcugugcuauuggcuucugcggugacucgag

SEQ ID NO: 4239431 - RNA, 58 nt, Mycobacterium leprae
ggacgccgucugugaucuuuaguucgcggcgacggauccggggucgcugggggcguuc

SEQ ID NO: 4239432 - RNA, 106 nt, Mycobacterium leprae
accgacggcaccagcccgcgugcgcugucgcuguucaucgaugccgccaccaaacucauugccgauaagcggaugacggugcuggcggacuugcugguccaucggu

SEQ ID NO: 4239433 - RNA, 86 nt, Mycobacterium leprae
gggucggucgaggcaugggaaaguacccgacgauccagccguucgaauaccucgaggaaguuguguuuucccaucuggauagaccc

SEQ ID NO: 4239434 - RNA, 70 nt, Mycobacterium leprae
gguaauccuggugcucaggcucggccucccagaaguccucagcgaggcugaccucggucacuacuuugcc

SEQ ID NO: 4239435 - RNA, 55 nt, Mycobacterium leprae
gaucggcggcaggucgaaaucguacucaacacgauucuugauccgcaccgccauc

SEQ ID NO: 4239436 - RNA, 58 nt, Mycobacterium leprae
ggcagcauuuucgucgaucuccgaaucgaauucggcggauucggcgagaaugcugacc

SEQ ID NO: 4239437 - RNA, 58 nt, Mycobacterium leprae
cagcccggaugcuuaucaaaaaccacagaccugucguuugaugaugucgcauucgcug

SEQ ID NO: 4239438 - RNA, 64 nt, Mycobacterium leprae
caccaucgaugcgcccaggguaccggcauuguaguugacaaagcccucgugcaucacgguggug

SEQ ID NO: 4239439 - RNA, 68 nt, Mycobacterium leprae
gggugcgcgagcgccugcguagguuacacgcgacggugccacugaccgauccgggcgccgcgucgccc

SEQ ID NO: 4239440 - RNA, 61 nt, Mycobacterium leprae
gccgcggccuguugcgcuguaccgaggccacgagcaacacggucagccacauggccgcggc

SEQ ID NO: 4239441 - RNA, 80 nt, Mycobacterium leprae
ggcacgccgacuucccaagggcuaugaugugcaaaaacacuucgguccgcauuauaacccgugggagcaacggcuguguc

SEQ ID NO: 4239442 - RNA, 69 nt, Mycobacterium leprae
gcggagauucgcgcgaugaauguaccugagcccacacucgacgaucugccguugcgcgauaaucuucgc

SEQ ID NO: 4239443 - RNA, 56 nt, Mycobacterium leprae
agugugcgugugggggucggcaccgcgcgguaaacgcucggccucgacgcgcgccu

SEQ ID NO: 4239444 - RNA, 61 nt, Mycobacterium leprae
gcguaaaaugcgaugcgcugcugguugauacgaucagccgcagugacacguauccguacgu

SEQ ID NO: 4239445 - RNA, 77 nt, Mycobacterium leprae
guauggcguucgaucgcagcgaacacacccaacucugacucauucuguugucgugguucgucgugauuacguuguac

SEQ ID NO: 4239446 - RNA, 56 nt, Mycobacterium leprae
gaguuggccugguuauggauuagcucgauaagcucuuuauccagcucagccagcuc

SEQ ID NO: 4239447 - RNA, 80 nt, Mycobacterium leprae
agcugggcugucaaggaugccaucgaguguggcgaacuugccagcuacaucgaugcguaucccuugaccgagaccuugcu

SEQ ID NO: 4239448 - RNA, 76 nt, Mycobacterium leprae
gacgacccuggcagcgcugaucucgcaggcgaccgggcaccgguucgaggcacugucggcguugucggcggguguc

SEQ ID NO: 4239449 - RNA, 61 nt, Mycobacterium leprae
gugucuggcgauacuguucuugugaucgaaacgauugaaguaacaguuuugccuucuaaac

SEQ ID NO: 4239450 - RNA, 79 nt, Mycobacterium leprae
gcgccgauugugauuggguccaccggggagcgggcuucauauccgguucucuucaucgacccagucgucguacuggugc

SEQ ID NO: 4239451 - RNA, 80 nt, Mycobacterium leprae
ugguuuaccagcacggucggugucauccagucaaguuguucgagacgggaccgggugacaucgagccugucacgacacca

SEQ ID NO: 4239452 - RNA, 65 nt, Mycobacterium leprae
caucgaaaucgacgccaacauguagggggcucucgcacuuuuccaugcugccguggauuucgaug

SEQ ID NO: 4239453 - RNA, 102 nt, Mycobacterium leprae
gagcaccagcucgcgcuuauuggcggacuggucgaugcugaugguuggaccgagagcaguggugccaccaugucgaucgcguuugccagccgggagcugcuc

SEQ ID NO: 4239454 - RNA, 94 nt, Mycobacterium leprae
gcuggcacgucgugaacgcugacccguuggagacugacgcugcucuuccugagcaguuucggauucgccgggacaagcgugcucguuuguuggc

SEQ ID NO: 4239455 - RNA, 100 nt, Mycobacterium leprae
acgagguaccaccaacccuguagaaggugcugcacuuuucgaugucccauaucucccuuccgggagcggaaacugacgcaccuuggcacagguaccucgu

SEQ ID NO: 4239456 - RNA, 129 nt, Mycobacterium leprae
gccgcacuaguggccccgacgcagguuggcaucuaaaguugccggccagaagcgaugcccguaucgagauccgcgcacgccuuuggucgcauacggcuauacggugccaaccgaguuacuggauguggu

SEQ ID NO: 4239457 - RNA, 55 nt, Mycobacterium leprae
ggcggcggugaugccggguuugacaacgauguugaacuccacaucuagcguuguc

SEQ ID NO: 4239458 - RNA, 65 nt, Mycobacterium leprae
accggcagugucguuggugcuuaacggaucguggcuggcguugaccgcgccggcgacgugcuggu

SEQ ID NO: 4239459 - RNA, 57 nt, Mycobacterium leprae
gccgcaguggucgacagugguuuccgugccuuggaaacggugucgaacgacugcggu

SEQ ID NO: 4239460 - RNA, 63 nt, Mycobacterium leprae
gauauggccuggaugcggcagcuucucgacuggcaacgagaggccgccgaaccaggugaguuc

SEQ ID NO: 4239461 - RNA, 66 nt, Mycobacterium leprae
ucuugguaguggcguuguucgaugaucgcgaaagacacgucuucggccgacauacgcuaccgcaga

SEQ ID NO: 4239462 - RNA, 57 nt, Mycobacterium leprae
gugguugguugacuggcuguugcaucuuaguugggcauccaucacuucgccgaccac

SEQ ID NO: 4239463 - RNA, 66 nt, Mycobacterium leprae
cugagcaaugauuucagucaccgccuagaaucgcacuucgcgccuggcagaugaaaucauagucag

SEQ ID NO: 4239464 - RNA, 63 nt, Mycobacterium leprae
guguucggcucaguacgccguaccgaucagcaacgagauaugcggaacaauagaguuggacac

SEQ ID NO: 4239465 - RNA, 55 nt, Mycobacterium leprae
acagcggaugcaagcugaugugcucacggccaagcgccaccaguagcaccgcugu

SEQ ID NO: 4239466 - RNA, 56 nt, Mycobacterium leprae
cguccgugaugagagcgauccgacgcucgccgagaucgcuuucaccgucgccgaug

SEQ ID NO: 4239467 - RNA, 98 nt, Mycobacterium leprae
gaugauucccuauuucuccggcggcgugggugaggaccacaaugcuaucaggggcggcgguuccuucuuccugcugucggugauuugcucgaguuauc

SEQ ID NO: 4239468 - RNA, 74 nt, Mycobacterium leprae
ggcuuuuugguaccguccccgggcgcagcgccgauuaaguuccgcagcaccuacgucgacgguaucuacgagcc

SEQ ID NO: 4239469 - RNA, 63 nt, Mycobacterium leprae
gccugcugaguacaacgcagucgucccgcguagcggacgacugcguuguacucagcacauggc

SEQ ID NO: 4239470 - RNA, 78 nt, Mycobacterium leprae
cuggucagagcacauucugcggacuauaacaaacacguaucagcgucuuaauauguccugggacuugcuucuguccag

SEQ ID NO: 4239471 - RNA, 105 nt, Mycobacterium leprae
gcuaccugguuacgcggugucucuaucguacaugugccgaccacguuguuagguauggucgacgcagcgguugggggcaagacugguaucaacaccgaggcuggc

SEQ ID NO: 4239472 - RNA, 60 nt, Mycobacterium leprae
ugauaucuauacgcgaccagguagaggcagauaucgcugcacuggccgccaugggaauua

SEQ ID NO: 4239473 - RNA, 98 nt, Mycobacterium leprae
aggauuuggaucauccugaccggguugaaaagcaucgcucacucgccgcaauagcacacagugauguuaucgacgcucuggucaaggaguuucguccu

SEQ ID NO: 4239474 - RNA, 59 nt, Mycobacterium leprae
guccccgugacuuuagauuaucuacgguaccacuguggauaucaaugauguuauuugac

SEQ ID NO: 4239475 - RNA, 80 nt, Mycobacterium leprae
ggcggaaccucuuggucgggugcuccuggucagccucgaugucgcgcacgucguugaucaaguacaccgacgaggccgcc

SEQ ID NO: 4239476 - RNA, 92 nt, Mycobacterium leprae
ccgagaugcgacauuagcgggugggugucaacuuuagucguaaugacgcgcaagacgaguucgacggucaccuuguuaucggagugggucgg

SEQ ID NO: 4239477 - RNA, 92 nt, Mycobacterium leprae
gugucaugcaccgcgaacgucgguugaucauggguggucggcugcgaaucuucgaaacaaccgcccugaucgauggcgaugucgaccaacac

SEQ ID NO: 4239478 - RNA, 61 nt, Mycobacterium leprae
gugugcgauguggacgcaagaguagcgcugaucgcuacucuugcguccacaucgcguucau

SEQ ID NO: 4239479 - RNA, 67 nt, Mycobacterium leprae
gauguaugcgcgcuuucgguacugaucgguucguucucugaucaguaccgaaagcgcgcaguacguc

SEQ ID NO: 4239480 - RNA, 58 nt, Mycobacterium leprae
cacgguuugauguggccguuaauugaggguugagacaucuucggcuacguggaucgug

SEQ ID NO: 4239481 - RNA, 82 nt, Mycobacterium leprae
guggcccaaggcuuucugucuguucguugccaauccauucaaccagugcaucaaugucagaauaggaugccauguuggccgc

SEQ ID NO: 4239482 - RNA, 78 nt, Mycobacterium leprae
ccacaaugcgaaugggugcgauugccauggucggcuagcuuaagcccgccgaccauggcaaucgcauagcggcggugg

SEQ ID NO: 4239483 - RNA, 83 nt, Mycobacterium leprae
acguuguccaaagcgucgccgacacugcugauggauccggcgauaccggccucgugcagcgccucggugaacgcgaucgacgu

SEQ ID NO: 4239484 - RNA, 73 nt, Mycobacterium leprae
gacguucuucgcgcagguaacccucgaccgccugcuuggugcucggaugggccugcagcgacagcgguucguc

SEQ ID NO: 4239485 - RNA, 96 nt, Mycobacterium leprae
cgcaccagggugaguuuggucggaaagucuuugcggucaggcgggaaucccgccugaccgcaaagacuuuccgagauccucuaaaccagcugugug

SEQ ID NO: 4239486 - RNA, 74 nt, Mycobacterium leprae
gcgccugacguucgagaacuucguguguuuguccuacggcagcgcgcugggguuuucgcugaaggauauggcgc

SEQ ID NO: 4239487 - RNA, 80 nt, Mycobacterium leprae
ccgguauuacguuguuggacuuguaauuuggccugugcaguuaacucgcugagcgcacuagaagacaagucggguaccgg

SEQ ID NO: 4239488 - RNA, 111 nt, Mycobacterium leprae
gguaaauacgagucacucggcgguccggucaacagcgaucugggauucccaaucaucgacgaaguucccggucuagcuggacccgacagccgaguuaguauauucgcugcc

SEQ ID NO: 4239489 - RNA, 55 nt, Mycobacterium leprae
guguugccauaucgucuaauccgcgcacggugugggcgaugguuaauguuagcgc

SEQ ID NO: 4239490 - RNA, 58 nt, Mycobacterium leprae
gguugguaacagaaucguugcccauucgcccugugcgggcaggacccuguugcucgcc

SEQ ID NO: 4239491 - RNA, 63 nt, Mycobacterium leprae
gguaaugguguucguggcugcgcaucacgagaucgaccuggugcucgucgaacaaccucaacc

SEQ ID NO: 4239492 - RNA, 64 nt, Mycobacterium leprae
uaucugcgguucuguguagccgauaguuguugguguagcuagcggcaaguguaggauugggaug

SEQ ID NO: 4239493 - RNA, 64 nt, Mycobacterium leprae
ugggacgucccgucacgagcaagagcuaccgauauugagcccccaucgggcggcgacgauucca

SEQ ID NO: 4239494 - RNA, 68 nt, Mycobacterium leprae
ugucggucgugcuauccggaaugguuucuuacacgcagcucaagaccguacccggccaugguccggca

SEQ ID NO: 4239495 - RNA, 61 nt, Mycobacterium leprae
agcgccgcgcaauguuucugcggaagccaccacgcauccgugcucgauauugcagcgugcu

SEQ ID NO: 4239496 - RNA, 79 nt, Mycobacterium leprae
gugaaauccuaaauucugcaguucauuccgcagauuguucaccacgaucugggauguugugcugcaaggguuaguguac

SEQ ID NO: 4239497 - RNA, 92 nt, Mycobacterium leprae
ugaccucgauggugcggaaucuggcauaguugguugcaugaugcaccucgcauuaguagccaaacacugugcaucccgaaaucuaucgguua

SEQ ID NO: 4239498 - RNA, 62 nt, Mycobacterium leprae
ccgggcuagcgaucgacguaacaggaaguaaugguauacuauuacgucgacgccagacccgg

SEQ ID NO: 4239499 - RNA, 64 nt, Mycobacterium leprae
ccagcuacgacaggcccgcgaacguuuuggcggcgauaaguucguggcuaccugaucguaaugg

SEQ ID NO: 4239500 - RNA, 70 nt, Mycobacterium leprae
guucggacuuuugaagcugcuggcugaggcgaauguguuucuuccggccaggucgcuuuaguauuugaac

SEQ ID NO: 4239501 - RNA, 85 nt, Mycobacterium leprae
gggagcagcaacuugccgaggucggagugguuaggcugcacgcggaacuggcccgucgugaccuggcagcagcugcggcaauccu

SEQ ID NO: 4239502 - RNA, 73 nt, Mycobacterium leprae
uugcauucccacucagcggucagcagcacuccgcgcccguggcgguagugggcgacaucugagugaucagcaa

SEQ ID NO: 4239503 - RNA, 96 nt, Mycobacterium leprae
cguugguccagucgcuggccaagcuuggugugucugcugacgacauugcagugaucuccaagcacgacacuucgacgcuggccaaugaucccaacg

SEQ ID NO: 4239504 - RNA, 65 nt, Mycobacterium leprae
gguuugcggcgggugguugaccgcgucggcaaugucuucgucggucgugacacgcgccgccagcc

SEQ ID NO: 4239505 - RNA, 62 nt, Mycobacterium leprae
ugcauacauugucuucgacaucagcagcauucgcugcugccgguauagaggcaaugucggca

SEQ ID NO: 4239506 - RNA, 78 nt, Mycobacterium leprae
gggucuggaagcgcugauccucucccgaaucgcuagcgauucgggagaggaucagcgcugcuucaaucaacgagaucc

SEQ ID NO: 4239507 - RNA, 93 nt, Mycobacterium leprae
uucuacggcguuacugggaacuguuuucuccagcuagcucccgguuuucucugcuggaguugcgagcgaaaucaguuugguagacgccgagaa

SEQ ID NO: 4239508 - RNA, 56 nt, Mycobacterium leprae
ucgaugaauucgguuuuucuaugucauuggcaugguggaaaagugugauuuauuga

SEQ ID NO: 4239509 - RNA, 56 nt, Mycobacterium leprae
gggcugaucgcgcuacaggaauucgagccggccggauucguagcgaaacucagccu

SEQ ID NO: 4239510 - RNA, 74 nt, Mycobacterium leprae
ccuaccgcacacucgccgacgcagugggacuagacccugcuggcuguaguccuuaccgcgacggugacgguagg

SEQ ID NO: 4239511 - RNA, 59 nt, Mycobacterium leprae
cgaugaagucgaucaccacagggcgguuguugaucgcccuggccugauugaucacaucg

SEQ ID NO: 4239512 - RNA, 61 nt, Mycobacterium leprae
cgucccgggcgggaucgacgacgauguggcgcacguccuguugcgguaccgcccggugaug

SEQ ID NO: 4239513 - RNA, 89 nt, Mycobacterium leprae
gcuguggguggccuauauacuacuaccuaauauagugcuuaaaugaaguugcugucgucuugggugguggccuuauuguuaccuucagc

SEQ ID NO: 4239514 - RNA, 74 nt, Mycobacterium leprae
uuuugccgaugauuacaucauccgcccaaugcuaugagguuagagcaccacacggucguguaguuuucgcggga

SEQ ID NO: 4239515 - RNA, 81 nt, Mycobacterium leprae
gguggcuuacugguaucgcuguagcgcuucuccuggccggcugcggcauagggaccggcggcuacugcaugcuacguuacc

SEQ ID NO: 4239516 - RNA, 101 nt, Mycobacterium leprae
uagcauggucgaagaucauagggguugguggccgguccggcaaagccgaaugcgauucggcuuugccggaccgguucauccuauuuggcccgccuaugcug

SEQ ID NO: 4239517 - RNA, 56 nt, Mycobacterium leprae
gccuguuugaucuccuggcgguugaaaaaucccucgccgccgcggaccugauaggc

SEQ ID NO: 4239518 - RNA, 62 nt, Mycobacterium leprae
cggcgacucacuggcgugagcggcuacacugguaacuagcugccacgaacccguggucgucg

SEQ ID NO: 4239519 - RNA, 63 nt, Mycobacterium leprae
uggcgcugggugguagcgaugucggcaaugcguggcuggcaucgacuagauacucgggugcca

SEQ ID NO: 4239520 - RNA, 60 nt, Mycobacterium leprae
gucggcgccgaucucgcccgguggcguaaucaacgucagcgcuaacagaucggcaccgac

SEQ ID NO: 4239521 - RNA, 68 nt, Mycobacterium leprae
gcuuguuaucggcaacgaccaucauugucauuggaaaaugauggucaaguuggccaaauaacaccagc

SEQ ID NO: 4239522 - RNA, 77 nt, Mycobacterium leprae
gauaacggcgucgcuguuugccgaguacacguugaugcaucaagcugugagugugcaggcagcgacgugccgugauc

SEQ ID NO: 4239523 - RNA, 65 nt, Mycobacterium leprae
accggccuggcggagauccagcugccagacuuacagccggguagcucgaucaugccaggcaaggu

SEQ ID NO: 4239524 - RNA, 88 nt, Mycobacterium leprae
cugguugcuggcugacaauuuuuugcucaugucucguuuugccacggcaucgaguauggguugaagcuugucggcuaaacgcauccag

SEQ ID NO: 4239525 - RNA, 78 nt, Mycobacterium leprae
gagcugagccuguccgacgccggccguaguugggggauuacugccuacgugcugacauucggcgggcugauguugcuc

SEQ ID NO: 4239526 - RNA, 88 nt, Mycobacterium leprae
ggccaucguccugaccgaauucggcuacugggccgaucgugccguaagcgaucuccagcgcgcugaaucucgggaugacgaaggggcc

SEQ ID NO: 4239527 - RNA, 57 nt, Mycobacterium leprae
agucgauucgauggauccgacggaacugaugacccugccggauucaucuguaucgcu

SEQ ID NO: 4239528 - RNA, 83 nt, Mycobacterium leprae
ugagggguucccgcggucgacacagcugcaaccacgcccgcaccaaacacguuguuguagucaaucaccguggcuacccucca

SEQ ID NO: 4239529 - RNA, 112 nt, Mycobacterium leprae
ugccgccacucaccgguucuuggcgcauuugcccgguuaccagggauggcagugggcgguugucgucgcugcuuauccuggugccgagcacgccacggugagugaaguggua

SEQ ID NO: 4239530 - RNA, 57 nt, Mycobacterium leprae
gauguccgacgcucaugaacaacgccagacuggcacuguucaugagcgucggacauu

SEQ ID NO: 4239531 - RNA, 59 nt, Mycobacterium leprae
gaucggcgaucgcugaccauguuguugccgagauucggcacguggguggucguccgguc

SEQ ID NO: 4239532 - RNA, 61 nt, Mycobacterium leprae
guacugcgcgcuuucgguacugaucagagaacgaaccgaucaguaccgaaagcgcgcauac

SEQ ID NO: 4239533 - RNA, 72 nt, Mycobacterium leprae
acaaguucgguuuugucgguaacccguggggagaauuggaagguguugccaacagaaccgacuucgacuugu

SEQ ID NO: 4239534 - RNA, 83 nt, Mycobacterium leprae
ugggguaaucgacgcuaucgucacgcuggacggacugcaacugacguugaaucgugcgcugacgaugaucgccgauguuccca

SEQ ID NO: 4239535 - RNA, 81 nt, Mycobacterium leprae
uggaccgguggcguucaucggggggaguaguagcagcgaaaaucccgguggcugcauacccggaugaacguuaccgaacca

SEQ ID NO: 4239536 - RNA, 93 nt, Mycobacterium leprae
gaaguaccacgcaggcgaauauaaaauucuaaauguuuccuaucaaguuauuuuacagaaaaaauuaguauuuaaugaucgcgugcuaacuuc

SEQ ID NO: 4239537 - RNA, 72 nt, Mycobacterium leprae
gcgaccccgauggcggcaugcacucgcuguggacugacauuuuggcgcggcagguguuugccccgcaggugc

SEQ ID NO: 4239538 - RNA, 77 nt, Mycobacterium leprae
agugcccgaagaguagccgguuacggugcgucuuccagaucaggagggcuuuccuagcugggcuacuucgggucacu

SEQ ID NO: 4239539 - RNA, 70 nt, Mycobacterium leprae
gaggggacgauggcuggcgauguucgccgacgacgacgucgucggcgaacaucgccagccagguuucuuu

SEQ ID NO: 4239540 - RNA, 59 nt, Mycobacterium leprae
gccaggguuuuguuguggcucgccgaggaauuccgcgguggcggcaaacaagcgcuggc

SEQ ID NO: 4239541 - RNA, 109 nt, Mycobacterium leprae
guuggccaugcucaacggcacguuguuugcgguuuugccgcugcgcgacugggggcguaucaagucgaccggugaaaccgccgcgacuuugcuggcuggcaugugaaac

SEQ ID NO: 4239542 - RNA, 88 nt, Mycobacterium leprae
uuccccuggcuggcuuaggcgugguguucggguuggcgcuguuucaggugcuauugguguuaucgaccaugcugccggucuggaggaa

SEQ ID NO: 4239543 - RNA, 80 nt, Mycobacterium leprae
gccagaacaucgcguggugaucccgagcaccgaucucguuuacgaggggauaugggcucagggcaccauccgagucaggu

SEQ ID NO: 4239544 - RNA, 55 nt, Mycobacterium leprae
gugcggccaucaaucagucuacgaccaauugucguagacugauugauggccgcac

SEQ ID NO: 4239545 - RNA, 62 nt, Mycobacterium leprae
ugccgccgucgaugaugaugucgcuggguuccauaacaucggcgaguucauugaugacggca

SEQ ID NO: 4239546 - RNA, 56 nt, Mycobacterium leprae
auggcuguucccaggugcagggcggcggcugcacgccagcguuugugaacagcugu

SEQ ID NO: 4239547 - RNA, 64 nt, Mycobacterium leprae
gccgagauagagcaguuggcggcaaccgaagccacauugcgccgccaaauugcagaucucgagc

SEQ ID NO: 4239548 - RNA, 74 nt, Mycobacterium leprae
ggcucacgguuucggcgucauccgccgaugccagcagagccucagcuagcaaggccauggcgccgaccgggguc

SEQ ID NO: 4239549 - RNA, 64 nt, Mycobacterium leprae
gcgaggucuuggaugcucuucagccccgaaucgccguggcuuucgaguuuauccaagaucgugc

SEQ ID NO: 4239550 - RNA, 64 nt, Mycobacterium leprae
gcagccggugguggaaucgguguucuccgguccucggagcuacgucgagauagucgccggcugc

SEQ ID NO: 4239551 - RNA, 92 nt, Mycobacterium leprae
gggaaucgggaucuuucgaacgauugucuucuugccacuggccauuuccucaguggugauggcggucguuuggcaguucaucuucaauaccc

SEQ ID NO: 4239552 - RNA, 107 nt, Mycobacterium leprae
cggcguguucgucgucguugguagcgauccauugggcgaugucgucguugcgcucaggugagugcgauuuggcuuuggccgguggggugacggugaugggguugccg

SEQ ID NO: 4239553 - RNA, 81 nt, Mycobacterium leprae
cagcggauugcagccagguaaucaugggcuuggcagccgcaaucggcgccaccgcugcuugcucugguucacacuucgcug

SEQ ID NO: 4239554 - RNA, 74 nt, Mycobacterium leprae
uaucgacggccgcgggaucaccgacauucgcgcguugucggccgaaguugcggugguuccgcgggcgcacggua

SEQ ID NO: 4239555 - RNA, 75 nt, Mycobacterium leprae
ucacgcacugaugcgaugguagcggggcugguccggccgggaggaucaccauggucaccaucgccucuggcuuga

SEQ ID NO: 4239556 - RNA, 80 nt, Mycobacterium leprae
aucgaccaagguagaucauuacccugcuggucuuugcgugagucuaagccuaugagcaagauguuuauguuguuaucggu

SEQ ID NO: 4239557 - RNA, 76 nt, Mycobacterium leprae
cugguauuuguuucaggucuaaguuaacauauugcuaucgguuauguguaacuaucgacuugcugagcucuauuag

SEQ ID NO: 4239558 - RNA, 69 nt, Mycobacterium leprae
gaaugacggcuugacacgccgcgcuacgucgcgggaucacgauggucgcgcuugucuaagucuucauuc

SEQ ID NO: 4239559 - RNA, 95 nt, Mycobacterium leprae
cauccuuggucuuggcgcgggcuaucuagacaaucgguaucgggaauuugcaccgaccgcuguuaggacuagcagugugccagacgcuuugggug

SEQ ID NO: 4239560 - RNA, 55 nt, Mycobacterium leprae
gggagcauugaacaccuagagugugagguuucgacucggcgcaucaauagcuccc

SEQ ID NO: 4239561 - RNA, 62 nt, Mycobacterium leprae
ucucguuuucugugcacaccucauauacuagauggugcauggggauggugcauggggccaga

SEQ ID NO: 4239562 - RNA, 71 nt, Mycobacterium leprae
gaaaugggcacaugcucgacagccugucgagggcaaauccucggcuggccgucgguguaguaccugucuuc

SEQ ID NO: 4239563 - RNA, 56 nt, Mycobacterium leprae
auuuuuacccaacgagcgccaugcucaccuuugcaagugccucguuaggugagggu

SEQ ID NO: 4239564 - RNA, 59 nt, Mycobacterium leprae
cagcgugguguucugcggcuuugccacacacgcgcuacgagcccggaucaccgaugcug

SEQ ID NO: 4239565 - RNA, 59 nt, Mycobacterium leprae
gacgcggucaaggacugcgacuggacagcugcgagugcgaagucguccuugaucguguc

SEQ ID NO: 4239566 - RNA, 86 nt, Mycobacterium leprae
gguggaguacugcaacaagcugcgggugcacgaacgucaccccuacgggggagaccucguguacaccgcguucucuggcagccacc

SEQ ID NO: 4239567 - RNA, 58 nt, Mycobacterium leprae
accucgcgguggaagaucgcucucugggcaacguugccggcgguguccacggcgaggu

SEQ ID NO: 4239568 - RNA, 56 nt, Mycobacterium leprae
gggcgaugcuagucggcuacggcagguacccugaucggccgauuucgguaucgucc

SEQ ID NO: 4239569 - RNA, 61 nt, Mycobacterium leprae
aaacaacgucguaguggccgccgaauuucgucaucaccggccgccaguacuccaguuguuu

SEQ ID NO: 4239570 - RNA, 62 nt, Mycobacterium leprae
gaguuggccaagcaccgugccgccgccgcgccuagggccagcacgagcucaggggucaacuc

SEQ ID NO: 4239571 - RNA, 104 nt, Mycobacterium leprae
ggauggcccugaaggcucgaauccuggaauuaacugacuaugccgcuugaguggucaucgaccgucgguauuccgauuuguugccgagugcaagguggcuaucc

SEQ ID NO: 4239572 - RNA, 55 nt, Mycobacterium leprae
cgucgccauggcgaaugacccggcaccgcggcuggcgucguuggccucggcgacg

SEQ ID NO: 4239573 - RNA, 92 nt, Mycobacterium leprae
cagcgggaucggauccuggugauugcacgggauggugugguccgaacccuugaaguccaaacaucccguccaguacaccagcacgcccguug

SEQ ID NO: 4239574 - RNA, 63 nt, Mycobacterium leprae
gagugguucgaguucgucggcgacaaguugcccucuggcaugcaggaugaauucgaagcacuc

SEQ ID NO: 4239575 - RNA, 63 nt, Mycobacterium leprae
gucgaggucggagucguaguccgcacacuccaacuguaugccgggugccgcugcgaccccggc

SEQ ID NO: 4239576 - RNA, 73 nt, Mycobacterium leprae
auccggcagugcugcugaucgucggugucaacggcaccggcaagaccaccacggucggcaaguuggcgcgggu

SEQ ID NO: 4239577 - RNA, 88 nt, Mycobacterium leprae
ggauugccauuucugcucacagucuggguuguucaugucgccggugcgcagugccuggcuggauauccgcagccugguagaggcagcc

SEQ ID NO: 4239578 - RNA, 84 nt, Mycobacterium leprae
ucuucccaccgguugcaucaguggugcaucaguggaaaggaaaacuuccuuugcacgugcauuauucgucaccggguuaggaga

SEQ ID NO: 4239579 - RNA, 73 nt, Mycobacterium leprae
cagcgcacagucgcuggcgugcuggaugaagcuuucacgacuguuuuccgcacaccggugcgacugcgcgcug

SEQ ID NO: 4239580 - RNA, 129 nt, Mycobacterium leprae
gcauguccagaaaaccguggggaagcugguugcgggaugcccgguacguaucuucgacagaaguugccguccugucgggcugugcgugaccggacgcaucguaguuagcggugaccaacuuuucugggc

SEQ ID NO: 4239581 - RNA, 60 nt, Mycobacterium leprae
gcgugccaagcgguccugcugcuggagacaccguaaccggaguagugcugcuggguaggc

SEQ ID NO: 4239582 - RNA, 68 nt, Mycobacterium leprae
gucgacaugacggugcgacuguuguugucccgggugggagauagcgcgucgucaccggcaugggugac

SEQ ID NO: 4239583 - RNA, 65 nt, Mycobacterium leprae
caucgaaauccacggcagcauggaaaagugcgagagcccccuacauguuggcgucgauuucgaug

SEQ ID NO: 4239584 - RNA, 98 nt, Mycobacterium leprae
uggcggcacuguuauucgucaugacguugugcuucgcaaccaccaacggcuggugguaugucucuagcuacggcguuccguucaacagugccaugcca

SEQ ID NO: 4239585 - RNA, 59 nt, Mycobacterium leprae
gugguuggguuacuggcuggcguugacuucggcugucgauccaguuacacgccgaccac

SEQ ID NO: 4239586 - RNA, 74 nt, Mycobacterium leprae
uccgaagaccugucuuagcaagucagcgguugugacgugcacacaacguuugccuuuaggacaggcuuucgugg

SEQ ID NO: 4239587 - RNA, 96 nt, Mycobacterium leprae
gccgguuuccgccaccacuguugaggaaggugaucgcagcagccgccgccacagccaagucacguuucucgcagaugguggugccgaaguccaggc

SEQ ID NO: 4239588 - RNA, 68 nt, Mycobacterium leprae
cugggaucguggugcgguguuuuuggcuccgggguaaucccacaaacccgucaucgcgcaucagccag

SEQ ID NO: 4239589 - RNA, 60 nt, Mycobacterium leprae
gaugauugugcucggugucgaugguauggggugaaugccgcggugcuagccacgaugauc

SEQ ID NO: 4239590 - RNA, 60 nt, Mycobacterium leprae
ggcuggcgggugcaccugacguggugauuacgacuaccauguccaaggcgcucggcagcc

SEQ ID NO: 4239591 - RNA, 56 nt, Mycobacterium leprae
gcguguugagcaguuugagacgccacaauaguggcgucucaaacugcucaacacgu

SEQ ID NO: 4239592 - RNA, 62 nt, Mycobacterium leprae
gcaucuggcggcauacgaucugccucgccacaccaggcggcagaucgcccugucccaaaugc

SEQ ID NO: 4239593 - RNA, 114 nt, Mycobacterium leprae
gauuggguugaggggcccggugcugaaguggcguuggcugauguggcccauacauugaaucaucaccggucgcggcacgccaaguucggcaccgugguugcccgugaucggauc

SEQ ID NO: 4239594 - RNA, 64 nt, Mycobacterium leprae
ggacugauccgguuuggcucccggcuggacacuuaucugccaccagguaccgagccggucgucc

SEQ ID NO: 4239595 - RNA, 108 nt, Mycobacterium leprae
gaggugaggugguugcgcucgcguuacauugugaucgguugcccgucguagacgggcaccgaucacaauguuggugugcauuauccucagcagcuacuacuaaaccuu

SEQ ID NO: 4239596 - RNA, 68 nt, Mycobacterium leprae
ggggacugcaucccaccauaaggugcaagcuagaugcuugcaccuuauggugggaucuuaggucacuc

SEQ ID NO: 4239597 - RNA, 85 nt, Mycobacterium leprae
caauugauuucguaucccccucgaagggcauuaagaucugcgaaacagaucuuaaugcccuucgagggggauagucuauauauug

SEQ ID NO: 4239598 - RNA, 110 nt, Mycobacterium leprae
guggcugggcugguuagacgucgccgagcgccuugcugagggucgguucgccaaaaguacgugcgggccccgccaguugcuuggcuacaaacagcccaaucuaauguugc

SEQ ID NO: 4239599 - RNA, 59 nt, Mycobacterium leprae
cgcagauggauaagccucgcagcgagggcauucuguucgccagggcuuauaccaucgcg

SEQ ID NO: 4239600 - RNA, 66 nt, Mycobacterium leprae
cugguugaagagcgagugcaugaugacccgccguugauucauguggugguguacgcgcucaaccag

SEQ ID NO: 4239601 - RNA, 65 nt, Mycobacterium leprae
gucgcgggaaucgccuuguucuucaggcacaaaaucguuuugaucagacccgcgauuccggcggc

SEQ ID NO: 4239602 - RNA, 65 nt, Mycobacterium leprae
gcaugguaugugguguugagacauucccagguuucacuggaugucacuucccgugccgauuuugc

SEQ ID NO: 4239603 - RNA, 61 nt, Mycobacterium leprae
gcggcaacucgcgcagugacguugaggccgaaggaggaaccgucgcugaucgcgagucugc

SEQ ID NO: 4239604 - RNA, 59 nt, Mycobacterium leprae
cucugugguugucggaccagcguguucgaugucgagcuugcccaagacaaaccgcguag

SEQ ID NO: 4239605 - RNA, 71 nt, Mycobacterium leprae
gcaucauugguuaugccaccgagucguuggcgaucacgaucgccaacgacucgguguaugagcuaauccgc

SEQ ID NO: 4239606 - RNA, 77 nt, Mycobacterium leprae
cgaucugacacuggugaccuuguauuucgacgggaguuaguccgaauucaccuuguucgcaacguuauuugagaucg

SEQ ID NO: 4239607 - RNA, 57 nt, Mycobacterium leprae
ccggcaguuggcugcgcaggggcagacgcacguuuaccgcugcacaccugcugcugg

SEQ ID NO: 4239608 - RNA, 56 nt, Mycobacterium leprae
ugguggcaggcgccgcucagcugggucaucucaguaugaagugucuccugccauua

SEQ ID NO: 4239609 - RNA, 67 nt, Mycobacterium leprae
gugguuggagugucgaaauuaucgaucucuugugacugaccucgguggauuucgauacuaucgccgc

SEQ ID NO: 4239610 - RNA, 97 nt, Mycobacterium leprae
gaccgaaacggugagguucucugcccugucgguugacaugcccugucggcugacaguugcaugagaaggaccgcaaugauccuuggcaguuuccguc

SEQ ID NO: 4239611 - RNA, 83 nt, Mycobacterium leprae
ggccgagugugucagcggcccgaugucgcuggagaacacgguugcggucucgagcacuugcggguugaagaaucgccgcggcu

SEQ ID NO: 4239612 - RNA, 87 nt, Mycobacterium leprae
ugucgucuucaaucggcuaaugaacugcucgccgucacccuagaucaaugacagguagccgaagucauggaccgguugagcauguca

SEQ ID NO: 4239613 - RNA, 125 nt, Mycobacterium leprae
uacgcuguugguggcaccguuguucccgaugauuguuugucacgauuccugcuagcauuuucgcgaugcuaccgguaucacagugacgaucgggcaguuggucagcgucgcuggacggcagugua

SEQ ID NO: 4239614 - RNA, 95 nt, Mycobacterium leprae
guguugcgugaccgcuugaucgagggugugcuggcgacgauugacgacguugcacucaacggugcccgcgaucggaugcggcuuccagguaacgc

SEQ ID NO: 4239615 - RNA, 68 nt, Mycobacterium leprae
ucgggcaucaccucggcgcgccacucgucgaugccuaacucgguggcgacggcuuuggcgaugucugg

SEQ ID NO: 4239616 - RNA, 84 nt, Mycobacterium leprae
gcgcgguccgguuggcccguggauucaccggacggaccaagaucauaaaguucucuggcugcuaucacggccauguggacgcgc

SEQ ID NO: 4239617 - RNA, 67 nt, Mycobacterium leprae
gguaccgauagucgccgguuucuauacgauggugcuauuuuaucuacagaccggugauuacggcacc

SEQ ID NO: 4239618 - RNA, 100 nt, Mycobacterium leprae
ggccaggcguaggauuuggaaguguaucgggcuggccgguguugucgcuagcaacgcgcugguccugcucgaucaacggaaacuacgugccuacacggcc

SEQ ID NO: 4239619 - RNA, 60 nt, Mycobacterium leprae
aggucaugugaugucaaagagaguugguguggaagccaacugggcagaucauaucgauuu

SEQ ID NO: 4239620 - RNA, 79 nt, Mycobacterium leprae
gucgguaauguugccauuggucgugaucacggugcugcggugcagcaccgaaagaauggccgcuggccacaaugcugac

SEQ ID NO: 4239621 - RNA, 56 nt, Mycobacterium leprae
gaucaucgguuucuuaccggagucgaucauuuccuccaauaagagauggauagauc

SEQ ID NO: 4239622 - RNA, 55 nt, Mycobacterium leprae
agcguguaggagagucugggagcggcaacaacgccaucucccacuucugcuugcu

SEQ ID NO: 4239623 - RNA, 56 nt, Mycobacterium leprae
uggcuucgacgaauugacuaccgaggcaagaauucucggcaucuuugucgaaggca

SEQ ID NO: 4239624 - RNA, 97 nt, Mycobacterium leprae
gcgcccgguacaguaccgauuacauagcgauucacuauguugagugacagugguccugggcacaguggaugucgcguauucgucgugcagcgggcgc

SEQ ID NO: 4239625 - RNA, 56 nt, Mycobacterium leprae
gccugccaacacgcugcggcagccgguggacccgaugcggcggccauguggcaggc

SEQ ID NO: 4239626 - RNA, 68 nt, Mycobacterium leprae
gauaaauggcugacugacgcgguugaagacuaagguguccaccaaggccgugucgguaggcuguuguc

SEQ ID NO: 4239627 - RNA, 75 nt, Mycobacterium leprae
gcuuugcaugaacgcaucaaggucaucgaacgacggcuguugguugacgugguggccgugaucgcgacagguggc

SEQ ID NO: 4239628 - RNA, 76 nt, Mycobacterium leprae
gcgccgacccgccacagcgacgaugcccgccucuuguucgugguacuuggcguugagcacguugugcgggaugugc

SEQ ID NO: 4239629 - RNA, 69 nt, Mycobacterium leprae
uggguugcuucggcaugcaugaauauacagaccggaguauggcgguuugcacaugucgcaaguagccua

SEQ ID NO: 4239630 - RNA, 68 nt, Mycobacterium leprae
ggugcaucauuccggugucgacaccccaauaaucaacaauugaguccaccaggcaauggcuugccacc

SEQ ID NO: 4239631 - RNA, 77 nt, Mycobacterium leprae
uacagauguccugcgguaucugguccaacgaucgcuccauuuuucgacguugaccaccuggcgcacaauuuccugua

SEQ ID NO: 4239632 - RNA, 83 nt, Mycobacterium leprae
ggaugugcggcguugguggcguagugacucgcuguggcaggcgcaugaugcucgcuaugacgccgaccaggugugcaucaucc

SEQ ID NO: 4239633 - RNA, 107 nt, Mycobacterium leprae
uucguuugcccgcgacauuguaacuacuucugccguuuugcauaccggguggcagagagccagcccagguguugcuagcgcagguuugcgcagugguggguuaugaa

SEQ ID NO: 4239634 - RNA, 63 nt, Mycobacterium leprae
gauuacgacaucggugucgguuucggcgaaagcuaccacgauggcugcaucgaggucgcgguc

SEQ ID NO: 4239635 - RNA, 96 nt, Mycobacterium leprae
uagcgucguucaacggagcuauuacccagacguccgcuaaugaccagacgcauuuugucaagcaggcggucgggguauuugcuaccaaugacgcug

SEQ ID NO: 4239636 - RNA, 56 nt, Mycobacterium leprae
gcgagauggaaacugggucaggucugccuaucggaguugucccuuuccaugcucgu

SEQ ID NO: 4239637 - RNA, 116 nt, Mycobacterium leprae
cugguugccgcgcuaguaucgcguuuagcgcucaggguuaagggcgaggcugcaugugaugaaauccgauuucgaccuuuuccugcugcgcuucgccggauuagugcugcagccag

SEQ ID NO: 4239638 - RNA, 71 nt, Mycobacterium leprae
cccgcaccugcgcacuggcguccagcugggacuggccccgcacccaggcggcgaucagugcacacaccggg

SEQ ID NO: 4239639 - RNA, 60 nt, Mycobacterium leprae
aaugcuguguuucaaccguauuggguaagggcguccggaugcaaugcugagacauaaguu

SEQ ID NO: 4239640 - RNA, 57 nt, Mycobacterium leprae
acgaugcgguaccacucgaucgcuccgcgagcugagcauugacgguguugacaucgu

SEQ ID NO: 4239641 - RNA, 81 nt, Mycobacterium leprae
gccgaggauuuuguugcggugggcuuacaggagcaguuuuugagcgucgguaccugugcuggccgacugcacucucucggu

SEQ ID NO: 4239642 - RNA, 56 nt, Mycobacterium leprae
gucgcggucuugaacggucucaguccccacauagaggcuaucguuucggcugcgau

SEQ ID NO: 4239643 - RNA, 68 nt, Mycobacterium leprae
guggcuucgcagcggacgacggguucuauaacguuaugagcuuagggucugucgaugcguggaggcgc

SEQ ID NO: 4239644 - RNA, 100 nt, Mycobacterium leprae
cagcuggugacauugaccuuccgacauuuuucggacgaugguguaccguaccuaucggaucaucggucgcgagguguucgcgguggugaauaaacagcug

SEQ ID NO: 4239645 - RNA, 80 nt, Mycobacterium leprae
ugucgaugcuuauaucaggguguucgacuccuucguggagcgauucgcacuggggggagcgcucguggugugcaacgacg

SEQ ID NO: 4239646 - RNA, 83 nt, Mycobacterium leprae
ucugggcggauaugccgacauugccucuauaccggcagcagcgaaugcugcugaugucgaagacaauguaugcaguuaccagg

SEQ ID NO: 4239647 - RNA, 58 nt, Mycobacterium leprae
uggucuggcgggugguguacucgcgauggcauugcuggugccccagucgccagagccg

SEQ ID NO: 4239648 - RNA, 58 nt, Mycobacterium leprae
cgcaguggucgucaaaaauauguccgcgucgcuggacgugccgacggcgaccagugug

SEQ ID NO: 4239649 - RNA, 55 nt, Mycobacterium leprae
cugcuuggucaucaccguguucgaaggcaucaaggaacgcgucgagagccagcag

SEQ ID NO: 4239650 - RNA, 65 nt, Mycobacterium leprae
ggggaugcaucggcgaucguggcguugcauaccgaugugaugcugccauuagcugaugcagggcc

SEQ ID NO: 4239651 - RNA, 60 nt, Mycobacterium leprae
cgagcauugcaugcucgcguugggggaugcuaucuccggcggggcaaugcaaggccuucg

SEQ ID NO: 4239652 - RNA, 83 nt, Mycobacterium leprae
ggugcugcauguugggaugcccgaugcuguuuggaccguuccggucuagagagaccauggggcauccgcugaccuguugugcu

SEQ ID NO: 4239653 - RNA, 103 nt, Mycobacterium leprae
gccgauaagcguugucaacguauggggggaugauggcugcucgaccugagacauccgaggcuucaucaugaccaucagcguguucgaucuguuuacgaucggc

SEQ ID NO: 4239654 - RNA, 71 nt, Mycobacterium leprae
gcucucaguuugcgguaugcguugcgccaucagcagcgguggcgcaacggccuuaccgucgguuugagcgc

SEQ ID NO: 4239655 - RNA, 70 nt, Mycobacterium leprae
gucggcggucugcucauggaugguguaggucucuaacgcauccggaugagacagagccgcuguaacccac

SEQ ID NO: 4239656 - RNA, 85 nt, Mycobacterium leprae
gcggcaaaguauaacacuugggaccggacuugcugcuaaugaacagggcagcagugccggccgaaguguuacguuuaagcaccgc

SEQ ID NO: 4239657 - RNA, 60 nt, Mycobacterium leprae
cgauggugcgucggugaucacccacagccagcaacgcuccgaucagcgaccgcaccaucg

SEQ ID NO: 4239658 - RNA, 84 nt, Mycobacterium leprae
gacugggaacucgacacucucgaugccggacugcgucagaagaucgaugcuauuugcgcccuugagaugcggggagugacaguc

SEQ ID NO: 4239659 - RNA, 64 nt, Mycobacterium leprae
cagauaacagucacgacaucaccucagcagguauuuuccaccuaauguugugauuuguugucug

SEQ ID NO: 4239660 - RNA, 75 nt, Mycobacterium leprae
ucaacacgcgaccggugaacucgucgacgaucaacacuucgccgucgcguacgauguaguccuugucgcgguuga

SEQ ID NO: 4239661 - RNA, 70 nt, Mycobacterium leprae
ccugcuuuuuagcguguaaaacuguggugucuccagaggugaucgccuaguaaccgcgccagauugcagg

SEQ ID NO: 4239662 - RNA, 65 nt, Mycobacterium leprae
cgcacaugaacgcgacagccuggcgacgcgcgauuggcucaccaaaggcuucgcguucuuuuacg

SEQ ID NO: 4239663 - RNA, 66 nt, Mycobacterium leprae
gcacgccagguucgccaggcaggacgccagaccaaggguguucgguugaugaacuuaggugagggc

SEQ ID NO: 4239664 - RNA, 78 nt, Mycobacterium leprae
gggcuccaagcucaccugucugauacuggccguuaaacugagccuggccggcgugcgacagcugaugcuggaacgccc

SEQ ID NO: 4239665 - RNA, 89 nt, Mycobacterium leprae
guuugggaacaucggcgaucaucgucagcgcacgauucaacgucaguugcaguccguccagcgugacgauagcgucgauuaccccaugc

SEQ ID NO: 4239666 - RNA, 59 nt, Mycobacterium leprae
cgcugcugucggccaacauugaccucgccaacgcugagucgguguugcugaugcggacg

SEQ ID NO: 4239667 - RNA, 57 nt, Mycobacterium leprae
cgacgacuuugggggcugaccuacugccccaaguacucaccgucaaucaggucgucg

SEQ ID NO: 4239668 - RNA, 75 nt, Mycobacterium leprae
ggaauugucacgcuguggucuucgcuaaccgaaaccgaaacuaucgauuugcuggaccgcaugcguggcggcauc

SEQ ID NO: 4239669 - RNA, 64 nt, Mycobacterium leprae
cgguuucguuagcucgcguaggggacugacuacgaggucacucccauucgugcugacgcagcug

SEQ ID NO: 4239670 - RNA, 57 nt, Mycobacterium leprae
gggagcucaaguucuuuggcuaacaauuuaagauggcgggagaacuccgagacuucc

SEQ ID NO: 4239671 - RNA, 66 nt, Mycobacterium leprae
ccgcccaccgcggucgcggcugcaaucagcgcggcguggucugcagccagcgccgcgguggauagg

SEQ ID NO: 4239672 - RNA, 55 nt, Mycobacterium leprae
gcgauacaagucgugugaaccggucucagcggccgacacgcugaacuuguguugu

SEQ ID NO: 4239673 - RNA, 62 nt, Mycobacterium leprae
ccgaucauuacggccaccgcggcgaucaccagagccaacacgcagcggucgccgaaggucgg

SEQ ID NO: 4239674 - RNA, 60 nt, Mycobacterium leprae
ggccgucucgucgacuacgauuucaccgccgcgauggaagacgagcucgaugagaucgcu

SEQ ID NO: 4239675 - RNA, 104 nt, Mycobacterium leprae
gacaggugcucgaaauaggaauugggugggucggcugggcauacacgcggccacuuguggagccuacgcccgcucaguuaucuuacucaucaagcagcaguguc

SEQ ID NO: 4239676 - RNA, 76 nt, Mycobacterium leprae
acggcccgcagccaggcagcugcuaggcggauguugcacgacagugacugcuuccaguugcuuggcuuuggggugu

SEQ ID NO: 4239677 - RNA, 66 nt, Mycobacterium leprae
ccaccggacgcuguugauuggucgcaaauaccgugaauucccucgcuaaacaaucccguacggugg

SEQ ID NO: 4239678 - RNA, 59 nt, Mycobacterium leprae
gcugcgaggcgaucgucugccgguucaccuaucuggugcugcugaugaucgcauccagc

SEQ ID NO: 4239679 - RNA, 61 nt, Mycobacterium leprae
gucuuugauccgcuggagcaccuggucuauuggggucggguggucuacguggucaaaguac

SEQ ID NO: 4239680 - RNA, 82 nt, Mycobacterium leprae
ucugaucggcucggcuggucggcuuggugguuuguuugcuggcgcacacgccgagcaggucgagcggcugagccgacucggg

SEQ ID NO: 4239681 - RNA, 93 nt, Mycobacterium leprae
guuauuuaggaucaacugcaggaucacuaguugcgccggacccaggaauaggaguccaaaacuaaguugaucccugcgccgaucucucagaac

SEQ ID NO: 4239682 - RNA, 67 nt, Mycobacterium leprae
cugguuccgauguauagggcgucguagcgauagaaguauuaagcacgaucucuucggcaucggucag

SEQ ID NO: 4239683 - RNA, 63 nt, Mycobacterium leprae
gacgccgaugcuuugcagucccuguucugcaaaacggagcacccauuucugcagcaucugcuc

SEQ ID NO: 4239684 - RNA, 76 nt, Mycobacterium leprae
ggaagccuaccgacucacugagcaaggugcguucgacgugaccguucgcccugcucaguagucggacccgguuacc

SEQ ID NO: 4239685 - RNA, 57 nt, Mycobacterium leprae
aaguagauucaccucguuccggauccugcccacgaucacaagagcggugaaucacuu

SEQ ID NO: 4239686 - RNA, 78 nt, Mycobacterium leprae
acuucgcuuuacggggguccuugccaugagucacugccacagguguaagcucaacguaaaucucauguagggucuugu

SEQ ID NO: 4239687 - RNA, 64 nt, Mycobacterium leprae
ccuaucucgucaguucgacggcagcuggacgcuaacugucagcaacugccgggcuggcgaaagg

SEQ ID NO: 4239688 - RNA, 71 nt, Mycobacterium leprae
gaccuugagcuaucuuuagcgguucguccuucacaucggaauccagccgacugcaagagauauucgacuuc

SEQ ID NO: 4239689 - RNA, 75 nt, Mycobacterium leprae
ccguccguggcacuuguuugccuagcugggucggcaccgacccgguugauugcguaggcggguuacacacuucgg

SEQ ID NO: 4239690 - RNA, 120 nt, Mycobacterium leprae
cuagguaccuauuccgggugguacucggugcgcgacgagagguuuuucgucgacucggagaccaaacuucucgauaacggcauccgaguagcaguagaaaccggcacacuagucaccugg

SEQ ID NO: 4239691 - RNA, 83 nt, Mycobacterium leprae
gacgcuccagugugcugguagugcauggcgaugauggacucgacgaauugaccaccacuacuaccaguacgaucuggcguguu

SEQ ID NO: 4239692 - RNA, 129 nt, Mycobacterium leprae
cggaggauuaccaagauguacucggguaacggucuugcgguacgagugauuccuugccuggacgucuauugugggcgugugguuaaaggggucaauuucaagaaccuccgggaugcgggugaucucgug

SEQ ID NO: 4239693 - RNA, 84 nt, Mycobacterium leprae
cugaucgcaaugccgguuuucggcggggccaaucagcgucgcagcgcugcgaugugguuggcagcgcuggaaacggcacgacag

SEQ ID NO: 4239694 - RNA, 79 nt, Mycobacterium leprae
gguuugggacugucgacgcgugucgacugacuguggguggugcgcuuagucgguaucggcagcgucgaaaaguugugcc

SEQ ID NO: 4239695 - RNA, 60 nt, Mycobacterium leprae
gugggugcaaccguuuaaguguagcggcagcuccgacgcaugaauguguugcgcuacguc

SEQ ID NO: 4239696 - RNA, 84 nt, Mycobacterium leprae
agaucucgacggacaaaacugugcggcccggccauuggccgcuggugagcuggccgagguugacagugcugugcuggccgaucu

SEQ ID NO: 4239697 - RNA, 62 nt, Mycobacterium leprae
ggcaucgcgauugcugggcggccgggugauccagcuccgaacgucccagguacuccggugcc

SEQ ID NO: 4239698 - RNA, 72 nt, Mycobacterium leprae
cugacugguguucuuggcgaauucggugaugcgggccgaagaucccgggucgucggacaacaccaacgucgg

SEQ ID NO: 4239699 - RNA, 62 nt, Mycobacterium leprae
gacccgucggugcgaguuuugcgucaaguaacacuggaugacgcggcggcugcugacgaguu

SEQ ID NO: 4239700 - RNA, 86 nt, Mycobacterium leprae
augucagcaggacugcgaucgaccuccuuaccucguagcgacggaacaauacagaagguacagcuguuguugcauccaacugagau

SEQ ID NO: 4239701 - RNA, 67 nt, Mycobacterium leprae
ggucgagauggucaccggucggauuuccuugcgcucuccggaguauucgccgaucucguccucgguc

SEQ ID NO: 4239702 - RNA, 84 nt, Mycobacterium leprae
ggaaaauaucgcggucagauuucuugugcgccgaauuuugguuucgaauuagcggugcgcagaacgucggaugacgauauggcu

SEQ ID NO: 4239703 - RNA, 62 nt, Mycobacterium leprae
cgacaaucaggucauugaucucgacaauacacaacuagucaagcgagaucgaccggaugucg

SEQ ID NO: 4239704 - RNA, 60 nt, Mycobacterium leprae
ugccguucgugucgcugggccccggucccacuuuugacacacucggugagguggacggca

SEQ ID NO: 4239705 - RNA, 58 nt, Mycobacterium leprae
gaucuuguugacgaccaggguagacaacgccucacccucgacauccucagcaaugauc

SEQ ID NO: 4239706 - RNA, 65 nt, Mycobacterium leprae
gcuacaaccuuggcaaucgaguuauaucgucgaccggccagugcaacuuaugcuagcgguuuagc

SEQ ID NO: 4239707 - RNA, 72 nt, Mycobacterium leprae
ucgaguuuugcgugaguuccaccucgguggugccgaugaggccaccuccgggauugaauacaugccgaucga

SEQ ID NO: 4239708 - RNA, 58 nt, Mycobacterium leprae
ucccuaggaaagugauaccuacuguugccgccgacgcggcgaucaccuugccuaggga

SEQ ID NO: 4239709 - RNA, 55 nt, Mycobacterium leprae
uguguucaccgcugccucugguagggguaguuuuaucagaacccagcgugagacg

SEQ ID NO: 4239710 - RNA, 71 nt, Mycobacterium leprae
cgagacaguaagacauguucgguagucguggggggcagcccggaauccuguugacguguuuugcuguguug

SEQ ID NO: 4239711 - RNA, 55 nt, Mycobacterium leprae
ggguuacugagcuuguauugcuuagcuaugcagugagcagugggcccaguggcuu

SEQ ID NO: 4239712 - RNA, 60 nt, Mycobacterium leprae
ggacaaugucugggaucucacgcccgaagaaaggcucgcgaugggauaccgagaauugcc

SEQ ID NO: 4239713 - RNA, 114 nt, Mycobacterium leprae
gccuaccgcgauuggaucgccgaaagugggcugcggauuucuggaacuucgcccgacgguuaucugguggaguucgucgaauauccggccaacaugcauccauucguugucggc

SEQ ID NO: 4239714 - RNA, 80 nt, Mycobacterium leprae
cggcagggaucuacggcguaugggcaucagcgccgccacgguggccgcgcugggccaggcgcugucagaccccgcggccg

SEQ ID NO: 4239715 - RNA, 76 nt, Mycobacterium leprae
ggucggggaaugccauugcuggaccuaauccaggagggcaaccugggguugauccgcgcgauggagaaguuugacu

SEQ ID NO: 4239716 - RNA, 58 nt, Mycobacterium leprae
guuguggggccgucauggcgggcaggcuguuugcaucgcccugauacuggcccccgac

SEQ ID NO: 4239717 - RNA, 102 nt, Mycobacterium leprae
gucgaucgguguccggcgcucggcgaagugagcgagggaugaguuacgaccugaccaauccgguuucgcugcuucguuuccaggcugcagcauccgguugac

SEQ ID NO: 4239718 - RNA, 130 nt, Mycobacterium leprae
ucaccgaccuucgcgauguugaguagaucuugcagcuggcggaugcgggcuuccugcuggcccuguuccucgcgggcggcgugauauccgccguucucgcgcaggucacccuccucgcggcggucguuga

SEQ ID NO: 4239719 - RNA, 67 nt, Mycobacterium leprae
ucggguuggcgauugcccgcgaauaugguacaggcacagucuuuuucgccggacagucgcuucucga

SEQ ID NO: 4239720 - RNA, 70 nt, Mycobacterium leprae
gaucacuaccagcgggaugcuggugguggugucagugacaccaccaccagcaucccgcugcauguugauc

SEQ ID NO: 4239721 - RNA, 95 nt, Mycobacterium leprae
cuguugcuuuuacagacgaucuguccauuguugaucgggucguaggagaaucugccuacgacccgaucaacaauggacaggcgacgacgcgauag

SEQ ID NO: 4239722 - RNA, 86 nt, Mycobacterium leprae
gccuugccaucugcgaggucggcgcauugaauaguccgaucgccuuggcgaaggugcccuucauggcgccggccaguuuggcuagc

SEQ ID NO: 4239723 - RNA, 69 nt, Mycobacterium leprae
caggguaucgguugcucgaaggugccugacauccacaauguggcacuaauggaggaccgcgccacccug

SEQ ID NO: 4239724 - RNA, 57 nt, Mycobacterium leprae
auguccguuucuuaaugcagccgcccagagggcacggguggcguugagcgaggacau

SEQ ID NO: 4239725 - RNA, 66 nt, Mycobacterium leprae
gcugcgcgaugguauaagcccuggcgaacagaaugcccucgcugcgaggcuuauccaucugcgugc

SEQ ID NO: 4239726 - RNA, 73 nt, Mycobacterium leprae
gcggcauccguguugaaggccgcugacgccuccgacgagaucaacguugccgucgacaugcuggagaugcugc

SEQ ID NO: 4239727 - RNA, 91 nt, Mycobacterium leprae
caggccgaucaccaccguuugcgcuacuucgcuggaucgccguguccagacaccggguaucgcggcgaaguagcgcgcggugaacggcuug

SEQ ID NO: 4239728 - RNA, 89 nt, Mycobacterium leprae
cccaacgcuagaucgaccuuggcgagcugcgcuuccucgagcgucaugucgucacgcucgaaauacgcgcagcuguaggucaggguggg

SEQ ID NO: 4239729 - RNA, 59 nt, Mycobacterium leprae
gugaaggggucaaagcuggucguuuccggcggcaacgaccgcagauugacuucgagcac

SEQ ID NO: 4239730 - RNA, 65 nt, Mycobacterium leprae
gugggugccacagucguugcgcgauaugaacaccaccaugaucgccgcaccauugggcgacccac

SEQ ID NO: 4239731 - RNA, 63 nt, Mycobacterium leprae
gggagcgaaugugaucacggccacggaccuugagguccgcgcuggugcgcgcaucuugcucuc

SEQ ID NO: 4239732 - RNA, 65 nt, Mycobacterium leprae
aagucgaucggauuguccgaauugaacugagcuccaguaacgauaucaccgauucguauugauuu

SEQ ID NO: 4239733 - RNA, 88 nt, Mycobacterium leprae
uccuggcucgauccagaugggugguguguccguccaugaugcgugggagcacggugugaugcccuauaccaccacuggaguguuugga

SEQ ID NO: 4239734 - RNA, 98 nt, Mycobacterium leprae
cuugcgaugcugggacauacugaugcagugagcuuuaccguagggaucgacgaaaauaacccgacggugcguagcgaugcguuacucagcauagcggg

SEQ ID NO: 4239735 - RNA, 81 nt, Mycobacterium leprae
ucucggacgcgagcauagcgagcagguugauauauagagucuaucggggagccggcuugcugcgcucgaucgcccguaaga

SEQ ID NO: 4239736 - RNA, 111 nt, Mycobacterium leprae
cggccuccauugagguguggaucucgucgccggugcgguccaagaagccaguguugauaaacacgacccgaucggcggcggccuugaugcacgccuucaaauugagugucg

SEQ ID NO: 4239737 - RNA, 59 nt, Mycobacterium leprae
ccgggucgagacggcuuucaggagagguuuaaccgacacugcugccgugcucgacuugg

SEQ ID NO: 4239738 - RNA, 58 nt, Mycobacterium leprae
gggugcuaacuggugucauccguuugguucggaucacccggagaguccagauagcccu

SEQ ID NO: 4239739 - RNA, 64 nt, Mycobacterium leprae
guuggauuuguuuggauuugucuugggaaauuacgucguaaugacccaaguuaagucuuccaac

SEQ ID NO: 4239740 - RNA, 84 nt, Mycobacterium leprae
cgcgaccgacagucgcagcgaucuaggcaaaugcgggccaccacgguggucagccaaguuccuagauugacgauggucggcgcg

SEQ ID NO: 4239741 - RNA, 104 nt, Mycobacterium leprae
ccggcucaucgauggcuccucggggugcgcgaucguggauagcgauaaccuagcagaggaccgaucagcaugaacgcggucgucaccccaccccggucagcggg

SEQ ID NO: 4239742 - RNA, 86 nt, Mycobacterium leprae
cagcgagcacgccgacgucgaaauccggcggcuggccauugucugccugcgccggcucgucgacguugcgcccgcaguauucgcug

SEQ ID NO: 4239743 - RNA, 69 nt, Mycobacterium leprae
uggcggugcagucgcuacguuccggugaguccgauuuggugcuggccggcgucgugacugucaacguca

SEQ ID NO: 4239744 - RNA, 55 nt, Mycobacterium leprae
caccugcaacgcacgugucuuguucugcagcugcgaccguucguuuugacaggug

SEQ ID NO: 4239745 - RNA, 80 nt, Mycobacterium leprae
cgccaugcuuagcgcugaccuguucggcgaaugcuucgaccgcugccgcgucggacacaucgagugcauaagcguaggcg

SEQ ID NO: 4239746 - RNA, 74 nt, Mycobacterium leprae
cuguuguuugucguuucugcaguagcugaacuggcggaaucggauugugugcugcucaggaugacggacgacgg

SEQ ID NO: 4239747 - RNA, 70 nt, Mycobacterium leprae
uacgcaacgugggguugcauuucaucugucgcgacgugugguugcgggugauaucgaccucgacggcgug

SEQ ID NO: 4239748 - RNA, 59 nt, Mycobacterium leprae
ucggcgaaggauaggcgggcaguacaaggugcugcucugcccaacccugccuuugccga

SEQ ID NO: 4239749 - RNA, 79 nt, Mycobacterium leprae
uuccacagucgacaguuguucccacauaaaaaauuccauacaaauuguuccgggaacaacuauugucgauugggcggaa

SEQ ID NO: 4239750 - RNA, 55 nt, Mycobacterium leprae
cauccuggcgcauugacgugcccgacuagcuguugcauucaucaggccagugaug

SEQ ID NO: 4239751 - RNA, 55 nt, Mycobacterium leprae
ggaucgauuuuugaugggcgcaaccgcguugccggcacccgucaagccgucgucu

SEQ ID NO: 4239752 - RNA, 70 nt, Mycobacterium leprae
gcaugucguuguugcuugaguuuuuugggauuaucgacgaucaggaaacauagaagcgaacaacaacagu

SEQ ID NO: 4239753 - RNA, 56 nt, Mycobacterium leprae
ggcagcaagacagcgagauccggcacagcccacggugcuggaggucaucugcugcu

SEQ ID NO: 4239754 - RNA, 56 nt, Mycobacterium leprae
acgcacgagaucggggcgggcucuacuucaagggaucucgcccuuuucucgugugu

SEQ ID NO: 4239755 - RNA, 90 nt, Mycobacterium leprae
uggccuggguauguauuggugcaaguguccugggcgugcugcuguuaaucguugaugcaguccgggaacaccagugcaucgaugcggcca

SEQ ID NO: 4239756 - RNA, 90 nt, Mycobacterium leprae
ugauugcguuggcagacugagccuguucggguggguaauugcuaacggcaauugaccaccacccgggcagcuagucgauuaaugugguua

SEQ ID NO: 4239757 - RNA, 72 nt, Mycobacterium leprae
gaacugaccgcgaccgucaucaccgcggcuccacacgauuuccacaccucggugugagguaccggcucguuc

SEQ ID NO: 4239758 - RNA, 100 nt, Mycobacterium leprae
acuguguguguaaggauaaaacgcugcuggguuggacgcacacgcaacgcgccuauugccgguugaugcugcgccgauucggcguccgaaucaccacggu

SEQ ID NO: 4239759 - RNA, 56 nt, Mycobacterium leprae
ggagggccucgaugucgugguggagcagugcgauucgcuggacauaaaggcucucc

SEQ ID NO: 4239760 - RNA, 78 nt, Mycobacterium leprae
guuugaucauugauugccauaucacguccauggcacgcuucaccgucauggaugauagacguguggcagacaucaaac

SEQ ID NO: 4239761 - RNA, 82 nt, Mycobacterium leprae
gauacggcugcgucagcugcguuggaccggauugcucgccgcguagcaccugcccgacgcggcggggcagaaucaccguauc

SEQ ID NO: 4239762 - RNA, 59 nt, Mycobacterium leprae
guagcgguaguggcgcacggaggccagaaaacuagugucugcucaaaucacaccgcuac

SEQ ID NO: 4239763 - RNA, 59 nt, Mycobacterium leprae
gugugggcaucccguauagaugugugacuacgucgaacacugcuacgugacugcggcgc

SEQ ID NO: 4239764 - RNA, 109 nt, Mycobacterium leprae
gaagcuucgcuaucgacaagguaaacgucuuugucugggcguucaaucagggcugcaacauugguccgacugaacgcucggccauagacgugccgaaugacagcgcuuc

SEQ ID NO: 4239765 - RNA, 77 nt, Mycobacterium leprae
gcccaagauacuguguacgucguaggcaaucgagucugacauuuugucagccaugcgauuggcgcagauuuuggugc

SEQ ID NO: 4239766 - RNA, 78 nt, Mycobacterium leprae
gguugugguaugcugcgcuugggugccugcaucgcuagcaacgcugugcugggcagccugugcggugugauggaagcc

SEQ ID NO: 4239767 - RNA, 66 nt, Mycobacterium leprae
cagagcguccaggugagccagcaccguaucgaagugcugcuuggcgccaucggacaaauggucuag

SEQ ID NO: 4239768 - RNA, 55 nt, Mycobacterium leprae
ugcugcaucuugguggcuguagggguuaaccgguguccggccagcgagagcagca

SEQ ID NO: 4239769 - RNA, 58 nt, Mycobacterium leprae
guucggguaaaaaggaguauggcggugagcgccaccgcauucaugauuuuauccgcac

SEQ ID NO: 4239770 - RNA, 92 nt, Mycobacterium leprae
gggcggacgggucgaucgugucuuuucgcccugaugcuaacgcggccagguugcguucgucggcgcggagaaucgcgauucccgagcugccc

SEQ ID NO: 4239771 - RNA, 80 nt, Mycobacterium leprae
gucguuggaugacauuagagccucaagguacgccuauuacgacgguacgguauuugggaacucuggugacuuaaaaugac

SEQ ID NO: 4239772 - RNA, 55 nt, Mycobacterium leprae
gcuucggucagcuugcaguaggcagcggaggccagucugcgaacuguucugaggu

SEQ ID NO: 4239773 - RNA, 95 nt, Mycobacterium leprae
ccuugccggggaguaugggacuccguuguuugucaucgacgaagacgacuuccguuuccguugccgggagauagcggcugcauucggcggugggg

SEQ ID NO: 4239774 - RNA, 79 nt, Mycobacterium leprae
gcaaugcaucucgucuaguucggcgccgagcgugucggucaccagccguacagcuuagccgaacguggucgugcccugc

SEQ ID NO: 4239775 - RNA, 59 nt, Mycobacterium leprae
ggcgcaggugcggcccggugauaucaucaccgugauggucacugaagcagcgccgcacc

SEQ ID NO: 4239776 - RNA, 74 nt, Mycobacterium leprae
gguccgcgagauauaccgcaucgacgacgagcaccucuuaaugguugcgucggaucggauaucggcguucgacu

SEQ ID NO: 4239777 - RNA, 95 nt, Mycobacterium leprae
uugugguuuacgcugcuugugguuuucgucgacgagucagcugggggccgucuaguugcagcuggccaguucgaaaguuguuaguacaaccacaa

SEQ ID NO: 4239778 - RNA, 55 nt, Mycobacterium leprae
ucaccgauccugcggcggcaauuaucgcaaucagguugccgcccuugaccggugg

SEQ ID NO: 4239779 - RNA, 75 nt, Mycobacterium leprae
ucgccggcuucgaacuugcugcacaccgugucaucggccuacugugcgauauugucggcgaguuugauccggaga

SEQ ID NO: 4239780 - RNA, 61 nt, Mycobacterium leprae
guuguccaucgcgucgguauugauccguccaccggacagaucgaacucgacgcggcccaac

SEQ ID NO: 4239781 - RNA, 76 nt, Mycobacterium leprae
ucgaacucguagcggucauacugcgcuggcucgucucgcguuagggucgugaccggugcaaugaucgcagcaucga

SEQ ID NO: 4239782 - RNA, 73 nt, Mycobacterium leprae
caagcuguggcuaguggcaucggacaacuucaucugacucgauuagcugacgguaauacuggcccgcagcaug

SEQ ID NO: 4239783 - RNA, 56 nt, Mycobacterium leprae
ucggcaguguguucuuuguuaacggagguagucgcagucggagagcgucgcgccga

SEQ ID NO: 4239784 - RNA, 63 nt, Mycobacterium leprae
gucgguaccuaggcggcugccacuacacugacuguguucaccgcgccacucuaagucaccgac

SEQ ID NO: 4239785 - RNA, 72 nt, Mycobacterium leprae
gcuggucgauggugcggucgcugaucggagcguugcuggcugugggugaucaccgacgcaccaucggcuggu

SEQ ID NO: 4239786 - RNA, 61 nt, Mycobacterium leprae
cugggccgcaagaucccgucugcucagaugcgccgcggcgacgucaucuucuacggcccgg

SEQ ID NO: 4239787 - RNA, 66 nt, Mycobacterium leprae
gggcacagcgagucaucacaaucgauuugccucccgguagcgucgacgucgugagucgcgcugccc

SEQ ID NO: 4239788 - RNA, 73 nt, Mycobacterium leprae
uucgagguuuugcccguugcggguggggugcagggagugaugagccccucgaaaucaggguaaaggccuugga

SEQ ID NO: 4239789 - RNA, 63 nt, Mycobacterium leprae
auccagcguuacugcaaguugacacuccgauauccgaucgugacgauggguaggacgcucgau

SEQ ID NO: 4239790 - RNA, 67 nt, Mycobacterium leprae
caacaucucggggugcaacuuggcccgaaacccguuuaacgggaaccgaguugacaucgggauguug

SEQ ID NO: 4239791 - RNA, 56 nt, Mycobacterium leprae
gucaacgggcguuggacugcggagcuguugaggcuaucguugucgaugcccgugac

SEQ ID NO: 4239792 - RNA, 55 nt, Mycobacterium leprae
gccgggugacuugcaaucucuggaacuuguugccagugaccgaguuccgccuggc

SEQ ID NO: 4239793 - RNA, 82 nt, Mycobacterium leprae
ucaccggccggaugcucaugguguugaugcuaacacugaucuucaguuucgcgaucgccgccgucagcuacgcgcuggucga

SEQ ID NO: 4239794 - RNA, 82 nt, Mycobacterium leprae
ccgcgcaggcuacgguuugagucgguguucggcgaucagcgugcugaccuccggaccaucgagcucaaucagccugcggcgg

SEQ ID NO: 4239795 - RNA, 89 nt, Mycobacterium leprae
cgacgaaguggcuuauuugcguuucgcgucgguauaccgauccuuuucgucggccgacgacuucgagcgcgagauugaggcgcuucgcg

SEQ ID NO: 4239796 - RNA, 56 nt, Mycobacterium leprae
gcggcgaucugggcuggccgugcguucccagucaugaccuggcccaucgcccaagc

SEQ ID NO: 4239797 - RNA, 71 nt, Mycobacterium leprae
ggggagccgcaagggugagugaugagcgugaugugagcccguacgcucggguucuggcccuugacgacccc

SEQ ID NO: 4239798 - RNA, 59 nt, Mycobacterium leprae
gggaagauguauaggacugccgacgguagcggcggucgagcuguucucaacaucuacuc

SEQ ID NO: 4239799 - RNA, 66 nt, Mycobacterium leprae
uaggcgcaugcagccucgccuagcgacugaccgaccacugcugcaggcuuggcuccgugaugcuua

SEQ ID NO: 4239800 - RNA, 93 nt, Mycobacterium leprae
cucucguucgacuacugccguucauggcugguccacagcgucucuaagcugccuacuaccgcgauguaugguguaguugccgcggacgaugag

SEQ ID NO: 4239801 - RNA, 66 nt, Mycobacterium leprae
cuucgaccgccgagcugguagcucuguuguaccaggcgauuccagcaccggcccggcgcaucggag

SEQ ID NO: 4239802 - RNA, 62 nt, Mycobacterium leprae
gaguacauccgucugauggcguugguggaguacuccgccgacgagaucaagacgguguucuc

SEQ ID NO: 4239803 - RNA, 66 nt, Mycobacterium leprae
ugcagccccgaggcagcucguugggccguggcaauauccccagcggcucagucuuggcggcgcgca

SEQ ID NO: 4239804 - RNA, 110 nt, Mycobacterium leprae
gggcugcauaagcuguucgguuggugggguggccagggguugaccggauucaagaauucgcugacccagguuggcuaccagcacgccgacauccuggcuuaugugagcgc

SEQ ID NO: 4239805 - RNA, 61 nt, Mycobacterium leprae
uuggucagcaccgcccuagucggcgaaaacauuuccggccgaccaaguggugguuuaccag

SEQ ID NO: 4239806 - RNA, 83 nt, Mycobacterium leprae
gacaucguguaguggcggccuuuagugucggugagcuggacgcgcucgccaacggugaacgggccaguugcggacacgcuguc

SEQ ID NO: 4239807 - RNA, 102 nt, Mycobacterium leprae
gugagaucggcuagcuccgaacgcaucugagguugcagcgcauccauggcuggguugugcggugccaccucgauguugacucggguggcaaaaccguccugc

SEQ ID NO: 4239808 - RNA, 58 nt, Mycobacterium leprae
guugggugaugacgccaaagaacucaccguccgguaguccuucgcguaggucggccac

SEQ ID NO: 4239809 - RNA, 85 nt, Mycobacterium leprae
augucaugccguacguaaaagaacgcgaagccuuuggugagccaaucgcgcgucgccaggcugucgcguucaugugcgccaacau

SEQ ID NO: 4239810 - RNA, 78 nt, Mycobacterium leprae
acaagaaauguucgaaguaguucgcgguaucuauaucuauccgauccgcagcuucgauauaucgaauaucaccuucgu

SEQ ID NO: 4239811 - RNA, 72 nt, Mycobacterium leprae
gaugcuguuagcgauccugucgaucaucuggggcaugaaucagguuugcuggcaggaugccuuaacggcguu

SEQ ID NO: 4239812 - RNA, 88 nt, Mycobacterium leprae
ggcagcuguccgcucagcgccggugcagucaugccggagauaaagcgguucgaccggacguuugcaccuggugcuggauucgacugcc

SEQ ID NO: 4239813 - RNA, 89 nt, Mycobacterium leprae
gucggaccucauugguggccgguaccgucccggagcacaaugacgugcuguuguccaccgagcggcuacgguccaucagugagguagac

SEQ ID NO: 4239814 - RNA, 100 nt, Mycobacterium leprae
uugacgagagcgcggugcugucgauguggauuacgacaucgacuccaucaccgaggauguucagaucggcaucgguuacuagggcugcgaucucgaucaa

SEQ ID NO: 4239815 - RNA, 87 nt, Mycobacterium leprae
gcguuuggguuuaaccgguuguccaucaucgacauugcgcauucgcaucagccgcugcgguggggaccaccggagacacccaaccgc

SEQ ID NO: 4239816 - RNA, 58 nt, Mycobacterium leprae
gaucacagcgacauucuucagggcaugucaccgcagcuuugucaaugucgcgguaguc

SEQ ID NO: 4239817 - RNA, 81 nt, Mycobacterium leprae
ucgugguauuuagucuggcggccucgucgguguacuugaucaacgacgugcgcgacaucgaggcugaccaggagcacccga

SEQ ID NO: 4239818 - RNA, 113 nt, Mycobacterium leprae
gcacguugggcugcgaaguuccuguucgcuggagggucgugucaugaguggugccauuaaguacuagcgcacuuuuccagccugacuaugaauuguuucgugaguucuacugc

SEQ ID NO: 4239819 - RNA, 62 nt, Mycobacterium leprae
ccuuaucgcgacacccccgguggggauuguggggcauucccagggggugcucgcugucgagg

SEQ ID NO: 4239820 - RNA, 55 nt, Mycobacterium leprae
gugcggccaucaaucagucuacgacaauuggucguagacugauugauggccgcac

SEQ ID NO: 4239821 - RNA, 107 nt, Mycobacterium leprae
cgcgcugcgcgaccaggaucgugugcuggcugugguucgugguucggcgaccaaucaagacggucgguccaacggcaugaccgcgccuaacgcgcuggcgcagcgcg

SEQ ID NO: 4239822 - RNA, 60 nt, Mycobacterium leprae
gugccgcaagcaccgaagugcgcuccgauuccaccgacgugcuacucgaggcugcgguau

SEQ ID NO: 4239823 - RNA, 68 nt, Mycobacterium leprae
ccagacuucugacgaagucaccguggagacgacuucggucuuccgcgccgacuuccucaacgaacugg

SEQ ID NO: 4239824 - RNA, 73 nt, Mycobacterium leprae
ggccauaccugaggcugugcugccgcgcgacgcggcgacggccgcuucgucgguugagucaugccuauaggcc

SEQ ID NO: 4239825 - RNA, 69 nt, Mycobacterium leprae
gccgcgggguugcuggauugcccuggugcgauguucaccgcgagccacaauccggcggccuacaacggc

SEQ ID NO: 4239826 - RNA, 55 nt, Mycobacterium leprae
cuaguugacgaagaucggugcgaucugcuggagcgcgagaucgaucgugagcugg

SEQ ID NO: 4239827 - RNA, 90 nt, Mycobacterium leprae
cccguaucuaucggcaaggcaaggaagaauucgacacugagcuuggcccggugguggucaauuuccugcuggccgaugagauuaaccggg

SEQ ID NO: 4239828 - RNA, 89 nt, Mycobacterium leprae
cuucgagaacuucaggcagcuggacguuucgacggcaaacuacaacgguuuuccgucggcaaugauccaaggcagcuaugaccucgagg

SEQ ID NO: 4239829 - RNA, 71 nt, Mycobacterium leprae
ccaucaaccggucguggcgggccgcggcguccaccagugugcugaggccggugaaugguccgggaacaugg

SEQ ID NO: 4239830 - RNA, 93 nt, Mycobacterium leprae
aggucugugggaccggguguuugguccagcuuagcgugacgaacacgucgucgcccuauuucauccggaugcgugcccguguuuuacggaucu

SEQ ID NO: 4239831 - RNA, 57 nt, Mycobacterium leprae
cgguuagacguuaacggguaugccgcgcugccaggcgaaccuugcauugucuagccg

SEQ ID NO: 4239832 - RNA, 80 nt, Mycobacterium leprae
cucgacagucagugacucgagcgauacaucaauaacccuggcgcggaacaaguguaccgcuucgauuaccuggcugcggg

SEQ ID NO: 4239833 - RNA, 61 nt, Mycobacterium leprae
uaucccccucgaagggcauuaagaucuguuucgcagaucuuaaugcccuucgagggggaua

SEQ ID NO: 4239834 - RNA, 80 nt, Mycobacterium leprae
ggcgcccgagcguaccgcauagcgaacauugucgccgacggcccgauggcagcugaacgucgauaugcccgccgggcguc

SEQ ID NO: 4239835 - RNA, 85 nt, Mycobacterium leprae
ucgguaucauuggcgccagccagauucuccaucaaggugucgacagugucuugggaguccuucuuguuggugccgaucaccccgg

SEQ ID NO: 4239836 - RNA, 60 nt, Mycobacterium leprae
cuguccauuguugaucgggucguaggcagauucuccuacgacccgaucaacaauggacag

SEQ ID NO: 4239837 - RNA, 68 nt, Mycobacterium leprae
cagcccuuccgcguguggacuugacgaauauugggauugauguucgcauauaaacauguguugggcug

SEQ ID NO: 4239838 - RNA, 69 nt, Mycobacterium leprae
cgugacagaacgggggcaccagauuuuugucggcgcccuggcugacgaucuugccgcccaucugucgcg

SEQ ID NO: 4239839 - RNA, 82 nt, Mycobacterium leprae
cggauacacgacguucgagguugccgaugcgguugccgaauuuugaguuacuucgccggcggacuucggauaagagggucug

SEQ ID NO: 4239840 - RNA, 75 nt, Mycobacterium leprae
gcugaucaaccgccggcugccgaccuaguuuuguuacaguugcgucagagucagaccggccgguguugggucggc

SEQ ID NO: 4239841 - RNA, 83 nt, Mycobacterium leprae
ggcgggccuuagccuuacuggccgucagguauucguagucaaaacgaaccgccuuaggugcggugccagguuccggagccgcc

SEQ ID NO: 4239842 - RNA, 94 nt, Mycobacterium leprae
ggacacacaguuggugcggcuuucguucgggaaguuuggugaucagguggccucgacugccucggacgaugagcugcuggcuugggcggugucc

SEQ ID NO: 4239843 - RNA, 69 nt, Mycobacterium leprae
gccgaccucgcaguuacuuuguggccguuucuuaccggaacggcuauuggguggcuggcgucucgcggc

SEQ ID NO: 4239844 - RNA, 79 nt, Mycobacterium leprae
cggcaguuagcucguggccuguuguuaagguaucugggcauugcugagggccaaacugacccaggccgagcaguugcug

SEQ ID NO: 4239845 - RNA, 87 nt, Mycobacterium leprae
cggacucaucuacgggcgcguugaagcguggcgguaacgacuguugcaacgaccagccagcacaaacgcguaccgguugaugauccg

SEQ ID NO: 4239846 - RNA, 69 nt, Mycobacterium leprae
uuuuuuaggcgacggugaaauggacgagcccgaaagccgcgggcucgcacaugucgcgucccucgaaga

SEQ ID NO: 4239847 - RNA, 56 nt, Mycobacterium leprae
gacgcuagcccaguugcgcgcgcuggaguacggugcguggcacaacagcuggcguc

SEQ ID NO: 4239848 - RNA, 99 nt, Mycobacterium leprae
cgauuacgugugcaguggacccccggaagcauuguguuagccgcagcguacgccgcggcuaacacaaugcuuccguagaacaaaaccaucacacuuucg

SEQ ID NO: 4239849 - RNA, 60 nt, Mycobacterium leprae
gcuguguuuaaaggagccgcggcagcuggacuaggcucguagugcucggccggacgcggu

SEQ ID NO: 4239850 - RNA, 70 nt, Mycobacterium leprae
cagcccgccagguugaucaacggggaccaaccaauugcauugguccagaugaagauuuggcacacgguug

SEQ ID NO: 4239851 - RNA, 75 nt, Mycobacterium leprae
ggcgugacgaccugcaggucguuaucgcgaugcugaagaacgccggccgugaugucgcuuugcaguucguccgcu

SEQ ID NO: 4239852 - RNA, 127 nt, Mycobacterium leprae
cacacucugugggcuucggcggacuggucccaugcgcuguugaucaggccggaaccgguuguguuccgcuggguggcaguguguggacuguuucuuccugggugcugcggaagccgucgcgguugug

SEQ ID NO: 4239853 - RNA, 95 nt, Mycobacterium leprae
cuugguugacaguguaacuucugucuuuucgaugaaaucgguugcugaauugcgucguucgauucuggaaaggcguaguuacaacguuggaaaag

SEQ ID NO: 4239854 - RNA, 83 nt, Mycobacterium leprae
gugugcucacguuaccgacgacaccaugcggugccaucucacucaucagacacaacggcgucgucgguguaacuguaugccac

SEQ ID NO: 4239855 - RNA, 85 nt, Mycobacterium leprae
ccgguaugagugaugaggagaugaagcgcuuucccgaagagcuugggaaaaugggcuucgucuucaacuucauuaccuauggcgg

SEQ ID NO: 4239856 - RNA, 93 nt, Mycobacterium leprae
ggugcucaccguaggcauugcucgcgaacuuuuuccguaccaggcgcucaccaacuuacggaacgaugcgauagcaacguuuuuguggguagc

SEQ ID NO: 4239857 - RNA, 77 nt, Mycobacterium leprae
ggcacguccaacggcgagggcagguagucgaugacggcgucgagcaucggcuggacaccuuuguucuugaacgcgcu

SEQ ID NO: 4239858 - RNA, 58 nt, Mycobacterium leprae
caguaguucaccgcgcugccgugugucgcaguaggacagcggcagccggugcacuuug

SEQ ID NO: 4239859 - RNA, 65 nt, Mycobacterium leprae
aucggcaugagcugaucgcagucggacaugaugaagacgcguuugacauacagcugcaugccgau

SEQ ID NO: 4239860 - RNA, 124 nt, Mycobacterium leprae
gguuagcugcggcaucgauggcucaaacgugguuaacaccacauccuauugggcugcugacgaagcaaucacccgagaugugguuuuuccuuagauguagcagccgccgacaucgcggcuaucc

SEQ ID NO: 4239861 - RNA, 57 nt, Mycobacterium leprae
gucggcgagcgugccggggugccgguauucgccccgcauccuggggccucgcccgau

SEQ ID NO: 4239862 - RNA, 129 nt, Mycobacterium leprae
guagucgcacugggcggccaguugcucguaggcggcgaccaucacgacggggucauggugcuugacgcugaucuugauguugccgaagccgugcucuucgaacagugaugccucccacagcgcagacuc

SEQ ID NO: 4239863 - RNA, 85 nt, Mycobacterium leprae
gcguugagguuggcgucuuuccccugcuugggcgcgguacccaggaccaccccgccgcuaggcggcaaggcggcgaccacagcgc

SEQ ID NO: 4239864 - RNA, 62 nt, Mycobacterium leprae
gugcaacgugcacgcgcuggugcaaccgugguaaucguuggccaccgcaagcacguugucgc

SEQ ID NO: 4239865 - RNA, 80 nt, Mycobacterium leprae
aucgucaaggcaucgucuggggcgcggcagcuggcuguggugcagucagcgccgcugguccagcgguuauccgagaugau

SEQ ID NO: 4239866 - RNA, 80 nt, Mycobacterium leprae
gcuaugacacgaccuauaccuggaacgguucggcuguuggucacgacggcaaggcuguuccgguaacgggcaaguuuagc

SEQ ID NO: 4239867 - RNA, 68 nt, Mycobacterium leprae
ccgugcgagacgaccuguuguggugucauuggaagccccugaugccuccgacugggccgucugugcgg

SEQ ID NO: 4239868 - RNA, 55 nt, Mycobacterium leprae
uuggccacgaaucugugcgccaggcagcagaauuggugcgcaaucacguugccga

SEQ ID NO: 4239869 - RNA, 63 nt, Mycobacterium leprae
gcccgcugcaacgcggucagcaucgccggguauugaucggugacgaccccguugcgguucagc

SEQ ID NO: 4239870 - RNA, 90 nt, Mycobacterium leprae
caguucgugguuggauagcgggguuucgucgcgccagcaguacggcaacacccgauagcucucguaagccaaacccuugucccacagcug

SEQ ID NO: 4239871 - RNA, 75 nt, Mycobacterium leprae
cgacugccgaacauccggugcgugucgaauucuggggugacgagauuaccgagaugcggauguuuucgguggucg

SEQ ID NO: 4239872 - RNA, 94 nt, Mycobacterium leprae
cgacgccguugugcucaacgccgccggugcgaucgucgccuacgcuggguuauccagccacgcugaauggucgcccgcgugggacgauggguug

SEQ ID NO: 4239873 - RNA, 62 nt, Mycobacterium leprae
cguuggaugcuuggcuuaaagucaacgacaugcugucguggucuuucgcacagguuccggcg

SEQ ID NO: 4239874 - RNA, 82 nt, Mycobacterium leprae
ggcugguggcgggcauugaggccgcuuacggugagccaccggagggucgccgugaccggaucccgaucaacgccaccgugcc

SEQ ID NO: 4239875 - RNA, 76 nt, Mycobacterium leprae
agauuuggcuguucaacaugggcaugccagcugcauuauuucuauguguaugccaauuuugugcggcggaaaaucu

SEQ ID NO: 4239876 - RNA, 90 nt, Mycobacterium leprae
ggacgaaacuccuugaccagagcgucgauaacaucacugugugcuauugcggcgagugagcgaugcuuuucaacccggucaggaugaucc

SEQ ID NO: 4239877 - RNA, 81 nt, Mycobacterium leprae
cacccagcccaguaccgcgaauagccggguacggagcccaaaguauucgaguacccgaucgucggcuaccagcugcaggug

SEQ ID NO: 4239878 - RNA, 71 nt, Mycobacterium leprae
ggccaucgugguuacaaugcacucguagccgcucaauggcagagagcgagugcuugaccagaagcgaugcu

SEQ ID NO: 4239879 - RNA, 57 nt, Mycobacterium leprae
gcuacuagcgugaguaauggccugcugaaaacgcacaggauuacgcauguuagucgc

SEQ ID NO: 4239880 - RNA, 59 nt, Mycobacterium leprae
gccauggcuucuaccgcagaugugacgcacugaauuuugcccgguggaacaguccaggc

SEQ ID NO: 4239881 - RNA, 130 nt, Mycobacterium leprae
aucgccgugaugucgucgagcgcagucacaagcagcuuggcaucgguuuucauugauuuauugcaguuuucgauggugugacugguccgagcuguuauguguuguaaugcuugaccguggucacgguggu

SEQ ID NO: 4239882 - RNA, 70 nt, Mycobacterium leprae
ucaccgcagaucacucgguccaucggcaccgacuuuuccauaucgcccuugaccucggugaucgcgguga

SEQ ID NO: 4239883 - RNA, 85 nt, Mycobacterium leprae
gacuggugccuuaagcugguuuugguccuggggcaggaagcguucgguuggcuugcccgggaucggcgcccaccuuggcccaguu

SEQ ID NO: 4239884 - RNA, 61 nt, Mycobacterium leprae
ucgauggcauuucagcacauagcggaauacgaaaucgccgucgcuaguuggaugcagucga

SEQ ID NO: 4239885 - RNA, 130 nt, Mycobacterium leprae
ggccaggcgggccguacuggccaggcgggccguacuggccaggcgggccguacuggccaggcgggccguacuggccaggcgggccguacuggccaggcgggccguacuggccaggcgagccguacuggcc

SEQ ID NO: 4239886 - RNA, 66 nt, Mycobacterium leprae
gucguggucuuugucgucuucagcggacuccugcaggcguuuuauuggauccggcaaggcggcgac

SEQ ID NO: 4239887 - RNA, 69 nt, Mycobacterium leprae
cggccaauucuuccgcuauguuguugagcugcacuaucaucaccaccgacgcggugggggagcuggccg

SEQ ID NO: 4239888 - RNA, 58 nt, Mycobacterium leprae
gugcgugggguguugauggcgaccaauuucuuuggugucaacacuauccccauugcgc

SEQ ID NO: 4239889 - RNA, 63 nt, Mycobacterium leprae
ucauccuggaaaacgaaauguucucaucauguucuccuagaacagcuuucauagccgggguga

SEQ ID NO: 4239890 - RNA, 84 nt, Mycobacterium leprae
gcggucgacuuccucaucggcgaugcguugaccggcuaugaucgcucgggcagucucgucuucgguuaacgcguccuggaucgc

SEQ ID NO: 4239891 - RNA, 85 nt, Mycobacterium leprae
gggaaauaccgucgggcuugauguacgaaggucgaccgcagacuucgucgcgugcucaaccuuugacauaaaucgauuguuuccu

SEQ ID NO: 4239892 - RNA, 95 nt, Mycobacterium leprae
gcacgucguuucucgguuguccgaugccaagcaaguuucacuugccgggagaaagucagcuugcuuggcuuggccgaggcgaggaaauucugugc

SEQ ID NO: 4239893 - RNA, 64 nt, Mycobacterium leprae
ucggucggugguggugcaaagguuugaugucggaggcacucaaccagauugcucaccacgccga

SEQ ID NO: 4239894 - RNA, 55 nt, Mycobacterium leprae
ggcuucgcugugcuugcgaccgccgcuaaacuggcugcgugcugauagcgacgcc

SEQ ID NO: 4239895 - RNA, 68 nt, Mycobacterium leprae
gguaggccggucccggaacuguggacgauggcgcaauaccaucgcuaugaguucggacuggcccugcc

SEQ ID NO: 4239896 - RNA, 61 nt, Mycobacterium leprae
gcuggccacggugauuggugaggucaccgacggcgaccgacuacggaucaccuggcacggc

SEQ ID NO: 4239897 - RNA, 67 nt, Mycobacterium leprae
aguguucgaguugcucucaauagcaucuugaugccguccaugaugcuguucccagcggccgagcccu

SEQ ID NO: 4239898 - RNA, 55 nt, Mycobacterium leprae
gcccgagcagggugcggguaugacucguucauuucaacccgcaacugcuugcggu

SEQ ID NO: 4239899 - RNA, 66 nt, Mycobacterium leprae
gcucgccgaauucaucggccuggaugaggucaaaaaccaggugucacggcugaagaguucgguggc

SEQ ID NO: 4239900 - RNA, 63 nt, Mycobacterium leprae
cauuugcucagucacaacuucguccagcaggcacugcuggcggcguuguugcuggggcuggug

SEQ ID NO: 4239901 - RNA, 73 nt, Mycobacterium leprae
ucguccuuaagaaucggcuugcgacggaacacauucguauucagugcgccguugcaguaguucuuagcagcga

SEQ ID NO: 4239902 - RNA, 95 nt, Mycobacterium leprae
gaugacggcggcggugaugcguguugugcgguucgaccguuacggaggucguagcguguuauaauuagccaacgucuauaugccgcugcacaguc

SEQ ID NO: 4239903 - RNA, 67 nt, Mycobacterium leprae
ggucaccgcggcgauucugguguucaucuucgcuuggaaugaucugcugcuagcauugucguugacc

SEQ ID NO: 4239904 - RNA, 55 nt, Mycobacterium leprae
ugcucgaugccgcgcggaaagauaagagcuaauuugguccgcgcugcugcgagcg

SEQ ID NO: 4239905 - RNA, 74 nt, Mycobacterium leprae
gguggcaucgguggggcggcugucuugggcgacugcguaccguccaggacguucaucgcauccaccgggcugcu

SEQ ID NO: 4239906 - RNA, 114 nt, Mycobacterium leprae
cucugaccguugaugcugucgcggcccucggucuuggcgccgguaaaauucgccagcacguuggcuagaccggcguccggauugaggauggacgcgacaucguaaaugucggag

SEQ ID NO: 4239907 - RNA, 121 nt, Mycobacterium leprae
ugggcgaacugcagacuugagaguaaguggccaccacgugguagacacacggacucagcgcugaguccugugccucugcugucgucggauuccuaagacuuucaccagcgcggugaguucg

SEQ ID NO: 4239908 - RNA, 62 nt, Mycobacterium leprae
cggucgaggcgugugcucagcguuccggcuaaucggucggcacuugacagcaugcuugacug

SEQ ID NO: 4239909 - RNA, 80 nt, Mycobacterium leprae
gaguucuaucccgauggcgcgucuucggugcgguuggugaaccaaaccggcuaccucugaagcgugucggaacgauccuc

SEQ ID NO: 4239910 - RNA, 113 nt, Mycobacterium leprae
gcuggucgagauggacgguuuuggcgaucgggcgggcgucaucuugaucgcggcaaccaaccggccugacaucuuggaccccgcgcuucuaaggcccgggcguuucgaccggc

SEQ ID NO: 4239911 - RNA, 64 nt, Mycobacterium leprae
ugugcgagaaauccgacagcgauaacugucaugcugacaguuaucgcugucggauuucuguaua

SEQ ID NO: 4239912 - RNA, 62 nt, Mycobacterium leprae
cuugcgaaccgugccgccgaaacaaaggcuaccgaugcuccaucgcggacauggucugcaag

SEQ ID NO: 4239913 - RNA, 89 nt, Mycobacterium leprae
cugcgucaucgaucgaggccgacgugcgcggucugcaaggugacaagaaaguccgcagugugcgggucggccaauugaucgccgagcgg

SEQ ID NO: 4239914 - RNA, 69 nt, Mycobacterium leprae
guaggggucgugugcuugcaggcagcggcgguacugggccggcccucuccugaggacaucgaccccaac

SEQ ID NO: 4239915 - RNA, 62 nt, Mycobacterium leprae
guaacacuucggccggcacugcugcccuguucauuagcagcaaguccggucccaaguguuau

SEQ ID NO: 4239916 - RNA, 61 nt, Mycobacterium leprae
ugaccuguucagcggugcgaauaaccgcuauaucccggugcgucgaccgccgagcagcuca

SEQ ID NO: 4239917 - RNA, 59 nt, Mycobacterium leprae
guaguggggagcuuggccaagagucggcugugucgacggggcucaaacuucugcgcugc

SEQ ID NO: 4239918 - RNA, 55 nt, Mycobacterium leprae
gaccacggugcuguuagucggauacucgauaucgacacugcagagcaccgugguu

SEQ ID NO: 4239919 - RNA, 95 nt, Mycobacterium leprae
gaucugcaucguuaccucgauggaauuccgcccuacccguaagaucuucuucuauccagagcugcuggaauuccucgagguauuguugacggauc

SEQ ID NO: 4239920 - RNA, 63 nt, Mycobacterium leprae
gccaugugcugaguacaacgcagucguccgcuacgcgggacgacugcguuguacucagcaggc

SEQ ID NO: 4239921 - RNA, 61 nt, Mycobacterium leprae
cgcacaccuuggccgcaucggugucggcuacuugcucgauuaccgggcucgcuggguggug

SEQ ID NO: 4239922 - RNA, 62 nt, Mycobacterium leprae
ggcugccaccagguacggucgucgucgugacugcgguuucggcgauguccugguggcaaguc

SEQ ID NO: 4239923 - RNA, 63 nt, Mycobacterium leprae
cgggcggugaccuucccgcgcagcagggucgcagucacaguggcgggcagggucaucgccucg

SEQ ID NO: 4239924 - RNA, 69 nt, Mycobacterium leprae
gcgggccuucugagugauccgcacgauggcguccucgacgucacgcggcgcagucaucaucaggucagc

SEQ ID NO: 4239925 - RNA, 68 nt, Mycobacterium leprae
ggugcagugccgccgaucgguauugggcgguguugcgcggcgccgguacucggaauggcggcagcgcc

SEQ ID NO: 4239926 - RNA, 70 nt, Mycobacterium leprae
gaucaggccgcaaaacagacacggccgccaguagcgccuguugacggccgugccuguuugccgcucuauu

SEQ ID NO: 4239927 - RNA, 57 nt, Mycobacterium leprae
guccuggggaauguggcuugacgcgaugucgauggcuucgggugccguuucccggac

SEQ ID NO: 4239928 - RNA, 58 nt, Mycobacterium leprae
caccaacagccgcaccuagaugucacacccugccuccauuucggccaggauguuggug

SEQ ID NO: 4239929 - RNA, 68 nt, Mycobacterium leprae
cgcugaucaugucgguuuugguaacuuucucggugccauccgagaaaugcccgcagaagccgacggcg

SEQ ID NO: 4239930 - RNA, 70 nt, Mycobacterium leprae
ggcgacacaguucgacuccacggccgacauucgaugaugaagucgacgucgaucucgauauuguguugcc

SEQ ID NO: 4239931 - RNA, 55 nt, Mycobacterium leprae
ugacgucagcuaccguccuggucgcaauugggugccgcggugcuuagagacgucg

SEQ ID NO: 4239932 - RNA, 65 nt, Mycobacterium leprae
cggggcggccauucugcacgcgaugcuggaacuuccgcuauaucgaacgcugguggcugcucgcg

SEQ ID NO: 4239933 - RNA, 69 nt, Mycobacterium leprae
cugguccgugacgucaccgaggugaagcgccgugaucgugcgcugaucucuaaggacgccacgauccgg

SEQ ID NO: 4239934 - RNA, 112 nt, Mycobacterium leprae
cacgcagcccguggugaggcauugcgcucugcacuggaccgacuggcggcugaguuaucgcaguggucgugugcggucgucgcagaucggcgucgcuuugugggcuggcgug

SEQ ID NO: 4239935 - RNA, 129 nt, Mycobacterium leprae
ugcuggucgauggugcggucgcugaucggagcguugcuggcugugggugaucaccgacgcaccaucggcugguguggugaguugcucacaaaggcaagccgguccagcgacuucacaacugcgccggca

SEQ ID NO: 4239936 - RNA, 76 nt, Mycobacterium leprae
agccgccgacgucuggcugcuacuguccauacccgcugauuggucgaacgcagaagcagccgguaugucagugguu

SEQ ID NO: 4239937 - RNA, 86 nt, Mycobacterium leprae
ucgaccagugcggcggugaggauggccgagucuaucaggcuagcgagacuggggauacugcucacgcgccccgauccacugguaga

SEQ ID NO: 4239938 - RNA, 61 nt, Mycobacterium leprae
guugggccgcgucgaguucgaucuguccgguggacggaucaauaccgacgcgauggacaac

SEQ ID NO: 4239939 - RNA, 64 nt, Mycobacterium leprae
gcggcguggauguguugcuggcgauguccggcuucuucuucggcggcaaaauccuucgcgccgc

SEQ ID NO: 4239940 - RNA, 118 nt, Mycobacterium leprae
gcguuucuggaagcguccugcgacggugauaucgccacguuguuggaucugcgggcacccgagguggugcggacagucaaucgcgugcugguucccgucggggugcugaccgagaugc

SEQ ID NO: 4239941 - RNA, 124 nt, Mycobacterium leprae
cagcaucugcgcugcagaucacaaccgggaucaccuagucguaaacgucuugcuuuacgcggcggcgcgguuacuacuggugauucuacucggcagcgugauuuacgggguggcgcgauuguug

SEQ ID NO: 4239942 - RNA, 73 nt, Mycobacterium leprae
aaugcaaaacagcgggaaugaugcccgccgcaccguuagucggagcggugaccacucuuccgcccacggcauu

SEQ ID NO: 4239943 - RNA, 67 nt, Mycobacterium leprae
gcgggcguugaucgauaguacgucgguuaccagccagucacugccgcgcuugaucaaugucacccgc

SEQ ID NO: 4239944 - RNA, 62 nt, Mycobacterium leprae
gcgccgguggucacgccuaccccguugcaacuuagcgaucgguugucggcgaucacuggugc

SEQ ID NO: 4239945 - RNA, 97 nt, Mycobacterium leprae
ggccacggacuggugcuaucgucgauucuguuguggacgggagugagccugaugcucauugcuugguuacgacugggucgacguguucuagcaggcc

SEQ ID NO: 4239946 - RNA, 61 nt, Mycobacterium leprae
ggggcaacacagugacccauuccaaacugcaaggaacaaaccugguccaguuacuggcccc

SEQ ID NO: 4239947 - RNA, 67 nt, Mycobacterium leprae
gcagcgaaacgcgcgacgauuguuuccggcacgaucagcaagaacaaugcgaucagcguuccgcagc

SEQ ID NO: 4239948 - RNA, 71 nt, Mycobacterium leprae
gcgaacgagugguggucgccaaugccgaucaacugcugaucgugguggcguuggcggacccaccgccacgc

SEQ ID NO: 4239949 - RNA, 55 nt, Mycobacterium leprae
gauguugcucaccgcuaucguggaaacguggucaccguauaguggugcgcggauc

SEQ ID NO: 4239950 - RNA, 57 nt, Mycobacterium leprae
cggacucgaaacaaugcggccccgauauuauuaucaaggucgcacuguuccgagcug

SEQ ID NO: 4239951 - RNA, 67 nt, Mycobacterium leprae
aucaaccaagcgacgauuagugcagaccgggaaguaaaauagguguaaggauggcgcucugguuggu

SEQ ID NO: 4239952 - RNA, 78 nt, Mycobacterium leprae
ccuugacgccgcacaccaucaugcggauuuggggagugguucaucagaucggcacaguggugaugcucaccggcaggg

SEQ ID NO: 4239953 - RNA, 64 nt, Mycobacterium leprae
ccgaaucguuuacccggcgguagcuguucucgccgcucgcagcaccgcauuggucaacgugugg

SEQ ID NO: 4239954 - RNA, 62 nt, Mycobacterium leprae
gccaggaccaguugggaucgucggguuucucggugagaacccgaauuugcagcagguccggc

SEQ ID NO: 4239955 - RNA, 60 nt, Mycobacterium leprae
ugcugaugauuggcauggcagugaaggugagagaucuucgccgccgggccugucgcagca

SEQ ID NO: 4239956 - RNA, 79 nt, Mycobacterium leprae
ugcgcgucuguagcaguagggaucagugccacgucgucguccgccuugacgacgacguggcggucaccacagcgcagca

SEQ ID NO: 4239957 - RNA, 72 nt, Mycobacterium leprae
guggccagcacaguuaaggucguguagaggcagcgccgccgccacuccgccgucuuuggcuguguugaccac

SEQ ID NO: 4239958 - RNA, 60 nt, Mycobacterium leprae
ggcuggauccgaagugucgacgcugcucggucguaugccgucggcgguaggguaccagcc

SEQ ID NO: 4239959 - RNA, 77 nt, Mycobacterium leprae
caugcugaagugguggcgcugcgcagcgccggcguuacagcggccggugccauugcaguggucacccuugagccgug

SEQ ID NO: 4239960 - RNA, 56 nt, Mycobacterium leprae
gguagacaucgacgcgcacaucgccuucgggaaugucgaugugaucggugaucucc

SEQ ID NO: 4239961 - RNA, 70 nt, Mycobacterium leprae
guaauuaggucgaugguggugacucgcuagcccggcuuuaccgcgcuugcgcucaucacuagcuccuugc

SEQ ID NO: 4239962 - RNA, 55 nt, Mycobacterium leprae
uccggccgacaguggcaagauccggggccagcgauuuagccgauugccggccgga

SEQ ID NO: 4239963 - RNA, 55 nt, Mycobacterium leprae
cgaucgcgcgaugaguuucgggaguuaccugcuccacgagucaacggcguggucg

SEQ ID NO: 4239964 - RNA, 59 nt, Mycobacterium leprae
gcagcgagauugcgcaagaacgcccuggcuucgggguuacuucgcgacaucuugcuagc

SEQ ID NO: 4239965 - RNA, 60 nt, Mycobacterium leprae
cgggucgacguuguugggccuuaauccgaagguuugguaaggccgcggugaugucgucug

SEQ ID NO: 4239966 - RNA, 81 nt, Mycobacterium leprae
cucgucgccagagagcugauacggcgcggcgaauuugacaagaucgacaucgguguaaugaucagccaccuaaccgacgag

SEQ ID NO: 4239967 - RNA, 82 nt, Mycobacterium leprae
ggcuagucgagcagcagcacggaugcgucugauccgagcgcucgagccaggcccagucgcugcugcugucccaaugacagcc

SEQ ID NO: 4239968 - RNA, 80 nt, Mycobacterium leprae
ggcaccguuaacaucagcgacuguacgucgucggugucgguaacgaccucggcgaucuguaguccaaguacauggcugcc

SEQ ID NO: 4239969 - RNA, 55 nt, Mycobacterium leprae
ggaagaauggcuaccacgucgaucaugugcucacgauggugcgccagcuuuuucc

SEQ ID NO: 4239970 - RNA, 79 nt, Mycobacterium leprae
uguugucuccgaccgcugugccaaugaaggugugccaaugaaggguugugcgucaugggacugcgguucggugaggaca

SEQ ID NO: 4239971 - RNA, 103 nt, Mycobacterium leprae
gucgcggucauauacgcccgcaacaaguuggcgguggcucgccggguguaccggccugcugaugggucaugcgcuaauuguggcgggugguagcgaccgugac

SEQ ID NO: 4239972 - RNA, 63 nt, Mycobacterium leprae
aggguacggccgguagacccgcuggcugcccagcggagccgugaucuccccggaccgcaccuu

SEQ ID NO: 4239973 - RNA, 58 nt, Mycobacterium leprae
gcgaguauggauacugcgacgcgauacguccgugacccgucgcaguauccauacccgc

SEQ ID NO: 4239974 - RNA, 94 nt, Mycobacterium leprae
uaacauccccgcguugucggcuuccuugucggcgcggaucacauggaccacuucguuuaucaacgccagacgggugaacgccuccggggaguug

SEQ ID NO: 4239975 - RNA, 57 nt, Mycobacterium leprae
gguggcugcugugguaccaccccggaccacauccgggaaguggccgcagcgguagcc

SEQ ID NO: 4239976 - RNA, 83 nt, Mycobacterium leprae
cgcugacgucauuaaacaugcugucgagcagaacacgcaggccccggcggugcgcuucggcgagcaguuagucgaagucggcg

SEQ ID NO: 4239977 - RNA, 70 nt, Mycobacterium leprae
gguguggauuggguuccuggcgaaauacuauaaucgaaguacaaguaucgcggaaaucaaucgcgcagcc

SEQ ID NO: 4239978 - RNA, 68 nt, Mycobacterium leprae
ggucgacgauacgaaaccggucccugcgggguuagcaagguaacccgcaguccuuucggaucguuacc

SEQ ID NO: 4239979 - RNA, 74 nt, Mycobacterium leprae
guuggacaccgaggcgaugcuggauucucaggcuuccaacgaucagcuagagaagguguugucuuacauacaau

SEQ ID NO: 4239980 - RNA, 59 nt, Mycobacterium leprae
agcggucgacuucaucgacgguguuguacacggcaaacgacgcccgcgcaguggccgcu

SEQ ID NO: 4239981 - RNA, 65 nt, Mycobacterium leprae
ggcuucugugguuggaauuuggugacgcaacagcguaucgcuaccuauccgcagaaaaacaugcc

SEQ ID NO: 4239982 - RNA, 62 nt, Mycobacterium leprae
gagaacaccgucuugaucucgucggcggaguacuccaccaacgccaucagacggauguacuc

SEQ ID NO: 4239983 - RNA, 78 nt, Mycobacterium leprae
gguuucugagaucgaucacgucgugcuggugggcgguucgacccggaugccugcggugaccgaucuugucaaggaacu

SEQ ID NO: 4239984 - RNA, 85 nt, Mycobacterium leprae
ccgauuuguccagcuugcgugucguguucguaucuggaucgcaacugggugccgaacuagccacacgcgcgcucgaggaacucgg

SEQ ID NO: 4239985 - RNA, 67 nt, Mycobacterium leprae
gcagcaugucgaucggaauccgaugcucggugaauaaccggcacccgacgucguggucgacaguggc

SEQ ID NO: 4239986 - RNA, 64 nt, Mycobacterium leprae
cguugggauaggcguuuugcagguauucucuauagauuuucuuugcaaaacgucaaucucgacg

SEQ ID NO: 4239987 - RNA, 65 nt, Mycobacterium leprae
cugguccccgccguagacggugauaccguucagcacggugucuuccuaucacgguguuggacgag

SEQ ID NO: 4239988 - RNA, 69 nt, Mycobacterium leprae
agaggccaccgccggcgaagccggggaaauuuacucgcugauuaacuuguucuccgguggugcgcugcu

SEQ ID NO: 4239989 - RNA, 85 nt, Mycobacterium leprae
ucguuagguugccgcaucguuguugugauaaccgcauagauugugauuugguggacuucaccgacaaagugcgucgcaaccccga

SEQ ID NO: 4239990 - RNA, 63 nt, Mycobacterium leprae
cggcgcuugcggcguucuggguaagccacuucucauacggcgugacccgcucugccagcgccg

SEQ ID NO: 4239991 - RNA, 84 nt, Mycobacterium leprae
uccgccgucaguucuuggccgaccucguacucagccgccgcguccgggugguccagacguaguucagccaaguaacgacgcggg

SEQ ID NO: 4239992 - RNA, 61 nt, Mycobacterium leprae
ugcuucgucaaggcgugaggcaacgaacccgcucgguaacguugcccgucugaucggggua

SEQ ID NO: 4239993 - RNA, 67 nt, Mycobacterium leprae
uccacaggacaauggcaaacgccggaucgugacgcagaacugaccggcugacagugucgcugcugga

SEQ ID NO: 4239994 - RNA, 73 nt, Mycobacterium leprae
ucugcgaacaccaauaccgcgucugaguccugcaguauccagcguaccugcuuggcugacgagguuucguaga

SEQ ID NO: 4239995 - RNA, 66 nt, Mycobacterium leprae
cgcgccgcgauccgguucgccauguuggcugcaguagccggcguuggcuuccugaucgcggccgcg

SEQ ID NO: 4239996 - RNA, 55 nt, Mycobacterium leprae
gguagauugccugcgcgucgugcacggcaucggugaccagcgccagcaaucuacu

SEQ ID NO: 4239997 - RNA, 65 nt, Mycobacterium leprae
gucguugcugggcaagacccgaugagcgaggacuacuuggaucgggauguuuccccggcgcugac

SEQ ID NO: 4239998 - RNA, 56 nt, Mycobacterium leprae
aagcucugaccauggcacgcgagauaggugacucugcuguuuuggcucgggcgcuu

SEQ ID NO: 4239999 - RNA, 98 nt, Mycobacterium leprae
gaacuacuccaggccgggcuccgguucgcuaucgugcgggccacggcaaucaacggaucccgcgacgucguaaucgaagucaaguucugcagagguuc

SEQ ID NO: 4240000 - RNA, 61 nt, Mycobacterium leprae
ggaucgagcggagcugggcgaaaacauucaggaugcugucgcggagcuccgcgucgaugcc

SEQ ID NO: 4240001 - RNA, 79 nt, Mycobacterium leprae
cuguguucgaccagacgaguggucaguuugccggugucugcacccaggucgggaaccuugcacgcuccugucggcacag

SEQ ID NO: 4240002 - RNA, 56 nt, Mycobacterium leprae
gcccgagcuacggcugccggaauaggccgacuugauccgguuguuaugucucgggc

SEQ ID NO: 4240003 - RNA, 55 nt, Mycobacterium leprae
ucgggguugacgcugguaucgcugaacgacguggugccguucgaugaggccccgg

SEQ ID NO: 4240004 - RNA, 107 nt, Mycobacterium leprae
gcucagacaacuccaggaacgggccguggcgaugucggucggucggccccggaugcaccaucaccgccaccgcgacaucgucgcaccuccuggccugcaacaugagc

SEQ ID NO: 4240005 - RNA, 111 nt, Mycobacterium leprae
gcgguucacucggugccgguagguuuugcgauucgcugacguggacgugcuggugcgugucgcgccaagcugcuccggucggugcugguaccugcugacgcuucuguucgc

SEQ ID NO: 4240006 - RNA, 72 nt, Mycobacterium leprae
uuccugcccgggguggucgaccggcauguucgcgguuccaaacccagcaucgaucgucgccacccgcaggga

SEQ ID NO: 4240007 - RNA, 57 nt, Mycobacterium leprae
cgguacgguuauaucuugcaucggcuaaccaugauccacaaagauuuaacuguaccg

SEQ ID NO: 4240008 - RNA, 83 nt, Mycobacterium leprae
accuugauagccauccuggugagcuuucuucaugccuuggaacuccacgaagaaaccgcuggccuauggccauugcucagggu

SEQ ID NO: 4240009 - RNA, 104 nt, Mycobacterium leprae
ggcaccgcuggaucgcaggcuuuugcucggcaugcucgccgaacuaccagccggagucggugucgaagcagccgaggcgucggcggcgcugaucuggcggcgcc

SEQ ID NO: 4240010 - RNA, 68 nt, Mycobacterium leprae
gcgccggucauaucgcuguuggcgaucagcagcuggagcagggugaucgcagcgauuauggccagugc

SEQ ID NO: 4240011 - RNA, 61 nt, Mycobacterium leprae
gucgagaucgacguuuugcaaggcuguucucaaacuugcucggcaaaacguugaucucgac

SEQ ID NO: 4240012 - RNA, 77 nt, Mycobacterium leprae
cacgucugacagucugacauagccuaccggcgucaguaugcuuaagacccgcugcaggcgguuaggcuccagauaug

SEQ ID NO: 4240013 - RNA, 61 nt, Mycobacterium leprae
guugagcugauccagguaggcaccgaucacgaggguuugcucgccggggugucggcucagc

SEQ ID NO: 4240014 - RNA, 79 nt, Mycobacterium leprae
ggcgcgcacuaucggcgagcgguuucgagauggcaccccgguuaucaucgauuuggugucgauggacaaugcugacgcu

SEQ ID NO: 4240015 - RNA, 71 nt, Mycobacterium leprae
cgagccugaccuagugguggucccggugggcggcgguggcugcaucgccggcaugaccacuuacuuggccg

SEQ ID NO: 4240016 - RNA, 56 nt, Mycobacterium leprae
gcgcugaucugggugaggauaucgauacaauacuuguccucaucaaucauacgcgc

SEQ ID NO: 4240017 - RNA, 67 nt, Mycobacterium leprae
ucccuucuggucguuucauugcagcggucaucgugaucgguggcaugcagcuauuggcgaccaugga

SEQ ID NO: 4240018 - RNA, 79 nt, Mycobacterium leprae
gccgucagccaggucagcuccauccuggccggcgacgcucgucguggccuagacccgagccuggccuagcuguacgcgc

SEQ ID NO: 4240019 - RNA, 91 nt, Mycobacterium leprae
gauguacugugguaauggcaagccuacggaauugggcggcaacaacuugcccgccaaguugcucgagggcuuagugcguaccagcaacauc

SEQ ID NO: 4240020 - RNA, 121 nt, Mycobacterium leprae
agauaucgacccgacgcucaaggcgcugcucgacguauucccgccgaccuuaaacgucgccgacggcaucgaagucgcacgcgcgaaacucaagcaguucgaagcaccuccggagauguuu

SEQ ID NO: 4240021 - RNA, 61 nt, Mycobacterium leprae
ugguccagcgucagcgcagccaucgcgcaugccgucgggguucgcgccgacaguuggacca

SEQ ID NO: 4240022 - RNA, 86 nt, Mycobacterium leprae
ggccgcaucacccuggaucgggaucuggugcucuauacuguucugcggcucagauuagcgccgguucugguucaugugggacggcc

SEQ ID NO: 4240023 - RNA, 130 nt, Mycobacterium leprae
gggaugagcacgucgaugccauugucauccagggucugcuugaucugaugcagcccggcccgcagcuugucggggugcacgugggcagugcccagcaugguuccgccuuuggcuaacagacggucauucc

SEQ ID NO: 4240024 - RNA, 64 nt, Mycobacterium leprae
ucggcauuggugguucagaccuggguccaguuaugguuuaccaggcacugcgccacuaugccga

SEQ ID NO: 4240025 - RNA, 70 nt, Mycobacterium leprae
cgcguugggucauugcugccgccgggugggaccggcggguguacgcggcgguggcguugcacccgacgcg

SEQ ID NO: 4240026 - RNA, 65 nt, Mycobacterium leprae
aucaccucgaccauguggaccgggaugcggauggugcgggcuugguccgccauggcgcgggugau

SEQ ID NO: 4240027 - RNA, 58 nt, Mycobacterium leprae
uggaaacgccgugguugaaguccuuugcgcaacacagucgcuucgccgaggcguuccg

SEQ ID NO: 4240028 - RNA, 59 nt, Mycobacterium leprae
gcaccggccggucaaacgcaccgacgagacagaaacggugcuuggccgcaauccggugc

SEQ ID NO: 4240029 - RNA, 65 nt, Mycobacterium leprae
cgugguuggcggugagcuugccguggugggcaccaacgcccaccacggccucggcgccugcuucg

SEQ ID NO: 4240030 - RNA, 57 nt, Mycobacterium leprae
aguccgaagagcagaagcagcgcuggcuuccggugaacugcucggcugcuucggguu

SEQ ID NO: 4240031 - RNA, 84 nt, Mycobacterium leprae
cggacggccuggcgcagucuaaggugguucugccggcuccagcuucgucccccgauccgcucucggauucguccagguuguccg

SEQ ID NO: 4240032 - RNA, 59 nt, Mycobacterium leprae
gccaaugucgauaccgcgcagugcggcugcgucucgcacugcaccauugacgauuaggc

SEQ ID NO: 4240033 - RNA, 60 nt, Mycobacterium leprae
ggcuucggcagcaugccgaucguaucaccaaccgauacggucgcgaugauugccgcagcc

SEQ ID NO: 4240034 - RNA, 82 nt, Mycobacterium leprae
gcacgucgaaaaauguuuuauuuaacuagacauccaggaaacgaacauccuuggcauuacgggugauaaagcuacggcgugc

SEQ ID NO: 4240035 - RNA, 57 nt, Mycobacterium leprae
guugucagugacgucagggccggugacaaucaucgcgcaggccuggucuuugacaau

SEQ ID NO: 4240036 - RNA, 78 nt, Mycobacterium leprae
gguggcggcgauggcugacgcgaccguggcccgcgugauucggguuagucgcgguaguuauagccauccggggucacc

SEQ ID NO: 4240037 - RNA, 100 nt, Mycobacterium leprae
cgcuggcagugacggcaucauccaguuuuccaccgguggugcggaguucgccuccgggcucggcgugaaggacauggugacgggugcgguagcgcuagcg

SEQ ID NO: 4240038 - RNA, 66 nt, Mycobacterium leprae
cgcuaacuggcguggauucgguuccgugcgauuucgcgugggcuauuuaggccaggaugauuagcg

SEQ ID NO: 4240039 - RNA, 83 nt, Mycobacterium leprae
uucaacggcuugcggguauggauacugcgacgggucacggacguaucgcgucgcaguauccauacucgcgaggaaccgaggaa

SEQ ID NO: 4240040 - RNA, 74 nt, Mycobacterium leprae
gcgggcacagccgggccucuuguucaccaacuugccguucccgcugagugacagcagugcaccgcugugcaagc

SEQ ID NO: 4240041 - RNA, 83 nt, Mycobacterium leprae
gggugugcacacaucggaaucaaggguccggcagcauucagcugcuagucaguugauuccgguuugaaucuugugaaauaccc

SEQ ID NO: 4240042 - RNA, 129 nt, Mycobacterium leprae
gaggaguucggcagcgucuccgcgacgacuuugccguugguggccaggcugucggcggacggguuauuggugggauguccggugacggguuggccaccgcggaugcggugucgcuguacgcuauugcuc

SEQ ID NO: 4240043 - RNA, 122 nt, Mycobacterium leprae
ucccgucguucgcugcacucacagcggaauguucccgugcuucuuggggggaaggugugcgaucuugcgcuccaacaggugaagcgccguggcaauguagccgcgagugugugacggcggga

SEQ ID NO: 4240044 - RNA, 78 nt, Mycobacterium leprae
cccgaucaguggucggccuggccccccacugcggaacaacaaugcgccuuccccgcgcuacgccaccaaugauccggg

SEQ ID NO: 4240045 - RNA, 84 nt, Mycobacterium leprae
ggucuguauaggcgcugcguagccauucgaugaacggaaccaaccgggcgaucucggugucuacgucaacgcccugaccaggcc

SEQ ID NO: 4240046 - RNA, 59 nt, Mycobacterium leprae
cgauauugccuucaggauuguauuaucccuaagcuacuacaauccagacggcaaucucg

SEQ ID NO: 4240047 - RNA, 65 nt, Mycobacterium leprae
uccagugugagcggcgaucagcaguaacgcagcgcuguugcugaccgccgcucaagucaccuggg

SEQ ID NO: 4240048 - RNA, 72 nt, Mycobacterium leprae
gcuauugaugggagcuauugaugcgccgagucgaaaccucacacucuagguguucaaugcuccccuccgagc

SEQ ID NO: 4240049 - RNA, 55 nt, Mycobacterium leprae
ucgccgacacugcugauggauccggcgauaccggccucgugcagcgccucgguga

SEQ ID NO: 4240050 - RNA, 78 nt, Mycobacterium leprae
gcgggcuagggcagcgucaucguccucggugacaacuggaucaucgagagcuacugacgcuucaucguagcggccugc

SEQ ID NO: 4240051 - RNA, 96 nt, Mycobacterium leprae
uugccuauauucccggcuaucgcauucuggucucgcgugccaagcgguccugcugcuggagacaccguaaccggaguagugcugcuggguaggcag

SEQ ID NO: 4240052 - RNA, 61 nt, Mycobacterium leprae
gucgaacgugaagcgccuggccgcacacucguucucgcaucgcggccagcuucacguucgc

SEQ ID NO: 4240053 - RNA, 55 nt, Mycobacterium leprae
gcucggcgcccgcuccggccaacugacuacucggcgggccgagcgaacgucgagc

SEQ ID NO: 4240054 - RNA, 71 nt, Mycobacterium leprae
guagcugccaacgguauuucggcgcgaggauaucuggaucuaaacguugacgcugaucguugcgcuguugc

SEQ ID NO: 4240055 - RNA, 67 nt, Mycobacterium leprae
augguugguggucuggcaggcacguuguuggcagauuugcuggcagccccggaaccgcccagcacau

SEQ ID NO: 4240056 - RNA, 83 nt, Mycobacterium leprae
gccgcgaccagugaggcgaugaaggcgcugacggcacggcuggaggccgcgcaugcugccgcguuuccaugccucguugcggu

SEQ ID NO: 4240057 - RNA, 63 nt, Mycobacterium leprae
ggauuggugauguagccgaugucgaucugaacagucggcauucgcgucaaucgcagcaaaucc

SEQ ID NO: 4240058 - RNA, 62 nt, Mycobacterium leprae
ccgggucuggcgucgacguaauaguauaccauuacuuccuguuacgucgaucgcuagcccgg

SEQ ID NO: 4240059 - RNA, 87 nt, Mycobacterium leprae
gguaacaagaucccggacacgcuugcuucccucgauuggcaucagcucacgugccaaucggaagcgggcugcaccaauccggcuacc

SEQ ID NO: 4240060 - RNA, 90 nt, Mycobacterium leprae
cggugcgguugcgggugcugacugaugcgggucgguuguccauaccguucaccaccggucugcuggucggcaucggcgagacguuggccg

SEQ ID NO: 4240061 - RNA, 61 nt, Mycobacterium leprae
gaucaagcuccgaagugauugaugcaguuuaguucugcauaauccugcuuagagcgcgauc

SEQ ID NO: 4240062 - RNA, 75 nt, Mycobacterium leprae
gucgaugcgauucgggccggugacguggauauggugaucaacacgcccuacggcaacuccggcccgcguaucgac

SEQ ID NO: 4240063 - RNA, 57 nt, Mycobacterium leprae
gccuucauugguaucagcgacgcugucgcccgaccacgucagcaucccggugguggc

SEQ ID NO: 4240064 - RNA, 105 nt, Mycobacterium leprae
gaaugcagaucgccauguugacugucgaggaagccacggccgagguagaacccggacgaauuggcugcuucggcggucgacucuaggguaggcauuugcgcguuc

SEQ ID NO: 4240065 - RNA, 108 nt, Mycobacterium leprae
ggcauccggggugucgauugaccuauccaccgcggcgcuggcugcagaccacgccgcgcugauugcagccgcgaccgcggugggcggugauccguggccgugggugcu

SEQ ID NO: 4240066 - RNA, 63 nt, Mycobacterium leprae
ggugcccguagcuuggguggccggcgacgaagucuauggagucgacccaagcugcgggcugcc

SEQ ID NO: 4240067 - RNA, 92 nt, Mycobacterium leprae
gcugcguuacgggaacuuggugacgacgcgacugcacggcaggucguugaacauguuuaugucgacgucgacgagaaguucugggaugcggc

SEQ ID NO: 4240068 - RNA, 55 nt, Mycobacterium leprae
ucggaaagucuuugcggucaggcgggauucccgccugaccgcaaagacuuuccga

SEQ ID NO: 4240069 - RNA, 69 nt, Mycobacterium leprae
ucggcaguugaucgucaguuuuuuugcucauaggagcauaugagcacgggaggcuggcgaauaggucga

SEQ ID NO: 4240070 - RNA, 67 nt, Mycobacterium leprae
cucguucgaugcgugcgugcaaugcguguaacacgucgacgguggugcgcgcgggcaucgucgcgag

SEQ ID NO: 4240071 - RNA, 100 nt, Mycobacterium leprae
gggcaucgcugaaguugcuguucgugccgguguuggcgugacgguguuugaaaccacugacacguuagucaccgcaggacgcaaccgcauugugaagucc

SEQ ID NO: 4240072 - RNA, 68 nt, Mycobacterium leprae
cagccgguuggcgaucucaccgcgggcggcccccagcagugcccgcgacgacuucgccgggcccgcug

SEQ ID NO: 4240073 - RNA, 72 nt, Mycobacterium leprae
ucuaagucgagaucaacguuuugccgagcaaguuugagaacagccuugcaaaacgucgaucucgacgcgaga

SEQ ID NO: 4240074 - RNA, 58 nt, Mycobacterium leprae
ccgauaccgccaugcaccugaauguugaguucggcauugcgaguguaggcggggaagg

SEQ ID NO: 4240075 - RNA, 63 nt, Mycobacterium leprae
uucaguacagcgucccggugagaaguacccucaggcagggagcucgccgugggcgggucugga

SEQ ID NO: 4240076 - RNA, 64 nt, Mycobacterium leprae
ugcccgcgucuacgguaaguggucgaagaaggcucgcagccccacugcauuguaggcgcgggua

SEQ ID NO: 4240077 - RNA, 106 nt, Mycobacterium leprae
gaccgcugauucuggucgcgcagcgugaagucggggcggugacuccgaagcccagcaucaacgcuucccgauccgcgacuucggcugaacuaaccggcuagcgcuc

SEQ ID NO: 4240078 - RNA, 78 nt, Mycobacterium leprae
ugcgggugucacuguuggcgacugccgguucggucaucgaaaagucgccgcaaaucuagucguccaacaacaccugca

SEQ ID NO: 4240079 - RNA, 75 nt, Mycobacterium leprae
cugggcgauuuccggucacuucaucaucccggauguuggcgauuugguucauggacuggccggcggucgcgacag

SEQ ID NO: 4240080 - RNA, 61 nt, Mycobacterium leprae
ggacggaauggugguggaagaagugcaacuaauugggaauucuuauaaauccauucuguuu

SEQ ID NO: 4240081 - RNA, 80 nt, Mycobacterium leprae
caucaccguuugggcgguugucgaccugcucggcaaacauguucagcagcuuggcgggcaagcaaucgcaguacgggaug

SEQ ID NO: 4240082 - RNA, 97 nt, Mycobacterium leprae
cggugggggggagaucaagccaacaccggggguggaguuccguaccugagcaauccauggguacacuuuccgccccggaaguuggcccccuucaccg

SEQ ID NO: 4240083 - RNA, 84 nt, Mycobacterium leprae
gcugaucgcucgccucagucaaacccaacgggacgugcugcagaaauugcucgaaggguccccacuggggcgcacccgcgacgc

SEQ ID NO: 4240084 - RNA, 56 nt, Mycobacterium leprae
gugaccggugagucgggucgccgcgauugacugugguaccaacucgauucgguugc

SEQ ID NO: 4240085 - RNA, 80 nt, Mycobacterium leprae
gcggacgauauuggugaugcagucgagaauuugguauucaaaaccgcauuucuggguggaguuaccuacacugucguugu

SEQ ID NO: 4240086 - RNA, 91 nt, Mycobacterium leprae
gguugaggagacgcuucguuaugauccagcaauccaucuaaucggucggguagcugcuaaggacaugacgaucggucagacaacuuuaacc

SEQ ID NO: 4240087 - RNA, 55 nt, Mycobacterium leprae
gaggaugaagucgacgagcuacugcgcagcggaacguugguugaccuuuauccuu

SEQ ID NO: 4240088 - RNA, 64 nt, Mycobacterium leprae
gacgcuggcgaauaccaggaaacuagcuuacgugagacggguuucuggcguuuugucagcgauc

SEQ ID NO: 4240089 - RNA, 87 nt, Mycobacterium leprae
cugcgcaaucuuggccgcugugcacgcgucguggucaucggcacgacacccgacgcgaccaccagcaccgacgaacgaaucgcgcag

SEQ ID NO: 4240090 - RNA, 70 nt, Mycobacterium leprae
ggaauagguucgugcacauggaaugggugcaugucgauggauccgccaaaguguucgacaccgauguucc

SEQ ID NO: 4240091 - RNA, 74 nt, Mycobacterium leprae
gugucaauggccuugaccgcaacacgaucggcuauuggguggucgguauguugucgucaccuaggcuacgaugc

SEQ ID NO: 4240092 - RNA, 122 nt, Mycobacterium leprae
cuucuucgucuuaauucgggaucauucgcgguggacacaucgacgucucagugcuugcggcugugcaagucuuggccaucggugaccucgucaacuggaugauuucggguaagauggucaag

SEQ ID NO: 4240093 - RNA, 89 nt, Mycobacterium leprae
ggcggcugggggucaaugcggcauggaaaucgcuguuggucagauggccgucaucgacugccuugccguuguugacuacugcggccacc

SEQ ID NO: 4240094 - RNA, 61 nt, Mycobacterium leprae
gucggcaaaggcaggguugggcagagcagcaccuuguacugcccgccuauccuucgccgau

SEQ ID NO: 4240095 - RNA, 61 nt, Mycobacterium leprae
gaucgcgcucuaagcaggauuaugcagaacuaaacugcaucaaucacuucggagcuugauc

SEQ ID NO: 4240096 - RNA, 97 nt, Mycobacterium leprae
gguggugaguggaacuuucguauugaccggcguuaguuucaucaagaccaacggugguccuaaauucccguuaaucgagguagucucgcucacgauc

SEQ ID NO: 4240097 - RNA, 65 nt, Mycobacterium leprae
ugggucuccgguaucaaagcccagcgucggaacauugacgaugguguuuaggugacgggggaaca

SEQ ID NO: 4240098 - RNA, 73 nt, Mycobacterium leprae
guuugcugcagugacggcacucuggauccuauaccuauccgaucccggggagauaucgucgcucgcgguggac

SEQ ID NO: 4240099 - RNA, 72 nt, Mycobacterium leprae
aggggagcucugcugguugaguuuugcguucaggacguacaccucgucaggccgaucggcggcgguucuucu

SEQ ID NO: 4240100 - RNA, 76 nt, Mycobacterium leprae
ucaccucggugggcgacaccaucgugccggaagucggugcccgaccggcucugguggucgccacccccggggcuga

SEQ ID NO: 4240101 - RNA, 72 nt, Mycobacterium leprae
gugcucgaggcaaucgaucuugacaguguggccucaaaggguuauugcuuccagaucgaucucacuuggcgc

SEQ ID NO: 4240102 - RNA, 73 nt, Mycobacterium leprae
ucugauugaggcacuaugguauuccaccacuuuaaguucgcaucggguggggaccgauauaccguuaaucaga

SEQ ID NO: 4240103 - RNA, 75 nt, Mycobacterium leprae
gccggaccaaggccgacaccauagccgccaugacgaucacggucgucauggcggcuauggugucgcugaucuggu

SEQ ID NO: 4240104 - RNA, 82 nt, Mycobacterium leprae
ccgccgcaggcugauugagcucgaugguccggaggucagcacgcugaucgccgaacaccgacucaaaccguagccugcgcgg

SEQ ID NO: 4240105 - RNA, 88 nt, Mycobacterium leprae
ucaguaugguccgcuggcugcaguuccgugccguugucccccgccgggggacaacggcacggaauuccgaucggugggcgagggcuga

SEQ ID NO: 4240106 - RNA, 96 nt, Mycobacterium leprae
gauguagauggaaccggugcggcuguuggucagugggccauuagcuucgccgguuuugaguccguggauugcggccagaccggugaacacugcauc

SEQ ID NO: 4240107 - RNA, 58 nt, Mycobacterium leprae
gcgauggugggaucgcagaagugaccgagcagaacauuucagugaaccacgccauggc

SEQ ID NO: 4240108 - RNA, 58 nt, Mycobacterium leprae
accugguuuaguucgccuuccgcgucgucagcgcuaauaccgaggcggugggccaggu

SEQ ID NO: 4240109 - RNA, 55 nt, Mycobacterium leprae
uugugcggguggugucgaugccguguguggaaugguucgagucacagccguacga

SEQ ID NO: 4240110 - RNA, 76 nt, Mycobacterium leprae
cuccuuggugucagcaucgaugacacgcggaccugacagguacccaccaaacucagcggugucagacaccgaguag

SEQ ID NO: 4240111 - RNA, 80 nt, Mycobacterium leprae
ggcguugucgcccuugaggaucagguucagcuggcugguuuccuucagcgccgaauccagguccuccaggcugauucgcu

SEQ ID NO: 4240112 - RNA, 68 nt, Mycobacterium leprae
guggagaccaacuuccuuccgccguguuucagcggcggguggcccaacaaagucuuugagucgaccac

SEQ ID NO: 4240113 - RNA, 77 nt, Mycobacterium leprae
uguccagcccacaacgcaacugagccgacguccggauaccguaacucgucggccauuggugcugggcgucugcgaca

SEQ ID NO: 4240114 - RNA, 67 nt, Mycobacterium leprae
ucgguguggugcaucgcaggcaggcuucgguguaugacgucgcuacgcuauugccgcacuacgccgg

SEQ ID NO: 4240115 - RNA, 74 nt, Mycobacterium leprae
caucggugaucuucuucgcccaugccgggucauugacgguuuugccgucgggcgcauggaagaucgccacgaug

SEQ ID NO: 4240116 - RNA, 70 nt, Mycobacterium leprae
uagcucgggguugguaaaguucaccgcgugcugucacgucuggguggcuuugaucgacgccggaacgcua

SEQ ID NO: 4240117 - RNA, 60 nt, Mycobacterium leprae
uccuggugugcaguaucgggcguucgaucugucggaggccggcccggugcgcaugcagga

SEQ ID NO: 4240118 - RNA, 107 nt, Mycobacterium leprae
auuaggcgugagguuaggcuguucuaugcgauccaaacugucuugauguugcagaacucacggaucccaugggucgacagcucucggccguagccugaccguuugau

SEQ ID NO: 4240119 - RNA, 66 nt, Mycobacterium leprae
uuagcccaccagcuaggcguuggaccgcuagagccgcuagagugcgccgcuuagcugguggguuaa

SEQ ID NO: 4240120 - RNA, 84 nt, Mycobacterium leprae
ucgauugcuaugauggcgguauguaauguuggucauacaauuugaucggaucgauauguacugcgcguaacuuaacgcagucga

SEQ ID NO: 4240121 - RNA, 57 nt, Mycobacterium leprae
accgcgaucgagcuugcuccuggggcguugccgcagcgucaggggcuucgaugcggu

SEQ ID NO: 4240122 - RNA, 60 nt, Mycobacterium leprae
aggcgaugaagcucgggaggugagggcauuuagugcgccagcacccgagcuucaucgccu

SEQ ID NO: 4240123 - RNA, 61 nt, Mycobacterium leprae
gucguuaucggaacgcgguucggccgccucgacgggggccgguugccgauucugaaaggac

SEQ ID NO: 4240124 - RNA, 55 nt, Mycobacterium leprae
auguccgacgcucaugaacagugccagucuggcguuguucaugagcgucggacau

SEQ ID NO: 4240125 - RNA, 70 nt, Mycobacterium leprae
uaccucgaggaauuccagcagcucuggauagaagaagaucuuacggguagggcggaauuccaucgaggua

SEQ ID NO: 4240126 - RNA, 55 nt, Mycobacterium leprae
gucaccgagcaacucaaucgaauuaccccaggauccggcgagaaacgcucggugc

SEQ ID NO: 4240127 - RNA, 129 nt, Mycobacterium leprae
ucaccaaagaacaccguggcucggugccccgggucgcugucgagccucuuguguugauguuggcgccgcuagccccacaucuggcagaagagcuguggcugcggcugggccacaccaccucuuuggcga

SEQ ID NO: 4240128 - RNA, 80 nt, Mycobacterium leprae
cuacuugccguagaaugcuauacaauaccuaccuuagcuguugcggcugaugucgggucggugaaguauuucggaaguag

SEQ ID NO: 4240129 - RNA, 69 nt, Mycobacterium leprae
gcucgcggcuagguaggcuuucacgcguguccccgaucucccgcgaugaggucuugcaccuggcccggc

SEQ ID NO: 4240130 - RNA, 90 nt, Mycobacterium leprae
agccgaccgggagggauugccgaaguuauauacuggguugcugcaugggugucgcucgguguugcggacuucaucccgcccgauucgguu

SEQ ID NO: 4240131 - RNA, 67 nt, Mycobacterium leprae
agcauucgacuggcucaacuaugaagauuuuuggaagaauuuuguguagugaagugagcucggugcu

SEQ ID NO: 4240132 - RNA, 70 nt, Mycobacterium leprae
cgugaucgccucgaguuuggacaaggucgcgauuucucacccggaucgccauacucgaggcggcgucgcg

SEQ ID NO: 4240133 - RNA, 57 nt, Mycobacterium leprae
ggugccgcguucagucgcaacaccuaaauaccucggaguugcggcgaaggugguacc

SEQ ID NO: 4240134 - RNA, 62 nt, Mycobacterium leprae
cacugucgaugguguugccucaucggucguccagaugucgauuggccgagacgaugacggug

SEQ ID NO: 4240135 - RNA, 61 nt, Mycobacterium leprae
ggugcaccgcccggcuacauuggccacgaucaggguggucagcugaccgaggcggugcgcc

SEQ ID NO: 4240136 - RNA, 77 nt, Mycobacterium leprae
cuucggcaccgggaucgggucagcagucauccacaacgggaaacugauuccuaacaccgaguucgggcaucucgagg

SEQ ID NO: 4240137 - RNA, 62 nt, Mycobacterium leprae
augccguagcuucaauacuaaaagcuuauucgccaagucuugccgaguguuggcggcggcau

SEQ ID NO: 4240138 - RNA, 71 nt, Mycobacterium leprae
gacgaugguugagaucucgacggauaggacgaucugacaccuguuacugccgauaucucagccaacacguc

SEQ ID NO: 4240139 - RNA, 61 nt, Mycobacterium leprae
ggagcggaugaagcuggacgcggcuggggccauucuggccacgcuggcuugcaccgcggcc

SEQ ID NO: 4240140 - RNA, 94 nt, Mycobacterium leprae
gaugaccaacgaaggugcuuguuuugcaaucucgaccauuacuggccuuaaggccagguaauggucgagauugcaaaacaagcaccacagcguc

SEQ ID NO: 4240141 - RNA, 94 nt, Mycobacterium leprae
auuaugaaacauguuuuuguccaaguuuuucgacugcaagcagccagcacgugcguagcucggaacuaacuuuggaaagggccuucagcguggu

SEQ ID NO: 4240142 - RNA, 75 nt, Mycobacterium leprae
gcaucuucgggccggucggccgcgaacuucgugagaaacgauucaugaagaucaucucgcuggcuccggaggugc

SEQ ID NO: 4240143 - RNA, 69 nt, Mycobacterium leprae
ucgucggcuaccggauagucgucggcguggguguacugauccugcuggcggucaagacgguagcugcga

SEQ ID NO: 4240144 - RNA, 86 nt, Mycobacterium leprae
gcugaucguuggcgcggcaucuggaguugcggucgggcaacaaugcacuagacauccgcugccucuucuugccgcgcuggcuaagc

SEQ ID NO: 4240145 - RNA, 55 nt, Mycobacterium leprae
gcccgcuagcguuugccgagcuugguugcuucggcugggcggauacuagucgggc

SEQ ID NO: 4240146 - RNA, 78 nt, Mycobacterium leprae
ucugcaguucauaaucacagucggguuggucaccaccgugaaagccggucucaauuugcugggauuguucgcuggaga

SEQ ID NO: 4240147 - RNA, 58 nt, Mycobacterium leprae
uuccuggacaguucguaccacagucuuaaucagauuguguugcaacuaagucccggag

SEQ ID NO: 4240148 - RNA, 98 nt, Mycobacterium leprae
uucaugauuaagggcauuaugcgaguuuacuaugccaaaaggcuguauagacugcuguuucagggauuugguauagaacuauagugcagcaaucugga

SEQ ID NO: 4240149 - RNA, 56 nt, Mycobacterium leprae
guggcggcuggucccggaauuaguggaggcggcugguuucguggcccagcagccgc

SEQ ID NO: 4240150 - RNA, 63 nt, Mycobacterium leprae
gcucaguucagacuaguaauuagaguuacaaacguagguucgugaccuagauaugaccugagc

SEQ ID NO: 4240151 - RNA, 66 nt, Mycobacterium leprae
gccuuuguuuucguagcucgggcguggaggcaagcagccuuugaguccucuacguggaacaguggc

SEQ ID NO: 4240152 - RNA, 64 nt, Mycobacterium leprae
gaaguuggcauaguuagaaccgaaguagacuugaucagcuucgcguccaguuguguccgccuuc

SEQ ID NO: 4240153 - RNA, 84 nt, Mycobacterium leprae
gaacaguguggguuacagcggcucugucucauccggaugcguuagagaccuacaccauccaugagcagaccgccgacaugguuu

SEQ ID NO: 4240154 - RNA, 65 nt, Mycobacterium leprae
gguugagcuggcgcacccgucgaccgagccguuggggucucggucgacgggugcgcaguccaucc

SEQ ID NO: 4240155 - RNA, 64 nt, Mycobacterium leprae
acggcugaucaccgaccgguuguugcgacuucaggacgccgacgaucggauaggugacguacgu

SEQ ID NO: 4240156 - RNA, 97 nt, Mycobacterium leprae
gccggacucaguguaacucacgcgccagaggccgguugaccuggcccucgcuucgaagugccgggcgacgcuuauuggcugcuagacugacuucugc

SEQ ID NO: 4240157 - RNA, 94 nt, Mycobacterium leprae
gacgggugguguagcugacgcgaauggcuaggcugcugacaacccucauagucuaucgugccguccgcguauuaucccgcgcggcuaccacguc

SEQ ID NO: 4240158 - RNA, 118 nt, Mycobacterium leprae
gcguuuggaauaccucgcuggcgaguccggucaaucuuccggcauuuaucacgucgacgacaguggacggauuuggcuugcugggaguugcuguugcgggugaggcggugccgaucgu

SEQ ID NO: 4240159 - RNA, 60 nt, Mycobacterium leprae
gcugucagaauuucgcuacgagcagccguauccagcccgcuucuaccgagcauuggcagc

SEQ ID NO: 4240160 - RNA, 57 nt, Mycobacterium leprae
accgggaaugcacgaugccuaacgcgcuagucagccguucaucuugcaagucccggu

SEQ ID NO: 4240161 - RNA, 129 nt, Mycobacterium leprae
agcgccaggguacagauugccggcguauuguauguuugguuuuucaggcuauucucuaccgcgauuggcagcgaaagaaagucaggaacccagcgaccggacgcaguaauggagucgacccgggccagu

SEQ ID NO: 4240162 - RNA, 60 nt, Mycobacterium leprae
gguccgggaccugcgucccgaacccgcuaccaacacaguccgggacgcaggucccgggcc

SEQ ID NO: 4240163 - RNA, 61 nt, Mycobacterium leprae
ggccgucguuguucaccaacaagagcccaugguggguauuguccggauuguaguggcggcc

SEQ ID NO: 4240164 - RNA, 56 nt, Mycobacterium leprae
gcguugguaagcaacguaucucgaggcaucaucgaugucgcuuuguuugccaucgc

SEQ ID NO: 4240165 - RNA, 55 nt, Mycobacterium leprae
ggggauuucagugaccagcugacggcucugcucgacgcuggucacguggauccuc

SEQ ID NO: 4240166 - RNA, 60 nt, Mycobacterium leprae
ucggcaccggccaggucauggugaccagccguuuugucaccagcuaucuggcugggucga

SEQ ID NO: 4240167 - RNA, 86 nt, Mycobacterium leprae
ucgucgauaaggccgcagaaaaauggucaagaaucgcugcggcuauagugauguucuccugauauuucugcguguacaucgucaga

SEQ ID NO: 4240168 - RNA, 94 nt, Mycobacterium leprae
ccggaucugaacuacgacaaugugaacgugcaagaagcgaggaucgauuuucuccucuuuugacuugucauguucaucgacgggguucagcugg

SEQ ID NO: 4240169 - RNA, 86 nt, Mycobacterium leprae
cacacgucgucaucaucgggcgcgguguuacgguuggucgcccguuggggcugcugcugacacgccguuccgagaacgccacggug

SEQ ID NO: 4240170 - RNA, 86 nt, Mycobacterium leprae
uaacaucuggagcgccccgucgugugcgaucucgucagcaguguccuuggcggcgaugauuuagcaccgaucggguccagcaguug

SEQ ID NO: 4240171 - RNA, 78 nt, Mycobacterium leprae
gcaagcauuaagcaggugugguuaggcgacaccgcuacaggaccauguggugcggugacgcuaaaucgcacugcuugc

SEQ ID NO: 4240172 - RNA, 68 nt, Mycobacterium leprae
uccaaucguagauggccgccaagucgccgcacuccucggcagcguggcggcacucugcgccauugcga

SEQ ID NO: 4240173 - RNA, 64 nt, Mycobacterium leprae
cauaacggaccagcgcaccgccgucuccccgucggggagcagcguaacauugcugguuucgaug

SEQ ID NO: 4240174 - RNA, 59 nt, Mycobacterium leprae
cguuauuguuugcacuggccgguuucgucacguuguugcugcuggcccaggcaguagcg

SEQ ID NO: 4240175 - RNA, 75 nt, Mycobacterium leprae
gugccugauugacugaauuguaucgcgaucuccggcuguuuagcggagauauucgcgaaacgguuagcugagcgc

SEQ ID NO: 4240176 - RNA, 74 nt, Mycobacterium leprae
gagccggagcguuaugggguguaccgcaguugaccgaugccggcaucgcuguauucuauaacgccgaccugcuc

SEQ ID NO: 4240177 - RNA, 62 nt, Mycobacterium leprae
gccccuccgaucugcucggucugcugugucagcuggccgggcgcagucggaggcucaccggc

SEQ ID NO: 4240178 - RNA, 55 nt, Mycobacterium leprae
ucaccuuucggguagacuugaacaaguucuggcaacaaguuuaucgagaugguga

SEQ ID NO: 4240179 - RNA, 92 nt, Mycobacterium leprae
cggccgugggaccgacgucgcgauuggugccgccgacaucaucuugguccgcgacaaucucgacgucguacccauaacacucgaccuggccg

SEQ ID NO: 4240180 - RNA, 66 nt, Mycobacterium leprae
cgagcacgaucuuggauaaacucgaaagccacggcgauucggggcugaagagcauccaagaccucg

SEQ ID NO: 4240181 - RNA, 60 nt, Mycobacterium leprae
gcugguauucggugucgguuucucgaugcuggcguugaugacacggcguugggugcuagc

SEQ ID NO: 4240182 - RNA, 116 nt, Mycobacterium leprae
cagcgugcuagggcaaaugaugugggcgaugcgcgcgucgggcaugugguccgacacugguggcaccaacaugcucgacgguggcgcgcccuacuacgaugcuuaugagugcgcug

SEQ ID NO: 4240183 - RNA, 80 nt, Mycobacterium leprae
aucgacuggcgagucaguuccuuagcgaugccgcauggcgacgggaauggcuuuuggcugaaacugaccgaccauucgau

SEQ ID NO: 4240184 - RNA, 68 nt, Mycobacterium leprae
cgucgguggccgcuucgaggugaucagcccgcacgaaccggcuggugaccagccagcggcuauugaug

SEQ ID NO: 4240185 - RNA, 88 nt, Mycobacterium leprae
gggugguacuagcgcgcuuguuuuucuagauaagcaccaauuguagcggaaaguguuguugcuuaacuggauaacgauguggucaccc

SEQ ID NO: 4240186 - RNA, 64 nt, Mycobacterium leprae
acccgcucggucucgguggugaccagccgaaugaucucgcggcgaaucgccgacugggcgcggu

SEQ ID NO: 4240187 - RNA, 98 nt, Mycobacterium leprae
caaugaccggugcggagcgaucacgggcccggccgcgugcuccaaguucaccaccugaccgcgcuaagguggcccguucgccucccgcguaggcguug

SEQ ID NO: 4240188 - RNA, 62 nt, Mycobacterium leprae
gcuacccguggacuagauccggcaccgucucgagcugccgcuauccugugccgcaugguugc

SEQ ID NO: 4240189 - RNA, 75 nt, Mycobacterium leprae
accgagcucacgguuuuggugcauggcgcagcggcaacccaggcuguugagcaugccagcagggcauuguucggu

SEQ ID NO: 4240190 - RNA, 66 nt, Mycobacterium leprae
cucgaugcagccgugcacaugugcgcagacggugagguggccgcacauggacagcgguucauugag

SEQ ID NO: 4240191 - RNA, 61 nt, Mycobacterium leprae
gaguauggaguguggcgucguggugccgaucuuguggauuugucguacgcaauucaugcuc

SEQ ID NO: 4240192 - RNA, 66 nt, Mycobacterium leprae
caugcgaacgugaagcuggccgcgaugcgagaacgagugugcggccaggcgcuucacguucgacug

SEQ ID NO: 4240193 - RNA, 72 nt, Mycobacterium leprae
ggcuucgauggcgucgaugugcgugguaccaaucaccgggucaccaccgauaccgauugcggucgagaagcc

SEQ ID NO: 4240194 - RNA, 59 nt, Mycobacterium leprae
gcgcgcggaucacggccguuuccaagagggguucgucggugaugguauugaugcgcggc

SEQ ID NO: 4240195 - RNA, 60 nt, Mycobacterium leprae
guuuuguguggacguguucucccaccccauccugggcuggcaggugaugaccagcaagac

SEQ ID NO: 4240196 - RNA, 71 nt, Mycobacterium leprae
guggccgaugcaggccaucacuaccggcuugggcuaggacaagagucgguauggcuuagcaucgaagucac

SEQ ID NO: 4240197 - RNA, 63 nt, Mycobacterium leprae
aucgacgguguacgauggcuucgacgucgaccuucgcgacgucggugagcucacgccgucggu

SEQ ID NO: 4240198 - RNA, 64 nt, Mycobacterium tuberculosis CDC1551; identical to SEQ ID NO: 4238290

SEQ ID NO: 4240199 - RNA, 86 nt, Mycobacterium tuberculosis CDC1551
gacgugcgcggccgacggucagcuguguccgcacaaccgggcacccucggugacggacugcacagcgauggaccgcguaacccguu

SEQ ID NO: 4240200 - RNA, 58 nt, Mycobacterium tuberculosis CDC1551; identical to SEQ ID NO: 4237872

SEQ ID NO: 4240201 - RNA, 61 nt, Mycobacterium tuberculosis CDC1551; identical to SEQ ID NO: 4238681

SEQ ID NO: 4240202 - RNA, 60 nt, Mycobacterium tuberculosis CDC1551
guguucggugguaaucguuucuggcuggcagccuuccagccccagcaauaucgccgacau

SEQ ID NO: 4240203 - RNA, 129 nt, Mycobacterium tuberculosis CDC1551; identical to SEQ ID NO: 4238717

SEQ ID NO: 4240204 - RNA, 64 nt, Mycobacterium tuberculosis CDC1551
ugccuugcggcaaugccggcaggccgcacgccaacggcggguugccgacgccguugcugcugua

SEQ ID NO: 4240205 - RNA, 69 nt, Mycobacterium tuberculosis CDC1551; identical to SEQ ID NO: 4238454

SEQ ID NO: 4240206 - RNA, 65 nt, Mycobacterium tuberculosis CDC1551; identical to SEQ ID NO: 4238897

SEQ ID NO: 4240207 - RNA, 56 nt, Mycobacterium tuberculosis CDC1551
gucagcgucgaugaccaugucgaccccacgguguggucgauggugaugacgcuggc

SEQ ID NO: 4240208 - RNA, 85 nt, Mycobacterium tuberculosis CDC1551
gccgcucgucgucauggucacuggcugugacugaguuguggaucuuguucaggcacagguaguuccgucgaccuuugagcagggc

SEQ ID NO: 4240209 - RNA, 58 nt, Mycobacterium tuberculosis CDC1551
ggaggagaugcuagaggcaacgaagucguggcaggaaucgggguuuaacgucuucucc

SEQ ID NO: 4240210 - RNA, 66 nt, Mycobacterium tuberculosis CDC1551; identical to SEQ ID NO: 4238240

SEQ ID NO: 4240211 - RNA, 121 nt, Mycobacterium tuberculosis CDC1551
uucgucaucuccgcacgcgcggaacccauccgccgccugcucggcggccugaaugaaacgguguucaggcuacgguagcggugcgcacggggacaaacgcgacgugggcggaggucacgga

SEQ ID NO: 4240212 - RNA, 93 nt, Mycobacterium tuberculosis CDC1551; identical to SEQ ID NO: 4238650

SEQ ID NO: 4240213 - RNA, 104 nt, Mycobacterium tuberculosis CDC1551; identical to SEQ ID NO: 4238296

SEQ ID NO: 4240214 - RNA, 69 nt, Mycobacterium tuberculosis CDC1551; identical to SEQ ID NO: 4239215

SEQ ID NO: 4240215 - RNA, 55 nt, Mycobacterium tuberculosis CDC1551
cguggaauuucuucgccauggggggcggauugccauggcgcacagaggauuuacg

SEQ ID NO: 4240216 - RNA, 61 nt, Mycobacterium tuberculosis CDC1551
cgccccggugcguuugugugcuugggcgaccgcgcgcaacacccgcucgacaccaggggug

SEQ ID NO: 4240217 - RNA, 59 nt, Mycobacterium tuberculosis CDC1551; identical to SEQ ID NO: 4237636

SEQ ID NO: 4240218 - RNA, 58 nt, Mycobacterium tuberculosis CDC1551
agcagcugcuucauggugacuacggccauaccuaugccuuacucaugugucgguuguu

SEQ ID NO: 4240219 - RNA, 60 nt, Mycobacterium tuberculosis CDC1551
gcgagcagacgcauaagcccccgcacgcacggcgugucgagggcuuuagugucugcucgc

SEQ ID NO: 4240220 - RNA, 75 nt, Mycobacterium tuberculosis CDC1551
ccgcggggaccaugcaucggaagaaccggcaugacaauguucaggccgaguucgucaugcagcuuccaggcgcgg

SEQ ID NO: 4240221 - RNA, 77 nt, Mycobacterium tuberculosis CDC1551
cgccggcggucagcacgcaugugcgguggccgacgcccucggcauccgcacggugcugaucccaccaauggccggcg

SEQ ID NO: 4240222 - RNA, 61 nt, Mycobacterium tuberculosis CDC1551; identical to SEQ ID NO: 4238988

SEQ ID NO: 4240223 - RNA, 65 nt, Mycobacterium tuberculosis CDC1551
cacgaucugccaugucauuccuggacuccuuugcugggucggggaguacgcgggccaggugcgug

SEQ ID NO: 4240224 - RNA, 63 nt, Mycobacterium tuberculosis CDC1551; identical to SEQ ID NO: 4238570

SEQ ID NO: 4240225 - RNA, 58 nt, Mycobacterium tuberculosis CDC1551
ggugcagcucaucgagggcgcgacccccgaaaacgccgcugcccuggacagguucacc

SEQ ID NO: 4240226 - RNA, 63 nt, Mycobacterium tuberculosis CDC1551; identical to SEQ ID NO: 4238346

SEQ ID NO: 4240227 - RNA, 81 nt, Mycobacterium tuberculosis CDC1551; identical to SEQ ID NO: 4238166

SEQ ID NO: 4240228 - RNA, 83 nt, Mycobacterium tuberculosis CDC1551
cgucgcugccgucgcgguugacugcggccaugcauaaccgcacuggugaccccgcaggcagugucaugccgccgacggugacg

SEQ ID NO: 4240229 - RNA, 56 nt, Mycobacterium tuberculosis CDC1551
agagcgcgauccaggcgagaggaccugguaacgucgcugucccgaggucacgcuuu

SEQ ID NO: 4240230 - RNA, 57 nt, Mycobacterium tuberculosis CDC1551
ucgcguaugcgaagaucacgagcggcaagaugagcacgaugaugaucguguaugcga

SEQ ID NO: 4240231 - RNA, 97 nt, Mycobacterium tuberculosis CDC1551
gacggagcaucucggcgaccgcucgccguuggcgcuggcgcggcaggcgcuggccgugcugcccaaagaacagcgagccgaggccgguaagcgcguc

SEQ ID NO: 4240232 - RNA, 67 nt, Mycobacterium tuberculosis CDC1551
cagauucgaagugacggccugggucuuggagaucuucuuggacuccagccguucacguucgagcaug

SEQ ID NO: 4240233 - RNA, 86 nt, Mycobacterium tuberculosis CDC1551
ccugcgaccacgucaggcuuucacuuaugcccuccgaaucccguucguaaucgauguaagugaaugccgugccguccgggugcagg

SEQ ID NO: 4240234 - RNA, 90 nt, Mycobacterium tuberculosis CDC1551
ggccugcgcaucgaagaugguuugcugaagaagcugggugccgaggcgguggcucagcgggucaacgaggcgcugcacaaugcgcaggcc

SEQ ID NO: 4240235 - RNA, 66 nt, Mycobacterium tuberculosis CDC1551
gccgaggguagacggggcgagcaugccguugacaacuaucgucgugucgccgccguugccgccggu

SEQ ID NO: 4240236 - RNA, 65 nt, Mycobacterium tuberculosis CDC1551; identical to SEQ ID NO: 4238138

SEQ ID NO: 4240237 - RNA, 56 nt, Mycobacterium tuberculosis CDC1551
cacuguugaucaugggccuggcaaccgugacugucgggcugguuccaacgacagug

SEQ ID NO: 4240238 - RNA, 67 nt, Mycobacterium tuberculosis CDC1551
caccagcucaucgccguagcugaggaccgcgaucccggugcucagcugcagugcggugggcgggaug

SEQ ID NO: 4240239 - RNA, 88 nt, Mycobacterium tuberculosis CDC1551; identical to SEQ ID NO: 4237614

SEQ ID NO: 4240240 - RNA, 57 nt, Mycobacterium tuberculosis CDC1551; identical to SEQ ID NO: 4238651

SEQ ID NO: 4240241 - RNA, 71 nt, Mycobacterium tuberculosis CDC1551; identical to SEQ ID NO: 4238647

SEQ ID NO: 4240242 - RNA, 76 nt, Mycobacterium tuberculosis CDC1551
ugccugcaaccgagcggccagcaccugcaacgcacgcgucuuguucugcagcugcgaccguucguucugacaggug

SEQ ID NO: 4240243 - RNA, 87 nt, Mycobacterium tuberculosis CDC1551
ugagcgccuaugaggcgguggugggugccgcgcugguggccacaccacacaccggcccggcaccggucaucgucaaacccggcgcca

SEQ ID NO: 4240244 - RNA, 67 nt, Mycobacterium tuberculosis CDC1551; identical to SEQ ID NO: 4237854

SEQ ID NO: 4240245 - RNA, 79 nt, Mycobacterium tuberculosis CDC1551
ccuguagcgcgagcagacgcaaaaucgcccgaaagccaucgguuucgggcgauuuugcgucugcucgcgccaacauagg

SEQ ID NO: 4240246 - RNA, 57 nt, Mycobacterium tuberculosis CDC1551; identical to SEQ ID NO: 4238111

SEQ ID NO: 4240247 - RNA, 57 nt, Mycobacterium tuberculosis CDC1551; identical to SEQ ID NO: 4238334

SEQ ID NO: 4240248 - RNA, 92 nt, Mycobacterium tuberculosis CDC1551
ggagcggccgggcucgcuggguggugggaaccgcuccagggcgggccaucccguucggcgcuuuccgccauuugaucagccugcccgccucc

SEQ ID NO: 4240249 - RNA, 64 nt, Mycobacterium tuberculosis CDC1551; identical to SEQ ID NO: 4238103

SEQ ID NO: 4240250 - RNA, 55 nt, Mycobacterium tuberculosis CDC1551; identical to SEQ ID NO: 4238051

SEQ ID NO: 4240251 - RNA, 70 nt, Mycobacterium tuberculosis CDC1551
cgccggccagcuggugagcggccaccacccgccgguugaguucggaggccagcucggccagcuggacgcg

SEQ ID NO: 4240252 - RNA, 60 nt, Mycobacterium tuberculosis CDC1551; identical to SEQ ID NO: 4238309

SEQ ID NO: 4240253 - RNA, 55 nt, Mycobacterium tuberculosis CDC1551; identical to SEQ ID NO: 4238187

SEQ ID NO: 4240254 - RNA, 76 nt, Mycobacterium tuberculosis CDC1551; identical to SEQ ID NO: 4238126

SEQ ID NO: 4240255 - RNA, 77 nt, Mycobacterium tuberculosis CDC1551
ucgaagaugagcgugggugaaagugaaaggccgguggcggauuugagccgguuacgcauuucgaccgcggucaacga

SEQ ID NO: 4240256 - RNA, 63 nt, Mycobacterium tuberculosis CDC1551; identical to SEQ ID NO: 4239201

SEQ ID NO: 4240257 - RNA, 125 nt, Mycobacterium tuberculosis CDC1551
ugucggugucuagcaccuugaagccggucgccagcaccagcacaucgaucucguggcuggcgccgucggugguggccaccgcagugggugugaucuugucgaucggcucggugaccagccgcacg

SEQ ID NO: 4240258 - RNA, 64 nt, Mycobacterium tuberculosis CDC1551
guagcccaccggugcuguaggcgaaggugcaggcaaagaucgccagcaccaccugguugggcac

SEQ ID NO: 4240259 - RNA, 94 nt, Mycobacterium tuberculosis CDC1551
gcggguguccccggcgguccaguacgucagauacaucguggaucggcgucgcauaucgaaggucucgacguacugcgccgccgcggccaucggc

SEQ ID NO: 4240260 - RNA, 59 nt, Mycobacterium tuberculosis CDC1551; identical to SEQ ID NO: 4237837

SEQ ID NO: 4240261 - RNA, 72 nt, Mycobacterium tuberculosis CDC1551; identical to SEQ ID NO: 4238810

SEQ ID NO: 4240262 - RNA, 66 nt, Mycobacterium tuberculosis CDC1551; identical to SEQ ID NO: 4238489

SEQ ID NO: 4240263 - RNA, 72 nt, Mycobacterium tuberculosis CDC1551; identical to SEQ ID NO: 4238770

SEQ ID NO: 4240264 - RNA, 100 nt, Mycobacterium tuberculosis CDC1551; identical to SEQ ID NO: 4237718

SEQ ID NO: 4240265 - RNA, 78 nt, Mycobacterium tuberculosis CDC1551
gcugucaucgaugucacggucgugacccgcugccaccaucucgaagucggcgguggugaccgccgcgacgucugcggc

SEQ ID NO: 4240266 - RNA, 68 nt, Mycobacterium tuberculosis CDC1551
ggggcgggcaucaccgucgugcaggcugacccgucgacucgccccguccgaagugaugcccgcgaccc

SEQ ID NO: 4240267 - RNA, 72 nt, Mycobacterium tuberculosis CDC1551; identical to SEQ ID NO: 4237958

SEQ ID NO: 4240268 - RNA, 92 nt, Mycobacterium tuberculosis CDC1551
cgaccccaccgagcgggugguggucgccaacgccgaccaacugcugaucguggucgcgcuggcagacccgccgccacgcaccggccuggucg

SEQ ID NO: 4240269 - RNA, 119 nt, Mycobacterium tuberculosis CDC1551
gugugacggucggcgcguuggucgcgcuggcguguaugguguuggccgggugcacggucagcccgccgccggcaccccagagcacugauacgccgcgcagcacaccgcccccgccgcgc

SEQ ID NO: 4240270 - RNA, 92 nt, Mycobacterium tuberculosis CDC1551; identical to SEQ ID NO: 4238019

SEQ ID NO: 4240271 - RNA, 98 nt, Mycobacterium tuberculosis CDC1551
gacgacgcgcucaaccugcccuggcuggccaugggcgccacgggcuucaucagcgugauugcccaccuggcagccgggcagcuucgagaguuguuguc

SEQ ID NO: 4240272 - RNA, 59 nt, Mycobacterium tuberculosis CDC1551; identical to SEQ ID NO: 4239136

SEQ ID NO: 4240273 - RNA, 58 nt, Mycobacterium tuberculosis CDC1551
cgucgccggucucccagucgaagaugugauugucgcucuuucccuccagaucggugcg

SEQ ID NO: 4240274 - RNA, 91 nt, Mycobacterium tuberculosis CDC1551
gaggucaggcggaacgucgaugcugcugcgaacuugagcgucggcuugccgggcuccagccgcgucagcagcgcgggucucgcgggacguc

SEQ ID NO: 4240275 - RNA, 57 nt, Mycobacterium tuberculosis CDC1551
gcgagcuggaaugcggugugcucgaaaugccggacggcacacuggaagccagcacgc

SEQ ID NO: 4240276 - RNA, 69 nt, Mycobacterium tuberculosis CDC1551; identical to SEQ ID NO: 4238069

SEQ ID NO: 4240277 - RNA, 76 nt, Mycobacterium tuberculosis CDC1551; identical to SEQ ID NO: 4238694

SEQ ID NO: 4240278 - RNA, 59 nt, Mycobacterium tuberculosis CDC1551; identical to SEQ ID NO: 4237618

SEQ ID NO: 4240279 - RNA, 101 nt, Mycobacterium tuberculosis CDC1551
aagggcguucgaaugagcauguugguguccgccgacgccaagucgaugccgcuggcgguacacguguucggguugggcacccgcgugcugaacaagcucuu

SEQ ID NO: 4240280 - RNA, 69 nt, Mycobacterium tuberculosis CDC1551; identical to SEQ ID NO: 4238234

SEQ ID NO: 4240281 - RNA, 59 nt, Mycobacterium tuberculosis CDC1551
cggugguggccaccgcagugggugugaucuugucgaucggcucggugaccagccgcacg

SEQ ID NO: 4240282 - RNA, 99 nt, Mycobacterium tuberculosis CDC1551
uguaugggcggggagaaccggcugaugcggugacgguggccgccgaacuggaucgccgugggcugcugcgccgcaucggcggugcucccuaccugcaca

SEQ ID NO: 4240283 - RNA, 67 nt, Mycobacterium tuberculosis CDC1551
gcauguccggcagaugaucgccgaccgggaacuggaaaccuggcugguggucgacaugucggccagc

SEQ ID NO: 4240284 - RNA, 129 nt, Mycobacterium tuberculosis CDC1551
cgucguggucaccggccgggucaccgacgccucgguggucgucggggcggcggccgcgcacuucggcuggggccgcaccgacuaccaccgacuggccggcgccgugguggccgggcacgugaucgaaug

SEQ ID NO: 4240285 - RNA, 57 nt, Mycobacterium tuberculosis CDC1551; identical to SEQ ID NO: 4239033

SEQ ID NO: 4240286 - RNA, 55 nt, Mycobacterium tuberculosis CDC1551; identical to SEQ ID NO: 4237650

SEQ ID NO: 4240287 - RNA, 71 nt, Mycobacterium tuberculosis CDC1551
gguagcgcugggcgaugaagcgcugggucaccgcgcccagcggcccggcggcuuugcucgcccaggucgcc

SEQ ID NO: 4240288 - RNA, 72 nt, Mycobacterium tuberculosis CDC1551; identical to SEQ ID NO: 4238265

SEQ ID NO: 4240289 - RNA, 110 nt, Mycobacterium tuberculosis CDC1551; identical to SEQ ID NO: 4238502

SEQ ID NO: 4240290 - RNA, 115 nt, Mycobacterium tuberculosis CDC1551
gcgcguguggagcuggcggcguucaacgcggcggucaccgauugggagaggauacguggauuugagcgccucuagguccgaugguggcgacccgcugcgcccggcuucgccgcgc

SEQ ID NO: 4240291 - RNA, 67 nt, Mycobacterium tuberculosis CDC1551; identical to SEQ ID NO: 4237956

SEQ ID NO: 4240292 - RNA, 59 nt, Mycobacterium tuberculosis CDC1551
ugccggcgaccgagguggcggugggccgcugagacaugacgugccucacgucgucggcg

SEQ ID NO: 4240293 - RNA, 73 nt, Mycobacterium tuberculosis CDC1551; identical to SEQ ID NO: 4238377

SEQ ID NO: 4240294 - RNA, 104 nt, Mycobacterium tuberculosis CDC1551; identical to SEQ ID NO: 4237713

SEQ ID NO: 4240295 - RNA, 81 nt, Mycobacterium tuberculosis CDC1551
gcgaucccugggcgacagacgcagaaucgcaucaaaaucgcugauuuugugcgauucugcgucugcucgcgccaugggagc

SEQ ID NO: 4240296 - RNA, 63 nt, Mycobacterium tuberculosis CDC1551
ggcucacgauguagucgauccgaucgacgauggcuuccaccggcucgaccaacacgaugagcc

SEQ ID NO: 4240297 - RNA, 69 nt, Mycobacterium tuberculosis CDC1551; identical to SEQ ID NO: 4237680

SEQ ID NO: 4240298 - RNA, 56 nt, Mycobacterium tuberculosis CDC1551
gcggcgcugaugaacgguugcacgaacugacccggcagcagguucaccacguaugc

SEQ ID NO: 4240299 - RNA, 59 nt, Mycobacterium tuberculosis CDC1551
ggccgaaacaccgcgcgaagggcgguucaaguuuccguccccucucgugguuuuggguc

SEQ ID NO: 4240300 - RNA, 59 nt, Mycobacterium tuberculosis CDC1551; identical to SEQ ID NO: 4239098

SEQ ID NO: 4240301 - RNA, 65 nt, Mycobacterium tuberculosis CDC1551; identical to SEQ ID NO: 4239099

SEQ ID NO: 4240302 - RNA, 59 nt, Mycobacterium tuberculosis CDC1551
cgcacggugaguaguaauucggaugcugcugcggcauccaugagcagcucgccgccgcg

SEQ ID NO: 4240303 - RNA, 84 nt, Mycobacterium tuberculosis CDC1551; identical to SEQ ID NO: 4238370

SEQ ID NO: 4240304 - RNA, 68 nt, Mycobacterium tuberculosis CDC1551
ucggacggcaucuccaugggucaugaggggaugcacuucucgcugguuucccgugaggugaucgccga

SEQ ID NO: 4240305 - RNA, 55 nt, Mycobacterium tuberculosis CDC1551; identical to SEQ ID NO: 4238771

SEQ ID NO: 4240306 - RNA, 56 nt, Mycobacterium tuberculosis CDC1551; identical to SEQ ID NO: 4238276

SEQ ID NO: 4240307 - RNA, 89 nt, Mycobacterium tuberculosis CDC1551; identical to SEQ ID NO: 4237619

SEQ ID NO: 4240308 - RNA, 55 nt, Mycobacterium tuberculosis CDC1551
gccggcugacgacuagcgcaccagcccuugccgugguggcuguuguugcgccggc

SEQ ID NO: 4240309 - RNA, 63 nt, Mycobacterium tuberculosis CDC1551
ggugccggugcgcagcgucagcucgacggcgacgccguccgggccggcuuugccgccgucacc

SEQ ID NO: 4240310 - RNA, 56 nt, Mycobacterium tuberculosis CDC1551; identical to SEQ ID NO: 4238195

SEQ ID NO: 4240311 - RNA, 59 nt, Mycobacterium tuberculosis CDC1551
augguuucguggcugacauugcugaagguaaggcacgcaagaccagguacguggaccau

SEQ ID NO: 4240312 - RNA, 55 nt, Mycobacterium tuberculosis CDC1551
ucgcccaggugcaggcucgcgucgccgccgaggcgcggcuucgcuaucuggccga

SEQ ID NO: 4240313 - RNA, 62 nt, Mycobacterium tuberculosis CDC1551; identical to SEQ ID NO: 4238675

SEQ ID NO: 4240314 - RNA, 62 nt, Mycobacterium tuberculosis CDC1551
ggguucacgucgaccgcagggaaaacccgccgcucggcgaucuugcgguccagcuugagcuc

SEQ ID NO: 4240315 - RNA, 68 nt, Mycobacterium tuberculosis CDC1551
cuucgccaacgcgcgaaccgccgccaacuacgacacugucguguguacuaccggguucgcgcgcgaag

SEQ ID NO: 4240316 - RNA, 80 nt, Mycobacterium tuberculosis CDC1551; identical to SEQ ID NO: 4238479

SEQ ID NO: 4240317 - RNA, 69 nt, Mycobacterium tuberculosis CDC1551
gcgggauucgucgauguggccaugugcggguuguuucauggcccacgccugcgcgacauggacgcccgc

SEQ ID NO: 4240318 - RNA, 105 nt, Mycobacterium tuberculosis CDC1551
gccggcggcgaauuuguagaugucgcguuugcgcaggggcaugucagcguaugugcucgacgcgacgaauccacugcgcuugacgaggcgguacgucgcgccggc

SEQ ID NO: 4240319 - RNA, 62 nt, Mycobacterium tuberculosis CDC1551
cacguaguuggcccgccaucgugguggccacgaucgcugcugugguggcggucgcugcgcug

SEQ ID NO: 4240320 - RNA, 95 nt, Mycobacterium tuberculosis CDC1551
acgcgcuucucgggggaacccguuucucaugacuucucgcggcgauagcauucgcccgaggaggacaugaggcgcgccgagacccguaaggcggu

SEQ ID NO: 4240321 - RNA, 56 nt, Mycobacterium tuberculosis CDC1551; identical to SEQ ID NO: 4239123

SEQ ID NO: 4240322 - RNA, 60 nt, Mycobacterium tuberculosis CDC1551; identical to SEQ ID NO: 4238476

SEQ ID NO: 4240323 - RNA, 97 nt, Mycobacterium tuberculosis CDC1551; identical to SEQ ID NO: 4238941

SEQ ID NO: 4240324 - RNA, 57 nt, Mycobacterium tuberculosis CDC1551; identical to SEQ ID NO: 4238071

SEQ ID NO: 4240325 - RNA, 62 nt, Mycobacterium tuberculosis CDC1551
gguagucaccgccgcgguuggugcgcauggugcgccgugcgaucuggacggcggcggucacc

SEQ ID NO: 4240326 - RNA, 74 nt, Mycobacterium tuberculosis CDC1551; identical to SEQ ID NO: 4238242

SEQ ID NO: 4240327 - RNA, 57 nt, Mycobacterium tuberculosis CDC1551
gugcagguucguacuggcaugccgaaucaccugggcgugcaccugcggaccaugcau

SEQ ID NO: 4240328 - RNA, 64 nt, Mycobacterium tuberculosis CDC1551
ggcgagcuugcggugcaguaugucgaugaccaucgugcacagugcugaccaccgccggcucacc

SEQ ID NO: 4240329 - RNA, 66 nt, Mycobacterium tuberculosis CDC1551
gggagcuacaccgcgcgcgcgguggcguguuucgcuuaccgccagcgggugccggugguggacacc

SEQ ID NO: 4240330 - RNA, 60 nt, Mycobacterium tuberculosis CDC1551; identical to SEQ ID NO: 4238473

SEQ ID NO: 4240331 - RNA, 85 nt, Mycobacterium tuberculosis CDC1551
cgagcggucgccgggaguaaucaccgccaugccaucggucagccgcuccaacacauggucggcggucauacccgcggccagcacg

SEQ ID NO: 4240332 - RNA, 63 nt, Mycobacterium tuberculosis CDC1551
ggaauccucgacccguaccuacucgacaugaucgguucgccgaagcugugggucgaggagucu

SEQ ID NO: 4240333 - RNA, 105 nt, Mycobacterium tuberculosis CDC1551
ggcgaggguggugcaaacgaccuccgagguuuggcggggcgugaccuccgaaggcgccgaggcucauugguacuccgaagcccaggagguguccgacgauucgcc

SEQ ID NO: 4240334 - RNA, 69 nt, Mycobacterium tuberculosis CDC1551; identical to SEQ ID NO: 4237821

SEQ ID NO: 4240335 - RNA, 74 nt, Mycobacterium tuberculosis CDC1551
ggcgcccacgccgaggagguguaccggguagagggcgacggccucuaccuugugggcaccuccgagguaccgcu

SEQ ID NO: 4240336 - RNA, 95 nt, Mycobacterium tuberculosis CDC1551
guugcuggccggcgaggaaacgcgguugcgacugcuggucaacgagauguuugagaccaugucgcggcguagccguucccuggucgaccagcagc

SEQ ID NO: 4240337 - RNA, 59 nt, Mycobacterium tuberculosis CDC1551; identical to SEQ ID NO: 4237599

SEQ ID NO: 4240338 - RNA, 56 nt, Mycobacterium tuberculosis CDC1551
ggguaaccgcuacaaaugaaguuggucagugcuggccaacuguguaaugguugccc

SEQ ID NO: 4240339 - RNA, 61 nt, Mycobacterium tuberculosis CDC1551
gaaggcaccagagagaucaccucggaguugaugcgacgcggcgagcucgucauggucuuuc

SEQ ID NO: 4240340 - RNA, 72 nt, Mycobacterium tuberculosis CDC1551
ugucugaggcgcugcaggagugcuuccacggccugguuggccacaugaucaauuucugagcggcucaugacg

SEQ ID NO: 4240341 - RNA, 57 nt, Mycobacterium tuberculosis CDC1551
ccucggaggugcccacaagguagaggccgucgcccucuacccgguacaccuccucgg

SEQ ID NO: 4240342 - RNA, 72 nt, Mycobacterium tuberculosis CDC1551; identical to SEQ ID NO: 4237877

SEQ ID NO: 4240343 - RNA, 57 nt, Mycobacterium tuberculosis CDC1551
ugggcagcggucaaggggcccaagcaaauuccgcauggagcuccuuucgcugccgca

SEQ ID NO: 4240344 - RNA, 80 nt, Mycobacterium tuberculosis CDC1551; identical to SEQ ID NO: 4239209

SEQ ID NO: 4240345 - RNA, 63 nt, Mycobacterium tuberculosis CDC1551
ccacgagcguaacggcacugcgaaaagccgggccggaaauucgcaguggcguuacauucgcgg

SEQ ID NO: 4240346 - RNA, 58 nt, Mycobacterium tuberculosis CDC1551; identical to SEQ ID NO: 4238786

SEQ ID NO: 4240347 - RNA, 95 nt, Mycobacterium tuberculosis CDC1551; identical to SEQ ID NO: 4238478

SEQ ID NO: 4240348 - RNA, 78 nt, Mycobacterium tuberculosis CDC1551; identical to SEQ ID NO: 4238466

SEQ ID NO: 4240349 - RNA, 74 nt, Mycobacterium tuberculosis CDC1551; identical to SEQ ID NO: 4238487

SEQ ID NO: 4240350 - RNA, 79 nt, Mycobacterium tuberculosis CDC1551; identical to SEQ ID NO: 4238607

SEQ ID NO: 4240351 - RNA, 59 nt, Mycobacterium tuberculosis CDC1551; identical to SEQ ID NO: 4239022

SEQ ID NO: 4240352 - RNA, 69 nt, Mycobacterium tuberculosis CDC1551
gcuacucggcggacaucggaugcguccggcugaccgaacgcuguuugcacuccgacccgccgacguugc

SEQ ID NO: 4240353 - RNA, 72 nt, Mycobacterium tuberculosis CDC1551
gguacgaggagcuguccgacaaaguauccgaggaacgccucgagacgauuugucggcagaucaugcuguauc

SEQ ID NO: 4240354 - RNA, 130 nt, Mycobacterium tuberculosis CDC1551
gcgacuugggcauaggcccacccugccagauaccuugacauauaucaaagagauguugcacacuggguucggcgccauuuugauauaagucaaacaacugggaggugucuaccaaugucccgcguucagc

SEQ ID NO: 4240355 - RNA, 96 nt, Mycobacterium tuberculosis CDC1551
cccgggugcuggcgaucuggccggacugggugcggcgguggcccacgccgucggccaccgccacggccagcaccgccgauguguuacgcgccuggg

SEQ ID NO: 4240356 - RNA, 57 nt, Mycobacterium tuberculosis CDC1551; identical to SEQ ID NO: 4238159

SEQ ID NO: 4240357 - RNA, 62 nt, Mycobacterium tuberculosis CDC1551; identical to SEQ ID NO: 4238544

SEQ ID NO: 4240358 - RNA, 63 nt, Mycobacterium tuberculosis CDC1551; identical to SEQ ID NO: 4238409

SEQ ID NO: 4240359 - RNA, 67 nt, Mycobacterium tuberculosis CDC1551; identical to SEQ ID NO: 4237771

SEQ ID NO: 4240360 - RNA, 66 nt, Mycobacterium tuberculosis CDC1551
ucgaugaaugagcggucagcgucgaucgugcgacgcaggaucacacuggccugcucaaccagcaga

SEQ ID NO: 4240361 - RNA, 70 nt, Mycobacterium tuberculosis CDC1551
ggccuuccaucucuguagguggugggugcggaucuugguccgcggcccggagccuccggggguauuggcc

SEQ ID NO: 4240362 - RNA, 58 nt, Mycobacterium tuberculosis CDC1551; identical to SEQ ID NO: 4238626

SEQ ID NO: 4240363 - RNA, 70 nt, Mycobacterium tuberculosis CDC1551
aucguguugacucugcguccaccaggcggguuacucgcacuuuugcgugguggacgcagagucaacggau

SEQ ID NO: 4240364 - RNA, 66 nt, Mycobacterium tuberculosis CDC1551; identical to SEQ ID NO: 4238540

SEQ ID NO: 4240365 - RNA, 74 nt, Mycobacterium tuberculosis CDC1551; identical to SEQ ID NO: 4239184

SEQ ID NO: 4240366 - RNA, 63 nt, Mycobacterium tuberculosis CDC1551
ccggcuucugcaccagcgggucaaccagggcgugguagcgguugacccacugggccgagucgg

SEQ ID NO: 4240367 - RNA, 80 nt, Mycobacterium tuberculosis CDC1551; identical to SEQ ID NO: 4238505

SEQ ID NO: 4240368 - RNA, 58 nt, Mycobacterium tuberculosis CDC1551
ucgauucacgccgauagcuuucucgaauccccacggcaagcguccggcgaugaauuga

SEQ ID NO: 4240369 - RNA, 129 nt, Mycobacterium tuberculosis CDC1551
gucggcucggugcagcaacgccagcagcucgguguggucgagguguccgacgaaccugguugcucugagcacccgguguuugcgggccugaucgaucaaccaauccugcugggugccuucgccggcgau

SEQ ID NO: 4240370 - RNA, 73 nt, Mycobacterium tuberculosis CDC1551
caaccgcgccgccaaugcagcguccguaccauguggacuacggugcugauguugacucugguggcgacggcug

SEQ ID NO: 4240371 - RNA, 55 nt, Mycobacterium tuberculosis CDC1551
cccagcggaaauugguugagcgcaugaucacgucgccauauaccagaucgcuggg

SEQ ID NO: 4240372 - RNA, 69 nt, Mycobacterium tuberculosis CDC1551
gccuggcgagcagacgcaaaagccccuaauaccugccgguuuagggggcuuuugcgucugcucgccggc

SEQ ID NO: 4240373 - RNA, 83 nt, Mycobacterium tuberculosis CDC1551
cauauuccgaaucccuugugaaguaguaaugugcgagcugagcgaugucgccgcucccaaaaauuaccaaugguuuggucaug

SEQ ID NO: 4240374 - RNA, 85 nt, Mycobacterium tuberculosis CDC1551; identical to SEQ ID NO: 4237683

SEQ ID NO: 4240375 - RNA, 114 nt, Mycobacterium tuberculosis CDC1551
gguugcguugccgccguugccgccguugccugcggugcugccggcggauccgucgguuacgcugccgccggcaccaccguugccgccggccccaaacuggccgccgucgccacc

SEQ ID NO: 4240376 - RNA, 78 nt, Mycobacterium tuberculosis CDC1551; identical to SEQ ID NO: 4237835

SEQ ID NO: 4240377 - RNA, 92 nt, Mycobacterium tuberculosis CDC1551; identical to SEQ ID NO: 4238554

SEQ ID NO: 4240378 - RNA, 62 nt, Mycobacterium tuberculosis CDC1551; identical to SEQ ID NO: 4238974

SEQ ID NO: 4240379 - RNA, 83 nt, Mycobacterium tuberculosis CDC1551; identical to SEQ ID NO: 4237607

SEQ ID NO: 4240380 - RNA, 102 nt, Mycobacterium tuberculosis CDC1551
guguugccauucgacuaugaccggcucagcaucgccgagcucgagccgggacggcgguuucgcgaggauucgacgaugcugagcaugcggcaauggcagcac

SEQ ID NO: 4240381 - RNA, 63 nt, Mycobacterium tuberculosis CDC1551; identical to SEQ ID NO: 4237666

SEQ ID NO: 4240382 - RNA, 118 nt, Mycobacterium tuberculosis CDC1551; identical to SEQ ID NO: 4238882

SEQ ID NO: 4240383 - RNA, 82 nt, Mycobacterium tuberculosis CDC1551; identical to SEQ ID NO: 4239079

SEQ ID NO: 4240384 - RNA, 66 nt, Mycobacterium tuberculosis CDC1551; identical to SEQ ID NO: 4238367

SEQ ID NO: 4240385 - RNA, 62 nt, Mycobacterium tuberculosis CDC1551
gcggacugucccgagcgcaccaggaaucgaaccaggcuuccuugugucaucgggcaggucgc

SEQ ID NO: 4240386 - RNA, 120 nt, Mycobacterium tuberculosis CDC1551
ggcggucgucauacuuuccggggucgcggcggcggccaacgaggcagcggcggcccuccucggcuucccgcugcugcucgugguuggggugucgcuggccuauuuguaugucguccugcu

SEQ ID NO: 4240387 - RNA, 126 nt, Mycobacterium tuberculosis CDC1551; identical to SEQ ID NO: 4238398

SEQ ID NO: 4240388 - RNA, 55 nt, Mycobacterium tuberculosis CDC1551; identical to SEQ ID NO: 4238684

SEQ ID NO: 4240389 - RNA, 63 nt, Mycobacterium tuberculosis CDC1551
uucgagcggauuuuucgcaccgggacguugauuaucgaguccgcgucacaagauccgcucgag

SEQ ID NO: 4240390 - RNA, 102 nt, Mycobacterium tuberculosis CDC1551; identical to SEQ ID NO: 4238419

SEQ ID NO: 4240391 - RNA, 62 nt, Mycobacterium tuberculosis CDC1551
gcgggaguugcgggauugaugaccgguuugcugcuugccgcgauccucgcaccgcucgccgc

SEQ ID NO: 4240392 - RNA, 89 nt, Mycobacterium tuberculosis CDC1551
cgcuacuugugccgccgaacagacacaaaaccacccuauuucgaccagaaucgggugcuuuugcgucugcucggccaacuaagcuagcg

SEQ ID NO: 4240393 - RNA, 99 nt, Mycobacterium tuberculosis CDC1551; identical to SEQ ID NO: 4238435

SEQ ID NO: 4240394 - RNA, 81 nt, Mycobacterium tuberculosis CDC1551
ccgcgcuguuugacgucagcgccgcccggucgcugcucgaccggccuacggcgcgggcggugcugagucgcuucggcgcgg

SEQ ID NO: 4240395 - RNA, 73 nt, Mycobacterium tuberculosis CDC1551; identical to SEQ ID NO: 4237703

SEQ ID NO: 4240396 - RNA, 60 nt, Mycobacterium tuberculosis CDC1551; identical to SEQ ID NO: 4239130

SEQ ID NO: 4240397 - RNA, 59 nt, Mycobacterium tuberculosis CDC1551
cgguucuuggccaggccgcugaccagcugcugcagcuggucgacacuggccgaaaauug

SEQ ID NO: 4240398 - RNA, 58 nt, Mycobacterium tuberculosis CDC1551; identical to SEQ ID NO: 4238040

SEQ ID NO: 4240399 - RNA, 90 nt, Mycobacterium tuberculosis CDC1551
ucaacuccgggacugccaacuucggguuguucaacuccggcagcuacaacaccgguaucggcaacuccgggguggccagcaccggguugg

SEQ ID NO: 4240400 - RNA, 61 nt, Mycobacterium tuberculosis CDC1551
cagucguggauuugccagggggccaguacgaagcugaacggcgcuccuuggacuacggcug

SEQ ID NO: 4240401 - RNA, 84 nt, Mycobacterium tuberculosis CDC1551
gcggucgacgacgccgaguaccgcgcgauguuccucgacccucugaucgacgaccugcacaccgcgcugcucgcgcgcaaccgc

SEQ ID NO: 4240402 - RNA, 61 nt, Mycobacterium tuberculosis CDC1551
ggugguggugaguuugagaucggcaagcugugucccaggcccgaggagacuuuccgccacc

SEQ ID NO: 4240403 - RNA, 59 nt, Mycobacterium tuberculosis CDC1551; identical to SEQ ID NO: 4238092

SEQ ID NO: 4240404 - RNA, 69 nt, Mycobacterium tuberculosis CDC1551
gaugccgcagauacccggcuagacguauugaguucaauuggucagcucauccgggauaucuuggauuuc

SEQ ID NO: 4240405 - RNA, 69 nt, Mycobacterium tuberculosis CDC1551
gugcccagcaccgaccagugccggccgccgagcucgauguggaugucggccugcucgguguuggugcac

SEQ ID NO: 4240406 - RNA, 64 nt, Mycobacterium tuberculosis CDC1551; identical to SEQ ID NO: 4238516

SEQ ID NO: 4240407 - RNA, 79 nt, Mycobacterium tuberculosis CDC1551
gucggagaugcauuggcgcugcaguacuuucacgcagcucccuggguugcguggucggaugcaggccagcguggccaac

SEQ ID NO: 4240408 - RNA, 71 nt, Mycobacterium tuberculosis CDC1551
gcacuuccucaagcaccgcgcgguccaggcucaccagcgucaggccaugggccggguucuugaccaacugc

SEQ ID NO: 4240409 - RNA, 83 nt, Mycobacterium tuberculosis CDC1551
guggcucaggucgauacccgaggggauggcaagugucaccccgccauccuuccaccucuuuucgggugcaacgaucgggccau

SEQ ID NO: 4240410 - RNA, 60 nt, Mycobacterium tuberculosis CDC1551
gccgagggugaaucucacgacgggucgucggcgugucgcgucgugcgauucacugucggc

SEQ ID NO: 4240411 - RNA, 59 nt, Mycobacterium tuberculosis CDC1551; identical to SEQ ID NO: 4239012

SEQ ID NO: 4240412 - RNA, 68 nt, Mycobacterium tuberculosis CDC1551
gguucuaacaacgguuucaacauugcccuccugaagggcgucguggaggcagggaugaagcucggacu

SEQ ID NO: 4240413 - RNA, 91 nt, Mycobacterium tuberculosis CDC1551
gaugcgaccgauggugguuugguugccuaccgcgugggcgcgcaccaccacgcguccgcgcaccacgaccgaaccggcgugcacgcgcguu

SEQ ID NO: 4240414 - RNA, 86 nt, Mycobacterium tuberculosis CDC1551
ccugcagcggcgccgccguugcgugagucugccgcggugcgaccggaggccaggcuggugucggcgguggcgccagcucccgcggg

SEQ ID NO: 4240415 - RNA, 87 nt, Mycobacterium tuberculosis CDC1551
aagccaucgggaaauguccauggggucagucuugcgcagcggcauccuguugcgccagcgccucccgcaggauccguccgguggcuu

SEQ ID NO: 4240416 - RNA, 78 nt, Mycobacterium tuberculosis CDC1551; identical to SEQ ID NO: 4238608

SEQ ID NO: 4240417 - RNA, 75 nt, Mycobacterium tuberculosis CDC1551; identical to SEQ ID NO: 4238766

SEQ ID NO: 4240418 - RNA, 80 nt, Mycobacterium tuberculosis CDC1551; identical to SEQ ID NO: 4238876

SEQ ID NO: 4240419 - RNA, 56 nt, Mycobacterium tuberculosis CDC1551; identical to SEQ ID NO: 4238284

SEQ ID NO: 4240420 - RNA, 85 nt, Mycobacterium tuberculosis CDC1551
aagcgagcguauucucggggaggcccucggcgacgaccgcaccgagguggugguggcuagcaaggucuucccggucgcgccguuu

SEQ ID NO: 4240421 - RNA, 72 nt, Mycobacterium tuberculosis CDC1551; identical to SEQ ID NO: 4238560

SEQ ID NO: 4240422 - RNA, 56 nt, Mycobacterium tuberculosis CDC1551; identical to SEQ ID NO: 4239145

SEQ ID NO: 4240423 - RNA, 108 nt, Mycobacterium tuberculosis CDC1551; identical to SEQ ID NO: 4239185

SEQ ID NO: 4240424 - RNA, 63 nt, Mycobacterium tuberculosis CDC1551
gguuuuuucgaggugcaucgugcccucggaacccauccgggcggcauccaugucgagauuacc

SEQ ID NO: 4240425 - RNA, 79 nt, Mycobacterium tuberculosis CDC1551
gguuugguuacagcaaaagccauucauuucuaauuggcuugugcccaauaggaacuggcuugugcccaauagccggauc

SEQ ID NO: 4240426 - RNA, 66 nt, Mycobacterium tuberculosis CDC1551
gaccgccgugguggugagcaccaacggugccaucucgguccgggugaauaccgccaugucacgguc

SEQ ID NO: 4240427 - RNA, 83 nt, Mycobacterium tuberculosis CDC1551
guugggauuacgaacggcacgcagaggacuagcacgucgaccgucgucacgcuaaacccuuugcguggcucgugacucccaac

SEQ ID NO: 4240428 - RNA, 68 nt, Mycobacterium tuberculosis CDC1551; identical to SEQ ID NO: 4238858

SEQ ID NO: 4240429 - RNA, 88 nt, Mycobacterium tuberculosis CDC1551
cggcaucggguagccguuacaggucaccacguagcggugccggucggcgccgaugaugcggaccuggaugcgcucgaccgacgagucg

SEQ ID NO: 4240430 - RNA, 63 nt, Mycobacterium tuberculosis CDC1551; identical to SEQ ID NO: 4239078

SEQ ID NO: 4240431 - RNA, 59 nt, Mycobacterium tuberculosis CDC1551
guugaugggcggcugaaggacugggcaagccucucccguuccggcccggguccagcgac

SEQ ID NO: 4240432 - RNA, 119 nt, Mycobacterium tuberculosis CDC1551
ggccgacguucgcagguucugggcaauaucggcgugguugucggcuugcugcugguagcacugcuuucugagcucgagcagcucacgcccggugucgcggagcucacugaaaauaggcc

SEQ ID NO: 4240433 - RNA, 58 nt, Mycobacterium tuberculosis CDC1551
agggcgagcguuuggccgggcagcgucguuaaucgucggcucaccaagccgccgucuu

SEQ ID NO: 4240434 - RNA, 61 nt, Mycobacterium tuberculosis CDC1551
uuugcggcagaccccgauuuucgagcagaugcugaucgaugacgggauucugcuucgcaaa

SEQ ID NO: 4240435 - RNA, 60 nt, Mycobacterium tuberculosis CDC1551; identical to SEQ ID NO: 4237735

SEQ ID NO: 4240436 - RNA, 55 nt, Mycobacterium tuberculosis CDC1551
cauuggcaccggaaaucgccgguacccauguugccgguggucgcggucgccgaug

SEQ ID NO: 4240437 - RNA, 62 nt, Mycobacterium tuberculosis CDC1551; identical to SEQ ID NO: 4237988

SEQ ID NO: 4240438 - RNA, 70 nt, Mycobacterium tuberculosis CDC1551; identical to SEQ ID NO: 4238208

SEQ ID NO: 4240439 - RNA, 72 nt, Mycobacterium tuberculosis CDC1551; identical to SEQ ID NO: 4239211

SEQ ID NO: 4240440 - RNA, 75 nt, Mycobacterium tuberculosis CDC1551; identical to SEQ ID NO: 4239133

SEQ ID NO: 4240441 - RNA, 55 nt, Mycobacterium tuberculosis CDC1551
ccgcccggcugcgcgagcugggcccaugacggucagcuacggcgcacccgggcgg

SEQ ID NO: 4240442 - RNA, 82 nt, Mycobacterium tuberculosis CDC1551
ggggcuacggcgaggacgaggucuggggucagcugaucaugucggagaccucgccggaccucgagcucuucaccgcgacccc

SEQ ID NO: 4240443 - RNA, 65 nt, Mycobacterium tuberculosis CDC1551; identical to SEQ ID NO: 4238615

SEQ ID NO: 4240444 - RNA, 60 nt, Mycobacterium tuberculosis CDC1551
cgauugauauuaccgauggaaugucuuagacauaagacaugacaucaguaaugucucacg

SEQ ID NO: 4240445 - RNA, 81 nt, Mycobacterium tuberculosis CDC1551
cagguggugaaaugccagcgcgaagaccgccaggucauagcuguggucguggccgucgauugcgguggcgucgaucacuug

SEQ ID NO: 4240446 - RNA, 58 nt, Mycobacterium tuberculosis CDC1551
agucugguccgaaggcuucggcaagccgccgggcggcuugucggaacucggccccacu

SEQ ID NO: 4240447 - RNA, 69 nt, Mycobacterium tuberculosis CDC1551; identical to SEQ ID NO: 4238730

SEQ ID NO: 4240448 - RNA, 57 nt, Mycobacterium tuberculosis CDC1551; identical to SEQ ID NO: 4237783

SEQ ID NO: 4240449 - RNA, 76 nt, Mycobacterium tuberculosis CDC1551
gcgcaagguggcagccagcgccuccgggacacgggccuugauccgggugcccucgggcuugugcuccgccugcugu

SEQ ID NO: 4240450 - RNA, 67 nt, Mycobacterium tuberculosis CDC1551
guggcgaugccgucgucaaccaggaucacgauccuggcgcgcggaucgacgacagggcguccgccgc

SEQ ID NO: 4240451 - RNA, 130 nt, Mycobacterium tuberculosis CDC1551
cuggacgacuacggcuacagcgacuaccgcuaggugggcgagcagacgcagaaucgcacgcgaaaugccugcgcgaugcgauucugcgucugcucgccgugguggaugagccggucuugcaucgccaaug

SEQ ID NO: 4240452 - RNA, 129 nt, Mycobacterium tuberculosis CDC1551; identical to SEQ ID NO: 4239149

SEQ ID NO: 4240453 - RNA, 55 nt, Mycobacterium tuberculosis CDC1551
gguggugccgguacgccaaugcccaacaaugaagauuggcggaucggcgaucacc

SEQ ID NO: 4240454 - RNA, 129 nt, Mycobacterium tuberculosis CDC1551; identical to SEQ ID NO: 4237651

SEQ ID NO: 4240455 - RNA, 62 nt, Mycobacterium tuberculosis CDC1551; identical to SEQ ID NO: 4237684

SEQ ID NO: 4240456 - RNA, 63 nt, Mycobacterium tuberculosis CDC1551
uuggccggcgacguuuccacgaucgcuaccacuccgccccucgucucgugggcgcgccgccaa

SEQ ID NO: 4240457 - RNA, 72 nt, Mycobacterium tuberculosis CDC1551
cagcggauguagguucgggcucauggagaaggugaucgccgugcucaugcggcccgagccagacgacgacug

SEQ ID NO: 4240458 - RNA, 100 nt, Mycobacterium tuberculosis CDC1551
gcgcagccgcgaaucaucgaaucgcuugccgaugccgucggucugggugacgccgugcagauccggauauuggccggugaaaaucgucgggcggcugggc

SEQ ID NO: 4240459 - RNA, 89 nt, Mycobacterium tuberculosis CDC1551
caccgaccucgggcgggcgcugucgauacagcgucagcacggguuuacgugugauggagugaucggcagccacagccgcuagguuggug

SEQ ID NO: 4240460 - RNA, 103 nt, Mycobacterium tuberculosis CDC1551; identical to SEQ ID NO: 4237881

SEQ ID NO: 4240461 - RNA, 130 nt, Mycobacterium tuberculosis CDC1551; identical to SEQ ID NO: 4238551

SEQ ID NO: 4240462 - RNA, 92 nt, Mycobacterium tuberculosis CDC1551
gcucaauccgaacgaaacccaggugcuugccauggcaguuaaagccaagcccggcaaaacacuaugcagcauuugggaucucacugauuggc

SEQ ID NO: 4240463 - RNA, 72 nt, Mycobacterium tuberculosis CDC1551
caaccucauugaacgacauggguuuucgagucaucccaagcgaugccaacuucguguuguucggcgaguuug

SEQ ID NO: 4240464 - RNA, 73 nt, Mycobacterium tuberculosis CDC1551; identical to SEQ ID NO: 4238294

SEQ ID NO: 4240465 - RNA, 97 nt, Mycobacterium tuberculosis CDC1551
gcgguauuuggagccggcgaccaucgagccgagaucgagcgcgacgauggucuugucgcgcaagcucuccggcacgucgccggccacgaugcgcugc

SEQ ID NO: 4240466 - RNA, 108 nt, Mycobacterium tuberculosis H37Rv
ccguucgaccagggugucggccaugacuuggccgcgggagcgcccgucgcagcgggugucugccgcucgggucagcgccgcauacaccgacacgccuugggcgacugg

SEQ ID NO: 4240467 - RNA, 84 nt, Mycobacterium tuberculosis H37Rv
cgcucuguggccgaaaaccuugcugccgaggcggcggccuucguucgcggucgucgggccgagguuuucggcaucuccagggcg

SEQ ID NO: 4240468 - RNA, 78 nt, Mycobacterium tuberculosis H37Rv
ccguacgccggcgguggcauagguaguugcucggcuucccuaggcuccaacuccaagaugccgcccccauaacugcgg

SEQ ID NO: 4240469 - RNA, 85 nt, Mycobacterium tuberculosis H37Rv
gccgcaagggcgcgagcagacgcagaaucgcaugauuugagcucaaaucaugcgauucugcgucugcucgcgaggcucgcguggc

SEQ ID NO: 4240470 - RNA, 87 nt, Mycobacterium tuberculosis H37Rv
cccugccgcucgaagaugcggcgcggguugucgacgagcauggugugcagcugcucgucggugacgccgugcugcuucagugcgggg

SEQ ID NO: 4240471 - RNA, 60 nt, Mycobacterium tuberculosis H37Rv
ggcccacaccgccuucaagcgggcggccaggucggaugcccguucgcguuugugugggcc

SEQ ID NO: 4240472 - RNA, 67 nt, Mycobacterium tuberculosis H37Rv
ggccaugccgaccgcggcgaucggggccagccugcugggcgccgugguggccgggaucggcauggcc

SEQ ID NO: 4240473 - RNA, 76 nt, Mycobacterium tuberculosis H37Rv
gugguuauguagaagaugucgaccgaucagaugaagcgauccgcgucaggugguauccgaugucuuuugugaccau

SEQ ID NO: 4240474 - RNA, 67 nt, Mycobacterium tuberculosis H37Rv; identical to SEQ ID NO: 4237868

SEQ ID NO: 4240475 - RNA, 76 nt, Mycobacterium tuberculosis H37Rv; identical to SEQ ID NO: 4238126

SEQ ID NO: 4240476 - RNA, 58 nt, Mycobacterium tuberculosis H37Rv
auguugcccgcugaacuguugcccgccgacuggccgggcgccggguuacgggcggcgu

SEQ ID NO: 4240477 - RNA, 103 nt, Mycobacterium tuberculosis H37Rv
ggcccgggccgcaccgagcacaacgucgucggcgugcgggugaugccgguguucgcguucaaguccggcgcauuuuucgcggcuaucgucgguguucugggcc

SEQ ID NO: 4240478 - RNA, 60 nt, Mycobacterium tuberculosis H37Rv; identical to SEQ ID NO: 4238013

SEQ ID NO: 4240479 - RNA, 78 nt, Mycobacterium tuberculosis H37Rv; identical to SEQ ID NO: 4239163

SEQ ID NO: 4240480 - RNA, 55 nt, Mycobacterium tuberculosis H37Rv
cgcggggucguugucggugaugccgauuuucgaggcaccgcagucgacgcucgcg

SEQ ID NO: 4240481 - RNA, 76 nt, Mycobacterium tuberculosis H37Rv; identical to SEQ ID NO: 4238928

SEQ ID NO: 4240482 - RNA, 113 nt, Mycobacterium tuberculosis H37Rv; identical to SEQ ID NO: 4237785

SEQ ID NO: 4240483 - RNA, 64 nt, Mycobacterium tuberculosis H37Rv; identical to SEQ ID NO: 4237983

SEQ ID NO: 4240484 - RNA, 61 nt, Mycobacterium tuberculosis H37Rv; identical to SEQ ID NO: 4238033

SEQ ID NO: 4240485 - RNA, 85 nt, Mycobacterium tuberculosis H37Rv
cgugcacacccacuaugacgccgagguguugcucgauccugguuugcgggagucggugcgccacggugucaccacggugcugcug

SEQ ID NO: 4240486 - RNA, 65 nt, Mycobacterium tuberculosis H37Rv
acugaagcggcccgauauggugcugccgcguacccuaccgcgcagccguccgugccggccguagu

SEQ ID NO: 4240487 - RNA, 61 nt, Mycobacterium tuberculosis H37Rv
gcuggaauucuuuggauucgccgggccagaguccuaaccaggcgaugaacgaaggaucggc

SEQ ID NO: 4240488 - RNA, 56 nt, Mycobacterium tuberculosis H37Rv; identical to SEQ ID NO: 4237922

SEQ ID NO: 4240489 - RNA, 61 nt, Mycobacterium tuberculosis H37Rv
gguucuccgggacuugcucgcgggacuuugcgugcagguaaaacgaguccaggaucgaacc

SEQ ID NO: 4240490 - RNA, 62 nt, Mycobacterium tuberculosis H37Rv; identical to SEQ ID NO: 4238029

SEQ ID NO: 4240491 - RNA, 70 nt, Mycobacterium tuberculosis H37Rv
gccuugaagcgcucggguugcaacguaucaagacugacagugaugcguuucauacccgcagccuucaggc

SEQ ID NO: 4240492 - RNA, 55 nt, Mycobacterium tuberculosis H37Rv; identical to SEQ ID NO: 4239176

SEQ ID NO: 4240493 - RNA, 63 nt, Mycobacterium tuberculosis H37Rv; identical to SEQ ID NO: 4238821

SEQ ID NO: 4240494 - RNA, 66 nt, Mycobacterium tuberculosis H37Rv; identical to SEQ ID NO: 4237780

SEQ ID NO: 4240495 - RNA, 76 nt, Mycobacterium tuberculosis H37Rv; identical to SEQ ID NO: 4238391

SEQ ID NO: 4240496 - RNA, 75 nt, Mycobacterium tuberculosis H37Rv; identical to SEQ ID NO: 4238406

SEQ ID NO: 4240497 - RNA, 58 nt, Mycobacterium tuberculosis H37Rv; identical to SEQ ID NO: 4238850

SEQ ID NO: 4240498 - RNA, 61 nt, Mycobacterium tuberculosis H37Rv
gcggcggcgccgauguggaagccgugcugccgacgguacggcccauuguggcggccgucgc

SEQ ID NO: 4240499 - RNA, 56 nt, Mycobacterium tuberculosis H37Rv; identical to SEQ ID NO: 4238698

SEQ ID NO: 4240500 - RNA, 81 nt, Mycobacterium tuberculosis H37Rv; identical to SEQ ID NO: 4238538

SEQ ID NO: 4240501 - RNA, 89 nt, Mycobacterium tuberculosis H37Rv
ggccgacgcaacccaccgacugugaaucucacgacgccuccgccgcgugucgcgucgugccauucacaguggccgggcugccccgcguc

SEQ ID NO: 4240502 - RNA, 87 nt, Mycobacterium tuberculosis H37Rv; identical to SEQ ID NO: 4238970

SEQ ID NO: 4240503 - RNA, 99 nt, Mycobacterium tuberculosis H37Rv
gauggggacuacuggcuggcggguggacgcggcucgguggugcgcacugcgcgcgggaugguuuacaccgagccggucaccaacgcguugggccucauc

SEQ ID NO: 4240504 - RNA, 87 nt, Mycobacterium tuberculosis H37Rv; identical to SEQ ID NO: 4239200

SEQ ID NO: 4240505 - RNA, 92 nt, Mycobacterium tuberculosis H37Rv; identical to SEQ ID NO: 4240462

SEQ ID NO: 4240506 - RNA, 61 nt, Mycobacterium tuberculosis H37Rv
guugacucugcguccaccaggcggguuacucgcacuuuugcgugguggacgcagagucaac

SEQ ID NO: 4240507 - RNA, 57 nt, Mycobacterium tuberculosis H37Rv; identical to SEQ ID NO: 4237844

SEQ ID NO: 4240508 - RNA, 60 nt, Mycobacterium tuberculosis H37Rv; identical to SEQ ID NO: 4239177

SEQ ID NO: 4240509 - RNA, 61 nt, Mycobacterium tuberculosis H37Rv; identical to SEQ ID NO: 4238168

SEQ ID NO: 4240510 - RNA, 72 nt, Mycobacterium tuberculosis H37Rv; identical to SEQ ID NO: 4238236

SEQ ID NO: 4240511 - RNA, 70 nt, Mycobacterium tuberculosis H37Rv
acccggucaaagaugucgcugggugcgcgaaggauuugauaggcgcgcagugacguuuguuggcugucgu

SEQ ID NO: 4240512 - RNA, 97 nt, Mycobacterium tuberculosis H37Rv
guuggcaaccaagguucgccgagcguaacgccacugcgaaaaaccgcgcggagauucgcagugccguuacguucgugacgcggguccgucggccagc

SEQ ID NO: 4240513 - RNA, 58 nt, Mycobacterium tuberculosis H37Rv; identical to SEQ ID NO: 4238846

SEQ ID NO: 4240514 - RNA, 92 nt, Mycobacterium tuberculosis H37Rv
gcgccugaggugcugccaagcagacgcagaaucgcacaaaccgggcgcgauuaaugcgauucugcgucugcuuggcggggcuaguugagcgc

SEQ ID NO: 4240515 - RNA, 63 nt, Mycobacterium tuberculosis H37Rv; identical to SEQ ID NO: 4237901

SEQ ID NO: 4240516 - RNA, 61 nt, Mycobacterium tuberculosis H37Rv
ugcccagcgauuucgaccgugccucgauaccaggcugggcauggucugacguucuggagca

SEQ ID NO: 4240517 - RNA, 69 nt, Mycobacterium tuberculosis H37Rv
ggcgaacaccggccacaggcugugcuggucuucgucguugaccagcacgaagaaugcgccguugucguc

SEQ ID NO: 4240518 - RNA, 104 nt, Mycobacterium tuberculosis H37Rv; identical to SEQ ID NO: 4239213

SEQ ID NO: 4240519 - RNA, 58 nt, Mycobacterium tuberculosis H37Rv
ugggugugcucggcgaggaacagcgacucaaacccgcggugcucgagugccgcaccca

SEQ ID NO: 4240520 - RNA, 56 nt, Mycobacterium tuberculosis H37Rv
accgaagccucgugcgcggccaacaagagcucgugccgccgcgccgcaacuucggu

SEQ ID NO: 4240521 - RNA, 85 nt, Mycobacterium tuberculosis H37Rv
gcggugcguuauuaaagcucacgguguucgcggugggggugaugcccuacaucaccgccagcaucaucgugcagcugcucaccgu

SEQ ID NO: 4240522 - RNA, 65 nt, Mycobacterium tuberculosis H37Rv; identical to SEQ ID NO: 4238620

SEQ ID NO: 4240523 - RNA, 77 nt, Mycobacterium tuberculosis H37Rv
ggccgccggagaaugcggaaucacgcugcugcuacuccguggcaccucaaagcgggguucagcguucuccgccaccc

SEQ ID NO: 4240524 - RNA, 74 nt, Mycobacterium tuberculosis H37Rv; identical to SEQ ID NO: 4239039

SEQ ID NO: 4240525 - RNA, 85 nt, Mycobacterium tuberculosis H37Rv
gccccucggguguggcguugcuggcgaucggauucaccgaaccgagacccacgguggcaaugugaucgccggcaacuccgcgggc

SEQ ID NO: 4240526 - RNA, 58 nt, Mycobacterium tuberculosis H37Rv; identical to SEQ ID NO: 4238387

SEQ ID NO: 4240527 - RNA, 94 nt, Mycobacterium tuberculosis H37Rv
auccaggcugucaucgaugucacggucgugacccgcugccaccaucucgaagucggcgguggugaccgccgcgacgucugcggcuagcucgggu

SEQ ID NO: 4240528 - RNA, 55 nt, Mycobacterium tuberculosis H37Rv
gcgguguucccagcgcggugugggucaucacacccaacggucgcuacagcauugc

SEQ ID NO: 4240529 - RNA, 70 nt, Mycobacterium tuberculosis H37Rv; identical to SEQ ID NO: 4237961

SEQ ID NO: 4240530 - RNA, 69 nt, Mycobacterium tuberculosis H37Rv; identical to SEQ ID NO: 4237962

SEQ ID NO: 4240531 - RNA, 86 nt, Mycobacterium tuberculosis H37Rv
gagguaucccggucuacgacgucgcuguaggccagcccggcgugcagaauccguucgacgaguuccucguggguccguuuuaccuc

SEQ ID NO: 4240532 - RNA, 81 nt, Mycobacterium tuberculosis H37Rv
gauaccuugacauauaucaaagagauguugcacacuggguucggcgccauuuugauauaagucaaacaacugggagguguc

SEQ ID NO: 4240533 - RNA, 124 nt, Mycobacterium tuberculosis H37Rv; identical to SEQ ID NO: 4237659

SEQ ID NO: 4240534 - RNA, 115 nt, Mycobacterium tuberculosis H37Rv
aguuggcugccgcgggcgguucgucgugccuggacccgauggaaguacccggcaagggcuucaugagccuggcggucgauccgucgggugcggccuucggccuguggcagccgcu

SEQ ID NO: 4240535 - RNA, 55 nt, Mycobacterium tuberculosis H37Rv
cagguugaccgccacgauuccgcccgagcgauuggagucgaagucggucagcuug

SEQ ID NO: 4240536 - RNA, 57 nt, Mycobacterium tuberculosis H37Rv
ggcgggaucgagaugcuccagcaggccacggugcugcugucaucgaugaacccugcc

SEQ ID NO: 4240537 - RNA, 70 nt, Mycobacterium tuberculosis H37Rv
cggccaggugcagguggucgacggcgauccgcuggcguucaagaucaccaccaaacuggaucuguugcug

SEQ ID NO: 4240538 - RNA, 64 nt, Mycobacterium tuberculosis H37Rv; identical to SEQ ID NO: 4237915

SEQ ID NO: 4240539 - RNA, 80 nt, Mycobacterium tuberculosis H37Rv
gcgauucgcgucggcacgcccaacgagguggccaccgaagucagcgugaacaccgcguucggugugcggcgugugguugc

SEQ ID NO: 4240540 - RNA, 62 nt, Mycobacterium tuberculosis H37Rv; identical to SEQ ID NO: 4239226

SEQ ID NO: 4240541 - RNA, 74 nt, Mycobacterium tuberculosis H37Rv; identical to SEQ ID NO: 4238844

SEQ ID NO: 4240542 - RNA, 55 nt, Mycobacterium tuberculosis H37Rv; identical to SEQ ID NO: 4237631

SEQ ID NO: 4240543 - RNA, 75 nt, Mycobacterium tuberculosis H37Rv
ggccagcgguuuucgcggccaucggaucggcggucaccgacaccggugagccggugguggaaggccugcugagcc

SEQ ID NO: 4240544 - RNA, 85 nt, Mycobacterium tuberculosis H37Rv; identical to SEQ ID NO: 4237683

SEQ ID NO: 4240545 - RNA, 65 nt, Mycobacterium tuberculosis H37Rv; identical to SEQ ID NO: 4238753

SEQ ID NO: 4240546 - RNA, 64 nt, Mycobacterium tuberculosis H37Rv
ggcgaugcgguggaucucgucgauaaacaacacgucgugcucgaccagguuggacagcaucgcc

SEQ ID NO: 4240547 - RNA, 129 nt, Mycobacterium tuberculosis H37Rv; identical to SEQ ID NO: 4237671

SEQ ID NO: 4240548 - RNA, 58 nt, Mycobacterium tuberculosis H37Rv; identical to SEQ ID NO: 4237700

SEQ ID NO: 4240549 - RNA, 57 nt, Mycobacterium tuberculosis H37Rv; identical to SEQ ID NO: 4238898

SEQ ID NO: 4240550 - RNA, 58 nt, Mycobacterium tuberculosis H37Rv
uugugggaaacgugcgugaccacaaugccgggcaugaugucacgcgguuguucuacga

SEQ ID NO: 4240551 - RNA, 82 nt, Mycobacterium tuberculosis H37Rv
gccgacgcugccggaagagaccggauuguugccugcggaauuauucgccgaggcaaucagucaggucgcuaucgccgccggc

SEQ ID NO: 4240552 - RNA, 55 nt, Mycobacterium tuberculosis H37Rv
gucgaccaagccaagcguguugugguugccaaccagcaaugcgcguucggucggc

SEQ ID NO: 4240553 - RNA, 55 nt, Mycobacterium tuberculosis H37Rv; identical to SEQ ID NO: 4238521

SEQ ID NO: 4240554 - RNA, 58 nt, Mycobacterium tuberculosis H37Rv; identical to SEQ ID NO: 4239082

SEQ ID NO: 4240555 - RNA, 56 nt, Mycobacterium tuberculosis H37Rv; identical to SEQ ID NO: 4238273

SEQ ID NO: 4240556 - RNA, 56 nt, Mycobacterium tuberculosis H37Rv
gguagcgccgcggcucgcaaugcaucgguccaugccauugcgucagcggugcuguc

SEQ ID NO: 4240557 - RNA, 61 nt, Mycobacterium tuberculosis H37Rv; identical to SEQ ID NO: 4237989

SEQ ID NO: 4240558 - RNA, 90 nt, Mycobacterium tuberculosis H37Rv; identical to SEQ ID NO: 4240399

SEQ ID NO: 4240559 - RNA, 56 nt, Mycobacterium tuberculosis H37Rv
ggacgcgccugcugcgcagcucgcucgcccggucgcgguugcgggccaucgcgucc

SEQ ID NO: 4240560 - RNA, 76 nt, Mycobacterium tuberculosis H37Rv; identical to SEQ ID NO: 4238144

SEQ ID NO: 4240561 - RNA, 76 nt, Mycobacterium tuberculosis H37Rv
ggccugguccgugauggaacgucuggagaccuugaacgcuacccaucucuuuauggcgugccgucgugaccgaccc

SEQ ID NO: 4240562 - RNA, 61 nt, Mycobacterium tuberculosis H37Rv; identical to SEQ ID NO: 4239113

SEQ ID NO: 4240563 - RNA, 68 nt, Mycobacterium tuberculosis H37Rv
ccaucugcagcuggaccgccugggugaucgguaccagccacagaugucgggggucccagugcggaugg

SEQ ID NO: 4240564 - RNA, 102 nt, Mycobacterium tuberculosis H37Rv; identical to SEQ ID NO: 4238419

SEQ ID NO: 4240565 - RNA, 61 nt, Mycobacterium tuberculosis H37Rv; identical to SEQ ID NO: 4238453

SEQ ID NO: 4240566 - RNA, 84 nt, Mycobacterium tuberculosis H37Rv
gaugcgguguacucgaucgucgccgacggcuaccgagcgguuaccgauuuggucggagcuggggcacgguuggaugaaucgguc

SEQ ID NO: 4240567 - RNA, 110 nt, Mycobacterium tuberculosis H37Rv; identical to SEQ ID NO: 4238911

SEQ ID NO: 4240568 - RNA, 72 nt, Mycobacterium tuberculosis H37Rv; identical to SEQ ID NO: 4238914

SEQ ID NO: 4240569 - RNA, 74 nt, Mycobacterium tuberculosis H37Rv
cggccgagacuacuucgaucugacgcccgaugacgaccagaagcugaucaucgagaccgucgacgaauucgccg

SEQ ID NO: 4240570 - RNA, 69 nt, Mycobacterium tuberculosis H37Rv; identical to SEQ ID NO: 4237699

SEQ ID NO: 4240571 - RNA, 70 nt, Mycobacterium tuberculosis H37Rv
uuccgcuacccagguugaaguugccgauguugccgcuacccacguugaagcuggaaaucuggccguggaa

SEQ ID NO: 4240572 - RNA, 56 nt, Mycobacterium tuberculosis H37Rv; identical to SEQ ID NO: 4239123

SEQ ID NO: 4240573 - RNA, 59 nt, Mycobacterium tuberculosis H37Rv
uugacucugcgcucaccacgcgggccacucgcacaauugccugguauccgcagagucaa

SEQ ID NO: 4240574 - RNA, 106 nt, Mycobacterium tuberculosis H37Rv
ggccaacauccgguggugcucgucggugucgguucggucggccugcgaacacgcgaugacgaguucgcgcaucaacggauugaccgcgagcaccgucgggguugcc

SEQ ID NO: 4240575 - RNA, 56 nt, Mycobacterium tuberculosis H37Rv
cgagcguaacgccacugcgaaauuucgggcagaaaaucgcaguggcguuacgcucg

SEQ ID NO: 4240576 - RNA, 69 nt, Mycobacterium tuberculosis H37Rv; identical to SEQ ID NO: 4237821

SEQ ID NO: 4240577 - RNA, 66 nt, Mycobacterium tuberculosis H37Rv
gccaaaggccuuacccuggcuggguuugcgaccucaacacagcccagcaggaaaggccuuuguggu

SEQ ID NO: 4240578 - RNA, 91 nt, Mycobacterium tuberculosis H37Rv
gggcaagguugcgccugugcacuacccguccgguugggcggcgguggcagcggcgaucaaugccgauccccggacgguugcggucuugccc

SEQ ID NO: 4240579 - RNA, 64 nt, Mycobacterium tuberculosis H37Rv
ugucggacuaucugguggccgauccgcacauggugcgcgaucugcacaccgagagaguuccgca

SEQ ID NO: 4240580 - RNA, 55 nt, Mycobacterium tuberculosis H37Rv
uggcgcugcaguacuuucacgcagcucccuggguugcguggucggaugcaggcca

SEQ ID NO: 4240581 - RNA, 72 nt, Mycobacterium tuberculosis H37Rv; identical to SEQ ID NO: 4240457

SEQ ID NO: 4240582 - RNA, 59 nt, Mycobacterium tuberculosis H37Rv; identical to SEQ ID NO: 4237618

SEQ ID NO: 4240583 - RNA, 65 nt, Mycobacterium tuberculosis H37Rv
ccuggcggcacuugccggggagcagguaugcacugaccguccacguucucguaguagccgcuagg

SEQ ID NO: 4240584 - RNA, 65 nt, Mycobacterium tuberculosis H37Rv; identical to SEQ ID NO: 4238894

SEQ ID NO: 4240585 - RNA, 70 nt, Mycobacterium tuberculosis H37Rv
cggaacuccucgacguccugcaugcccuguaggcuaaccuaccaagcacuugcuuuguuaggagcguccg

SEQ ID NO: 4240586 - RNA, 59 nt, Mycobacterium tuberculosis H37Rv
ugucgaucugcugaugguggucgcggcgaucggcgcggccgccaucgggcagaucgccg

SEQ ID NO: 4240587 - RNA, 74 nt, Mycobacterium tuberculosis H37Rv
cugagugccgagcgugcaucuggggcgggaauucggcgauuuuuccgcccugaguucacgcucggcgcaaucgg

SEQ ID NO: 4240588 - RNA, 70 nt, Mycobacterium tuberculosis H37Rv
agcaguucugcggcggggucgucgcggugguagccgaccgcggugcacaccaucgcccaguacuucugcu

SEQ ID NO: 4240589 - RNA, 96 nt, Mycobacterium tuberculosis H37Rv
gcccugggcaaauuccgugauacgcgccgacgauccggggucgucggagagcacgaccgugggcucuucggccgucaucguggugagcaggcgggc

SEQ ID NO: 4240590 - RNA, 130 nt, Mycobacterium tuberculosis H37Rv
gauaugguggacuucgcaccggucaccgggugcguggcaguugggucgaccaugggugcggugcccgcguugcugcggguccguuucccguggccgcccuucgaaccggacgugcgacuuucaccguauc

SEQ ID NO: 4240591 - RNA, 72 nt, Mycobacterium tuberculosis H37Rv
gcgaccucuggguuaugagcuaaccagucgcaaucucucccaucgcggucggucucauacguccagaucagc

SEQ ID NO: 4240592 - RNA, 73 nt, Mycobacterium tuberculosis H37Rv; identical to SEQ ID NO: 4240370

SEQ ID NO: 4240593 - RNA, 129 nt, Mycobacterium tuberculosis H37Rv; identical to SEQ ID NO: 4238948

SEQ ID NO: 4240594 - RNA, 70 nt, Mycobacterium tuberculosis H37Rv
aguugucccccuucaaggggaccggagguucaaauccucucgccuccgcaguccuuuaggggacacaacu

SEQ ID NO: 4240595 - RNA, 69 nt, Mycobacterium tuberculosis H37Rv; identical to SEQ ID NO: 4238329

SEQ ID NO: 4240596 - RNA, 57 nt, Mycobacterium tuberculosis H37Rv
ucgucgggcucuucagcgucgcggccaugaaugcggacgugcuggagaucccgacga

SEQ ID NO: 4240597 - RNA, 89 nt, Mycobacterium tuberculosis H37Rv
cgcugagaccagcggcuguggcggagucugcuugaggucuagaaacagagucauaucgggcggagucgcgccaauggcuugcuccagug

SEQ ID NO: 4240598 - RNA, 71 nt, Mycobacterium tuberculosis H37Rv; identical to SEQ ID NO: 4238044

SEQ ID NO: 4240599 - RNA, 66 nt, Mycobacterium tuberculosis H37Rv; identical to SEQ ID NO: 4238085

SEQ ID NO: 4240600 - RNA, 81 nt, Mycobacterium tuberculosis H37Rv
uugacggcuucgacgaaugcgaaugcauccgcucguggugacggaaucucgaagaugcgucgauucguuguuagccggagg

SEQ ID NO: 4240601 - RNA, 95 nt, Mycobacterium tuberculosis H37Rv
ugcgccgcuucgagcaugccgccgguggacaagaucuuuacccgcucggcugggaaugcuccuucgccggcgagguauagcgccgagguugcgca

SEQ ID NO: 4240602 - RNA, 91 nt, Mycobacterium tuberculosis H37Rv; identical to SEQ ID NO: 4238796

SEQ ID NO: 4240603 - RNA, 56 nt, Mycobacterium tuberculosis H37Rv
cgcgcguaucgcacgcauugggugucgccggagcucucggagcgugcggucgcgcg

SEQ ID NO: 4240604 - RNA, 62 nt, Mycobacterium tuberculosis H37Rv; identical to SEQ ID NO: 4237723

SEQ ID NO: 4240605 - RNA, 85 nt, Mycobacterium tuberculosis H37Rv; identical to SEQ ID NO: 4237797

SEQ ID NO: 4240606 - RNA, 75 nt, Mycobacterium tuberculosis H37Rv; identical to SEQ ID NO: 4238949

SEQ ID NO: 4240607 - RNA, 58 nt, Mycobacterium tuberculosis H37Rv
gugcgagccgauuucgauuuggcggccggccucgccgauuaucgagauggcgucgugc

SEQ ID NO: 4240608 - RNA, 56 nt, Mycobacterium tuberculosis H37Rv
ggauuucgugaccuuguagccgcaguaccugcggcggcauggucgugaacuggucc

SEQ ID NO: 4240609 - RNA, 87 nt, Mycobacterium tuberculosis H37Rv
cgguaccaccaugaguugcagauccggcccaccuugggcgacggccggucgcccaagguggccgaucugcgccgcgccguggugcug

SEQ ID NO: 4240610 - RNA, 55 nt, Mycobacterium tuberculosis H37Rv; identical to SEQ ID NO: 4238024

SEQ ID NO: 4240611 - RNA, 80 nt, Mycobacterium tuberculosis H37Rv; identical to SEQ ID NO: 4237711

SEQ ID NO: 4240612 - RNA, 57 nt, Mycobacterium tuberculosis H37Rv
ccucggugucaaggcgauuagcgcgcgagcugggcgcacgcuuucuggacaccgggg

SEQ ID NO: 4240613 - RNA, 78 nt, Mycobacterium tuberculosis H37Rv; identical to SEQ ID NO: 4239007

SEQ ID NO: 4240614 - RNA, 77 nt, Mycobacterium tuberculosis H37Rv; identical to SEQ ID NO: 4240221

SEQ ID NO: 4240615 - RNA, 63 nt, Mycobacterium tuberculosis H37Rv; identical to SEQ ID NO: 4238215

SEQ ID NO: 4240616 - RNA, 59 nt, Mycobacterium tuberculosis H37Rv; identical to SEQ ID NO: 4237599

SEQ ID NO: 4240617 - RNA, 93 nt, Mycobacterium tuberculosis H37Rv
gccgcaccagcuuccagggcgcgagcagacgcagaaucgcccaauuucgugccgaaaugggcgauucugcgucugcucgcgagcgggagcggc

SEQ ID NO: 4240618 - RNA, 96 nt, Mycobacterium tuberculosis H37Rv
cugccagaccgggacuucguggcacuugccgaacugggcgguguuguagccguugagcuuuagcguccgcgcgaucggcgacaugguguucgguag

SEQ ID NO: 4240619 - RNA, 62 nt, Mycobacterium tuberculosis H37Rv
gcaccgcugagcgugguugcggugaacugcagacguucaucggcugccaccgcucgcggugu

SEQ ID NO: 4240620 - RNA, 78 nt, Mycobacterium tuberculosis H37Rv
cggcgccgagcgugcacugggggcgagauucgggccagccgauuuuccgcccucaguucacgcugggcgacggcgccg

SEQ ID NO: 4240621 - RNA, 58 nt, Mycobacterium tuberculosis H37Rv
guuggcgccggacacgucggcgaugaacgcaaagaagucgucggcuucccgguccaau

SEQ ID NO: 4240622 - RNA, 119 nt, Mycobacterium tuberculosis H37Rv
gggccugcacgacgaucuuguuggcggucgauguuccguuggugacgaaguaggucugguuggcguuccaggucaccgcggcuuuguccaucgccgucuugauguugccaugcgggucc

SEQ ID NO: 4240623 - RNA, 74 nt, Mycobacterium tuberculosis H37Rv; identical to SEQ ID NO: 4238999

SEQ ID NO: 4240624 - RNA, 125 nt, Mycobacterium tuberculosis H37Rv
agcccgcgcagaucgugcucacggccggcaaacgcggugcucaacgccucggugaugucuugaaccuggcccaguccgccgccguugagcaccagcgacagcgcugccagcgucugcucggugcu

SEQ ID NO: 4240625 - RNA, 67 nt, Mycobacterium tuberculosis H37Rv
gggcgcgagcagacgcaaaaucgcccauuucggcacgaaauugggcgauuuugcgucugcucgcccu

SEQ ID NO: 4240626 - RNA, 71 nt, Mycobacterium tuberculosis H37Rv
uacgccgccgacugugaaccgcgcgacgucuccucggcgugucacgucgugagauucaccgucggcgcgug

SEQ ID NO: 4240627 - RNA, 85 nt, Mycobacterium tuberculosis H37Rv
ccggcgggguccaacgccugcgucaugggguuccaacccauuuguuggaaugccggcgacgcggcguugaacccauuggugcugg

SEQ ID NO: 4240628 - RNA, 65 nt, Mycobacterium tuberculosis H37Rv; identical to SEQ ID NO: 4238831

SEQ ID NO: 4240629 - RNA, 101 nt, Mycobacterium tuberculosis H37Rv; identical to SEQ ID NO: 4240279

SEQ ID NO: 4240630 - RNA, 84 nt, Mycobacterium tuberculosis H37Rv
cggccaccaacgccgaugagaucaacgacgucguccggaacacauucguccagggcacccugucgaucgucuucgugguggucg

SEQ ID NO: 4240631 - RNA, 77 nt, Mycobacterium tuberculosis H37Rv; identical to SEQ ID NO: 4237909

SEQ ID NO: 4240632 - RNA, 57 nt, Mycobacterium tuberculosis H37Rv; identical to SEQ ID NO: 4237931

SEQ ID NO: 4240633 - RNA, 71 nt, Mycobacterium tuberculosis H37Rv
ugaccgcuggugagcagacgcagagucgcacugcggccggcgcagugcgacucugcgucugcucgcgcuca

SEQ ID NO: 4240634 - RNA, 121 nt, Mycobacterium tuberculosis H37Rv
cguguuguacgacccaggguuggccacaccgguauugaaauuaccggcauugaaaagcccaguacugcccguuccgccauugccgaugccgguguugaagcugcccgaguugaacaacccg

SEQ ID NO: 4240635 - RNA, 59 nt, Mycobacterium tuberculosis H37Rv
ggaccgguugcccgccguggaucgcgccauucugcgcgucucgguaugggagcugcucc

SEQ ID NO: 4240636 - RNA, 120 nt, Mycobacterium tuberculosis H37Rv
gcguccgcaacuucuccaccaccugccgguagggcugcacgacagcgucgaagucgguguugaguugaccgaccguuccgucgugcagucgcugcaggcuggcaucgauguugucggcgu

SEQ ID NO: 4240637 - RNA, 56 nt, Mycobacterium tuberculosis H37Rv; identical to SEQ ID NO: 4238107

SEQ ID NO: 4240638 - RNA, 85 nt, Mycobacterium tuberculosis H37Rv
gccgacggccuugaugucgggguggugcaggauggcgucgacggccuccuugucgccgugcaccaccuggaacacgcccgccggc

SEQ ID NO: 4240639 - RNA, 76 nt, Mycobacterium tuberculosis H37Rv; identical to SEQ ID NO: 4238694

SEQ ID NO: 4240640 - RNA, 73 nt, Mycobacterium tuberculosis H37Rv; identical to SEQ ID NO: 4238427

SEQ ID NO: 4240641 - RNA, 58 nt, Mycobacterium tuberculosis H37Rv; identical to SEQ ID NO: 4238563

SEQ ID NO: 4240642 - RNA, 59 nt, Mycobacterium tuberculosis H37Rv
uuggugggauccagccccagccacucgaaccgcccgggcugcugcggaguccacaccga

SEQ ID NO: 4240643 - RNA, 65 nt, Mycobacterium tuberculosis H37Rv
gcagcgcucguguucgaugcggccaucgccuuugcggccguggucacagacgaucacgauguugu

SEQ ID NO: 4240644 - RNA, 57 nt, Mycobacterium tuberculosis H37Rv; identical to SEQ ID NO: 4238221

SEQ ID NO: 4240645 - RNA, 69 nt, Mycobacterium tuberculosis H37Rv
accgaauggcggcuucuuacgagcaguugucaccacguuggcaaaguucacgaagaugcccugcgcggu

SEQ ID NO: 4240646 - RNA, 86 nt, Mycobacterium tuberculosis H37Rv
ggaucgcugaccucaacgauguugggccggaaaugccuucggguguaggcgcggucccgcucaacaucguuaacggcguacgcacc

SEQ ID NO: 4240647 - RNA, 58 nt, Mycobacterium tuberculosis H37Rv; identical to SEQ ID NO: 4237622

SEQ ID NO: 4240648 - RNA, 104 nt, Mycobacterium tuberculosis H37Rv
ccgcaucgccgggccauggcgucaucuggacgugcacgccaacggcauccgauuccacgucgucgaggcugugccguccggccagccggagggcccggaugcgg

SEQ ID NO: 4240649 - RNA, 64 nt, Mycobacterium tuberculosis H37Rv
ucgcucagucgguccugaaggcguugcaguccaccgaaguacacgccuugguagccgcugacga

SEQ ID NO: 4240650 - RNA, 56 nt, Mycobacterium tuberculosis H37Rv; identical to SEQ ID NO: 4239145

SEQ ID NO: 4240651 - RNA, 116 nt, Mycobacterium tuberculosis H37Rv; identical to SEQ ID NO: 4238077

SEQ ID NO: 4240652 - RNA, 72 nt, Mycobacterium tuberculosis H37Rv; identical to SEQ ID NO: 4238265

SEQ ID NO: 4240653 - RNA, 60 nt, Mycobacterium tuberculosis H37Rv
cgacgcgcugaccgcggugcgccgccgggugaccugggcguuccacgaccggcgcggccg

SEQ ID NO: 4240654 - RNA, 78 nt, Mycobacterium tuberculosis H37Rv; identical to SEQ ID NO: 4238670

SEQ ID NO: 4240655 - RNA, 61 nt, Mycobacterium tuberculosis H37Rv; identical to SEQ ID NO: 4239097

SEQ ID NO: 4240656 - RNA, 66 nt, Mycobacterium tuberculosis H37Rv; identical to SEQ ID NO: 4239180

SEQ ID NO: 4240657 - RNA, 68 nt, Mycobacterium tuberculosis H37Rv
gcgcauuugcacguagaucgacucggcgauguuguuguugccgcgccagucgguugcgcgcuccgcgu

SEQ ID NO: 4240658 - RNA, 87 nt, Mycobacterium tuberculosis H37Rv
cgcugugcaucgucgcuggcgcgagucauaggcgccgcuccuccucaucgcuucgcugugcaucgucgccggcgcgagucauaggcg

SEQ ID NO: 4240659 - RNA, 87 nt, Mycobacterium tuberculosis H37Rv
ugcguuaaccucgaaucuguggugauucguugcgugcuuagaacggaggagggccgauggaccgccuggaugacaccgacgaacgca

SEQ ID NO: 4240660 - RNA, 93 nt, Mycobacterium tuberculosis H37Rv
ucagcgcugacgacguccugugcacggcgaugcggucuggcaagugucggcgcugccaguaccucucgaugccaacaggaucgucggucuuga

SEQ ID NO: 4240661 - RNA, 66 nt, Mycobacterium tuberculosis H37Rv
gggccagcggugaucguggugcagagggguugggucgacgaugucugguccagcggucaccguccc

SEQ ID NO: 4240662 - RNA, 77 nt, Mycobacterium tuberculosis H37Rv; identical to SEQ ID NO: 4238341

SEQ ID NO: 4240663 - RNA, 71 nt, Mycobacterium tuberculosis H37Rv; identical to SEQ ID NO: 4238983

SEQ ID NO: 4240664 - RNA, 110 nt, Mycobacterium tuberculosis H37Rv
cgggcagaagaucuggagcucgcgggcgccguucgccgacauggguuuugggcuguuccgcuccgaucccgcggucgaacggcaccgcgggcucacguauuucauguucg

SEQ ID NO: 4240665 - RNA, 60 nt, Mycobacterium tuberculosis H37Rv
gaguaugccggauccuucagcuggucugcgagagcagggcuggucguuggucugaugcuc

SEQ ID NO: 4240666 - RNA, 74 nt, Mycobacterium tuberculosis H37Rv; identical to SEQ ID NO: 4237705

SEQ ID NO: 4240667 - RNA, 68 nt, Mycobacterium tuberculosis H37Rv; identical to SEQ ID NO: 4240304

SEQ ID NO: 4240668 - RNA, 84 nt, Mycobacterium tuberculosis H37Rv
gcggccgggcaggccgacacuuccagcucggggcaggcggguccgugccgggcggaacgugucagccgaguggugcagguucgc

SEQ ID NO: 4240669 - RNA, 57 nt, Mycobacterium tuberculosis H37Rv
ugucagggugcacaccgucgccacaaacucggguccguguggcgguggcaccuggca

SEQ ID NO: 4240670 - RNA, 86 nt, Mycobacterium tuberculosis H37Rv
gcauuccccgaugguguugaccgauggaucacgguaccgcccgccacauggguggcagcccaggguccgcgggacacccagaaugu

SEQ ID NO: 4240671 - RNA, 62 nt, Mycobacterium tuberculosis H37Rv; identical to SEQ ID NO: 4238617

SEQ ID NO: 4240672 - RNA, 88 nt, Mycobacterium tuberculosis H37Rv; identical to SEQ ID NO: 4238907

SEQ ID NO: 4240673 - RNA, 89 nt, Mycobacterium tuberculosis H37Rv; identical to SEQ ID NO: 4238773

SEQ ID NO: 4240674 - RNA, 77 nt, Mycobacterium tuberculosis H37Rv
cguugauaccgcaugcucguccggccugacggccgugcacauggcgugucgcagccugcacgagggugaaagcgacg

SEQ ID NO: 4240675 - RNA, 84 nt, Mycobacterium tuberculosis H37Rv; identical to SEQ ID NO: 4240401

SEQ ID NO: 4240676 - RNA, 70 nt, Mycobacterium tuberculosis H37Rv
ccagccuggccaucgagggcaucgggccuagccgaagcgcccggagauguaguccucgguggccuucugg

SEQ ID NO: 4240677 - RNA, 60 nt, Mycobacterium tuberculosis H37Rv; identical to SEQ ID NO: 4238632

SEQ ID NO: 4240678 - RNA, 75 nt, Mycobacterium tuberculosis H37Rv; identical to SEQ ID NO: 4238491

SEQ ID NO: 4240679 - RNA, 72 nt, Mycobacterium tuberculosis H37Rv
cgacggcgaaaucgacagcagcgcgacaaaguucgacgagaagacaccgcgcuaaugucgauuucgaugacg

SEQ ID NO: 4240680 - RNA, 68 nt, Mycobacterium tuberculosis H37Rv; identical to SEQ ID NO: 4238880

SEQ ID NO: 4240681 - RNA, 61 nt, Mycobacterium tuberculosis H37Rv; identical to SEQ ID NO: 4238106

SEQ ID NO: 4240682 - RNA, 82 nt, Mycobacterium tuberculosis H37Rv
guccgcgcccgcaacuccaugcgcguacagggggccgauaagccgcucccccaccaguaccgggucgagauugcggccgggc

SEQ ID NO: 4240683 - RNA, 79 nt, Mycobacterium tuberculosis H37Rv; identical to SEQ ID NO: 4238426

SEQ ID NO: 4240684 - RNA, 67 nt, Mycobacterium tuberculosis H37Rv
cuguuagcacaggcugcccuaauuuuagugguuacccuaucuucgaaccacgcaccugcgcuaccag

SEQ ID NO: 4240685 - RNA, 76 nt, Mycobacterium tuberculosis H37Rv; identical to SEQ ID NO: 4238428

SEQ ID NO: 4240686 - RNA, 69 nt, Mycobacterium tuberculosis H37Rv; identical to SEQ ID NO: 4239215

SEQ ID NO: 4240687 - RNA, 79 nt, Mycobacterium tuberculosis H37Rv; identical to SEQ ID NO: 4238192

SEQ ID NO: 4240688 - RNA, 85 nt, Mycobacterium tuberculosis H37Rv
ggugacguaguugaugauggucggcgccgacacgugcgggaugucuggauuguccuugucggagccgacuuucgccgcucgcacc

SEQ ID NO: 4240689 - RNA, 59 nt, Mycobacterium tuberculosis H37Rv; identical to SEQ ID NO: 4239105

SEQ ID NO: 4240690 - RNA, 59 nt, Mycobacterium tuberculosis H37Rv
uugcgcauaguagguagguguggcgaacagcaucggcacgcuggugaagcuuugcgcaa

SEQ ID NO: 4240691 - RNA, 56 nt, Mycobacterium tuberculosis H37Rv
ccaggaacgggacgccgugugcaucggcgaccgccugcgcggcugccgucuccugg

SEQ ID NO: 4240692 - RNA, 96 nt, Mycobacterium tuberculosis H37Rv
gccaccgugguggucgcgcaggugcucgcugaucuugucgacggcaucgucggcggugacgucgagccacagcgcggugccgcccaccuugcuggc

SEQ ID NO: 4240693 - RNA, 66 nt, Mycobacterium tuberculosis H37Rv
gccgggcauuacggccgucguugggcccaacggcuccggcaaauccaauguggucgaugcccuggc

SEQ ID NO: 4240694 - RNA, 83 nt, Mycobacterium tuberculosis H37Rv; identical to SEQ ID NO: 4237712

SEQ ID NO: 4240695 - RNA, 65 nt, Mycobacterium tuberculosis H37Rv; identical to SEQ ID NO: 4238218

SEQ ID NO: 4240696 - RNA, 61 nt, Mycobacterium tuberculosis H37Rv; identical to SEQ ID NO: 4238547

SEQ ID NO: 4240697 - RNA, 66 nt, Mycobacterium tuberculosis H37Rv
ucggguggcacaccacccgacgucgcugggcgccgccccggugaccacgguggugcgccacgacga

SEQ ID NO: 4240698 - RNA, 74 nt, Mycobacterium tuberculosis H37Rv; identical to SEQ ID NO: 4237964

SEQ ID NO: 4240699 - RNA, 90 nt, Mycobacterium tuberculosis H37Rv
cgccguccugccggcgaagcugauucugauggcgauugcguugauuugcgcggccgcaguguucucggcgaucgcccugcgggacuugcg

SEQ ID NO: 4240700 - RNA, 68 nt, Mycobacterium tuberculosis H37Rv
gcccauuugcccgacgucgcauugcuggacuaccgcaugcccggcauggacggcgcgcagguugcggc

SEQ ID NO: 4240701 - RNA, 56 nt, Mycobacterium tuberculosis H37Rv
cggguucgcgaucgcgccggagcuggugcgcacggugcugcgcgacaacgaacccg

SEQ ID NO: 4240702 - RNA, 76 nt, Mycobacterium tuberculosis H37Rv
gcuggugccgcuggcaggugcggugcugaucauccugcuaccacccggucggcgccgacucgccaagugggccggu

SEQ ID NO: 4240703 - RNA, 126 nt, Mycobacterium tuberculosis H37Rv
gcggccgaguccugagggcugcagugacccccggucgacucgaucggcgagccccgugccuuggugcacggggcucgcccguugguguagacacaaggacgugcagccaucgccggacucacccgc

SEQ ID NO: 4240704 - RNA, 120 nt, Mycobacterium tuberculosis H37Rv; identical to SEQ ID NO: 4240386

SEQ ID NO: 4240705 - RNA, 65 nt, Mycobacterium tuberculosis H37Rv; identical to SEQ ID NO: 4238053

SEQ ID NO: 4240706 - RNA, 111 nt, Mycobacterium tuberculosis H37Rv; identical to SEQ ID NO: 4237704

SEQ ID NO: 4240707 - RNA, 59 nt, Mycobacterium tuberculosis H37Rv; identical to SEQ ID NO: 4237889

SEQ ID NO: 4240708 - RNA, 113 nt, Mycobacterium tuberculosis H37Rv
gugcuugcgcuaccggcgguagggcagaacuggccgacggugucgccggugcgcgugcgggcgcgccgggcggccaccgcggcgcacuaugaaaaccauggcggcacaggcac

SEQ ID NO: 4240709 - RNA, 57 nt, Mycobacterium tuberculosis H37Rv; identical to SEQ ID NO: 4239033

SEQ ID NO: 4240710 - RNA, 72 nt, Mycobacterium tuberculosis H37Rv
gccggcauccccuccguuggccccggugccgggagcaccguuagccccguuaccgaucagcggacggccggu

SEQ ID NO: 4240711 - RNA, 69 nt, Mycobacterium tuberculosis H37Rv; identical to SEQ ID NO: 4237725

SEQ ID NO: 4240712 - RNA, 59 nt, Mycobacterium tuberculosis H37Rv; identical to SEQ ID NO: 4239136

SEQ ID NO: 4240713 - RNA, 102 nt, Mycobacterium tuberculosis H37Rv; identical to SEQ ID NO: 4238079

SEQ ID NO: 4240714 - RNA, 56 nt, Mycobacterium tuberculosis H37Rv; identical to SEQ ID NO: 4239081

SEQ ID NO: 4240715 - RNA, 64 nt, Mycobacterium tuberculosis H37Rv; identical to SEQ ID NO: 4238475

SEQ ID NO: 4240716 - RNA, 89 nt, Mycobacterium tuberculosis H37Rv; identical to SEQ ID NO: 4238942

SEQ ID NO: 4240717 - RNA, 69 nt, Mycobacterium tuberculosis H37Rv; identical to SEQ ID NO: 4238757

SEQ ID NO: 4240718 - RNA, 95 nt, Mycobacterium tuberculosis H37Rv
ggcacgcguugugguguguugccaagaucguugauccccagugcuugugccaaucgcuuggcugggucaaucgucaaaacgaccacagugcggcc

SEQ ID NO: 4240719 - RNA, 88 nt, Mycobacterium tuberculosis H37Rv
ggacaaguuuggcgcgcacgauuucaaaucuaaggauugugauuuauuuggucuuagaguuugaaauugguccuuauuuacuuagucc

SEQ ID NO: 4240720 - RNA, 59 nt, Mycobacterium tuberculosis H37Rv
ccucuucgagcuccuuggcgaugcccagcaaggagucaucgccgccgagcuuggccagg

SEQ ID NO: 4240721 - RNA, 111 nt, Mycobacterium tuberculosis H37Rv
cggucccgucgaucccguucgcgccgucgccgaucaaugggcgcccggucagcgacugaacgggugcguugaucgcaucgagcacguucugcagcgguguugcgcuggccg

SEQ ID NO: 4240722 - RNA, 107 nt, Mycobacterium tuberculosis H37Rv; identical to SEQ ID NO: 4237746

SEQ ID NO: 4240723 - RNA, 55 nt, Mycobacterium tuberculosis H37Rv; identical to SEQ ID NO: 4238684

SEQ ID NO: 4240724 - RNA, 55 nt, Mycobacterium tuberculosis H37Rv
gcuggucgaugggcggcuacggcgcuuugcugcucggcagccgccuuggaccggc

SEQ ID NO: 4240725 - RNA, 55 nt, Mycobacterium tuberculosis H37Rv; identical to SEQ ID NO: 4238462

SEQ ID NO: 4240726 - RNA, 56 nt, Mycobacterium tuberculosis H37Rv; identical to SEQ ID NO: 4238799

SEQ ID NO: 4240727 - RNA, 58 nt, Mycobacterium tuberculosis H37Rv; identical to SEQ ID NO: 4239018

SEQ ID NO: 4240728 - RNA, 123 nt, Mycobacterium tuberculosis H37Rv; identical to SEQ ID NO: 4238537

SEQ ID NO: 4240729 - RNA, 82 nt, Mycobacterium tuberculosis H37Rv
ucgugcaccgugauucgggaguagcgcuccuugagcgcguggaugucggugagcgccugcuucagggucuccucggugcgga

SEQ ID NO: 4240730 - RNA, 55 nt, Mycobacterium tuberculosis H37Rv
augaucggcggcgcgguguggucggccgguccggccgcgcggcgauagucgucgu

SEQ ID NO: 4240731 - RNA, 60 nt, Mycobacterium tuberculosis H37Rv; identical to SEQ ID NO: 4238701

SEQ ID NO: 4240732 - RNA, 92 nt, Mycobacterium tuberculosis H37Rv; identical to SEQ ID NO: 4238927

SEQ ID NO: 4240733 - RNA, 106 nt, Mycobacterium tuberculosis H37Rv; identical to SEQ ID NO: 4237950

SEQ ID NO: 4240734 - RNA, 64 nt, Mycobacterium tuberculosis H37Rv; identical to SEQ ID NO: 4238516

SEQ ID NO: 4240735 - RNA, 61 nt, Mycobacterium tuberculosis H37Rv; identical to SEQ ID NO: 4238100

SEQ ID NO: 4240736 - RNA, 112 nt, Mycobacterium tuberculosis H37Rv
gccuugccagaauguacguggugacccgagccgggcaaccauuacacaguuggccagcacugaccaacuucauuuguagcgguuacccucaccuguacucauucggccgggc

SEQ ID NO: 4240737 - RNA, 77 nt, Mycobacterium tuberculosis H37Rv
gcgagccucgcgagcagacgcagaaucgcaugauuugagcucaaaucaugcgauucugcgucugcucgcgcccuugc

SEQ ID NO: 4240738 - RNA, 55 nt, Mycobacterium tuberculosis H37Rv
gugggggcaggugcugcgacggcagccgcugccgcugucgcugcuggccacccac

SEQ ID NO: 4240739 - RNA, 65 nt, Mycobacterium tuberculosis H37Rv; identical to SEQ ID NO: 4238330

SEQ ID NO: 4240740 - RNA, 130 nt, Mycobacterium tuberculosis H37Rv; identical to SEQ ID NO: 4238612

SEQ ID NO: 4240741 - RNA, 82 nt, Mycobacterium tuberculosis H37Rv
cgaugucaccgauuuggcgggugcugcgguguggggguuggugcgcucugcccaggcugaacauccgggccgggugguguug

SEQ ID NO: 4240742 - RNA, 65 nt, Mycobacterium tuberculosis H37Rv; identical to SEQ ID NO: 4238615

SEQ ID NO: 4240743 - RNA, 68 nt, Mycobacterium tuberculosis H37Rv; identical to SEQ ID NO: 4237715

SEQ ID NO: 4240744 - RNA, 73 nt, Mycobacterium tuberculosis H37Rv
agauaucgugggaugcgcuacuccucgugcuaugugacgaugcgcgacggggugcgcaucgccaucgaccucu

SEQ ID NO: 4240745 - RNA, 61 nt, Mycobacterium tuberculosis H37Rv
gucgcagaccggcaggaacacgucagcgccgccggcguugacguggagcuuggucugaaac

SEQ ID NO: 4240746 - RNA, 56 nt, Mycobacterium tuberculosis H37Rv
gagcagacgcaaaaucgcccaauucggcacgaaauugggcgauuuugcgucugcuc

SEQ ID NO: 4240747 - RNA, 67 nt, Mycobacterium tuberculosis H37Rv
ucgcuaaggccggcaacggcggugccggcggcaacggcggcaaugugggcguugccggccagggugg

SEQ ID NO: 4240748 - RNA, 81 nt, Mycobacterium tuberculosis H37Rv; identical to SEQ ID NO: 4238576

SEQ ID NO: 4240749 - RNA, 82 nt, Mycobacterium tuberculosis H37Rv
cgaccacacaguaguagacgucgucgcagccggccaucgccucggccacgguggcggugucgaagacgucgccguggaaucg

SEQ ID NO: 4240750 - RNA, 78 nt, Mycobacterium tuberculosis H37Rv
uagguugcgcgagcagacguaaaagcccccgacacgccgagcgugcgggggcuuuuacgucugcucgcgcucagcuua

SEQ ID NO: 4240751 - RNA, 63 nt, Mycobacterium tuberculosis H37Rv
guugggcagcgcgccgccguugacggggcagguguucuucgucaacccgaauguguugccagc

SEQ ID NO: 4240752 - RNA, 109 nt, Mycobacterium tuberculosis H37Rv
gaagaagccgaacucgucgucggagagcuucucgccgucgauaucggcuuggaucaacugagucacgaugucgucggcgggguucuucgccuucuccucggccaucuuc

SEQ ID NO: 4240753 - RNA, 80 nt, Mycobacterium tuberculosis H37Rv
cagaccgccccacccguaugaucgcugcggccacugcgucgcguugccagccagcgagcaugccgggugccgaggugcug

SEQ ID NO: 4240754 - RNA, 65 nt, Mycobacterium tuberculosis H37Rv; identical to SEQ ID NO: 4238599

SEQ ID NO: 4240755 - RNA, 103 nt, Mycobacterium tuberculosis H37Rv; identical to SEQ ID NO: 4238395

SEQ ID NO: 4240756 - RNA, 62 nt, Mycobacterium tuberculosis H37Rv; identical to SEQ ID NO: 4238955

SEQ ID NO: 4240757 - RNA, 68 nt, Mycobacterium tuberculosis H37Rv
guaguuugucgggaucuugaccaagggagaaggucagacaaccuugcggauccagaucgacgagcagc

SEQ ID NO: 4240758 - RNA, 63 nt, Mycobacterium tuberculosis H37Rv; identical to SEQ ID NO: 4239201

SEQ ID NO: 4240759 - RNA, 87 nt, Mycobacterium tuberculosis H37Rv
ucaucacgaacggcuugaacagcuccagcgccaucagcuugggcagaccgcacuggugcagcuugagcugcgggccgaccacgauga

SEQ ID NO: 4240760 - RNA, 57 nt, Mycobacterium tuberculosis H37Rv
ccaacccgucgauguucgagccggugcauggcagcgcgccggacaucgccggucagg

SEQ ID NO: 4240761 - RNA, 75 nt, Mycobacterium tuberculosis H37Rv; identical to SEQ ID NO: 4237727

SEQ ID NO: 4240762 - RNA, 60 nt, Mycobacterium tuberculosis H37Rv
gcagcacgccgcuauggcaguggccaccgggguggcugacgucgugguggcguaucgggc

SEQ ID NO: 4240763 - RNA, 58 nt, Mycobacterium tuberculosis H37Rv
cgagcagacgcaaaaucgcccaauuucgucucgaaaugggcgauuuugcgucugcucg

SEQ ID NO: 4240764 - RNA, 59 nt, Mycobacterium tuberculosis H37Rv; identical to SEQ ID NO: 4238233

SEQ ID NO: 4240765 - RNA, 55 nt, Mycobacterium tuberculosis H37Rv; identical to SEQ ID NO: 4238404

SEQ ID NO: 4240766 - RNA, 86 nt, Mycobacterium tuberculosis H37Rv; identical to SEQ ID NO: 4237634

SEQ ID NO: 4240767 - RNA, 98 nt, Mycobacterium tuberculosis H37Rv
ccgcccugacuaccugcagacgugccgggugacguuuccgucggggcggauggcugacgcgcugaaggugacccacccggcggcgaucguaugggcgg

SEQ ID NO: 4240768 - RNA, 64 nt, Mycobacterium tuberculosis H37Rv
guaucggugacgcgcgaccggaagcuggcgagcacaucaccaucgucgacgugaucaccgauac

SEQ ID NO: 4240769 - RNA, 101 nt, Mycobacterium tuberculosis H37Rv
cggccccgccgauaccggcguugcccgcgguuccgccgguguuggccaggccgccgacgccggcgucgccgccggucccgccggugccgccggacccgccg

SEQ ID NO: 4240770 - RNA, 130 nt, Mycobacterium tuberculosis H37Rv
aguccggucccggcgcgaguuaucggggcccgccgcgauggugugucggcgaucacgcuggaccgcgguuugccggcugacgguggcgacgccaugccguggcugauagccagcgccaaaacacuguccu

SEQ ID NO: 4240771 - RNA, 97 nt, Mycobacterium tuberculosis H37Rv
cgacgucggugcccggccggccaguaucagcaucaagguggucuucccugauccguuggccccgaugaucgcuaggugcucgccggcccggacgucg

SEQ ID NO: 4240772 - RNA, 57 nt, Mycobacterium tuberculosis H37Rv; identical to SEQ ID NO: 4238645

SEQ ID NO: 4240773 - RNA, 60 nt, Mycobacterium tuberculosis H37Rv; identical to SEQ ID NO: 4238390

SEQ ID NO: 4240774 - RNA, 81 nt, Mycobacterium tuberculosis H37Rv
ccggcggcgauggacgcgucgaggucuuccugauggguguagggaaccuccaucaucggaaggcgucgacucccgccccgg

SEQ ID NO: 4240775 - RNA, 74 nt, Mycobacterium tuberculosis H37Rv; identical to SEQ ID NO: 4238685

SEQ ID NO: 4240776 - RNA, 66 nt, Mycobacterium tuberculosis H37Rv; identical to SEQ ID NO: 4238196

SEQ ID NO: 4240777 - RNA, 57 nt, Mycobacterium tuberculosis H37Rv
ccgaggcauccaccgccgcaucggugucgaucaacacgauccggccgggauuuucgg

SEQ ID NO: 4240778 - RNA, 118 nt, Mycobacterium tuberculosis H37Rv
gugccucgacauuggccgggauguaccggaucuggucggggucgaucuccagucugaggcucgccccguucugggcccacucgauccgaccgaucugggcgacccggccgaccugcac

SEQ ID NO: 4240779 - RNA, 72 nt, Mycobacterium tuberculosis H37Rv
ugaaucccacucgcguggugcacaucggcgauucgcuugaggacgccgcugcugccagcgcggucggagcca

SEQ ID NO: 4240780 - RNA, 60 nt, Mycobacterium tuberculosis H37Rv
gucagcagacgcaaaagcccccgacacgccgagcgugcgggggcuuuagcgucugcucgc

SEQ ID NO: 4240781 - RNA, 76 nt, Mycobacterium tuberculosis H37Rv
cagccucgcgaucuggauggccgguguuacgcgggagaucaaccugcucgcgcaggccucacaauggcgcaggcug

SEQ ID NO: 4240782 - RNA, 71 nt, Mycobacterium tuberculosis H37Rv; identical to SEQ ID NO: 4237911

SEQ ID NO: 4240783 - RNA, 72 nt, Mycobacterium tuberculosis H37Rv; identical to SEQ ID NO: 4239211

SEQ ID NO: 4240784 - RNA, 61 nt, Mycobacterium tuberculosis H37Rv; identical to SEQ ID NO: 4238368

SEQ ID NO: 4240785 - RNA, 58 nt, Mycobacterium tuberculosis H37Rv
gucgucggccaguagcgcaccgucggaaaagaccgcggguggaucacuggccagcgac

SEQ ID NO: 4240786 - RNA, 66 nt, Mycobacterium tuberculosis H37Rv
ccgaacgcgucggugggaucggugccacccaccccgucgccgccgaucccgaaccggcgcucgcgg

SEQ ID NO: 4240787 - RNA, 68 nt, Mycobacterium tuberculosis H37Rv
caccuggccguaccccgaaaucgcuaccgcagccaugauuucgccaucggguccgcgacuggccggug

SEQ ID NO: 4240788 - RNA, 75 nt, Mycobacterium tuberculosis H37Rv
gcgacgccgaaucggcacuguugcagcgggucgaacggaucgagacccgguuggacaugucgaucccggcgccgc

SEQ ID NO: 4240789 - RNA, 129 nt, Mycobacterium tuberculosis H37Rv
uuguuccagcgcggccagucacuuucagaugccgagaacaccuuggguuccuggcugccgccggggccggcugcggucgcugacuauccgacggugcugcucaguggugcauggcuaucgcaggagcaa

SEQ ID NO: 4240790 - RNA, 62 nt, Mycobacterium tuberculosis H37Rv
gccgcgaugucgaucucggucuccucgaacccgccggucaaccgaacgauccacgcgauggc

SEQ ID NO: 4240791 - RNA, 56 nt, Mycobacterium tuberculosis H37Rv; identical to SEQ ID NO: 4238114

SEQ ID NO: 4240792 - RNA, 99 nt, Mycobacterium tuberculosis H37Rv
gaacaccacgaugaucaucacggugaacaccgacagcaccaaccagacgaugccgaguuugauaguugugccugugguuuucauggguugaucguguuc

SEQ ID NO: 4240793 - RNA, 57 nt, Mycobacterium tuberculosis H37Rv; identical to SEQ ID NO: 4237811

SEQ ID NO: 4240794 - RNA, 61 nt, Mycobacterium tuberculosis H37Rv; identical to SEQ ID NO: 4240339

SEQ ID NO: 4240795 - RNA, 63 nt, Mycobacterium tuberculosis H37Rv
cccaugguccgggucagcuuguggcugucggugacggcggucgccgugcuguucggcuggggg

SEQ ID NO: 4240796 - RNA, 86 nt, Mycobacterium tuberculosis H37Rv; identical to SEQ ID NO: 4237864

SEQ ID NO: 4240797 - RNA, 66 nt, Mycobacterium tuberculosis H37Rv
gacuccgaugguggcacggggcugguguugggguucgccggcgugcugcuguucaucaucggguuc

SEQ ID NO: 4240798 - RNA, 65 nt, Mycobacterium tuberculosis H37Rv
cggugccgugggucggcaauagcaucaguaacaggcaucaugaugcguuguuguguccggcgccg

SEQ ID NO: 4240799 - RNA, 71 nt, Mycobacterium tuberculosis H37Rv
guauccagucguggauuugccagggggccaguacgaagcugaacggcgcuccuuggacuacggcugugugc

SEQ ID NO: 4240800 - RNA, 57 nt, Mycobacterium tuberculosis H37Rv; identical to SEQ ID NO: 4238397

SEQ ID NO: 4240801 - RNA, 56 nt, Mycobacterium tuberculosis H37Rv
agccgagcaggugcgcuuccucgacgaccacgacgggggugcguccgcgcucggcu

SEQ ID NO: 4240802 - RNA, 57 nt, Mycobacterium tuberculosis H37Rv
cucagcgaggaguacuacagggcguacggcgccgccacucuggagauucucgcugag

SEQ ID NO: 4240803 - RNA, 55 nt, Mycobacterium tuberculosis H37Rv; identical to SEQ ID NO: 4237899

SEQ ID NO: 4240804 - RNA, 79 nt, Mycobacterium tuberculosis H37Rv; identical to SEQ ID NO: 4238132

SEQ ID NO: 4240805 - RNA, 91 nt, Mycobacterium tuberculosis H37Rv; identical to SEQ ID NO: 4239159

SEQ ID NO: 4240806 - RNA, 102 nt, Mycobacterium tuberculosis H37Rv
cguugaucgugaugguuccgguguccgguuggucgaggccggcuauggugcgcaacagcgucgacuugcccgaaccgcuggggcccaacaaugcggucagcg

SEQ ID NO: 4240807 - RNA, 104 nt, Mycobacterium tuberculosis H37Rv; identical to SEQ ID NO: 4239236

SEQ ID NO: 4240808 - RNA, 56 nt, Mycobacterium tuberculosis H37Rv; identical to SEQ ID NO: 4237765

SEQ ID NO: 4240809 - RNA, 97 nt, Mycobacterium tuberculosis H37Rv
cgcgaugcggguagccccgccagcgugacgccacugcgagaaucagcgacgaauuucgccgugacguuacgcuggcggcgacgcucccacgucgacg

SEQ ID NO: 4240810 - RNA, 86 nt, Mycobacterium tuberculosis H37Rv
ccagcgcgucccgcgagcagacgcaaaagcccccaaaaucgcccgauuuggggugcuuuugcgucugcucgcgcacugugucaugg

SEQ ID NO: 4240811 - RNA, 60 nt, Mycobacterium tuberculosis H37Rv
gaucguggugcggugcuugccaugacugguguaggagggcagguacucgcagacgcgguc

SEQ ID NO: 4240812 - RNA, 82 nt, Mycobacterium tuberculosis H37Rv; identical to SEQ ID NO: 4237981

SEQ ID NO: 4240813 - RNA, 62 nt, Mycobacterium tuberculosis H37Rv
ccgcggugacgacggacuugcggaucgagugcgggacaacccauuugaaguccucuccgcgg

SEQ ID NO: 4240814 - RNA, 62 nt, Mycobacterium tuberculosis H37Rv; identical to SEQ ID NO: 4239178

SEQ ID NO: 4240815 - RNA, 69 nt, Mycobacterium tuberculosis H37Rv; identical to SEQ ID NO: 4237612

SEQ ID NO: 4240816 - RNA, 57 nt, Mycobacterium tuberculosis H37Rv; identical to SEQ ID NO: 4238381

SEQ ID NO: 4240817 - RNA, 56 nt, Mycobacterium tuberculosis H37Rv; identical to SEQ ID NO: 4238933

SEQ ID NO: 4240818 - RNA, 107 nt, Mycobacterium tuberculosis H37Rv; identical to SEQ ID NO: 4237623

SEQ ID NO: 4240819 - RNA, 95 nt, Mycobacterium tuberculosis H37Rv
cccgcuagauuugcggccaccgcgaggggcggcgcuaucaauccggcuaccaguccgauuccgauugccgccccauugguggcuaacgccagggg

SEQ ID NO: 4240820 - RNA, 62 nt, Mycobacterium tuberculosis H37Rv; identical to SEQ ID NO: 4238974

SEQ ID NO: 4240821 - RNA, 68 nt, Mycobacterium tuberculosis H37Rv
ccuacagcgucaaugcaccugcgaucgucaagagugucuacgguucgcaggcgaugaccgcuacuugg

SEQ ID NO: 4240822 - RNA, 67 nt, Mycobacterium tuberculosis H37Rv; identical to SEQ ID NO: 4237854

SEQ ID NO: 4240823 - RNA, 118 nt, Mycobacterium tuberculosis H37Rv; identical to SEQ ID NO: 4237847

SEQ ID NO: 4240824 - RNA, 72 nt, Mycobacterium tuberculosis H37Rv
cgucgguacggaccgaucaugacgaugcccauucucagccugggugacguugcgaucguguccgacucggcg

SEQ ID NO: 4240825 - RNA, 60 nt, Mycobacterium tuberculosis H37Rv; identical to SEQ ID NO: 4237735

SEQ ID NO: 4240826 - RNA, 63 nt, Mycobacterium tuberculosis H37Rv
ggggcaagccggucacgcguggccaaccguucggaguugguggccgcagugucggccuggacc

SEQ ID NO: 4240827 - RNA, 93 nt, Mycobacterium tuberculosis H37Rv
ccgcuguaguucugaccgcgagcagacgcagaaucgcacgcgcgagguccgcgccgugcgauucugcgucugcucgccaguuauccccagcgg

SEQ ID NO: 4240828 - RNA, 106 nt, Mycobacterium tuberculosis H37Rv; identical to SEQ ID NO: 4239048

SEQ ID NO: 4240829 - RNA, 55 nt, Mycobacterium tuberculosis H37Rv
ugcucuuguccagugcggcgccguaggcaucgacggcaccuaccgacaggacgua

SEQ ID NO: 4240830 - RNA, 80 nt, Mycobacterium tuberculosis H37Rv; identical to SEQ ID NO: 4238614

SEQ ID NO: 4240831 - RNA, 82 nt, Mycobacterium tuberculosis H37Rv
cggucugaccgugcucaccggacugcgcgaauugauacuggcggagaucaaggcgcuacuguucggggucauggccgggcug

SEQ ID NO: 4240832 - RNA, 83 nt, Mycobacterium tuberculosis H37Rv
cgccggugggaaggguggcgccggcggcgccggcgccaccgagggugugaccggcgcgaccggcgcuaccgugcacaguggug

SEQ ID NO: 4240833 - RNA, 81 nt, Mycobacterium tuberculosis H37Rv; identical to SEQ ID NO: 4239182

SEQ ID NO: 4240834 - RNA, 74 nt, Mycobacterium tuberculosis H37Rv
ggcugaagaacgcgucguagcgcucgugaccgaaauguucgaaagcaccgaugcugacgaugcggucgacgggc

SEQ ID NO: 4240835 - RNA, 63 nt, Mycobacterium tuberculosis H37Rv; identical to SEQ ID NO: 4238693

SEQ ID NO: 4240836 - RNA, 64 nt, Mycobacterium tuberculosis H37Rv
gcagggcccgcagcgcggccagcaggccgucgugguggcguuggccggcgcugcgggugucggc

SEQ ID NO: 4240837 - RNA, 55 nt, Mycobacterium tuberculosis H37Rv; identical to SEQ ID NO: 4237800

SEQ ID NO: 4240838 - RNA, 59 nt, Mycobacterium tuberculosis H37Rv
acccguucgaccagggugucggccaugacuuggccgcgggagcgcccgucgcagcgggu

SEQ ID NO: 4240839 - RNA, 89 nt, Mycobacterium tuberculosis H37Rv; identical to SEQ ID NO: 4238501

SEQ ID NO: 4240840 - RNA, 93 nt, Mycobacterium tuberculosis H37Rv
gggcaagaauccauugcgggaccaccgugaagaucguccaacgcugcaaguagguggcgaucgcggugguguccacgaucgacgucaucgccc

SEQ ID NO: 4240841 - RNA, 68 nt, Mycobacterium tuberculosis H37Rv; identical to SEQ ID NO: 4239196

SEQ ID NO: 4240842 - RNA, 57 nt, Mycobacterium tuberculosis H37Rv; identical to SEQ ID NO: 4238613

SEQ ID NO: 4240843 - RNA, 56 nt, Mycobacterium tuberculosis H37Rv
agugcgguucauguauucgguggauccguaccugccaccggggacaaagccgcgcu

SEQ ID NO: 4240844 - RNA, 59 nt, Mycobacterium tuberculosis H37Rv
cacgcuugacguggugaguauaagacguuuuaauacgucuuaugacaucugucaagcug

SEQ ID NO: 4240845 - RNA, 125 nt, Mycobacterium tuberculosis H37Rv; identical to SEQ ID NO: 4238640

SEQ ID NO: 4240846 - RNA, 60 nt, Mycobacterium tuberculosis H37Rv; identical to SEQ ID NO: 4238476

SEQ ID NO: 4240847 - RNA, 65 nt, Mycobacterium tuberculosis H37Rv; identical to SEQ ID NO: 4238201

SEQ ID NO: 4240848 - RNA, 59 nt, Mycobacterium tuberculosis H37Rv; identical to SEQ ID NO: 4238015

SEQ ID NO: 4240849 - RNA, 92 nt, Mycobacterium tuberculosis H37Rv; identical to SEQ ID NO: 4238019

SEQ ID NO: 4240850 - RNA, 75 nt, Mycobacterium tuberculosis H37Rv; identical to SEQ ID NO: 4239041

SEQ ID NO: 4240851 - RNA, 65 nt, Mycobacterium tuberculosis H37Rv
caguccgagugccgcgaucgcgugcgcggacgacaucgucgacgcggucgccgcgcuggguauug

SEQ ID NO: 4240852 - RNA, 116 nt, Mycobacterium tuberculosis H37Rv; identical to SEQ ID NO: 4237729

SEQ ID NO: 4240853 - RNA, 63 nt, Mycobacterium tuberculosis H37Rv; identical to SEQ ID NO: 4240366

SEQ ID NO: 4240854 - RNA, 75 nt, Mycobacterium tuberculosis H37Rv
cggugacguucuucagcccaguguggcauagcggcaccaacuggucccgcugaccugcuguguuagccgucgccg

SEQ ID NO: 4240855 - RNA, 67 nt, Mycobacterium tuberculosis H37Rv; identical to SEQ ID NO: 4238190

SEQ ID NO: 4240856 - RNA, 73 nt, Mycobacterium tuberculosis H37Rv; identical to SEQ ID NO: 4238086

SEQ ID NO: 4240857 - RNA, 72 nt, Mycobacterium tuberculosis H37Rv; identical to SEQ ID NO: 4238770

SEQ ID NO: 4240858 - RNA, 64 nt, Mycobacterium tuberculosis H37Rv; identical to SEQ ID NO: 4238225

SEQ ID NO: 4240859 - RNA, 72 nt, Mycobacterium tuberculosis H37Rv
ucggcucaugggcgacggcgaacauggucgcccacaccggguggcuguggaucacgcugccaaugucgucga

SEQ ID NO: 4240860 - RNA, 122 nt, Mycobacterium tuberculosis H37Rv
ggucgaugccgcugucacgcccggugagcucgucggccaucaacuguagcuuugccgcaacccgguagaccggcuguucgguggccgcggccaacgcgucggcugucacuggggugucgauc

SEQ ID NO: 4240861 - RNA, 89 nt, Mycobacterium tuberculosis H37Rv
ccuggcugacggccaucauggauggcgaggcguuguggucugcugcgaccgcggacgucuacgccguccucgaggcacggcucgacggg

SEQ ID NO: 4240862 - RNA, 129 nt, Mycobacterium tuberculosis H37Rv; identical to SEQ ID NO: 4238852

SEQ ID NO: 4240863 - RNA, 98 nt, Mycobacterium tuberculosis H37Rv
gccggcggcggcguugguguaggccacggcguuggagaugucggucuugcguugcgcgagccggugaaucaacgcugauagcgacgucaccgccuggu

SEQ ID NO: 4240864 - RNA, 98 nt, Mycobacterium tuberculosis H37Rv; identical to SEQ ID NO: 4237888

SEQ ID NO: 4240865 - RNA, 78 nt, Mycobacterium tuberculosis H37Rv; identical to SEQ ID NO: 4238756

SEQ ID NO: 4240866 - RNA, 112 nt, Mycobacterium tuberculosis H37Rv; identical to SEQ ID NO: 4237820

SEQ ID NO: 4240867 - RNA, 80 nt, Mycobacterium tuberculosis H37Rv; identical to SEQ ID NO: 4238923

SEQ ID NO: 4240868 - RNA, 96 nt, Mycobacterium tuberculosis H37Rv; identical to SEQ ID NO: 4238998

SEQ ID NO: 4240869 - RNA, 59 nt, Mycobacterium tuberculosis H37Rv
gcgcucaacgggauauugauaccuucgcugccgguguugucgguguagccguugaucgu

SEQ ID NO: 4240870 - RNA, 106 nt, Mycobacterium tuberculosis H37Rv; identical to SEQ ID NO: 4239172

SEQ ID NO: 4240871 - RNA, 80 nt, Mycobacterium tuberculosis H37Rv
gagucggcaucaaccuagcgguccaagaugcggucgcggcagcgaccaucuuggccgaaccgcugcgugagcaucgaguc

SEQ ID NO: 4240872 - RNA, 55 nt, Mycobacterium tuberculosis H37Rv; identical to SEQ ID NO: 4237774

SEQ ID NO: 4240873 - RNA, 93 nt, Mycobacterium tuberculosis H37Rv; identical to SEQ ID NO: 4238739

SEQ ID NO: 4240874 - RNA, 67 nt, Mycobacterium tuberculosis H37Rv; identical to SEQ ID NO: 4240232

SEQ ID NO: 4240875 - RNA, 80 nt, Mycobacterium tuberculosis H37Rv
gggcgguucggagacguuguauggcgagaucgagcguuucgauaccucggucuugcucgacguucgcgcaaaagccgccc

SEQ ID NO: 4240876 - RNA, 57 nt, Mycobacterium tuberculosis H37Rv; identical to SEQ ID NO: 4238170

SEQ ID NO: 4240877 - RNA, 62 nt, Mycobacterium tuberculosis H37Rv; identical to SEQ ID NO: 4237883

SEQ ID NO: 4240878 - RNA, 81 nt, Mycobacterium tuberculosis H37Rv; identical to SEQ ID NO: 4240445

SEQ ID NO: 4240879 - RNA, 55 nt, Mycobacterium tuberculosis H37Rv
cuugcguagccggaucgucgcugggcguugaccggcggcguucagguugagcagg

SEQ ID NO: 4240880 - RNA, 74 nt, Mycobacterium tuberculosis H37Rv
cggcgcgagaucgucgggaucuccagcacguccgcauucauggccgcgacgcugaagagcccgacgaagcggug

SEQ ID NO: 4240881 - RNA, 58 nt, Mycobacterium tuberculosis H37Rv
ggucggcgucggaccgcugcgcgugcugcaaccgccgccuagcccaccggcgccgauc

SEQ ID NO: 4240882 - RNA, 62 nt, Mycobacterium tuberculosis H37Rv
gcgugggcaugaucuguggaucaggaacccgauacgggauuccacgguuuaucgugcccagc

SEQ ID NO: 4240883 - RNA, 70 nt, Mycobacterium tuberculosis H37Rv; identical to SEQ ID NO: 4239024

SEQ ID NO: 4240884 - RNA, 61 nt, Mycobacterium tuberculosis H37Rv
acggcgagcaugucgcggccgaucuggccgccggguuggcagagcgcgacgucucggucgu

SEQ ID NO: 4240885 - RNA, 56 nt, Mycobacterium tuberculosis H37Rv; identical to SEQ ID NO: 4239222

SEQ ID NO: 4240886 - RNA, 70 nt, Mycobacterium tuberculosis H37Rv
gcccgcgaagccgccugcugcacucgcaggggcaagggucaacggcgccagcggggcggcuagcaggggc

SEQ ID NO: 4240887 - RNA, 89 nt, Mycobacterium tuberculosis H37Rv
cgacgaagacagcguugccggcauuggcgaccgugucucgcugauggagacgcguccgcugucggcgaccaagcgcuggcggcucgucg

SEQ ID NO: 4240888 - RNA, 108 nt, Mycobacterium tuberculosis H37Rv; identical to SEQ ID NO: 4238311

SEQ ID NO: 4240889 - RNA, 80 nt, Mycobacterium tuberculosis H37Rv
gcuguucgcugaggcuguaacucugcaggcaaagugcgagugggggccugcaaaauuacaggcucggcgacccaaacggu

SEQ ID NO: 4240890 - RNA, 77 nt, Mycobacterium tuberculosis H37Rv
ggccgugcggccacucgccgcugguguugugggcccugggccccgcgcgccuggacgaaguggcaccacgugcggcc

SEQ ID NO: 4240891 - RNA, 58 nt, Mycobacterium tuberculosis H37Rv; identical to SEQ ID NO: 4238716

SEQ ID NO: 4240892 - RNA, 58 nt, Mycobacterium tuberculosis H37Rv; identical to SEQ ID NO: 4238728

SEQ ID NO: 4240893 - RNA, 81 nt, Mycobacterium tuberculosis H37Rv
gucccuggaucgggcgugguacggugguguaccguggcuuguccaguacgguacucuuugguaccaaaccugacaagggau

SEQ ID NO: 4240894 - RNA, 61 nt, Mycobacterium tuberculosis H37Rv
gcuugaugaugggucccagcggaucguccuucggacgcacuccgcccagacccaucauggu

SEQ ID NO: 4240895 - RNA, 58 nt, Mycobacterium tuberculosis H37Rv; identical to SEQ ID NO: 4237872

SEQ ID NO: 4240896 - RNA, 111 nt, Mycobacterium tuberculosis H37Rv; identical to SEQ ID NO: 4238127

SEQ ID NO: 4240897 - RNA, 58 nt, Mycobacterium tuberculosis H37Rv; identical to SEQ ID NO: 4238834

SEQ ID NO: 4240898 - RNA, 57 nt, Mycobacterium tuberculosis H37Rv; identical to SEQ ID NO: 4238045

SEQ ID NO: 4240899 - RNA, 60 nt, Mycobacterium tuberculosis H37Rv
gaagucgacggucuccggugguugacccgguuugcucgucgccacguacaccguugcuuc

SEQ ID NO: 4240900 - RNA, 56 nt, Mycobacterium tuberculosis H37Rv; identical to SEQ ID NO: 4237615

SEQ ID NO: 4240901 - RNA, 86 nt, Mycobacterium tuberculosis H37Rv
ggauaacguuuggcaccucgucgauguugaacggagcggugaggccuagcuucaacgcgccgaccacauacggcgaagcccguucc

SEQ ID NO: 4240902 - RNA, 78 nt, Mycobacterium tuberculosis H37Rv; identical to SEQ ID NO: 4237731

SEQ ID NO: 4240903 - RNA, 73 nt, Mycobacterium tuberculosis H37Rv
ucggccuggacgccggcgcggcgacggugcaccaacgggccuucaccgucgcuuccgcuggugccagcgccga

SEQ ID NO: 4240904 - RNA, 130 nt, Mycobacterium tuberculosis H37Rv; identical to SEQ ID NO: 4238551

SEQ ID NO: 4240905 - RNA, 109 nt, Mycobacterium tuberculosis H37Rv
gauucgcggccgcgguucgugaggugcugcccgcugaccaggccacgauguugccggcccugguucucggcgauaccucgacggucaccgccuuaaccagccgcgaguu

SEQ ID NO: 4240906 - RNA, 65 nt, Mycobacterium tuberculosis H37Rv
uucaagaucgcgggcucgcaggugcucaaaaaggcugccgcacuugcgcagccggugauccugga

SEQ ID NO: 4240907 - RNA, 66 nt, Mycobacterium tuberculosis H37Rv; identical to SEQ ID NO: 4238367

SEQ ID NO: 4240908 - RNA, 82 nt, Mycobacterium tuberculosis H37Rv; identical to SEQ ID NO: 4239235

SEQ ID NO: 4240909 - RNA, 56 nt, Mycobacterium tuberculosis H37Rv; identical to SEQ ID NO: 4238195

SEQ ID NO: 4240910 - RNA, 99 nt, Mycobacterium tuberculosis H37Rv; identical to SEQ ID NO: 4238867

SEQ ID NO: 4240911 - RNA, 56 nt, Mycobacterium tuberculosis H37Rv; identical to SEQ ID NO: 4238182

SEQ ID NO: 4240912 - RNA, 73 nt, Mycobacterium tuberculosis H37Rv; identical to SEQ ID NO: 4238278

SEQ ID NO: 4240913 - RNA, 61 nt, Mycobacterium tuberculosis H37Rv
cccagcccgauuuccucggugaauggcugcccggccagauacugcagggaaucgggguggg

SEQ ID NO: 4240914 - RNA, 57 nt, Mycobacterium tuberculosis H37Rv
gucgagcaggaccuuggcuucaagaucaucuucgggcugccgggaaucgugcuuggc

SEQ ID NO: 4240915 - RNA, 118 nt, Mycobacterium tuberculosis H37Rv
ggaaggccguggcguaaugcgcguucgacgaacgcugcgucuuuggucagcgagcauucccagcccgcgaucacaccggcguaggcgucgaccacgaacgcgguguagccggaacucc

SEQ ID NO: 4240916 - RNA, 55 nt, Mycobacterium tuberculosis H37Rv
aacccgcuugccgaccucauccagccggacuugcgggugcucgucgaguuggguu

SEQ ID NO: 4240917 - RNA, 76 nt, Mycobacterium tuberculosis H37Rv; identical to SEQ ID NO: 4238590

SEQ ID NO: 4240918 - RNA, 59 nt, Mycobacterium tuberculosis H37Rv
cgugauugugcccggcaccagcagcagcgugaaaggcggcugguugcaugacaaucacg

SEQ ID NO: 4240919 - RNA, 101 nt, Mycobacterium tuberculosis H37Rv; identical to SEQ ID NO: 4237900

SEQ ID NO: 4240920 - RNA, 88 nt, Mycobacterium tuberculosis H37Rv
aaccgucggggucguauucggcgcgcacccggucgagcuuggccauggccgcgucgcuggcgaagcgcgccggacgcgcaccgagguu

SEQ ID NO: 4240921 - RNA, 67 nt, Mycobacterium tuberculosis H37Rv
ggugagccggccauccucgagcaccugcagcaggcuguuguagaucuccugaugcgccuucucgauc

SEQ ID NO: 4240922 - RNA, 55 nt, Mycobacterium tuberculosis H37Rv; identical to SEQ ID NO: 4240453

SEQ ID NO: 4240923 - RNA, 62 nt, Mycobacterium tuberculosis H37Rv
acuucgguaucgccuccgccuuuggccagcagcagccacagcgcgguucgcggaccgaacgu

SEQ ID NO: 4240924 - RNA, 59 nt, Mycobacterium tuberculosis H37Rv; identical to SEQ ID NO: 4238571

SEQ ID NO: 4240925 - RNA, 65 nt, Mycobacterium tuberculosis H37Rv; identical to SEQ ID NO: 4238980

SEQ ID NO: 4240926 - RNA, 79 nt, Mycobacterium tuberculosis H37Rv
guccuggcgucaucaguugugcggccugaccggggcgcggguggucgcggucgaucugcgcggcuacggcggcagcgac

SEQ ID NO: 4240927 - RNA, 96 nt, Mycobacterium tuberculosis H37Rv; identical to SEQ ID NO: 4238873

SEQ ID NO: 4240928 - RNA, 99 nt, Mycobacterium tuberculosis H37Rv; identical to SEQ ID NO: 4237810

SEQ ID NO: 4240929 - RNA, 60 nt, Mycobacterium tuberculosis H37Rv; identical to SEQ ID NO: 4237846

SEQ ID NO: 4240930 - RNA, 129 nt, Mycobacterium tuberculosis H37Rv; identical to SEQ ID NO: 4238124

SEQ ID NO: 4240931 - RNA, 69 nt, Mycobacterium tuberculosis H37Rv; identical to SEQ ID NO: 4240372

SEQ ID NO: 4240932 - RNA, 74 nt, Mycobacterium tuberculosis H37Rv; identical to SEQ ID NO: 4239168

SEQ ID NO: 4240933 - RNA, 73 nt, Mycobacterium tuberculosis H37Rv
ccgcgauccagaccgguuacccggugaucucagugagccacucgaugaacaucgugaccgucuacguccgcgg

SEQ ID NO: 4240934 - RNA, 75 nt, Mycobacterium tuberculosis H37Rv
ccgaaccagcguuugcacgagcgggucaacacgcuuuguucggcguagcccaguucacgugccaaauggguaagg

SEQ ID NO: 4240935 - RNA, 64 nt, Mycobacterium tuberculosis H37Rv; identical to SEQ ID NO: 4239049

SEQ ID NO: 4240936 - RNA, 124 nt, Mycobacterium tuberculosis H37Rv
cgaucguggcgggcucggucaaugucaauguccacuugucggaguaggcaccgccgaaugcccaguucggucccugaaacguccacgagaugaggucggcguuagcccagccgugcgccgaucg

SEQ ID NO: 4240937 - RNA, 113 nt, Mycobacterium tuberculosis H37Rv; identical to SEQ ID NO: 4238357

SEQ ID NO: 4240938 - RNA, 56 nt, Mycobacterium tuberculosis H37Rv
guucaggagagucguugcgguacuucagcguuuugaacugcgacacgcucccgaau

SEQ ID NO: 4240939 - RNA, 62 nt, Mycobacterium tuberculosis H37Rv
gugauccgcagcaagguguagaagucgaccgugaagagcccucugcccagcgcguggaucac

SEQ ID NO: 4240940 - RNA, 59 nt, Mycobacterium tuberculosis H37Rv; identical to SEQ ID NO: 4237906

SEQ ID NO: 4240941 - RNA, 63 nt, Mycobacterium tuberculosis H37Rv
ugguucaccucacuguucagucagcacacccucgaccugcucgagcugggacuggguggaccg

SEQ ID NO: 4240942 - RNA, 63 nt, Mycobacterium tuberculosis H37Rv; identical to SEQ ID NO: 4238570

SEQ ID NO: 4240943 - RNA, 90 nt, Mycobacterium tuberculosis H37Rv; identical to SEQ ID NO: 4239190

SEQ ID NO: 4240944 - RNA, 102 nt, Mycobacterium tuberculosis H37Rv; identical to SEQ ID NO: 4238561

SEQ ID NO: 4240945 - RNA, 93 nt, Mycobacterium tuberculosis H37Rv
ggugacgguucucccgcgagcagacgcagaaucgcaccgccacgcccgucggcgugcgauucugcgucugcucgccacagaaaagugagcacc

SEQ ID NO: 4240946 - RNA, 78 nt, Mycobacterium tuberculosis H37Rv; identical to SEQ ID NO: 4239014

SEQ ID NO: 4240947 - RNA, 57 nt, Mycobacterium tuberculosis H37Rv; identical to SEQ ID NO: 4238133

SEQ ID NO: 4240948 - RNA, 77 nt, Mycobacterium tuberculosis H37Rv; identical to SEQ ID NO: 4237807

SEQ ID NO: 4240949 - RNA, 62 nt, Mycobacterium tuberculosis H37Rv; identical to SEQ ID NO: 4238343

SEQ ID NO: 4240950 - RNA, 129 nt, Mycobacterium tuberculosis H37Rv
cugcgccaggagaugcuggucgccaggcauccggucaaggugacgugcgugcaucccggcggcaucaaaaccgccgucgcgcgcaacgccaccguggccgacggcgaggaccagcagacguucgcggag

SEQ ID NO: 4240951 - RNA, 62 nt, Mycobacterium tuberculosis H37Rv
aggccgugacgaucagguccggcgauuugucaagaaguaccgcgacccggucuucgcugccu

SEQ ID NO: 4240952 - RNA, 89 nt, Mycobacterium tuberculosis H37Rv; identical to SEQ ID NO: 4237619

SEQ ID NO: 4240953 - RNA, 64 nt, Mycobacterium tuberculosis H37Rv
gucagcuucgugcccaggugaucgagcacggccccaaccaguugguccuuggugccgaagugac

SEQ ID NO: 4240954 - RNA, 57 nt, Mycobacterium tuberculosis H37Rv; identical to SEQ ID NO: 4237992

SEQ ID NO: 4240955 - RNA, 66 nt, Mycobacterium tuberculosis H37Rv
ucgccgagcagacacagaaucgcacgaaaucagcccgcccaaugcgauucugcgucugcucggcgg

SEQ ID NO: 4240956 - RNA, 90 nt, Mycobacterium tuberculosis H37Rv
caggaucucuacggcgaguugguguuuccgcugcagguggugaucaaccugagcgauccggaaaccgacuacaccggcggcgaguuccug

SEQ ID NO: 4240957 - RNA, 58 nt, Mycobacterium tuberculosis H37Rv
gcauggcugaacgggcgccacgcggcgaagucgccgugaugguggccgugcagucggc

SEQ ID NO: 4240958 - RNA, 58 nt, Mycobacterium tuberculosis H37Rv; identical to SEQ ID NO: 4238055

SEQ ID NO: 4240959 - RNA, 80 nt, Mycobacterium tuberculosis H37Rv
ggauuccgcuaaagccauggucgaccgcgccgucggugcuuucggcggcaucgacuaucuggugaacaaugcggcgaucu

SEQ ID NO: 4240960 - RNA, 96 nt, Mycobacterium tuberculosis H37Rv; identical to SEQ ID NO: 4238934

SEQ ID NO: 4240961 - RNA, 85 nt, Mycobacterium tuberculosis H37Rv
gcgucgcguaaguugaaggaucuggcgucggcgggcaguggguucguuuucuucggccugcuggcaccgaaucuguuugcgacgc

SEQ ID NO: 4240962 - RNA, 106 nt, Mycobacterium tuberculosis H37Rv
gcuaugggugcgcugcuugcccguucgaucgucggcaucgucgagcagguggaacagacucucaguggugccagcguguuguggcugggggagucgcgccucuagc

SEQ ID NO: 4240963 - RNA, 73 nt, Mycobacterium tuberculosis H37Rv
ggucagcgagguggcggucaucggcuugcccgacgagaaguggggcgagaucgccgccgccaucgucguugcc

SEQ ID NO: 4240964 - RNA, 58 nt, Mycobacterium tuberculosis H37Rv
ucccgacguuucguucggugucugugcgauagcggugaccccggcgcgcacgucggga

SEQ ID NO: 4240965 - RNA, 85 nt, Mycobacterium tuberculosis H37Rv; identical to SEQ ID NO: 4238648

SEQ ID NO: 4240966 - RNA, 80 nt, Mycobacterium tuberculosis H37Rv; identical to SEQ ID NO: 4238030

SEQ ID NO: 4240967 - RNA, 79 nt, Mycobacterium tuberculosis H37Rv; identical to SEQ ID NO: 4237753

SEQ ID NO: 4240968 - RNA, 89 nt, Mycobacterium tuberculosis H37Rv
ggcuaugggaccggcaucuacugaacugcgccgugaucggugagcuccucgaacgcggugaccgggucguggauaucgguagcggagcc

SEQ ID NO: 4240969 - RNA, 66 nt, Mycobacterium tuberculosis H37Rv; identical to SEQ ID NO: 4238540

SEQ ID NO: 4240970 - RNA, 107 nt, Mycobacterium tuberculosis H37Rv
ccgcugcaggugauguacggggugggcggugaacgcagccuggucgaagcggagcugcaccauuuguccggcuacgaucaugcccgcccggugcgcaucggcaacgg

SEQ ID NO: 4240971 - RNA, 83 nt, Mycobacterium tuberculosis H37Rv; identical to SEQ ID NO: 4240228

SEQ ID NO: 4240972 - RNA, 61 nt, Mycobacterium tuberculosis H37Rv
gcgagcagacgcagaaucgcaugcgcgggaccccgcgcagugcgauucugcgucugcucgc

SEQ ID NO: 4240973 - RNA, 72 nt, Mycobacterium tuberculosis H37Rv; identical to SEQ ID NO: 4238274

SEQ ID NO: 4240974 - RNA, 55 nt, Mycobacterium tuberculosis H37Rv; identical to SEQ ID NO: 4238811

SEQ ID NO: 4240975 - RNA, 57 nt, Mycobacterium tuberculosis H37Rv; identical to SEQ ID NO: 4238348

SEQ ID NO: 4240976 - RNA, 61 nt, Mycobacterium tuberculosis H37Rv
ggcgcgcaacgcaucagugccggcgccgagucacucgcccgugccgcugaucguugccguc

SEQ ID NO: 4240977 - RNA, 79 nt, Mycobacterium tuberculosis H37Rv; identical to SEQ ID NO: 4238607

SEQ ID NO: 4240978 - RNA, 83 nt, Mycobacterium tuberculosis H37Rv
aagauggccgcuacgucggaucugucggccgcggcggccgucccaagcuguagcggucgcgauaccguguagcaggcggucuu

SEQ ID NO: 4240979 - RNA, 58 nt, Mycobacterium tuberculosis H37Rv; identical to SEQ ID NO: 4238193

SEQ ID NO: 4240980 - RNA, 87 nt, Mycobacterium tuberculosis H37Rv; identical to SEQ ID NO: 4238443

SEQ ID NO: 4240981 - RNA, 67 nt, Mycobacterium tuberculosis H37Rv; identical to SEQ ID NO: 4240238

SEQ ID NO: 4240982 - RNA, 61 nt, Mycobacterium tuberculosis H37Rv; identical to SEQ ID NO: 4238660

SEQ ID NO: 4240983 - RNA, 63 nt, Mycobacterium tuberculosis H37Rv; identical to SEQ ID NO: 4237791

SEQ ID NO: 4240984 - RNA, 71 nt, Mycobacterium tuberculosis H37Rv
gucgagguggucccagcuucuguugugcugcacacaauccuuuccgcugcaacagaauugggcuacuccgc

SEQ ID NO: 4240985 - RNA, 130 nt, Mycobacterium tuberculosis H37Rv
uaccgaggaugccgacugccucccgccgguugaugugauacacgccgacguuacucgccgcaugcauggcgagguggcgaccgacguugucgcggccggcgaacuggugauagcggcgcgacacuugcug

SEQ ID NO: 4240986 - RNA, 71 nt, Mycobacterium tuberculosis H37Rv; identical to SEQ ID NO: 4239238

SEQ ID NO: 4240987 - RNA, 127 nt, Mycobacterium tuberculosis H37Rv
gaaaagguaggggucacgggugccaaccuaccgcgcgagcagacgcagaaucgcacugcgcggggucccgcgcaugcgauucugcgucugcucgccguacucaggcuuccaggucgcccucgguuuc

SEQ ID NO: 4240988 - RNA, 73 nt, Mycobacterium tuberculosis H37Rv; identical to SEQ ID NO: 4238715

SEQ ID NO: 4240989 - RNA, 61 nt, Mycobacterium tuberculosis H37Rv
caagaaggcuuuagggucgcugucauggugcgucagaugcgggcggcccuggcagcccuug

SEQ ID NO: 4240990 - RNA, 57 nt, Mycobacterium tuberculosis H37Rv; identical to SEQ ID NO: 4238321

SEQ ID NO: 4240991 - RNA, 83 nt, Mycobacterium tuberculosis H37Rv
cgcuuguccgugucaugcggcggaucugccgcgcggcgaccgacaacgucgccagauccuucuggccgcuggcacggaugucg

SEQ ID NO: 4240992 - RNA, 57 nt, Mycobacterium tuberculosis H37Rv; identical to SEQ ID NO: 4240275

SEQ ID NO: 4240993 - RNA, 79 nt, Mycobacterium tuberculosis H37Rv
ccgguaaugccgaccccaugguccgugaauggcugaccgugcuguugcgacgcgaccugggguuacugguaacgaucgg

SEQ ID NO: 4240994 - RNA, 81 nt, Mycobacterium tuberculosis H37Rv
gggucuuugcgucgagaucgacggcagcgcccccgcgagagagagcaucgcgcugacgucgaucucgaugcgucaacaccc

SEQ ID NO: 4240995 - RNA, 72 nt, Mycobacterium tuberculosis H37Rv; identical to SEQ ID NO: 4237958

SEQ ID NO: 4240996 - RNA, 96 nt, Mycobacterium tuberculosis H37Rv; identical to SEQ ID NO: 4240355

SEQ ID NO: 4240997 - RNA, 56 nt, Mycobacterium tuberculosis H37Rv
gcgucgacucagucgccgccgagguuaagcgaaaucggcguaggccaaguggacgc

SEQ ID NO: 4240998 - RNA, 62 nt, Mycobacterium tuberculosis H37Rv; identical to SEQ ID NO: 4238675

SEQ ID NO: 4240999 - RNA, 67 nt, Mycobacterium tuberculosis H37Rv
ccgcgcgagcagacgcuaaagcccccgcacgcucggcgugucgggggcuuuugcgucugcugaccgg

SEQ ID NO: 4241000 - RNA, 59 nt, Mycobacterium tuberculosis H37Rv; identical to SEQ ID NO: 4239059

SEQ ID NO: 4241001 - RNA, 57 nt, Mycobacterium tuberculosis H37Rv
gaagucggucaccacagugccguacaggugacgguuggccgcgugggugaccgacuc

SEQ ID NO: 4241002 - RNA, 86 nt, Mycobacterium tuberculosis H37Rv
gugucaccgcgaaccgggugaaccugcccucggcaucaaccucgaaaucuggucgcaggguguugagcccggucgucuucagccac

SEQ ID NO: 4241003 - RNA, 91 nt, Mycobacterium tuberculosis H37Rv; identical to SEQ ID NO: 4239074

SEQ ID NO: 4241004 - RNA, 70 nt, Mycobacterium tuberculosis H37Rv; identical to SEQ ID NO: 4240361

SEQ ID NO: 4241005 - RNA, 69 nt, Mycobacterium tuberculosis H37Rv; identical to SEQ ID NO: 4238069

SEQ ID NO: 4241006 - RNA, 82 nt, Mycobacterium tuberculosis H37Rv
gacgccggccaucaaucaaaugaggcccgcgcgcagcgcaugugcgacggcaugcgugcgguugcggagcuucagccgcguc

SEQ ID NO: 4241007 - RNA, 58 nt, Mycobacterium tuberculosis H37Rv; identical to SEQ ID NO: 4238000

SEQ ID NO: 4241008 - RNA, 68 nt, Mycobacterium tuberculosis H37Rv; identical to SEQ ID NO: 4237649

SEQ ID NO: 4241009 - RNA, 82 nt, Mycobacterium tuberculosis H37Rv
caucgacuuuccgacaucggugucaccguugacccgaccgcaucgcagcaagcgcggugucgccgagcguugggaccuggug

SEQ ID NO: 4241010 - RNA, 80 nt, Mycobacterium tuberculosis H37Rv
uagagcccggccgagugugagccugacagcccgacaccggcggcgugugucgcgucgccagguucacgcucggcgaucua

SEQ ID NO: 4241011 - RNA, 63 nt, Mycobacterium tuberculosis H37Rv; identical to SEQ ID NO: 4238180

SEQ ID NO: 4241012 - RNA, 130 nt, Mycobacterium tuberculosis H37Rv; identical to SEQ ID NO: 4239075

SEQ ID NO: 4241013 - RNA, 57 nt, Mycobacterium tuberculosis H37Rv
uggcgaagcgcacgucgccgccgcggcgggccacggcguggacaagugcuugugcua

SEQ ID NO: 4241014 - RNA, 77 nt, Mycobacterium tuberculosis H37Rv
gggcuggaaccuguuagcgcccggccacuggccaaugauggucuuccggauuggccaugcgcgggcgccgucaguuc

SEQ ID NO: 4241015 - RNA, 61 nt, Mycobacterium tuberculosis H37Rv
ucgccggcggaggucaagcgccgcuccuccucaucgcugcgcucugcaucgucgccggcgg

SEQ ID NO: 4241016 - RNA, 95 nt, Mycobacterium tuberculosis H37Rv; identical to SEQ ID NO: 4239085

SEQ ID NO: 4241017 - RNA, 57 nt, Mycobacterium tuberculosis H37Rv; identical to SEQ ID NO: 4237691

SEQ ID NO: 4241018 - RNA, 66 nt, Mycobacterium tuberculosis H37Rv; identical to SEQ ID NO: 4240426

SEQ ID NO: 4241019 - RNA, 62 nt, Mycobacterium tuberculosis H37Rv; identical to SEQ ID NO: 4240391

SEQ ID NO: 4241020 - RNA, 64 nt, Mycobacterium tuberculosis H37Rv
cggggucgccaacacggcguugacagugcccaggauguagucgaugucggccuugguggccgcg

SEQ ID NO: 4241021 - RNA, 98 nt, Mycobacterium tuberculosis H37Rv
cguggaugccgauuugaucaacgcgggcaaggagacggucaccacgcugccgggugccgcauucuucagcucgucgacuucguucggaaucauccgcg

SEQ ID NO: 4241022 - RNA, 57 nt, Mycobacterium tuberculosis H37Rv
gauuggucuagagcauucccggauuccguguauugggucggcaaagccuggacgauc

SEQ ID NO: 4241023 - RNA, 61 nt, Mycobacterium tuberculosis H37Rv
ugcuuugaccgcaucgaccacgcggaccugauggaccgggugcgucaccggaucaaagaca

SEQ ID NO: 4241024 - RNA, 83 nt, Mycobacterium tuberculosis H37Rv
gaucggcuccggcagcggcacgucgacgcuggcgauggcgaaggccgaaccccaugucgacgugaucgcuguggacgucuauc

SEQ ID NO: 4241025 - RNA, 57 nt, Mycobacterium tuberculosis H37Rv; identical to SEQ ID NO: 4238047

SEQ ID NO: 4241026 - RNA, 71 nt, Mycobacterium tuberculosis H37Rv; identical to SEQ ID NO: 4238254

SEQ ID NO: 4241027 - RNA, 88 nt, Mycobacterium tuberculosis H37Rv; identical to SEQ ID NO: 4237614

SEQ ID NO: 4241028 - RNA, 63 nt, Mycobacterium tuberculosis H37Rv
guagucaccgccgcgguuggugcgcauggugcgccgugcgaucuggacggcggcggucaccgc

SEQ ID NO: 4241029 - RNA, 60 nt, Mycobacterium tuberculosis H37Rv; identical to SEQ ID NO: 4237620

SEQ ID NO: 4241030 - RNA, 95 nt, Mycobacterium tuberculosis H37Rv
gaccccaaauacgugguggcgaucgguugucccgcgacaagcucgcggaccgggcugucgccgcaaccgucguuaucgaccacgaucaggugguc

SEQ ID NO: 4241031 - RNA, 57 nt, Mycobacterium tuberculosis H37Rv
ggcuggaucgugccgcgcuggccggcgcuggugcugcgcuaccggcauuauucagcc

SEQ ID NO: 4241032 - RNA, 81 nt, Mycobacterium tuberculosis H37Rv
cuaugcuuugacuaagcggggcgagcgcuccgcuuagccgaacuauacggaacgcgcgccccgcuuugucaaggcuuucgg

SEQ ID NO: 4241033 - RNA, 86 nt, Mycobacterium tuberculosis H37Rv; identical to SEQ ID NO: 4238580

SEQ ID NO: 4241034 - RNA, 77 nt, Mycobacterium tuberculosis H37Rv
gccggauccaucgcacccgaauccgcuugcaccagugugcaauuacauuugcagcuagcaccggcggauuuuccggc

SEQ ID NO: 4241035 - RNA, 63 nt, Mycobacterium tuberculosis H37Rv
ggguucgauccuggacucguuuuaccugcacgcaaagucccgcgagcaagucccggagaaccu

SEQ ID NO: 4241036 - RNA, 56 nt, Mycobacterium tuberculosis H37Rv; identical to SEQ ID NO: 4237851

SEQ ID NO: 4241037 - RNA, 78 nt, Mycobacterium tuberculosis H37Rv; identical to SEQ ID NO: 4239164

SEQ ID NO: 4241038 - RNA, 80 nt, Mycobacterium tuberculosis H37Rv
gguugccgcagugcaguagugaacggauucgguagugggugagguuucugaauccgagggcguuacggcauagggcuucc

SEQ ID NO: 4241039 - RNA, 56 nt, Mycobacterium tuberculosis H37Rv
gcuuuucgcgaucggcgcgacgggcuacaucuuggucgcguugcaguucgaagagc

SEQ ID NO: 4241040 - RNA, 61 nt, Mycobacterium tuberculosis H37Rv
cgccguccggagggcuccgaugacgccuuggucgucaucgacgccaccuccggugcuggcg

SEQ ID NO: 4241041 - RNA, 84 nt, Mycobacterium tuberculosis H37Rv; identical to SEQ ID NO: 4237652

SEQ ID NO: 4241042 - RNA, 74 nt, Mycobacterium tuberculosis H37Rv
gcuaccgguggggccaugccgaggacacggugcggcuggccgccgcacugcgcccggcgcuggccucccgcggc

SEQ ID NO: 4241043 - RNA, 91 nt, Mycobacterium tuberculosis H37Rv
gcggccaucgcauaaugccgauugugaaucuggcgacgcgacacgccggugcggcgucgcgggauucacacucggcgauacgugucgccgu

SEQ ID NO: 4241044 - RNA, 64 nt, Mycobacterium tuberculosis H37Rv; identical to SEQ ID NO: 4238819

SEQ ID NO: 4241045 - RNA, 91 nt, Mycobacterium tuberculosis H37Rv; identical to SEQ ID NO: 4237640

SEQ ID NO: 4241046 - RNA, 91 nt, Mycobacterium tuberculosis H37Rv; identical to SEQ ID NO: 4238152

SEQ ID NO: 4241047 - RNA, 56 nt, Mycobacterium tuberculosis H37Rv; identical to SEQ ID NO: 4238465

SEQ ID NO: 4241048 - RNA, 67 nt, Mycobacterium tuberculosis H37Rv; identical to SEQ ID NO: 4237812

SEQ ID NO: 4241049 - RNA, 91 nt, Mycobacterium tuberculosis H37Rv; identical to SEQ ID NO: 4238707

SEQ ID NO: 4241050 - RNA, 84 nt, Mycobacterium tuberculosis H37Rv
ggccucgacgcauggccaaccucccgacugguacccgcgccggcucgguuacgccgguugugguuggccgugcucaucguggcu

SEQ ID NO: 4241051 - RNA, 55 nt, Mycobacterium tuberculosis H37Rv; identical to SEQ ID NO: 4238051

SEQ ID NO: 4241052 - RNA, 71 nt, Mycobacterium tuberculosis H37Rv; identical to SEQ ID NO: 4239132

SEQ ID NO: 4241053 - RNA, 80 nt, Mycobacterium tuberculosis H37Rv
ucggcgcugaucacguacucccauugcggaucgucgacgucggcgaugaucacggugugcggggucggggucugcgccga

SEQ ID NO: 4241054 - RNA, 79 nt, Mycobacterium tuberculosis H37Rv
gaacggccaccacuucagguugcgugacgccgacgagaucacgcuggcggucgggcaccuaggggugguggaagccuuc

SEQ ID NO: 4241055 - RNA, 60 nt, Mycobacterium tuberculosis H37Rv
uugagcucggugagguugcgcaccaaccgguuuggguaaaugugcaccuccaccggccag

SEQ ID NO: 4241056 - RNA, 55 nt, Mycobacterium tuberculosis H37Rv
guugggcagcgucacggucgucggagccugcgguggcgauucugacuugcccagc

SEQ ID NO: 4241057 - RNA, 93 nt, Mycobacterium tuberculosis H37Rv; identical to SEQ ID NO: 4238650

SEQ ID NO: 4241058 - RNA, 63 nt, Mycobacterium tuberculosis H37Rv; identical to SEQ ID NO: 4238382

SEQ ID NO: 4241059 - RNA, 59 nt, Mycobacterium tuberculosis H37Rv; identical to SEQ ID NO: 4237871

SEQ ID NO: 4241060 - RNA, 60 nt, Mycobacterium tuberculosis H37Rv; identical to SEQ ID NO: 4237806

SEQ ID NO: 4241061 - RNA, 74 nt, Mycobacterium tuberculosis H37Rv; identical to SEQ ID NO: 4237825

SEQ ID NO: 4241062 - RNA, 72 nt, Mycobacterium tuberculosis H37Rv
accgcgcuggccguggugugucgcgcauccgcagaaccgagcggagugcggcuauccgccgccgacgccggu

SEQ ID NO: 4241063 - RNA, 78 nt, Mycobacterium tuberculosis H37Rv
gcguuaucggacaggucggcaccaccaucgggcucggucuacuuuucgauacccuggugguccgaucguucaugacgc

SEQ ID NO: 4241064 - RNA, 121 nt, Mycobacterium tuberculosis H37Rv; identical to SEQ ID NO: 4239166

SEQ ID NO: 4241065 - RNA, 73 nt, Mycobacterium tuberculosis H37Rv
ggcugucagaccgagucgauacggugcggccaugcauucccugauguauccgucgaucgaccucgaugacgcc

SEQ ID NO: 4241066 - RNA, 71 nt, Mycobacterium tuberculosis H37Rv
ggcuggcgaugcuccugaauucaacugcaccacauuggauuaacccacaaucagcauggcaucggccggcu

SEQ ID NO: 4241067 - RNA, 57 nt, Mycobacterium tuberculosis H37Rv; identical to SEQ ID NO: 4238926

SEQ ID NO: 4241068 - RNA, 84 nt, Mycobacterium tuberculosis H37Rv
acugcugaucuacggcauggucuuucugcugcccggugacccaguugccgcgcuggcgggcgaccguccguugacucccgcggu

SEQ ID NO: 4241069 - RNA, 62 nt, Mycobacterium tuberculosis H37Rv
gaucgcugauggcgucggccagacacggauugucggcguccgcgcuggccgccaucgcgauc

SEQ ID NO: 4241070 - RNA, 61 nt, Mycobacterium tuberculosis H37Rv
cagugccgcagcuuucgaguugugcggccccgucgcugcaauucgacagcugugcguucug

SEQ ID NO: 4241071 - RNA, 58 nt, Mycobacterium tuberculosis H37Rv; identical to SEQ ID NO: 4237756

SEQ ID NO: 4241072 - RNA, 61 nt, Mycobacterium tuberculosis H37Rv
ugcagcgugucggguccgagccggauuuccuccgcguguggcugccgggccaacugcugca

SEQ ID NO: 4241073 - RNA, 119 nt, Mycobacterium tuberculosis H37Rv
gcucaucgccuacgacacuaccgacgagcgggugcgguauuggugcccggccugccagcgcugaaccgggcgaucaaagccagcaccuagucgcggccguggguagcgaagaacugggc

SEQ ID NO: 4241074 - RNA, 90 nt, Mycobacterium tuberculosis H37Rv
uucgggcggcuggcgaguugucgcgcugaggcgggcaaauugcguaucugcucgaccaaugcgacgcggcuggccaaacagcacaccgaa

SEQ ID NO: 4241075 - RNA, 58 nt, Mycobacterium tuberculosis H37Rv
ucccgacgugcgcgccggggucaccgcuaucgcacagacaccgaacgaaacgucggga

SEQ ID NO: 4241076 - RNA, 70 nt, Mycobacterium tuberculosis H37Rv
guuguugaucgcaugcccgugcgcggugggacuguccaccccgaccgcgaucagcgcagcgaucggcaac

SEQ ID NO: 4241077 - RNA, 80 nt, Mycobacterium tuberculosis H37Rv; identical to SEQ ID NO: 4238509

SEQ ID NO: 4241078 - RNA, 62 nt, Mycobacterium tuberculosis H37Rv
guggucgagguggcgugugccgacggaaagcucaguugacuuggcguguccacguugaccgc

SEQ ID NO: 4241079 - RNA, 91 nt, Mycobacterium tuberculosis H37Rv; identical to SEQ ID NO: 4237598

SEQ ID NO: 4241080 - RNA, 57 nt, Mycobacterium tuberculosis H37Rv; identical to SEQ ID NO: 4240230

SEQ ID NO: 4241081 - RNA, 59 nt, Mycobacterium tuberculosis H37Rv; identical to SEQ ID NO: 4237636

SEQ ID NO: 4241082 - RNA, 86 nt, Mycobacterium tuberculosis H37Rv; identical to SEQ ID NO: 4238335

SEQ ID NO: 4241083 - RNA, 71 nt, Mycobacterium tuberculosis H37Rv
ucucggcgguguggacggucuggugcaugucuccgagcuaucguggaagcacaucgaccacccguccgagg

SEQ ID NO: 4241084 - RNA, 88 nt, Mycobacterium tuberculosis H37Rv; identical to SEQ ID NO: 4238740

SEQ ID NO: 4241085 - RNA, 121 nt, Mycobacterium tuberculosis H37Rv
gcgcucgcggggcucucaccagcggcggccuagccggcggcgucggggccggcggcaccggcggcaccggcgguaccggcggcaacggcgcugacgccgcugcuguggugggcuucggcgc

SEQ ID NO: 4241086 - RNA, 113 nt, Mycobacterium tuberculosis H37Rv; identical to SEQ ID NO: 4238710

SEQ ID NO: 4241087 - RNA, 62 nt, Mycobacterium tuberculosis H37Rv
gugcagcgagcgcacuggccguugggaacauugcaacugacggccaucgcugcuugcugcgc

SEQ ID NO: 4241088 - RNA, 86 nt, Mycobacterium tuberculosis H37Rv; identical to SEQ ID NO: 4240414

SEQ ID NO: 4241089 - RNA, 60 nt, Mycobacterium tuberculosis H37Rv; identical to SEQ ID NO: 4238641

SEQ ID NO: 4241090 - RNA, 85 nt, Mycobacterium tuberculosis H37Rv
uagcccgaugguguugggcuucugggacaucgcggugccgaucgucggcgccccgauggccggcggcccgagcaccccggcguug

SEQ ID NO: 4241091 - RNA, 61 nt, Mycobacterium tuberculosis H37Rv; identical to SEQ ID NO: 4238131

SEQ ID NO: 4241092 - RNA, 59 nt, Mycobacterium tuberculosis H37Rv; identical to SEQ ID NO: 4238765

SEQ ID NO: 4241093 - RNA, 87 nt, Mycobacterium tuberculosis H37Rv; identical to SEQ ID NO: 4237855

SEQ ID NO: 4241094 - RNA, 90 nt, Mycobacterium tuberculosis H37Rv
cggaggacggcaucgcggccggcacccgcugggacgacauccccgaugacuggaguugcccggauugcggugcggcaaagucggauuucg

SEQ ID NO: 4241095 - RNA, 66 nt, Mycobacterium tuberculosis H37Rv; identical to SEQ ID NO: 4238140

SEQ ID NO: 4241096 - RNA, 60 nt, Mycobacterium tuberculosis H37Rv; identical to SEQ ID NO: 4238333

SEQ ID NO: 4241097 - RNA, 72 nt, Mycobacterium tuberculosis H37Rv
ccgacaucggcaagcacggcgacaccggucgcagcgaacucgacgcgguggaugcggugcucgccggugagg

SEQ ID NO: 4241098 - RNA, 63 nt, Mycobacterium tuberculosis H37Rv; identical to SEQ ID NO: 4238143

SEQ ID NO: 4241099 - RNA, 75 nt, Mycobacterium tuberculosis H37Rv; identical to SEQ ID NO: 4239133

SEQ ID NO: 4241100 - RNA, 108 nt, Mycobacterium tuberculosis H37Rv
gcugugguucgacgcccugcgaucgguggccgucgaccaccgugacggcccggucgucgugcacccgucgugguggucggcggcucgggucgagguggucaccgcagc

SEQ ID NO: 4241101 - RNA, 92 nt, Mycobacterium tuberculosis H37Rv
gcgcucaacuagccccgccaagcagacgcagaaucgcauuaaucgcgcccgguuugugcgauucugcgucugcuuggcagcaccucaggcgc

SEQ ID NO: 4241102 - RNA, 93 nt, Mycobacterium tuberculosis H37Rv; identical to SEQ ID NO: 4238699

SEQ ID NO: 4241103 - RNA, 62 nt, Mycobacterium tuberculosis H37Rv; identical to SEQ ID NO: 4239127

SEQ ID NO: 4241104 - RNA, 63 nt, Mycobacterium tuberculosis H37Rv; identical to SEQ ID NO: 4238778

SEQ ID NO: 4241105 - RNA, 58 nt, Mycobacterium tuberculosis H37Rv
gagcgccgaguucgacucgacaucgccgccggcgcaugccgacaugaacgcggcacuc

SEQ ID NO: 4241106 - RNA, 69 nt, Mycobacterium tuberculosis H37Rv; identical to SEQ ID NO: 4238593

SEQ ID NO: 4241107 - RNA, 63 nt, Mycobacterium tuberculosis H37Rv
guacugcuggccagcguugcgcuguuguugcuguacuggcaauggcgaacgaugccggcgguc

SEQ ID NO: 4241108 - RNA, 92 nt, Mycobacterium tuberculosis H37Rv; identical to SEQ ID NO: 4239157

SEQ ID NO: 4241109 - RNA, 72 nt, Mycobacterium tuberculosis H37Rv
ggcguccgucgccaguagccacuguuccgcccaccaccacgggaacgcggguggcugggcuggcggcggucc

SEQ ID NO: 4241110 - RNA, 64 nt, Mycobacterium tuberculosis H37Rv; identical to SEQ ID NO: 4237767

SEQ ID NO: 4241111 - RNA, 66 nt, Mycobacterium tuberculosis H37Rv
cacacgggugaacugcacgcgguguccuacucguucgcccgcggacacagagugcaguacucggug

SEQ ID NO: 4241112 - RNA, 67 nt, Mycobacterium tuberculosis H37Rv; identical to SEQ ID NO: 4238191

SEQ ID NO: 4241113 - RNA, 79 nt, Mycobacterium tuberculosis H37Rv
gcggcggucaucgaggcguucagcacccggacuuugcacccacccggaguugugcaccccagcccuuggcgcccgcugc

SEQ ID NO: 4241114 - RNA, 80 nt, Mycobacterium tuberculosis H37Rv; identical to SEQ ID NO: 4238627

SEQ ID NO: 4241115 - RNA, 62 nt, Mycobacterium tuberculosis H37Rv
gcggcccauccacucacugucgcguuuagccagguagucguugacggugacgaugugcacgc

SEQ ID NO: 4241116 - RNA, 60 nt, Mycobacterium tuberculosis H37Rv
cugugaucggucugcuggccagcgucgcaggacugcggcgcgugguggcgaucgauccgg

SEQ ID NO: 4241117 - RNA, 63 nt, Mycobacterium tuberculosis H37Rv
accggcgggggcaccguugcugcgaacgcggcuucguacgcugcagcggcagccuccgccugu

SEQ ID NO: 4241118 - RNA, 59 nt, Mycobacterium tuberculosis H37Rv
gcgugagguccgcggccuguaguuggguucccauugcaccgucgccgaccaucacucgc

SEQ ID NO: 4241119 - RNA, 89 nt, Mycobacterium tuberculosis H37Rv
gugccugcaccucuggguccaggguggugcggaucagguacccgcccguggcgaccugcuccuugcugaucccggcccgagacagguac

SEQ ID NO: 4241120 - RNA, 65 nt, Mycobacterium tuberculosis H37Rv
ccaccucgacgagcaccauccggucccgccgugcugcggcgacggugagggcgucgucgaguugg

SEQ ID NO: 4241121 - RNA, 78 nt, Mycobacterium tuberculosis H37Rv
ccuguagcgcgacagacgcaaaaucgcccgaaagccaucgguuucgggcgauuuugcgucugcucgcgccaacauagg

SEQ ID NO: 4241122 - RNA, 55 nt, Mycobacterium tuberculosis H37Rv
ccgcccgggugcgccguagcugaccgucaugggcccagcucgcgcagccgggugg

SEQ ID NO: 4241123 - RNA, 65 nt, Mycobacterium tuberculosis H37Rv; identical to SEQ ID NO: 4238583

SEQ ID NO: 4241124 - RNA, 82 nt, Mycobacterium tuberculosis H37Rv
gcugugaucgcgccccgagugugaacugcgcaacggguuagcgugucgcguagugcauuucacagucggauugcugucaggc

SEQ ID NO: 4241125 - RNA, 116 nt, Mycobacterium tuberculosis H37Rv; identical to SEQ ID NO: 4238417

SEQ ID NO: 4241126 - RNA, 89 nt, Mycobacterium tuberculosis H37Rv
gugcugaguuguuuguggccgccuaugugccguauguggcgugguuggugcaggccagugcggauagcgcggcggcggccggugagcau

SEQ ID NO: 4241127 - RNA, 86 nt, Mycobacterium tuberculosis H37Rv
ccacgucggccgagguccguaccgcgugcguggccgccaaccgcagccgguugcgcaucgucaccgguaccgccucggcaucgugg

SEQ ID NO: 4241128 - RNA, 63 nt, Mycobacterium tuberculosis H37Rv
ccuccauugugaaaugugcgacgccagcgcggcgugucgugucgcgaguuucacucucggggg

SEQ ID NO: 4241129 - RNA, 63 nt, Mycobacterium tuberculosis H37Rv; identical to SEQ ID NO: 4238738

SEQ ID NO: 4241130 - RNA, 55 nt, Mycobacterium tuberculosis H37Rv; identical to SEQ ID NO: 4238018

SEQ ID NO: 4241131 - RNA, 56 nt, Mycobacterium tuberculosis H37Rv; identical to SEQ ID NO: 4238602

SEQ ID NO: 4241132 - RNA, 80 nt, Mycobacterium tuberculosis H37Rv
gugaucugcccgucgugcgcgaaugccucgucgggugcccacgacgugcgcucgucgagcagguagcgcacggcgaucac

SEQ ID NO: 4241133 - RNA, 82 nt, Mycobacterium tuberculosis H37Rv; identical to SEQ ID NO: 4238376

SEQ ID NO: 4241134 - RNA, 67 nt, Mycobacterium tuberculosis H37Rv
cgcugcgagcguaacgccacggcgagcuugcgugcaccgaauucgccguggcguuacgcucgcggcg

SEQ ID NO: 4241135 - RNA, 62 nt, Mycobacterium tuberculosis H37Rv; identical to SEQ ID NO: 4238093

SEQ ID NO: 4241136 - RNA, 102 nt, Mycobacterium tuberculosis H37Rv
ggacggcuugacacguccgacaccgggcuggacggugccggcgaucaagcccagcagggucgacuugccggcgccguuagccccgacgaugccgauacguuc

SEQ ID NO: 4241137 - RNA, 66 nt, Mycobacterium tuberculosis H37Rv; identical to SEQ ID NO: 4238893

SEQ ID NO: 4241138 - RNA, 57 nt, Mycobacterium tuberculosis H37Rv
ccgaucucgccggagccgauucggggguggacuucaaucgguuugucggcgaggugg

SEQ ID NO: 4241139 - RNA, 75 nt, Mycobacterium tuberculosis H37Rv; identical to SEQ ID NO: 4238903

SEQ ID NO: 4241140 - RNA, 57 nt, Mycobacterium tuberculosis H37Rv; identical to SEQ ID NO: 4239188

SEQ ID NO: 4241141 - RNA, 65 nt, Mycobacterium tuberculosis H37Rv
gcuugggguuggcggccagugagcacgcgcucuugggcgcggugaucgaucugccggccucgggc

SEQ ID NO: 4241142 - RNA, 61 nt, Mycobacterium tuberculosis H37Rv
ggcgugagcuacugagcagguaucugggcaccuccauagugcuggccgguggcgucgcgcu

SEQ ID NO: 4241143 - RNA, 59 nt, Mycobacterium tuberculosis H37Rv; identical to SEQ ID NO: 4239098

SEQ ID NO: 4241144 - RNA, 129 nt, Mycobacterium tuberculosis H37Rv; identical to SEQ ID NO: 4238820

SEQ ID NO: 4241145 - RNA, 59 nt, Mycobacterium tuberculosis H37Rv; identical to SEQ ID NO: 4239150

SEQ ID NO: 4241146 - RNA, 85 nt, Mycobacterium tuberculosis H37Rv; identical to SEQ ID NO: 4239141

SEQ ID NO: 4241147 - RNA, 58 nt, Mycobacterium tuberculosis H37Rv
acuucgacgauaagggccggccgguacugauuacugccgccgcucccucguaugaggu

SEQ ID NO: 4241148 - RNA, 118 nt, Mycobacterium tuberculosis H37Rv; identical to SEQ ID NO: 4238809

SEQ ID NO: 4241149 - RNA, 71 nt, Mycobacterium tuberculosis H37Rv; identical to SEQ ID NO: 4238393

SEQ ID NO: 4241150 - RNA, 107 nt, Mycobacterium tuberculosis H37Rv
gcggaguaucgagcggaucgccaucggcguagcagauaccgggucagagcagcguacgcuggcacauucggcuucggcucgcugguuagcgauuguuaguugcacgc

SEQ ID NO: 4241151 - RNA, 72 nt, Mycobacterium tuberculosis H37Rv
uguuggcgcgagcagacgcaaaaucgcccgaaaccgauggcuuucgggcgauuuugcgucugucgcgcuaca

SEQ ID NO: 4241152 - RNA, 67 nt, Mycobacterium tuberculosis H37Rv
gcucggcucgguuaucaguugauaacauacccuccauguuaucgacugauaaccgauugucaacagc

SEQ ID NO: 4241153 - RNA, 130 nt, Mycobacterium tuberculosis H37Rv; identical to SEQ ID NO: 4239010

SEQ ID NO: 4241154 - RNA, 59 nt, Mycobacterium tuberculosis H37Rv
auggccgcgugugcaaguagcggcuugaucagcaaggcgccugcucccagcgcggcuau

SEQ ID NO: 4241155 - RNA, 80 nt, Mycobacterium tuberculosis H37Rv
cgagaccgggcaacgcggcggcgggcggguccgcccguucgacgaccggguggagcuggcugccgcgcuagaggcccucg

SEQ ID NO: 4241156 - RNA, 81 nt, Mycobacterium tuberculosis H37Rv
ggucggcgaugcguuggagauuggagacgucggccgcgucacguuugacgacgcggucgacguuccuagcuuucgccgauu

SEQ ID NO: 4241157 - RNA, 55 nt, Mycobacterium tuberculosis H37Rv
cggugcaauggucgcaugcucuguugaguggaccugagcgugcguuguugcaccg

SEQ ID NO: 4241158 - RNA, 68 nt, Mycobacterium tuberculosis H37Rv
ucggcugcccguagggcucgacgccgaaugcugucauaaggccuggcuccugucugugcgggcagaga

SEQ ID NO: 4241159 - RNA, 82 nt, Mycobacterium tuberculosis H37Rv; identical to SEQ ID NO: 4239079

SEQ ID NO: 4241160 - RNA, 129 nt, Mycobacterium tuberculosis H37Rv
gcccgguccggucagccaaaacggcgacacguaucgccgagugugaaucccgcgacgccgcaccggcgugucgcgucgccagauucacaaucggcauuaugcgauggccgcgagccuggccgcacccac

SEQ ID NO: 4241161 - RNA, 63 nt, Mycobacterium tuberculosis H37Rv; identical to SEQ ID NO: 4240456

SEQ ID NO: 4241162 - RNA, 75 nt, Mycobacterium tuberculosis H37Rv
gcggcacugugucgggcgcgagcucagccacgucagucgacgguccaagugucgcgcccgugcaacagugacugc

SEQ ID NO: 4241163 - RNA, 67 nt, Mycobacterium tuberculosis H37Rv; identical to SEQ ID NO: 4237719

SEQ ID NO: 4241164 - RNA, 63 nt, Mycobacterium tuberculosis H37Rv; identical to SEQ ID NO: 4238410

SEQ ID NO: 4241165 - RNA, 95 nt, Mycobacterium tuberculosis H37Rv; identical to SEQ ID NO: 4238478

SEQ ID NO: 4241166 - RNA, 85 nt, Mycobacterium tuberculosis H37Rv
gugagcaugcugaagucgccgcugauggugucggucgggguguugccgacgaacacggucacgguggcgacgucgucgugcccau

SEQ ID NO: 4241167 - RNA, 57 nt, Mycobacterium tuberculosis H37Rv
ggcaugagucgaagccucaacggaauacaccacaccgucgggugcuacgacuuugcc

SEQ ID NO: 4241168 - RNA, 102 nt, Mycobacterium tuberculosis H37Rv
gcaggcgaugaacacgguguugcgcaagcuggaagaugccggugcgguggcccggcccgcaucggugucuuccgggcguucgcuaccggcuacauugaccgc

SEQ ID NO: 4241169 - RNA, 98 nt, Mycobacterium tuberculosis H37Rv; identical to SEQ ID NO: 4238854

SEQ ID NO: 4241170 - RNA, 76 nt, Mycobacterium tuberculosis H37Rv
uugacguugagcuucucgucgggaauguugagguccuucuggaacuucagcaccaccgacgcgaacgccucguuga

SEQ ID NO: 4241171 - RNA, 79 nt, Mycobacterium tuberculosis H37Rv
gccgcgacaccgaacugaugcuggacgcgcugcagacccugggccugcgcgucgacgguguggguucggaacugacggu

SEQ ID NO: 4241172 - RNA, 76 nt, Mycobacterium tuberculosis H37Rv
caccgccggguugguggcggccagcagcaacgagugaccgucggcguguugcaggcccucaccggucaggguggug

SEQ ID NO: 4241173 - RNA, 59 nt, Mycobacterium tuberculosis H37Rv; identical to SEQ ID NO: 4238764

SEQ ID NO: 4241174 - RNA, 56 nt, Mycobacterium tuberculosis H37Rv
gagcagacgcaaaaucgcccaauuucgugccgaauugggcgauuuugcgucugcuc

SEQ ID NO: 4241175 - RNA, 60 nt, Mycobacterium tuberculosis H37Rv; identical to SEQ ID NO: 4238309

SEQ ID NO: 4241176 - RNA, 65 nt, Mycobacterium tuberculosis H37Rv
gggcuggggucugugggaucaggccagcgccaugaccggcggccuggacgccgcagaccuggccc

SEQ ID NO: 4241177 - RNA, 64 nt, Mycobacterium tuberculosis H37Rv
gcacggcgugcgcggugaaccccuccggcgccagcaccgccaccuuucccgcguccacgucggc

SEQ ID NO: 4241178 - RNA, 93 nt, Mycobacterium tuberculosis H37Rv
ccgcuggggauaacuggcgagcagacgcagaaucgcacggcgcggaccucgcgcgugcgauucugcgucugcucgcggucagaacuacagcgg

SEQ ID NO: 4241179 - RNA, 60 nt, Mycobacterium tuberculosis H37Rv
cauggaaaugcuuugcacggcgaauaguuucccucgcugaugacagccuguguuuccgug

SEQ ID NO: 4241180 - RNA, 73 nt, Mycobacterium tuberculosis H37Rv
agguauucgucaccgaaguugcggcgcggcggcacgagcucuuguuggccgcgcacgaggcuucgguucaucu

SEQ ID NO: 4241181 - RNA, 62 nt, Mycobacterium tuberculosis H37Rv; identical to SEQ ID NO: 4238939

SEQ ID NO: 4241182 - RNA, 68 nt, Mycobacterium tuberculosis H37Rv; identical to SEQ ID NO: 4237978

SEQ ID NO: 4241183 - RNA, 99 nt, Mycobacterium tuberculosis H37Rv
caacgcuguagacccggcugcgcgagcagacgcaaaaucgcccaaaaccacugguuuucgggcgauuuugcgucugcucgcgcaagcccucagcgggug

SEQ ID NO: 4241184 - RNA, 77 nt, Mycobacterium tuberculosis H37Rv
uccggcucgauguuuuggguaugucaugugcggccugugccagccgcgucgagacgaagcucaacaagauccccgga

SEQ ID NO: 4241185 - RNA, 76 nt, Mycobacterium tuberculosis H37Rv
gaauucagguguugagaaaauguauaaaaauaguauugcuaucgcaaucgguacauugacuauggcaguugaauuu

SEQ ID NO: 4241186 - RNA, 74 nt, Mycobacterium tuberculosis H37Rv; identical to SEQ ID NO: 4239199

SEQ ID NO: 4241187 - RNA, 60 nt, Mycobacterium tuberculosis H37Rv; identical to SEQ ID NO: 4238023

SEQ ID NO: 4241188 - RNA, 62 nt, Mycobacterium tuberculosis H37Rv; identical to SEQ ID NO: 4238857

SEQ ID NO: 4241189 - RNA, 73 nt, Mycobacterium tuberculosis H37Rv; identical to SEQ ID NO: 4237606

SEQ ID NO: 4241190 - RNA, 79 nt, Mycobacterium tuberculosis H37Rv
uuccuggcacggguaguugcgagcgccgcgcaccgugcucgggucguucugcgcggucuugcaguacaugucccgggga

SEQ ID NO: 4241191 - RNA, 88 nt, Mycobacterium tuberculosis H37Rv
cggcacgaucgucaacgccgcauuggcgaugucggcgguugggagcaccgucgcguagcucgucgcggccaccuucgaaaucguguug

SEQ ID NO: 4241192 - RNA, 69 nt, Mycobacterium tuberculosis H37Rv; identical to SEQ ID NO: 4238057

SEQ ID NO: 4241193 - RNA, 104 nt, Mycobacterium tuberculosis H37Rv; identical to SEQ ID NO: 4238884

SEQ ID NO: 4241194 - RNA, 72 nt, Mycobacterium tuberculosis H37Rv
gaaugcguccccggccacauccgggucggcggcggcgucgucgaccagugagguggcaacgucgauagcauc

SEQ ID NO: 4241195 - RNA, 58 nt, Mycobacterium tuberculosis H37Rv; identical to SEQ ID NO: 4238040

SEQ ID NO: 4241196 - RNA, 68 nt, Mycobacterium tuberculosis H37Rv
gucgcguuugcgcaggggcaugucagcguaugugcucgacgcgacgaauccacugcgcuugacgaggc

SEQ ID NO: 4241197 - RNA, 82 nt, Mycobacterium tuberculosis H37Rv; identical to SEQ ID NO: 4238832

SEQ ID NO: 4241198 - RNA, 68 nt, Mycobacterium tuberculosis H37Rv; identical to SEQ ID NO: 4237672

SEQ ID NO: 4241199 - RNA, 110 nt, Mycobacterium tuberculosis H37Rv; identical to SEQ ID NO: 4238502

SEQ ID NO: 4241200 - RNA, 86 nt, Mycobacterium tuberculosis H37Rv; identical to SEQ ID NO: 4238354

SEQ ID NO: 4241201 - RNA, 84 nt, Mycobacterium tuberculosis H37Rv
gcgguaggccggcgagcagacgcaaaagcccccuaaaccggcagguauuaggggcuuuugcgucugcucgccaggcaagccagc

SEQ ID NO: 4241202 - RNA, 83 nt, Mycobacterium tuberculosis H37Rv
gcugucggcguuuugcucggcgcacccguuggcgaaggugcaagucuguucccggcuggcugcgaccgagcuguaccgacggc

SEQ ID NO: 4241203 - RNA, 80 nt, Mycobacterium tuberculosis H37Rv; identical to SEQ ID NO: 4237954

SEQ ID NO: 4241204 - RNA, 69 nt, Mycobacterium tuberculosis H37Rv; identical to SEQ ID NO: 4238985

SEQ ID NO: 4241205 - RNA, 79 nt, Mycobacterium tuberculosis H37Rv; identical to SEQ ID NO: 4239197

SEQ ID NO: 4241206 - RNA, 102 nt, Mycobacterium tuberculosis H37Rv; identical to SEQ ID NO: 4238935

SEQ ID NO: 4241207 - RNA, 74 nt, Mycobacterium tuberculosis H37Rv
ucgaugaaccaccugacaugaccccauccuuuccaagaacuggagucuccggacaugccggggcgguucaucga

SEQ ID NO: 4241208 - RNA, 80 nt, Mycobacterium tuberculosis H37Rv
gggucguuggugaugcugcucggacccagcggcugcggcaagacgacacugcuuuccugucugggcggcauucugcgccc

SEQ ID NO: 4241209 - RNA, 70 nt, Mycobacterium tuberculosis H37Rv; identical to SEQ ID NO: 4238385

SEQ ID NO: 4241210 - RNA, 61 nt, Mycobacterium tuberculosis H37Rv
cggggcgcgaugaacuucccggcaucggcaucgccaggucgacggacguggucgcgcuaug

SEQ ID NO: 4241211 - RNA, 69 nt, Mycobacterium tuberculosis H37Rv; identical to SEQ ID NO: 4238211

SEQ ID NO: 4241212 - RNA, 64 nt, Mycobacterium tuberculosis H37Rv
uuggcgaauccgugcgaguugaucgccgaucucagcaccggcacgaacaggcgggauucgccga

SEQ ID NO: 4241213 - RNA, 55 nt, Mycobacterium tuberculosis H37Rv
ggaucgggugcuugcggugaucugcgguucugcggucaaccaggacggccgaucc

SEQ ID NO: 4241214 - RNA, 130 nt, Mycobacterium tuberculosis H37Rv
uaggcgggucagaaaaaaugucguacuggcccacgauauugauugugucguacuggcuuuccgcuggggccggaacgguguagucgaugaucggcacguggguucccggccuaaacgcccgccaaagaag

SEQ ID NO: 4241215 - RNA, 81 nt, Mycobacterium tuberculosis H37Rv; identical to SEQ ID NO: 4237830

SEQ ID NO: 4241216 - RNA, 68 nt, Mycobacterium tuberculosis H37Rv
gcgaugcagccggucucggcgccgcgcguguugucggcugcggcggugguaggccgguuacgcguugu

SEQ ID NO: 4241217 - RNA, 56 nt, Mycobacterium tuberculosis H37Rv
gugaccgccccggagcgagcaccuucgauggaagaggucgcugcugcggcggucgc

SEQ ID NO: 4241218 - RNA, 71 nt, Mycobacterium tuberculosis H37Rv
ggauuccgcgagcguaacgccacugcgcuauucggaucgcaaucucgcagugacguuacgcucggcggacc

SEQ ID NO: 4241219 - RNA, 61 nt, Mycobacterium tuberculosis H37Rv
cgcauaugucgacgcggcccgcgcgguggcaaaugccaucggugcgcacgcgucgacagcg

SEQ ID NO: 4241220 - RNA, 71 nt, Mycobacterium tuberculosis H37Rv
ggcgcggucgggaauacgacgaguucgucagucgcuauaucgaaacggcucaacgguuauuuccgcgugcc

SEQ ID NO: 4241221 - RNA, 55 nt, Mycobacterium tuberculosis H37Rv; identical to SEQ ID NO: 4238853

SEQ ID NO: 4241222 - RNA, 68 nt, Mycobacterium tuberculosis H37Rv
acgaacgauggccugaugcuccgccucaagcgacgccgccugagcgcggaucauggcgccaugagcgu

SEQ ID NO: 4241223 - RNA, 63 nt, Mycobacterium tuberculosis H37Rv
cgccgagauugacguuuugcagacgcccucucgcacuuucacugcaaaacgucagucucggug

SEQ ID NO: 4241224 - RNA, 57 nt, Mycobacterium tuberculosis H37Rv; identical to SEQ ID NO: 4238071

SEQ ID NO: 4241225 - RNA, 58 nt, Mycobacterium tuberculosis H37Rv; identical to SEQ ID NO: 4238971

SEQ ID NO: 4241226 - RNA, 66 nt, Mycobacterium tuberculosis H37Rv
gggcacuggcgauaucagacguucgaccgugccgacggucuggacuucgacgucgccccacugccc

SEQ ID NO: 4241227 - RNA, 56 nt, Mycobacterium tuberculosis H37Rv
agcgugaucaggcucggcucgcgaguucggcgaagaaguggcucgccugaucaccu

SEQ ID NO: 4241228 - RNA, 65 nt, Mycobacterium tuberculosis H37Rv; identical to SEQ ID NO: 4238687

SEQ ID NO: 4241229 - RNA, 86 nt, Mycobacterium tuberculosis H37Rv; identical to SEQ ID NO: 4238723

SEQ ID NO: 4241230 - RNA, 83 nt, Mycobacterium tuberculosis H37Rv; identical to SEQ ID NO: 4238962

SEQ ID NO: 4241231 - RNA, 75 nt, Mycobacterium tuberculosis H37Rv
uggggucggugagccagcggcggacgucgguccaauuccagcgaugccgaaugcgcugccaguucaccagccgca

SEQ ID NO: 4241232 - RNA, 69 nt, Mycobacterium tuberculosis H37Rv
ccgagcugacgccgagcugguugacggcgaagucgagugccgcgucaaccgaucggucguccggaucgg

SEQ ID NO: 4241233 - RNA, 63 nt, Mycobacterium tuberculosis H37Rv; identical to SEQ ID NO: 4238346

SEQ ID NO: 4241234 - RNA, 86 nt, Mycobacterium tuberculosis H37Rv; identical to SEQ ID NO: 4239139

SEQ ID NO: 4241235 - RNA, 68 nt, Mycobacterium tuberculosis H37Rv
ggaccaugaugggucugggcggagugcguccgaaggacgauccgcugggacccaucaucaagcuguuc

SEQ ID NO: 4241236 - RNA, 77 nt, Mycobacterium tuberculosis H37Rv; identical to SEQ ID NO: 4238339

SEQ ID NO: 4241237 - RNA, 70 nt, Mycobacterium tuberculosis H37Rv
ggcccacuggcgguagaggccgccggcagcuagcacgucgucaggcgccggccgcgcagugaaaucggcc

SEQ ID NO: 4241238 - RNA, 58 nt, Mycobacterium tuberculosis H37Rv; identical to SEQ ID NO: 4240446

SEQ ID NO: 4241239 - RNA, 114 nt, Mycobacterium tuberculosis H37Rv
ggcauugucggccaagggauuggaggaugcggugcaccgugcgauuagcgagggcccguagugaccgcucaucgcaguguucugcuggucguccacaccgggcgcgacgaagcc

SEQ ID NO: 4241240 - RNA, 111 nt, Mycobacterium tuberculosis H37Rv
gcagauccagcugcugugagggucugugcccacgcgugugacgcugcggcgaauccaagcgcgauuucuugccgcgccauuacgcucgccgggcgcucgcggcagguuugc

SEQ ID NO: 4241241 - RNA, 83 nt, Mycobacterium tuberculosis H37Rv
cgcgcgcgcguauugucaacgccaccauucggugccacccauuggucgcaucgacggcgucguuggcgaacugucgugcggcg

SEQ ID NO: 4241242 - RNA, 129 nt, Mycobacterium tuberculosis H37Rv; identical to SEQ ID NO: 4238392

SEQ ID NO: 4241243 - RNA, 121 nt, Mycobacterium tuberculosis H37Rv; identical to SEQ ID NO: 4238268

SEQ ID NO: 4241244 - RNA, 86 nt, Mycobacterium tuberculosis H37Rv; identical to SEQ ID NO: 4240199

SEQ ID NO: 4241245 - RNA, 65 nt, Mycobacterium tuberculosis H37Rv; identical to SEQ ID NO: 4238806

SEQ ID NO: 4241246 - RNA, 127 nt, Mycobacterium tuberculosis H37Rv
augcccuucggaucgguauuggugugggcgaucaggucgaacgucucgugcuugggugggugaauggcucacccuaucuggucgcacgaggcgugccgguacaucgacacgccgguacugguggcau

SEQ ID NO: 4241247 - RNA, 58 nt, Mycobacterium tuberculosis H37Rv
gaucgcugcgcugaucgcggucgggguggacagucccaccgcgcacgggcaugcgauc

SEQ ID NO: 4241248 - RNA, 90 nt, Mycobacterium tuberculosis H37Rv; identical to SEQ ID NO: 4238112

SEQ ID NO: 4241249 - RNA, 85 nt, Mycobacterium tuberculosis H37Rv
cgggccaacacgaggaauucgcacccgcugccggcgugaccaacgccacgcuggcagcaaucggguauccgaucgcguuggccag

SEQ ID NO: 4241250 - RNA, 75 nt, Mycobacterium tuberculosis H37Rv
ucguucguugacucugcguccaccacgcaaaagugcgaguaacccguccgguggacgcagagucaacagauaagg

SEQ ID NO: 4241251 - RNA, 55 nt, Mycobacterium tuberculosis H37Rv
ggccgguggaggugcacauuuacccaaaccgguuggugcgcaaccucaccgagcu

SEQ ID NO: 4241252 - RNA, 69 nt, Mycobacterium tuberculosis H37Rv; identical to SEQ ID NO: 4238037

SEQ ID NO: 4241253 - RNA, 102 nt, Mycobacterium tuberculosis H37Rv
gcauaacggguuguggggguaucacguugaccgcgguggcgugcugcgcgguagucgucgcggccgcuacgcuggucggcgcgaucacugcggccccggugc

SEQ ID NO: 4241254 - RNA, 63 nt, Mycobacterium tuberculosis H37Rv
gcgacccggacgcgaucuuggccaccccgguggaaacggugcgccgcgaucguuccggcaagc

SEQ ID NO: 4241255 - RNA, 75 nt, Mycobacterium tuberculosis H37Rv
auggcaggcgaccuuucgacgcguugucgacgaccagucggucaucgaacaucggucgaaggucucgcccaccgu

SEQ ID NO: 4241256 - RNA, 63 nt, Mycobacterium tuberculosis H37Rv; identical to SEQ ID NO: 4237661

SEQ ID NO: 4241257 - RNA, 55 nt, Mycobacterium tuberculosis H37Rv; identical to SEQ ID NO: 4239116

SEQ ID NO: 4241258 - RNA, 63 nt, Mycobacterium tuberculosis H37Rv
cgagcgauguggugugcguacuggccgcggcaaaggccgcgcaggucgcgaccacgcugaccg

SEQ ID NO: 4241259 - RNA, 61 nt, Mycobacterium tuberculosis H37Rv; identical to SEQ ID NO: 4238289

SEQ ID NO: 4241260 - RNA, 78 nt, Mycobacterium tuberculosis H37Rv; identical to SEQ ID NO: 4238286

SEQ ID NO: 4241261 - RNA, 81 nt, Mycobacterium tuberculosis H37Rv
augcgaguaucgcucaucucugugucgauccgaugauugugggcguccuuuucaucgagauccauaugauguacuccgcau

SEQ ID NO: 4241262 - RNA, 106 nt, Mycobacterium tuberculosis H37Rv
cuguggcagcuggagcgggaacggaucuucaaccgguccuggaugcuugucgcgcaugucgaccaagucgccaagaccggugacuacgucaccguguccgucgcag

SEQ ID NO: 4241263 - RNA, 63 nt, Mycobacterium tuberculosis H37Rv; identical to SEQ ID NO: 4238490

SEQ ID NO: 4241264 - RNA, 71 nt, Mycobacterium tuberculosis H37Rv
gccgacgcggugauccaucucgccccggucgacaccagcgccccgggcgguguuggcaucaccggacuggc

SEQ ID NO: 4241265 - RNA, 58 nt, Mycobacterium tuberculosis H37Rv
acuugcucgccgaccugcugccgccguugucucacaagccgcgggugcgcgagcgggu

SEQ ID NO: 4241266 - RNA, 63 nt, Mycobacterium tuberculosis H37Rv; identical to SEQ ID NO: 4238567

SEQ ID NO: 4241267 - RNA, 114 nt, Mycobacterium tuberculosis H37Rv; identical to SEQ ID NO: 4238726

SEQ ID NO: 4241268 - RNA, 94 nt, Mycobacterium tuberculosis H37Rv
cgggacugcgaaccugcaccacucggcugacacguuccgcccggcacggacccgccugccccgagcuggaagugucggccugcccggccgcccg

SEQ ID NO: 4241269 - RNA, 56 nt, Mycobacterium tuberculosis H37Rv
gucagcgcgucguuggccagcguggucacauggaaguggucgacgacgagcuuggc

SEQ ID NO: 4241270 - RNA, 56 nt, Mycobacterium tuberculosis H37Rv
ccugaucgcgucaucgaucgugcgccgcuguggugcgcggucgacuuacgcgaugg

SEQ ID NO: 4241271 - RNA, 83 nt, Mycobacterium tuberculosis H37Rv
cgguuugguuacagcaaaagccauucauuucuaauuggcuugugcccaauaggaacuggcuugugcccaauagccggaucccg

SEQ ID NO: 4241272 - RNA, 64 nt, Mycobacterium tuberculosis H37Rv
ggucgccgacccgcugcacggugaugcgcauucgccacgcucguggaaccgggucggcuucgcc

SEQ ID NO: 4241273 - RNA, 57 nt, Mycobacterium tuberculosis H37Rv; identical to SEQ ID NO: 4238122

SEQ ID NO: 4241274 - RNA, 92 nt, Mycobacterium tuberculosis H37Rv
gcggcggcaaucgccgacggcgcucggaucaucaucuuguccgaccgcgaguccgacgaggaaauggcuccgauaccgucgcugcucgccgu

SEQ ID NO: 4241275 - RNA, 95 nt, Mycobacterium tuberculosis H37Rv; identical to SEQ ID NO: 4238953

SEQ ID NO: 4241276 - RNA, 95 nt, Mycobacterium tuberculosis H37Rv; identical to SEQ ID NO: 4237838

SEQ ID NO: 4241277 - RNA, 117 nt, Mycobacterium tuberculosis H37Rv
cugcgcgccgagcgugggcuggcugcgccgaaugugcacugguggcggcgacacgcccgggcgacgccgccgugguugcacguucggcguaggcagccccgugcgcuugccgggcag

SEQ ID NO: 4241278 - RNA, 56 nt, Mycobacterium tuberculosis H37Rv
gacccggaugucuuucgcgccgaccgcaacccggucgggcaucucgcguucggcuc

SEQ ID NO: 4241279 - RNA, 95 nt, Mycobacterium tuberculosis H37Rv; identical to SEQ ID NO: 4240336

SEQ ID NO: 4241280 - RNA, 79 nt, Mycobacterium tuberculosis H37Rv
cgccgccgcggacugucccgagcgcaccaggaaucgaaccaggcuuccuugugucaucgggcaggucgcaaauccggug

SEQ ID NO: 4241281 - RNA, 61 nt, Mycobacterium tuberculosis H37Rv
ugggccaggugcugcugaccgcgcacgacauuucgaugcgggugcagcacaccaacgccca

SEQ ID NO: 4241282 - RNA, 67 nt, Mycobacterium tuberculosis H37Rv; identical to SEQ ID NO: 4237647

SEQ ID NO: 4241283 - RNA, 85 nt, Mycobacterium tuberculosis H37Rv; identical to SEQ ID NO: 4238141

SEQ ID NO: 4241284 - RNA, 107 nt, Mycobacterium tuberculosis H37Rv; identical to SEQ ID NO: 4237832

SEQ ID NO: 4241285 - RNA, 83 nt, Mycobacterium tuberculosis H37Rv; identical to SEQ ID NO: 4238638

SEQ ID NO: 4241286 - RNA, 76 nt, Mycobacterium tuberculosis H37Rv
ggccacgcagccggaucagcggggacuugguuucggucagcgccgcgaucuccuccucgcugagcggaucgucgcc

SEQ ID NO: 4241287 - RNA, 81 nt, Mycobacterium tuberculosis H37Rv
ccgacaucugcugcaccucgucaaacgccgucgacguggucgcauccaucgaucccgaccgcgagguguuguucuguccgg

SEQ ID NO: 4241288 - RNA, 83 nt, Mycobacterium tuberculosis H37Rv; identical to SEQ ID NO: 4239223

SEQ ID NO: 4241289 - RNA, 60 nt, Mycobacterium tuberculosis H37Rv; identical to SEQ ID NO: 4240219

SEQ ID NO: 4241290 - RNA, 72 nt, Mycobacterium tuberculosis H37Rv; identical to SEQ ID NO: 4240353

SEQ ID NO: 4241291 - RNA, 62 nt, Mycobacterium tuberculosis H37Rv
cgaccaccgucaauacgauguugcugcgcgucggggcgcgcucgucguaucugaugggguug

SEQ ID NO: 4241292 - RNA, 87 nt, Mycobacterium tuberculosis H37Rv
cggcgucgacccggccgcugcagcggcucguggguggugugcaggacccgcaucgcacguucugcugcagcgccgaugggggugucg

SEQ ID NO: 4241293 - RNA, 105 nt, Mycobacterium tuberculosis H37Rv
cgguguuguucggcgugugguggaucggugcgcaagcgauacucgacgauucucccgccgauguggcacugugcaccgccgaccgucuggccgaagccgacgccg

SEQ ID NO: 4241294 - RNA, 78 nt, Mycobacterium tuberculosis H37Rv
gcaucguggugagguuguguccaacgguggcgaucacccgucguccaaugaaccacaaccccgcgcacaacgcgacgc

SEQ ID NO: 4241295 - RNA, 85 nt, Mycobacterium tuberculosis H37Rv; identical to SEQ ID NO: 4239129

SEQ ID NO: 4241296 - RNA, 76 nt, Mycobacterium tuberculosis H37Rv
ccggcgcgacggcgugcgcgugcugcccgccacggcgggcuucguggacgagcaucgcgagcacgcagcgcgcugg

SEQ ID NO: 4241297 - RNA, 57 nt, Mycobacterium tuberculosis H37Rv; identical to SEQ ID NO: 4238322

SEQ ID NO: 4241298 - RNA, 59 nt, Mycobacterium tuberculosis H37Rv
acccguuguugagugccacgauggccgcggagucgaucaucgggauucagcagcagggu

SEQ ID NO: 4241299 - RNA, 59 nt, Mycobacterium tuberculosis H37Rv; identical to SEQ ID NO: 4239022

SEQ ID NO: 4241300 - RNA, 114 nt, Mycobacterium tuberculosis H37Rv
gggacaacucaaccacccguuggcgcaucgagucgacgaugugguggucgugcguggccaucagcaccgucgugccggugcgguugauccgcuccaauaaguccaugauguccc

SEQ ID NO: 4241301 - RNA, 130 nt, Mycobacterium tuberculosis H37Rv
gugcccugcuggcgauccuggccgucgugccguggcggcaguucgccaguggcgaguccccguuugugacgauguucucccuagccggacuugccgcugcggcgucggucgucaacuucgucguggucac

SEQ ID NO: 4241302 - RNA, 69 nt, Mycobacterium tuberculosis H37Rv; identical to SEQ ID NO: 4237773

SEQ ID NO: 4241303 - RNA, 103 nt, Mycobacterium tuberculosis H37Rv; identical to SEQ ID NO: 4237881

SEQ ID NO: 4241304 - RNA, 57 nt, Mycobacterium tuberculosis H37Rv; identical to SEQ ID NO: 4240327

SEQ ID NO: 4241305 - RNA, 66 nt, Mycobacterium tuberculosis H37Rv; identical to SEQ ID NO: 4238919

SEQ ID NO: 4241306 - RNA, 73 nt, Mycobacterium tuberculosis H37Rv
ggcuugcgcgagcagacgcaaaaucgcccgaaaaccagugguuuugggcgauuuugcgucugcucgcgcagcc

SEQ ID NO: 4241307 - RNA, 69 nt, Mycobacterium tuberculosis H37Rv
ggcgcugcggcgcggugauacgccgggagagguuuaugaaccgcucgucguucuacugcccgcgaugcc

SEQ ID NO: 4241308 - RNA, 62 nt, Mycobacterium tuberculosis H37Rv
ugcccgucgccaaguacgacugaccgagcaaacgaacgaucgucguccuuuccgugggggua

SEQ ID NO: 4241309 - RNA, 93 nt, Mycobacterium tuberculosis H37Rv; identical to SEQ ID NO: 4237873

SEQ ID NO: 4241310 - RNA, 64 nt, Mycobacterium tuberculosis H37Rv; identical to SEQ ID NO: 4238862

SEQ ID NO: 4241311 - RNA, 69 nt, Mycobacterium tuberculosis H37Rv; identical to SEQ ID NO: 4238534

SEQ ID NO: 4241312 - RNA, 99 nt, Mycobacterium tuberculosis H37Rv
gcugaccacaaaugccagcugcgccgaaggcccagcgcggacggcaaacaccuuccguugcaacaccuucggaugcagcuuggacggaaggugaccagu

SEQ ID NO: 4241313 - RNA, 73 nt, Mycobacterium tuberculosis H37Rv
ucuucgacguugaagcccgcguugugggcaucuugaacggcauagaugacccugcgcugggcugcgccgaugg

SEQ ID NO: 4241314 - RNA, 128 nt, Mycobacterium tuberculosis H37Rv; identical to SEQ ID NO: 4237664

SEQ ID NO: 4241315 - RNA, 60 nt, Mycobacterium tuberculosis H37Rv
gugaagcgcgcccaagccgccgucgcgcaaaccggccugaccgagcgggugcgcuuccac

SEQ ID NO: 4241316 - RNA, 65 nt, Mycobacterium tuberculosis H37Rv; identical to SEQ ID NO: 4238678

SEQ ID NO: 4241317 - RNA, 79 nt, Mycobacterium tuberculosis H37Rv; identical to SEQ ID NO: 4237679

SEQ ID NO: 4241318 - RNA, 86 nt, Mycobacterium tuberculosis H37Rv; identical to SEQ ID NO: 4238198

SEQ ID NO: 4241319 - RNA, 68 nt, Mycobacterium tuberculosis H37Rv
ggguucaacgccgcgucgccggcauuccaacaaauggguuggaaccccaugacgcaggcguuggaccc

SEQ ID NO: 4241320 - RNA, 97 nt, Mycobacterium tuberculosis H37Rv; identical to SEQ ID NO: 4237946

SEQ ID NO: 4241321 - RNA, 85 nt, Mycobacterium tuberculosis H37Rv
cuguccgggaccgcggagccggaguuugugcuugugcaugaugccgcgcgggcacugacaccaccggcccuggucgcccgggugg

SEQ ID NO: 4241322 - RNA, 56 nt, Mycobacterium tuberculosis H37Rv; identical to SEQ ID NO: 4238276

SEQ ID NO: 4241323 - RNA, 87 nt, Mycobacterium tuberculosis H37Rv; identical to SEQ ID NO: 4239034

SEQ ID NO: 4241324 - RNA, 94 nt, Mycobacterium tuberculosis H37Rv
cccauuucgccggccauccgcuagccaacguuaauaaccgacccaccgguuguuagcuuggaaggugcuuggccgaaacguccaacagcauggg

SEQ ID NO: 4241325 - RNA, 94 nt, Mycobacterium tuberculosis H37Rv
ucccaacggucgcaacgcgauggacgcucuggccacuaaguugugguucugcgggugcacgacgugaccggagcguccgagcugacacugggga

SEQ ID NO: 4241326 - RNA, 63 nt, Mycobacterium tuberculosis H37Rv; identical to SEQ ID NO: 4237990

SEQ ID NO: 4241327 - RNA, 67 nt, Mycobacterium tuberculosis H37Rv
augucggugguugccggggugacguggaucgacaggucagcgucggcccccgaaccaguuacggcau

SEQ ID NO: 4241328 - RNA, 77 nt, Mycobacterium tuberculosis H37Rv; identical to SEQ ID NO: 4238667

SEQ ID NO: 4241329 - RNA, 62 nt, Mycobacterium tuberculosis H37Rv
guauuucggaagcaaaguguugcggacggugauuccacgcagcgucaagguuuccgaagcgc

SEQ ID NO: 4241330 - RNA, 109 nt, Mycobacterium tuberculosis H37Rv
ucgaagguccgcacgaaacugguuccguccaucgguuccugcucgaagccgucgacaugggucggcuccgguaaaccgauggccgccaacacggucggcgcgaugucga

SEQ ID NO: 4241331 - RNA, 77 nt, Mycobacterium tuberculosis H37Rv; identical to SEQ ID NO: 4238146

SEQ ID NO: 4241332 - RNA, 55 nt, Mycobacterium tuberculosis H37Rv; identical to SEQ ID NO: 4238990

SEQ ID NO: 4241333 - RNA, 130 nt, Mycobacterium tuberculosis H37Rv; identical to SEQ ID NO: 4238676

SEQ ID NO: 4241334 - RNA, 70 nt, Mycobacterium tuberculosis H37Rv; identical to SEQ ID NO: 4237935

SEQ ID NO: 4241335 - RNA, 129 nt, Mycobacterium tuberculosis H37Rv
gacgaccggaacguuccugcacagacagacaggauugccgagcguguugauguuguccaguacaacagaaagcgucugggcaguagccagcaugccgggaucgaccccacggaauguugccccguuguc

SEQ ID NO: 4241336 - RNA, 62 nt, Mycobacterium tuberculosis H37Rv; identical to SEQ ID NO: 4237688

SEQ ID NO: 4241337 - RNA, 84 nt, Mycobacterium tuberculosis H37Rv
gggcugccuacgccgaacgugcaaccacggcggcgucgcccgggcgugucgccgccaccagugcacauucggcgcagccagccc

SEQ ID NO: 4241338 - RNA, 56 nt, Mycobacterium tuberculosis H37Rv; identical to SEQ ID NO: 4238421

SEQ ID NO: 4241339 - RNA, 92 nt, Mycobacterium tuberculosis H37Rv
cgucgguucggcuuucgaacgcggugucggcggccugcccacggaucaacucacggguggcuuccgaaaucgcgcgcagcgccgcaccgacg

SEQ ID NO: 4241340 - RNA, 57 nt, Mycobacterium tuberculosis H37Rv
ugcgcuugcccuugccgaguuuggaaaugugcaccagaccgucgcggccaggcagca

SEQ ID NO: 4241341 - RNA, 117 nt, Mycobacterium tuberculosis H37Rv; identical to SEQ ID NO: 4238481

SEQ ID NO: 4241342 - RNA, 115 nt, Mycobacterium tuberculosis H37Rv; identical to SEQ ID NO: 4240290

SEQ ID NO: 4241343 - RNA, 65 nt, Mycobacterium tuberculosis H37Rv; identical to SEQ ID NO: 4238267

SEQ ID NO: 4241344 - RNA, 65 nt, Mycobacterium tuberculosis H37Rv
ggaccagcaccgcggcgaccgcaccggccucguugauggccaagugcgucagcagcggugcugcc

SEQ ID NO: 4241345 - RNA, 73 nt, Mycobacterium tuberculosis H37Rv
cgcaguucacggccaugaugcaguucuacgacgacggcguuguacagcuggaucgugcugcacucacgcugcg

SEQ ID NO: 4241346 - RNA, 55 nt, Mycobacterium tuberculosis H37Rv; identical to SEQ ID NO: 4237836

SEQ ID NO: 4241347 - RNA, 55 nt, Mycobacterium tuberculosis H37Rv
ugcaccucgaacgagguggcgucgcggacgucgccgggcgucaccccggggugua

SEQ ID NO: 4241348 - RNA, 68 nt, Mycobacterium tuberculosis H37Rv; identical to SEQ ID NO: 4239060

SEQ ID NO: 4241349 - RNA, 70 nt, Mycobacterium tuberculosis H37Rv; identical to SEQ ID NO: 4238855

SEQ ID NO: 4241350 - RNA, 65 nt, Mycobacterium tuberculosis H37Rv; identical to SEQ ID NO: 4238424

SEQ ID NO: 4241351 - RNA, 55 nt, Mycobacterium tuberculosis H37Rv
ggccgggguggggcgacuguucgccgaagggguggcgguugauuggucuucgguc

SEQ ID NO: 4241352 - RNA, 83 nt, Mycobacterium tuberculosis H37Rv; identical to SEQ ID NO: 4237817

SEQ ID NO: 4241353 - RNA, 56 nt, Mycobacterium tuberculosis H37Rv; identical to SEQ ID NO: 4237841

SEQ ID NO: 4241354 - RNA, 64 nt, Mycobacterium tuberculosis H37Rv; identical to SEQ ID NO: 4238818

SEQ ID NO: 4241355 - RNA, 61 nt, Mycobacterium tuberculosis H37Rv
uuguguaauuccugaaagcucguugccaguagucugcuaacagucugccaggaaucgccaa

SEQ ID NO: 4241356 - RNA, 129 nt, Mycobacterium tuberculosis H37Rv; identical to SEQ ID NO: 4238303

SEQ ID NO: 4241357 - RNA, 63 nt, Mycobacterium tuberculosis H37Rv; identical to SEQ ID NO: 4238418

SEQ ID NO: 4241358 - RNA, 73 nt, Mycobacterium tuberculosis H37Rv
cgagcugcugcggcucgucuacggcgggcagagguugagauugcccgccgcggcgagccgguagcaaagcuug

SEQ ID NO: 4241359 - RNA, 60 nt, Mycobacterium tuberculosis H37Rv
gcgagcagacgcaaaagcccccgaaaaugggcauuucgggggcauuuugcgucugcucgc

SEQ ID NO: 4241360 - RNA, 74 nt, Mycobacterium tuberculosis H37Rv
uccgcuugccgauggaucguucguacgggucugcgacauacaccucgacgucccucucuauuggcaaugcugga

SEQ ID NO: 4241361 - RNA, 76 nt, Mycobacterium tuberculosis H37Rv
gccggacccugaugaaaugcaugccgccggaccugcguucaccggccggcccggcauguucguccgggcgucaggc

SEQ ID NO: 4241362 - RNA, 56 nt, Mycobacterium tuberculosis H37Rv; identical to SEQ ID NO: 4237686

SEQ ID NO: 4241363 - RNA, 81 nt, Mycobacterium tuberculosis H37Rv
gguguuuccgggaagguggugguggcgauuccggcgguagcggcggugauuuugcuugccacuucuuguucggacacgacc

SEQ ID NO: 4241364 - RNA, 89 nt, Mycobacterium tuberculosis H37Rv; identical to SEQ ID NO: 4237721

SEQ ID NO: 4241365 - RNA, 60 nt, Mycobacterium tuberculosis H37Rv; identical to SEQ ID NO: 4237790

SEQ ID NO: 4241366 - RNA, 55 nt, Mycobacterium tuberculosis H37Rv
ccgacgacguugaccaagaauucgggguaaccgccauuuugauucgggucguugg

SEQ ID NO: 4241367 - RNA, 97 nt, Mycobacterium tuberculosis H37Rv
ggagacgcuggccgagggccuacaagaguuugguggcuacugcgauugugagaucguaaugaaugucgaaccugaggcgaucuucggcuaguccucu

SEQ ID NO: 4241368 - RNA, 97 nt, Mycobacterium tuberculosis H37Rv; identical to SEQ ID NO: 4238139

SEQ ID NO: 4241369 - RNA, 85 nt, Mycobacterium tuberculosis H37Rv
gcaucgcgcuggccgaggagcuggucgcgcugcugggggccgaccagcggacgcgaguguucuucugcaacuccggcgccgaggc

SEQ ID NO: 4241370 - RNA, 62 nt, Mycobacterium tuberculosis H37Rv
guucagcauggcgcauaccuuguccgggggaucggacguggaaaauguggucgugaucgagc

SEQ ID NO: 4241371 - RNA, 56 nt, Mycobacterium tuberculosis H37Rv; identical to SEQ ID NO: 4239112

SEQ ID NO: 4241372 - RNA, 96 nt, Mycobacterium tuberculosis H37Rv; identical to SEQ ID NO: 4238519

SEQ ID NO: 4241373 - RNA, 58 nt, Mycobacterium tuberculosis H37Rv
acaccaaggccgucagcuuggcccagccaccguugggcaagcugcgggcgcuuggugu

SEQ ID NO: 4241374 - RNA, 56 nt, Mycobacterium tuberculosis H37Rv; identical to SEQ ID NO: 4239153

SEQ ID NO: 4241375 - RNA, 64 nt, Mycobacterium tuberculosis H37Rv
ggcgagcagacgucaaagcccccgaauuucagugaaaucgggggcuuuugcgucugcuggcgcc

SEQ ID NO: 4241376 - RNA, 79 nt, Mycobacterium tuberculosis H37Rv
gcuggcugcgccgaaugugcacugguggcggagacacacccaggcgaugccgcccugguugcacguucggcgugucagc

SEQ ID NO: 4241377 - RNA, 56 nt, Mycobacterium tuberculosis H37Rv
cgggauggugaccgcggcgaugaugcccucgaucaugucggggucacucauccgcg

SEQ ID NO: 4241378 - RNA, 99 nt, Mycobacterium tuberculosis H37Rv; identical to SEQ ID NO: 4239167

SEQ ID NO: 4241379 - RNA, 68 nt, Mycobacterium tuberculosis H37Rv
gcgucggugaucucgugggugucgaucguccucaucuaugucgucguuguguacgaggucaucgaugu

SEQ ID NO: 4241380 - RNA, 105 nt, Mycobacterium tuberculosis H37Rv
gcgauucggggcguugagucccacgccuccauaaaccagcaaugcgcaauccagagggugugcgcgaucaguucauggucgcuuggauagacuacgaaccgccgc

SEQ ID NO: 4241381 - RNA, 98 nt, Mycobacterium tuberculosis H37Rv
cgaccucgaugucgacccggccgaccugguggugaucgucggcggcgccgaaaucggcccguacggcucgucacgcacccgguucgagauggaggucg

SEQ ID NO: 4241382 - RNA, 69 nt, Mycobacterium tuberculosis H37Rv
cggugaucacggucggcggguagaaccagcccggccggucgagacgcuuuccgccgcaccggaucaccg

SEQ ID NO: 4241383 - RNA, 81 nt, Mycobacterium tuberculosis H37Rv
ggcgguuugacgucggcugaguuuagucaagcgcguggcuugccaugucguuaugagaacaucgccggcagaggacuagcc

SEQ ID NO: 4241384 - RNA, 130 nt, Mycobacterium tuberculosis H37Rv
ugguugaucacgauguugggugcgacggcgucggcggcugugccgagggcuucgcuggccgccgccaaggcgaucucggcgaaccccgcggccggcaugauggguugaccgaacaccuuguggucugcca

SEQ ID NO: 4241385 - RNA, 59 nt, Mycobacterium tuberculosis H37Rv
gcgagcguaacgccacggcgaauucggugcacgcaagcucgccguggcguuacgcucgc

SEQ ID NO: 4241386 - RNA, 65 nt, Mycobacterium tuberculosis H37Rv; identical to SEQ ID NO: 4239077

SEQ ID NO: 4241387 - RNA, 90 nt, Mycobacterium tuberculosis H37Rv; identical to SEQ ID NO: 4240234

SEQ ID NO: 4241388 - RNA, 57 nt, Mycobacterium tuberculosis H37Rv; identical to SEQ ID NO: 4238663

SEQ ID NO: 4241389 - RNA, 85 nt, Mycobacterium tuberculosis H37Rv
agucgucccugcuccggcacguuggucgagauugacgcauaggcucuggccaaggugucgagcacguccucugucagggugcgcu

SEQ ID NO: 4241390 - RNA, 65 nt, Mycobacterium tuberculosis H37Rv
gcuggcuguuuacccccgauccgucgcugaccaucacccgcgacggcucgcgugacgccgucagc

SEQ ID NO: 4241391 - RNA, 64 nt, Mycobacterium tuberculosis H37Rv; identical to SEQ ID NO: 4239138

SEQ ID NO: 4241392 - RNA, 60 nt, Mycobacterium tuberculosis H37Rv; identical to SEQ ID NO: 4238661

SEQ ID NO: 4241393 - RNA, 89 nt, Mycobacterium tuberculosis H37Rv; identical to SEQ ID NO: 4238886

SEQ ID NO: 4241394 - RNA, 75 nt, Mycobacterium tuberculosis H37Rv
guugagcgcgagcagacgcagagucgcacugcgccggccgcagugcgacucugcgucugcucaccagcggucagc

SEQ ID NO: 4241395 - RNA, 68 nt, Mycobacterium tuberculosis H37Rv
gcgggcguaucggcacggcgagacggccgaugacuucgucggcuccguacuugccgugcugcgccggc

SEQ ID NO: 4241396 - RNA, 60 nt, Mycobacterium tuberculosis H37Rv; identical to SEQ ID NO: 4238833

SEQ ID NO: 4241397 - RNA, 100 nt, Mycobacterium tuberculosis H37Rv; identical to SEQ ID NO: 4237718

SEQ ID NO: 4241398 - RNA, 57 nt, Mycobacterium tuberculosis H37Rv; identical to SEQ ID NO: 4238159

SEQ ID NO: 4241399 - RNA, 72 nt, Mycobacterium tuberculosis H37Rv
gcauguucacgauguugcgaaacgccugauucaucugggucauggugucuagcgaggucgccucggccaugc

SEQ ID NO: 4241400 - RNA, 61 nt, Mycobacterium tuberculosis H37Rv; identical to SEQ ID NO: 4238497

SEQ ID NO: 4241401 - RNA, 57 nt, Mycobacterium tuberculosis H37Rv; identical to SEQ ID NO: 4238412

SEQ ID NO: 4241402 - RNA, 89 nt, Mycobacterium tuberculosis H37Rv; identical to SEQ ID NO: 4239204

SEQ ID NO: 4241403 - RNA, 60 nt, Mycobacterium tuberculosis H37Rv
gguucgagcuggacgcgggucugugguugcuggcgaccggauccgaguccgagcucggcc

SEQ ID NO: 4241404 - RNA, 72 nt, Mycobacterium tuberculosis H37Rv; identical to SEQ ID NO: 4239122

SEQ ID NO: 4241405 - RNA, 62 nt, Mycobacterium tuberculosis H37Rv
ggccgagaaagucgaccugcgagaguuggcccaucuagaacagcucgcgguguuuuccgacc

SEQ ID NO: 4241406 - RNA, 97 nt, Mycobacterium tuberculosis H37Rv; identical to SEQ ID NO: 4239104

SEQ ID NO: 4241407 - RNA, 87 nt, Mycobacterium tuberculosis H37Rv
accgaccucgggcgggcgcugucgauacagcgucagcacggguuuacgugugauggagugaucggcagccacagccgcuagguuggu

SEQ ID NO: 4241408 - RNA, 69 nt, Mycobacterium tuberculosis H37Rv; identical to SEQ ID NO: 4238743

SEQ ID NO: 4241409 - RNA, 130 nt, Mycobacterium tuberculosis H37Rv
caguacgugguccgguucggccucggguacugcgaagaaguccauccugacuugcagauagucggcuaugccgaucccguccggaugcacuucgcgcagccugcaggccccuuggacuacugaacgacug

SEQ ID NO: 4241410 - RNA, 65 nt, Mycobacterium tuberculosis H37Rv; identical to SEQ ID NO: 4238683

SEQ ID NO: 4241411 - RNA, 64 nt, Mycobacterium tuberculosis H37Rv
gcaccgggucgucucgaucgaacugaaacagcguuacgguuccgucguaggcguccacgguugc

SEQ ID NO: 4241412 - RNA, 77 nt, Mycobacterium tuberculosis H37Rv; identical to SEQ ID NO: 4238803

SEQ ID NO: 4241413 - RNA, 62 nt, Mycobacterium tuberculosis H37Rv; identical to SEQ ID NO: 4237907

SEQ ID NO: 4241414 - RNA, 69 nt, Mycobacterium tuberculosis H37Rv; identical to SEQ ID NO: 4237596

SEQ ID NO: 4241415 - RNA, 58 nt, Mycobacterium tuberculosis H37Rv
gcggauuggaucaaggugauggccacgggcggauucguuaccacagcauccgauccgu

SEQ ID NO: 4241416 - RNA, 96 nt, Mycobacterium tuberculosis H37Rv; identical to SEQ ID NO: 4238665

SEQ ID NO: 4241417 - RNA, 69 nt, Mycobacterium tuberculosis H37Rv; identical to SEQ ID NO: 4238234

SEQ ID NO: 4241418 - RNA, 80 nt, Mycobacterium tuberculosis H37Rv
gcgcgcaccccgcgagcagacacagagucgcacaaaaucggcgguuuugaugcgacucugugucugcucgcccagcacgc

SEQ ID NO: 4241419 - RNA, 76 nt, Mycobacterium tuberculosis H37Rv; identical to SEQ ID NO: 4238946

SEQ ID NO: 4241420 - RNA, 62 nt, Mycobacterium tuberculosis H37Rv; identical to SEQ ID NO: 4237594

SEQ ID NO: 4241421 - RNA, 67 nt, Mycobacterium tuberculosis H37Rv; identical to SEQ ID NO: 4237613

SEQ ID NO: 4241422 - RNA, 70 nt, Mycobacterium tuberculosis H37Rv
cagcgugcugacucagacuccggcugcgguggcaauguugccgacgcaggguuuggagucgguggcguug

SEQ ID NO: 4241423 - RNA, 62 nt, Mycobacterium tuberculosis H37Rv; identical to SEQ ID NO: 4239004

SEQ ID NO: 4241424 - RNA, 63 nt, Mycobacterium tuberculosis H37Rv; identical to SEQ ID NO: 4239066

SEQ ID NO: 4241425 - RNA, 111 nt, Mycobacterium tuberculosis H37Rv
ggcuuggccugcggucugcgaucucgaguggucugggcucgaccgcgccagcgauaucggcgggugcgagccaggccggcucggucggggggaugucggugccgccgagcu

SEQ ID NO: 4241426 - RNA, 78 nt, Mycobacterium tuberculosis H37Rv
gccggcggccuguacgugcugggcaccgagcgccacgagucgcggcggaucgacaaccaguugcguggccgguccggc

SEQ ID NO: 4241427 - RNA, 115 nt, Mycobacterium tuberculosis H37Rv
gaucggugucguagaggugcuugucggccgcagucacauggcaaggauagucggccuaugaaauuuccucagucguugacagcgcucugccagguaccgcgacgucgcaucgguc

SEQ ID NO: 4241428 - RNA, 66 nt, Mycobacterium tuberculosis H37Rv
gucggucugaaaaugugcggcgagcuccucauaguuggcgaugcgccguacgucuucgaugcugac

SEQ ID NO: 4241429 - RNA, 63 nt, Mycobacterium tuberculosis H37Rv; identical to SEQ ID NO: 4240345

SEQ ID NO: 4241430 - RNA, 73 nt, Mycobacterium tuberculosis H37Rv; identical to SEQ ID NO: 4238840

SEQ ID NO: 4241431 - RNA, 56 nt, Mycobacterium tuberculosis H37Rv; identical to SEQ ID NO: 4239174

SEQ ID NO: 4241432 - RNA, 62 nt, Mycobacterium tuberculosis H37Rv; identical to SEQ ID NO: 4237917

SEQ ID NO: 4241433 - RNA, 129 nt, Mycobacterium tuberculosis H37Rv; identical to SEQ ID NO: 4240369

SEQ ID NO: 4241434 - RNA, 114 nt, Mycobacterium tuberculosis H37Rv; identical to SEQ ID NO: 4238109

SEQ ID NO: 4241435 - RNA, 70 nt, Mycobacterium tuberculosis H37Rv; identical to SEQ ID NO: 4238336

SEQ ID NO: 4241436 - RNA, 87 nt, Mycobacterium tuberculosis H37Rv
ggugccgcgcuggugaugaucgguuccgcggccgccggcaaguugcagggccugacuccgcgggcgcgcaucgucgccaccgccacc

SEQ ID NO: 4241437 - RNA, 56 nt, Mycobacterium tuberculosis H37Rv; identical to SEQ ID NO: 4238400

SEQ ID NO: 4241438 - RNA, 81 nt, Mycobacterium tuberculosis H37Rv; identical to SEQ ID NO: 4237745

SEQ ID NO: 4241439 - RNA, 61 nt, Mycobacterium tuberculosis H37Rv
cguucgaucaccggcccgcugcuggcuucguugggagcgaccggacugguggucggagucg

SEQ ID NO: 4241440 - RNA, 55 nt, Mycobacterium tuberculosis H37Rv; identical to SEQ ID NO: 4238768

SEQ ID NO: 4241441 - RNA, 58 nt, Mycobacterium tuberculosis H37Rv
ucgggccgcagccaguccucgcuguaggugaccucguuaggccuggccugcgccccga

SEQ ID NO: 4241442 - RNA, 59 nt, Mycobacterium tuberculosis H37Rv; identical to SEQ ID NO: 4240299

SEQ ID NO: 4241443 - RNA, 90 nt, Mycobacterium tuberculosis H37Rv; identical to SEQ ID NO: 4238433

SEQ ID NO: 4241444 - RNA, 74 nt, Mycobacterium tuberculosis H37Rv; identical to SEQ ID NO: 4238162

SEQ ID NO: 4241445 - RNA, 91 nt, Mycobacterium tuberculosis H37Rv
ggccuaguuaucugcgccgagcgugaacucagggcgagauuucggccguuuucucgcccuggcuucacguucggcgaaguugggaacgguc

SEQ ID NO: 4241446 - RNA, 94 nt, Mycobacterium tuberculosis H37Rv; identical to SEQ ID NO: 4238657

SEQ ID NO: 4241447 - RNA, 71 nt, Mycobacterium tuberculosis H37Rv; identical to SEQ ID NO: 4238744

SEQ ID NO: 4241448 - RNA, 69 nt, Mycobacterium tuberculosis H37Rv
aggcuucagcggggggcuuaucgaugcauccccaccccaucccucgagauaagaucccccgcuggcccu

SEQ ID NO: 4241449 - RNA, 57 nt, Mycobacterium tuberculosis H37Rv
ggaucgaccgguacgacgcugcugacggugacgucggcgacguaggugccggugucc

SEQ ID NO: 4241450 - RNA, 59 nt, Mycobacterium tuberculosis H37Rv
uuuccccgcaagcgggucggccccgaucaucugcgggagcucccgaucucccggggaga

SEQ ID NO: 4241451 - RNA, 89 nt, Mycobacterium tuberculosis H37Rv; identical to SEQ ID NO: 4238022

SEQ ID NO: 4241452 - RNA, 70 nt, Mycobacterium tuberculosis H37Rv; identical to SEQ ID NO: 4237676

SEQ ID NO: 4241453 - RNA, 93 nt, Mycobacterium tuberculosis H37Rv
ccgccggagccggcgaguagacgcgaaagaacaugaugggcgcuggugcccaucauguucuuuugcgccuacucgcgcuacagacaggucagg

SEQ ID NO: 4241454 - RNA, 78 nt, Mycobacterium tuberculosis H37Rv
gcgcguugccgagggccgguuauuggaugugcacgccaacacguggcgcuacaaccagcugaucgcccagcagcgcgc

SEQ ID NO: 4241455 - RNA, 62 nt, Mycobacterium tuberculosis H37Rv; identical to SEQ ID NO: 4238389

SEQ ID NO: 4241456 - RNA, 75 nt, Mycobacterium tuberculosis H37Rv; identical to SEQ ID NO: 4238695

SEQ ID NO: 4241457 - RNA, 80 nt, Mycobacterium tuberculosis H37Rv
gccgaacucaauggcgacccggcccgcacgaugcgccgaaugaucggcggucugcgcccuccgggcgaucagagcgcggc

SEQ ID NO: 4241458 - RNA, 60 nt, Mycobacterium tuberculosis H37Rv
gugagcagacgcagaaguccccgauuuccggugaaaucggcgacuucugcgucugcucgc

SEQ ID NO: 4241459 - RNA, 57 nt, Mycobacterium tuberculosis H37Rv; identical to SEQ ID NO: 4238334

SEQ ID NO: 4241460 - RNA, 73 nt, Mycobacterium tuberculosis H37Rv
cccgcccgccccgguguugaagaagcccgacgacggaacgguggugguguucccaaugcccggggugggcggg

SEQ ID NO: 4241461 - RNA, 63 nt, Mycobacterium tuberculosis H37Rv
guugucggcggcagccgagcgcggucgucgcccgccccugcgcccuugccugucgucgaccac

SEQ ID NO: 4241462 - RNA, 57 nt, Mycobacterium tuberculosis H37Rv
ggcgguacaggcauugcgcgaugcgcaaccagcgcagaucgugauugccgugccggc

SEQ ID NO: 4241463 - RNA, 93 nt, Mycobacterium tuberculosis H37Rv
ggcgcgacccgcgcggcgggcgaggaggcacgaagccucgccgacgagauuggugaugcauuccuuucacguucaugucgcugggcgcuggcc

SEQ ID NO: 4241464 - RNA, 56 nt, Mycobacterium tuberculosis H37Rv; identical to SEQ ID NO: 4238732

SEQ ID NO: 4241465 - RNA, 75 nt, Mycobacterium tuberculosis H37Rv; identical to SEQ ID NO: 4238358

SEQ ID NO: 4241466 - RNA, 63 nt, Mycobacterium tuberculosis H37Rv; identical to SEQ ID NO: 4238153

SEQ ID NO: 4241467 - RNA, 69 nt, Mycobacterium tuberculosis H37Rv; identical to SEQ ID NO: 4238362

SEQ ID NO: 4241468 - RNA, 68 nt, Mycobacterium tuberculosis H37Rv
gcgacccggacucuggugauggugugguccgcgcgcgccgaccaccauacauccggaccuccgggcgc

SEQ ID NO: 4241469 - RNA, 64 nt, Mycobacterium tuberculosis H37Rv; identical to SEQ ID NO: 4238677

SEQ ID NO: 4241470 - RNA, 88 nt, Mycobacterium tuberculosis H37Rv; identical to SEQ ID NO: 4238361

SEQ ID NO: 4241471 - RNA, 59 nt, Mycobacterium tuberculosis H37Rv; identical to SEQ ID NO: 4237842

SEQ ID NO: 4241472 - RNA, 55 nt, Mycobacterium tuberculosis H37Rv
guaccgcuggcaugcgcaacagggcugggcgcgcuugcgcagcuggacgcggugc

SEQ ID NO: 4241473 - RNA, 79 nt, Mycobacterium tuberculosis H37Rv; identical to SEQ ID NO: 4237902

SEQ ID NO: 4241474 - RNA, 61 nt, Mycobacterium tuberculosis H37Rv
gggcggucgggcgcggcgaccgcggcaccgaccgcagccgggaugccguaaccgauugccc

SEQ ID NO: 4241475 - RNA, 67 nt, Mycobacterium tuberculosis H37Rv; identical to SEQ ID NO: 4237956

SEQ ID NO: 4241476 - RNA, 62 nt, Mycobacterium tuberculosis H37Rv; identical to SEQ ID NO: 4237752

SEQ ID NO: 4241477 - RNA, 57 nt, Mycobacterium tuberculosis H37Rv; identical to SEQ ID NO: 4239181

SEQ ID NO: 4241478 - RNA, 57 nt, Mycobacterium tuberculosis H37Rv
augcggacagaauacgcugccgauuugucuaccuauuggcugccgauucguccccau

SEQ ID NO: 4241479 - RNA, 75 nt, Mycobacterium tuberculosis H37Rv
aggcggucgcgauggugguggcggccugccuacugcuggaauacgggguagccaccgcagcggucgcggucggcu

SEQ ID NO: 4241480 - RNA, 57 nt, Mycobacterium tuberculosis H37Rv; identical to SEQ ID NO: 4238621

SEQ ID NO: 4241481 - RNA, 55 nt, Mycobacterium tuberculosis H37Rv
cgcgccgauggauugcggcguucucuuccucguagaacggcaacacgucgucgcg

SEQ ID NO: 4241482 - RNA, 80 nt, Mycobacterium tuberculosis H37Rv
cuguagcgcgaguaggcgcaaaagaacaugaugggcaccagcgcccaucauguucuuucgcgucuacucgccggcuccgg

SEQ ID NO: 4241483 - RNA, 63 nt, Mycobacterium tuberculosis H37Rv; identical to SEQ ID NO: 4238409

SEQ ID NO: 4241484 - RNA, 59 nt, Mycobacterium tuberculosis H37Rv
cgggguagucagcgaguagaugaagucgcuuucgccauccgccgccuugaacucccacg

SEQ ID NO: 4241485 - RNA, 118 nt, Mycobacterium tuberculosis H37Rv
agcugcgauccuacugggcgcguccauugccggcgaccaucgucaugcgcgccggagagcagacgcaguucagggugcaugugaccgauggcgcuccggccgacgugugguugcagcu

SEQ ID NO: 4241486 - RNA, 65 nt, Mycobacterium tuberculosis H37Rv; identical to SEQ ID NO: 4238603

SEQ ID NO: 4241487 - RNA, 60 nt, Mycobacterium tuberculosis H37Rv
gcagccgcagcuugucgauguccucgccguuggcggcggccucggccagcugcuggcggu

SEQ ID NO: 4241488 - RNA, 75 nt, Mycobacterium tuberculosis H37Rv; identical to SEQ ID NO: 4238766

SEQ ID NO: 4241489 - RNA, 78 nt, Mycobacterium tuberculosis H37Rv; identical to SEQ ID NO: 4237867

SEQ ID NO: 4241490 - RNA, 90 nt, Mycobacterium tuberculosis H37Rv
gaucgggaugcggccgucggguuggcgguccagguauccgaggugccacgcugcggaugcaccggccagcaugaagcccgcguucugguc

SEQ ID NO: 4241491 - RNA, 67 nt, Mycobacterium tuberculosis H37Rv
ggcgggugauucgggcguucugacgucgcugggcgacaaugaaaggacgaugaacuuuuacuccgcc

SEQ ID NO: 4241492 - RNA, 69 nt, Mycobacterium tuberculosis H37Rv
cgggcacgcuggcgacauggcgggcagcggccuccaucacgcguucgcccgccuugucccagaucacug

SEQ ID NO: 4241493 - RNA, 67 nt, Mycobacterium tuberculosis H37Rv
ggcgguguccgcguucgggaugagcgguaccaauagccacgugaucguuucgaugccggacaccguu

SEQ ID NO: 4241494 - RNA, 62 nt, Mycobacterium tuberculosis H37Rv
cggcuagcagcccaacaggacuuguguugaaccaacccgacagucccgagccgcuguugccg

SEQ ID NO: 4241495 - RNA, 81 nt, Mycobacterium tuberculosis H37Rv
gcgucuaggcccuuguugauggcguccugguggcuaccggagaacgcgguguacaccaggucgccgccauaggggugacgu

SEQ ID NO: 4241496 - RNA, 78 nt, Mycobacterium tuberculosis H37Rv
agucgcggccaacaguggcgagccgguccguagguucaaggccugcagcaugguuucgucgugcugguuuucguggcu

SEQ ID NO: 4241497 - RNA, 94 nt, Mycobacterium tuberculosis H37Rv
gcggcgaugccgauaaauauggugugauauaucaccuuugccugacagcgacuucacggcacgauggaaugucgcaaccaaaugcauuguccgc

SEQ ID NO: 4241498 - RNA, 79 nt, Mycobacterium tuberculosis H37Rv
cgccaucccggguaucggcugcaccccgugguauuggaugcggcauugcaaagcgugggugccgcgauacccgacggcg

SEQ ID NO: 4241499 - RNA, 70 nt, Mycobacterium tuberculosis H37Rv
ggugccuggucggcauuuucgcagucgagggcucucguguagccugggcgaguugccgacgcaggcgacc

SEQ ID NO: 4241500 - RNA, 77 nt, Mycobacterium tuberculosis H37Rv; identical to SEQ ID NO: 4239160

SEQ ID NO: 4241501 - RNA, 59 nt, Mycobacterium tuberculosis H37Rv
uuggucuugacguugccguuggcggugguggugcugcucaagggcaagguuuggaccgg

SEQ ID NO: 4241502 - RNA, 74 nt, Mycobacterium tuberculosis H37Rv
cuaacaaucguuaccgaaaugcaucggcgcaucguggcgcagcgcaugagccugcguuuauggcgcguuguuag

SEQ ID NO: 4241503 - RNA, 90 nt, Mycobacterium tuberculosis H37Rv; identical to SEQ ID NO: 4238344

SEQ ID NO: 4241504 - RNA, 72 nt, Mycobacterium tuberculosis H37Rv; identical to SEQ ID NO: 4238635

SEQ ID NO: 4241505 - RNA, 62 nt, Mycobacterium tuberculosis H37Rv; identical to SEQ ID NO: 4239194

SEQ ID NO: 4241506 - RNA, 97 nt, Mycobacterium tuberculosis H37Rv
cgauggcggcacguugccgccgauguucgucgaucugaucaacgcgccgaccaggcgccaggucgaugacucguuggccgcggcgaaaucgaaaucg

SEQ ID NO: 4241507 - RNA, 56 nt, Mycobacterium tuberculosis H37Rv
ugcgcuguucggcacggcgccgagccaccagccccgacacgucugccggcagcgca

SEQ ID NO: 4241508 - RNA, 63 nt, Mycobacterium tuberculosis H37Rv; identical to SEQ ID NO: 4240389

SEQ ID NO: 4241509 - RNA, 77 nt, Mycobacterium tuberculosis H37Rv; identical to SEQ ID NO: 4237738

SEQ ID NO: 4241510 - RNA, 63 nt, Mycobacterium tuberculosis H37Rv; identical to SEQ ID NO: 4238758

SEQ ID NO: 4241511 - RNA, 65 nt, Mycobacterium tuberculosis H37Rv
uugcauggcggcgggaucggucgcaucggcggccaccgcgaugagaucuguuccggucgcagcga

SEQ ID NO: 4241512 - RNA, 76 nt, Mycobacterium tuberculosis H37Rv
accaaagccaccgccagggcaauaucccaucgcacuauucggcaugugcggaucuugucccggcgguggcgcgggu

SEQ ID NO: 4241513 - RNA, 62 nt, Mycobacterium tuberculosis H37Rv
gguacuggcgggcggccgcgaccggcaccgaugggucgaucucgccgucgcccgccaacgcc

SEQ ID NO: 4241514 - RNA, 87 nt, Mycobacterium tuberculosis H37Rv
gcugggucagccgggugaugccgacguggucggacuggucaugcucggccaguucgguauguuuggcggccacccggucggccaggc

SEQ ID NO: 4241515 - RNA, 59 nt, Mycobacterium tuberculosis H37Rv
uuguugcgccacgggcagacggagcugucggagcaacgccgcuauucggggcgcggcaa

SEQ ID NO: 4241516 - RNA, 60 nt, Mycobacterium tuberculosis H37Rv; identical to SEQ ID NO: 4238868

SEQ ID NO: 4241517 - RNA, 62 nt, Mycobacterium tuberculosis H37Rv
cgcgagcagacgcagaaucgcaucgaaauccggauuuucaugcgacucugcgucugcucgcg

SEQ ID NO: 4241518 - RNA, 74 nt, Mycobacterium tuberculosis H37Rv
ggguggacacgggguggucgcguacucggcggccaaccggcugcucgacgugauggccgcccagcugcgcgccc

SEQ ID NO: 4241519 - RNA, 91 nt, Mycobacterium tuberculosis H37Rv; identical to SEQ ID NO: 4240413

SEQ ID NO: 4241520 - RNA, 92 nt, Mycobacterium tuberculosis H37Rv; identical to SEQ ID NO: 4240268

SEQ ID NO: 4241521 - RNA, 66 nt, Mycobacterium tuberculosis H37Rv
cggccgucgcgcgguauguggaaagccacgcggcugacccgggcuuccguaccgccgacauugccg

SEQ ID NO: 4241522 - RNA, 73 nt, Mycobacterium tuberculosis H37Rv
gacaggaccguuucgauuuugacagcaucgaaccaugaugacaauauauugucaaaguuggaggcgggauguc

SEQ ID NO: 4241523 - RNA, 78 nt, Mycobacterium tuberculosis H37Rv
ggcucgccgugcaggcgaugacugcuguggucgcucgccacgucgaucuggccgcggugaucgccugcgccgggagcc

SEQ ID NO: 4241524 - RNA, 68 nt, Mycobacterium tuberculosis H37Rv
ggucacagcagagcggccgucgucaacccgacagucugucggacuauacgccucucauguugugcgcc

SEQ ID NO: 4241525 - RNA, 61 nt, Mycobacterium tuberculosis H37Rv; identical to SEQ ID NO: 4240434

SEQ ID NO: 4241526 - RNA, 81 nt, Mycobacterium tuberculosis H37Rv
ggggucccgguccgugcgucgaucgccgcgcuggaccgcgcggugcugcgagccgaggcgcgggcacacuucggcuucccc

SEQ ID NO: 4241527 - RNA, 62 nt, Mycobacterium tuberculosis H37Rv
gcugaucgaguugaugcgccaucgcgacgccuacgcggccgugaucgacgaacucgacgagc

SEQ ID NO: 4241528 - RNA, 78 nt, Mycobacterium tuberculosis H37Rv; identical to SEQ ID NO: 4238950

SEQ ID NO: 4241529 - RNA, 116 nt, Mycobacterium tuberculosis H37Rv
ggaucugcccgccgagcaggugaucgcggaggucgaugcgcgucggguagaacggauccugcgcaaucugauugccaaugccaucgaccacgccgaacacaaaccggugcggaucc

SEQ ID NO: 4241530 - RNA, 67 nt, Mycobacterium tuberculosis H37Rv
cgcugcuaucgguggggcgccgcauuuucuugccgccacgaacuaaagccuaaucggugaguuagcg

SEQ ID NO: 4241531 - RNA, 77 nt, Mycobacterium tuberculosis H37Rv
gcgucaugcccggcuugagguccagcuuguccagguugaggucgaccuuggcguauugggcuucuucgagcgugagc

SEQ ID NO: 4241532 - RNA, 55 nt, Mycobacterium tuberculosis H37Rv; identical to SEQ ID NO: 4238150

SEQ ID NO: 4241533 - RNA, 93 nt, Mycobacterium tuberculosis H37Rv
cguccgacgggcuugcggugagugccgcguucaugucggcaugcgccggcggcgaugucgagucgaacucggcgcucgaggucaccgucgccg

SEQ ID NO: 4241534 - RNA, 126 nt, Mycobacterium tuberculosis H37Rv
gguagggacggcggccggggagaccgccgagccggagaagaucaugccgcgggcgaucaauucgguggucgcucgcaucgcgaucuuuuaugucgggucgguggcccugcuagcgcuguugcugcc

SEQ ID NO: 4241535 - RNA, 58 nt, Mycobacterium tuberculosis H37Rv; identical to SEQ ID NO: 4237653

SEQ ID NO: 4241536 - RNA, 109 nt, Mycobacterium tuberculosis H37Rv; identical to SEQ ID NO: 4237766

SEQ ID NO: 4241537 - RNA, 114 nt, Mycobacterium tuberculosis H37Rv
gcggcguccacggauuccguugugacccacacggucacucgcacauguucguucucgaaacaucgcugcgaauccgggucaccgugcaccuggaucaccgggaccggacgcugc

SEQ ID NO: 4241538 - RNA, 65 nt, Mycobacterium tuberculosis H37Rv; identical to SEQ ID NO: 4238235

SEQ ID NO: 4241539 - RNA, 55 nt, Mycobacterium tuberculosis H37Rv
gcgauucugcgcggugugugggaaugucucugacaacgagcguugcagaaucugc

SEQ ID NO: 4241540 - RNA, 60 nt, Mycobacterium tuberculosis H37Rv; identical to SEQ ID NO: 4238035

SEQ ID NO: 4241541 - RNA, 68 nt, Mycobacterium tuberculosis H37Rv
ggcgcgauccggauuccggggaagaagcugggcuugacccaaaucucugagguugguccggacgugcu

SEQ ID NO: 4241542 - RNA, 68 nt, Mycobacterium tuberculosis H37Rv
gccgacucgaugcgccggacggugccgucggaguccuugacggugaugccguugcggucgacgucggu

SEQ ID NO: 4241543 - RNA, 78 nt, Mycobacterium tuberculosis H37Rv; identical to SEQ ID NO: 4238823

SEQ ID NO: 4241544 - RNA, 69 nt, Mycobacterium tuberculosis H37Rv
aggcuuccggcgcgaccggucugaucggcuucuucuucuugaccgcggacacgaucgcgucggcuaccu

SEQ ID NO: 4241545 - RNA, 77 nt, Mycobacterium tuberculosis H37Rv
ccagaauguucuccgguuugacgucgcgaugcguugccccggcagcgugcgcggcgucgagcgccgagccgaucugg

SEQ ID NO: 4241546 - RNA, 93 nt, Mycobacterium tuberculosis H37Rv
gcugggcgaaccggcuucgcgagcguaaccggacugcgaaaauccgugccgaaaaucgcagccacguuacgcucgcgggccaaagccgucagc

SEQ ID NO: 4241547 - RNA, 56 nt, Mycobacterium tuberculosis H37Rv
gcuggacguucgucggcggcccggucaucaaggacggccggccgguggacuucggc

SEQ ID NO: 4241548 - RNA, 63 nt, Mycobacterium tuberculosis H37Rv
cuggucuguaaucggugcccggucaccacagagugccucagcugggcacugaauaccggccag

SEQ ID NO: 4241549 - RNA, 86 nt, Mycobacterium tuberculosis H37Rv; identical to SEQ ID NO: 4239093

SEQ ID NO: 4241550 - RNA, 79 nt, Mycobacterium tuberculosis H37Rv; identical to SEQ ID NO: 4237678

SEQ ID NO: 4241551 - RNA, 86 nt, Mycobacterium tuberculosis H37Rv
ugcccacgccgaguagucacgugccaguuugcgcgaauucccaaaguuagaccggcaaacgugacggcaccgauccguguggugca

SEQ ID NO: 4241552 - RNA, 68 nt, Mycobacterium tuberculosis H37Rv
guaccugggccgacccgcgcauggucgaucccagcaucgaaccgaccaagcgucggcccaaccagugc

SEQ ID NO: 4241553 - RNA, 79 nt, Mycobacterium tuberculosis H37Rv
cugaugaugaccgccgugaugaucggugccgucgcaugcggcagcggccgcggacccgcaccgaucaaggucaucgcgg

SEQ ID NO: 4241554 - RNA, 84 nt, Mycobacterium tuberculosis H37Rv; identical to SEQ ID NO: 4238149

SEQ ID NO: 4241555 - RNA, 126 nt, Mycobacterium tuberculosis H37Rv; identical to SEQ ID NO: 4237632

SEQ ID NO: 4241556 - RNA, 75 nt, Mycobacterium tuberculosis H37Rv
ggcaguugaucaggaucgacucggacuuguaguugccguagcgguugugcagccaguugaucaugaacgacggcc

SEQ ID NO: 4241557 - RNA, 59 nt, Mycobacterium tuberculosis H37Rv
cucgaugaugucguugacgucgccaauguugguuuugaagucaccgacgaucgcuugag

SEQ ID NO: 4241558 - RNA, 56 nt, Mycobacterium tuberculosis H37Rv; identical to SEQ ID NO: 4239217

SEQ ID NO: 4241559 - RNA, 88 nt, Mycobacterium tuberculosis H37Rv; identical to SEQ ID NO: 4238318

SEQ ID NO: 4241560 - RNA, 69 nt, Mycobacterium tuberculosis H37Rv
guuccggcgcugacggugagcagcgcgggggcuugccguacccggguuuguuguuuguagugccggggc

SEQ ID NO: 4241561 - RNA, 55 nt, Mycobacterium tuberculosis H37Rv
cccggcagcgccccgucgucaacgggcaucccguucaccgcgacggcuugccggg

SEQ ID NO: 4241562 - RNA, 65 nt, Mycobacterium tuberculosis H37Rv; identical to SEQ ID NO: 4238388

SEQ ID NO: 4241563 - RNA, 80 nt, Mycobacterium tuberculosis H37Rv; identical to SEQ ID NO: 4238496

SEQ ID NO: 4241564 - RNA, 77 nt, Mycobacterium tuberculosis H37Rv
ggagugccggcagcggugguggugcggcugcccggcaacgccgccucgaccucaucggccaucgcugcgggcacuuc

SEQ ID NO: 4241565 - RNA, 58 nt, Mycobacterium tuberculosis H37Rv; identical to SEQ ID NO: 4238871

SEQ ID NO: 4241566 - RNA, 60 nt, Mycobacterium tuberculosis H37Rv; identical to SEQ ID NO: 4238528

SEQ ID NO: 4241567 - RNA, 62 nt, Mycobacterium tuberculosis H37Rv
ggcgaguagacgcaaaagcccccgacacuccgugcgugcgggggcuuuugcgucuguucgcc

SEQ ID NO: 4241568 - RNA, 85 nt, Mycobacterium tuberculosis H37Rv
cgccucacgguaguugucgucgucggugccaaaaucgucgagacccaccaguuugguagccgaugcgugcaguucgucgacggug

SEQ ID NO: 4241569 - RNA, 80 nt, Mycobacterium tuberculosis H37Rv
gcuggaagccauggguguucuccucgaccuugucgaacacgaugacggugucauagagcgagaacccgagaauggucagc

SEQ ID NO: 4241570 - RNA, 79 nt, Mycobacterium tuberculosis H37Rv
ggcgcgguaccgcucgggcgcgaggacgcugauccacgauaucgaugcggcgaccaccguuugagcggccaccguagcc

SEQ ID NO: 4241571 - RNA, 63 nt, Mycobacterium tuberculosis H37Rv; identical to SEQ ID NO: 4237666

SEQ ID NO: 4241572 - RNA, 59 nt, Mycobacterium tuberculosis H37Rv; identical to SEQ ID NO: 4237979

SEQ ID NO: 4241573 - RNA, 71 nt, Mycobacterium tuberculosis H37Rv
cugcggauguucgaagcuguggagcaacaagcguugaucgcauugccgcccagggcauuugaacucaccag

SEQ ID NO: 4241574 - RNA, 68 nt, Mycobacterium tuberculosis H37Rv; identical to SEQ ID NO: 4238858

SEQ ID NO: 4241575 - RNA, 70 nt, Mycobacterium tuberculosis H37Rv
guccuggugaccgucgccgcgucguugcuugccggacugcuggcacacguggccgaucgguuacuagggc

SEQ ID NO: 4241576 - RNA, 59 nt, Mycobacterium tuberculosis H37Rv
ggcgaugccgaguugggucagcgauuccuacggauggucgacaaaacgcgguauccgcc

SEQ ID NO: 4241577 - RNA, 60 nt, Mycobacterium tuberculosis H37Rv; identical to SEQ ID NO: 4238520

SEQ ID NO: 4241578 - RNA, 72 nt, Mycobacterium tuberculosis H37Rv
ucggcgucauugggcccaacgggguaggcaagaccacacuguucaaaaccaucgucgggcucgagacaccgg

SEQ ID NO: 4241579 - RNA, 68 nt, Mycobacterium tuberculosis H37Rv; identical to SEQ ID NO: 4239031

SEQ ID NO: 4241580 - RNA, 65 nt, Mycobacterium tuberculosis H37Rv; identical to SEQ ID NO: 4238877

SEQ ID NO: 4241581 - RNA, 103 nt, Mycobacterium tuberculosis H37Rv
ccucacggacgcgcucaaccagcucgcgagcagacgcagagucgcaugaaaauccggauuucgaugcgauucugcgucugcucgcgcucacggggccuccagg

SEQ ID NO: 4241582 - RNA, 87 nt, Mycobacterium tuberculosis H37Rv
gacgccggaucggcuccguagcagcguuggcuacgcggccauguugcugguggucacgcugauugccgggccguugcuguucguguu

SEQ ID NO: 4241583 - RNA, 129 nt, Mycobacterium tuberculosis H37Rv; identical to SEQ ID NO: 4237651

SEQ ID NO: 4241584 - RNA, 86 nt, Mycobacterium tuberculosis H37Rv
cgccggugaucgcguaggugaccagucgagcaccguugucgauaucgacgaugguuaccuguucgccuuccagcaggucggcggcg

SEQ ID NO: 4241585 - RNA, 92 nt, Mycobacterium tuberculosis H37Rv; identical to SEQ ID NO: 4237693

SEQ ID NO: 4241586 - RNA, 78 nt, Mycobacterium tuberculosis H37Rv
gccaaacggcgccgagcgugcacugagggcgagauuccggccgauucuccgcccucaguucacgcugggcgacggcgc

SEQ ID NO: 4241587 - RNA, 71 nt, Mycobacterium tuberculosis H37Rv
acaauaauaucggcauuggguuaaccggcagcaaucagaucggcuuuggcggacugaauuccgguagcggu

SEQ ID NO: 4241588 - RNA, 74 nt, Mycobacterium tuberculosis H37Rv; identical to SEQ ID NO: 4238256

SEQ ID NO: 4241589 - RNA, 109 nt, Mycobacterium tuberculosis H37Rv
gccgcguuggaccgcguccaggucccggugcugcucgucggcggcuggcaggacaucuuccugcggcagacgcugcagcaguaccggcaccugcgcgaccggggugugc

SEQ ID NO: 4241590 - RNA, 64 nt, Mycobacterium tuberculosis H37Rv; identical to SEQ ID NO: 4237960

SEQ ID NO: 4241591 - RNA, 58 nt, Mycobacterium tuberculosis H37Rv; identical to SEQ ID NO: 4237932

SEQ ID NO: 4241592 - RNA, 81 nt, Mycobacterium tuberculosis H37Rv
ggguguugacgcaucgagaucgacgucagcgcgaugcucucucucgcgggggcgcugccgucgaucucgacgcaaagaccc

SEQ ID NO: 4241593 - RNA, 102 nt, Mycobacterium tuberculosis H37Rv
aacggcgugcccuuguccgcgaugaccuugaucggugcggguccgcggccgcugccgcaugcgacggcaccgaucaucacggcggucaucaucagcgcgguu

SEQ ID NO: 4241594 - RNA, 62 nt, Mycobacterium tuberculosis H37Rv
cguggauuuugaggcgcaccggccggugguggagucgguuucggugcuguucgagcuuuaug

SEQ ID NO: 4241595 - RNA, 80 nt, Mycobacterium tuberculosis H37Rv; identical to SEQ ID NO: 4238479

SEQ ID NO: 4241596 - RNA, 76 nt, Mycobacterium tuberculosis H37Rv
uuuucuguggcgagcagacgcagaaucgcacgccgacgggcguggcggugcgauucugcgucugcucgcgggagaa

SEQ ID NO: 4241597 - RNA, 64 nt, Mycobacterium tuberculosis H37Rv
cugccgacuguggauccugcgacgcgacacgccgauacggcgucgucagauucacggucgccgg

SEQ ID NO: 4241598 - RNA, 57 nt, Mycobacterium tuberculosis H37Rv
guccggcaaccgugcucgacuccauccucgagggaguccgggccgacguugccgcgc

SEQ ID NO: 4241599 - RNA, 64 nt, Mycobacterium tuberculosis H37Rv
cagugcccaaccgcgcggaccaugacgacacucggguguuccuucgcgacugggagaaccacug

SEQ ID NO: 4241600 - RNA, 129 nt, Mycobacterium tuberculosis H37Rv
cggcggguuuggcgccgguaccggcggcagcgguggugucggcggcaacgccgugcugaucggcaacggcggcaacggcggcaacgccggcaaagccggggccacgcccggugccggcggcaccggcgg

SEQ ID NO: 4241601 - RNA, 57 nt, Mycobacterium tuberculosis H37Rv; identical to SEQ ID NO: 4238161

SEQ ID NO: 4241602 - RNA, 100 nt, Mycobacterium tuberculosis H37Rv; identical to SEQ ID NO: 4238706

SEQ ID NO: 4241603 - RNA, 79 nt, Mycobacterium tuberculosis H37Rv; identical to SEQ ID NO: 4239013

SEQ ID NO: 4241604 - RNA, 57 nt, Mycobacterium tuberculosis H37Rv
cgguagggccggugucacggugaucacguugggcaaccaucgcggcucggccuaccg

SEQ ID NO: 4241605 - RNA, 59 nt, Mycobacterium tuberculosis H37Rv; identical to SEQ ID NO: 4239012

SEQ ID NO: 4241606 - RNA, 72 nt, Mycobacterium tuberculosis H37Rv
gggguuugguggcgggaaagacucagaccuauuugccgugggauucgugggaucaccccuaccgcgcgcccc

SEQ ID NO: 4241607 - RNA, 90 nt, Mycobacterium tuberculosis H37Rv
gugcgaacacgguaccgggaucggcgccagguccgaucgccgaugugaugcggcgguggaucucggcgccgauucggucgcgcaccgcac

SEQ ID NO: 4241608 - RNA, 56 nt, Mycobacterium tuberculosis H37Rv
uccgcaagcgcugaccaucgcuuggaguccgccgagucgauucaacguuugacgga

SEQ ID NO: 4241609 - RNA, 101 nt, Mycobacterium tuberculosis H37Rv
ucaaagcgcaacugggucggcaccaagaugacccuaccggugcuagugcggcucaguaccauguaggaguuagucucgaaccgccccaguggcguugcgga

SEQ ID NO: 4241610 - RNA, 64 nt, Mycobacterium tuberculosis H37Rv
cgaugucgccgccaugaaaccacuugauccacaagcgauucaaccgguauugguggcggcuucg

SEQ ID NO: 4241611 - RNA, 81 nt, Mycobacterium tuberculosis H37Rv; identical to SEQ ID NO: 4239207

SEQ ID NO: 4241612 - RNA, 130 nt, Mycobacterium tuberculosis H37Rv; identical to SEQ ID NO: 4237597

SEQ ID NO: 4241613 - RNA, 62 nt, Mycobacterium tuberculosis H37Rv; identical to SEQ ID NO: 4239134

SEQ ID NO: 4241614 - RNA, 101 nt, Mycobacterium tuberculosis H37Rv
gagcggcggccaacuucuucuugugcaggaugccgacggccgccuuagcgcccaucaccgcgaccucggcguccggccaggcgaacaccuuggucgcguuc

SEQ ID NO: 4241615 - RNA, 77 nt, Mycobacterium tuberculosis H37Rv
cagugcgcgagcagacgcaaaagcaccccaaaucgggcgauuuugggggcuuuugcgucugcucgcgggacgcgcug

SEQ ID NO: 4241616 - RNA, 71 nt, Mycobacterium tuberculosis H37Rv
uucggaucccuugguaugucacgguucucgaucuaggaucggcgggcgcgguguacaccgagggaugggaa

SEQ ID NO: 4241617 - RNA, 60 nt, Mycobacterium tuberculosis H37Rv; identical to SEQ ID NO: 4237818

SEQ ID NO: 4241618 - RNA, 94 nt, Mycobacterium tuberculosis H37Rv
ggucagcccgaacccggagucagccgcgguauggcgcacgaccgcuagcgccgugcguuaucccacggcagauagccgggcaaucgggcuugcc

SEQ ID NO: 4241619 - RNA, 64 nt, Mycobacterium tuberculosis H37Rv
ugcguugcccggugaacgagugcgggcgcgggugaccgcgcaacguggcucuuacuggcacgca

SEQ ID NO: 4241620 - RNA, 92 nt, Mycobacterium tuberculosis H37Rv; identical to SEQ ID NO: 4237829

SEQ ID NO: 4241621 - RNA, 91 nt, Mycobacterium tuberculosis H37Rv
cagagcccccuggguggucagcgucgaugaccaugucgaccccacgguguggucgauggugaugacgcuggcgcuggacugcggggcgaug

SEQ ID NO: 4241622 - RNA, 82 nt, Mycobacterium tuberculosis H37Rv
uuggcgucgauugcgaggugcgggccucggccccggucucagguggcugggccggacccgagcaccuugaugcguucgccga

SEQ ID NO: 4241623 - RNA, 65 nt, Mycobacterium tuberculosis H37Rv; identical to SEQ ID NO: 4239165

SEQ ID NO: 4241624 - RNA, 58 nt, Mycobacterium tuberculosis H37Rv; identical to SEQ ID NO: 4238101

SEQ ID NO: 4241625 - RNA, 78 nt, Mycobacterium tuberculosis H37Rv; identical to SEQ ID NO: 4239005

SEQ ID NO: 4241626 - RNA, 76 nt, Mycobacterium tuberculosis H37Rv
uagcugcccggcgagcagacgcaaaaucgcccauuucgagacgaaauugggcgauuuugcgucugcucggcaguug

SEQ ID NO: 4241627 - RNA, 78 nt, Mycobacterium tuberculosis H37Rv
gccucgccaccaugcccgguagcucguugcgcaguccuugguugugcaagucgaucugccggcgcgaccaaccgaggu

SEQ ID NO: 4241628 - RNA, 95 nt, Mycobacterium tuberculosis H37Rv; identical to SEQ ID NO: 4237795

SEQ ID NO: 4241629 - RNA, 55 nt, Mycobacterium tuberculosis H37Rv
ucaccggucuuggcgacuuggucgacaugcgcgacaagcauccaggaccgguuga

SEQ ID NO: 4241630 - RNA, 77 nt, Mycobacterium tuberculosis H37Rv; identical to SEQ ID NO: 4238524

SEQ ID NO: 4241631 - RNA, 62 nt, Mycobacterium tuberculosis H37Rv
cgcgagcagacgcaaaaucgcccauuuucaugacgaaaagggcgauuuugcgucugcucgcg

SEQ ID NO: 4241632 - RNA, 65 nt, Mycobacterium tuberculosis H37Rv; identical to SEQ ID NO: 4238644

SEQ ID NO: 4241633 - RNA, 88 nt, Mycobacterium tuberculosis H37Rv; identical to SEQ ID NO: 4238323

SEQ ID NO: 4241634 - RNA, 60 nt, Mycobacterium tuberculosis H37Rv; identical to SEQ ID NO: 4238088

SEQ ID NO: 4241635 - RNA, 58 nt, Mycobacterium tuberculosis H37Rv
ggagcaguucaacgagcccgucgaccgcaucgugucgaucggcgcguucgagcacuuc

SEQ ID NO: 4241636 - RNA, 113 nt, Mycobacterium tuberculosis H37Rv; identical to SEQ ID NO: 4238944

SEQ ID NO: 4241637 - RNA, 71 nt, Mycobacterium tuberculosis H37Rv; identical to SEQ ID NO: 4238155

SEQ ID NO: 4241638 - RNA, 91 nt, Mycobacterium tuberculosis H37Rv; identical to SEQ ID NO: 4239214

SEQ ID NO: 4241639 - RNA, 86 nt, Mycobacterium tuberculosis H37Rv
cccgacaugcgccgagauccacgccagagcggaaaaucaccauaaggcgugacgcuaacgucgaucucggcgcagggacugugggg

SEQ ID NO: 4241640 - RNA, 87 nt, Mycobacterium tuberculosis H37Rv; identical to SEQ ID NO: 4238032

SEQ ID NO: 4241641 - RNA, 95 nt, Neisseria meningitidis MC58
ggauucccacuuucgugggaaugacggcguaaagguuuccguuuuuuaaguuuuagguaacuaaugaguugucauucccgcgcaggcgggaaucc

SEQ ID NO: 4241642 - RNA, 60 nt, Neisseria meningitidis MC58
caagcgaaagaaugccgucugaagccuuuuuuccgguuuucagacggcauuuuuugcuug

SEQ ID NO: 4241643 - RNA, 66 nt, Neisseria meningitidis MC58
guauauuugaauguuuccucuuugccggcaucgucaucuucaggacagccggaaacauagauauac

SEQ ID NO: 4241644 - RNA, 130 nt, Neisseria meningitidis MC58
cagguuuuucuuggcacggcgcuugauuucgacggucaguuccaugccgucugaaaggguguggacaaaggcggucaugcgguuucagacggcauuuuggcggcaaacgggccugcgccggaaauaagcg

SEQ ID NO: 4241645 - RNA, 114 nt, Neisseria meningitidis MC58
cccuguuagauaaggggggaagauuugaagcgguugucggcuuccugccguccgcuagcgcguccgucaucacgccggcaaccgccuuugucaucccuugcuuaucuuccaugg

SEQ ID NO: 4241646 - RNA, 77 nt, Neisseria meningitidis MC58
gucggcguuuuucugauacaguaucuguccgguuuuguuguugacgaccagggcagacugugaggagagaaucagac

SEQ ID NO: 4241647 - RNA, 83 nt, Neisseria meningitidis MC58
uaaugaugccgccggcguggcauccuccucuaaaaucaaaggaaaauauguuaaggaaguuacagucgcaaacggcgucguua

SEQ ID NO: 4241648 - RNA, 65 nt, Neisseria meningitidis MC58
aaucucgagguuucagucauuuccgauagauucccgccugugcgggaaugacggauuucgagauu

SEQ ID NO: 4241649 - RNA, 55 nt, Neisseria meningitidis MC58
augccgucugcaggaagcagguuacagcaauguacggcucaucuuggacggacau

SEQ ID NO: 4241650 - RNA, 109 nt, Neisseria meningitidis MC58
cccgucauucccgcgaaagcgggaauccagguucguugaguuucggucauuuccgauaaacucuugcagcuuugcguuucuagauucccucuuucgcgggaaugacggg

SEQ ID NO: 4241651 - RNA, 84 nt, Neisseria meningitidis MC58
ugugcaggauacgaaugugcagcugacacguggcaauguaguacgaacuguugccuuggaagauuuaguugcaaauccgcgaca

SEQ ID NO: 4241652 - RNA, 84 nt, Neisseria meningitidis MC58
uuuggauucccgccugcgcgggaaugacgaauccauccauacggaaccugcaccacgucauucccacgaaagugggaaucuaga

SEQ ID NO: 4241653 - RNA, 78 nt, Neisseria meningitidis MC58
guguuuuuccugaaauguccucugaaagcgcagccauugucggcgccgcaguuuuccucgguguuucccuuaaaaugc

SEQ ID NO: 4241654 - RNA, 107 nt, Neisseria meningitidis MC58
guuucagucauuuccgauaaauugccuuagcauugaaugucuagauucccgccugcgcgggaaugacggauuuuagguuggggucauuuauugggaaaagcagaaac

SEQ ID NO: 4241655 - RNA, 56 nt, Neisseria meningitidis MC58
gaagcuuuagagauucuggauucccacuuucgugggaaugacgggauuagaguuuc

SEQ ID NO: 4241656 - RNA, 103 nt, Neisseria meningitidis MC58
cuggauucccgccugcgcgggaaugacgaauuucagguuucugcuuuuuccaauaaaugcccccaaccuaaaauccgucauucccgcguaggcgggaaucuag

SEQ ID NO: 4241657 - RNA, 59 nt, Neisseria meningitidis MC58
ggaggcuucaaacaaggcuuuccgcuccgacgguucggacugccuuguuugaaucuucu

SEQ ID NO: 4241658 - RNA, 69 nt, Neisseria meningitidis MC58
cgugggaaugacggcguaaagguuucuguuuuuuaaguuuuagguaacuaaugaguugucauucccgcg

SEQ ID NO: 4241659 - RNA, 85 nt, Neisseria meningitidis MC58
uaaccugccgcacggucugaaacccuaacuaugcacauucggauuuuagugugcauuauuaguguuuuagcagugcgguauuuug

SEQ ID NO: 4241660 - RNA, 56 nt, Neisseria meningitidis MC58
gucgcccugcugcauuugcgccaaagccuuuuucgcccgcaaaaucggcaggggac

SEQ ID NO: 4241661 - RNA, 55 nt, Neisseria meningitidis MC58
guuucagacgaccuuaagaugucuuuguguaccggcuuguaacgucgucugaaau

SEQ ID NO: 4241662 - RNA, 70 nt, Neisseria meningitidis MC58
aaaaaaccgaaaccgaacaagccggauucccgccugcgcgggaaugacggcagagcgguuucuguuuuuu

SEQ ID NO: 4241663 - RNA, 56 nt, Neisseria meningitidis MC58
gccgucugaagggaccgggcagaaaccgccgguuuuguuugccccguucagacggc

SEQ ID NO: 4241664 - RNA, 67 nt, Neisseria meningitidis MC58
guaagccuuuagagcguuaaaaaugccgucugaaccgcuucagacggcauuuugauguucggcuugc

SEQ ID NO: 4241665 - RNA, 107 nt, Neisseria meningitidis MC58
ucgucauucccgcgaaagcgggaauccagguucguugaguuucggucauuuccgauaaauucuugcaacuuugcguuucuagauucccacuuucgugggaaugacgg

SEQ ID NO: 4241666 - RNA, 60 nt, Neisseria meningitidis MC58
uuuugaaaaugaaugccgucugaaacagaaucccuguuucagacggcauuguuuuugagg

SEQ ID NO: 4241667 - RNA, 69 nt, Neisseria meningitidis MC58
gucgcugcggucgugauacgccaagaguuuguuuucggcaacaagcugcugaaucacacuguaaaaggc

SEQ ID NO: 4241668 - RNA, 60 nt, Neisseria meningitidis MC58
aaugccgucugaaaugccugcgagcgcgguguccaaaaguugcagcacauaggcggcguu

SEQ ID NO: 4241669 - RNA, 119 nt, Neisseria meningitidis MC58
uacacgcccgucauucccgcacaggcgggaauccggaaggucgggccugccguuauuuucaaucauuacagaaacugaaaggucuggauucccgccugcgcgggaaugacgggcgugug

SEQ ID NO: 4241670 - RNA, 101 nt, Neisseria meningitidis MC58
ggacgacuucgucgcccaguuugcaaucguguuggacgacggcguuugccaagaugcggcagccuucgccgagcacgguguuugcgccgauguagacguuc

SEQ ID NO: 4241671 - RNA, 70 nt, Neisseria meningitidis MC58
ucgacacguuugaagcccgccugcacgauuggcacgacaaccaucugcgcgauacgcucaaacgguuuga

SEQ ID NO: 4241672 - RNA, 94 nt, Neisseria meningitidis MC58
cugcuuguuuccgaaccuuaaaaucaaucaaacaaaucgcgcagcuugucuaaaaacgauuucuugcgcgguguuugguuuuccaagccgguag

SEQ ID NO: 4241673 - RNA, 103 nt, Neisseria meningitidis MC58
guugcccgaaaccucaaaaaaaccgaaaccgaacaagccggauucccgccugcgcgggaaugacggcagaacgguuucuguuuuuuccgauaaaugccgcaau

SEQ ID NO: 4241674 - RNA, 74 nt, Neisseria meningitidis MC58
gcguauuuugguacagaugccgcagcaggaagacccuguugucagccugccugcgcaucuggcggacggucugc

SEQ ID NO: 4241675 - RNA, 102 nt, Neisseria meningitidis MC58
gaagguugcuaugauauaguggcuugacuuuaaaccgguacggcauccccucgccuuguccugauuuaaaguuaauccacuaucucauucccgucauccuuc

SEQ ID NO: 4241676 - RNA, 100 nt, Neisseria meningitidis MC58
cccgaaacaagaaaaagaaccgaaaccgaacaagccggauucccgccugcgcgggaaugacgggauuucagguuacuguuuuugauuuucuguuuugugg

SEQ ID NO: 4241677 - RNA, 72 nt, Neisseria meningitidis MC58
guggaagggugugcugggugcggcauugucggcaguuuugcccgaaaugccguuuuucaggauauuguccau

SEQ ID NO: 4241678 - RNA, 75 nt, Neisseria meningitidis MC58
gguggaggccgucugaaaauaaaaucuuucuuuauaaaaaggcaggccauguuucauuuucagacggccuaaauc

SEQ ID NO: 4241679 - RNA, 130 nt, Neisseria meningitidis MC58
cuagacauucaaugcuaaggcaauuuaucgggaaugacugaaacucaaaaaacuggauucccacuuucgugggaaugacgggauuagaguuucaaaauuuauucuaaauagcugaagcucaacgcacugg

SEQ ID NO: 4241680 - RNA, 58 nt, Neisseria meningitidis MC58
uugagauuuugcguccuggauucccacuuucgugggaaugacgggauuaaaguuucaa

SEQ ID NO: 4241681 - RNA, 93 nt, Neisseria meningitidis MC58
gacggcauguuauuugauguaaccgugcuaugccgucugaaaaccggacgcaagccuucagacggcauaccgcuauguuaaaauaugcccguu

SEQ ID NO: 4241682 - RNA, 100 nt, Neisseria meningitidis MC58
gucuggauucccgccugcgcgggaaugacggguuucgagauugcguuguugucgggaaugcaacugaaccgucauucccacggaagugggaaucuaggac

SEQ ID NO: 4241683 - RNA, 65 nt, Neisseria meningitidis MC58
uguuuuaagggacaaaugccgucugaaaaucgguuucagacggcauuuucuguuuauuuaaagca

SEQ ID NO: 4241684 - RNA, 108 nt, Neisseria meningitidis MC58
guuucagucauuuucaauaaauugccuuagcauugaaugucuagauucccgccugcgcgggaaugacggauuuuaguuuggggggcauuuauuggaaaaagcagaaac

SEQ ID NO: 4241685 - RNA, 58 nt, Neisseria meningitidis MC58
guaugccguccgaacgcuguccgacgggguuuugauuggcggcggaaggacgguacac

SEQ ID NO: 4241686 - RNA, 111 nt, Neisseria meningitidis MC58
gucaaacacuccuuugguuaccugcuuugugucaaaaauaccgucugaaagccgaauaucguuucagacgguauuuugauuguuggguuuuuaaucagagcuuuguuugau

SEQ ID NO: 4241687 - RNA, 109 nt, Neisseria meningitidis MC58
gcgccgucugucgaacgccugcaaaaccucuaagccggacgaugccgucugaaaccauuuuucagacggcauuuucccguuuuaccguccaaccguuuuccgagcgcgc

SEQ ID NO: 4241688 - RNA, 114 nt, Neisseria meningitidis MC58
gcugccgucuugguaauaaacgggcgugccggcgggauauuuuugacggacggcggucuugccguugccgucuugauaaguuucccacgcgcagcccgacaaaagggcggcggc

SEQ ID NO: 4241689 - RNA, 62 nt, Neisseria meningitidis MC58
aauacagcacacugccgggcagcggcuuugccuauuuugccguccucgccagcguguuuguu

SEQ ID NO: 4241690 - RNA, 59 nt, Neisseria meningitidis Z2491
cgaggacggcgaaauaggcaaagccgcugcccggcagggugcuguauuucgccgcuucg

SEQ ID NO: 4241691 - RNA, 92 nt, Neisseria meningitidis Z2491
ggugcaacguauuuaccaacauagggagcauuugauugagggauuuacauuacgguacaacguuacuaugcugguuugguaugaacugcauc

SEQ ID NO: 4241692 - RNA, 59 nt, Neisseria meningitidis Z2491
ugccgauuauuucuacgacuucgaagaagcgauuaacgcagguuuggaagaaaucggca

SEQ ID NO: 4241693 - RNA, 87 nt, Neisseria meningitidis Z2491
gguaaucagaccgaucgcgcccugcccuacgucuauaccuucauaaagcuguugggcgguacgcauggugcggucgguggugaagcc

SEQ ID NO: 4241694 - RNA, 87 nt, Neisseria meningitidis Z2491
cuacgccgaugauaguugaguauccugcggucaaugccuuauucauggcguucgcgccgaugauggucaacucuucguuuuuaguag

SEQ ID NO: 4241695 - RNA, 57 nt, Neisseria meningitidis Z2491
gacggcgaggauuuccugccaaaagcguuugccuguggcggcgacaucgucgcuuuc

SEQ ID NO: 4241696 - RNA, 58 nt, Neisseria meningitidis Z2491
aaagcccgcguuuuucgagaaguucggcgugcgugccuucuucgaugaugcggccuuu

SEQ ID NO: 4241697 - RNA, 83 nt, Neisseria meningitidis Z2491
gcauuugaaguaaaggcugcaauugcucaaauugauucccgaugacaaucauacccuuguguugcggucuuuuuuucaaaugc

SEQ ID NO: 4241698 - RNA, 101 nt, Neisseria meningitidis Z2491
gccgccgauguagugccguuuguuuucaaaacgaaaacccgggcggaacagccacgaucggcuuucguaugaaagcggaucggcgaggaagcgguuugggc

SEQ ID NO: 4241699 - RNA, 85 nt, Neisseria meningitidis Z2491
aaaucggcgagaaaaauggcgugguguucaucgacgacagcaaaggcacgaacgucggugcgaccgccgccgcgauugccgguuu

SEQ ID NO: 4241700 - RNA, 79 nt, Neisseria meningitidis Z2491
gcguuucggacgauaugcagggcggaggguuuggcagcacauucgcccgaucuuucuaucugcaguaucagcgauucgu

SEQ ID NO: 4241701 - RNA, 72 nt, Neisseria meningitidis Z2491
ugcguauugccgucgugucuucgcuugccgcugucguuuugggcacgcuggcgggcuaugcgauggcgcgua

SEQ ID NO: 4241702 - RNA, 70 nt, Neisseria meningitidis Z2491
aaaauauccagaaugaugacgauuauuuggcaauggauugccuucauaauuuugucguugcggauauuuu

SEQ ID NO: 4241703 - RNA, 67 nt, Neisseria meningitidis Z2491
cacgauguuugccagcaccgccgccgcuuccugauuuugggaagccgcacgguuuugguaaaccgug

SEQ ID NO: 4241704 - RNA, 69 nt, Neisseria meningitidis Z2491
cccggcaaucaaaaugccgucugaagcguuauacggcuuucagacggcauuuuuguauuuaaagccggg

SEQ ID NO: 4241705 - RNA, 59 nt, Neisseria meningitidis Z2491
cggcaaucaggcugucggugcggucgaacacgccgccguguccgggcagcagguugcug

SEQ ID NO: 4241706 - RNA, 96 nt, Neisseria meningitidis Z2491
gguggcgugcuuauugaaauuucgacaaaggucgucugaaaaccgaaaauaugguuuucagacgaccuuuguuguauuugguaacuauauguuccc

SEQ ID NO: 4241707 - RNA, 57 nt, Neisseria meningitidis Z2491
acggugccgaauacgucgacgguuacgaauacgucggugucggcguauucgggcggu

SEQ ID NO: 4241708 - RNA, 55 nt, Neisseria meningitidis Z2491
caaacgaaaugccgucugaaagccgauuugguuucagacggcauuuuuucguaug

SEQ ID NO: 4241709 - RNA, 79 nt, Neisseria meningitidis Z2491
gucugaagccuucagacggcauacgaaacggguucuguaucauacagaacccguuuuuugucgcaaaucggcuucagac

SEQ ID NO: 4241710 - RNA, 63 nt, Neisseria meningitidis Z2491
guauuugaaacguccgaugccgucugaaauccgcuucggacggcauugccguuugcaugcugc

SEQ ID NO: 4241711 - RNA, 61 nt, Neisseria meningitidis Z2491
guugggcuguucgccgaucaagccgcuuucgugcgccccaaucggguugaaauagcgcaac

SEQ ID NO: 4241712 - RNA, 67 nt, Neisseria meningitidis Z2491
gguuuuauguucuugugggaaugaugaaauuuuaaguuuuaggaauuuaucgggagcaacagaaacc

SEQ ID NO: 4241713 - RNA, 119 nt, Neisseria meningitidis Z2491
cgucgacuuuguggcgguggugaccuucaaugauuucgaugucguagccuucguugaguacgagggcgacggugucgaggauguggaaggugagguugacgccgacgcugaaguuggcg

SEQ ID NO: 4241714 - RNA, 88 nt, Neisseria meningitidis Z2491
aaucuucauucccgucgccgagcguuuggguaacgaagugauugaauuugugaauguuuccaaaucguucggcgacaaagugcugauu

SEQ ID NO: 4241715 - RNA, 108 nt, Neisseria meningitidis Z2491
cguuuggacaaaggccgcggcgcgguugccacauuacugguucaaagcgguacgcugaaaaaaggcgauaugcugcuggccgguaccgcguucggcaaaauccgcgcg

SEQ ID NO: 4241716 - RNA, 80 nt, Neisseria meningitidis Z2491
gccgcuuucuucgacaaugauuuucggccacagcauuccgggggugucguacagccagaagucaucggcgaggaagaggc

SEQ ID NO: 4241717 - RNA, 68 nt, Neisseria meningitidis Z2491
caaucaggaaaacuuugucggcguagggauggcguuuuugaccguugaugccuucaaaguuuugguug

SEQ ID NO: 4241718 - RNA, 87 nt, Neisseria meningitidis Z2491
ccgagcuguucaagcuggcggucauccuuuauuuggcaagccuguucacgcgccgugaagaaguguugcgcagcauggaaaguuugg

SEQ ID NO: 4241719 - RNA, 67 nt, Neisseria meningitidis Z2491
cuuuauaaaggccgucugaaauauggcuuagauaauuagccuuauuuucagacggccuuuguucuag

SEQ ID NO: 4241720 - RNA, 108 nt, Neisseria meningitidis Z2491
gccgucauucccgcgaaagcgggaaucuagaauuuuaaugcggcaaaaauuuaucggaaaaaaccgaaguuuaaagaccuagauucccgccugcgcgggaaugacggu

SEQ ID NO: 4241721 - RNA, 85 nt, Neisseria meningitidis Z2491
ggcggcagaauccggacggauucggacggaugccgccccguguugaaaaaggguguauuuuuuaaguauguuccgauuccccgcc

SEQ ID NO: 4241722 - RNA, 60 nt, Neisseria meningitidis Z2491
augccgucugaacguccggcagagggcgcgaaucugccccuugccgcuuucagacggcau

SEQ ID NO: 4241723 - RNA, 82 nt, Neisseria meningitidis Z2491
aagccgccgcucaaagaagacgagucggaaacaaagggauguuccuugguuucgccgucguuuuuggguuugucgguugcuu

SEQ ID NO: 4241724 - RNA, 82 nt, Neisseria meningitidis Z2491
guuacgcacagguucaggaaaaauucgacaaauacggcaacuggguguuauuugucgcucguuuccugcccgguuugcggac

SEQ ID NO: 4241725 - RNA, 100 nt, Neisseria meningitidis Z2491
cagccggguaaaaucacggugaaaaaugaaaaaugccgucuggaacuugaaaacaucggguuucagacggcauuuuguuugacgguuuauugcuuauuug

SEQ ID NO: 4241726 - RNA, 60 nt, Neisseria meningitidis Z2491
cggcaaagcgguuuggacaucuaugcauggcacggcauauauuucuucccccgcuuuccg

SEQ ID NO: 4241727 - RNA, 59 nt, Neisseria meningitidis Z2491
cuaugccguuaucgaaugcgaagguuuggaaaaccacguccgcaucgaucacgguuugg

SEQ ID NO: 4241728 - RNA, 72 nt, Neisseria meningitidis Z2491
gguagucauauuuccacaacugcuauuggguauuggguaaucccuuuggcaaguagugagaaauguguugcc

SEQ ID NO: 4241729 - RNA, 86 nt, Neisseria meningitidis Z2491
gauuguugacaauuuaaggcaucuguugcggcaaauacggucugcucgccguguuuccuuauuggaaugucuuuuggaaggcaguc

SEQ ID NO: 4241730 - RNA, 58 nt, Neisseria meningitidis Z2491
cagcggauuguaugugaacgaguugaugcugaaguugaccguccgcgaagauccguug

SEQ ID NO: 4241731 - RNA, 65 nt, Neisseria meningitidis Z2491
gggauuugacgguuucgggacgggcuugcaggauguagaguuugccguccaagccgucgcguccc

SEQ ID NO: 4241732 - RNA, 105 nt, Neisseria meningitidis Z2491
cgucauucccgcgcaggcgggaauccaggccuuugggcgacggcaauauucaaagauuaucugaaaguuuagagguucuagauucccguuuucacgggaaugacg

SEQ ID NO: 4241733 - RNA, 78 nt, Neisseria meningitidis Z2491
ggauacgguaacuucuugaccguuuuucagcaauucgguugcauugccgcagccgacaacggcaggaauacccaguuc

SEQ ID NO: 4241734 - RNA, 103 nt, Neisseria meningitidis Z2491
cuggauucccgccugcgcgggaaugacgaauuucagguuucugcuuuuuccaauaaaugcccccaaccuaaaauccgucauucccgcguaggcgugaaucuag

SEQ ID NO: 4241735 - RNA, 103 nt, Neisseria meningitidis Z2491
ggaagacgguuugaaccgcaucuauaucgccguuuuggucgauaaggaaagccaaaaggcgauuuuaaucggcaaaggcggggagcguuugaagaaaauuucc

SEQ ID NO: 4241736 - RNA, 70 nt, Neisseria meningitidis Z2491
guaggucggauacuuguauccgacagaguggguaaaaaggcaaaaugucggauuuaagaauccgcccuac

SEQ ID NO: 4241737 - RNA, 76 nt, Neisseria meningitidis Z2491
cagcucguguacgguaucgacuaagauuuuggcguguucggggucggcguguugguugaugccguguccgagguug

SEQ ID NO: 4241738 - RNA, 58 nt, Neisseria meningitidis Z2491
auccaagagcuucaguuucccgucugccguggcagcggagagaaucaugccuucggau

SEQ ID NO: 4241739 - RNA, 75 nt, Neisseria meningitidis Z2491
ugccgcacggucugaaacccuaacuaugcacauucggauuuuagugugcauuauuaguguuuuagcagugcggua

SEQ ID NO: 4241740 - RNA, 60 nt, Neisseria meningitidis Z2491
ggugcaguagucgggguuuucuucguugugcgcgaccucgaaauccgccacuacgcaauc

SEQ ID NO: 4241741 - RNA, 62 nt, Neisseria meningitidis Z2491
ucaugcugaaauguuuucagacgaccucauuaauaacaaggucgucugaacguuucacguga

SEQ ID NO: 4241742 - RNA, 59 nt, Neisseria meningitidis Z2491
aacaaaguggcggauaaggcggacugccugauagcugccguuuuucgcccacuccgguu

SEQ ID NO: 4241743 - RNA, 58 nt, Neisseria meningitidis Z2491
uucaagcgcagcccgcuuugcccgauggcgguaacgggcggaauguccugcacuugga

SEQ ID NO: 4241744 - RNA, 83 nt, Neisseria meningitidis Z2491
cugccguauauauuuuggcaaacgguaaaaauggaacacucuauaucgguguuaccaugaauuugccggaaaggguuuggcag

SEQ ID NO: 4241745 - RNA, 130 nt, Neisseria meningitidis Z2491
ucgaugcaauccugaccaggcugcacggcauggcggauacggaaaacacccuaugccgucugaacgggcgcaaggcgguuuuuuccaacggcccgucguuuuacguccgugccguugucggcgcacucgg

SEQ ID NO: 4241746 - RNA, 72 nt, Neisseria meningitidis Z2491
guuggcaucgcccaaggggguggacgugccgugcgcguugacguaauccacgucuucgggauugaugccggc

SEQ ID NO: 4241747 - RNA, 82 nt, Neisseria meningitidis Z2491
ccgccugcgcgggaaugacggcucaaaaguuacgaaacgaaaaauaaccgaaaccaaacaagucggauucccgcgcgggcgg

SEQ ID NO: 4241748 - RNA, 71 nt, Neisseria meningitidis Z2491
cgggcaucgggaagagcagcucggcggagacguuggcuuuuuuguugccgccguagcugauuuuuucgccg

SEQ ID NO: 4241749 - RNA, 59 nt, Neisseria meningitidis Z2491
cgccgucuucgcggcugacgaggaagaguuuggcgguuuugucaggcgcgaugacggcg

SEQ ID NO: 4241750 - RNA, 81 nt, Neisseria meningitidis Z2491
gaacuuccccgaucagugcgaggacuuuagacguaccgauauccaguacgcugauguaucuuugcugcuguuccauuguuc

SEQ ID NO: 4241751 - RNA, 84 nt, Neisseria meningitidis Z2491
gcagcacggauuggauuugcgcgugguucaggauauguugggacaugccgauuugaauacgacgcagauuuauacccauguugc

SEQ ID NO: 4241752 - RNA, 55 nt, Neisseria meningitidis Z2491
acgucgcccgcuucgacgcguuccaacuggcaggcgcguggaugaagggcgaugu

SEQ ID NO: 4241753 - RNA, 82 nt, Neisseria meningitidis Z2491
gcaguguaacucaaagggacggcguacgguuuuaccgauguuugacauaugggaaaagugugccgcuuccgcgugaaacugc

SEQ ID NO: 4241754 - RNA, 130 nt, Neisseria meningitidis Z2491
ucggcagcguuuucgauggguguaaccgcguuuuuaccgauguugaugcccaauacgccacugaauuuacuuuuuucgauguugcguaucauggugucgauaccgugguuguugaaacccaugcgguuga

SEQ ID NO: 4241755 - RNA, 57 nt, Neisseria meningitidis Z2491
gcgcaaaaacugccguacccacguuuuuuugucauacggaagauagcggcauugugc

SEQ ID NO: 4241756 - RNA, 59 nt, Neisseria meningitidis Z2491
accgcuuuuuggacauucaaaucaggaugccggaugauuugcgcuauuuggaaagcggu

SEQ ID NO: 4241757 - RNA, 92 nt, Neisseria meningitidis Z2491
ucccuuauuucgcaaaacccgugauuuucggcacuuuugcugcaaaauuggcaggcgugcccagaaucgucgggaugcuggaagguuuggga

SEQ ID NO: 4241758 - RNA, 117 nt, Neisseria meningitidis Z2491
gucgcggugcacauagacuuugggcugcgccaacaggggcggcagcagcguaucgacgguuugcugccaaaguuggcguuguuugaauguuaauucgcgccccaauucuuuugcgac

SEQ ID NO: 4241759 - RNA, 72 nt, Neisseria meningitidis Z2491
uauaguggauuaaauuuaaccaguacggcguugccucgccuugccguacugguuuaaauuuaauccacuaua

SEQ ID NO: 4241760 - RNA, 58 nt, Neisseria meningitidis Z2491
cgcggauaaagccguugugcaaccaguauuugacguggcuggcaaugcuuugaccgug

SEQ ID NO: 4241761 - RNA, 64 nt, Neisseria meningitidis Z2491
cgacgauggcaggcagagcgcgccgcaccgugucgcguugugggaaaagcugcuugccgcguug

SEQ ID NO: 4241762 - RNA, 57 nt, Neisseria meningitidis Z2491
guuugaaagacagacaagauaauguuuugaacauuguccugucgguuucuuugaagc

SEQ ID NO: 4241763 - RNA, 65 nt, Neisseria meningitidis Z2491
aagauugauucuucagacggcauucgcggcuuuuuguuuaaaaugccgucugaaaaaucaauuuu

SEQ ID NO: 4241764 - RNA, 80 nt, Neisseria meningitidis Z2491
ugcggacgguuuccgucagauugaguacggcuuucgacuccugcccuuccugcccugccgaagacggaagcugugccgca

SEQ ID NO: 4241765 - RNA, 73 nt, Neisseria meningitidis Z2491
ccuuguacgagcaagagcggcagauagucgucaggcaguuguaaggcgacauccugcauuuguuugcgcgagg

SEQ ID NO: 4241766 - RNA, 66 nt, Neisseria meningitidis Z2491
cuguccggcauuuaugcguacacaauaaaucuugcaggauauuguugcgggucaaaugccggccgg

SEQ ID NO: 4241767 - RNA, 59 nt, Neisseria meningitidis Z2491
cggccugcgcgggcgcguggucgacaucaaccuguugaacacgcugaugaugcaggucg

SEQ ID NO: 4241768 - RNA, 71 nt, Neisseria meningitidis Z2491
gguuucuugagauuuugcauccuggauucccacuuucgugggaaucuagaaucucggacuuucagauaauc

SEQ ID NO: 4241769 - RNA, 59 nt, Neisseria meningitidis Z2491
uguggauuucguugacguagauuuuccggcccgguucgaugugcaggacgaaaucgacg

SEQ ID NO: 4241770 - RNA, 55 nt, Neisseria meningitidis Z2491
uuucaaaacacguugcgccaaagacaucgcuucuucggcauaacguucguugaaa

SEQ ID NO: 4241771 - RNA, 71 nt, Neisseria meningitidis Z2491
uauaguggauuaacaaaaaccaguacggcguugccucgccuugccguacugguuuuuguuaauccgcuaua

SEQ ID NO: 4241772 - RNA, 71 nt, Neisseria meningitidis Z2491
uauagcggauuaacaaaaaccaguacggcaaggcgaggcaacgccguacugguuuuuguuaauccacuaua

SEQ ID NO: 4241773 - RNA, 104 nt, Neisseria meningitidis Z2491
cgucauucccgcgaaagcgggaaucuagaaucucggacuuucagauaaucuuugaauauugcuguuguucuaaggucuagauucccgcguucgcgggaaugacg

SEQ ID NO: 4241774 - RNA, 56 nt, Neisseria meningitidis Z2491
guaaaccaaggcaagcgacauauuucagacggccuuauucgccggcuucgguuugc

SEQ ID NO: 4241775 - RNA, 57 nt, Neisseria meningitidis Z2491
guuugccaaagaccuucaagcgcaagggaaaagcgcgguugaagccgcuuuggaagc

SEQ ID NO: 4241776 - RNA, 115 nt, Neisseria meningitidis Z2491
gcaggacggggcggcugaauguguuuugaaggucgucugaaaagaugccugcuucggcggagaggcuuucagacggccuuuggaaugguucggcuuggaaugcuuguccgucugc

SEQ ID NO: 4241777 - RNA, 58 nt, Neisseria meningitidis Z2491
ucgucgaaaacaacguccaaauggcgaccgccgcccacgaauugcacgauuucgacga

SEQ ID NO: 4241778 - RNA, 60 nt, Neisseria meningitidis Z2491
gaaaucgaggguuucuucgaugacggggauggauucgguuuggauaagcugcuugaguuc

SEQ ID NO: 4241779 - RNA, 56 nt, Neisseria meningitidis Z2491
gcgcaucgaugacggggucgaguucgcugaaaagcucggcaaucgguucgaugcgu

SEQ ID NO: 4241780 - RNA, 83 nt, Neisseria meningitidis Z2491
guugccaaagccuauuucaacgaacguuaugccgaagaagcgaugucuuuggcgcaacguguuuugaaaacgcgcgaggaaac

SEQ ID NO: 4241781 - RNA, 55 nt, Neisseria meningitidis Z2491
gccaaaauauucgccaucaguaugaugaccgcauccugccugauaauguuuuggc

SEQ ID NO: 4241782 - RNA, 59 nt, Neisseria meningitidis Z2491
caaugccgucugaaaccccaaacgcccgauuaggcugaugaggauuuuagacggcauug

SEQ ID NO: 4241783 - RNA, 111 nt, Neisseria meningitidis Z2491
gguugaagaugaugcgucuauccgcuacgguucgccccaaaucuaccgcaaucuggauuugcuccguaccguacgcgaacgaaaccccaaugccuauaucaucuacaaacc

SEQ ID NO: 4241784 - RNA, 80 nt, Neisseria meningitidis Z2491
uuucaaacaaaggccgucugaaggggucgggcggaaaccgccgguuucguuugccccguucagacggcauuaugaugaaa

SEQ ID NO: 4241785 - RNA, 61 nt, Neisseria meningitidis Z2491
gcaggguguucacgucgcugaauaggaagcgguauucccacaucacgucguaaaugcccgc

SEQ ID NO: 4241786 - RNA, 105 nt, Neisseria meningitidis Z2491
cugacgcuguuugcugccggcggucuggauaaugguggcaucaacgacggcggcggaugcuuucucuauuuuuaggccuuuuucggucaguuggcaguuaaucag

SEQ ID NO: 4241787 - RNA, 70 nt, Neisseria meningitidis Z2491
uauaguggauuaaauuuaaauaaggacaaggcgaggcaacgccguacugguuuaaauuuaauccacuaua

SEQ ID NO: 4241788 - RNA, 58 nt, Neisseria meningitidis Z2491
guuggacgaaccguccucuuucagcguguagcugcuuucgagggcgguuuuguucgac

SEQ ID NO: 4241789 - RNA, 106 nt, Neisseria meningitidis Z2491
gcccuuggaagaaaccguuauuugggcauaaggcaaugccgucugaaaacgcaaggauuuucagacggcauuuuuuaaugcuuauuuaaaacgauucaccgggggc

SEQ ID NO: 4241790 - RNA, 108 nt, Neisseria meningitidis Z2491
gggcaaaccagucgcgcagccguuugaggccgaagucuucgguguggaggguaaagcccauuucgggacagcggcacucgggcgggaugucggacaggcaguaugccc

SEQ ID NO: 4241791 - RNA, 67 nt, Neisseria meningitidis Z2491
uuaucggcagcaacaucgucaaagcacuuaaucaacgcgguauuacugacauuguugccgucgauaa

SEQ ID NO: 4241792 - RNA, 55 nt, Neisseria meningitidis Z2491
gucgggcagguucaaaaucagagugguguucauacauuuugaugagugcgucggc

SEQ ID NO: 4241793 - RNA, 62 nt, Neisseria meningitidis Z2491
gcggagguuguagucuucuucaaacugcgccuguuuuuugcggaacgcugcgaccagcccgc

SEQ ID NO: 4241794 - RNA, 77 nt, Neisseria meningitidis Z2491; identical to SEQ ID NO: 4241646

SEQ ID NO: 4241795 - RNA, 60 nt, Neisseria meningitidis Z2491
augccgucugaaagcggcaaggggcagauucgcgcccucugccggacguucagacggcau

SEQ ID NO: 4241796 - RNA, 66 nt, Neisseria meningitidis Z2491
gcuuccuuaaaguugaaacccgcacauauuggcgguaugcaagcaggguuuaaauuuuguaaacgc

SEQ ID NO: 4241797 - RNA, 113 nt, Neisseria meningitidis Z2491
gagauugccaugagugccgcgcuggugugugucgugaugguaucgggcagcaugaacuucuccgacaucguugccgcacaagccaaagguauugccggcgguucgguauucuc

SEQ ID NO: 4241798 - RNA, 105 nt, Neisseria meningitidis Z2491
ccugccgcugauuaccguaaacugcgcgauuuucggugccguaucguuuauggcgcagcgcgaauacggcuucggcgaauccgucguguacggcuucggugcggg

SEQ ID NO: 4241799 - RNA, 98 nt, Neisseria meningitidis Z2491
guucgucuaucaucgccugcuguucggcuugggcgaagaagugggcaauggaacgcgccacuaccguaccgaugucgggcaggcaggcgaggacgggu

SEQ ID NO: 4241800 - RNA, 104 nt, Neisseria meningitidis Z2491
cgucauucccgcgaaagcgggaaucuagaaucucggacuuucagauaaucuuugaauauugcuguuguucuaaggucuagauucccgccugcgcgggaaugacg

SEQ ID NO: 4241801 - RNA, 114 nt, Neisseria meningitidis Z2491
ugaaccgucauucccgcaaaagcgggaaucuagaaucucagacuuucagauaaucuuugaauauugcuguuguucuaaggucuggauucccgccugcgcgggaaugacgauuca

SEQ ID NO: 4241802 - RNA, 74 nt, Neisseria meningitidis Z2491
cgacguauugaugauugacggagaacacgggcagauucugauuccguucguuucccaauauaucgaaaccgucg

SEQ ID NO: 4241803 - RNA, 82 nt, Neisseria meningitidis Z2491
gugucuucgugcagccccaguuuuuucgccaaagccauauucacggggauauuggcggcggaagaacggguaaagaaggcau

SEQ ID NO: 4241804 - RNA, 83 nt, Neisseria meningitidis Z2491
cuggauucccgccugcgcgggaaugacgaauccauccauacggaaaccugcaccacgucauucccacgaaagugggaaucuag

SEQ ID NO: 4241805 - RNA, 129 nt, Neisseria meningitidis Z2491
gauagccguuuuuccaccagccgacgcggguuuugucggggaaccacacgccggcgauguaggugcccaaguggcugucggcggaguagguuuccucaaagcugccgcgcauacccauauagccguugc

SEQ ID NO: 4241806 - RNA, 68 nt, Neisseria meningitidis Z2491
cgauagauuggauaaagaugcugccuaugccuuguacggcguaggcaccggcuuuguccaucgguucg

SEQ ID NO: 4241807 - RNA, 57 nt, Neisseria meningitidis Z2491
uguuucagacgaccuuaagaugucuuuguguaccggcuuguaacgucgucugaaaua

SEQ ID NO: 4241808 - RNA, 57 nt, Neisseria meningitidis Z2491
aaugccgucuaaaauccucaucagccuaaucgggcguuugggguuucagacggcauu

SEQ ID NO: 4241809 - RNA, 58 nt, Neisseria meningitidis Z2491
ucgggaaaacgcugccgcaacucgcguaucaaagguugggcggcacgcguuuccccga

SEQ ID NO: 4241810 - RNA, 63 nt, Neisseria meningitidis Z2491
caggcacggauaaggaugucguauugggcauaggcgacgaugcggcgauuguccgcccgcgug

SEQ ID NO: 4241811 - RNA, 58 nt, Neisseria meningitidis Z2491
aagcgcaaaagcggauuggacggcguuuccagccaaaccaguuugaccuugugcgcuu

SEQ ID NO: 4241812 - RNA, 72 nt, Neisseria meningitidis Z2491
ugaaauaugcgguagccgugcugacgauacugcuuuuggcggcaaucgggcugcacgcuuccguauaucgca

SEQ ID NO: 4241813 - RNA, 59 nt, Neisseria meningitidis Z2491
gcacuucuuuggcagcggcacugcgcgcuuuuucgaugcugccgcuguugaggauuugu

SEQ ID NO: 4241814 - RNA, 58 nt, Neisseria meningitidis Z2491
uuggcucgccguuaugccuuuaugguugagauucaaauggaggcucaacggcgguugg

SEQ ID NO: 4241815 - RNA, 82 nt, Neisseria meningitidis Z2491
ucauuagcuugggaaaugccguccugguugagauccugccauacacgcaggguuuagaaugcggcgucugccgcguugauga

SEQ ID NO: 4241816 - RNA, 109 nt, Neisseria meningitidis Z2491
ucugcgggcugaaguccguccugcuuucaggcugccugcaauggugugcaggcugcuuuuucagguagccugaaugguaguuauuuugugcggucuuuuuucuguuuga

SEQ ID NO: 4241817 - RNA, 64 nt, Neisseria meningitidis Z2491
ucuuugccgccaauguguuauggacucuggcguaugacacgguuuaugcaauggcggacaaaga

SEQ ID NO: 4241818 - RNA, 65 nt, Neisseria meningitidis Z2491
auccgcacgaagccgccgucgacgaguuugccgaacaggaguucgucggcgagcgguuugcggau

SEQ ID NO: 4241819 - RNA, 106 nt, Neisseria meningitidis Z2491
gccaguucgucaggcugcauuuuggcaguuucgaugccgucgauucgguacgaaccggaaccggcgguauccaaacagccgaguauguucaucagcguggacuugc

SEQ ID NO: 4241820 - RNA, 130 nt, Neisseria meningitidis Z2491
gaaaccuaaaauucgucauucccacgaaagugggaaucuagaaucucggacuuucagauaaucuuugaauauuacuguuguucuaaggucuagauucccgccugcgcgggaaugacgacagaacgguuuc

SEQ ID NO: 4241821 - RNA, 69 nt, Neisseria meningitidis Z2491
gggucaguugcguguagcucauggcaaucuuucuugcaggaaaggucguaugcuaccgcauacuggccu

SEQ ID NO: 4241822 - RNA, 75 nt, Neisseria meningitidis Z2491
guacggcguggugaugcagugcuucgcgugggcgaugguugccuaugcgauuccgcugcuuucgcugucgcugac

SEQ ID NO: 4241823 - RNA, 70 nt, Neisseria meningitidis Z2491
gguaucuugcgcgaugcaguuuucgaugucgucgcagauacguuggaacagcgcgucgaacaagucuucc

SEQ ID NO: 4241824 - RNA, 62 nt, Neisseria meningitidis Z2491
uggcccgcuuuccgcgaaugggugggcgaccgcguauuccaagauaugaaggcgcacggcua

SEQ ID NO: 4241825 - RNA, 56 nt, Neisseria meningitidis Z2491
gcgcucaaacaaauggucgaaguguacgaacgcagcggcaacagcauuuugggcgu

SEQ ID NO: 4241826 - RNA, 66 nt, Neisseria meningitidis Z2491
ggaaacuggguauuuucgcgguuuuuuaggaauuuuccaacaaaucugcaauaaaucccaguugcc

SEQ ID NO: 4241827 - RNA, 95 nt, Neisseria meningitidis Z2491
ggaacaaaaaguuauaaagaaagaaauuuuggauauugguuuuuuaggcggcauagguuuaggauaaagccauauccgaaauuuguuuauguuuc

SEQ ID NO: 4241828 - RNA, 84 nt, Neisseria meningitidis Z2491
uuuugucugcaccgaagaagauaauaucgccguuuugugcgccgguacgcgcgaugauuuccuucagggcauucucagacagga

SEQ ID NO: 4241829 - RNA, 67 nt, Neisseria meningitidis Z2491
aaugucgguuugccguugcauuugauuucuuuuuccaauucgucaaacucggcuucaaaccgccguu

SEQ ID NO: 4241830 - RNA, 59 nt, Neisseria meningitidis Z2491
ggauucguggaugcuuugcaugaugccgaacaggcguuggucgacuucuucacgagucc

SEQ ID NO: 4241831 - RNA, 129 nt, Neisseria meningitidis Z2491
gaaguugugaagcaaugcgccguuuugacggcaaccgcgaauccguccgcgcgcaggcggucgccuucgcguuggaacgguuggcggggcugauugaaaacggcggcgaugcugucuaaacaaaaucuc

SEQ ID NO: 4241832 - RNA, 76 nt, Neisseria meningitidis Z2491
cagccgcagcggcggauucaugggcauuuccuucgccaucccgauugacguugccaugaaugucgccgaacagcug

SEQ ID NO: 4241833 - RNA, 77 nt, Neisseria meningitidis Z2491
augccgaggaagaguuugcccacuucggcgauggguucaaaguugaauucguugccugcgcggacuuguuugggcgu

SEQ ID NO: 4241834 - RNA, 83 nt, Neisseria meningitidis Z2491
ggcgcguauuguacgacagaaaccgcuucagacggcaucggguuugaugccguccgaagcgguuuccccaaacgaaaacgucc

SEQ ID NO: 4241835 - RNA, 130 nt, Neisseria meningitidis Z2491
ccagugcguugaguuucagcuauuuagaauaaauuuugaaacucuaaucgcgucauucccacgaaagugggaauccaguuuuuugaguuucagucauuuccgauaaauugccuuagcauugaaugccugg

SEQ ID NO: 4241836 - RNA, 63 nt, Neisseria meningitidis Z2491
cacuuggucugcuuucucuuuguugccgaaaucgacgguaacgguaucgaagaagaccuuaug

SEQ ID NO: 4241837 - RNA, 130 nt, Neisseria meningitidis Z2491
cuuuuccugauuuaauucaagcucuaagacuucgauauucagggcguuuauggcuuuuugcucuucaugaauauagaaagcacaggcguugcuacugucguacucuucgggcugaagaccuuugggauag

SEQ ID NO: 4241838 - RNA, 106 nt, Neisseria meningitidis Z2491
ccgucauucccgcgaaagcgggaaucuagaauuuuaaugcggcaagaauuuaucggaaaaaacugaaguuuaaagaccuagauucccgccugcgcgggaaugacgg

SEQ ID NO: 4241839 - RNA, 76 nt, Neisseria meningitidis Z2491
auuggggcaaacuuggcuucuucuucgcgaaaauggguuuccaauucggaaaaaugcgguucgaguucgucccgau

SEQ ID NO: 4241840 - RNA, 72 nt, Neisseria meningitidis Z2491
cgguccugauuuggcacgugugggcggucgcuauuccgacgaauggcaccguauccaccugcugaauccccg

SEQ ID NO: 4241841 - RNA, 64 nt, Neisseria meningitidis Z2491
cgggcaggaaacgagcgacaaauaacacccaguugccguauuugucgaauuuuuccugaaccug

SEQ ID NO: 4241842 - RNA, 63 nt, Neisseria meningitidis Z2491
uacaucgguuuggcgugggcaucgcugcaaagcggcgaauucaaaaccaagcugacaacugug

SEQ ID NO: 4241843 - RNA, 92 nt, Neisseria meningitidis Z2491
aaacauuggcaggaccuaugccgucugaaaaggcggauuugcccgaacaacaauaaagccgccguucagacggcauuuucuguuuucaguuu

SEQ ID NO: 4241844 - RNA, 68 nt, Neisseria meningitidis Z2491
ugccgcaaagucuguuucagaugacccauuucccgccaaguuucagccugaaagagauguuugcgcca

SEQ ID NO: 4241845 - RNA, 100 nt, Neisseria meningitidis Z2491
gcggcguuuuggucggcgaugcggcggguuuccucaauaugccgcgcaucaaaggcauucauaccgcgaugaaauccgccaugcucgccgccgaagccgu

SEQ ID NO: 4241846 - RNA, 96 nt, Neisseria meningitidis Z2491
ugaacgaguguccgcuguauuggcggcugcugccggugaguuuguuuucggaauuaaagguguauuugucguaacggccgccgaggacgaauuuca

SEQ ID NO: 4241847 - RNA, 68 nt, Neisseria meningitidis Z2491
gcacagcgguaaacgucauuuugcgcccuccuuauuuuuccaacgcaacgguguggcugccguugagc

SEQ ID NO: 4241848 - RNA, 74 nt, Neisseria meningitidis Z2491
aacggaaugccgcgaugguagaggguuuuguacacgucuuugacggcggaaaucugcucugcgguaaaaccguu

SEQ ID NO: 4241849 - RNA, 93 nt, Neisseria meningitidis Z2491
ggcacgaugagauacgggauugugcauuuucuuuucaaacggcacgcagucguaaaagaaaauucuauauaaaucauccauuugaucugugcc

SEQ ID NO: 4241850 - RNA, 55 nt, Neisseria meningitidis Z2491; identical to SEQ ID NO: 4241649

SEQ ID NO: 4241851 - RNA, 60 nt, Neisseria meningitidis Z2491
agucagcuugggcgugaugucgaaaccgacaccggcgaugacaccaagacccaagcugcu

SEQ ID NO: 4241852 - RNA, 65 nt, Neisseria meningitidis Z2491
cggauauuucgaugauuuugcugucgccuuugacgacggcuucggcagggauguucaaauguucg

SEQ ID NO: 4241853 - RNA, 83 nt, Neisseria meningitidis Z2491
cuggauucccgccugcgcgggaaugacgaauccauccguacggaaaccugcaccacgucauucccacgaaagugggaauccag

SEQ ID NO: 4241854 - RNA, 59 nt, Neisseria meningitidis Z2491
uccauccggaggauggauaugacgggccgcaaggcagcgauuauccgccccccggagga

SEQ ID NO: 4241855 - RNA, 60 nt, Neisseria meningitidis Z2491
gccgcugaugauucugauucccgcgcuggcgggcggaggggacggaaauauuugggcggc

SEQ ID NO: 4241856 - RNA, 58 nt, Neisseria meningitidis Z2491
acugggauuuauugcagauuuguuggaaaauuccuaaaaaaccgcgaaaauacccagu

SEQ ID NO: 4241857 - RNA, 67 nt, Neisseria meningitidis Z2491
guuguaucggcguaccgcuucuuccaaauccgcuauaaacugcgcccaagucggugccgccgacagc

SEQ ID NO: 4241858 - RNA, 62 nt, Neisseria meningitidis Z2491
gcagcguucggaguuugccggauuaccgcugacgguaaccgacagacagucugaaacggugu

SEQ ID NO: 4241859 - RNA, 59 nt, Neisseria meningitidis Z2491
auugauuuuucagacggcauuuuaaacaaaaagccgcgaaugccgucugaagaaucaau

SEQ ID NO: 4241860 - RNA, 60 nt, Neisseria meningitidis Z2491
aggcgguugucggcgugaugacggacgcaccggcggacggcaggaagccggcaaccgcuu

SEQ ID NO: 4241861 - RNA, 86 nt, Neisseria meningitidis Z2491
gccgcgccugcuucguccauuacaucgauggcuuugucgggcaggaaacgcucguugauguagcgggcggagaguucggcggcggc

SEQ ID NO: 4241862 - RNA, 77 nt, Neisseria meningitidis Z2491
gauaagguuuaagccgaauggacaaaugccgucugagcuguucggacggcauuuuuuauauuuggaaauuuccuguc

SEQ ID NO: 4241863 - RNA, 81 nt, Neisseria meningitidis Z2491
uucgcccagcuugugggucaaaccgguauagaacaaaauacguucugucgucgugguuuuacccgcaucgauaugggcgga

SEQ ID NO: 4241864 - RNA, 109 nt, Neisseria meningitidis Z2491
caaauugaugcgguugaugugagcuuggaugcuuuggaaguggcagggaucaaugucgaagauuaugguuuggaagaacgcauccggcuuauucauacggauuuguuug

SEQ ID NO: 4241865 - RNA, 84 nt, Neisseria meningitidis Z2491
ggcauuaccgguuaagacuacggugcugccugcagaugaauaagcaacguuguuugccuguccgcgcaccgugccuuugccgcc

SEQ ID NO: 4241866 - RNA, 72 nt, Neisseria meningitidis Z2491
ggcaagcgugccgucgaggucgaagaguacggcguguaucauguauguuccuuuucagacgguauuuuuguu

SEQ ID NO: 4241867 - RNA, 79 nt, Neisseria meningitidis Z2491
cauccugucaagcggucgcagaugggcgagaucgcauugccgaaagggaaauccgccgucagcgacaauuuugccgaug

SEQ ID NO: 4241868 - RNA, 69 nt, Neisseria meningitidis Z2491
aacagaauuauauucccaaaaagauaagguaauucuauuuccaaaguuuggugaauaugauuugguguu

SEQ ID NO: 4241869 - RNA, 128 nt, Neisseria meningitidis Z2491
ggcuucggcgauucgcguccgauguggaaaguguugcgcguauugggcaaccuguuugaccugaaagguuuugaauaccacgauaccgucgcgauucugaaagacgcgcuggaugcggaaagccugcc

SEQ ID NO: 4241870 - RNA, 76 nt, Neisseria meningitidis Z2491
cggcacgguacgaaaauaccgucugaaacccagauugucaggcuucagacggcauuuuuuguucaggcgguugccg

SEQ ID NO: 4241871 - RNA, 58 nt, Neisseria meningitidis Z2491
gguuuaaagcaaaaagcgaugguuucuaaugagaauguaucguuaagcggcuuaagcc

SEQ ID NO: 4241872 - RNA, 78 nt, Neisseria meningitidis Z2491
cuugucgacgaugggcagcauuucuuucgggcuugccuugguggcgggcaggaagcguguucccaucccugcgacggg

SEQ ID NO: 4241873 - RNA, 58 nt, Neisseria meningitidis Z2491
uuccgcguuggaaguuuuuggcggcgagcauuuugucgaagaguucuuucggcagggg

SEQ ID NO: 4241874 - RNA, 70 nt, Neisseria meningitidis Z2491
auuuucagccaguuuuccggugcggcuucgauaaagcauaucgggcuguuuucggaaagcgagagaaagu

SEQ ID NO: 4241875 - RNA, 121 nt, Neisseria meningitidis Z2491
cgucugaagguuuuucaauacgccgucaaagaguuguuuuucuaaggcgagggcuugcucuugagcagucagcacuuugucuucaaaggcuuucaguuccggcgugaugaagcguucggcg

SEQ ID NO: 4241876 - RNA, 55 nt, Neisseria meningitidis Z2491
uccggcggcacgauuacgcagcagaugcgccgugugggcuguucugccgacugga

SEQ ID NO: 4241877 - RNA, 93 nt, Neisseria meningitidis Z2491
ggcuuuggcaacgguggcaaucaggcucaaaugugccgcaucgcgguuggcggugcuggcgaaauagccuugcagugccgccucgcugcugcu

SEQ ID NO: 4241878 - RNA, 67 nt, Neisseria meningitidis Z2491
ugaggauugaaugaguaaaggccaucugaaaauaggauuucagacggccuuuuguauuuaggcuuua

SEQ ID NO: 4241879 - RNA, 57 nt, Neisseria meningitidis Z2491
ggcuguuuggauaccgccgguuccgguucguaccgaaucgacggcaucgaaacugcc

SEQ ID NO: 4241880 - RNA, 72 nt, Neisseria meningitidis Z2491
uauaguggauuaaauuuaaaccaguacggcaaggcgaggcaacgccguacugguuaaauuuaauccacuaua

SEQ ID NO: 4241881 - RNA, 69 nt, Neisseria meningitidis Z2491
uuuuggcgguaacgggggcuuugucgaaaucgaguucgauuuugaugucgccuuuguuggugugcagga

SEQ ID NO: 4241882 - RNA, 72 nt, Neisseria meningitidis Z2491
cugcaggcgcgccaguucgucguccaauuuauccacaguugucagcuugguuuugaauucgccgcuuugcag

SEQ ID NO: 4241883 - RNA, 122 nt, Neisseria meningitidis Z2491
cagcguuucgggacgggugguggcgacgaugacggcuucggcaggauuguccgccagcggauagcggaugugccacauagagccuuguucuuccacgcuuuccacuuccaaaucagacacug

SEQ ID NO: 4241884 - RNA, 60 nt, Neisseria meningitidis Z2491
ugccgucugaaacuggcccugcgucaaauuccaagcuguaaaauauaguuucagacggca

SEQ ID NO: 4241885 - RNA, 63 nt, Neisseria meningitidis Z2491
gauaucgucgguuucgaagauuuggcugcugaaaucaaagcaggcaaucugaacuuugauguc

SEQ ID NO: 4241886 - RNA, 83 nt, Neisseria meningitidis Z2491
uuacucucggaacugucuauccaucaucauaaacguaauggaguagucuuagagugguaugaagaugguucuaaaaagaguga

SEQ ID NO: 4241887 - RNA, 59 nt, Neisseria meningitidis Z2491
augccgucugaacggcggcuuuauuguuguucgggcaaauccgccuuuucagacggcau

SEQ ID NO: 4241888 - RNA, 89 nt, Neisseria meningitidis Z2491
gccacuucgcaggcgggggcgcagguugccuugcgccgggcggauuuggcacgcgcacaggaugauuugcgccgccggucugcuuuggc

SEQ ID NO: 4241889 - RNA, 60 nt, Neisseria meningitidis Z2491
agcagcuugggucuuggugucaucgccggugucgguuucgacaucacgcccaagcugacu

SEQ ID NO: 4241890 - RNA, 67 nt, Neisseria meningitidis Z2491
gguuuccgcgccgcauuugucauuacccguauauuuauggaugguuacaaaggcgguacgcaauacc

SEQ ID NO: 4241891 - RNA, 60 nt, Neisseria meningitidis Z2491; identical to SEQ ID NO: 4241668

SEQ ID NO: 4241892 - RNA, 71 nt, Neisseria meningitidis Z2491
guacuaccaaguuggaaaucaguguuuagagcagaaucaggccgaaaacgucuauuucagcuugguaguac

SEQ ID NO: 4241893 - RNA, 66 nt, Neisseria meningitidis Z2491
uggauuuggguuuggacggcgugauggaauacacgaaaaccaucgggcuguauaaaaccaagucca

SEQ ID NO: 4241894 - RNA, 66 nt, Neisseria meningitidis Z2491
gcggcaguucgcucaaaucgacgccggcuucaucagcauggcgcacggcuugggcgacgacuucgu

SEQ ID NO: 4241895 - RNA, 56 nt, Neisseria meningitidis Z2491
gguaacggguuucuuuaugucgggcgaacucaucggcauggacggcaucuguuccc

SEQ ID NO: 4241896 - RNA, 83 nt, Neisseria meningitidis Z2491
ggcgguaucggcaagcgucucgccuuuuuuggcacugguauucgcgccguccgagaaaccgaugaccuugccgcccaaacgcu

SEQ ID NO: 4241897 - RNA, 77 nt, Neisseria meningitidis Z2491
ggaaugcccguaaaaugcucgauaccgauacgcggcaaaauacccgucguuuccuuauccagcauaucgcccguuuc

SEQ ID NO: 4241898 - RNA, 74 nt, Neisseria meningitidis Z2491
uauugucggcgaguuucacgcggcaauguaugaggcggcgaaaucgggcaaaucguuugaggcuuggcgcgaug

SEQ ID NO: 4241899 - RNA, 99 nt, Neisseria meningitidis Z2491
gagguauuggucgaauauguccgcaagcugucccgcaagcugguaaucugccgauucgccgcugcccagauagucuugcagcacauuccucacaucuuc

SEQ ID NO: 4241900 - RNA, 78 nt, Neisseria meningitidis Z2491
cgggcgugccggcgggauauuuuugacggacggcggucuugccguugccgucuugauaaguuucccacgcgcagcccg

SEQ ID NO: 4241901 - RNA, 55 nt, Neisseria meningitidis Z2491
gaaaccuaaaaucccgucauucccacgaaagugggaauccaguuuuuugaguuuc

SEQ ID NO: 4241902 - RNA, 56 nt, Neisseria meningitidis Z2491
cauccgguuuugcgcuguacgauguguuuuagcgcggacuugcucaaaaucggaug

SEQ ID NO: 4241903 - RNA, 76 nt, Neisseria meningitidis Z2491
acggcauuuuuuauauuuggaaauuuccugucagauaauguuuauccacagauuuuuccauaugguuugaugcugu

SEQ ID NO: 4241904 - RNA, 55 nt, Neisseria meningitidis Z2491
ugaaagucaaaugccgucugaaacaaacacgcuucagacggcauuuucauucuca

SEQ ID NO: 4241905 - RNA, 61 nt, Neisseria meningitidis Z2491
cuguuugaaagacagacaagauaauguuuugaacauuguccugucgguuucuuugaagcag

SEQ ID NO: 4241906 - RNA, 65 nt, Neisseria meningitidis Z2491
gccguagccaucguugcugccgaacagguugacguaaccguguucgcgguauugguggaaauggu

SEQ ID NO: 4241907 - RNA, 65 nt, Neisseria meningitidis Z2491
uuauccgcgcaaaacagccguuuuucuuuaaaacacuugaacuaacacuguuuuucgugguauaa

SEQ ID NO: 4241908 - RNA, 59 nt, Neisseria meningitidis Z2491
ggguguggaaaugccgucugaagcggucaaaugacguuucagacggcauuuuuaugccc

SEQ ID NO: 4241909 - RNA, 69 nt, Neisseria meningitidis Z2491
gggucaguugcguguagcucauggcaaucuuucuugcaggaaaggccguaugcuaccgcauacuggccu

SEQ ID NO: 4241910 - RNA, 67 nt, Neisseria meningitidis Z2491
gcggcgcaaaugccgucugaagcgguuuccguaugaccggcccggcuuucagacggcauaccgccgc

SEQ ID NO: 4241911 - RNA, 57 nt, Neisseria meningitidis Z2491
gcaacgcuuggauuugccgugcauugaaaauggcggcaucgauuuucaggcgguugc

SEQ ID NO: 4241912 - RNA, 64 nt, Neisseria meningitidis Z2491
augccgccgaguacgaauuuuuucaacaucauucucuccuguaaaaagugugcaagugcggcau

SEQ ID NO: 4241913 - RNA, 101 nt, Neisseria meningitidis Z2491
ugcacgauuuugcggaaacguugguaugcccugucaucuguacacagagugucgccguggcagaugaggguuuugcagccgaacaaguccaaaaccgagua

SEQ ID NO: 4241914 - RNA, 91 nt, Neisseria meningitidis Z2491
ccuguucgguaucagcgcgauggguaucuuuaugaaccgcaaaaacgugcuggucuugcugauguccaucgagcugaugcuuuuggcagug

SEQ ID NO: 4241915 - RNA, 77 nt, Neisseria meningitidis Z2491
guguuguacggcgugucgcggcgcaggucggcuuuacggauuuugcccuuguaugccgcacccaugccguaaaucac

SEQ ID NO: 4241916 - RNA, 58 nt, Neisseria meningitidis Z2491
ccggcauuugacccgcaacaauauccugcaagauuuauuguguacgcauaaaugccgg

SEQ ID NO: 4241917 - RNA, 56 nt, Neisseria meningitidis Z2491
cgguacgaguuuggcggaaaugcauccugcuucggguuuuaccgccgaacuguccg

SEQ ID NO: 4241918 - RNA, 100 nt, Neisseria meningitidis Z2491
ucugaaacucggggacucagacggcauuuuguauccaaacgguaacuaauguauccgcacuuuguuauagaauggcugcuguuuuuucuucguaauuaga

SEQ ID NO: 4241919 - RNA, 69 nt, Neisseria meningitidis Z2491
ggcggaaaguucgguugccaaaacccagccuaucugccgggcugcgguuucggcggcggacgcgccguc

SEQ ID NO: 4241920 - RNA, 57 nt, Neisseria meningitidis Z2491
uugggagaaagggcugaaugagaacaccaacggacucauccggcaauacuuccccaa

SEQ ID NO: 4241921 - RNA, 55 nt, Neisseria meningitidis Z2491
cauugaaaccuucagacggcaucguugaaaugccgucugaaaaccauuucacuug

SEQ ID NO: 4241922 - RNA, 116 nt, Neisseria meningitidis Z2491
gacggucaaaaccuguucgccggcgacggcuaugccgguuugagcgacaccgcccuuuauuacaucggcggcaucaucaaacacgccaaagcccugaacgcgauuaccaauccguc

SEQ ID NO: 4241923 - RNA, 76 nt, Neisseria meningitidis Z2491
cuggauucccacuuucgugggaaugacgcgaacagaaaccucaaaucccgucauucccgcgcaggcgggaaucuag

SEQ ID NO: 4241924 - RNA, 98 nt, Neisseria meningitidis Z2491
auccuuugaacguaacgggcagggucuucguucugucugaccguuucgucgauguuggcaggcagcuugacgaccugauagcccaacugugucaggau

SEQ ID NO: 4241925 - RNA, 67 nt, Neisseria meningitidis Z2491
ggcggcaaguacggcaucggcuuugccuucgguuaugccuucaaucaggugccggacauugccgacc

SEQ ID NO: 4241926 - RNA, 98 nt, Neisseria meningitidis Z2491
uugggcgaagucgccgcccauuugaacggcaucgaaccuuuggcgcaaaccgaaugccaaguuccucagaugccguuugaacauggcggacaaccuga

SEQ ID NO: 4241927 - RNA, 68 nt, Neisseria meningitidis Z2491
gcgcgguaagcguagaugccgauauggcgcaggacggcgguuucagacggcauuucgcguuuuccggc

SEQ ID NO: 4241928 - RNA, 56 nt, Neisseria meningitidis Z2491
ugggaggcugagaugguucaggcuuuggaugacgauccugacgaacuugccuucca

SEQ ID NO: 4241929 - RNA, 61 nt, Neisseria meningitidis Z2491
gcgguagaaaaugccgucugaaacuuauccgcaggcaggguucggacggcauuuuugaugc

SEQ ID NO: 4241930 - RNA, 64 nt, Neisseria meningitidis Z2491
gcacgucugcaauaguguucaugaguuguuuuuccuuaauauucauguaauuguugagaugugu

SEQ ID NO: 4241931 - RNA, 70 nt, Neisseria meningitidis Z2491
gcguggaucccgaaacgcaauuggucgaaagcuauaugcugaacgauguguugcgguuuugggacagcgc

SEQ ID NO: 4241932 - RNA, 107 nt, Neisseria meningitidis Z2491
augcggcagguuugcaugaugugcuuggacuugguuuuauacagcccgaugguuuucguguauuccaucacgccguccaaacccaaauccagcaucgccugcggcgu

SEQ ID NO: 4241933 - RNA, 66 nt, Neisseria meningitidis Z2491
ggcuuuggcguguuugaugaugccgccgauguaauaaagggcggugucgcucaaaccggcauagcc

SEQ ID NO: 4241934 - RNA, 76 nt, Neisseria meningitidis Z2491
ucggaaucguggucggcaagccagucgaugggggcgaaacuguccucgucgucgcuguugucugccaugauggcga

SEQ ID NO: 4241935 - RNA, 100 nt, Neisseria meningitidis Z2491
gggcgugccgagucggacggcaggcaggccgccgccuuugugcauaaugucggcaacgcgcaaaaguaggcguuugccgaggcugccggcaggguggcuc

SEQ ID NO: 4241936 - RNA, 63 nt, Neisseria meningitidis Z2491
cccggaaaucuugcugcgguaacgcgcgacgcuuucgggcgugcagcggcaggguuugacggg

SEQ ID NO: 4241937 - RNA, 56 nt, Neisseria meningitidis Z2491
cggucggaauaaagccugcgccgaugccuugaaucgggugcgggccuuuuucgccg

SEQ ID NO: 4241938 - RNA, 58 nt, Neisseria meningitidis Z2491
ucggcggugcggucgaugaguucgggggcaaucagcggcucgucgcccuguacguuga

SEQ ID NO: 4241939 - RNA, 72 nt, Neisseria meningitidis Z2491
uucgacgcggaugucuuggauggugaagucggcaagugccaaaggcgauaugcccaagaccaucagugcgga

SEQ ID NO: 4241940 - RNA, 70 nt, Neisseria meningitidis Z2491
uccagcgcggcuuguuugacgggcggggcagucaguugcauaccgcgcccuuucggacggucgggcuggg

SEQ ID NO: 4241941 - RNA, 113 nt, Neisseria meningitidis Z2491
ggauucccgccugcgcgggaaugacgaauuuuagguuucuguuuuugguuuucuguuuuuuccgauaaaugccgcaaccucaaaucccgucauucccgcgcaggcgggaaucu

SEQ ID NO: 4241942 - RNA, 69 nt, Neisseria meningitidis Z2491
aggcgcauaucuaaagcggcggaaaucgucgucccccugauggcgguuuuguaccucuuuaucgcgcuu

SEQ ID NO: 4241943 - RNA, 107 nt, Neisseria meningitidis Z2491
ucgucauucucgcgaaagcgggaauccagguucguugaguuucggucauuuccgauaaauucuugcaacuuugcguuucuagauucccacuuucgugggaaugacgg

SEQ ID NO: 4241944 - RNA, 92 nt, Neisseria meningitidis Z2491
guuucggagccggcgggguaauuuaacaggcgguauuguacgcgcaaaaauucguccauaaccgccuguuggauuuccagccgcuuugaaac

SEQ ID NO: 4241945 - RNA, 77 nt, Neisseria meningitidis Z2491
gcggcgcggucagccccugcgucagcauuucggggaaaucuucauccugaagcagcaucaggcggcauccgucccgc

SEQ ID NO: 4241946 - RNA, 68 nt, Neisseria meningitidis Z2491
guuuagagguucuagauucccguuuucacgggaaugacgaaagguugugggaauccagaccuuugggc

SEQ ID NO: 4241947 - RNA, 56 nt, Neisseria meningitidis Z2491
ugccagcgucuguuuuucgccguccauuuccacgccgaaagauuuugaccugugca

SEQ ID NO: 4241948 - RNA, 85 nt, Neisseria meningitidis Z2491
gacggcaggugcuuggugucgauuucguugccgcugucggcggugacgucggcgucgguggcggcgucgcgcuuaaccggcuguc

SEQ ID NO: 4241949 - RNA, 65 nt, Neisseria meningitidis Z2491
ccgugaaauugcguucgcugacgguauagcccaaaucuuuggcaaccgucaguacggaaucgcgg

SEQ ID NO: 4241950 - RNA, 69 nt, Neisseria meningitidis Z2491
ccucgucuccgccaucaucgccgccugcaucgugcuauccgcgaugcgcggcgugauugcggaggcugg

SEQ ID NO: 4241951 - RNA, 57 nt, Neisseria meningitidis Z2491
aaagccguagguuacuuugacuuuuuuaccuugcuggcagacguagcugacgguuuu

SEQ ID NO: 4241952 - RNA, 72 nt, Neisseria meningitidis Z2491; identical to SEQ ID NO: 4241677

SEQ ID NO: 4241953 - RNA, 130 nt, Neisseria meningitidis Z2491
gacaugcccaaccgcgucauucccgcgcaggcgggaauccagaccuugauuuaucaggaauauuuaaaaauugcagcaauuccaaaucucuggauucccgccugcgcggaaaggacgguuuagagcgucc

SEQ ID NO: 4241954 - RNA, 60 nt, Neisseria meningitidis Z2491
ggcgaagcgcaaccaagcuuugcccugccugaaaaauacgcaggcuuggaccgcuuugcc

SEQ ID NO: 4241955 - RNA, 60 nt, Neisseria meningitidis Z2491
ggcgcgcaggcauugguugacguugccucugccgacgaagucagcggugucaugugcgcc

SEQ ID NO: 4241956 - RNA, 64 nt, Neisseria meningitidis Z2491
cgccguuauccgcuggaguaucgacggguggcagccuaaauccgaacccggcgcgauggcggcg

SEQ ID NO: 4241957 - RNA, 61 nt, Neisseria meningitidis Z2491
ggcggcuugcgcggcggcggugguggcuuggauuuucgaacuguuguugggcagugccgcc

SEQ ID NO: 4241958 - RNA, 90 nt, Neisseria meningitidis Z2491
gucggcguugcggacgggcgauuugucaaaagcgaugccggcgcgcaguugcagcgguucgcugauuugauaagaaccgccgaagccgac

SEQ ID NO: 4241959 - RNA, 55 nt, Neisseria meningitidis Z2491
uaaaaucaugccgucugaaaacggggaugcgguuuucagacggcauuggguuuug

SEQ ID NO: 4241960 - RNA, 65 nt, Neisseria meningitidis Z2491; identical to SEQ ID NO: 4241683

SEQ ID NO: 4241961 - RNA, 64 nt, Neisseria meningitidis Z2491
gcggauaaccuugucgauaaacugguccacauacaaaaccguauugucguaaguguugaccagc

SEQ ID NO: 4241962 - RNA, 72 nt, Neisseria meningitidis Z2491
uuugcagauauugcgcgccugcauccguuuguaaaaaaaauccaugugaugaaauggcggcaauggcgcaaa

SEQ ID NO: 4241963 - RNA, 67 nt, Pseudomonas aeruginosa PA01
gccaggaaaucgccuucgccagcgagcgcgacgggcgucccgccgccuucgaaggcuguagccuggc

SEQ ID NO: 4241964 - RNA, 72 nt, Pseudomonas aeruginosa PA01
gacccgaucgagguuuuccgcguagucggugaccaccacgguguuguuccccggauaggcauugaucggguu

SEQ ID NO: 4241965 - RNA, 90 nt, Pseudomonas aeruginosa PA01
ggucuugcugucgucggugcugcuguucaugucgacggugaugacguugccgucguccaucucgcagcggucguugacgaucagcggacc

SEQ ID NO: 4241966 - RNA, 76 nt, Pseudomonas aeruginosa PA01
cagcgagaccuucaagaccuggaccgcgauggagaccauccucuccguggucggccuggucuucauccuguugcug

SEQ ID NO: 4241967 - RNA, 68 nt, Pseudomonas aeruginosa PA01
cggcgaguugcgcgaggcguucgucgaccugcggguuggucggcaccagggcuucgcgcagauagucg

SEQ ID NO: 4241968 - RNA, 56 nt, Pseudomonas aeruginosa PA01
cggaggggccguaggggcuuucguugaaauccaggaaggucucuugcggcuugccg

SEQ ID NO: 4241969 - RNA, 68 nt, Pseudomonas aeruginosa PA01
gcggccgcuggaggagguaaggguaacgaucagcuggaugcuguccgccgccuucuccacguagaugc

SEQ ID NO: 4241970 - RNA, 80 nt, Pseudomonas aeruginosa PA01
gggccucgaugagcgugcggaucaggcgcuugcgccgucgcaacaacuccggcagccugcccagcacuucuaccaggccc

SEQ ID NO: 4241971 - RNA, 57 nt, Pseudomonas aeruginosa PA01
auggaaugaaccgcugacggcccccgcgaagggggccgucguaccugcgcauuccau

SEQ ID NO: 4241972 - RNA, 68 nt, Pseudomonas aeruginosa PA01
cggcgcgacugucggucuggaagccuuccugccaggucaggucgaucuccggcccguaguugcgcacg

SEQ ID NO: 4241973 - RNA, 107 nt, Pseudomonas aeruginosa PA01
guccgaagcgucgcugagaggggcuaccuggcaagacugggcgucgccgcacgcccggauuugcugguagccuugguugaauucgcaguaauggaucgcacaugggc

SEQ ID NO: 4241974 - RNA, 77 nt, Pseudomonas aeruginosa PA01
gaggcuguccggggucggguuggcugggguguuccggcucaugccauccugcucgaucacggccugguucauguuuc

SEQ ID NO: 4241975 - RNA, 62 nt, Pseudomonas aeruginosa PA01
ccccgacugcucgaacaugugccacgaagccagcggcguggcacugggccgcagcgucgggg

SEQ ID NO: 4241976 - RNA, 61 nt, Pseudomonas aeruginosa PA01
ggugauguucugccugauggacgucuccggcucgaugacccaggcgaccaaggacaucgcc

SEQ ID NO: 4241977 - RNA, 56 nt, Pseudomonas aeruginosa PA01
gucguucggugaucaaccugaucaacgcccagucgaucaagggugagaugagcgac

SEQ ID NO: 4241978 - RNA, 127 nt, Pseudomonas aeruginosa PA01
gcagccgccacccagggccaggccguugaucgcggcgaugaacaccuuguccaugcggcgcaugugcgcggugaccucauggaacagguucaugucggcgacgccugccagcagggugcgccgcagc

SEQ ID NO: 4241979 - RNA, 83 nt, Pseudomonas aeruginosa PA01
ccgggguggcgccaugggcuucgcggaagcgccgguugaaauggcucggacuggcgaagccgcaggccagcgagaccuccugg

SEQ ID NO: 4241980 - RNA, 64 nt, Pseudomonas aeruginosa PA01
ggucgaccugaucguggacgggggcuauggcggcggcgaggccuccaccgugaucagccugacc

SEQ ID NO: 4241981 - RNA, 56 nt, Pseudomonas aeruginosa PA01
ugggcgacggcggcggcgaggugcucuccuaccaucgccucagcaugcaucgcccg

SEQ ID NO: 4241982 - RNA, 69 nt, Pseudomonas aeruginosa PA01
ucggugcgcugguggucgagcagcacccgggcguugucggcguagcugcggaucgccgccagcggcugg

SEQ ID NO: 4241983 - RNA, 82 nt, Pseudomonas aeruginosa PA01
guucgccguuucgcgccaggacaagcgcaaccccaacgacgccgaccggcugcgcaaguaccuggcgcguuucggccuggac

SEQ ID NO: 4241984 - RNA, 58 nt, Pseudomonas aeruginosa PA01
cggguaggccagcgguauccauggggccuguucguggaauaccaccugggccugcucg

SEQ ID NO: 4241985 - RNA, 55 nt, Pseudomonas aeruginosa PA01
cuuguuggugaagucgaccgaacgcuugcgcucgucggugauggucaucgacgag

SEQ ID NO: 4241986 - RNA, 86 nt, Pseudomonas aeruginosa PA01
gccacggugcucgccggguucuuccacuaugugcgcgucggucccaaccgcgcggacgacgaggaagaccacgggcaagccgaggc

SEQ ID NO: 4241987 - RNA, 68 nt, Pseudomonas aeruginosa PA01
guguacuuguccacgccguagcgcgcggccaccuggucgagcagcuugucgugcugggcgagcaucgc

SEQ ID NO: 4241988 - RNA, 65 nt, Pseudomonas aeruginosa PA01
ucccauuugaucgcauccagcacgcggaucggcgucugcgccucgacgaugcgaucggacaggga

SEQ ID NO: 4241989 - RNA, 58 nt, Pseudomonas aeruginosa PA01
gagcucgcucuggaugcgcguccgcacaugcuggaagaccgccaucagcgcgggcauc

SEQ ID NO: 4241990 - RNA, 74 nt, Pseudomonas aeruginosa PA01
gccggccuggaucgccuugcgcauggugaugggccugggccugaugugccaguacauggugaucgagagcuggc

SEQ ID NO: 4241991 - RNA, 62 nt, Pseudomonas aeruginosa PA01
cggcgggguguacaccacgguggucugggaaccgcgaccggcguugaugucgccuuccgccg

SEQ ID NO: 4241992 - RNA, 104 nt, Pseudomonas aeruginosa PA01
aacgccgaucgcggccugugcgggcccggcgauccggacaugcacguggccaagcgccuguacuggaugcgccagggcacuccgcacaccuccgagcggcuguu

SEQ ID NO: 4241993 - RNA, 77 nt, Pseudomonas aeruginosa PA01
ccagggcuuguucagcgccagguagaagaucccgcccagcagggugaggcugaggacgcugagcaggcccuugccgg

SEQ ID NO: 4241994 - RNA, 87 nt, Pseudomonas aeruginosa PA01
ggugaagcgcucggucaccgucaguucgcggcgcagcucgaugcccauccaggugccgccggccggcggugccucgcagcgcucgcc

SEQ ID NO: 4241995 - RNA, 73 nt, Pseudomonas aeruginosa PA01
ggccuggaauacgugucgaucaccaccauccacucggcgaugaacgaccagccggugaucgacgccuaccacc

SEQ ID NO: 4241996 - RNA, 64 nt, Pseudomonas aeruginosa PA01
guggcaguugcccaugcggauggucagguugcgguucaucgccaggccgaugggaaacugccgc

SEQ ID NO: 4241997 - RNA, 55 nt, Pseudomonas aeruginosa PA01
ucgccgugcucggcggcgacggcacgcacaaggcaguggccgccgaggucggcga

SEQ ID NO: 4241998 - RNA, 65 nt, Pseudomonas aeruginosa PA01
gggucgguccggcggugcggaggaagccgaccacuuccuucaucugcucgccgcgaccggcgacc

SEQ ID NO: 4241999 - RNA, 67 nt, Pseudomonas aeruginosa PA01
gcaaagcuggaagaucaccuguucgaucccgccuaccguuucgcucagguaggucuuguagaagugc

SEQ ID NO: 4242000 - RNA, 64 nt, Pseudomonas aeruginosa PA01
agcaugccguugcucaggacgauucgcaucggaugaucguagccguguccgagccauggaugcu

SEQ ID NO: 4242001 - RNA, 75 nt, Pseudomonas aeruginosa PA01
ucagcgccaaccucugcggauuggaagaugucuggcuggauggccguaccuuccaggccgacagcggcgaccuga

SEQ ID NO: 4242002 - RNA, 64 nt, Pseudomonas aeruginosa PA01
gccgguguucgacaggacucgcugcaagccuuccaguacgcuguagcgacccuugagcgccggc

SEQ ID NO: 4242003 - RNA, 57 nt, Pseudomonas aeruginosa PA01
gcuggcgccguugcccaguaccagcaauuugcuggugcuggcgcaacuggcgucggu

SEQ ID NO: 4242004 - RNA, 60 nt, Pseudomonas aeruginosa PA01
ggcgaaaccuucugggcgcgcaucagcgugucgcuggugcgcgacgaggagggagucgcc

SEQ ID NO: 4242005 - RNA, 115 nt, Pseudomonas aeruginosa PA01
ucgugggcauccuuggcggcgagcaacugcuguucgaggaccuuggcgucgucgaccagggcgaagcgggucuugaguaccgacagcucgccgagccagcgcuggaugccggcga

SEQ ID NO: 4242006 - RNA, 108 nt, Pseudomonas aeruginosa PA01
uugcuucggcaucuucgucacccuucucgggcuggugaccaaccugggcaucggcgccuugcaggugucguccggucucgaguaccugaccggcaugccgcacagcaa

SEQ ID NO: 4242007 - RNA, 65 nt, Pseudomonas aeruginosa PA01
gccgcgccuguacgauuaccucuaccaguugcgcagcaagcacaaggugcucgaccaggugcgcc

SEQ ID NO: 4242008 - RNA, 71 nt, Pseudomonas aeruginosa PA01
gcgagcugucgaaggucuccugggcccuccacguauucgucgcgcggcccucgaagauccucauggccugc

SEQ ID NO: 4242009 - RNA, 64 nt, Pseudomonas aeruginosa PA01
ucgcgcauucgggucggggucuccaucgugcagauccucgacggacucgaccacgaacgcguga

SEQ ID NO: 4242010 - RNA, 76 nt, Pseudomonas aeruginosa PA01
ucuggcgcuacuacaugcucucgcccuggacccgcgaugcccgggugcgggccgacgugguggugguggcgccgga

SEQ ID NO: 4242011 - RNA, 69 nt, Pseudomonas aeruginosa PA01
gggcgguuuccucgaugucgccgcccuugguggcgcgcgccgaguugaugucgauggaaaccagggccu

SEQ ID NO: 4242012 - RNA, 73 nt, Pseudomonas aeruginosa PA01
gaagggcaagguggccaagcuggucugccccuaccaccaguggaccuacgagcuggauggccgccugcuguuc

SEQ ID NO: 4242013 - RNA, 61 nt, Pseudomonas aeruginosa PA01
caggcucagguaauagcugggcaccgagacauagaucgacugcucggcgauaucgagcuug

SEQ ID NO: 4242014 - RNA, 68 nt, Pseudomonas aeruginosa PA01
ccugcucgaagucggcgccgucuccgugaccuucauggacgccgaagaccagccgaucuucgagccgg

SEQ ID NO: 4242015 - RNA, 66 nt, Pseudomonas aeruginosa PA01
cgguguucaucugcuggguguccaccagcgcgccgacguugguuuccggauccagcggguugcccg

SEQ ID NO: 4242016 - RNA, 77 nt, Pseudomonas aeruginosa PA01
ccagugcaucgcccugucccuggccggcauccuguuccucaacccgaucgucgccgcggcggcggggcuggcgcugg

SEQ ID NO: 4242017 - RNA, 96 nt, Pseudomonas aeruginosa PA01
gcggcgaucagcucgcgcaggcgcgccucgccggccgggucgccguagcccaggcaguccgccggcggguugcgccagaagcgcgccuguagccgc

SEQ ID NO: 4242018 - RNA, 81 nt, Pseudomonas aeruginosa PA01
cgcggcuaguuugccgcaauccccggagggccgcaaaagaacgcaacgcguccuacggcgaacggcggcgaacagguugcg

SEQ ID NO: 4242019 - RNA, 68 nt, Pseudomonas aeruginosa PA01
uggccgcgcuggcggaggaggaagucggcgccggcgcgcagguguuccuccaguugccggcgcgaacg

SEQ ID NO: 4242020 - RNA, 60 nt, Pseudomonas aeruginosa PA01
uguuccggacgggcucggcgagggcggccucaaggucgacgccucgcugccguucgagca

SEQ ID NO: 4242021 - RNA, 84 nt, Pseudomonas aeruginosa PA01
ggcgaucacgcccuggccgcgcaccagaucgccauccaggcgguauacguggcguucauggugccggugggguugucguacgcc

SEQ ID NO: 4242022 - RNA, 80 nt, Pseudomonas aeruginosa PA01
ugucuaccgggcggugucgaagcagauccaugcgaucuuccgcgauuauaccgaucugaucgagccgcuuucgcuggacg

SEQ ID NO: 4242023 - RNA, 100 nt, Pseudomonas aeruginosa PA01
agggccugccgcagccggaugcgagccuguugcagcaggucuacguggcgccgcgaagcgaucuggagcaacaggucgcggggaucugggcggagguccu

SEQ ID NO: 4242024 - RNA, 71 nt, Pseudomonas aeruginosa PA01
gguugucgaugugccgcgagccgcugauauggccgacagcgaagcucugcgggucgcggaugucgaccacc

SEQ ID NO: 4242025 - RNA, 57 nt, Pseudomonas aeruginosa PA01
ucuccaguucggugcggguuugguagggaaugccgguccagaacgccgaacugguga

SEQ ID NO: 4242026 - RNA, 69 nt, Pseudomonas aeruginosa PA01
ucagguucuucggguucucggcgauguccuugggcguggccagggcguuguucggauccuucaacuuga

SEQ ID NO: 4242027 - RNA, 57 nt, Pseudomonas aeruginosa PA01
ugccgaccaucguggugguggucgacgaauucgccgacaugaugaugaucgucggca

SEQ ID NO: 4242028 - RNA, 68 nt, Pseudomonas aeruginosa PA01
uugcaccugugccuggucugccucgaacgccugcucggcgaggcgagggcggccgggcgcagcgucga

SEQ ID NO: 4242029 - RNA, 76 nt, Pseudomonas aeruginosa PA01
gcgcucaacgcggccaucgaggcggcccgugccggcgaggccggacguggcuuugcgguggucgccgacgaagugc

SEQ ID NO: 4242030 - RNA, 97 nt, Pseudomonas aeruginosa PA01
ggcguccguggccagcggcgcggacaguugggaagacugguggcaacgcgccgcgcagaucccccggcuggccccgcugaaggcgcagcgcgacgcc

SEQ ID NO: 4242031 - RNA, 73 nt, Pseudomonas aeruginosa PA01
gcggcgugcaggccgccugugccgccggcgcgaccugcguggcgaucggcgaggagagcggccugcucgccgc

SEQ ID NO: 4242032 - RNA, 66 nt, Pseudomonas aeruginosa PA01
cggggcuggcguugcugccgucguucgcccaggcggaguuuuuugccgacggcaaggccggccucg

SEQ ID NO: 4242033 - RNA, 72 nt, Pseudomonas aeruginosa PA01
gccgaaacgcgccagguacuugcgcagccggucggcgucguugggguugcgcuuguccuggcgcgaaacggc

SEQ ID NO: 4242034 - RNA, 81 nt, Pseudomonas aeruginosa PA01
ccgcgcgaaccgcgcucgaacaccggcuugagggugccgaucuucuccaggucgauauccgggcgcagguucuggucgcgg

SEQ ID NO: 4242035 - RNA, 58 nt, Pseudomonas aeruginosa PA01
gcgucggccaggaggugguacgccagacccuggagcggaucgagcgacuggccgaggc

SEQ ID NO: 4242036 - RNA, 58 nt, Pseudomonas aeruginosa PA01
gucgauccucaaggucaggcugucggacuccaugcccggcuuguccagcagggucagc

SEQ ID NO: 4242037 - RNA, 105 nt, Pseudomonas aeruginosa PA01
gcucaugcgcuugccgucgcgcaggaacaguucgacgcccagguccuccucgagcuggcggauccgcguggugacguucgacugcgcucgcugcaaccgcugagc

SEQ ID NO: 4242038 - RNA, 78 nt, Pseudomonas aeruginosa PA01
gccggcaggguggcgcuggcuuccuugaccagggcguucaucacgcugaaggugaaggacgccagcaccgccagcagc

SEQ ID NO: 4242039 - RNA, 69 nt, Pseudomonas aeruginosa PA01
uagggcuggccgccagggcgccuccagccggccgaaagcacggccggggcgcccuggcggucaggccug

SEQ ID NO: 4242040 - RNA, 55 nt, Pseudomonas aeruginosa PA01
gauccccugggcgucguugcgggucagcgccagcagcgccggccccauggggauc

SEQ ID NO: 4242041 - RNA, 57 nt, Pseudomonas aeruginosa PA01
cgggucgacggccacgaccgcccggacucccgcgagcgggucgaugccaucggcccg

SEQ ID NO: 4242042 - RNA, 59 nt, Pseudomonas aeruginosa PA01
uucgccaagcugcugcccuggcuggagcaguugaacgggcagggcgugcagguggcgga

SEQ ID NO: 4242043 - RNA, 57 nt, Pseudomonas aeruginosa PA01
ggaugccgccaugccgcagcaggcugucgcgcagcccugcgccggcggcggcgaucc

SEQ ID NO: 4242044 - RNA, 57 nt, Pseudomonas aeruginosa PA01
cgcggugaucgcccacaugaucggggaaaucuucgacgacagcgccgaucagccgcg

SEQ ID NO: 4242045 - RNA, 57 nt, Pseudomonas aeruginosa PA01
cggcguugcugguggcccagggcggcuaccugcugacccugacccgaggcuacgccg

SEQ ID NO: 4242046 - RNA, 68 nt, Pseudomonas aeruginosa PA01
ggcgauguugucggcgacggucuucgaggacagcagguugaagugcuggaagaucaucccgacgcgcu

SEQ ID NO: 4242047 - RNA, 61 nt, Pseudomonas aeruginosa PA01
uucugcgcgugcagcaccggcacgucgaccacuuccuugaugccggccgccaggugcagga

SEQ ID NO: 4242048 - RNA, 79 nt, Pseudomonas aeruginosa PA01
cggcgucaucgcgccauggucgaccaggaacagcgccugccggugaucguccagggccaucaccacggcgcggccgccg

SEQ ID NO: 4242049 - RNA, 70 nt, Pseudomonas aeruginosa PA01
gucaggacgccuccuucacguugcgcgagggguugccggccuggcgcgcggcggagggauggacgaugac

SEQ ID NO: 4242050 - RNA, 57 nt, Pseudomonas aeruginosa PA01
cgccgcuggucgaggccguacugcucgagcaguggugcgggcucgacgccggcggcg

SEQ ID NO: 4242051 - RNA, 65 nt, Pseudomonas aeruginosa PA01
ccucgaggaaggcguccuggauuucgccgaggaguuccucgggcagauccagcgccugcuccagg

SEQ ID NO: 4242052 - RNA, 71 nt, Pseudomonas aeruginosa PA01
gcuucaguugccagcucgauucaucgcagcgcugcuugagcuccugcagacgcuguucgaucugcugaagc

SEQ ID NO: 4242053 - RNA, 117 nt, Pseudomonas aeruginosa PA01
cgccuucaccgccccaucguccagcaccagggugccgcgcaucugcaaguggccggccagccauugcuugcgcgccgccuugcgacugcgaucaggggucaacagggugccgaggcg

SEQ ID NO: 4242054 - RNA, 87 nt, Pseudomonas aeruginosa PA01
cugcugcuugagccacagcugggucagccgccaggucugcccgcggccccagaccuccugcaccgagcugaugugcccggcacgcgg

SEQ ID NO: 4242055 - RNA, 60 nt, Pseudomonas aeruginosa PA01
acgggggccucgcgguagcaugcgggccauugcauagcuggcuaaccaagggguucccgu

SEQ ID NO: 4242056 - RNA, 64 nt, Pseudomonas aeruginosa PA01
guuguagccgauggcggugucgucgcccuugauguugaucuugguaucgccguugcugccgagc

SEQ ID NO: 4242057 - RNA, 57 nt, Pseudomonas aeruginosa PA01
gucgguuuccaccuugcuacccgccggaacgcucagggucgggccggugaaaccgac

SEQ ID NO: 4242058 - RNA, 58 nt, Pseudomonas aeruginosa PA01
agaccgacgaucagugcgcggcugcgcuucaggcgcagcuggcccucgacgucgaccu

SEQ ID NO: 4242059 - RNA, 61 nt, Pseudomonas aeruginosa PA01
gaucagcgccacgguggcgccggugauugaggcggugcgggugccgccgucggccuggauc

SEQ ID NO: 4242060 - RNA, 92 nt, Pseudomonas aeruginosa PA01
gguugaccauguacaggaucaucuccggcgaacucaggugcgccagccgcauggucgccugcaagucgucguggcgguugucccggucggcc

SEQ ID NO: 4242061 - RNA, 81 nt, Pseudomonas aeruginosa PA01
cuggcgcacgaucaccgcgauggugcccagcgcggcgcccagcgccagcgcgccgacgucgcccaugaagaccugcgccgg

SEQ ID NO: 4242062 - RNA, 98 nt, Pseudomonas aeruginosa PA01
gcuguugcacgguggccaucgcguuggccuggccguuggucaccagggcgccuucggucaccgcggaacggccgaugcggccggagaucggcgacagc

SEQ ID NO: 4242063 - RNA, 64 nt, Pseudomonas aeruginosa PA01
cugguacacccugaagaaggaaaagggcgaguugaacucgcgccugcacuacuucggcaaccag

SEQ ID NO: 4242064 - RNA, 56 nt, Pseudomonas aeruginosa PA01
cccgacauucugcgccuaaguucgaaauccgcucaagcgcggcgccgaauaucggg

SEQ ID NO: 4242065 - RNA, 61 nt, Pseudomonas aeruginosa PA01
gguugccgugaucgacuccaaggaccgucgccugucggcccuggucgacgucggcaagacc

SEQ ID NO: 4242066 - RNA, 104 nt, Pseudomonas aeruginosa PA01
gcuuguugcgcucgcggaugcuggucaucaguccuuguucuucauugcugcaacggcggcaggaagccgaggaugguagcacccgcccggagcgccccucaagc

SEQ ID NO: 4242067 - RNA, 60 nt, Pseudomonas aeruginosa PA01
uggccaaggccggcggcgacccgcagaagaucaacccgcugucgccgguggaccugguca

SEQ ID NO: 4242068 - RNA, 76 nt, Pseudomonas aeruginosa PA01
cgcagggcacgccggcgaggcugcggcgcucgcggacgacgccgccggcgcccagcgucgccaggcucagcccgcg

SEQ ID NO: 4242069 - RNA, 110 nt, Pseudomonas aeruginosa PA01
ggcggauccccgggguguuuccggccgcuuccgccgaucgcagcccgaucucgaacgagucgcuggagcuucgccggaagcgggcgcauauaaugccagccgauuccgcu

SEQ ID NO: 4242070 - RNA, 56 nt, Pseudomonas aeruginosa PA01
gugcugaacaugagcuggggcggcuucggcgcgcugcucuacaucgccuucggcgc

SEQ ID NO: 4242071 - RNA, 57 nt, Pseudomonas aeruginosa PA01
cgaagagcccgucgagggccugcucggugacauagcccucgacguuggcgcucuucg

SEQ ID NO: 4242072 - RNA, 59 nt, Pseudomonas aeruginosa PA01
ccggggcgguuucccagacacagacgcccccgcguugagugucugcgaaaccgccccgg

SEQ ID NO: 4242073 - RNA, 61 nt, Pseudomonas aeruginosa PA01
cgcgcugauccugcucgccgccguauaccugggcugcgaauacggcgggcggaucagcucg

SEQ ID NO: 4242074 - RNA, 83 nt, Pseudomonas aeruginosa PA01
gccuggucggcgugaugccugucacauguuggcaaucugacauugcuuaacuggcggguaucccuucauugccccguccgggc

SEQ ID NO: 4242075 - RNA, 60 nt, Pseudomonas aeruginosa PA01
ccagccgcucgcggccgaucugcgacagcggugggugguagagcagcacgcaguggcugg

SEQ ID NO: 4242076 - RNA, 85 nt, Pseudomonas aeruginosa PA01
ggccuggucgcccacgaaugcauccucgaccugcguccgcucaaggacagcagcgggaucagcgucgacgacguggccaagcgcc

SEQ ID NO: 4242077 - RNA, 76 nt, Pseudomonas aeruginosa PA01
gccaggcaaugggcgagccacucgccgaggaacagguugagcugguucuucucgucgggcuggugcaucgccuggu

SEQ ID NO: 4242078 - RNA, 62 nt, Pseudomonas aeruginosa PA01
cggccacgccccguggcgacagggccggggccgcuuggcacccugcuugcuacgggcugccg

SEQ ID NO: 4242079 - RNA, 84 nt, Pseudomonas aeruginosa PA01
gcuccugcugcuggucaccgggccccugggcagcggcaagacccuguugcgccaggcgcugguggccagcaccaacaaggaugc

SEQ ID NO: 4242080 - RNA, 55 nt, Pseudomonas aeruginosa PA01
gcagugguucugggucucgcugcggcccugggcgucgagguccuugaccacgugc

SEQ ID NO: 4242081 - RNA, 72 nt, Pseudomonas aeruginosa PA01
gccgaggucgaugaggugcuuggcgacacgaugggcgucaccggcgugcgccugaagacccgcgaugguggc

SEQ ID NO: 4242082 - RNA, 71 nt, Pseudomonas aeruginosa PA01
gggguggaccaggcgaucacgaucggcacccgguagcgcagggucaggccgauggucgccaggcccaugcc

SEQ ID NO: 4242083 - RNA, 100 nt, Pseudomonas aeruginosa PA01
ucgcgggcgcugcugaucucggcgcucugcgccugcagcgcggcaucgacuucgaugccggccaccggagccggcgcgcggaacagccaggcgcccauga

SEQ ID NO: 4242084 - RNA, 96 nt, Pseudomonas aeruginosa PA01
ccugcggguauucaucccggcgcuggcggauccgcugcugauggucagcguggccaucgccgcgaucuggcugugcacccugaucaaccugcgagg

SEQ ID NO: 4242085 - RNA, 62 nt, Pseudomonas aeruginosa PA01
cacuggccgcaucgcugaaggaacagcccgacgggcgcgccuucuucagccugcgcgccgug

SEQ ID NO: 4242086 - RNA, 65 nt, Pseudomonas aeruginosa PA01
aaggcggcggcggucaagccggaaagcgugaugaccgacgaaacccggcaacugcugaccgccuu

SEQ ID NO: 4242087 - RNA, 60 nt, Pseudomonas aeruginosa PA01
ugcuucuuggucauuggccaucgccuggcuugcagucgcgaugcccagugccagcaggca

SEQ ID NO: 4242088 - RNA, 62 nt, Pseudomonas aeruginosa PA01
gcgugccccgcgcgaggccgccggcgacccggcggcgaucgccuacucgccgagcggcgcgc

SEQ ID NO: 4242089 - RNA, 82 nt, Pseudomonas aeruginosa PA01
uggcgcugccgggcucgauguacaggcugcgggugcucaccccgagcauucgcaccucgugcucgacgcccggcggaaucca

SEQ ID NO: 4242090 - RNA, 77 nt, Pseudomonas aeruginosa PA01
gcuuguucggaucgacgccaggcacgccgagggugacgauuuccuucuucagcuugaccuuggugcgguagaacggc

SEQ ID NO: 4242091 - RNA, 85 nt, Pseudomonas aeruginosa PA01
uggccugcgcgcuggccggggugcuccacgaguucuggcugacccgcgcguucuccugggucucccuggucaccgcgcugggcua

SEQ ID NO: 4242092 - RNA, 65 nt, Pseudomonas aeruginosa PA01
cgcggugcagcugcucgguggccacggcuucaccaaggagcauccggccgagcgcugguaccgcg

SEQ ID NO: 4242093 - RNA, 56 nt, Pseudomonas aeruginosa PA01
ucgccgcuuugcggaugcacgcggaccaccgggugcucggucucguagacggucga

SEQ ID NO: 4242094 - RNA, 94 nt, Pseudomonas aeruginosa PA01
gagccauggacgcaagccgcaggcggaaguuaucgagcccgguuucaaauacaaccuggccgaccucaacgccgcccucgcgcugguccagcuc

SEQ ID NO: 4242095 - RNA, 57 nt, Pseudomonas aeruginosa PA01
caggcgcugcaugauccacaguucgaggucgucgcuguugccgccaugcagcgccug

SEQ ID NO: 4242096 - RNA, 121 nt, Pseudomonas aeruginosa PA01
cgacggagcgauggcgaaggguugcauggcgcaccucaaaggggaucacggaaggcgcgcauuguagccguuaucgguuuuuggcggugaaaaugacgacuuuucgccgcagcagccgacg

SEQ ID NO: 4242097 - RNA, 66 nt, Pseudomonas aeruginosa PA01
cgccgcgguggucaucaguacuggccgcaggcggaucgcggcggccugcucgauggccucgcgacg

SEQ ID NO: 4242098 - RNA, 93 nt, Pseudomonas aeruginosa PA01
gaucuucucgcgcagggcgaugucgccgggauuggcgaucaucuguaccagauugccaucgaucaggcgcaucgcuuccagcgcguggggauc

SEQ ID NO: 4242099 - RNA, 58 nt, Pseudomonas aeruginosa PA01
gcgcgcagcgagacgguggugcgcuacgccgggcuuggcgccggcgucuacugcaugc

SEQ ID NO: 4242100 - RNA, 70 nt, Pseudomonas aeruginosa PA01
ucgacacgccgccgggauucgccgucuauccgucggccaguccaaaggcggcgaaccugccggcugucga

SEQ ID NO: 4242101 - RNA, 72 nt, Pseudomonas aeruginosa PA01
gucgagggcagccgcggcgguuauugcuucgaacucaacucgcuguucgcccgccugcugcuggcccucggc

SEQ ID NO: 4242102 - RNA, 87 nt, Pseudomonas aeruginosa PA01
guccaggucgcgauccucggcggcguacagguagcggccgucgcuggcgacgcccuccaccuggaugccgucgaacagcggccgggc

SEQ ID NO: 4242103 - RNA, 102 nt, Pseudomonas aeruginosa PA01
caggcgcgcguauaccguguaggucugggugcuggcgggaaaguuggcgaugguccgcgcgagugccccguugccccagaccugggaguaggcggcauccug

SEQ ID NO: 4242104 - RNA, 74 nt, Pseudomonas aeruginosa PA01
gcugccgcuggggaucuuccugaucgucgcgguguuccucuuccgcggccucuggcuggaccccagcgagcugc

SEQ ID NO: 4242105 - RNA, 73 nt, Pseudomonas aeruginosa PA01
cgggguguccuggcgggugcugcuggaggaccugcaacaggucuaccgucaguucgccgagggcgccgaaccg

SEQ ID NO: 4242106 - RNA, 100 nt, Pseudomonas aeruginosa PA01
ggcgcggcaggaagcucagggucuguucguugaucuggguggcggccuggaacaucgccaccacgagaccgaccagcaggcucggaaccaccagcacgcc

SEQ ID NO: 4242107 - RNA, 70 nt, Pseudomonas aeruginosa PA01
uggucgugguggucauccucggcauccucgccgcccugguggugccgcagguaaugagccgucccgacca

SEQ ID NO: 4242108 - RNA, 124 nt, Pseudomonas aeruginosa PA01
guacggcagccaggauaucggcaucggcuggggcgacagcggccccgaggccggcuauuuccccuucuacaucggccugcugcugagugccgccagccucggcaaccugcucuuggcccugugc

SEQ ID NO: 4242109 - RNA, 80 nt, Pseudomonas aeruginosa PA01
gauccuuuccaauauugacacugaacgagccggaguuauugccauagguuccgggcacgucguuguagauaagagugauu

SEQ ID NO: 4242110 - RNA, 70 nt, Pseudomonas aeruginosa PA01
cuguggauaacucugugagcaagguggugaugacuguuuugcgacaaaugcucacgcgggugcgccgcag

SEQ ID NO: 4242111 - RNA, 55 nt, Pseudomonas aeruginosa PA01
ggcacagcuucgguggggcgagggcgagagcgggugcgccgccgccgcuguugcc

SEQ ID NO: 4242112 - RNA, 69 nt, Pseudomonas aeruginosa PA01
cgucggccagggcggccuccgggguuugcuccagcaauuugaacagcgccggaggaucgcuuugccgcg

SEQ ID NO: 4242113 - RNA, 80 nt, Pseudomonas aeruginosa PA01
gguaacccucggcgcggcgcuguucgucaugccgcugcaauugcagaguggcggggcggacgcgcugagccgggugaucc

SEQ ID NO: 4242114 - RNA, 63 nt, Pseudomonas aeruginosa PA01
ggguugggcguuguucgucagacgggcaguugcgcgugcccaugacguucgagcgccuguucc

SEQ ID NO: 4242115 - RNA, 57 nt, Pseudomonas aeruginosa PA01
cgacgaagacgccacgggccucugccgggaaggagaggccgcgcgacgucuuugucg

SEQ ID NO: 4242116 - RNA, 65 nt, Pseudomonas aeruginosa PA01
ggaugucgagaaaggcaugagccagcaggaaguccugcgcaucggcggcacgccuuccggcaccc

SEQ ID NO: 4242117 - RNA, 94 nt, Pseudomonas aeruginosa PA01
cggcaguugcgaccugcuguucuccagccuggccauccaguggugcgccgaccucccggcgguccuggccgaggcgcggcggguccugcggccg

SEQ ID NO: 4242118 - RNA, 55 nt, Pseudomonas aeruginosa PA01
gcggaucgccaccaggaucgcguugauguuuucgcuguccuuggccagguucugc

SEQ ID NO: 4242119 - RNA, 65 nt, Pseudomonas aeruginosa PA01
gguccgcauggcgacugacgaagaacaccagcgagacgcgcucgccggcggucaccugcuggacc

SEQ ID NO: 4242120 - RNA, 64 nt, Pseudomonas aeruginosa PA01
ggaacugaaugcggccuuguugugugguuucgccauucccgccagcgaccgcaacuucaucgcc

SEQ ID NO: 4242121 - RNA, 126 nt, Pseudomonas aeruginosa PA01
ugccguuggugccuucgcagggcucgcuccagucggcgccgagccagaggccggcguguucgaaggucuggcgcugggcgucggcguugacgcaauugaggaucaccccgcgggcaucggugagca

SEQ ID NO: 4242122 - RNA, 63 nt, Pseudomonas aeruginosa PA01
gcgaggaucccgagcagaacgccgcauugcgccaugcgaucggcggugugcucgagacccugc

SEQ ID NO: 4242123 - RNA, 62 nt, Pseudomonas aeruginosa PA01
ggcgcucgccggccuguugcucaacgacagccgcuaucugcgcgacagcgucggcgaacgcc

SEQ ID NO: 4242124 - RNA, 72 nt, Pseudomonas aeruginosa PA01
cgccgccagcaguucgcgggcacgggccaccgccaacggcuccugcccggccuucggcgcuucuggcaggcg

SEQ ID NO: 4242125 - RNA, 56 nt, Pseudomonas aeruginosa PA01
gcugaucagucuuccuggcgcaggucgcugagcaucugcucccaguacugguuggc

SEQ ID NO: 4242126 - RNA, 69 nt, Pseudomonas aeruginosa PA01
cugcgcgccgaggaagaaacaccgauucgcgucuggcuggcggaaaucgccgugcugcccggcgcacag

SEQ ID NO: 4242127 - RNA, 57 nt, Pseudomonas aeruginosa PA01
ucgagggucacgauguccugggccuugaggucuuccagggcaucgauggccacuugg

SEQ ID NO: 4242128 - RNA, 81 nt, Pseudomonas aeruginosa PA01
ggccuggcgcugcuggaacggggcggcuaccgggucggccugaccgccgccggucgcuccuuccaccagcgugcccaggcc

SEQ ID NO: 4242129 - RNA, 130 nt, Pseudomonas aeruginosa PA01
caagcgccucggcguuucgcauaccacggcggcgaacaagcugcgccagcauggcguggggcaaagcgagggcugagcggcaugcuugccgguuuguugcaggcugggaaagaaacgguggaggcgucgg

SEQ ID NO: 4242130 - RNA, 72 nt, Pseudomonas aeruginosa PA01
ccgcggccuguucgaugccgggcagggagaacaccugggugucuugcggcagguagucgaagagggucgcgg

SEQ ID NO: 4242131 - RNA, 57 nt, Pseudomonas aeruginosa PA01
gaggucgagcgugcccuggcgcuguaugccggcgagcgccagcggcgugccgaccuc

SEQ ID NO: 4242132 - RNA, 58 nt, Pseudomonas aeruginosa PA01
cugcaacggcgcgccguccuggaagaaauaguccugccaggaggccggcuuguugcgg

SEQ ID NO: 4242133 - RNA, 59 nt, Pseudomonas aeruginosa PA01
ugcgucgccauuccggcuuguuggugcuggugaggaucgacggcggauuggugaaggca

SEQ ID NO: 4242134 - RNA, 62 nt, Pseudomonas aeruginosa PA01
gggccucgucgaugaacaggauggucggccugggcgcugccuucacuucgucgaugacgccu

SEQ ID NO: 4242135 - RNA, 73 nt, Pseudomonas aeruginosa PA01
gcgauggcgaagauguucgcaucgaagaugaugucuuccggugggaagccgacuucgucgaccaggaugucgu

SEQ ID NO: 4242136 - RNA, 59 nt, Pseudomonas aeruginosa PA01
uucagcuucaaggacgcgaugguguucgccuucgcgccgccgucgguacuggaacuggg

SEQ ID NO: 4242137 - RNA, 94 nt, Pseudomonas aeruginosa PA01
gcgggcgauucgcgagggggccaugcuggcggcgcgcuuguagggggauaacgccgcuggcgguauggcugccguagagcgaacaaucgcucgc

SEQ ID NO: 4242138 - RNA, 75 nt, Pseudomonas aeruginosa PA01
cugcugcccgaggccaggaucgaggaggccggcgaucucgccgggguccugcgccuggcugacgaaggcgagcag

SEQ ID NO: 4242139 - RNA, 69 nt, Pseudomonas aeruginosa PA01
gccaccagccuggcccaggucaagcgccggcugcuggucggcgaccugcucggccaggccuucaguggc

SEQ ID NO: 4242140 - RNA, 65 nt, Pseudomonas aeruginosa PA01
gcucggccaccgaccgaaucggcgaguccuucggcaggaggaucgccucgcuggucggcgccggc

SEQ ID NO: 4242141 - RNA, 64 nt, Pseudomonas aeruginosa PA01
cauaagcccuggagaucccguuggugcuugaaagguguaacgggcgaggguaccgggagcuaug

SEQ ID NO: 4242142 - RNA, 61 nt, Pseudomonas aeruginosa PA01
ggugcuguucgccggcggcggcggaccguagcgguuggcgccggugcugccgggcaggacc

SEQ ID NO: 4242143 - RNA, 113 nt, Pseudomonas aeruginosa PA01
gaucgagcagacgccagacgcgcaccagcuugccguaguggcggugcuccagggucaucuccaccgccagcggcaggcuuuccaggcgcuccuccucgcugccuucgucgguc

SEQ ID NO: 4242144 - RNA, 62 nt, Pseudomonas aeruginosa PA01
cgcagcgacgggcgggagcugcucauugaugagagcggggcgguucccgagcaguugcugcg

SEQ ID NO: 4242145 - RNA, 113 nt, Pseudomonas aeruginosa PA01
uggcggaaacaacaccacugccgcguccaguucggcauucuccaggcgcgccagcaaauggcugccccagccagugccgaccugcgcgcgcagcuccggguacucgucggcca

SEQ ID NO: 4242146 - RNA, 56 nt, Pseudomonas aeruginosa PA01
ggcgcgaguugcugcgcgucuaccaucgccuggaagcgcgcggcgagauucgcggc

SEQ ID NO: 4242147 - RNA, 61 nt, Pseudomonas aeruginosa PA01
ucuucgguggaguuggccuccagcgcgaccuucaugcgcucgccggccaguucgccgaggg

SEQ ID NO: 4242148 - RNA, 61 nt, Pseudomonas aeruginosa PA01
gucgcgcaccuccuggucgaggucgucgcagacguggcugaccagguucagguagcgcggc

SEQ ID NO: 4242149 - RNA, 105 nt, Pseudomonas aeruginosa PA01
cuuguuggagaccacgaacaggcgaucgauacggccuucgagguaugcgucgagcaucaccuugacacugccgaucaggucguugaucgaaggcucuucgccgag

SEQ ID NO: 4242150 - RNA, 129 nt, Pseudomonas aeruginosa PA01
caggcucaucagcaacuggccgauuggucggcugcgcugggugugcuggccgcagugucgcaggacgacaccgugcgccagcugcucaaagagccucagcugaccucuucggccaaggcccagagccug

SEQ ID NO: 4242151 - RNA, 78 nt, Pseudomonas aeruginosa PA01
gcggccuggaggugcugcugguggacggcggcucgcucgacguggcgccguucaagccggaggcgcccuacgagccgc

SEQ ID NO: 4242152 - RNA, 62 nt, Pseudomonas aeruginosa PA01
cgccgaguucggcauggaccaggucgaaggcguuccagucgacgcuguccagccggcuggcg

SEQ ID NO: 4242153 - RNA, 64 nt, Pseudomonas aeruginosa PA01
ggacguggcgguguggagccagacggcggagauccucccgccgcugucgccgaccgacccggcc

SEQ ID NO: 4242154 - RNA, 60 nt, Pseudomonas aeruginosa PA01
ugccggcgcaguucgggcgcaaguccaccgaccugaucugcgucgaggaaggcgucggca

SEQ ID NO: 4242155 - RNA, 118 nt, Pseudomonas aeruginosa PA01
gggugcgcagcagcgaggucuugccgguauugguguggccgaccacggccaggaucagcggcucagucauggccggucuccagccaggccagcggcgaggucucgccgugcggcaguu

SEQ ID NO: 4242156 - RNA, 96 nt, Pseudomonas aeruginosa PA01
gguccguugugagcgcccgguccuguccgugacguccuacaggaaacugugaacgcaugguuaacggagaucgacauggcauacgcagaauggauc

SEQ ID NO: 4242157 - RNA, 88 nt, Pseudomonas aeruginosa PA01
ggccuacgugccggcgauguccgacgaaaccgugauggugcgcgaacaggccaccaucuuccucgccgggccgccgcuggugaaggcc

SEQ ID NO: 4242158 - RNA, 56 nt, Pseudomonas aeruginosa PA01
gcugguggagguccgcgccaucucggucaacccgguggauaccaagguccgccagc

SEQ ID NO: 4242159 - RNA, 71 nt, Pseudomonas aeruginosa PA01
gaguccgccagccggcugugaccgagauucugcaggcgcuccagacucuccaggucggucggcggcgguuc

SEQ ID NO: 4242160 - RNA, 94 nt, Pseudomonas aeruginosa PA01
gcgaucagcaaccagcgcgccucggcgauguuggccaguuccagcacgccgggacuggcggcauugccgaggaccacgcuguagcccuguucgc

SEQ ID NO: 4242161 - RNA, 60 nt, Pseudomonas aeruginosa PA01
aggugcguucgcccggaagcgguucgaagcugauugcgccgccuucgucggcgaugcccu

SEQ ID NO: 4242162 - RNA, 127 nt, Pseudomonas aeruginosa PA01
ccucgggagccgcuucgcgccagcggcgcagccagcccugggcgucgcucagguagcugucgcgcugccugggcgugcgcagggccuggagcagcgacuggaacagggcauagcgguauucccgcgg

SEQ ID NO: 4242163 - RNA, 71 nt, Pseudomonas aeruginosa PA01
cgcggcgacccgccaggcgcugggcgagucgcucugcgaggugcucgccggagcgguggcgggcggcggcg

SEQ ID NO: 4242164 - RNA, 130 nt, Pseudomonas aeruginosa PA01
ucgcgaaaggugucgagcgcccuuuucagagagcgcgucuuaccggauccugccccggcguagagaaaaaagcuuugcggcgcggcgggauucagacaggcccguaucuguacgucggcgcucucaucga

SEQ ID NO: 4242165 - RNA, 88 nt, Pseudomonas aeruginosa PA01
gcucgccgaacaggucgguuuccagguggguauagagcuugaccuuccagguccaccgcaccaccucggccagccacuugucggcggc

SEQ ID NO: 4242166 - RNA, 80 nt, Pseudomonas aeruginosa PA01
gcaguggcgggcaggugauccucaacgugguggaagggaugagccgcaucgccgacguggucaaccaguccuccaccagc

SEQ ID NO: 4242167 - RNA, 93 nt, Pseudomonas aeruginosa PA01
cgccggguggcgaggccgagcgucucaugcagguggucgccgaugaggucgggcgccuucgcgaggcgccgcugaaccugccguugccuggcg

SEQ ID NO: 4242168 - RNA, 60 nt, Pseudomonas aeruginosa PA01
gcggcguugcagggcgcgcaacggcugaucgacauccagcgcgcgcacaucgacgcuugc

SEQ ID NO: 4242169 - RNA, 96 nt, Pseudomonas aeruginosa PA01
agcgcgaggagcgcugcaccguauugccgaacgagcuggccaagguacaggccuucgucagccagcacggcaaucgcggcaagccgcucugagccu

SEQ ID NO: 4242170 - RNA, 74 nt, Pseudomonas aeruginosa PA01
cgaaggcgauggucgccaccaugaucaagccuuccucguugaggaagcgcuucugguggugggcacgcaguucg

SEQ ID NO: 4242171 - RNA, 69 nt, Pseudomonas aeruginosa PA01
ccggcgcgccagaacucgaccggucgcuacccguuacgcaggccggucgguacgcucuggcgcugucgg

SEQ ID NO: 4242172 - RNA, 61 nt, Pseudomonas aeruginosa PA01
gggccgcguaacggcauccuguccuugaccaucaaggacaaguccgugcuguacgccgccu

SEQ ID NO: 4242173 - RNA, 67 nt, Pseudomonas aeruginosa PA01
cugccgggccaugguguuguuacuguauuuguugaugucgcggaugaucucgaccaggucuggcgag

SEQ ID NO: 4242174 - RNA, 70 nt, Pseudomonas aeruginosa PA01
guugcuggucugcgucucggugcugucgcugggcguggugccgcagcacgaacuggcgcagaugaagaac

SEQ ID NO: 4242175 - RNA, 59 nt, Pseudomonas aeruginosa PA01
gccgauguacggguucagcgcggugaccagaccgaugcugugcucgaccaguucguggc

SEQ ID NO: 4242176 - RNA, 88 nt, Pseudomonas aeruginosa PA01
cagccuggcacagcgggugcugaugagccggcggaccuucacccggcauuuccgccagcucaccggcaccaccgucagccaguggcug

SEQ ID NO: 4242177 - RNA, 55 nt, Pseudomonas aeruginosa PA01
cgccgagcauggcuacgaggaggccuacacccccuaucucguccaggcuccggcg

SEQ ID NO: 4242178 - RNA, 67 nt, Pseudomonas aeruginosa PA01
cggguuggaggugaugaucaggaacagcaggaagccggugcugaucaugcccaucaccgccagcacg

SEQ ID NO: 4242179 - RNA, 66 nt, Pseudomonas aeruginosa PA01
gcugggucgcuauuuucgcuggaucaucggcggcgacacccugccgcagcagaagcccgacccggc

SEQ ID NO: 4242180 - RNA, 85 nt, Pseudomonas aeruginosa PA01
ggucugcaucuucagccgggucugcgcgucgagggcgccgaagggcucguccaucagcagcaggcgcggccgguugaccagcacc

SEQ ID NO: 4242181 - RNA, 86 nt, Pseudomonas aeruginosa PA01
ggccugcucaccgugaugaagcgcaugucgcgauccucgcgccgcggcgaggcggagaugccguuguccuugcuguugaaguggcu

SEQ ID NO: 4242182 - RNA, 98 nt, Pseudomonas aeruginosa PA01
ggugguggcggggaucggcguggggguggugucggccgcggaguucggcgccgacacgcggguccaugcgcuacccaucgucgauugccagcgacgcc

SEQ ID NO: 4242183 - RNA, 56 nt, Pseudomonas aeruginosa PA01
ucgcggccgggggugucguaguacugguuguacaguucgcggcgcucccagcccga

SEQ ID NO: 4242184 - RNA, 63 nt, Pseudomonas aeruginosa PA01
gccgacuucgccgcugagcugcuggauggcgguaccgaacggcggcaucagggucaggucggc

SEQ ID NO: 4242185 - RNA, 65 nt, Pseudomonas aeruginosa PA01
gccaucgggauuuccucaucagcucauuucuaugcccacagggcuugugaggaugauccuauggc

SEQ ID NO: 4242186 - RNA, 79 nt, Pseudomonas aeruginosa PA01
accacgccagcgccccggugccgccguggaaggauggcgucggccuuuccacggucagcaccgccggcgagaucgaggu

SEQ ID NO: 4242187 - RNA, 64 nt, Pseudomonas aeruginosa PA01
ggcgacggugaaaccggguuugcggguugcgccugacauucgcgggccccuuuuucuugucguu

SEQ ID NO: 4242188 - RNA, 73 nt, Pseudomonas aeruginosa PA01
acgccuguugccugcuguuccuugccugccuggcguucaacgccgccggcuggcgcuggcaggcggccggcgu

SEQ ID NO: 4242189 - RNA, 98 nt, Pseudomonas aeruginosa PA01
ugcacuaccucaucgucagcgguucagaaacuggccggcgcgcaggcccggccacugcgcgcggccucgcgaaccgccucgaccagcgccagggugcg

SEQ ID NO: 4242190 - RNA, 89 nt, Pseudomonas aeruginosa PA01
cgaugaccuugccgccgcgguuguccaguugcucgcgggcguucacggcgaccuucgaggugcuggaaaucucgccggcgcgguugucg

SEQ ID NO: 4242191 - RNA, 75 nt, Pseudomonas aeruginosa PA01
aguacgaacugucgcgcuggcucggcccgcucgccacccaggugcucggcagcagccugcgcgacgcuucgcgcu

SEQ ID NO: 4242192 - RNA, 97 nt, Pseudomonas aeruginosa PA01
gguggugcccucgggcaggccgauaugcuggaacugcagggugucgcgcaggcguacccuggccuguccggccagcggauggcccuggggcaccgcc

SEQ ID NO: 4242193 - RNA, 62 nt, Pseudomonas aeruginosa PA01
caccuggcugcucaacucggcgaagcgcugcgcgucguugcccgguugcagcggcaccaggg

SEQ ID NO: 4242194 - RNA, 109 nt, Pseudomonas aeruginosa PA01
gccagcaccaggcgcaccggguuggugccggucucgcgggccuggccgagaaggaauacggcgaugccggccaggccggcgccgaggaaggcgcaaccgagguacuggc

SEQ ID NO: 4242195 - RNA, 72 nt, Pseudomonas aeruginosa PA01
gggccugcgucugcuggagcgcggcgagaccagccuggugcuggccuggaacgccuccagcgggcagcgucc

SEQ ID NO: 4242196 - RNA, 66 nt, Pseudomonas aeruginosa PA01
gcgucaucgccaucgaccagccgagauagcgcaggcguccgauccggccguugguggugaacacgu

SEQ ID NO: 4242197 - RNA, 64 nt, Pseudomonas aeruginosa PA01
acugggugaaggaguuggcgauggcgaugaucggcuucuugaagucuucguccuucaucccggu

SEQ ID NO: 4242198 - RNA, 72 nt, Pseudomonas aeruginosa PA01
ugguggucgaaggcagcuucuccggcucgauggacaguuccaucggcagguugaggaugucgcccgccgcca

SEQ ID NO: 4242199 - RNA, 89 nt, Pseudomonas aeruginosa PA01
gcggugauggacuaccuugcccucggcgaacgcuucucuaccugggugcuggagggcguaccgccgauggcgcgcuguucggucgccgc

SEQ ID NO: 4242200 - RNA, 81 nt, Pseudomonas aeruginosa PA01
cuggacgccaagggccuggcgauguacggccagaugaccgccgguucguggaucuacaucggcagccagggcaucguccag

SEQ ID NO: 4242201 - RNA, 58 nt, Pseudomonas aeruginosa PA01
ggcggagaucuucgucgaaggugcgcgcggcuucgccaaccaggcgcggaucuccgcc

SEQ ID NO: 4242202 - RNA, 129 nt, Pseudomonas aeruginosa PA01
gagcuggcgcggcacccggcgcuggaugauggucggguagucgucgggguucuucaaugcgucgauaagccccucgcggaucucggcgaugcgcuccggguuguugccgauggagucgccgucggcguc

SEQ ID NO: 4242203 - RNA, 69 nt, Pseudomonas aeruginosa PA01
guugcaggcucgcucguucagcuuuccagcggcaccucuaugaggaagcggaacagcgcgccaugcugc

SEQ ID NO: 4242204 - RNA, 82 nt, Pseudomonas aeruginosa PA01
ccagccggccuugccgcgcaggcagauaccguacuggcccugguccgggcgguugagccuggcggcgaacucgccgagcugg

SEQ ID NO: 4242205 - RNA, 61 nt, Pseudomonas aeruginosa PA01
cacgggcugcuguucguccuggcgggucagcuuccacuccggguacgagugcaguccgcug

SEQ ID NO: 4242206 - RNA, 56 nt, Pseudomonas aeruginosa PA01
ccgcgucggccaguugcgccaucucgccgccgcgauagcgcggcagcucggcgcgg

SEQ ID NO: 4242207 - RNA, 85 nt, Pseudomonas aeruginosa PA01
gccaguagagcaggccggcauucaggcaggcggccaggccgauggacagggccaggccggcaugcugaagcgggccgaugaaggc

SEQ ID NO: 4242208 - RNA, 81 nt, Pseudomonas aeruginosa PA01
ggcuuuccaggccgccagccguucggccuugagcgccccgcagaccaguucguggccaagggcgauggcggccugcuggcc

SEQ ID NO: 4242209 - RNA, 130 nt, Pseudomonas aeruginosa PA01
ugccugcguuggccaagaccggacuggcgccgcugcugguggaaaccguagccgcggcguugacgccgcugcugaucggcuucgccggauucugugcggcgcugcaggcgcugguguuggugucgagcca

SEQ ID NO: 4242210 - RNA, 61 nt, Pseudomonas aeruginosa PA01
gguugaacagcggcuggccggcggcguccggcgcgcagaccgccaccaguuguucgugacc

SEQ ID NO: 4242211 - RNA, 64 nt, Pseudomonas aeruginosa PA01
uugcucugcgccgcgcagggcggacgaucgccggcgaucauccgccgaugcggcgauauugcaa

SEQ ID NO: 4242212 - RNA, 130 nt, Pseudomonas aeruginosa PA01
gugaggcgcagcagcggguugcucgggguuuccacccagaccaugcggguuuccggggucagcgcggccucgaaggccugcaggucggucgggucgacgaagcugaagcgaugcccggcgcugcgccggc

SEQ ID NO: 4242213 - RNA, 63 nt, Pseudomonas aeruginosa PA01
gacgcccagcggccucagguaguccuuguagaguuccugggugcgugggucgcgcugggcguu

SEQ ID NO: 4242214 - RNA, 89 nt, Pseudomonas aeruginosa PA01
ggggaucacgccgcccggcucgaaguugacgauguugacgugcaugucguggcgcaugucgcucaugucgacgaagcggguggugcucc

SEQ ID NO: 4242215 - RNA, 83 nt, Pseudomonas aeruginosa PA01
caguucuccagcguggacuggcgcggaucgcgaccgagcgggugcggcugguugcgcugccgcgccaguucgaucuguuucug

SEQ ID NO: 4242216 - RNA, 60 nt, Pseudomonas aeruginosa PA01
cuugccgccgacaucgcugaugugaacgaugcgaucgaucaucagcauguugggggcggg

SEQ ID NO: 4242217 - RNA, 97 nt, Pseudomonas aeruginosa PA01
acgaugaugacgccggugagaucgguuuccucaccguccugcaggggcagccagaagucggugaagaagcugaucgcagagagcgucaucagcacgu

SEQ ID NO: 4242218 - RNA, 68 nt, Pseudomonas aeruginosa PA01
ccugguggcgcgccagcagcucggcgagggcgcguuucuucucgucguccaugcucgcgcccaucggg

SEQ ID NO: 4242219 - RNA, 71 nt, Pseudomonas aeruginosa PA01
ccuuuggcuggaggggcguguggucgaucugccggcgagcggcgagggcgucacgcgcuuccggcuggagg

SEQ ID NO: 4242220 - RNA, 69 nt, Pseudomonas aeruginosa PA01
ugacccagaucggccaguucgacguggucacccugaaccguggccagcgcgacgggcuggccgagggca

SEQ ID NO: 4242221 - RNA, 87 nt, Pseudomonas aeruginosa PA01
cgcaagccaggaacgcgcugaacgacgaagugcgccagcgccucgccagccacuuccagacgcucggcgcggauccggcgauccgcg

SEQ ID NO: 4242222 - RNA, 87 nt, Pseudomonas aeruginosa PA01
gccgcaccgcccacccuggaagcgcugaucgccggcuaccggcaauugaucgaacgggcgcacaaccgggguauccgggucgucggc

SEQ ID NO: 4242223 - RNA, 125 nt, Pseudomonas aeruginosa PA01
gcuguccggcguuuccagggccuguagggcgaauaccgccacaggcgguauccgccgauaccccggauaagcggcggauaaccgcgagcgguuauucgcccuacggaguugggacgcuguccggc

SEQ ID NO: 4242224 - RNA, 66 nt, Pseudomonas aeruginosa PA01
gcgccuggccacgcaggcccagcggaagggucucguccuucucgcuguaggcgguggcgcgggcgc

SEQ ID NO: 4242225 - RNA, 56 nt, Pseudomonas aeruginosa PA01
cgaagugcuggaacagguccgccgcugggacgaagacggccuguuccgccgcuucg

SEQ ID NO: 4242226 - RNA, 55 nt, Pseudomonas aeruginosa PA01
acggccgcgaguaccucgaacagaucgcgccgauccucgcccagcucgcggcggu

SEQ ID NO: 4242227 - RNA, 60 nt, Pseudomonas aeruginosa PA01
ggcaguuucccaucggccuggcgaugaaccgcaaccugaccauccgcaugggcaacugcc

SEQ ID NO: 4242228 - RNA, 102 nt, Pseudomonas aeruginosa PA01
gcgagcgccgggccgcccucgcgggaaagcugggcauagaggucgucgagguugucggcggucucgaucuucagcucgacgccgaggcgcucggcgaagcgc

SEQ ID NO: 4242229 - RNA, 68 nt, Pseudomonas aeruginosa PA01
gagugcgcggggauccaaggcggcgcuaaagcauucuggagcgcuaucgaugcgaucuucgcucaguc

SEQ ID NO: 4242230 - RNA, 77 nt, Pseudomonas aeruginosa PA01
gcaggacgaucucgcccuucaccggcucggcggucuugaaguccggcuuggccaggucgagggcgacuucgaagugc

SEQ ID NO: 4242231 - RNA, 60 nt, Pseudomonas aeruginosa PA01
gcaccggcucgccgcgccggaaggccgcacugaucgccgcauccagcgccgggccggugc

SEQ ID NO: 4242232 - RNA, 84 nt, Pseudomonas aeruginosa PA01
caguacagcaacgacgcgguggucuacgucaccgacgccucgcgcgcgguaggcguggccaccagccugcuguccaaggagcug

SEQ ID NO: 4242233 - RNA, 55 nt, Pseudomonas aeruginosa PA01
cgccagucuucgccgccaggcgccgggcagccgccuggcggugcuggagcuggcg

SEQ ID NO: 4242234 - RNA, 60 nt, Pseudomonas aeruginosa PA01
gcagcugguuggcaauggcggccugguccagcuccuggccgaucaccaccagccgggugc

SEQ ID NO: 4242235 - RNA, 130 nt, Pseudomonas aeruginosa PA01
cugcgcucggccccgccgcucuaagcauagacccugucuaucugcguaacguuacgcuauucugauugcguaacguuacgcagauagaggcguucaugaaagccagcaaacccgggcccaagccgagcgg

SEQ ID NO: 4242236 - RNA, 60 nt, Pseudomonas aeruginosa PA01
aggcggugcgccuggcgcuguucggcacugccgccccuacgcaaacccggcgcgccgccu

SEQ ID NO: 4242237 - RNA, 57 nt, Pseudomonas aeruginosa PA01
acgcgagggccgccugcugguugacguggcacgggauccggcgcggccuuucgucgu

SEQ ID NO: 4242238 - RNA, 66 nt, Pseudomonas aeruginosa PA01
ggcugccggugucucggcguccguggcccggaaugggcaggcgagggcaggggcgccggcgaggcc

SEQ ID NO: 4242239 - RNA, 59 nt, Pseudomonas aeruginosa PA01
ucgucggugcaggcacugccuucggccguuagggcucagggcagccugccucgccucga

SEQ ID NO: 4242240 - RNA, 78 nt, Pseudomonas aeruginosa PA01
cgggccagagucguucgcugugcuggccgacggcauggacauaggccagguagcggcgggcgaacgacucgcuguccg

SEQ ID NO: 4242241 - RNA, 88 nt, Pseudomonas aeruginosa PA01
ggucgccgccgacgcgccauuugugcaguucgccggguagcguauagcugguggcgagcuugaacagguggcguggcuuggccgcguc

SEQ ID NO: 4242242 - RNA, 68 nt, Pseudomonas aeruginosa PA01
gccaggccgcgggcggcaccgccggagaggaccagaccgaucuucggccgggccuccgcggcgagggc

SEQ ID NO: 4242243 - RNA, 70 nt, Pseudomonas aeruginosa PA01
aucuguugcgagugaucgaagacggcaucgucgaacagcaguucaccggcuucgaacgcaugcaaccgau

SEQ ID NO: 4242244 - RNA, 65 nt, Pseudomonas aeruginosa PA01
gcucugcgccgacuucgaggccuacuggcaugcgcagugccgggucgaggaagucuggcgcgagc

SEQ ID NO: 4242245 - RNA, 67 nt, Pseudomonas aeruginosa PA01
guggggcuccugguugccgggagcggcucggcgaugugccgccgcuucccguggccaggaguguugc

SEQ ID NO: 4242246 - RNA, 122 nt, Pseudomonas aeruginosa PA01
gcgcaccacuucggcaccggccuuggccagcaccgcacuggcgaagcggucggcgguagcgccgcgcugcacgccgaugcgcuugccggccaacuggcugaagcugucgucgagcugggcgc

SEQ ID NO: 4242247 - RNA, 64 nt, Pseudomonas aeruginosa PA01
ucgguggcgcccugcaucaggcgcgccucgaggaacaggccgcucugcugcagggccuggccga

SEQ ID NO: 4242248 - RNA, 62 nt, Pseudomonas aeruginosa PA01
gcuuuugcgggugcgcucgguucaggcgcgauagcgucugcaccgccuguacgcccgccagc

SEQ ID NO: 4242249 - RNA, 77 nt, Pseudomonas aeruginosa PA01
gggccaggcccugcggcggcugggacucgggcacagccugaaccuggugcucgguuucagucugcagcgggccaucc

SEQ ID NO: 4242250 - RNA, 65 nt, Pseudomonas aeruginosa PA01
gcgcauguucuggcccagggccaguucgcccaugucgguggacggaccgucggccaggaugucgc

SEQ ID NO: 4242251 - RNA, 72 nt, Pseudomonas aeruginosa PA01
gcggugcuccaggcgcuggcggaggaaagcggcagcgugcuggucuuucuucccggccaggccgagauccgc

SEQ ID NO: 4242252 - RNA, 63 nt, Pseudomonas aeruginosa PA01
gggcgaacugcuugaggccggucccgcggguccgcgcagugaccgccuggagcggaucagccu

SEQ ID NO: 4242253 - RNA, 87 nt, Pseudomonas aeruginosa PA01
ggcuuuuccgagagcgcccugcugagcagccuggacgccgccagcgggccggcccgggugauccuccagcauguccucgcggaugcc

SEQ ID NO: 4242254 - RNA, 75 nt, Pseudomonas aeruginosa PA01
ccgcguuggccagccguugacccugaucgccgaacgcuucggcgagucggccggcgacagcggcuggcaggccgg

SEQ ID NO: 4242255 - RNA, 62 nt, Pseudomonas aeruginosa PA01
gggcgaggaagccgccggcgucgacuucgccggucaaccggcgcgcgcggcgcuccucgccu

SEQ ID NO: 4242256 - RNA, 58 nt, Pseudomonas aeruginosa PA01
acggccagguggugcagaucgagcgcaaggaaaaauuccgucugcagcaaccggccgu

SEQ ID NO: 4242257 - RNA, 61 nt, Pseudomonas aeruginosa PA01
gcccagcgcgaucaacuggauguggcgauucuucaggccacgcuucagcucgcccuggugc

SEQ ID NO: 4242258 - RNA, 126 nt, Pseudomonas aeruginosa PA01
gugcuggagaagucgcugacgguguucgccgggcaguucugcaugaccgguucgcgccugcuggugcagcgcggcguugccgaacggcuacgcgaacgccuggcgcagcgccuggaaaaccugcgc

SEQ ID NO: 4242259 - RNA, 63 nt, Pseudomonas aeruginosa PA01
ugcaugcccgaggugaagccggacaucuuuuccugguuguucugcucgaucuugcgcaccgca

SEQ ID NO: 4242260 - RNA, 66 nt, Pseudomonas aeruginosa PA01
ucacguaguugacccgccccugcuccucgccguacagcaggcaggcaugguggaucgacugcauga

SEQ ID NO: 4242261 - RNA, 57 nt, Pseudomonas aeruginosa PA01
ggaucguccgggguggucuugcuggagaacugcgcgaccacccugcccuggcgaucc

SEQ ID NO: 4242262 - RNA, 55 nt, Pseudomonas aeruginosa PA01
gcggugacgaucuccuugauuccggugucgcgggucaggccgaagaucgcgccgc

SEQ ID NO: 4242263 - RNA, 68 nt, Pseudomonas aeruginosa PA01
gcgccuguugcuggaagaacggccgcuggcggaacucgcccagcaccucggcuucuacgaccaggcgc

SEQ ID NO: 4242264 - RNA, 58 nt, Pseudomonas aeruginosa PA01
gccggcgugcucgaagcguucguaggaaaagucguugaagcuucucgggcgggccggc

SEQ ID NO: 4242265 - RNA, 99 nt, Pseudomonas aeruginosa PA01
auggcggccaccucgaugcgcgguugcgguuggcucaugccgccuccagggcgucgcggaugcgccgcaccgcagccagcgaggcgggguugucgccgu

SEQ ID NO: 4242266 - RNA, 67 nt, Pseudomonas aeruginosa PA01
cggacgcggcgcccugcgccugggcggugacccggcguugcugcccucggcacaggggcugcgggug

SEQ ID NO: 4242267 - RNA, 69 nt, Pseudomonas aeruginosa PA01
ucggcaugccggcgaugggcgacuucggaucguucuucgccgccggguugaccacgucguuggcaccga

SEQ ID NO: 4242268 - RNA, 129 nt, Pseudomonas aeruginosa PA01
cggaagcccccuccagcaaguagccgaaggucggcuucgaguggaccagcgguagcgcggucgccgccaacgcgccccacuggcgccgcucgaaggcgccgaagggcuggcugaaaucgaggaugcccg

SEQ ID NO: 4242269 - RNA, 73 nt, Pseudomonas aeruginosa PA01
gugaucagcgacgugaacaugccgggcauggacggacaccaguugcucggccugauccguacacgcuacccgc

SEQ ID NO: 4242270 - RNA, 57 nt, Pseudomonas aeruginosa PA01
uccgcgagcugucggcuuccaucacacggauggcgacccuggccgacagcgggcgga

SEQ ID NO: 4242271 - RNA, 82 nt, Pseudomonas aeruginosa PA01
cuacgugaacaucgccgaaggggcgaagaagcccgacgaagacaagcccggguucuucagucgccuguucggcggcggcgag

SEQ ID NO: 4242272 - RNA, 65 nt, Pseudomonas aeruginosa PA01
gagucgcaaagccgcgcguugccgcuaucacaagcuuuauggaacaaugcgggcacaugcgauuu

SEQ ID NO: 4242273 - RNA, 64 nt, Pseudomonas aeruginosa PA01
ugcaaauaaagugaaguugcccguguggccguuaugaacggacaggcagcgcuucgcaguugcg

SEQ ID NO: 4242274 - RNA, 61 nt, Pseudomonas aeruginosa PA01
ucgaggggaaucucguaccaggcgccgacguucugccguggugcggagauuuccgacucga

SEQ ID NO: 4242275 - RNA, 82 nt, Pseudomonas aeruginosa PA01
gccgcagguacaggguugcccgugcgcauccugccuacggccgccguggcacggccgcugcacgggcaauucggcuggcggc

SEQ ID NO: 4242276 - RNA, 129 nt, Pseudomonas aeruginosa PA01
uguggcagacggacgcggaucgcgccuugaucugcugcaggucgacggcgccuccccgcuucgccgcggagaggcgccgcggcccugucagccgaggaggagggcgucgucggcgagcuucucgccgcg

SEQ ID NO: 4242277 - RNA, 63 nt, Pseudomonas aeruginosa PA01
cugcugguagaacaguugcagcuucugcguacgcaggccggcguugaucuguuccaccagcag

SEQ ID NO: 4242278 - RNA, 89 nt, Pseudomonas aeruginosa PA01
cguggaagggcgccuggacaucgcccgggugaucuacaagaccgaccuguggagcgccugugggaucgucccggcgcgccuggucuacg

SEQ ID NO: 4242279 - RNA, 62 nt, Pseudomonas aeruginosa PA01
gucuuucccggauggauggagacgcggccccguauuuccggccccauccauccgagagagac

SEQ ID NO: 4242280 - RNA, 75 nt, Pseudomonas aeruginosa PA01
gucgaggcgcucgucggugaccggcgagaccagccgacgcggcucgcugaagacgcuacgggugucccauucgac

SEQ ID NO: 4242281 - RNA, 87 nt, Pseudomonas aeruginosa PA01
gccggcggugaucuauggcgaccugagccguccgcgggccaugaccguggaguggaucagguacgcccagagccuuaccgacaaggu

SEQ ID NO: 4242282 - RNA, 63 nt, Pseudomonas aeruginosa PA01
cuggaugucgaggaagaccaggcgauucuucauggcgaacgccuccuccaucuucggcuucag

SEQ ID NO: 4242283 - RNA, 55 nt, Pseudomonas aeruginosa PA01
gcgcccugcucgaccaggcgcuugaguucgcggucgagcuggcgcagcagggugc

SEQ ID NO: 4242284 - RNA, 86 nt, Pseudomonas aeruginosa PA01
gcacguggcccuggugcagcacggugacauggucggcgaugcugccgacgaaacccaugucgugcuccaccaccaucagcgagugc

SEQ ID NO: 4242285 - RNA, 95 nt, Pseudomonas aeruginosa PA01
ucgcccggaagcugucgcugugcaguugcaugcgugccagcggguccaccgcguuggcgucgaagccacuggcgaccacgaucaauugcgggcgg

SEQ ID NO: 4242286 - RNA, 66 nt, Pseudomonas aeruginosa PA01
ugaucagcgccaguaccgggcggccgcgaccgaguucgaguugcucggugcuggcgcgggugauca

SEQ ID NO: 4242287 - RNA, 83 nt, Pseudomonas aeruginosa PA01
ccugguacuggaagcgaucggcgcggcugaucgacugggccaguuccaccgguuggccgguacggucgcgggacagggugagg

SEQ ID NO: 4242288 - RNA, 85 nt, Pseudomonas aeruginosa PA01
gguggucgacuugcccgcuccguuggggccgaggagaccgacgaucucuccccggucgaugcggaagcucaagucguuuaccacc

SEQ ID NO: 4242289 - RNA, 66 nt, Pseudomonas aeruginosa PA01
gaugaucaggcggucggcaucgccgaagaggauugcgguggacuugaugccgaucuucaggucguc

SEQ ID NO: 4242290 - RNA, 58 nt, Pseudomonas aeruginosa PA01
gguugucaucgacgcuacuccauguguguuuuuuguuaugagugcguggacuauagcu

SEQ ID NO: 4242291 - RNA, 61 nt, Pseudomonas aeruginosa PA01
gccuugcuugagcgcauggcggaggacuucuucggccucuuccucggcgcccaggcgaagc

SEQ ID NO: 4242292 - RNA, 91 nt, Pseudomonas aeruginosa PA01
gccguucuacggacuggcggugaugugcguggaugauccgguugugcgugagauccucccgcagaucgcccgcccgaccgugaccuacggc

SEQ ID NO: 4242293 - RNA, 59 nt, Pseudomonas aeruginosa PA01
augcgcgacgcggggauggacguggaggccuaucucuacgccaucugagugcucgccau

SEQ ID NO: 4242294 - RNA, 129 nt, Pseudomonas aeruginosa PA01
gagguaguaggucugggugaagcgguugcugaacaucuucggcgcuuucuucagcaccaccaugaacgugcugcccggguuggacuggaggaacgcccccagugccgcgccaccgaugaucaggaccuc

SEQ ID NO: 4242295 - RNA, 62 nt, Pseudomonas aeruginosa PA01
ggugccgccggacggucagccgaucguccugcucaacgaccggcagaccaucggcggcuacc

SEQ ID NO: 4242296 - RNA, 97 nt, Pseudomonas aeruginosa PA01
ccuggucaucccguugcuggccagccuggucaccggccugcugaugcucuacguggucggcaagccgguggccgggaugcucgcggcacugaccggg

SEQ ID NO: 4242297 - RNA, 71 nt, Pseudomonas aeruginosa PA01
guugauugcgguagcacgcaagcgcucgcgccugaagcuggugaagagcgaccugcgccugcugcaggaac

SEQ ID NO: 4242298 - RNA, 73 nt, Pseudomonas aeruginosa PA01
gauccucaggcugaugcaugguaucgggaggcaguagcucucgccaagcccgauacccugcgucccugggauc

SEQ ID NO: 4242299 - RNA, 130 nt, Pseudomonas aeruginosa PA01
ucggcgccgaucaggccgccgccauccagggccaccuugggcugguaguaggcuucgaacucgccauugucgaggccgcgcaccacguccgccacggagggcagcucggcgacuucgaucugucgcggaa

SEQ ID NO: 4242300 - RNA, 60 nt, Pseudomonas aeruginosa PA01
gcgggacgccugagcggcgcggcgggacagggacaacgcggcugccguuauccguccugc

SEQ ID NO: 4242301 - RNA, 59 nt, Pseudomonas aeruginosa PA01
gcggcguuccgccuaccugguguugcugaccgagaaccccggcgcgcuggagcgccugc

SEQ ID NO: 4242302 - RNA, 71 nt, Pseudomonas aeruginosa PA01
gggcuaggaaggagugcgcguuuuuucgccaggcuugcggaguuccgcaagccuggggauaacgucagccc

SEQ ID NO: 4242303 - RNA, 63 nt, Pseudomonas aeruginosa PA01
uguggcuggaggacgaggagcugcgccugcaggccggcgacgguuuccagauucccagccaua

SEQ ID NO: 4242304 - RNA, 63 nt, Pseudomonas aeruginosa PA01
gugccgggcuccggcggacgcaggguguugacgaagcgccgcucgccuucgcggaguccggac

SEQ ID NO: 4242305 - RNA, 55 nt, Pseudomonas aeruginosa PA01
gccggugcagagcuucgugacccgcagcgacaugggaugcggcucgaccaucggc

SEQ ID NO: 4242306 - RNA, 63 nt, Pseudomonas aeruginosa PA01
ccgucgaaggcgccgagggcguuuuccaccucggugguggaaacguucucgcccuuccagcgg

SEQ ID NO: 4242307 - RNA, 76 nt, Pseudomonas aeruginosa PA01
cgaaagucuguugcaggucgcuggcaucugagcgcgggugcuaccaucgccgcgaaacacugcacagguccuuucg

SEQ ID NO: 4242308 - RNA, 61 nt, Pseudomonas aeruginosa PA01
gcggugcccugcaucggcgcguugaucgcggugcgcucggcggccuugcgcauggcaccgu

SEQ ID NO: 4242309 - RNA, 68 nt, Pseudomonas aeruginosa PA01
acugguggaugccggugauccaggcccgcccggacaggcacgggaggaucgccggacggccgccgagu

SEQ ID NO: 4242310 - RNA, 66 nt, Pseudomonas aeruginosa PA01
gcuuguguucgcccugggcgccggcgucgaagcgcgccaggccggcgccgauggcgaauuccaggc

SEQ ID NO: 4242311 - RNA, 70 nt, Pseudomonas aeruginosa PA01
cacgcccuucacguugcgcaacugcggacggaugauccaguccuggauggugcgcaggucggugggcgug

SEQ ID NO: 4242312 - RNA, 93 nt, Pseudomonas aeruginosa PA01
ggcgccaaugucugccgaaucgccgugcaucgcccccagggcggcgaccuggugguggugcugucggugaucgacaaccuggucaagggcgcc

SEQ ID NO: 4242313 - RNA, 104 nt, Pseudomonas aeruginosa PA01
agcggaucgcccaggcuggcgccuucgaaggccuggccgauggccuugaagauggcgucggcggccaguucgaagugcucgccggugucgcccaggcgaccguu

SEQ ID NO: 4242314 - RNA, 79 nt, Pseudomonas aeruginosa PA01
agcugagccggauucucgccgaccgcacccgcgccuccgacacccuggcgcggcugggcggcgaugaguucggccugcu

SEQ ID NO: 4242315 - RNA, 127 nt, Pseudomonas aeruginosa PA01
gccuucugcuugccggccacggcgccguauugcaggucgcgcuugaccucggcgcggugccaggcgugcgcugcgccgaggcucaggcgccauugcugcaauugccggccgagguaggcgccgaggu

SEQ ID NO: 4242316 - RNA, 66 nt, Pseudomonas aeruginosa PA01
aggcgcugguggucgauccgggcaaggaagccuucguccguugccugggcugcaccaccagcggcu

SEQ ID NO: 4242317 - RNA, 57 nt, Pseudomonas aeruginosa PA01
cagggcguugucgccggccgagcgggaaaucgccaguuggccgaagucggcgcccug

SEQ ID NO: 4242318 - RNA, 55 nt, Pseudomonas aeruginosa PA01
gauggucucguuggcgcccaccgacucgcugcggucggcgccgaugcugaucguc

SEQ ID NO: 4242319 - RNA, 74 nt, Pseudomonas aeruginosa PA01
gcgcuucccgcugacgcugcauuuccgcaaggccggcgacgugccgguggaaaucgucgucgaguccaaggcgc

SEQ ID NO: 4242320 - RNA, 55 nt, Pseudomonas aeruginosa PA01
ggugcgcaccgucgagggcgaggaccucgacaucgccuucgacucggugugcauc

SEQ ID NO: 4242321 - RNA, 77 nt, Pseudomonas aeruginosa PA01
gcgaagagguguucaagcagcgcacuucgcugguguucaaaagcaugcagguggugcgcuucuucgaucgcaagcgc

SEQ ID NO: 4242322 - RNA, 55 nt, Pseudomonas aeruginosa PA01
uggucgaucccggcguugguccgcgaaucggaggcgaacaccaacccaucggcca

SEQ ID NO: 4242323 - RNA, 86 nt, Pseudomonas aeruginosa PA01
cggcggauaaccgcguggcgguuauucgcccuacacggggaggggacaagcgguagggcgaauaacgccccaggcguuauccgccg

SEQ ID NO: 4242324 - RNA, 93 nt, Pseudomonas aeruginosa PA01
ggcaacgccagcaccacgaugcuggucagcuuggcguuggugacgaacaucagcagcaccccgccgaccagcaucagggcauugcgcagggcc

SEQ ID NO: 4242325 - RNA, 78 nt, Pseudomonas aeruginosa PA01
ggccaguaggggccgaucagcaccaguucgacgaagaaacacgcgccgauggucgcgaucagccccagcacuauggcc

SEQ ID NO: 4242326 - RNA, 88 nt, Pseudomonas aeruginosa PA01
cccgcgagugguaccugcuguugucgcgccagggcuggcugugucccggcuggcccagggaguacggcggcauggggcugagcgccgg

SEQ ID NO: 4242327 - RNA, 65 nt, Pseudomonas aeruginosa PA01
ccggguggacgccagcgacccgcgccuguuucccggcaaggcgcuggaccuggcgcucggccugg

SEQ ID NO: 4242328 - RNA, 79 nt, Pseudomonas aeruginosa PA01
cgccugggccucgcccuggcgguagcgcgcguaggccucguagucgaacagcggcugcuccaggcugagggucgaggcg

SEQ ID NO: 4242329 - RNA, 106 nt, Pseudomonas aeruginosa PA01
cagggccaacuggaucagcucgcgguuggcucgugcgagggagguggcgagcaccgagguacgugccuccaggcgcgaguccagcaccgagacgaucagggcgaug

SEQ ID NO: 4242330 - RNA, 85 nt, Pseudomonas aeruginosa PA01
gccgguagccgaggcuggccugcggccugucgugcucgucgaugcgcaacgggccuuccaggcugccgucgagcagguugccggc

SEQ ID NO: 4242331 - RNA, 86 nt, Pseudomonas aeruginosa PA01
gcugggacuccccgcgaagcugggucaggaccuuggugacuuccgucgccagggcgccgaucagcucgcuggagguaugccccagc

SEQ ID NO: 4242332 - RNA, 81 nt, Pseudomonas aeruginosa PA01
gcgaccugaagaacuucgacuucaccgucuacgaguggcacaaggacgccacccggaccgaggucaaguaagcaucguugc

SEQ ID NO: 4242333 - RNA, 73 nt, Pseudomonas aeruginosa PA01
gucgcugggcguucgccuguuggugcuggccgugcugucggucagccugauggugguggacgcccgguucgac

SEQ ID NO: 4242334 - RNA, 67 nt, Pseudomonas aeruginosa PA01
gccggcacgcuggcguaggucauggucaacgggcaaccggugccggccuccgccuggcugugcaggu

SEQ ID NO: 4242335 - RNA, 100 nt, Pseudomonas aeruginosa PA01
cgggcgccggacggcagcaccagcgggccgggcuucagcaucgacgcgaccaccaacgugauccaguucaguccggccacuggcaauccgccgacucccg

SEQ ID NO: 4242336 - RNA, 102 nt, Pseudomonas aeruginosa PA01
ugcaccgcuggagcgacuacgccagcgcguucuuggccugccagcggagauucgcccggccugccuggacgcgcugcgcgccgaccguugccugcggcugca

SEQ ID NO: 4242337 - RNA, 71 nt, Pseudomonas aeruginosa PA01
guuccuugaccugcuugucgaugucgagggucgcgcccuggcugaccacgaucggcaggcgggcgacgaac

SEQ ID NO: 4242338 - RNA, 62 nt, Pseudomonas aeruginosa PA01
cgaccagggcuucaccaucggcggggcgcgccagcgccucuccggcgacgaggccaaggacg

SEQ ID NO: 4242339 - RNA, 125 nt, Pseudomonas aeruginosa PA01
gagguguucaccacguagcugguggccucgaccagccgcucguaguccgggucggcgagguagccguggaucagcacgaugcggcagcgguaggacugguucuuguacagguggugaagcauguc

SEQ ID NO: 4242340 - RNA, 123 nt, Pseudomonas aeruginosa PA01
gauccggccaaccccgaggaagccagcgaagugccggagauggaagcacagggcuacuaccgcguacugucccuggccaccgucccgcuguugcugggcaugcucgucugguccggcuggauc

SEQ ID NO: 4242341 - RNA, 128 nt, Pseudomonas aeruginosa PA01
ccuccgagacgcggaccgucagcacccgccccaugcucuuguguugcagcgaaugcacuucgacccuggccagugcgggagucgcgcagaacacggcgaggcaggcgaggacgguccggaggcggagg

SEQ ID NO: 4242342 - RNA, 62 nt, Pseudomonas aeruginosa PA01
guuauucgcccuacggagcuggggcgcaguccggcuuuuucgggguguguagggcgaauaac

SEQ ID NO: 4242343 - RNA, 116 nt, Pseudomonas aeruginosa PA01
gagcgccuggaguucagugccgaacgcgagaucguccugcguuguggcaaggccagcaucacccugacccgcgccggcaaggugaucauccguggcgccuaucuuuccagccgcuc

SEQ ID NO: 4242344 - RNA, 78 nt, Pseudomonas aeruginosa PA01
cuccgucaggugaucgacaagccauucuccguggccuugcugcauacggugcauggcgucggcuaccgccuggcggag

SEQ ID NO: 4242345 - RNA, 72 nt, Pseudomonas aeruginosa PA01
ccgcgacccucuucgacuaccugccgcaagacacccagguguucucccugcccggcaucgaacaggccgcgg

SEQ ID NO: 4242346 - RNA, 74 nt, Pseudomonas aeruginosa PA01
gaaaggcgcgcggcgcucugcggcgggcuuccgggcuauuugccgaagugccccggggcgaccgcgcaacgguc

SEQ ID NO: 4242347 - RNA, 58 nt, Pseudomonas aeruginosa PA01
gcgccaggccugcucguguuccggggccgccuggcgccagcgcugccaggccuggcgc

SEQ ID NO: 4242348 - RNA, 55 nt, Pseudomonas aeruginosa PA01
cgucgcggaggauguacuggaacugcucggcggugccggucaucuuguugcggcg

SEQ ID NO: 4242349 - RNA, 94 nt, Pseudomonas aeruginosa PA01
gaucgacugauaccgacuaccuggggcgggcuguccgccggaugcgggaagcguccggcaggcagcccgcccuucugucucuagcaagguuuuc

SEQ ID NO: 4242350 - RNA, 83 nt, Pseudomonas aeruginosa PA01
ggcgggaacguggcaggccacgcaguuggccugggcgaacaggcgcuugccggccagcaccugcgggucguccaccuugcgcc

SEQ ID NO: 4242351 - RNA, 66 nt, Pseudomonas aeruginosa PA01
gccggggcggccgagguagacguugucgagguacagcccgacgcugccuuccaggccgucgcuggc

SEQ ID NO: 4242352 - RNA, 55 nt, Pseudomonas aeruginosa PA01
cuggaagaaauugucgcugacgccgaucgccgggcguuucagcacgcucuuccag

SEQ ID NO: 4242353 - RNA, 79 nt, Pseudomonas aeruginosa PA01
ccgcgacccaggugcgcuggaagaucgacgacguccucggugucuggccguugcacggucuuugcggggucuggggcgg

SEQ ID NO: 4242354 - RNA, 86 nt, Pseudomonas aeruginosa PA01
gcagauccaccagguuguccaggcgguggcccucgaucagcggcugcaacuugacggccagggccuggagacucucgcgggucugc

SEQ ID NO: 4242355 - RNA, 69 nt, Pseudomonas aeruginosa PA01
gcgccugcguucgggcaucuccgccacgguguuccacgaaggcaugagcauucucgagcgcgaccgcgc

SEQ ID NO: 4242356 - RNA, 80 nt, Pseudomonas aeruginosa PA01
gcgucccggcgcggcggccuugaagccgucgccggccuuguaggagaggccggcggcgucgaugucguggcccuuggcgc

SEQ ID NO: 4242357 - RNA, 58 nt, Pseudomonas aeruginosa PA01
gaccaucgacgaagaccgcugcaucgccgacaagggcugcaccgucugcgucgagguc

SEQ ID NO: 4242358 - RNA, 62 nt, Pseudomonas aeruginosa PA01
gcgcucgggauaggugguccagguguagcccugcuccaccgggccguugcugucguggucgu

SEQ ID NO: 4242359 - RNA, 74 nt, Pseudomonas aeruginosa PA01
gccgugguagccgguggggaggauguccgaaaggcaggucaggucgcggaucuucuccaucgccgcuucgcggu

SEQ ID NO: 4242360 - RNA, 129 nt, Pseudomonas aeruginosa PA01
gacggcggccacagcgugcaucgcgcggugcucuggucgcuggcgcugguaguacugaucgagaucgucccgcucgccgcgcugcugaucggcgcgccgucgcucccggcgaugcucgccagccccgac

SEQ ID NO: 4242361 - RNA, 61 nt, Pseudomonas aeruginosa PA01
cagaauccacaacauauuguuguuuugcaaaaucaaaacacaucauguuguggagaaguug

SEQ ID NO: 4242362 - RNA, 87 nt, Pseudomonas aeruginosa PA01
gcggcaucaccgccucguaguuaccuaccggcaccaucgcccgugggcugccguuggugcugguggugaaggcgaagcgcuugccgc

SEQ ID NO: 4242363 - RNA, 98 nt, Pseudomonas aeruginosa PA01
cugccgaucuucaucuucggacugcugcggaugggcgucacgcccgacgucaacgccgugucgacguugauccucggcgucuccgugaucuucgucag

SEQ ID NO: 4242364 - RNA, 58 nt, Pseudomonas aeruginosa PA01
cgaguagcgcaugucggcuuccgccgaagccucggcgggaaugauguugcgcuucucg

SEQ ID NO: 4242365 - RNA, 128 nt, Pseudomonas aeruginosa PA01
cggcguccaacugcgccgggguggucagguucugccauucgccgggcgugcucggcggcccggcauggaucgacggcaccgagcggcccagcggauggaucggguccgacucgcccugcagggcgccg

SEQ ID NO: 4242366 - RNA, 66 nt, Pseudomonas aeruginosa PA01
gcgaucgccucgcugucgauggccgggugggccaccagccggucguaggcggcgagcagguccugc

SEQ ID NO: 4242367 - RNA, 82 nt, Pseudomonas aeruginosa PA01
caucuuguaguagaggcgacugcccaguugcggcggcuugacgaagucguccagcuggaacggcucgccgagcaccuggaug

SEQ ID NO: 4242368 - RNA, 112 nt, Pseudomonas aeruginosa PA01
gcucgccggguugcucaucgcggugcuguucagcuaccgccgcaagcgcgucuacgacuugcagcggaucgagcaggccgaacgcgucgaugucagcuacaacccgaagagc

SEQ ID NO: 4242369 - RNA, 106 nt, Pseudomonas aeruginosa PA01
guaugccugcgaagacgaccgagcaagcgcuuggguaacagccgagaacggauuuguuucugcccucuucucaaccaagcgcuugcuugguaaugucgccccacac

SEQ ID NO: 4242370 - RNA, 98 nt, Pseudomonas aeruginosa PA01
gcaauggguagagcaugucgucgucgaauagcggcuuuucgaugcgcagguagccuucgccgucgaacagccgcuucgccagcgcguucgccuguugc

SEQ ID NO: 4242371 - RNA, 65 nt, Pseudomonas aeruginosa PA01
gccgcgcaacugcugcugcaacgcaucgccgagcgcgaggagccgaugcagcggcgggugguggc

SEQ ID NO: 4242372 - RNA, 58 nt, Pseudomonas aeruginosa PA01
cagaaggucaucgguuucgagcccaaccaaagauauguggccaauugauggccuugug

SEQ ID NO: 4242373 - RNA, 73 nt, Pseudomonas aeruginosa PA01
ggacgucggcgggugcucggagcgcuugccgcuggaccacagcggcgaccagccuucgcgcuugccggugacc

SEQ ID NO: 4242374 - RNA, 81 nt, Pseudomonas aeruginosa PA01
gccugcucggcccacggaucuucgaccggggugaccggcgcuuccugccggccauccaucucgacggacugacgcucaggc

SEQ ID NO: 4242375 - RNA, 59 nt, Pseudomonas aeruginosa PA01
cggucgaggagcagcccggcacugcgcaacugggccagguggcggcugaucuucggcug

SEQ ID NO: 4242376 - RNA, 60 nt, Pseudomonas aeruginosa PA01
cgcuggguucggaccgugagguggagagcgacuuccagcuuaucgccgggacccaccgcg

SEQ ID NO: 4242377 - RNA, 60 nt, Pseudomonas aeruginosa PA01
gggcgcuggcguuguugauggccgcguucagguuccggccgaucagcccgcccagugcuu

SEQ ID NO: 4242378 - RNA, 57 nt, Pseudomonas aeruginosa PA01
ggcgacgaucugcucgaggaucuugcuacgcaggguuuccucguacagcuugucguc

SEQ ID NO: 4242379 - RNA, 111 nt, Pseudomonas aeruginosa PA01
gcuuccgcagguugagcgccccccuggacgcgccguugcgcugguucgccgguaaccacgacgaacgcgagccgaugcaacgggcgaccgagggcagcgaccuguuggagc

SEQ ID NO: 4242380 - RNA, 65 nt, Pseudomonas aeruginosa PA01
cagcgggucgucgaacagcgugcgcaggcgcgacagcgcggcgcugauggccggcuggccggcug

SEQ ID NO: 4242381 - RNA, 68 nt, Pseudomonas aeruginosa PA01
gcuccgccuucucgagcaucugcagaucgaccagacgucgcugcggauguucggcgaaugccuccagc

SEQ ID NO: 4242382 - RNA, 75 nt, Pseudomonas aeruginosa PA01
cuggcccagguaauugaaagugauccgcgccugcggcaaccccgccaggacccgggcacuuuccucuccagccag

SEQ ID NO: 4242383 - RNA, 77 nt, Pseudomonas aeruginosa PA01
ggcugcgaccaguugauccaugccggcgacaucggcaagccggaaauccucgccgagcuggaacgccuggcgccgcu

SEQ ID NO: 4242384 - RNA, 74 nt, Pseudomonas aeruginosa PA01
gucugcagggccuugucggucaggggaauuucacgcuugagcugcuccggcgugaucagggucucguuggaggc

SEQ ID NO: 4242385 - RNA, 94 nt, Pseudomonas aeruginosa PA01
gggcaaggaagcgcugaauuuccagaucaccguggcgcuggcgauguucgucagcuuccugcugaugcugguggugaucggcuucuuccugcuc

SEQ ID NO: 4242386 - RNA, 76 nt, Pseudomonas aeruginosa PA01
gcgauccgacgaaaaacccaugccuugcgggcaugaaaaauauuccugaaaggcugguguuuucgccguuggaagc

SEQ ID NO: 4242387 - RNA, 69 nt, Pseudomonas aeruginosa PA01
ggcguccaguucgcguucgcggcucaucgucggcuacucgucgugggccuggauggcgaaggggaagcu

SEQ ID NO: 4242388 - RNA, 76 nt, Pseudomonas aeruginosa PA01
acugcggaucacucgucgcggaucgagaaguuggccaugugcuccaggcccuugaucagcgccgaguggucccagu

SEQ ID NO: 4242389 - RNA, 100 nt, Pseudomonas aeruginosa PA01
gagcaggcggccgagccauuugccgaggaacagccaggcgugggugaggggugcgcgcauggaguggguguccuugguggugugcguuggcugugggcuu

SEQ ID NO: 4242390 - RNA, 67 nt, Pseudomonas aeruginosa PA01
gcgacgcuggcgagcaacugcucggccggcaucggccugccgagcaggaagccuugcagcgaauugc

SEQ ID NO: 4242391 - RNA, 71 nt, Pseudomonas aeruginosa PA01
caccgggaugugcagcggcuccagggccugcaugauggccucgcgggucgggccgaucugcgcgcccggug

SEQ ID NO: 4242392 - RNA, 76 nt, Pseudomonas aeruginosa PA01
ugcaacauucgccccgcagacugccagaccagacauccggucggcgcggucgccacggcgaauguccuacccugca

SEQ ID NO: 4242393 - RNA, 55 nt, Pseudomonas aeruginosa PA01
ggugauccaggcuugugccgcgccgcguaacuacgccgacggcaccuggaucacc

SEQ ID NO: 4242394 - RNA, 61 nt, Pseudomonas aeruginosa PA01
ucgccggcaaagucgagggcuuccugaagguccgcgcgggugccgacgauugagccggcga

SEQ ID NO: 4242395 - RNA, 115 nt, Pseudomonas aeruginosa PA01
gcugucgcggucgccgagggcuuucagguaaucgcccauggccuugggcgccggccgcugcggggcguugcgcgcgaccauggcgaacaccaggagggucaggacgagcggcagc

SEQ ID NO: 4242396 - RNA, 59 nt, Pseudomonas aeruginosa PA01
gcggaucggacgguugcggugcaccaugcccucggugaccaugcagccggcgaucgcgc

SEQ ID NO: 4242397 - RNA, 57 nt, Pseudomonas aeruginosa PA01
gaaggucgccugcuggucagcggcacgccgaagccguuccagcgccugcugaccuuc

SEQ ID NO: 4242398 - RNA, 58 nt, Pseudomonas aeruginosa PA01
gcccuucguagaaugcuggcgaggcggaacgacgggggagcgggcauguacgaagggc

SEQ ID NO: 4242399 - RNA, 57 nt, Pseudomonas aeruginosa PA01
ucaggcccagcacggugcccauggagaacuucgccuggugcacggucugcggcucga

SEQ ID NO: 4242400 - RNA, 62 nt, Pseudomonas aeruginosa PA01
gcggguugaggacgaugucgaccggggugccguuggcaucgugcggcaugucuuccaccggc

SEQ ID NO: 4242401 - RNA, 58 nt, Pseudomonas aeruginosa PA01
ggaauaggugguggagaacugcucggaauuuucccggcgauucugcagcgccuuuucc

SEQ ID NO: 4242402 - RNA, 55 nt, Pseudomonas aeruginosa PA01
gccgggcgucggcaccgaggugaucaucccuacccgcuucgugcugccgccuggc

SEQ ID NO: 4242403 - RNA, 96 nt, Pseudomonas aeruginosa PA01
gauguccggggagacgaucaucagguucucgaagcgcuggucuucgauaucguccaccagcacgggcgaaccguagauguugucuaccgggauauc

SEQ ID NO: 4242404 - RNA, 65 nt, Pseudomonas aeruginosa PA01
gcgauucgggcguggugaccaggaugugcggcgggcgcuugcgcaucgcuccgcgcucgaccugc

SEQ ID NO: 4242405 - RNA, 70 nt, Pseudomonas aeruginosa PA01
ggccaacaaguaauacucgguucuccggcgggcggcagcgcccgccggagaaaucguguuaugaugagcc

SEQ ID NO: 4242406 - RNA, 80 nt, Pseudomonas aeruginosa PA01
cacuccuuguucagcugugccagcggagcgacgaauuccuugacggcuucguuggcuucguuggccuggcagaacuugug

SEQ ID NO: 4242407 - RNA, 60 nt, Pseudomonas aeruginosa PA01
acucggucuggggccuggaaggcgccugggcgcugggugccuucucggcccaggccgagu

SEQ ID NO: 4242408 - RNA, 65 nt, Pseudomonas aeruginosa PA01
cgcuggcguugcaauugccgccgcuggcgcagggggugcugguggugcagucgucgaugccggug

SEQ ID NO: 4242409 - RNA, 80 nt, Pseudomonas aeruginosa PA01
ccagaccaccggcuugcugcuggucgccuaugcccugcuguucaugccgcugacccaggcaccgauccgcguggcccugg

SEQ ID NO: 4242410 - RNA, 62 nt, Pseudomonas aeruginosa PA01
gggcgccucugaaagcugucccaagaccuugcaccggcaggcguuuugggagaguuuucccc

SEQ ID NO: 4242411 - RNA, 75 nt, Pseudomonas aeruginosa PA01
gcccagggcgaggaauucgccuugcugcgcgacgcccuggccgggcgcccggaagcgcggguccucgaccugggc

SEQ ID NO: 4242412 - RNA, 79 nt, Pseudomonas aeruginosa PA01
ggcgguagccauggcuggggucgaccuuguugucggucuccagcagcgaguagccgauccccggcaucaggaagcugcu

SEQ ID NO: 4242413 - RNA, 63 nt, Pseudomonas aeruginosa PA01
uggugugggcagagccugccguccacgcccuucuggcgcagggccaggcgcugcugcacgccg

SEQ ID NO: 4242414 - RNA, 64 nt, Pseudomonas aeruginosa PA01
ggaaaggguguccggcaccggcgucaccgcaccgaggauggucgccggaucggcgcccagcgcc

SEQ ID NO: 4242415 - RNA, 62 nt, Pseudomonas aeruginosa PA01
ccagggcgaggacgucgaccuugagcaggccgaccgcgucgagaucguccuugucccacugg

SEQ ID NO: 4242416 - RNA, 65 nt, Pseudomonas aeruginosa PA01
gguagucuucgaugcgccgcagguugcacuugaaguguccgugguacaccgcaucgaagcgcacc

SEQ ID NO: 4242417 - RNA, 81 nt, Pseudomonas aeruginosa PA01
ccgucgaauucuggaugacccugucccaggccgagcagcgcaaccccgcgcgccugcagggcaugcaggaaaccaaggcgg

SEQ ID NO: 4242418 - RNA, 77 nt, Pseudomonas aeruginosa PA01
cgccgcgugcucgguuguggcggaugguggcggcgaugcgcucgcugucgccuucacgcccggcgcguaucgcggcg

SEQ ID NO: 4242419 - RNA, 74 nt, Pseudomonas aeruginosa PA01
ggggucccgggagguggagagauagccggcgucguggccgaccuggcccucuuucaccgccucgaaggcauccc

SEQ ID NO: 4242420 - RNA, 71 nt, Pseudomonas aeruginosa PA01
gcauccagucgagucgccgccucgaacgugaagcacaacgcaacgucgaguugauguggcugaccggacgc

SEQ ID NO: 4242421 - RNA, 107 nt, Pseudomonas aeruginosa PA01
ggccgaccguuuuccccgcggucucgauggcugagcauugccugagugcgcgucccgcaccgcgcagcgugcccucaggcaaugcucagccgaacgcgaagucggcc

SEQ ID NO: 4242422 - RNA, 97 nt, Pseudomonas aeruginosa PA01
aggcggcccugcuggagaucuggaagagcgugcugaaacgcccggcgaucggcgucagcgacaauuucuuccaggucggcggcgacuccauccgccu

SEQ ID NO: 4242423 - RNA, 63 nt, Pseudomonas aeruginosa PA01
ggucggggugcugaucggcgucgugcuguacgccgcggcgcggucgcucgacgguacgccgcc

SEQ ID NO: 4242424 - RNA, 73 nt, Pseudomonas aeruginosa PA01
ucuuccugcucguccugguacuccagggccagggugugggaaagguccggggucaggucgcugagcagggaga

SEQ ID NO: 4242425 - RNA, 59 nt, Pseudomonas aeruginosa PA01
ccuggugaacaucgucucggccgacuacuucgggcucggcuucggcgaguacgccgcgg

SEQ ID NO: 4242426 - RNA, 79 nt, Pseudomonas aeruginosa PA01
cggaucguaggugcggcaguucgggauggucgaggccagcagguggcuguggccguccucgugcugcaggccuucgccg

SEQ ID NO: 4242427 - RNA, 55 nt, Pseudomonas aeruginosa PA01
cgaggccggcguggcgaaguaggcgaccagcggcaguucgucauccaccgccucg

SEQ ID NO: 4242428 - RNA, 56 nt, Pseudomonas aeruginosa PA01
ccguugaagaaccucgaucgcggcacccaccaggucgcaguggaaaucaucgaugg

SEQ ID NO: 4242429 - RNA, 65 nt, Pseudomonas aeruginosa PA01
gcgcuuguuugcacgcaccuuccaggugcucgacaaggcugugggaaaguugcugcaacaggugc

SEQ ID NO: 4242430 - RNA, 89 nt, Pseudomonas aeruginosa PA01
ggccguagagcauccggcuguugcaguagacgccgcuguuguagaccgacaaugccgcggugaguacuacgaaguugaggauguuggcc

SEQ ID NO: 4242431 - RNA, 89 nt, Pseudomonas aeruginosa PA01
cuuccucgcccucgcuggacagcaggcggcgggcgaccacguaggccaugcgguugcccaggccgaucucuuccagcagguccucgaag

SEQ ID NO: 4242432 - RNA, 90 nt, Pseudomonas aeruginosa PA01
gcccucggccugccgcugcugugcguggagggggucgaggccgacgacgugaucggcacccuggcgcgcagcagcgccgcggcugaccgc

SEQ ID NO: 4242433 - RNA, 100 nt, Pseudomonas aeruginosa PA01
gguucugagccuccgcccgcgucucugcguuucguaaagcaagccccgccggccgcggggcugugucgcaagcgcgacaagggcugaagcgucagccgcc

SEQ ID NO: 4242434 - RNA, 79 nt, Pseudomonas aeruginosa PA01
gccucguaggcuucguagaucuucagcaugguggcgaggaacaggucgccgccgggcuggauguguugcggccgcaggc

SEQ ID NO: 4242435 - RNA, 89 nt, Pseudomonas aeruginosa PA01
gccgaggccgacggcgagcgccaggugauccucggcagcaccccgcugcucgacgccgacgccgcgcucgccgcgcucgacgccgcggu

SEQ ID NO: 4242436 - RNA, 64 nt, Pseudomonas aeruginosa PA01
gcugcgaaacugcugcugcaacugcacggugagguucugcaguuccuccacgcgguuucccagc

SEQ ID NO: 4242437 - RNA, 97 nt, Pseudomonas aeruginosa PA01
gguggugaucgcgcaggccgcuuucggcauguggacggugacccucaagcucuggccgcagguggucaccgcccaucugcucggcggcuucaccacc

SEQ ID NO: 4242438 - RNA, 62 nt, Pseudomonas aeruginosa PA01
cuucccgucgucucgucggucacagcuggaaagggcggcuggccgagcgauucggcgggagg

SEQ ID NO: 4242439 - RNA, 61 nt, Pseudomonas aeruginosa PA01
gcgaagaucagguggcaauugggguucuccgccggauacggcuugaucuccgccaccucgc

SEQ ID NO: 4242440 - RNA, 83 nt, Pseudomonas aeruginosa PA01
gcguugaggaggaucuccagggugguguaggcgccgaucucguggagggucuugcgcuuguccuggaagaucuuuucccgcgc

SEQ ID NO: 4242441 - RNA, 56 nt, Pseudomonas aeruginosa PA01
gggguguggaucugcgucggguccaguucgccgggcucgacgaucuccuccaccuc

SEQ ID NO: 4242442 - RNA, 84 nt, Pseudomonas aeruginosa PA01
gcaacucggcugggacgaggaccgcaucgccgcccugggccugcgccugggcgccgacgugccggucuucacccgcggacgcgc

SEQ ID NO: 4242443 - RNA, 70 nt, Pseudomonas aeruginosa PA01
gggggcaagccggcgaucgccuugagcgguccggcagggaucgccgcggcgacgccggcgagccugaccc

SEQ ID NO: 4242444 - RNA, 56 nt, Pseudomonas aeruginosa PA01
ggggcggcgacguucagcccggaucgcggugguccggguggaagucgcugaccgcc

SEQ ID NO: 4242445 - RNA, 125 nt, Pseudomonas aeruginosa PA01
ccugcugguugccggccgggacgaaggcguucccgccgcuguuuucggcgugcgccgccuggaugccgagggccaggcugagaaggacggcgggaacguacgaacgacuggaaggggcaaacagg

SEQ ID NO: 4242446 - RNA, 68 nt, Pseudomonas aeruginosa PA01
cuugaccggcuucggcggccuucugcuucagucggcaugcggcggacagaccggcggggccggcgccg

SEQ ID NO: 4242447 - RNA, 81 nt, Pseudomonas aeruginosa PA01
ggcagguggaugccgagaagcacgugguugcgcgccagggugaagaugucgcgcagcggcuccucggcauucuccacugcc

SEQ ID NO: 4242448 - RNA, 67 nt, Pseudomonas aeruginosa PA01
cgcauggccuugcggcggucguaguggucggucacaccgaccauggagaucgccgacaucaccagcg

SEQ ID NO: 4242449 - RNA, 63 nt, Pseudomonas aeruginosa PA01
aggggccgaucggcgcggugguggcccugccgcuggugcugccgccgacggugaucggcuucu

SEQ ID NO: 4242450 - RNA, 59 nt, Pseudomonas aeruginosa PA01
ggagcuguuucucguggcccugcgccgcgaggugcgcaagcucgacgagaacggcaucc

SEQ ID NO: 4242451 - RNA, 65 nt, Pseudomonas aeruginosa PA01
gccccagguguucggcaucggccgccagcgccccgaggccguggccgggaucgagcaacuggcgc

SEQ ID NO: 4242452 - RNA, 58 nt, Pseudomonas aeruginosa PA01
cgcguuguuggugccguugagcgggccgaacaggcccaucggggcgaggaucagcgcg

SEQ ID NO: 4242453 - RNA, 79 nt, Pseudomonas aeruginosa PA01
gcaugcucgcugauacccgccagguggcgcacgaucaauugcuccagugccuucucgcugguaucgguggguuucaugc

SEQ ID NO: 4242454 - RNA, 84 nt, Pseudomonas aeruginosa PA01
cggugcccgauggccuguggauggugccggccggguucgguguguggauucccggcggcaucgcccauagcaaccgggucaccg

SEQ ID NO: 4242455 - RNA, 59 nt, Pseudomonas aeruginosa PA01
ugccggcgaggucggccaugacgcccaugacgaagggcagcuggaccuucuucucggca

SEQ ID NO: 4242456 - RNA, 57 nt, Pseudomonas aeruginosa PA01
gcucggguguccugcaagcagaucacgucggcauucugugcuugcagccaacugagc

SEQ ID NO: 4242457 - RNA, 85 nt, Pseudomonas aeruginosa PA01
ggcguugcggccaucguagugcuguaccgggagcgcguuggcgucgauguccuccaggcagcgcgcguugaccgcggccaucgcc

SEQ ID NO: 4242458 - RNA, 86 nt, Pseudomonas aeruginosa PA01
ggcguucgauggccucggcgggcgcgauggccucgcguugcaggaggaucgacaaggccgcgaugcgcccgccgaucaucgccgcc

SEQ ID NO: 4242459 - RNA, 74 nt, Pseudomonas aeruginosa PA01
ugcaggcgcucgaccuugaugucuuccaggccggaaacgguaaauuccgggaagacuucgaagguugcgaugua

SEQ ID NO: 4242460 - RNA, 102 nt, Pseudomonas aeruginosa PA01
gucgggggcgaagaaccgcaguuccuguuccaggcguucggcauucuggcugucggcggucagcagcagggugaagcgcuuggcggaacuggcggccucggc

SEQ ID NO: 4242461 - RNA, 83 nt, Pseudomonas aeruginosa PA01
uccagccgggcaugagucaacgacaugaccccgcggcccggcuucggcgcaggaaugucguuggucucaccaauccgguugga

SEQ ID NO: 4242462 - RNA, 88 nt, Pseudomonas aeruginosa PA01
gcgagcugggcgaauucgcuggcggagaagugcggguugcccagcgccaccaggucgauccgcgucucgccggcgcuguccagcucgc

SEQ ID NO: 4242463 - RNA, 55 nt, Pseudomonas aeruginosa PA01
ucggccuugagccgacgucgcgagcccagguugcggcguuucaccuccaggcuga

SEQ ID NO: 4242464 - RNA, 129 nt, Pseudomonas aeruginosa PA01
ggaaagagcgccgucggucagucgaggguuucgacuuucaggcgcaggcuggugucgucgcgucccugggucgaguagcgacgcacgaagccgcgcuggucggccugguucuguucgcugacgccgccc

SEQ ID NO: 4242465 - RNA, 57 nt, Pseudomonas aeruginosa PA01
gcgaggaccugccgggcgcucuggcgaaucaccccccagcgcuugggaucguccugc

SEQ ID NO: 4242466 - RNA, 99 nt, Pseudomonas aeruginosa PA01
gcacgcagguccucgucacggaagcacuuggcgaucugguaguagcgaucgaagccggcgaccaucagcaguugcuugaacagcuguggcgacugcggc

SEQ ID NO: 4242467 - RNA, 84 nt, Pseudomonas aeruginosa PA01
ugcuugcccucaacgccgccaucgaggccgcgcgggccggggaaaugggccgcggcuucgccgugguggccgaugaggugcgca

SEQ ID NO: 4242468 - RNA, 129 nt, Pseudomonas aeruginosa PA01
cggccgggccgaugcugucguagccggggagcaccgcgaugccgccggugcccagcgccaucaggaacaggguaaggagcaucgccggcuugcgcccggcgcggucggcguaggcgccgauaaggaccg

SEQ ID NO: 4242469 - RNA, 87 nt, Pseudomonas aeruginosa PA01
gugggugagaaucaacgggaagcccagggccucggccgucucgcguagggcaucgaggucgcucggggcuuccauguucucgccgau

SEQ ID NO: 4242470 - RNA, 60 nt, Pseudomonas aeruginosa PA01
gacggcgggaugguggugaacaacuggaugaugcaauuccucaccgacauccuuggcguc

SEQ ID NO: 4242471 - RNA, 60 nt, Pseudomonas aeruginosa PA01
ugcuccaguugcgccaguuccaccugcaacuugccuucguggguacgugcgcgcugggcg

SEQ ID NO: 4242472 - RNA, 55 nt, Pseudomonas aeruginosa PA01
gcuaccauuagaacaagggcagauauuuucauaucugccccuggauaaauggagc

SEQ ID NO: 4242473 - RNA, 75 nt, Pseudomonas aeruginosa PA01
cauccucgacggacggucauuuucguucgaaaucacgaacguacgcacauggaauggacucccgccgacgagaug

SEQ ID NO: 4242474 - RNA, 99 nt, Pseudomonas aeruginosa PA01
ggcaguggcacaggcgcuuggucgucggggggcagugcggauggaucgguuucuccggguugccgacgcuccucuccgcggccuucgccgcccgcuguc

SEQ ID NO: 4242475 - RNA, 57 nt, Pseudomonas aeruginosa PA01
acagggugguaucggccugcgccugcgacgcguauggcugcugauggcuauccaugu

SEQ ID NO: 4242476 - RNA, 87 nt, Pseudomonas aeruginosa PA01
ugaucgcggugcucucgcggaggaauucgggguuggugccgacgccgaagucgaccccggccuucuugcccgagcaguccucgauca

SEQ ID NO: 4242477 - RNA, 62 nt, Pseudomonas aeruginosa PA01
guggcccguguggcugacucgaccagucgaacgccgaucaccgagucaaccguacaggccac

SEQ ID NO: 4242478 - RNA, 56 nt, Pseudomonas aeruginosa PA01
cuggccugauagucgaacagcuucgccagucccgaggcgacgaacaucagggccag

SEQ ID NO: 4242479 - RNA, 118 nt, Pseudomonas aeruginosa PA01
gccgagcuggcgcucguugaugaucgcgguguagucgggguuguccgaaagacgcgggaagaagcccuggaccaccuccuuguacugacugacgaauuccucgacgcgccggcucggu

SEQ ID NO: 4242480 - RNA, 69 nt, Pseudomonas aeruginosa PA01
gacgucgucgcccaguucggccgcggccauggcuucgcgcaugccggcggugggcugggugacgguguc

SEQ ID NO: 4242481 - RNA, 79 nt, Pseudomonas aeruginosa PA01
guagagaugugauugguguucagcaaaggccgguucugcuaucaucgccggccauuguugaaaacaguucgcagucagc

SEQ ID NO: 4242482 - RNA, 83 nt, Pseudomonas aeruginosa PA01
cugcucgaggagcgcccggcgaugcgcgcuugccggcgcguggaaaagacggcgagcgcuuccugaggcgcguagcagagggg

SEQ ID NO: 4242483 - RNA, 74 nt, Pseudomonas aeruginosa PA01
aacugcucgaggacgcugaaggcaugcuccaucucgcgcagggucugcagcaugaucuuggcgucccagcgguu

SEQ ID NO: 4242484 - RNA, 122 nt, Pseudomonas aeruginosa PA01
ugccgccgucauugccgccgccguuauuguuuccaccgccauugccaucgccgccgccgucacugcccggcguggucgggucgguuggauccgugggaucggucggggccuugacgcaggua

SEQ ID NO: 4242485 - RNA, 72 nt, Pseudomonas aeruginosa PA01
gcugcccucgcagcgccaggcacuguugucgcggugggccaccagcaggccgcggcgcucgcgcucggcagc

SEQ ID NO: 4242486 - RNA, 88 nt, Pseudomonas aeruginosa PA01
gcggaugccggcggaguucaucgacggcuacggccaggcucugcucgccggggccugacccgucgcgcgucgaccggcaggcauucgc

SEQ ID NO: 4242487 - RNA, 70 nt, Pseudomonas aeruginosa PA01
ugccggcgauuggccggccgucgacgcggaucucgccgucguagucgcgguccaggccgaucagcaggcg

SEQ ID NO: 4242488 - RNA, 84 nt, Pseudomonas aeruginosa PA01
ucacccgccgcggauugagcuggaggaacugcaccagcuucagcgcggugcgguuggccgccggcuugaguucggcgcgguuga

SEQ ID NO: 4242489 - RNA, 76 nt, Pseudomonas aeruginosa PA01
ccggagauguucaggucgaugucgccgaugucgaauagauagucgagauugucgaagcggcgcuggauggcuucgg

SEQ ID NO: 4242490 - RNA, 76 nt, Pseudomonas aeruginosa PA01
gugaccgccggcagcggugggccccacggcugcgaagcguuucgcggccugucccaucccccgccugcgcggucac

SEQ ID NO: 4242491 - RNA, 70 nt, Pseudomonas aeruginosa PA01
gcccgaaugccguucguccucagugcccggaggcggccgcgccgggcuuggcgccgaacggcgggcgggc

SEQ ID NO: 4242492 - RNA, 60 nt, Pseudomonas aeruginosa PA01
agcaggucgagcaguaccgcgcugccgacgaggccaagcgcggcaagauguucggcuucu

SEQ ID NO: 4242493 - RNA, 98 nt, Pseudomonas aeruginosa PA01
ggacguuguugaugaacgacuucggaucguucagcaccuugcggucgaccugguaggcccagaacugcuuggagaucucgaaguucucguugaucgcc

SEQ ID NO: 4242494 - RNA, 75 nt, Pseudomonas aeruginosa PA01
gcuucgugccgaucgccaccgggaucagcgcggucugccugggccugcuguucggggugaucuggccaccgcugc

SEQ ID NO: 4242495 - RNA, 85 nt, Pseudomonas aeruginosa PA01
cggguccgugcacugauguggcugcgcggaccgcugccgccggaggccgggggcuuggucagcgcggccaguugcacgcgguucg

SEQ ID NO: 4242496 - RNA, 124 nt, Pseudomonas aeruginosa PA01
cggaacgaccuugaucagaagaauggcggagacgaucaaggcaacgaugaugacggcgauaggauaagucaucgccuuccugaucuuugcuuuuaacgauuccguuuuuuccuuguaggucgcg

SEQ ID NO: 4242497 - RNA, 57 nt, Pseudomonas aeruginosa PA01
gcgcuuuuuacgaccuuugcuugagcgaaaucgaaaccgaaggaaaaagaagggcgc

SEQ ID NO: 4242498 - RNA, 59 nt, Pseudomonas aeruginosa PA01
ccuggggcaguucgaucagcgcguugaggcgguacucgccgcgccuccagugcuccagg

SEQ ID NO: 4242499 - RNA, 75 nt, Pseudomonas aeruginosa PA01
gucgagcccgcgcuuguggcacucgugggcgauggcuuccucgaagucgcugaugaaguucaccgcggucuugac

SEQ ID NO: 4242500 - RNA, 59 nt, Pseudomonas aeruginosa PA01
ugcagcacggccugguugucccaccagacgaugucgcccaccgaccaggcguggcugua

SEQ ID NO: 4242501 - RNA, 63 nt, Pseudomonas aeruginosa PA01
gugaugucaugggugacggugaaggugccguaggccgcggagccuuucgcaugcaugcgucgc

SEQ ID NO: 4242502 - RNA, 58 nt, Pseudomonas aeruginosa PA01
ggcgcugcuguuccaguacgcgguggcgauccagcaucugcgccuggacaaguacgcc

SEQ ID NO: 4242503 - RNA, 79 nt, Pseudomonas aeruginosa PA01
gaccgauggagcguucggcaaaggugccuacgucgcgccgaccguguucaccgauugccgcgacgacaugaccaucguc

SEQ ID NO: 4242504 - RNA, 56 nt, Pseudomonas aeruginosa PA01
gccggugaagcugcaauggacccgcgaggacgacauccacggcgguuucuaccggc

SEQ ID NO: 4242505 - RNA, 71 nt, Pseudomonas aeruginosa PA01
uugaguaggaagcuauugacguggaucagcauucaacaauagccgcugccgccuaaugucuucacucucaa

SEQ ID NO: 4242506 - RNA, 61 nt, Pseudomonas aeruginosa PA01
ugccgaccagguccagggacggagcgagggucuucucgccuuccuuccacuuggccgggca

SEQ ID NO: 4242507 - RNA, 61 nt, Pseudomonas aeruginosa PA01
gcgaugcgccggaucggcugaccggcaucgaccagcagcggcucacgccccagcgcaucgc

SEQ ID NO: 4242508 - RNA, 64 nt, Pseudomonas aeruginosa PA01
gguggccgaguucgcggccggugacgaggugaucgucaccggcuacgaccugggcaugaacacc

SEQ ID NO: 4242509 - RNA, 108 nt, Pseudomonas aeruginosa PA01
gccguccucgcgucgccagcgcucccacaacuugcgguaggccgcgcgcgagcgcagcggcugaggccaguuguggaagaugaagcuggcguccucgcugaaggcggc

SEQ ID NO: 4242510 - RNA, 119 nt, Pseudomonas aeruginosa PA01
cagccgguugguggcgcugcacagcggaggccugcagggccgccgggcauugcaggagcguuugcuggcguugcucugaucaggcauccgcggccuggcgcgcgcuaccccacaggcug

SEQ ID NO: 4242511 - RNA, 63 nt, Pseudomonas aeruginosa PA01
gccgugccugguauggcaacccucucccgcgagcgggagaggggcuggaauggcaggccuggc

SEQ ID NO: 4242512 - RNA, 58 nt, Pseudomonas aeruginosa PA01
ggcaggccggguugauggccaggaugcgcgccgccaucaccucgaccuuggccuugcc

SEQ ID NO: 4242513 - RNA, 64 nt, Pseudomonas aeruginosa PA01
aggaucuugugcuugacgaacucguccucguaacgcaggccgucuucguugagcacgcgguucu

SEQ ID NO: 4242514 - RNA, 58 nt, Pseudomonas aeruginosa PA01
ggcggugcuggagaugaacuucgaguacgucaacucggaggucaacccggccauggcc

SEQ ID NO: 4242515 - RNA, 109 nt, Pseudomonas aeruginosa PA01
uggugccggugaccuuguagcuaccgucggccugcggcucggccuuggugcgcagcaugcccaggucggugccgcagugcggcucggucaggcacauggugccggucca

SEQ ID NO: 4242516 - RNA, 62 nt, Pseudomonas aeruginosa PA01
gcagucaggcugcgcucaccugacgcugcgcccccagguccaggugagcgcagcccgacggc

SEQ ID NO: 4242517 - RNA, 70 nt, Pseudomonas aeruginosa PA01
guugaucagccucugcgccuucgucgcgccgagcgcggaagggcgcgagcaggccagggcgcugaucggc

SEQ ID NO: 4242518 - RNA, 55 nt, Pseudomonas aeruginosa PA01
ggggcuggucgguagccugcaggcgcuggaggcgcucaagcugcuggccgguuuc

SEQ ID NO: 4242519 - RNA, 67 nt, Pseudomonas aeruginosa PA01
gauuggcggcgccaucucccuguuccagcuacccaucagcgaauacccggaaguggugccgccgacc

SEQ ID NO: 4242520 - RNA, 63 nt, Pseudomonas aeruginosa PA01
ggcgccgagcgcgaggagauggucgagguggucaacaccuucacccgccguugcgccagugcc

SEQ ID NO: 4242521 - RNA, 79 nt, Pseudomonas aeruginosa PA01
gcggccggccaggucggcuucaccucggugccggcgacggucgccagccugaccagccuggccaccuuccugaugccgc

SEQ ID NO: 4242522 - RNA, 69 nt, Pseudomonas aeruginosa PA01
ggaucggugguguagacgccgucgacgucgguguagaucuggcauucgucggccuucaacgccgccgcc

SEQ ID NO: 4242523 - RNA, 94 nt, Pseudomonas aeruginosa PA01
agcugcuggaacuggucgagauggaaguucgcgaucugcugaacaccuacgacuucccgggcgacgacacuccgaucaucaucgguuccgcgcu

SEQ ID NO: 4242524 - RNA, 56 nt, Pseudomonas aeruginosa PA01
cgccgguaauguagacgccaccgagcgcgccgacggugagcaccgcguugccggcg

SEQ ID NO: 4242525 - RNA, 64 nt, Pseudomonas aeruginosa PA01
cgcaucgcggcggacgaauggcgccagcucgucacaguucgccgucgucccagccgcgagugcg

SEQ ID NO: 4242526 - RNA, 69 nt, Pseudomonas aeruginosa PA01
cgaugcccguaccgccuauaucaugaccagcaugcugcaggacgugaucaagcgcgguaccgggcgucg

SEQ ID NO: 4242527 - RNA, 69 nt, Pseudomonas aeruginosa PA01
gcgcaugccgagcugggcggcgcuggccagcagcacgcugcccagcgccgccagccagccgcguagcgc

SEQ ID NO: 4242528 - RNA, 94 nt, Pseudomonas aeruginosa PA01
ggcccgggccagcucggcgcucaguugcuugaccugggccagcgccgcaucgcgcuggcuuuccagcgcggcuuucgccgcgguggccugggcc

SEQ ID NO: 4242529 - RNA, 70 nt, Pseudomonas aeruginosa PA01
uugagcagcgcauacagaacuugcgagagaaugccaaggcaagacgugaagaucguauuguucagcucaa

SEQ ID NO: 4242530 - RNA, 58 nt, Pseudomonas aeruginosa PA01
gcuuguccaggaacagcacuuccagggcgcccugcgccugggcccguuccuggagggc

SEQ ID NO: 4242531 - RNA, 97 nt, Pseudomonas aeruginosa PA01
gccaccgcugggcggugggcgagagcggcuucgacccggcgggggcgaccuacgcgccggccgccgaggucgccaauggcuaccgccgagccauggc

SEQ ID NO: 4242532 - RNA, 55 nt, Pseudomonas aeruginosa PA01
caggucgaugcgcgcauuguggaaggccugguugacgaucccgcgcaucgggcug

SEQ ID NO: 4242533 - RNA, 61 nt, Pseudomonas aeruginosa PA01
gcuugcggccugguguuccaggccuuccugccgaaggccguggucgacgccgcgcgcaagc

SEQ ID NO: 4242534 - RNA, 72 nt, Pseudomonas aeruginosa PA01
uuccuggcaccagacgaugugcuugagguucuuguacggagccagaacuuccgccaggucgucuuccgggaa

SEQ ID NO: 4242535 - RNA, 91 nt, Pseudomonas aeruginosa PA01
ggcuguucgggauucucagcuacgucgaaccggugcugcuguuccugguggcgguacuguuccucggcgaggcguuccgucccgagcagcu

SEQ ID NO: 4242536 - RNA, 60 nt, Pseudomonas aeruginosa PA01
acucggccugggccgagaaggcacccagcgcccaggcgccuuccaggccccagaccgagu

SEQ ID NO: 4242537 - RNA, 103 nt, Pseudomonas aeruginosa PA01
uggcucggccagcccgaccugguggcgcagaugcugcgccagggcgugcauccggucugggugcagucgaccugggcgggcaucacgccgcugcuggccgccg

SEQ ID NO: 4242538 - RNA, 80 nt, Pseudomonas aeruginosa PA01
gucggccauggccugguugcuggcauaguugaccgcgaccgcgaaaccgucggcggccagccgccgggcaauggcgcgac

SEQ ID NO: 4242539 - RNA, 60 nt, Pseudomonas aeruginosa PA01
cgaaggagagcgugucggacaugucuuuucucgguggaagcaugugcgaccguuuuagcg

SEQ ID NO: 4242540 - RNA, 103 nt, Pseudomonas aeruginosa PA01
aggccggcggacgaaaggagacggauuuccaggcgaaggguuggguauucuauuuuuuguuauaagaaaaucugaauuuauucuuuuuaacgucagccggccu

SEQ ID NO: 4242541 - RNA, 108 nt, Pseudomonas aeruginosa PA01
gaucgaggcgaccuccagcaacugcgccggcuggccgucggcgucgaagcuuuccuucgagucgaagaucggcagcagguagaacugguccugggggaucgcccgguc

SEQ ID NO: 4242542 - RNA, 89 nt, Pseudomonas aeruginosa PA01
gccgaccacgccgggcguguagccggacugaaagguggcgaugaagccuugcgcccauuccuugcugucgugcccggaagcgugccggc

SEQ ID NO: 4242543 - RNA, 130 nt, Pseudomonas aeruginosa PA01
caagcccucgcagcucuccggcggccagcagcagcggguggccaugggccgggcgcuggcgcggcggcccaaggucuaccuguucgacgagccgcuguccaaccucgaugccaagcugcggguggaaaug

SEQ ID NO: 4242544 - RNA, 62 nt, Pseudomonas aeruginosa PA01
ugcgcggaucccgcgacuagcagugcgcaccgacgcgcgccugcugucgcggauccugcgca

SEQ ID NO: 4242545 - RNA, 65 nt, Pseudomonas aeruginosa PA01
ucggcugacagggccgcggcgccucuccgcggcgaagcggggaggcgccgucgaccugcagcaga

SEQ ID NO: 4242546 - RNA, 69 nt, Pseudomonas aeruginosa PA01
ggcgcgggucagcggcggcaucagguggucgaugaucaccgccugggugcggcgcuuggccugggcgcc

SEQ ID NO: 4242547 - RNA, 88 nt, Pseudomonas aeruginosa PA01
caccggcggcagggccagcucuucggcgauggugguguucuugaugguuuccgccucguccagggucuugcccuucauccacucggug

SEQ ID NO: 4242548 - RNA, 87 nt, Pseudomonas aeruginosa PA01
gcgcgaggucggcgcggcgcacgugcuggagcgcccgcugcaaagcauuuccggcggcgaacugcaacgcgugcugcuggcccgcgc

SEQ ID NO: 4242549 - RNA, 66 nt, Pseudomonas aeruginosa PA01
gucguccaucaccaccaacccuucgcucucggccuucuuggcgaaacgguaggugugaucggcgac

SEQ ID NO: 4242550 - RNA, 91 nt, Pseudomonas aeruginosa PA01
agcgacuggcugaaccggcgaccgucggcgucgaccagggucggcagcgcgcccaucggguugcgcuggcggucggccgggcgcaguugcu

SEQ ID NO: 4242551 - RNA, 77 nt, Pseudomonas aeruginosa PA01
gcggcgugccagcgcagugcuuucaugguugguuuccuugcaggacggagguaggcgcgcugcgcuggcgcgccagc

SEQ ID NO: 4242552 - RNA, 74 nt, Pseudomonas aeruginosa PA01
gcgccgcgccuuguucgccuggcgucgcagguagagcaugcccacggcgaagacgaacagcgcgccgagggugc

SEQ ID NO: 4242553 - RNA, 91 nt, Pseudomonas aeruginosa PA01
gcgacauuaccaagcaagcgcuugguugagaagagggcagaaacaaauccguucucggcuguuacccaagcgcuugcucggucgucuucgc

SEQ ID NO: 4242554 - RNA, 79 nt, Pseudomonas aeruginosa PA01
gcucgaucucggcuacgucggcuucuacgcgguaggugccuacaccuacgcgcugcucgccgaguacgccggguucggc

SEQ ID NO: 4242555 - RNA, 74 nt, Pseudomonas aeruginosa PA01
gcggcaugaccguguacgacuacugccaucugggccacggccgcagcaugguggcguucgacgugaucacccgc

SEQ ID NO: 4242556 - RNA, 130 nt, Pseudomonas aeruginosa PA01
cggcagcaugcugaugaccacgucggcgcccugcaccgcgucgcgggcgcugcgggcggcgcuggcgccggcggcgaccaggccgucgacggcgcucugcaccaggucgaagacguucagcagguagccg

SEQ ID NO: 4242557 - RNA, 76 nt, Pseudomonas aeruginosa PA01
cgagucggcgauggccagcagcgcggcgaucacuuccgcgucauucuugccgcgcaggucggcgaucccguacucg

SEQ ID NO: 4242558 - RNA, 92 nt, Pseudomonas aeruginosa PA01
gcgugcccggcaccgggaaggacauggucggggcguggaagccguaguccaucaggcgcuuggccacgucuuccucgguuaucccggucugc

SEQ ID NO: 4242559 - RNA, 105 nt, Pseudomonas aeruginosa PA01
gcuggcgguccggcgucgcucgcgguguugcucaagcaacugccggccaguuucaaugccgcaguggugcuggugcagcaugucgacgagguauucgccgccggc

SEQ ID NO: 4242560 - RNA, 95 nt, Pseudomonas aeruginosa PA01
gggcgccauggcgcuguucggcgagaaguacggcgaccaggugcgcguacugagcaugggcggcgauuucuccgucgagcugugcgguggcaccc

SEQ ID NO: 4242561 - RNA, 71 nt, Pseudomonas aeruginosa PA01
auggugguggcgggccgggcauggggccgaucggggucaagcggcaccuggcgccguucgucgccaaccau

SEQ ID NO: 4242562 - RNA, 68 nt, Pseudomonas aeruginosa PA01
caaccgcgugcgccagccguucaaugucaauagccuggcacuggcggcugccugcgcggcgcuggacg

SEQ ID NO: 4242563 - RNA, 56 nt, Pseudomonas aeruginosa PA01
aucggcgaucagcacaucggccuugggagucagcacgaugugcuuggcccgccggu

SEQ ID NO: 4242564 - RNA, 79 nt, Pseudomonas aeruginosa PA01
ucggcguccagguccuuggucgcggcgaugaucucguggucguccauguccgcgaucaggguuucccggaccgcgucgg

SEQ ID NO: 4242565 - RNA, 66 nt, Pseudomonas aeruginosa PA01
gcgcagcuucaggcuggcgucgucgaucggcagcuucucgacggucagccggccgaaguucagcgc

SEQ ID NO: 4242566 - RNA, 94 nt, Pseudomonas aeruginosa PA01
accugggcgcugggcgguguguagggagacgcgcccgcagccgcgguggccgcaggcgcggcguuuuccccgagcugcgccuggcgugccaggu

SEQ ID NO: 4242567 - RNA, 56 nt, Pseudomonas aeruginosa PA01
gucuccuggaggcuucgcucggccugccaguagaggaugagcagccccaggacgau

SEQ ID NO: 4242568 - RNA, 88 nt, Pseudomonas aeruginosa PA01
ccgcgcacgcccaggcggcgcgccucuuccagcagccagucgcagaucggcuggcccugguggcggcgccccugcugggugaugaagg

SEQ ID NO: 4242569 - RNA, 63 nt, Pseudomonas aeruginosa PA01
cgguggcgcuguugcugcucggcugguucuggagcgccaaccugcucagcgacggcgcugccg

SEQ ID NO: 4242570 - RNA, 66 nt, Pseudomonas aeruginosa PA01
ggcgagggugccauccacggaccgcuggaggacaugcugcggccgauccugcgcggcacccuggcc

SEQ ID NO: 4242571 - RNA, 89 nt, Pseudomonas aeruginosa PA01
ggggucauggguugcucgugucggucgcuuuucuaaugcgaaucaaucgcggucaugagcacuacacgaagcggcgccggauuuaccuc

SEQ ID NO: 4242572 - RNA, 79 nt, Pseudomonas aeruginosa PA01
ccggcgguacgcugaucgagcugaccuacgaacaaccggccgaucucggcaaggugcguggucaacuggucggcgccgg

SEQ ID NO: 4242573 - RNA, 61 nt, Pseudomonas aeruginosa PA01
ggaaagcuggaacggauagugcucggcgaaaccggcgaggugacacuucuccagcauuucc

SEQ ID NO: 4242574 - RNA, 60 nt, Pseudomonas aeruginosa PA01
gggaccuugccagcgccagcccgccgauccagaugaucuggcugcccugggacaaggccc

SEQ ID NO: 4242575 - RNA, 100 nt, Pseudomonas aeruginosa PA01
gccgcagggcgcaccuggaaccagcgcagccgcggcgcccugcgccugcuacgcuggcaggcgcuggccuguggcgcccaguuccugcuggccuugucgu

SEQ ID NO: 4242576 - RNA, 111 nt, Pseudomonas aeruginosa PA01
gccgccgagauuccccgcuucgccgguaucccgaccuucaugcgccugccggcguucaccgacccggcggcgcugcaggucggccugaucggcgugcccugggauggcggc

SEQ ID NO: 4242577 - RNA, 76 nt, Pseudomonas aeruginosa PA01
ggugcggaucaccacguugugcaacgaagucaccgugccgaugccgcugaccuguugcucgacgucgcgccgcucc

SEQ ID NO: 4242578 - RNA, 78 nt, Pseudomonas aeruginosa PA01
gcccagcagcuuccagccggcggaauacuucggguccugcucuacgcagcgcuggagguguuccgccgcgcguucggc

SEQ ID NO: 4242579 - RNA, 84 nt, Pseudomonas aeruginosa PA01
cggcgggccugcugcaggagggccagggcaugggcgcgggcuuccugcggaugcucgaagcgcuccagcggcucauguucgccg

SEQ ID NO: 4242580 - RNA, 69 nt, Pseudomonas aeruginosa PA01
gcgccuacaccuccucgcugucggccaaggacaucgaguuguuccagcgcgacggcgaggagugggugc

SEQ ID NO: 4242581 - RNA, 89 nt, Pseudomonas aeruginosa PA01
ggcacagcuggauguaccgggacugggaaggguuuugcuggccggcgacggcgggcgcaucgcucucaguuccuacaaugggcuguauc

SEQ ID NO: 4242582 - RNA, 64 nt, Pseudomonas aeruginosa PA01
ucgccggugaccgccugcggauaggccgagaugcccucggcgacuaccccguggucgccggcga

SEQ ID NO: 4242583 - RNA, 57 nt, Pseudomonas aeruginosa PA01
gcgccgacagcggcaccccggcgccgaggcccuugccgaggguaacgaugucggcgc

SEQ ID NO: 4242584 - RNA, 82 nt, Pseudomonas aeruginosa PA01
ucgcuaccgugcugcaguugcucaagcugccggauggcaccgucaaggugcuggucgaaggcgagcagcgcggccaggucga

SEQ ID NO: 4242585 - RNA, 55 nt, Pseudomonas aeruginosa PA01
gguuuccaugaccacgcccugccccgcgaaggcggcaucgccguggauggaaauc

SEQ ID NO: 4242586 - RNA, 66 nt, Pseudomonas aeruginosa PA01
ccgccagcagcgaguugagcuggucgaucuggcccaggaaagcguucagcucgcuguucuggcugg

SEQ ID NO: 4242587 - RNA, 69 nt, Pseudomonas aeruginosa PA01
ggaccgugaccgugcuggcggcgaucaucguggugcugguggugaucgucgcccugcgcggccgcggcc

SEQ ID NO: 4242588 - RNA, 77 nt, Pseudomonas aeruginosa PA01
gcaggugguuuccgcagucuucagcaugccgcgucccuggcagcaggggcacggcucgcagaggaucugcaccaggc

SEQ ID NO: 4242589 - RNA, 70 nt, Pseudomonas aeruginosa PA01
cgggugcuggcggaugucgccgauuggcugcggguggcuacccuggccgucggggacguccacgugcgcg

SEQ ID NO: 4242590 - RNA, 77 nt, Pseudomonas aeruginosa PA01
gggcaauggcgugggcagaaugcuaucgaugcucauauuuaccaugauguugcugccauucugccugaucuuggccc

SEQ ID NO: 4242591 - RNA, 62 nt, Pseudomonas aeruginosa PA01
cugggaucacgcggccaacgacagcuacgacacucaucggcuguucgccgagugggucccgg

SEQ ID NO: 4242592 - RNA, 61 nt, Pseudomonas aeruginosa PA01
gcuuuccgggucgaucugcacgucguagcggucacgguaccagugcgagauggcccggcgc

SEQ ID NO: 4242593 - RNA, 83 nt, Pseudomonas aeruginosa PA01
cgggcauggcaggcugaccgacaaggugcgcggccucgaucucggcgccgacgacuucauggucaagccguuccaguuccccg

SEQ ID NO: 4242594 - RNA, 60 nt, Pseudomonas aeruginosa PA01
ggcggcgcuccucgaaggggaacggcagauugcgguagcccuccuccacguggcgccgcu

SEQ ID NO: 4242595 - RNA, 76 nt, Pseudomonas aeruginosa PA01
gcagggccgccaguccacgacgcaaagcgauggugcgcauggcgcucuccuuugucguugugggugccgaaccugc

SEQ ID NO: 4242596 - RNA, 111 nt, Pseudomonas aeruginosa PA01
gacggugaccaggucguucucgccgaugcggccggccucgaucuccuugguggcgauguaggcggucaucaguuuggucaggcuggccggcggcaggcgcuggucgccguu

SEQ ID NO: 4242597 - RNA, 91 nt, Pseudomonas aeruginosa PA01
uguucgccuggugcgucggccagagccucggccaggucacccugcuggcgacccuggugcugcuggccggcaugugcaucaacggcgcgca

SEQ ID NO: 4242598 - RNA, 128 nt, Pseudomonas aeruginosa PA01
uggauuaaugcucagcuucugcugaacuucauggacgcagcgagggucgguccgaaggugcguugcucgcgaccuuucccgcgaaccgcucgccuccaugaaauaacaagccaagcggaguacaacca

SEQ ID NO: 4242599 - RNA, 60 nt, Pseudomonas aeruginosa PA01
gcccggcgcaggguauggcgguucaccgcgaagcgcugggccagcuggaucucgccgggc

SEQ ID NO: 4242600 - RNA, 82 nt, Pseudomonas aeruginosa PA01
gcucaccggcaaugccuggagcaugcucuauggcacccugauccuccuggcgcugugccuguuccagggcgugccgcugagu

SEQ ID NO: 4242601 - RNA, 79 nt, Pseudomonas aeruginosa PA01
cggggaaccgucgaggcgggcaacgccgccgacgaucgccgggucgucggcgaaaugccggucgccgugcaguuccucg

SEQ ID NO: 4242602 - RNA, 112 nt, Pseudomonas aeruginosa PA01
ucgaggccggccgggagacgccggcgaagcgcuggcacgggcucgccgagacacucgacagcaguccucggcuggacccgcugcgcgucgcccugagcgcccccggccucga

SEQ ID NO: 4242603 - RNA, 58 nt, Pseudomonas aeruginosa PA01
gggugggauugcccugcaaggcuagcguaccuucgcaguuuggcauggcaacccaguc

SEQ ID NO: 4242604 - RNA, 65 nt, Pseudomonas aeruginosa PA01
ugccaguagggcgaacgccccguccgaccgacggucugugaacuaucgcccguacgaaaugcgca

SEQ ID NO: 4242605 - RNA, 99 nt, Pseudomonas aeruginosa PA01
gucgagggccuugucgauguccucggcgguggaacgggggaacucggcgaucggcuggccguucaccggcgagguguuggugaaguacuggcccuugac

SEQ ID NO: 4242606 - RNA, 101 nt, Pseudomonas aeruginosa PA01
cgacccgcgcguagucgccacggugcacguugagguuggugacguagccgucgaccugcgccaccacccgggugcgcuccagguucaggcgcgcggcgucg

SEQ ID NO: 4242607 - RNA, 78 nt, Pseudomonas aeruginosa PA01
gagcaccuugggcaaagucugccgcacuacauguugccgucggcguucgugguccuggcggagcugcccaagacgcuc

SEQ ID NO: 4242608 - RNA, 63 nt, Pseudomonas aeruginosa PA01
ggcacgcaauacccucgaagagcugcacggucuccagccgcagcaccgcacgguauugcggcu

SEQ ID NO: 4242609 - RNA, 119 nt, Pseudomonas aeruginosa PA01
ccggucggaccagcggucgcagcgucgucgacgcuuccauuccgcagcacccgcgccggcgggaacuggggaauggaagcgaggcgcccggacgcagaggccgugaaucucccggccgg

SEQ ID NO: 4242610 - RNA, 66 nt, Pseudomonas aeruginosa PA01
cggcguggugauccaggugccgucggcguaguuacgcggcgcggcacaagccuggaucaccgcccg

SEQ ID NO: 4242611 - RNA, 59 nt, Pseudomonas aeruginosa PA01
gggcgcgggugcgguagaacgaauaccaguuggcgaaguucugccuuugcucugugcuc

SEQ ID NO: 4242612 - RNA, 103 nt, Pseudomonas aeruginosa PA01
gcccgccaucguucgccgcagacccugguggugcucggucgcgacaucgggcggcccggugagcgccugcugcgcaccacccugggcgagcugcgugcggagc

SEQ ID NO: 4242613 - RNA, 56 nt, Pseudomonas aeruginosa PA01
ggcccuucgaccuacggacggaugcguugcugcggaucagucuguucgaaguggcu

SEQ ID NO: 4242614 - RNA, 60 nt, Pseudomonas aeruginosa PA01
auggauggggucuucgaacuggcgcggcagaucgccgcgaagucgccgaucgccauccgu

SEQ ID NO: 4242615 - RNA, 56 nt, Pseudomonas aeruginosa PA01
gcccggcuucccggcggaaagucucgagguccugggcuucgccgugauagccgggc

SEQ ID NO: 4242616 - RNA, 61 nt, Pseudomonas aeruginosa PA01
agguagguugcgugaucgagcgcgcgcacguggccguguucgauccacagcaggccguccu

SEQ ID NO: 4242617 - RNA, 60 nt, Pseudomonas aeruginosa PA01
uucgccgaggagaccuggcggguaccgggcuaccgggccugccugcuguuucccggcgag

SEQ ID NO: 4242618 - RNA, 63 nt, Pseudomonas aeruginosa PA01
gucgccauucccuaccugggcgccuacuccgccgcgcaguucgccaaggagggagugagcgac

SEQ ID NO: 4242619 - RNA, 58 nt, Pseudomonas aeruginosa PA01
gcgggccaagcacaugggguuguugcgcuaggcgcgccaccccauaugccuggcgugc

SEQ ID NO: 4242620 - RNA, 72 nt, Pseudomonas aeruginosa PA01
ucagccgcgaggugcgagccuucgccgccggcgccaacgccgaacuggcggaguucgucaccccgcugcuga

SEQ ID NO: 4242621 - RNA, 92 nt, Pseudomonas aeruginosa PA01
gcagggccaggucguugaccggcaggccgaccguucggucgaucagccaggcccccucaucgucggccugccugaccaacugcccgcccugc

SEQ ID NO: 4242622 - RNA, 61 nt, Pseudomonas aeruginosa PA01
ucgacgggcauggcgagcugcgccugugucgcgaggacaucggccgccacaacgcccucga

SEQ ID NO: 4242623 - RNA, 82 nt, Pseudomonas aeruginosa PA01
gggcgagguguccgccugggagggcucgagccuggaggaacuggaucuuuccgaccucgaucuccccgaggugcaauugccc

SEQ ID NO: 4242624 - RNA, 78 nt, Pseudomonas aeruginosa PA01
cccggcgcuucuucgccacccuggugcaggagguggucggccugcaccagcgccugcgcgaggaaaccgagcgcuggg

SEQ ID NO: 4242625 - RNA, 61 nt, Pseudomonas aeruginosa PA01
ggaaaucuggucgaugaauucgcggaugucggcauccuugagguugaucguccagugcgcc

SEQ ID NO: 4242626 - RNA, 62 nt, Pseudomonas aeruginosa PA01
agcgggcaguugccggugaucgcagugaccuuccgccaccuggucaccgccgacuggcuguu

SEQ ID NO: 4242627 - RNA, 67 nt, Pseudomonas aeruginosa PA01
cgguagcccuuguggucacugccuggagcggccgcggccugcccacggcgcugccacagaagcacug

SEQ ID NO: 4242628 - RNA, 87 nt, Pseudomonas aeruginosa PA01
cgcccagggcuucaccgcgcgcuggcagaccagcuucuucgccaccaacauggaagaggcgcugcgcaguugcguggaggagcagcg

SEQ ID NO: 4242629 - RNA, 64 nt, Pseudomonas aeruginosa PA01
ggugaucaugguggcgccgagaucgacgcugcuguccgccgccucggcgacgcugaugguuauc

SEQ ID NO: 4242630 - RNA, 75 nt, Pseudomonas aeruginosa PA01
ccggggucagcucggcgaugccgcaacugaaggugcagcgcaggucggucgguugcgccggguaguggaucucgg

SEQ ID NO: 4242631 - RNA, 63 nt, Pseudomonas aeruginosa PA01
guugccgaucacgcugucauggccgaugugcgcauaggccaugaucagguuguggucgccaau

SEQ ID NO: 4242632 - RNA, 105 nt, Pseudomonas aeruginosa PA01
cgcugaaguagcgugaaugggcccuuucgccguggauuaacaggaucgggcguggcgagaucuccuugauguaggugaggaucggcauguucaugaacgacagcg

SEQ ID NO: 4242633 - RNA, 61 nt, Pseudomonas aeruginosa PA01
augccgguuuccagggcgagacgggcaaacccggcaccgcccucgccuacgaacaccgcgu

SEQ ID NO: 4242634 - RNA, 93 nt, Pseudomonas aeruginosa PA01
ucggccuggcucucuaccucggcuggacccucuggcagcuacugcgccugcaccaguggcugcgcaaccaccagccagacgagccaccgccgg

SEQ ID NO: 4242635 - RNA, 129 nt, Pseudomonas aeruginosa PA01
ucagucgguuguugcaggauauagaagcggagcagcgacaaguaucgguggaguuucuggaacugaacaauauguugucgcccaugcucaaucuacaauugucguuccuguucguagcggccuauugaa

SEQ ID NO: 4242636 - RNA, 108 nt, Pseudomonas aeruginosa PA01
ggacgguucuccccggccucuucgccggccaguuuggaggccucggcggccucgucggcgaggcccagcccgagcuggcgaccgcgcaacagguugacgaggauuucc

SEQ ID NO: 4242637 - RNA, 59 nt, Pseudomonas aeruginosa PA01
gcuuggcgcacugcgcgaauucgcccggcugcagggccugucgcugcaacacgucaagc

SEQ ID NO: 4242638 - RNA, 60 nt, Pseudomonas aeruginosa PA01
acuugcucggccagcucgggcugcuggugucaccggcggcgcgggucuggcugagcacgu

SEQ ID NO: 4242639 - RNA, 59 nt, Pseudomonas aeruginosa PA01
ggcggucgaggagaucgucaagcaauugccgaaaggcguuggcuacuccuggaccggcc

SEQ ID NO: 4242640 - RNA, 55 nt, Pseudomonas aeruginosa PA01
gcccuguucgagagccuggcggacccgcccggcguccaccaguucgaacagcggc

SEQ ID NO: 4242641 - RNA, 73 nt, Pseudomonas aeruginosa PA01
ucguugaggucgaugcguggggugcucuugccgaugcucaugcgcaccagcggcccgcgcaucaccgcggcga

SEQ ID NO: 4242642 - RNA, 81 nt, Pseudomonas aeruginosa PA01
ggcaguggagaaugccgaggagccgcugcgcgacaucuucacccuggcgcgcaaccacgugcuucucggcauccaccugcc

SEQ ID NO: 4242643 - RNA, 69 nt, Pseudomonas aeruginosa PA01
gaggcguuccaguucggccgcggcuggcaggugccgcucguccaguuccagggucagcuggcgcgccuc

SEQ ID NO: 4242644 - RNA, 88 nt, Pseudomonas aeruginosa PA01
ucgcgcuucaacgcgcgcagcagccuggccggcaguuuuucgucguugaggaagccgaacagguagcugagcagcagcaugacgccga

SEQ ID NO: 4242645 - RNA, 71 nt, Pseudomonas aeruginosa PA01
cgaagccgaugauccgcuccugcucgccgagccccaggccggcgugcaccaccggaucgguggccaucucg

SEQ ID NO: 4242646 - RNA, 58 nt, Pseudomonas aeruginosa PA01
guugcggucgcguaccucgaugaagcgcacaugcggggugucgaggguggccugcagc

SEQ ID NO: 4242647 - RNA, 58 nt, Pseudomonas aeruginosa PA01
gguggccaguaccguggugcuguugcgcgcccuggagcagcgccaguugcuggacacc

SEQ ID NO: 4242648 - RNA, 88 nt, Pseudomonas aeruginosa PA01
gcggcgcagcccguggagaaggcccggaggaggacgacaugcuggcauccugggccuucugggcacugcuuucggcgcuguucgccgc

SEQ ID NO: 4242649 - RNA, 129 nt, Pseudomonas aeruginosa PA01
aaggcgggccccgcuggacggggccucguugaagguucagaagcugaagucgaccuugguccagaagguccggcccggcucuggaaccguuucguuggcggagaaaccgaagccggcgucgccggccuu

SEQ ID NO: 4242650 - RNA, 63 nt, Pseudomonas aeruginosa PA01
gggguacgcugcggcuuggcgccgaagcggcggaacgccucggcccaggcugccaggugcgcc

SEQ ID NO: 4242651 - RNA, 60 nt, Pseudomonas aeruginosa PA01
ggcguugaccggguuguccaccacgcucagcagcagggacuggagcaccucggcgaugcc

SEQ ID NO: 4242652 - RNA, 60 nt, Pseudomonas aeruginosa PA01
ucagccgguaguagaggucagcgcggaaacggccuucgcgcaucgccugcugcaggucga

SEQ ID NO: 4242653 - RNA, 55 nt, Pseudomonas aeruginosa PA01
ucggcaggcagcugauagcuccagguuucgcucaguggcuucugcgccucgucga

SEQ ID NO: 4242654 - RNA, 55 nt, Pseudomonas aeruginosa PA01
gcuggccgggguggcggugccgagggcgccguggaagcucgccacgccggccagc

SEQ ID NO: 4242655 - RNA, 60 nt, Pseudomonas aeruginosa PA01
ugucguugggcagaccgcgcaggcucaccccgagcagugcgccgaguacgcccagcggca

SEQ ID NO: 4242656 - RNA, 63 nt, Pseudomonas aeruginosa PA01
ccaauggggcggcaugaucggcaucggcgccaaucgccugccacagaucggccgccugccggg

SEQ ID NO: 4242657 - RNA, 60 nt, Pseudomonas aeruginosa PA01
gucguugggcagcaggcucugcgcggcguugaucgccgccuggacuuccugcucggcgac

SEQ ID NO: 4242658 - RNA, 73 nt, Pseudomonas aeruginosa PA01
gauugccaccuugcuguucagcgccacggcgcuggccgcgccgaagccgugcgaggaacucaaggcggagauc

SEQ ID NO: 4242659 - RNA, 97 nt, Pseudomonas aeruginosa PA01
agcgccuaccuggcccucgaccggcagaucgaggaggggcgcggcgaacagaccgcgcugaucuacgacucgccggugaccggcacccaggaccgcu

SEQ ID NO: 4242660 - RNA, 73 nt, Pseudomonas aeruginosa PA01
ggucgugcagcguggccuucuccucggacagccagcgcugcuggagaaugucgcggcugcgcucgucgaggcc

SEQ ID NO: 4242661 - RNA, 63 nt, Pseudomonas aeruginosa PA01
ggcugaugcagcagcgccauguccccgauccgcuguaucgcggcgcgcugcugcuggucagcu

SEQ ID NO: 4242662 - RNA, 79 nt, Pseudomonas aeruginosa PA01
agcugcgcgccgcgcgccacggcauucugcgacugguuguagccguccaggccggccuguggcgcuucggucugccgcu

SEQ ID NO: 4242663 - RNA, 58 nt, Pseudomonas aeruginosa PA01
cggggugcuguuccgcaucggcaucgagaucugcaacgccgccgagcaacagacccug

SEQ ID NO: 4242664 - RNA, 82 nt, Pseudomonas aeruginosa PA01
cgccaccggcgcgccggcagccugcugcgcgccuaugucuggccgcugggcgcguacaucggugucggcgcggugcuuggcg

SEQ ID NO: 4242665 - RNA, 61 nt, Pseudomonas aeruginosa PA01
ucggcgggcgcaucgcggccuugucgauccuccugcaacgcgaggccaucgcgcccgccga

SEQ ID NO: 4242666 - RNA, 55 nt, Pseudomonas aeruginosa PA01
cccggcgggcaccuguguggccgggaaacguuugccgcgccuggaccgcgccggg

SEQ ID NO: 4242667 - RNA, 76 nt, Pseudomonas aeruginosa PA01
caccgggccgaaggagagguccgcuccggugagcuugccgaagcucaggcgcggagugaucucgccguaguaggug

SEQ ID NO: 4242668 - RNA, 88 nt, Pseudomonas aeruginosa PA01
guagcugaauuccggcucgucguggucggcaccgagcuugaucuugccguagccggaaagcgcggugaccaccacgaagaucagguac

SEQ ID NO: 4242669 - RNA, 59 nt, Pseudomonas aeruginosa PA01
gcaccugaaggccuccggcaacggccacguggucaaugucuccagcgucuucgggcugu

SEQ ID NO: 4242670 - RNA, 69 nt, Pseudomonas aeruginosa PA01
gggcgucgccuggcuggccaacaagcuggcgcccuacggcgucugccuggaggccggccaggugauccu

SEQ ID NO: 4242671 - RNA, 91 nt, Pseudomonas aeruginosa PA01
ggcugagaucgucggccugcagguggcgcucgacgccggcgcucgggugcgccgggcgcucgucguuggcgcugucgcugacgaucucgcc

SEQ ID NO: 4242672 - RNA, 65 nt, Pseudomonas aeruginosa PA01
uuguccagccauucgcgguagaccaccaccgccagcggcaggcugccgccgauggccuuggacag

SEQ ID NO: 4242673 - RNA, 78 nt, Pseudomonas aeruginosa PA01
cucgaguucccgcuggcagauggcccugaccucgucuuccuggccaccggggccacgugccagcaggaguuccucgag

SEQ ID NO: 4242674 - RNA, 102 nt, Pseudomonas aeruginosa PA01
gcgccucgcgggccaucuucuggcugagcaugcgcugcgcgccggccacguugaugguuuccggcgagaucgacaugcucagguacaacgccaccgaggcgc

SEQ ID NO: 4242675 - RNA, 129 nt, Pseudomonas aeruginosa PA01
ggagugggcgcaagcgcucgaagaggcuggagugggugagauuuuucuaaauucuauugaucgagauggagugcagaaaggcuucgacaacgcucuaguggaaaauaucgcuucuaacguccaugugcc

SEQ ID NO: 4242676 - RNA, 100 nt, Pseudomonas aeruginosa PA01
uccugccauugaucgcccuggccgccugguggguggugcgugccggccucgaaccguugaaccgcuuccgccggguggccgcccaggucagcccgcagga

SEQ ID NO: 4242677 - RNA, 75 nt, Pseudomonas aeruginosa PA01
cucggggagcuggccgaugaucucggcgaugcugucguagaagcccaugucgagcauccggucggcuucgucgag

SEQ ID NO: 4242678 - RNA, 77 nt, Pseudomonas aeruginosa PA01
cggcgccguggcaggccuggcagugcuggcgguagagcgcuucccccggcgcuucgccggccugugcgagggcgccg

SEQ ID NO: 4242679 - RNA, 56 nt, Pseudomonas aeruginosa PA01
gcgccagggucacccguggcuccgagccgccggcgagcagcgcggcgacccggcgc

SEQ ID NO: 4242680 - RNA, 109 nt, Pseudomonas aeruginosa PA01
ggugcugccgacaugcucgaugcccagcccgggcagcgccagcgccgugcggauggccucggcuucggcggcgaaguguuguggccaggcggggucggcaggcagcacc

SEQ ID NO: 4242681 - RNA, 71 nt, Pseudomonas aeruginosa PA01
gcaacaggcucgccggcgauagcagcgcacgggccagggccagucguugcaguucgccgccggacaguugc

SEQ ID NO: 4242682 - RNA, 90 nt, Pseudomonas aeruginosa PA01
ugggcaauugcaggcgguacaggguggcggcgccgaggaaggucuugccgacgauccgcgccuucagcucgcccugcggcgcgugcacca

SEQ ID NO: 4242683 - RNA, 69 nt, Pseudomonas aeruginosa PA01
agggccgggcgacgaacuggacgccgagaucgcggaaauccucggccguccggacgacgacccggcguu

SEQ ID NO: 4242684 - RNA, 72 nt, Pseudomonas aeruginosa PA01
ggccgagggggucuggauguauucgcccaggugcugcgccagcgccccgccgaacauccaggccaccgcgcc

SEQ ID NO: 4242685 - RNA, 56 nt, Pseudomonas aeruginosa PA01
cgccgaaggauggcccgagcgcaggcaucggcaugugcacggcgcugguuucggcg

SEQ ID NO: 4242686 - RNA, 63 nt, Pseudomonas aeruginosa PA01
guuggcgccggagggggagggcgggacccugaggcgggccccgcuuucuaucgagcgaucgac

SEQ ID NO: 4242687 - RNA, 88 nt, Pseudomonas aeruginosa PA01
aggucgaguuucggcgccucggcuucggccuuggcguccuguaggucggcgccuaccggagccaggccgaaauccggcgcaucgaccu

SEQ ID NO: 4242688 - RNA, 76 nt, Pseudomonas aeruginosa PA01
ccuccggccugcaggcgaucgccaucgccgccaaccagaucgcuuccgguugcagcgaggugaucgucgccggcgg

SEQ ID NO: 4242689 - RNA, 66 nt, Pseudomonas aeruginosa PA01
gcccagcuggaugcucgcgcucagcucgugcaacacacuucgcucgcgauugccguccagccaggc

SEQ ID NO: 4242690 - RNA, 107 nt, Pseudomonas aeruginosa PA01
uuguagucgccgcggcggaucaucaucagcgggcugagggugcccucggcgguguauucgccgaucaccucgucaugcccgcugccgucgcgcaggugcggcagcag

SEQ ID NO: 4242691 - RNA, 127 nt, Pseudomonas aeruginosa PA01
gcgccaacgacgaguccggcaagagcaacgggggcaagccggcgaucgccuugagcgguccggcagggaucgccgcggcgacgccggcgagccugacccuggccgccggcgagcacgucgacagcgu

SEQ ID NO: 4242692 - RNA, 101 nt, Pseudomonas aeruginosa PA01
gccugccgccaggcgcuggcgcuggaucgccaggccugcgggcgcugggcgcgggagcaguccuggcggguuucggcggaggaguuccuggcgcugcaggc

SEQ ID NO: 4242693 - RNA, 75 nt, Pseudomonas aeruginosa PA01
gaagguggcgucgcguugcguacgggugcgaucgaauacggugcgcacgccguugccgaugcugaggaugacuuc

SEQ ID NO: 4242694 - RNA, 55 nt, Pseudomonas aeruginosa PA01
gcugcaggucggggagggcgaggagcgcguucaugcggccucccgugcuugcggc

SEQ ID NO: 4242695 - RNA, 130 nt, Pseudomonas aeruginosa PA01
gaucucgcggucggcggucagcucgaugcgcuggcugccgagggugaugcucugaccguccagggugaucuuagagccaucgucgcugccgcccacgcucacuucguagcuaucgcccaccgacaagguc

SEQ ID NO: 4242696 - RNA, 68 nt, Pseudomonas aeruginosa PA01
gcccgaggcugauggcauccacgccauuaucgguaucgccgacgaucuggugcccuucggcuuccagc

SEQ ID NO: 4242697 - RNA, 81 nt, Pseudomonas aeruginosa PA01
uccgccacggccagcggcaacuggcggaggcgguguacaaggccgccuccgccgguuguugccugauggcccaggcgccga

SEQ ID NO: 4242698 - RNA, 60 nt, Pseudomonas aeruginosa PA01
ggcgagaggcgucgaggucggcgcgucggcugucgcggcggccuccgucguuucgucgcc

SEQ ID NO: 4242699 - RNA, 94 nt, Pseudomonas aeruginosa PA01
gccuggcgggucugguggcugggugccgagccgaggcucuugccgccgccgaagcgcuuggcauuggcauccaggcugacggucagcgccaggc

SEQ ID NO: 4242700 - RNA, 73 nt, Pseudomonas aeruginosa PA01
caccacucccggcgacgacgaagaguaaaugcuugaaaaucaaggauuuacggauucucucccaggaguggug

SEQ ID NO: 4242701 - RNA, 96 nt, Pseudomonas aeruginosa PA01
uugagcgccaggcggguauugcggaagucgccgaggcgcuggcgcgccuguccuucggcggcgacgaacaggcugcaaugcucgccgggagcacaa

SEQ ID NO: 4242702 - RNA, 65 nt, Pseudomonas aeruginosa PA01
ucaugcgggugaucgucgcccgccgccugcuggagcagggcggcaugcucgaucgccugcuguga

SEQ ID NO: 4242703 - RNA, 63 nt, Pseudomonas aeruginosa PA01
gcccgucgcgugcaggacuccaccgacgagaucacccagaugauccucgcccugcagucgggu

SEQ ID NO: 4242704 - RNA, 55 nt, Pseudomonas aeruginosa PA01
gaccgucucguugcggucgaccgucuugcugcgguuggcaugcacggugaugguc

SEQ ID NO: 4242705 - RNA, 64 nt, Pseudomonas aeruginosa PA01
cgcguagggcagcagcccguacagccgguagaugcuggcggugaaggcguugcugcucuccgcg

SEQ ID NO: 4242706 - RNA, 89 nt, Pseudomonas aeruginosa PA01
ggccggcgaagugcaugccuaugugaagaccggccgcacccaccugauggaugcgaugccgguacgcaugagccaggugcucgguggcu

SEQ ID NO: 4242707 - RNA, 59 nt, Pseudomonas aeruginosa PA01
gggcgaguugcguaggucuaggaaggggguguugcaccguucuagccuugcagccgucu

SEQ ID NO: 4242708 - RNA, 76 nt, Pseudomonas aeruginosa PA01
cgccagggugcuguugucgaggggauugcugaccgggaugcgcugggcgccgagaccuucgacgaaggcucccgcg

SEQ ID NO: 4242709 - RNA, 75 nt, Pseudomonas aeruginosa PA01
ugcggucgguuuccgccacuuccugcucaugaggcaccaggcuuucgcggacgaacuggcggaugcuguccagca

SEQ ID NO: 4242710 - RNA, 65 nt, Pseudomonas aeruginosa PA01
ggucgacuugcgaguucggauccagcgguccgcggaaacgcuggucguaguauucgaagucgacc

SEQ ID NO: 4242711 - RNA, 82 nt, Pseudomonas aeruginosa PA01
gcgaugcgguccagcaaguaggucgccgcggcagcguaaaccucgcaguugcggcaauggacaugcucggccaggcguucgc

SEQ ID NO: 4242712 - RNA, 111 nt, Pseudomonas aeruginosa PA01
ccgagucggcacgacgcucggacaggcgcugguuguaguuggcggaaccggugcuaucgguguagcccucuacgaucaccuggcgcuccggguucugcuggaggaacucgg

SEQ ID NO: 4242713 - RNA, 73 nt, Pseudomonas aeruginosa PA01
gcggcgcugaagccgauccgcccggugccggagccaucccacaccugcaucucgcgauagggcucggcgcggc

SEQ ID NO: 4242714 - RNA, 58 nt, Pseudomonas aeruginosa PA01
gcccuguggcaagucaccgacgaugcgcacauccgcgucaucgcccuugccgcaccgc

SEQ ID NO: 4242715 - RNA, 57 nt, Pseudomonas aeruginosa PA01
uugcuauggcaucgucggcgacacccucaaccaugucaccgacgccauccaucgcag

SEQ ID NO: 4242716 - RNA, 121 nt, Pseudomonas aeruginosa PA01
gcgcguggugggaggccugcugggcaucuaccugcugguggcgaugcugguuggcugguacuggagccaggaacccgaccuguuccccgugcagcaggacgcccaggccgccgccgagcgc

SEQ ID NO: 4242717 - RNA, 60 nt, Pseudomonas aeruginosa PA01
gaugcugguggaggacugguugaccacgucggcgaugcggcucaucccuuccaccacguu

SEQ ID NO: 4242718 - RNA, 77 nt, Pseudomonas aeruginosa PA01
gccgcguucguccgcgaggacggccuggaccugguauucagcuuccaccaugcgauccucgacggcuggagcguggc

SEQ ID NO: 4242719 - RNA, 67 nt, Pseudomonas aeruginosa PA01
ucguucugccgggccagcgaccgguugccuuccucggucaccgcguucaguugcucggcagcggcgg

SEQ ID NO: 4242720 - RNA, 84 nt, Pseudomonas aeruginosa PA01
gcugguggauuucaucagcaguucgcggacguucgcuccgcucaguucgagcagcgucugcccgccgcugacguugaccaccgc

SEQ ID NO: 4242721 - RNA, 56 nt, Pseudomonas aeruginosa PA01
cugaggcgagaaugaaaaaggccggcauucgccggccuuuuucguggaucgcacgg

SEQ ID NO: 4242722 - RNA, 83 nt, Pseudomonas aeruginosa PA01
auuuucaugaucccgaacugauaccuguuggucuucgacugaaaaagcaagguaagcagguuaucuucgacucccaugaggau

SEQ ID NO: 4242723 - RNA, 90 nt, Pseudomonas aeruginosa PA01
ccuuguguuguucgucgagcgccuuguucugccagccgucguugcccggcagcaacagguugaggacgauggcgacgauggcgcacaggg

SEQ ID NO: 4242724 - RNA, 68 nt, Pseudomonas aeruginosa PA01
ggcgguucaccugcaccugcuggugcagagccccuacgaacugcaacugagcgugcuggagaaccgcc

SEQ ID NO: 4242725 - RNA, 116 nt, Pseudomonas aeruginosa PA01
gccuccuacgcuggccagccggaugcuccgcggggucuuuccaucgcugccggcgagggccguccgcagcgguacgcaggccucgcagccguccagcucgggcaggugggccaggc

SEQ ID NO: 4242726 - RNA, 70 nt, Pseudomonas aeruginosa PA01
gcgcuacaucgccgaccucgaaggcggucgccucugccuggccauggccugggucggcgacgcccugcgc

SEQ ID NO: 4242727 - RNA, 75 nt, Pseudomonas aeruginosa PA01
ucgggaaaauuucccguucauugaaaaguuuguuaaugguagcgacacuuauauaacgggugagaauuuuuacga

SEQ ID NO: 4242728 - RNA, 58 nt, Pseudomonas aeruginosa PA01
cacuuucuuggccuugaucagcggacucucgccgcguacgucgaggucguagaaggug

SEQ ID NO: 4242729 - RNA, 91 nt, Pseudomonas aeruginosa PA01
gcggcaugggcgcggcggugggccagguaccggaguacguggagauggucacccgcuggugcaaggcccacugcucgcugccggugaucgu

SEQ ID NO: 4242730 - RNA, 71 nt, Pseudomonas aeruginosa PA01
gugcuggccaagcaguucgacguggccgagggcaagaucgucccgcgccacgaggaacgcguggccagggc

SEQ ID NO: 4242731 - RNA, 72 nt, Pseudomonas aeruginosa PA01
ccguggcaucguugccgacgaucaugcauuccaccccuucgacccggccgaucccggcgacgaugccggcgg

SEQ ID NO: 4242732 - RNA, 74 nt, Pseudomonas aeruginosa PA01
cugcugguguccugggucggcggcuauuacgccggaaucgaggcgcucggccgcggauugacccagaccagcgg

SEQ ID NO: 4242733 - RNA, 92 nt, Pseudomonas aeruginosa PA01
ggugccucggcuugcccguggucuuccucgucguccgcgcgguugggaccgacgcgcacauaguggaagaacccggcgagcaccguggcgcc

SEQ ID NO: 4242734 - RNA, 114 nt, Pseudomonas aeruginosa PA01
ccgaccccaggacaccgcgacccauggccgguugggcggcaagccugcgcgacaguggacugcuggcgcuggcagugccgcgcguguucgccggcauggagcgggacugggggg

SEQ ID NO: 4242735 - RNA, 60 nt, Pseudomonas aeruginosa PA01
gccaucuucaauacugaaaccagcaaggcugaccgcguuggcuucaagguagaagacggu

SEQ ID NO: 4242736 - RNA, 65 nt, Pseudomonas aeruginosa PA01
accgccaucggcgaggaucgccagcucgcaaucgaguugcgucucgucgucgaggguaagccggu

SEQ ID NO: 4242737 - RNA, 126 nt, Pseudomonas aeruginosa PA01
agcccgagccgcuggucgacgucgucagccuguucgaacgccaggucgaggcgcugccgggcagcgccgcgcuggccuucgaggagcaacgcuggaccuaucgcgaccucgaccauguggcgcgcu

SEQ ID NO: 4242738 - RNA, 71 nt, Pseudomonas aeruginosa PA01
gcagaucgcgguggcggugaugguggagaacggcgaguccggcuccggcgucgccgccccgguggucaagc

SEQ ID NO: 4242739 - RNA, 55 nt, Pseudomonas aeruginosa PA01
gcuucuucgagcagggcaagggcgccaaugucaccgugccguucaaggaagaggc

SEQ ID NO: 4242740 - RNA, 78 nt, Pseudomonas aeruginosa PA01
ggcgaugccgacccgggugccauaggcugcgcagaggaacgaguccuucuggcagaacaggcgcccgccgacaucguc

SEQ ID NO: 4242741 - RNA, 68 nt, Pseudomonas aeruginosa PA01
gacggcuugcuggcggcgguccguucggggggcaauuguucgccggaugggcgccgccgcagaauguc

SEQ ID NO: 4242742 - RNA, 130 nt, Pseudomonas aeruginosa PA01
cugccguagcagccuggcguaugaggggccaguaggaacgcccauccuuacguggcaccaguguuauugaccugacuuuccaguagggagaggugggcugcuggccaacguggagagcucgcuacggcag

SEQ ID NO: 4242743 - RNA, 57 nt, Pseudomonas aeruginosa PA01
cacuggagcagcgccuggaucggcuacucgcuggcccucuacggcgugcucgcggug

SEQ ID NO: 4242744 - RNA, 66 nt, Pseudomonas aeruginosa PA01
gcucgccugggucuucucguugagggugauggugaugaugucgcccacgcggaaggccuugcgguc

SEQ ID NO: 4242745 - RNA, 65 nt, Pseudomonas aeruginosa PA01
gccccgguaacugccauuaccagugcgaaccccagaaugccuauaggaguggcuguugccguggc

SEQ ID NO: 4242746 - RNA, 68 nt, Pseudomonas aeruginosa PA01
gcgcaucgaccugguccuugagacuggccugcuccuucaggcgccgguucuccagcaccaggcggcgc

SEQ ID NO: 4242747 - RNA, 81 nt, Pseudomonas aeruginosa PA01
ccgggcgcuucuccggcucgacgccggcgagguccuggccguugaggcggaucucgccgcuguccggcuggucgaagccgg

SEQ ID NO: 4242748 - RNA, 55 nt, Pseudomonas aeruginosa PA01
ggacaucgacgggcugcucagcuggcgccugacgcccgagcagacccucgaguuc

SEQ ID NO: 4242749 - RNA, 56 nt, Pseudomonas aeruginosa PA01
cgggucggcagccugcucggcaugcucggccgccugcgcgagcggcugacggccug

SEQ ID NO: 4242750 - RNA, 91 nt, Pseudomonas aeruginosa PA01
gaucgggccgagcaggccggcuaccucgaaggcggugggaacgaucgccgcgccgaccuugccgagcgccggcaugcguucguagacgauc

SEQ ID NO: 4242751 - RNA, 72 nt, Pseudomonas aeruginosa PA01
gguacccgggcgcuacgccgaccgcgugcugcacaugaaguacaucaguaccggcgccagcgcccugcaacc

SEQ ID NO: 4242752 - RNA, 55 nt, Pseudomonas aeruginosa PA01
ggcuucgucaguggucagguugaguucgcucauggcgcugcuccgcugugggguc

SEQ ID NO: 4242753 - RNA, 66 nt, Pseudomonas aeruginosa PA01
ggcgagaucgacgaugcggccgagguagcugaacagcgccaccucgaucagcgcgacgaucaggcc

SEQ ID NO: 4242754 - RNA, 62 nt, Pseudomonas aeruginosa PA01
uucggcgagcgcggcgaggugacgaucgaacuggacaaccgccugcaacacgugccgcugag

SEQ ID NO: 4242755 - RNA, 64 nt, Pseudomonas aeruginosa PA01
gggucguggcgaugucggcguggccgagcaguuccugcacggcgcgcaggucgccggacgacuc

SEQ ID NO: 4242756 - RNA, 72 nt, Pseudomonas aeruginosa PA01
gcagaugcacagcaucggucugaucaacgcgcacuucuggcuggccaccaucgguaccgugcuguacaucgc

SEQ ID NO: 4242757 - RNA, 79 nt, Pseudomonas aeruginosa PA01
gaucggcuuccugcugauggucaacguggugcugcuggucgccggcagcuucauggagcccucggcgaucgugcugauc

SEQ ID NO: 4242758 - RNA, 63 nt, Pseudomonas aeruginosa PA01
gccgaucagcuuggccuugauggugaccggcuuggucacgccguucagggucagguugccggu

SEQ ID NO: 4242759 - RNA, 80 nt, Pseudomonas aeruginosa PA01
gggcguagucgcugucgucgaacagcagaugguggacgcagacuuccgcggugaugcguuucuggcacagcggcuugucc

SEQ ID NO: 4242760 - RNA, 65 nt, Pseudomonas aeruginosa PA01
ccaggcgaucggugccggaguugugcucggcacgcgucagcagcgccucggcgccgaaccccugg

SEQ ID NO: 4242761 - RNA, 56 nt, Pseudomonas aeruginosa PA01
ggacaggucauacgguuucaugcgggcgacuccggaagaucggggugacguugucc

SEQ ID NO: 4242762 - RNA, 64 nt, Pseudomonas aeruginosa PA01
gcgcuacuggagcggcggcgggcgggcggucaacuucuccgucggcuacagcaaccaguggcgc

SEQ ID NO: 4242763 - RNA, 66 nt, Pseudomonas aeruginosa PA01
gcucgacgucggcgaucucggcgcggacgagaucgagguccgccuggcgggcgccgacgucuucgc

SEQ ID NO: 4242764 - RNA, 62 nt, Pseudomonas aeruginosa PA01
agggugcgcacgaagggcaccaugaucucgacguuggucaggcccauuucguugcggaccuu

SEQ ID NO: 4242765 - RNA, 90 nt, Pseudomonas aeruginosa PA01
gacaggcggccgagccagucggcaaggcgcuugcccggcaccgcgaggaugccgguguugaucucgccgaucuggcgcugcgccgggguc

SEQ ID NO: 4242766 - RNA, 100 nt, Pseudomonas aeruginosa PA01
gguguugggcagcgccgccuugagcuugcgcaggcguucccacgggucuuccuugaggaagcgcacgcaggcgucgaagguggcgccgccccagacuucc

SEQ ID NO: 4242767 - RNA, 86 nt, Pseudomonas aeruginosa PA01
cgauucccaggcggccgagcagcgccuguugcaggucggccugcuccagcaggcuguagcgaugggcgcgcggcuuggccgaaucg

SEQ ID NO: 4242768 - RNA, 90 nt, Pseudomonas aeruginosa PA01
cagccguccaccgcccugcugcgccugcgccgcgaacuggccagcggccaguuggagcgcgccggcgacaacgcggcgaaggucucccug

SEQ ID NO: 4242769 - RNA, 61 nt, Pseudomonas aeruginosa PA01
gaggcuugcgcugggcccagccgcucucacggaaggcgcggugggcgccggccauggccuc

SEQ ID NO: 4242770 - RNA, 85 nt, Pseudomonas aeruginosa PA01
ggccagcgccugcuggcugguguuggcggcgcgcaugcuguccuguagcgcggugcuggcaccgagcgcggcggcccagccggcc

SEQ ID NO: 4242771 - RNA, 72 nt, Pseudomonas aeruginosa PA01
ccgacgucagccuggcccaggccgaguugcugaggaaccaggccagccucggccuggcccaggccaacgugg

SEQ ID NO: 4242772 - RNA, 129 nt, Pseudomonas aeruginosa PA01
cacggcgccgcuggcggccuugccgacgaagaucgcggcgucgaguucggucagguugcgcccccaguugcgcagccggcagcccucgacggugaucccggggcuggucagggucagcagacugccgug

SEQ ID NO: 4242773 - RNA, 77 nt, Pseudomonas aeruginosa PA01
gggcuuucccuguagcguuccgggcagcggcgcaaccccuucggucgcgccccgccaggagccuacggaggaaaccc

SEQ ID NO: 4242774 - RNA, 64 nt, Pseudomonas aeruginosa PA01
gagcagcuggaucgggcgccgcgcccugcgcgccaagggccaggccucgucgcucuaucuguuc

SEQ ID NO: 4242775 - RNA, 60 nt, Pseudomonas aeruginosa PA01
ucagccaggucuggcggauguagccgcccugcacaucgaggguuccgccggacagguuga

SEQ ID NO: 4242776 - RNA, 67 nt, Pseudomonas aeruginosa PA01
ucgaugauguagcccuggccgagguccgggccgacguugccgaccugcgacagggcuaccccgccga

SEQ ID NO: 4242777 - RNA, 85 nt, Pseudomonas aeruginosa PA01
gcgcagcgagucgauggccagccgcuccggccgccagcaggcgcugcuggcgcugacccggcuggucaugaucagccugcugcgu

SEQ ID NO: 4242778 - RNA, 63 nt, Pseudomonas aeruginosa PA01
ucuugaucagcgaguggccggucuuccacaucaccggacggccgccguagccgcugaucaggg

SEQ ID NO: 4242779 - RNA, 58 nt, Pseudomonas aeruginosa PA01
guugcgcucgguuucgccgaaguacuuguuguagagacaggcgaaauccagacgcagc

SEQ ID NO: 4242780 - RNA, 68 nt, Pseudomonas aeruginosa PA01
ccgccguguagcgagccgaugguuucauagcgaaugccuuugagcgcgugguucagcagcacauacgg

SEQ ID NO: 4242781 - RNA, 105 nt, Pseudomonas aeruginosa PA01
ugaucggcacgcgcgagaugucgggcucggaggcgaucagguugaggaaggugaccauggccgccuucgaguccagcaugccuucguccauguugaugucgauca

SEQ ID NO: 4242782 - RNA, 66 nt, Pseudomonas aeruginosa PA01
gguacgcgccgacaucguuacccucggcaagggccucggcgccggggugccgcugucggcgcugcu

SEQ ID NO: 4242783 - RNA, 115 nt, Pseudomonas aeruginosa PA01
gugccgcuggccgucaccggcugguagcgcgaggcgggaguauccggauggcucgggucgaaaccggaguccaucucgccgaucuucacgcccuggccgucgaugccggcggcau

SEQ ID NO: 4242784 - RNA, 93 nt, Pseudomonas aeruginosa PA01
gaucaggcucacguagggcaccuggaacucguggcgcaggcuguccucgacgguacugaccacgucuuccaggcugguggcgucgagcagguc

SEQ ID NO: 4242785 - RNA, 125 nt, Pseudomonas aeruginosa PA01
ccucguccucgcgaacgaucagguuguacuggcucugcaucgagaugaauugcgccaggccgugguggcgcuggaaggcgagcaucuucaugaagcgccaggccggcaucgacgaggcgccgagg

SEQ ID NO: 4242786 - RNA, 55 nt, Pseudomonas aeruginosa PA01
acgaucgauauauggaugcgaguuuuaugugauuccuaucgauuuauugaaucgu

SEQ ID NO: 4242787 - RNA, 82 nt, Pseudomonas aeruginosa PA01
cguagaccagguagaucagaugcuugcgugaguuggccaugucugucguggaucgcgugagaggcaucccugccgguauacg

SEQ ID NO: 4242788 - RNA, 61 nt, Pseudomonas aeruginosa PA01
ggugccgaggaucgacagcccgccgaggaugcccaggcgcggguucauggucuucagcgcc

SEQ ID NO: 4242789 - RNA, 75 nt, Pseudomonas aeruginosa PA01
gcugccguuugcguaaggccugccuaaaggcuugugcaacugacuuggcaugcaggcuuucaugcacaugguggc

SEQ ID NO: 4242790 - RNA, 109 nt, Pseudomonas aeruginosa PA01
ucgauguagcgagcggacuguucgcccggacggaugcccggaauaaaugcaccggacuucuugagguucuccgccacguccuucggguugaacaucagcgcuguauaga

SEQ ID NO: 4242791 - RNA, 63 nt, Pseudomonas aeruginosa PA01
uggugaucgcguagggcaguugggugccgcuacggcuggccagcucgcccaugcgggucauca

SEQ ID NO: 4242792 - RNA, 79 nt, Pseudomonas aeruginosa PA01
auuucauggaggcgagcgguucgcgggaaaggucgcgagcaacgcaccuucggaccgacccucgcugcguccaugaagu

SEQ ID NO: 4242793 - RNA, 63 nt, Pseudomonas aeruginosa PA01
gccgcgccggacgcagugauggucuucgcccgccagggcgacaagggcagcguguccgucggc

SEQ ID NO: 4242794 - RNA, 76 nt, Pseudomonas aeruginosa PA01
ggucggccugaucgucgcgcugaucgagguggcgcuguucagcuaccucggccgcaucgucgaucucgcccagagc

SEQ ID NO: 4242795 - RNA, 55 nt, Pseudomonas aeruginosa PA01
gaccgugcccagcgaggaggcgaagaucaccuugcgcuccuccuggggcgugguc

SEQ ID NO: 4242796 - RNA, 94 nt, Pseudomonas aeruginosa PA01
ggcaggaacugcucggccagcucaccgagcccuacgaccuggugcucugccacgccgugcucgaguggcuggccgaaccccaugcgauccugcc

SEQ ID NO: 4242797 - RNA, 58 nt, Pseudomonas aeruginosa PA01
gggcgagaccgagcagcgcgguggcgaggaaacgcuucaucgggccuccggcucgucc

SEQ ID NO: 4242798 - RNA, 103 nt, Pseudomonas aeruginosa PA01
gaaggugaagucgagguagcucgccggcgucgccgccggauugccgaagcgcaccgcguagccgauucccuggcuggcgcugagcaguugcacgacgccguuc

SEQ ID NO: 4242799 - RNA, 65 nt, Pseudomonas aeruginosa PA01
cggucuugaacagggaggcgauguagacgcgcgagucguuuucgucgaccuguucguugaggcug

SEQ ID NO: 4242800 - RNA, 61 nt, Pseudomonas aeruginosa PA01
ucgacguacuggaugccgcgccacggguggacgaaguggugcugcuguccggugacggcga

SEQ ID NO: 4242801 - RNA, 68 nt, Pseudomonas aeruginosa PA01
cgcgcuggaugccguugccggccaggagcggccauggauccgccuggcccugcaacggcuuggcggcg

SEQ ID NO: 4242802 - RNA, 66 nt, Pseudomonas aeruginosa PA01
gagucggucgucgauggcgccggccaggccgaaggccucgccgcgcugcuggcgaagcugaaacuc

SEQ ID NO: 4242803 - RNA, 90 nt, Pseudomonas aeruginosa PA01
ccguucgccgcgcuccagggcgugcaacaggaccucggacagcaccgccgcaucgaggaagcccagguucacgcccuguccggccagcgg

SEQ ID NO: 4242804 - RNA, 61 nt, Pseudomonas aeruginosa PA01
cgagcgauccuccaguucuuccuugcgccauucgccgccgagggugaagagaugucgcucg

SEQ ID NO: 4242805 - RNA, 86 nt, Pseudomonas aeruginosa PA01
agcccuccuucgccgccaccuggcuggugccgcgccucggucaauucagcgcgucgcacccgcagguggaaguccgcguggaggcu

SEQ ID NO: 4242806 - RNA, 79 nt, Pseudomonas aeruginosa PA01
guccugcaggucgauauccacauccacggugucgcaacuggaacgucgcaccgcgaucccgcggauauccuugcggaac

SEQ ID NO: 4242807 - RNA, 72 nt, Pseudomonas aeruginosa PA01
guagcaccgauggacgaggacgaggaugucgaggagaucaucuucucggcgcgcuucgccugcccggucugc

SEQ ID NO: 4242808 - RNA, 76 nt, Pseudomonas aeruginosa PA01
gucuacgcugcuucaaggagcacuagacuauguuggauacaaugaggaaagucuggcuuuugaaguucugugugac

SEQ ID NO: 4242809 - RNA, 63 nt, Pseudomonas aeruginosa PA01
cggguugugcuggagcugcuguccgaccacacagaauuguucaagcaguucagcgacaacccg

SEQ ID NO: 4242810 - RNA, 62 nt, Pseudomonas aeruginosa PA01
cagccgaaaagagcuggggcuucaggcguguuugcuauuguucagcuuguuuuuccgggcug

SEQ ID NO: 4242811 - RNA, 130 nt, Pseudomonas aeruginosa PA01
cgauguugagcaguucgauuucuccgccgcgaauccgcagcaggcucaggcaggccgccggcaugucuucgaggucgugccagucgcggccgcucugggcgcggaagucgcccuggauaucguugagcag

SEQ ID NO: 4242812 - RNA, 83 nt, Pseudomonas aeruginosa PA01
cgacuuccucuggccgcccggcagccaugcccacuggcuguucgacgagcaggucgggccggucugccgggcgagcgacgucg

SEQ ID NO: 4242813 - RNA, 57 nt, Pseudomonas aeruginosa PA01
cugcggaucgcucucgccggccaacauguagguguuggucaugcguggcaucggcag

SEQ ID NO: 4242814 - RNA, 64 nt, Pseudomonas aeruginosa PA01
cggcggcggccagccaggcccgcaccaggccgcgccgguggacuggcacuggcuggcccugcug

SEQ ID NO: 4242815 - RNA, 91 nt, Pseudomonas aeruginosa PA01
uucccaugccggcgacgcggucaguugcgccggcgcaugggcgaacacuucgaccugcagucgcgcgcugacccgcagcgccucgugggga

SEQ ID NO: 4242816 - RNA, 60 nt, Pseudomonas aeruginosa PA01
gucgaucaaggacguggcugccgccgaagcuuccggcguguaagucgagucgugaucgau

SEQ ID NO: 4242817 - RNA, 61 nt, Pseudomonas aeruginosa PA01
gauacacaucguauccguauugagagaguguucuacacugcuuucgaaauauacgaauauc

SEQ ID NO: 4242818 - RNA, 55 nt, Pseudomonas aeruginosa PA01
guggcgaacgcccggcuuuccucggccaugccggccaggaaggccgcuucgccgc

SEQ ID NO: 4242819 - RNA, 75 nt, Pseudomonas aeruginosa PA01
cuggcuggcguuggccgccagcagcaacugcugggcguugcgcagggcggcgcugcggcggccgaagucgaacag

SEQ ID NO: 4242820 - RNA, 69 nt, Pseudomonas aeruginosa PA01
ggccaggucggccugcuugccgggggccagcucgccgaugucgcugcgcccgagcaggcgugccgagcc

SEQ ID NO: 4242821 - RNA, 64 nt, Pseudomonas aeruginosa PA01
uucgcgcuggaacgacgucuaccugacucuccggggccaguacggcgcgcgcuccagccgcgaa

SEQ ID NO: 4242822 - RNA, 61 nt, Pseudomonas aeruginosa PA01
ucgucgccggugaacugggcgacccagcccuccggguuguugaacaggcgcacggcgacga

SEQ ID NO: 4242823 - RNA, 80 nt, Pseudomonas aeruginosa PA01
ggcggcggcgacgccacuccucguuccaggcugaagucauuccgcucaguccugcagcagggugccgcgguugagccgcc

SEQ ID NO: 4242824 - RNA, 60 nt, Pseudomonas aeruginosa PA01
gaucgcgugguggacaucgacggcggccuccugcuguccggcgacacccucuacgugguc

SEQ ID NO: 4242825 - RNA, 58 nt, Pseudomonas aeruginosa PA01
ggcccaacgccugcggcaagucgacccugcuggcggcauugucgcgccuguuggcgcc

SEQ ID NO: 4242826 - RNA, 70 nt, Pseudomonas aeruginosa PA01
gcuucgaucagccgggugaugccgcagguggucgaggccgagcaccugcgcgacgcccagcgcuucaagc

SEQ ID NO: 4242827 - RNA, 65 nt, Pseudomonas aeruginosa PA01
caggcgcgggcgcgucccgguugcccggccuugaggcuggucagcgcgagauuguucagcgccug

SEQ ID NO: 4242828 - RNA, 55 nt, Pseudomonas aeruginosa PA01
cagcaacugcuccgccgcgcgccggccgauggcuucgcgcggggugcggaugcug

SEQ ID NO: 4242829 - RNA, 66 nt, Pseudomonas aeruginosa PA01
gguuauggcuguugcgcaccucgccgaagcuguagcggucggcgagaucggcgauggccuccagcu

SEQ ID NO: 4242830 - RNA, 77 nt, Pseudomonas aeruginosa PA01
gauacugcgcaggaaauggcccggggaggcucgccuacgaucguaggcccggcucccuuggccauuuccgccguguc

SEQ ID NO: 4242831 - RNA, 78 nt, Pseudomonas aeruginosa PA01
gagcacuucguaggccugcggaucggugaccuucuucggcuugccgcgcuugucggucucguaggcguagaagcccuu

SEQ ID NO: 4242832 - RNA, 90 nt, Pseudomonas aeruginosa PA01
gcacgaucuuggugaagcccuucagcgccucgcccugggucaucagcaccuugcgacccagcaggucgagggccugaacgccgguggugc

SEQ ID NO: 4242833 - RNA, 61 nt, Pseudomonas aeruginosa PA01
gugcccgagguccugcugggggcggguacccugauccacaccgagcaguuucucgaggcgc

SEQ ID NO: 4242834 - RNA, 66 nt, Pseudomonas aeruginosa PA01
cguugagggccaggucgucgccgaggacaccggcggucuucuucgcggcgaccuuggucaucagcg

SEQ ID NO: 4242835 - RNA, 64 nt, Pseudomonas aeruginosa PA01
gaauuuguagaaaggcccgccaaggacgcccgggcgucuucggcgggccuuuuucaugccuuuc

SEQ ID NO: 4242836 - RNA, 66 nt, Pseudomonas aeruginosa PA01
cucaaggaccuggccugcgaacuggguaucggcgagcgcgugcuguuccucggccaggucgaagag

SEQ ID NO: 4242837 - RNA, 55 nt, Pseudomonas aeruginosa PA01
uucaccuggacuucuggggcagcccggcccugggcagcgucacccgccaggugga

SEQ ID NO: 4242838 - RNA, 62 nt, Pseudomonas aeruginosa PA01
cggcgaaaacaccagccuuucaggaauauuuuucaugcccgcaaggcauggguuuuucgucg

SEQ ID NO: 4242839 - RNA, 129 nt, Pseudomonas aeruginosa PA01
ucuugaacaguucgacgaacucgccgugcagcgcggcgggcaggcgcguggugucguuguuccaguagaggaugucgaacgccggcggcugguugccgagcagguaguuguugacccaguaguuccaga

SEQ ID NO: 4242840 - RNA, 71 nt, Pseudomonas aeruginosa PA01
cagggguguuggggcugucgaaggucggaugcagcagcggggcgacuuccgcagccucggcgaguuccuug

SEQ ID NO: 4242841 - RNA, 103 nt, Pseudomonas aeruginosa PA01
gaggcgggaaagaccgauuggaacgcuggcugcaauaacccacugcacuacugaggcuugcaguugucauagcggcaguauauucacucaguacuuuucccuc

SEQ ID NO: 4242842 - RNA, 69 nt, Pseudomonas aeruginosa PA01
cgguccaccacggcgaccacguugggguucucgccaagggcgcggaugcugauggugccguccuggccg

SEQ ID NO: 4242843 - RNA, 61 nt, Pseudomonas aeruginosa PA01
gcgccgugggcuccggaaggggaggcgucgcgcugaccucccuccuugcagccggcggcgc

SEQ ID NO: 4242844 - RNA, 61 nt, Pseudomonas aeruginosa PA01
uccacuacguaggaaagacgaucgguggcaucggcgaucugcgacauuuccugcgcguggg

SEQ ID NO: 4242845 - RNA, 99 nt, Pseudomonas aeruginosa PA01
gaaaagaaaaccuugcuagagacagaagggcgggcugccugccggacgcuucccgcauccggcggacagcccgccccagguagucgguaucagucgauc

SEQ ID NO: 4242846 - RNA, 69 nt, Pseudomonas aeruginosa PA01
uggcggaggacggcgaaacgccugccagcagcgccagcucgcuggccgggcgggcgcugccauccauca

SEQ ID NO: 4242847 - RNA, 60 nt, Pseudomonas aeruginosa PA01
gacgcugcugccguccggcgccaccugcacgucgguagccggcgccggggcgguaguguc

SEQ ID NO: 4242848 - RNA, 67 nt, Pseudomonas aeruginosa PA01
guaggcgcuggccagcagggugucgagcucgucgucgcggacgcucuccaggcuggccggcgcaugc

SEQ ID NO: 4242849 - RNA, 85 nt, Pseudomonas aeruginosa PA01
gagcggagacgaucaugccggcgccaacggugccguuggucaggcgaucgaugacgaugaaggcgccgguggugcgguucugcuc

SEQ ID NO: 4242850 - RNA, 61 nt, Pseudomonas aeruginosa PA01
cggcgugguggucaugcaggugaccaggucgaacaucagguugagcaggcgcaucgcgcug

SEQ ID NO: 4242851 - RNA, 73 nt, Pseudomonas aeruginosa PA01
gaugucggcccgccagcguauccugauguaucgcuucaucgaauggaucgggcgcuggucgaugcucgauauc

SEQ ID NO: 4242852 - RNA, 62 nt, Pseudomonas aeruginosa PA01
cguccucgguguagcccggcaggcggaugacuuccauccgauccagcaggggcgccgggaug

SEQ ID NO: 4242853 - RNA, 63 nt, Pseudomonas aeruginosa PA01
gcuucuuggcgaacuccagcgagcccagaugcgcguagggcucggggaucuucgcccagacgu

SEQ ID NO: 4242854 - RNA, 74 nt, Pseudomonas aeruginosa PA01
ggcgcuucaagcagcgccugaaggaagucgacuaugaccuggugaucgacgcccaggggcugcugaagagugcc

SEQ ID NO: 4242855 - RNA, 84 nt, Pseudomonas aeruginosa PA01
gcuuggcgaacagguugugcaggugccacuugaugguggcuuccgacaggugcaccgccugcgcgauaucgcgguucgacaagc

SEQ ID NO: 4242856 - RNA, 102 nt, Pseudomonas aeruginosa PA01
agcucgcagccgcugaguucgccgacugcgcgugcgaaaccgcccagcagggccgugaugucgguuucccgcgacagcgcgccgaacugagcgagcagggcu

SEQ ID NO: 4242857 - RNA, 75 nt, Pseudomonas aeruginosa PA01
ggacgucaggcggcgcuggaucggcccccucucccgcuugcgggagagggggagcggccgugccggucggaugcc

SEQ ID NO: 4242858 - RNA, 76 nt, Pseudomonas aeruginosa PA01
acgaagucguccagggcggcgaccccguucagccggccgaggccggacuggcgguagccgcccuccucgaauucgu

SEQ ID NO: 4242859 - RNA, 121 nt, Pseudomonas aeruginosa PA01
gcgcuugguacgcauggccuugagggucgccggcgagcaguuggcgauguccaccugcgaaccuucgugcucgaucagcagcuugccgcggcugaccuuguucaggccguugaugcagcgc

SEQ ID NO: 4242860 - RNA, 63 nt, Pseudomonas aeruginosa PA01
aguaggugagggugcggcugaauuuuuccggguguuccugguucagcagcagcuucagguauu

SEQ ID NO: 4242861 - RNA, 92 nt, Pseudomonas aeruginosa PA01
cccccaggcccaguugcgccaggucggcggcgaccaggccgaagaugugccgggucagaucgccgaucaugccguugucuucggccaggggg

SEQ ID NO: 4242862 - RNA, 115 nt, Pseudomonas aeruginosa PA01
ucgucgcugaccuugccggugccgaagguguugaucgagaucgaggucggcugggccacgccgauggcguaggaaaccuggaucucgcaacgcucggcgaggccggcggcgacga

SEQ ID NO: 4242863 - RNA, 59 nt, Pseudomonas aeruginosa PA01
gucuucagaccgaucuucucggcaaaggccagguagucggccuugaucuguucgaagac

SEQ ID NO: 4242864 - RNA, 80 nt, Pseudomonas aeruginosa PA01
aguggccgacaugcugaccgucgucggggucaaccguguccucacggucgaccugcacgcggaucagauccagggcuucu

SEQ ID NO: 4242865 - RNA, 70 nt, Pseudomonas aeruginosa PA01
ucaaggcgcaccagcuggcggugauggccggcgugcaggccgccauccgccaccugcuggcgcgcuucga

SEQ ID NO: 4242866 - RNA, 123 nt, Pseudomonas aeruginosa PA01
ucggcgcggcgaagcacaccgaguccaggcggucgagcaugccaccgugaccuucgaucaugugcccccaguccuugaccccacggucgcgcuugaucgccgacaucaccaggccgccgaaga

SEQ ID NO: 4242867 - RNA, 66 nt, Pseudomonas aeruginosa PA01
gccgaucaugaguucgucgggcaagggccagagcguccugaaaggccccgacgaccugcaggcggc

SEQ ID NO: 4242868 - RNA, 70 nt, Pseudomonas aeruginosa PA01
uggauggaggguaagugucgcuaaaggugcugguuguaaguacagagccuuccacgcauauccuucagca

SEQ ID NO: 4242869 - RNA, 76 nt, Pseudomonas aeruginosa PA01
gccaggucgcggucggugaccacgccggucaggcgcucgcccucguugaccagcaaggcgccgauaucggcuuggc

SEQ ID NO: 4242870 - RNA, 64 nt, Pseudomonas aeruginosa PA01
gcccagcgccauggcgccggcgaccagcccggcaccgggccgcuggugcgccaggcgcuguggc

SEQ ID NO: 4242871 - RNA, 59 nt, Pseudomonas aeruginosa PA01
ggcgcgcugucgcgcucgucgaagcugaggucggcgucggccgagccgaugguguagcc

SEQ ID NO: 4242872 - RNA, 89 nt, Pseudomonas aeruginosa PA01
gacgccacggucaaggcgaugcgccagaucagcggggccaucgucggcaucaccguagugcuggucucgguguucgugccgauggcguu

SEQ ID NO: 4242873 - RNA, 93 nt, Pseudomonas aeruginosa PA01
ggcgaugacguuguccaggcucaucaccgcgucggcgaugaugauggucuugaucgcgccgagcaggugggugcugcccuugaugucgucgcc

SEQ ID NO: 4242874 - RNA, 64 nt, Pseudomonas aeruginosa PA01
ggguuggugcaugggguucucccguauccagaucgauugacgggagcaacgcuaugcccggcgc

SEQ ID NO: 4242875 - RNA, 83 nt, Pseudomonas aeruginosa PA01
gguggaggacaccgugcaguugcugaagaccgggcagaaccgcuucgccacgguguccggcagcaugaccgaugucauccacc

SEQ ID NO: 4242876 - RNA, 65 nt, Pseudomonas aeruginosa PA01
ccauggagacguaguagucgccacugacggugccuuccgacauggacgaaacgauacgucccugg

SEQ ID NO: 4242877 - RNA, 129 nt, Pseudomonas aeruginosa PA01
ccggaucggugccgaggguauucagguauuccagguagcgcuugugggcgaacggcaggugguaggcguccacgccguuuuccgcgagcagcuuccaguuggccuugaucgaaugcucgaagccgccgg

SEQ ID NO: 4242878 - RNA, 72 nt, Pseudomonas aeruginosa PA01
gaaauccggggcgguuucgcagacacucaacgcgggggcgucugugucugggaaaccgccccgguccuuuuc

SEQ ID NO: 4242879 - RNA, 56 nt, Pseudomonas aeruginosa PA01
guugcccuucugccgcacggucaggucgaucuucaccggcggcuggaacgggcugc

SEQ ID NO: 4242880 - RNA, 57 nt, Pseudomonas aeruginosa PA01
gcgcgaucaguuggcugcuggcccagacguucugggucggcggccucugguugcugc

SEQ ID NO: 4242881 - RNA, 66 nt, Pseudomonas aeruginosa PA01
gucgauggaaauguccggcagcgcggcgaaggcuucgcccgccagcucaugcuggaugccaucggc

SEQ ID NO: 4242882 - RNA, 84 nt, Pseudomonas aeruginosa PA01
gcaggcuccgugccuggucgcuggccucgcguuucaucccggcgccgcgccacaugcgccaggccgaccagagcaccagcaggc

SEQ ID NO: 4242883 - RNA, 129 nt, Pseudomonas aeruginosa PA01
cuugacgccgagggcuuccagcucguccagcgacagcuccaggcgcggcgaaccgaccagcacguugaucggcuucggcgccaccgcuucgagcaccgcgacgaucuguucgcggcgguucaaaccggg

SEQ ID NO: 4242884 - RNA, 66 nt, Pseudomonas aeruginosa PA01
ggcgcacccaugcuguucuuucacagcaucgacgauaccauugugccccucgagaacggcaucgcc

SEQ ID NO: 4242885 - RNA, 57 nt, Pseudomonas aeruginosa PA01
ucaccggcggcaucaguuggcugcccaugcucgcggucgccucgacgccgccggcga

SEQ ID NO: 4242886 - RNA, 95 nt, Pseudomonas aeruginosa PA01
cggcgaagaccuggccguuuucgcugcgcaggcuguccggaugcaccgggaaauggcuuccggccugacgcaggaggaagcgccgggcuucggcg

SEQ ID NO: 4242887 - RNA, 66 nt, Pseudomonas aeruginosa PA01
gcggugaggccgagguagucgagggcgcugccggugagcaucgccgcggccgccuugguuuccugc

SEQ ID NO: 4242888 - RNA, 78 nt, Pseudomonas aeruginosa PA01
cgccagcuucaucuuccacaacuggccucagccgcugcgcucgcgcgcggccuaccgcaaguugugggagcgcuggcg

SEQ ID NO: 4242889 - RNA, 87 nt, Pseudomonas aeruginosa PA01
agcggaucaccggauaggagaaguccgaggcgauuucauuggcguagcgcagugcgaugccuucggccuuuuccugggauauccguu

SEQ ID NO: 4242890 - RNA, 117 nt, Pseudomonas aeruginosa PA01
cggguccuggcgcgggccaugagccgucgcggccugcgggucagcaccgccggcuccgccgaggaaggccuggcgcuggcccagcaggacacgccggacuaugccgugcucgaccug

SEQ ID NO: 4242891 - RNA, 81 nt, Pseudomonas aeruginosa PA01
gacgcugguggugaacggugugagcaugccacugaagguggacgccgauggcagcuucgaccgcccguucgccuucccguc

SEQ ID NO: 4242892 - RNA, 72 nt, Pseudomonas aeruginosa PA01
gcgcucgcggugcuccaggcauucgucgaggaagcugcgcuccucgcgggcuucgagcaacggcaagagcgc

SEQ ID NO: 4242893 - RNA, 57 nt, Pseudomonas aeruginosa PA01
gccgucgcggccgacgacaaaggcgguuuccgaaagauuguucucuuccgcgauggc

SEQ ID NO: 4242894 - RNA, 56 nt, Pseudomonas aeruginosa PA01
cgcggcuguggcaggacaggcacuuguugcuguccuugucgaugcgauagccgacg

SEQ ID NO: 4242895 - RNA, 69 nt, Pseudomonas aeruginosa PA01
gggagcaggcugucgggguaguccugguagcacagcgggcgcaggaaacgcucgauggccaggguuccc

SEQ ID NO: 4242896 - RNA, 56 nt, Pseudomonas aeruginosa PA01
aaggcggcaggcuauuaccuucuugcugcaagccaaggaaaugaugaugcugccuu

SEQ ID NO: 4242897 - RNA, 55 nt, Pseudomonas aeruginosa PA01
gaucaaugccguacgcuacgccuuccucgagcugggcguggacgauggcgugauc

SEQ ID NO: 4242898 - RNA, 92 nt, Pseudomonas aeruginosa PA01
cgccggcgucgccgaucaccuugaucggauaacgcucgcaggggaauucgauuuucggggguugaacgucagggguaucggucauggcggcg

SEQ ID NO: 4242899 - RNA, 57 nt, Pseudomonas aeruginosa PA01
cagcgacuggcccaggcucaguccgguccacuucagcacuaccugggccaauugcug

SEQ ID NO: 4242900 - RNA, 74 nt, Pseudomonas aeruginosa PA01
ggcccucggcaagcgccuggagauagucgucgagggaacgcuuggggccgucgcccacgcgcuugcucagggcc

SEQ ID NO: 4242901 - RNA, 71 nt, Pseudomonas aeruginosa PA01
cgccgccgcccgccaccgcuccggcgagcaccucgcagagcgacucgcccagcgccuggcgggucgccgcg

SEQ ID NO: 4242902 - RNA, 76 nt, Pseudomonas aeruginosa PA01
ggauuucucgcuggcgcggcugcucagggcguaggccagggcgaggaacacgcagccgagcagcagcgaggaaccc

SEQ ID NO: 4242903 - RNA, 79 nt, Pseudomonas aeruginosa PA01
ggugcugaugcucggcgacggagucaacgacguaccggugcucgccggugccgacaucagcgucgccaugggcagcgcc

SEQ ID NO: 4242904 - RNA, 57 nt, Pseudomonas aeruginosa PA01
gcccuugagggcggcggcgaacucggccagccaaggcucggcgucggucucgggggu

SEQ ID NO: 4242905 - RNA, 80 nt, Pseudomonas aeruginosa PA01
guaagcaucgaacugagucucggcaaucauagacagaaucugauuauuacgauuauugaaauucauaagaugcuccuugc

SEQ ID NO: 4242906 - RNA, 62 nt, Pseudomonas aeruginosa PA01
cggcggcgcgggccugcucgcuguuggugccgaacaccacggcgaucaugcgcuggccgucg

SEQ ID NO: 4242907 - RNA, 63 nt, Pseudomonas aeruginosa PA01
cugcaaggccugguagucgaggcccagcucggcgaacagcuggcguccgucuaggccuuccag

SEQ ID NO: 4242908 - RNA, 97 nt, Pseudomonas aeruginosa PA01
gcaucgaccugucggugagcuggcaggcgcucugggaugaucacgcaguaguggcgcggguggucuucgagcguccgcagcucaacuucgucgaugc

SEQ ID NO: 4242909 - RNA, 80 nt, Pseudomonas aeruginosa PA01
cggcggcgaggucggcguaggugacgucguccugcagggagauccagucggugaggcggaucugcgucggcgcgcugccg

SEQ ID NO: 4242910 - RNA, 76 nt, Pseudomonas aeruginosa PA01
gguaggcgugccgcucagggucgcgccgcggguggcggcgugcacgcgcggcgcggcggggguggcccgcacugcc

SEQ ID NO: 4242911 - RNA, 71 nt, Pseudomonas aeruginosa PA01
ccucaacgcggccaucgaggcggcccgcgccggcgagcaugggcgcggcuucgcggugguugccgaagagg

SEQ ID NO: 4242912 - RNA, 70 nt, Pseudomonas aeruginosa PA01
gugaccugccugcucggucgcaacggggugggcaagaccacccugcugcgcugccugaugggccuggucc

SEQ ID NO: 4242913 - RNA, 81 nt, Pseudomonas aeruginosa PA01
cgccgcagcgcccagcggguggcuucccggcgcauccgcgcggggucgccguggaagcgcucgcggcgcgagaacagggcg

SEQ ID NO: 4242914 - RNA, 56 nt, Pseudomonas aeruginosa PA01
gcuggccaccgagggcauccgcccgagcaguuggccgaugccuuccagcagccagu

SEQ ID NO: 4242915 - RNA, 56 nt, Pseudomonas aeruginosa PA01
gcaucagucacccugcgccuccagcagguagccgaggccgcggaaggugacgaugc

SEQ ID NO: 4242916 - RNA, 67 nt, Pseudomonas aeruginosa PA01
gccgauguucucgacgauggugggguagcccggcacggagcgcuugaucaugucggggaacacgcgc

SEQ ID NO: 4242917 - RNA, 62 nt, Pseudomonas aeruginosa PA01
ccuggaaccagaaguugauguuggcguaguccauugccguccagcucaucuucucggcaagg

SEQ ID NO: 4242918 - RNA, 94 nt, Pseudomonas aeruginosa PA01
uugcgcggcaucgauagggaccugggcggcagcuauguccucggcaaucgaaucgcaggcggcaacuccagcuuccugucgauaggcaacgcga

SEQ ID NO: 4242919 - RNA, 95 nt, Pseudomonas aeruginosa PA01
ggggauaucgucgagaaacaguucgcgguagugcuggguguugucgcgcauuacagcaccuguaccgcgagacucugucgcucgaccagcucgcc

SEQ ID NO: 4242920 - RNA, 88 nt, Pseudomonas aeruginosa PA01
ccuggccugcgagcgcgaggaaaccucgcuggccggcgagaucgccaccacgguggauuuccucgaggugaucuucgacgaggccggg

SEQ ID NO: 4242921 - RNA, 76 nt, Pseudomonas aeruginosa PA01
cgugcgccggggcuggucucgacccuguucgcggcgaugccgcaggaacacgagcgcagccucggucucuggcacg

SEQ ID NO: 4242922 - RNA, 65 nt, Pseudomonas aeruginosa PA01
gggacaccgcgcggccaugaaaaaaccgcccgaaggcggcuuuuccauggacuguugcggcgcuc

SEQ ID NO: 4242923 - RNA, 83 nt, Pseudomonas aeruginosa PA01
gcgcguccuuggccggguugagcuuggccuccagcgcguaguugguguugaucagguccaggucgaccugguccagcacgcgc

SEQ ID NO: 4242924 - RNA, 57 nt, Pseudomonas aeruginosa PA01
ggcgaguccgcgauccugcuguucgcccgcgauccgaacggcaggaugcacgucgcc

SEQ ID NO: 4242925 - RNA, 61 nt, Pseudomonas aeruginosa PA01
uccacggcgaaggugccgcugcccugcaacgguacgcagguguggcugccuucgccgccga

SEQ ID NO: 4242926 - RNA, 92 nt, Pseudomonas aeruginosa PA01
gcaggcgcacgucgccgggacgcugcuggcgccagaggaaggugaccagcacacguucggcauccagcggcuccaccagcggcgugcccugc

SEQ ID NO: 4242927 - RNA, 82 nt, Pseudomonas aeruginosa PA01
ggcgcucgaugaccuggucguccauggcgaaggccuugccgacgaagcgccgauugccguaggcgaccaggaauuucucgcc

SEQ ID NO: 4242928 - RNA, 74 nt, Pseudomonas aeruginosa PA01
gucgggcaacgcccaggccagcgauggcgaggcgcugcgccgucuggccguggccggccugggccuggcgcggc

SEQ ID NO: 4242929 - RNA, 69 nt, Pseudomonas aeruginosa PA01
guggcagaacagcucggccuugcgcuucuuguccaccggcaccagccauugccugacgcucuucgccgc

SEQ ID NO: 4242930 - RNA, 62 nt, Pseudomonas aeruginosa PA01
ggugggguucuccggcacgcugaucacccaggcgcugaaaccguugcuggagaaccaccgcc

SEQ ID NO: 4242931 - RNA, 67 nt, Pseudomonas aeruginosa PA01
gaggcgacgaucgacuagacuggcggaaauucaccccucucccgcgaacugguaugaugcgcgccuu

SEQ ID NO: 4242932 - RNA, 103 nt, Pseudomonas aeruginosa PA01
uggucgaggucgcgauagguccagcguugcuccucgaaggccagcgcggcgcugcccggcagcgccucgaccuggcguucgaacaggcugacgacgucgacca

SEQ ID NO: 4242933 - RNA, 93 nt, Pseudomonas aeruginosa PA01
cuuggccucggccaccgcgaucgaggcggcggccacgcucuccucgucgggggcggcgagcgccgcuucgauggcgucggccgccaggucgag

SEQ ID NO: 4242934 - RNA, 130 nt, Pseudomonas aeruginosa PA01
gccggcugcucuaccugucgcgccaggacgucgcggaaaugucgcgcugcgaggccagcgaggcgcagcgcuucgccuucgagacgcggaugaucgaucgccuggcggugauggucggccugcugccggc

SEQ ID NO: 4242935 - RNA, 89 nt, Pseudomonas aeruginosa PA01
gcccguuccucuugcuggacuacgccgggccugcugauuucccccccgcacagcagcgccgcggcguaggccagcauccucaucgcggc

SEQ ID NO: 4242936 - RNA, 57 nt, Pseudomonas aeruginosa PA01
ggcuacguggggcuggaggucguggacuucgaugcgcccuucguacccgcgguggcc

SEQ ID NO: 4242937 - RNA, 86 nt, Pseudomonas aeruginosa PA01
ucgcgggugacgauggacaggucgaggucguugcgcgccagcagguugagcgaggugucgcaaugcaccucgaccugcaccagcgg

SEQ ID NO: 4242938 - RNA, 60 nt, Pseudomonas aeruginosa PA01
ggucuuggcggugaugcggguguucgcgaucggcgaaccccagcccucgcggccgaugcc

SEQ ID NO: 4242939 - RNA, 71 nt, Pseudomonas aeruginosa PA01
ggucggugugcuccagcgacucgucggggcccuugggcauggucgccucgacguacucgcggagaucggcc

SEQ ID NO: 4242940 - RNA, 64 nt, Pseudomonas aeruginosa PA01
cgacaaaaaacugaggaaagcgaaccuguauaaaaauacagaaacgcgcuuuuuucguuuuucg

SEQ ID NO: 4242941 - RNA, 77 nt, Pseudomonas aeruginosa PA01
ggcgcugaucggcggcgaggaccaacugcgcgaccugcggguggagaagcaguucgacccgccgcuggaccagcgcc

SEQ ID NO: 4242942 - RNA, 118 nt, Pseudomonas aeruginosa PA01
gucgcuggaguugcugccggagagcgaacgggagauggucgaggacaugauccgcgacaucgaggacauggacgcgauccucgaccaguuccucgccuucauccgcgacggccgcgac

SEQ ID NO: 4242943 - RNA, 87 nt, Pseudomonas aeruginosa PA01
cccacaccguaucgccgucggggcgaacguagcggccgcucaucucgaacgccgcgccggucgcuccgccuggcgccgcggggaggg

SEQ ID NO: 4242944 - RNA, 61 nt, Pseudomonas aeruginosa PA01
ggcgcagcaggagauugccguccagcguggccgccgcaugcuggcgucgcuccugcuggcc

SEQ ID NO: 4242945 - RNA, 78 nt, Pseudomonas aeruginosa PA01
gccggccguggcggaucgccugcagaagccggugaagauccuuuccgcgcugcuguugcuggugaucauccugcuggc

SEQ ID NO: 4242946 - RNA, 95 nt, Pseudomonas aeruginosa PA01
guucggcgaggaaggugcggcucuucagcccggagagcuuuuccgccucgauguaguucaggucgaagaaguugcgcccgaccgcguuccagaac

SEQ ID NO: 4242947 - RNA, 102 nt, Pseudomonas aeruginosa PA01
ucccuggccgauuggcugagcuaucucgaacaacuccauccgacggccaucgacaugggccuggagcguucccgcgagguagcgcgccggcucggccuggga

SEQ ID NO: 4242948 - RNA, 88 nt, Pseudomonas aeruginosa PA01
acugcgcucaugucugcuuccacauggucggugaccuugaaaccguuggcuucgaggugcuugauccaguccuugcagcagccgcagu

SEQ ID NO: 4242949 - RNA, 125 nt, Pseudomonas aeruginosa PA01
cagccuggugaccugggcgcugguggugguaaugcugcuguugccgcugguccgcgccuggcgccgccgcguggcccgucgcgcgacagggcuggccgaugccugagcgcgucaccuggaggcug

SEQ ID NO: 4242950 - RNA, 61 nt, Pseudomonas aeruginosa PA01
caccgcgcccuccaucaccucgcccagggaguacagggugagguugaugcgauggucggug

SEQ ID NO: 4242951 - RNA, 89 nt, Pseudomonas aeruginosa PA01
accgggaucaccuucuucgucaucuuccucuacaccaaguucuucgacugguggugggaagcgaugccgaaguaccuguucuuccuggu

SEQ ID NO: 4242952 - RNA, 56 nt, Pseudomonas aeruginosa PA01
ucgccuggacguugggaauggugacgaugcggucgcauuucaugacguccaggcgg

SEQ ID NO: 4242953 - RNA, 78 nt, Pseudomonas aeruginosa PA01
ugcgggaagucgaaaugcauuucgccuugcuccugcagcgucugccggggcugguggagcugcguuuccacgacggca

SEQ ID NO: 4242954 - RNA, 79 nt, Pseudomonas aeruginosa PA01
cguuggcggccagggcgagauccucuucuucaacgccaagaccggugucgaacugaagcgugucgcucugccgcuuccg

SEQ ID NO: 4242955 - RNA, 57 nt, Pseudomonas aeruginosa PA01
uggccagccgaaaauucuauggagaguuccuggaucgccauaugagugagcuggcca

SEQ ID NO: 4242956 - RNA, 57 nt, Pseudomonas aeruginosa PA01
agcgcagcaggcaggccugguagaucgccucauggggcggcuugccuucguugcgcu

SEQ ID NO: 4242957 - RNA, 68 nt, Pseudomonas aeruginosa PA01
caggcgccagucggcgcgcgcgugucgaaacggcuacggccggggaagcgggcguccaacugcgccug

SEQ ID NO: 4242958 - RNA, 61 nt, Pseudomonas aeruginosa PA01
cggcggcuggcugaugggcaaccugcucggcgaggacggccugcucgccggcuugccgccg

SEQ ID NO: 4242959 - RNA, 63 nt, Pseudomonas aeruginosa PA01
uguucaccagcgccuugcaggagcgcggcagcgcgacgcgggacaacgaggcgcuggugaaca

SEQ ID NO: 4242960 - RNA, 57 nt, Pseudomonas aeruginosa PA01
cgccagcagcagcgggaacagcgaguagaacagcagcagguucauggugugcuggcg

SEQ ID NO: 4242961 - RNA, 70 nt, Pseudomonas aeruginosa PA01
ggcgcaggcguucggaccucagcgucggcaggcggaacacauccugccgcucggucugcaacgcauugcc

SEQ ID NO: 4242962 - RNA, 70 nt, Pseudomonas aeruginosa PA01
ggaaggcaaggacuacaucgucaaggacggcgacgugaugcauuuccgcuucaacguguaauccccuucc

SEQ ID NO: 4242963 - RNA, 88 nt, Pseudomonas aeruginosa PA01
gggcaguauagcgacggcggcgaggccugcggaaaacccguuuuucauauccgguaacagaccucugccugccguguauuccuugucc

SEQ ID NO: 4242964 - RNA, 62 nt, Pseudomonas aeruginosa PA01
ggcgcugcggguggaagugaucgacaccggcaucgguuucgacauggccgccggcagcgacc

SEQ ID NO: 4242965 - RNA, 68 nt, Pseudomonas aeruginosa PA01
ugaccaggaagguggcgaugcgcucgucggcagucuucuucgacagcagcagcaucaucugcugguca

SEQ ID NO: 4242966 - RNA, 68 nt, Pseudomonas aeruginosa PA01
gccugggucgcuucaaguuccucaccggcgacgacaaguccagcugguucagccugaugcgccugggc

SEQ ID NO: 4242967 - RNA, 69 nt, Pseudomonas aeruginosa PA01
acguagccgugcgguggccgaccugcaccaacaguugcucauggugcguuaccaggugcgcggcuacgu

SEQ ID NO: 4242968 - RNA, 57 nt, Pseudomonas aeruginosa PA01
gccgaacugaugggcgacgagaaccgggccugggugcucaccugccugucggucggc

SEQ ID NO: 4242969 - RNA, 76 nt, Pseudomonas aeruginosa PA01
gcgcagggcauagaugcaggugggcucggcggcgggcaagccgucgucgcagaacagcgccugcaguucgccgcgc

SEQ ID NO: 4242970 - RNA, 75 nt, Pseudomonas aeruginosa PA01
guccuggcugcgcgcgcgcaccccgccgaagacgaugcuuugcgccgcuucgaggaaggugccgugguagccgac

SEQ ID NO: 4242971 - RNA, 100 nt, Pseudomonas aeruginosa PA01
gggccuccguuccguggggcgaauacgccaccggcguuauccgccgguaucccgccgcaacggcggauaaccgcaggcgguuauucgcccuaccaggccc

SEQ ID NO: 4242972 - RNA, 129 nt, Pseudomonas aeruginosa PA01
gccaucgagcaucagguugcggucgagcgccucgaagcguacgccgccggcgcugcugaucgcuucguccagcggacgcgggcgcagcagcgucagcggcaggcgcuugaucgccgccgccaggcgggc

SEQ ID NO: 4242973 - RNA, 72 nt, Pseudomonas aeruginosa PA01
ggauccaucacuucgauguuggucaggccggucaguucgucggucugacgcuugacggugaugcccucuucc

SEQ ID NO: 4242974 - RNA, 98 nt, Pseudomonas aeruginosa PA01
cgagcaguuccaugucgaagaccaguaccgaguuggccgggaucgccgggcucgggcucugcgcgccguaggccagcucgcuggggauguacagcuug

SEQ ID NO: 4242975 - RNA, 56 nt, Pseudomonas aeruginosa PA01
gccgcgggcacucauguuggccugguugaagaagauccggccgaagugcucgcggu

SEQ ID NO: 4242976 - RNA, 67 nt, Pseudomonas aeruginosa PA01
guugcgcaggauccgcgacagcaggcgcgcgucggugcgcacugcuagucgcgggauccgcgcacgc

SEQ ID NO: 4242977 - RNA, 76 nt, Pseudomonas aeruginosa PA01
cgccuucagcgccgccgggccgccgcugacuucggcgggaaacagcuugaagcggcgguagccauggcgguaggcg

SEQ ID NO: 4242978 - RNA, 66 nt, Pseudomonas aeruginosa PA01
caugcgguucagcgaagcggugaugucgcccaucagcgcgucgcgcucgcccgauaccacuucaug

SEQ ID NO: 4242979 - RNA, 96 nt, Pseudomonas aeruginosa PA01
cgccuuggccacccgcuguucguugagcaggugcucguugugccggacgaucaggucgcgcugcuccagcaccguucguugcagcaggugcaggcg

SEQ ID NO: 4242980 - RNA, 72 nt, Pseudomonas aeruginosa PA01
caccaggcccucgggcaggugauugaggaggaauugcaggcaacggucgagcaccgcgcccugggccaggug

SEQ ID NO: 4242981 - RNA, 67 nt, Pseudomonas aeruginosa PA01
ggucuugccauucagcuccacggccugggccgcgaucuucaggucgcccuggcuggaggccugggcc

SEQ ID NO: 4242982 - RNA, 59 nt, Pseudomonas aeruginosa PA01
ugaucccggacaccgauuuaggcgagaauccucgccgugaaagaggugucugaugagca

SEQ ID NO: 4242983 - RNA, 88 nt, Pseudomonas aeruginosa PA01
cuggcccaccggaccgcagccgaacacggcgacgguguugccgggggcgauaccggccaguucggcgccgaaguaaccgguggggaag

SEQ ID NO: 4242984 - RNA, 66 nt, Pseudomonas aeruginosa PA01
cggcgcugcgccguuucgacgaugcucgguugccaggccggcgcaucgucgaaacgcuggcggccg

SEQ ID NO: 4242985 - RNA, 82 nt, Pseudomonas aeruginosa PA01
gaucaccgccggggagauggcguucaccuugccguuguugagggucaggguggcgaugccgucuucgaacugguagcugauc

SEQ ID NO: 4242986 - RNA, 61 nt, Pseudomonas aeruginosa PA01
gcugggcuacccgcgcgacaccuucgccaaccucggccagcauggcgcuggugagcccggc

SEQ ID NO: 4242987 - RNA, 119 nt, Pseudomonas aeruginosa PA01
ggucggccaccuggaaggcggcgaacagcgcggccugcuggcuaucggucaacuccaggagguuggccagcagcagcgggcccaucucgcugaugguggugcgcaacggguggccgguc

SEQ ID NO: 4242988 - RNA, 59 nt, Pseudomonas aeruginosa PA01
gacggguugccgccgcuggccgccgaccgccuguuccaggccaugcucgacaacccguc

SEQ ID NO: 4242989 - RNA, 70 nt, Pseudomonas aeruginosa PA01
guucguccgggcccgguucgucgggcuugagguaggaccagucgaggccgaggaucgggucggggaaggc

SEQ ID NO: 4242990 - RNA, 56 nt, Pseudomonas aeruginosa PA01
cugagccucggcggcagccgcauccucgauggcgugcgccugcgcgucgaggccgg

SEQ ID NO: 4242991 - RNA, 75 nt, Pseudomonas aeruginosa PA01
cuccucgaugaaccggcgcagcgcggccagcggcucggcggccuuggcuucgaucgccagguucggcagcggcag

SEQ ID NO: 4242992 - RNA, 88 nt, Pseudomonas aeruginosa PA01
gcccuggcgauugcccuccaggaacgggcccaggcgcagggcgcccuggaagugcuguuccuggacaagcagggcgacuaccgcuggc

SEQ ID NO: 4242993 - RNA, 60 nt, Pseudomonas aeruginosa PA01
uucgucggcgaacuccgagcgcagcaggucggucucguugcgccccugguucucgaugaa

SEQ ID NO: 4242994 - RNA, 60 nt, Pseudomonas aeruginosa PA01
cgcagggugaugugcgcggccaucaucagcacguaggagauggucgcgccgaacaccgcg

SEQ ID NO: 4242995 - RNA, 129 nt, Pseudomonas aeruginosa PA01
gaaguacagguagcggucgagcuugagcagguuguagcugccguuggccagcaccgccgccugguuggucugcaggugcaguugcucgccgcgguagcgcaugaugugguuccagaucgcuuccuggcc

SEQ ID NO: 4242996 - RNA, 76 nt, Pseudomonas aeruginosa PA01
gaccuccaccaguccgggagcgauggcguugacggugaugccgucgccgcccagcucgcgggccaggcugcggguc

SEQ ID NO: 4242997 - RNA, 61 nt, Pseudomonas aeruginosa PA01
cgcccgaggguuggccuguuugauccgugccaccacaucgagaauggcgcggcccugggcg

SEQ ID NO: 4242998 - RNA, 58 nt, Pseudomonas aeruginosa PA01
gcugacgaacacgauggucuugugcaguugccguugcagcaccagcaguucguccugc

SEQ ID NO: 4242999 - RNA, 77 nt, Pseudomonas aeruginosa PA01
gcuccuggcugcgccgcagcgccuccuuggccgcgcgcccuucgcugaggucguggaucagcugggcgaagccgagc

SEQ ID NO: 4243000 - RNA, 56 nt, Pseudomonas aeruginosa PA01
agccuggcgcuguucgccgcggucgccuggaugcuccugcgcagccgcgccgggcu

SEQ ID NO: 4243001 - RNA, 59 nt, Pseudomonas aeruginosa PA01
uucgccauguaccagcacguccagccccaguuguuccuggaucugcaccgcauggcgga

SEQ ID NO: 4243002 - RNA, 74 nt, Pseudomonas aeruginosa PA01
cgaugaaggcguucucguaguccuggcuguccuuaggcaacaggccgaacaggaucuucgagaauccaaggucg

SEQ ID NO: 4243003 - RNA, 67 nt, Pseudomonas aeruginosa PA01
gcugucaggcuauaaggcccgauguagagccuuuucgacguugugcgucgagccuguggucuucggu

SEQ ID NO: 4243004 - RNA, 64 nt, Pseudomonas aeruginosa PA01
ggacgagcggcugaugcggcggcugaucgacgaacagaucccgcugaccgucugcccgcugucc

SEQ ID NO: 4243005 - RNA, 58 nt, Pseudomonas aeruginosa PA01
cgucauccagagcgcccgggugaucuucagcagcggucgcgacgcgcucuggaugccg

SEQ ID NO: 4243006 - RNA, 86 nt, Pseudomonas aeruginosa PA01
gcaggaccuucucgauggccggcuggccguagcgcaucgccaguuccaccggcccaugcggccagugcggcuucaucgccuccugc

SEQ ID NO: 4243007 - RNA, 72 nt, Pseudomonas aeruginosa PA01
gcaaguucgacgucggcgcccuggcgcgcaacgccggcgaggcggucgggguauucgccgacgucaaggugc

SEQ ID NO: 4243008 - RNA, 81 nt, Pseudomonas aeruginosa PA01
gcgcuggcgaucuggguguucaugucguugaucaccgauaccgccugggugaucgauuccagcgccucggccgccuggcgc

SEQ ID NO: 4243009 - RNA, 71 nt, Pseudomonas aeruginosa PA01
gcaguaucugcggcuggugcaccagcgcgcgggcgaugccgacgcgcuguuucugcccgccggagagcugu

SEQ ID NO: 4243010 - RNA, 62 nt, Pseudomonas aeruginosa PA01
ccucgccaucgaggcucugcaggcgcuccagcaagggcugcagggccuguucgcuggcgagg

SEQ ID NO: 4243011 - RNA, 62 nt, Pseudomonas aeruginosa PA01
cccugggggaaccacugcuugcagcgcucgaagucgcgguagaucaguacguucucccaggg

SEQ ID NO: 4243012 - RNA, 64 nt, Pseudomonas aeruginosa PA01
ggcgaacuccuggccuggcugcgcgaccacaagcaggucagcggcuacggccuggagaucgacc

SEQ ID NO: 4243013 - RNA, 74 nt, Pseudomonas aeruginosa PA01
ccugccgguggagcgcgugaccggcuacgguucgcucgacgagcaccugaccgccaugcgcuauuccgacuggg

SEQ ID NO: 4243014 - RNA, 65 nt, Pseudomonas aeruginosa PA01
caucggcagguugcacgccgcccuggccgcccggaugggcggcggggcgcucugcaacuugcaug

SEQ ID NO: 4243015 - RNA, 66 nt, Pseudomonas aeruginosa PA01
gcccagcgcgcacgcacacccagcucgucgaucaacgcucgguagguggcguugucgcgcuggcgc

SEQ ID NO: 4243016 - RNA, 60 nt, Pseudomonas aeruginosa PA01
ucagccugaagaacagcugccugguggcgcaguccgccgccggccaguccuucaggcugg

SEQ ID NO: 4243017 - RNA, 65 nt, Pseudomonas aeruginosa PA01
ggugagcgagcggccggacuucggcgagauccaggcgaucuugcgcgaccuugccgcucgcagcc

SEQ ID NO: 4243018 - RNA, 72 nt, Pseudomonas aeruginosa PA01
gucgggguugugccugguucaggcggcgcuggcgacacccgucgggcgccgcgagaacaggcugaccaggac

SEQ ID NO: 4243019 - RNA, 95 nt, Pseudomonas aeruginosa PA01
gccaccggcuccaacccgcggauggcccgugcccagggggucaacaccggcggcaugauccugcucggcauggccaucuccaacgcgcugguggc

SEQ ID NO: 4243020 - RNA, 71 nt, Pseudomonas aeruginosa PA01
cgaauucgaaaauagcuuagucgauugcgcaguuauugaccagcccgauucaccaggcuuuuucaauuucg

SEQ ID NO: 4243021 - RNA, 60 nt, Pseudomonas aeruginosa PA01
gacggccgguugcugcagacggaauuuuuccuugcgcucgaucugcaccaccuggccguu

SEQ ID NO: 4243022 - RNA, 96 nt, Pseudomonas aeruginosa PA01
guuaugaggcgauaaaauucggcagagcuaucgagucacgcaugauggcacguuggugucgugcugaaguggcauuugccgguuauccuuuguggc

SEQ ID NO: 4243023 - RNA, 57 nt, Pseudomonas aeruginosa PA01
gcgugcugcuggucgcuccgcugugcaugcuggucggcggcgcgaccuucggcgcgc

SEQ ID NO: 4243024 - RNA, 80 nt, Pseudomonas aeruginosa PA01
cgaugacgggcuugcggcgaugcucggcgauggcaucggccaccacgaagaccgcgccgagaucggccgcgccguccucg

SEQ ID NO: 4243025 - RNA, 55 nt, Pseudomonas aeruginosa PA01
gcucgacguacugauaucggauugcccggacugucugaugggacugcguccgagc

SEQ ID NO: 4243026 - RNA, 63 nt, Pseudomonas aeruginosa PA01
ggcgaauggggcuggcgcgugccguucuucaucggcugccugaucguuccggcgcuguucguc

SEQ ID NO: 4243027 - RNA, 60 nt, Pseudomonas aeruginosa PA01
uuccuugagcuucagcgcgccuuccagggccaccgggaacugcgcgccacggccgaggaa

SEQ ID NO: 4243028 - RNA, 120 nt, Pseudomonas aeruginosa PA01
cacuucaugcagcaggccugugcgcagauccagcgcccggugugccggcuggcgccgggcaccuacccggcgcugcugagcaaccgcuggccgggcaacgugcgccaguugcagaacgug

SEQ ID NO: 4243029 - RNA, 69 nt, Pseudomonas aeruginosa PA01
ggcuggugauguugccggcaaggaacuucagacgcuucacuucccaaugugcuggcaccucgccuagcc

SEQ ID NO: 4243030 - RNA, 107 nt, Pseudomonas aeruginosa PA01
accgccggauaggccucguggaggagauccggggcggugaagaaauacucgcugguaacggcgaagaacuccgccggaucuuccgccgcauaggggucgauggcggu

SEQ ID NO: 4243031 - RNA, 67 nt, Pseudomonas aeruginosa PA01
agcgaugcgcggcguuuccucgccgaaguggauuccgcuucggugauggucaacgccucgacccgcu

SEQ ID NO: 4243032 - RNA, 64 nt, Pseudomonas aeruginosa PA01
ucgcccagggucuuuugcggguggcgcgggccgaccuggccagccgcgaccugacccugggcgg

SEQ ID NO: 4243033 - RNA, 60 nt, Pseudomonas aeruginosa PA01
gcgaggaaguugaggauggcguuggacucccacaggcaacugccguccuccagcuccagc

SEQ ID NO: 4243034 - RNA, 68 nt, Pseudomonas aeruginosa PA01
ggagcuuaucaguuugaaguguaucugggaggagucccggauuuugagucagacugguuuucuguuuc

SEQ ID NO: 4243035 - RNA, 79 nt, Pseudomonas aeruginosa PA01
ugaggauugaggccaagcgccccucgggcagaggguaucugcucagggggcgcugguuucgcuaugaaccuucauccca

SEQ ID NO: 4243036 - RNA, 95 nt, Pseudomonas aeruginosa PA01
gguugcccagggcgagguuggcgcugaucgacugguccagcagcaggcccucgcccuugcgguccucggugaucagcgccacccccuggcgcacc

SEQ ID NO: 4243037 - RNA, 66 nt, Pseudomonas aeruginosa PA01
gugggcgaagugcgcguagcugccccaggccggggucucgcggcgcaggcgcagcaguucgucggc

SEQ ID NO: 4243038 - RNA, 60 nt, Pseudomonas aeruginosa PA01
gucuggggugaggccgagccgacauccugucgaggccucgucguucagcccacccccggc

SEQ ID NO: 4243039 - RNA, 76 nt, Pseudomonas aeruginosa PA01
cgccggccagguggagcguugcggcgccggcgggguuuccaguuggcggccgucgcgcaccaccaguucgccgccg

SEQ ID NO: 4243040 - RNA, 70 nt, Pseudomonas aeruginosa PA01
gugguauugcggauccgccgguaggcaucggcgcuacgcuggagaaucugcugggauaccgcgaucucgc

SEQ ID NO: 4243041 - RNA, 74 nt, Pseudomonas aeruginosa PA01
cugcugccguuggcacaugcucaggccgauucgcugcguugcggcagccgccuggugaguaccggcgacagcag

SEQ ID NO: 4243042 - RNA, 57 nt, Pseudomonas aeruginosa PA01
gcuggccuugaacgcaucgacguagcuggacagcucgucgccgccuucgcggccggc

SEQ ID NO: 4243043 - RNA, 78 nt, Pseudomonas aeruginosa PA01
cccggcgagcgggcggucggcagcgcucaugucgcgcagcagcaugaacauggcguccuugccguuggccucgccggg

SEQ ID NO: 4243044 - RNA, 91 nt, Pseudomonas aeruginosa PA01
gauaucagcgaccgauugcgauggccugauuauucaugauccgcggugucaggaaaaccagaaguucguuuuuccggucggugacgguauc

SEQ ID NO: 4243045 - RNA, 66 nt, Pseudomonas aeruginosa PA01
accuguucgccauggacccggaguucgccggccgccccgacggccucggccccaugagcgagcugu

SEQ ID NO: 4243046 - RNA, 62 nt, Pseudomonas aeruginosa PA01
gcugggagaacucguagacgcugcccggcaccucaagggccgcggccugcaauucuuccagc

SEQ ID NO: 4243047 - RNA, 86 nt, Pseudomonas aeruginosa PA01
ggcaugccgaagucgcgcucgaccuccuggaucgccgacagcucgcccuugccacgcuccuggcgguucagcgcgaucagcacgcc

SEQ ID NO: 4243048 - RNA, 65 nt, Pseudomonas aeruginosa PA01
ggcgccuuucuggccgucgggaccgaucaguuguaccugaauuuucuggguggcggggaagcgcu

SEQ ID NO: 4243049 - RNA, 65 nt, Pseudomonas aeruginosa PA01
gggcgccugggucugccccgccucgcgcuccagcagaucgcgcaggcgcugcgcauccagcggcc

SEQ ID NO: 4243050 - RNA, 77 nt, Pseudomonas aeruginosa PA01
gcuccggcagggugguccacagcggcaggccgaauuucuccucgaccaggccgccgucguggaugcgcuggucgagc

SEQ ID NO: 4243051 - RNA, 77 nt, Pseudomonas aeruginosa PA01
ccagcgccagcggguugcagccguuguagaagggcacccggccuucgccgagcaggcgcagcuugugcaugcgcugg

SEQ ID NO: 4243052 - RNA, 111 nt, Pseudomonas aeruginosa PA01
agcucaucuugcgcggguuggcgcgcaccgccuugaacuguuccucgagcaccuuggaggccugcacgcggaacuucaggccgcgggcguccuucggcucgcgcaggggcu

SEQ ID NO: 4243053 - RNA, 69 nt, Pseudomonas aeruginosa PA01
gcaccgcgggcagccccggaucggcgcggaaggcuuccagcgcggcgaucucggcgcugcucgcgccgc

SEQ ID NO: 4243054 - RNA, 66 nt, Pseudomonas aeruginosa PA01
ugcgcgcaguuuacccggagaaccccgccauggggcgggcuucuaccggaaaagcggcgccaggca

SEQ ID NO: 4243055 - RNA, 77 nt, Pseudomonas aeruginosa PA01
gcuccgacuucgccgcccucggccagcuuuccgccgaccugcugggcaagcugaagaugggcggcauggacuucagc

SEQ ID NO: 4243056 - RNA, 60 nt, Pseudomonas aeruginosa PA01
gggccgcccggcgggaucuugcccugggcgacggucagcacuugccgcgcguggcggcuc

SEQ ID NO: 4243057 - RNA, 110 nt, Pseudomonas aeruginosa PA01
gugcugccgacgaucagcagggugucgcaaugcuccaucagcaugcugcuggcgcgggugccgagcaggccgauggagccggucacguacggcaggucgucggaaaccgc

SEQ ID NO: 4243058 - RNA, 78 nt, Pseudomonas aeruginosa PA01
gcgucuggggaucgacugcgucuaccuggacaucagccacaagccggccgaguucaucaaggcgcacuuccccaccgu

SEQ ID NO: 4243059 - RNA, 55 nt, Pseudomonas aeruginosa PA01
ggccaugaggcggcggcgcugugccugcuggcggcggccgcccuccucaugugcc

SEQ ID NO: 4243060 - RNA, 55 nt, Pseudomonas aeruginosa PA01
gcuccauuuauccaggggcagauaugaaaauaucugcccuuguucuaaugguagc

SEQ ID NO: 4243061 - RNA, 72 nt, Pseudomonas aeruginosa PA01
ccugugccuggugaugggcguggcgggugcgagcauggcgcauucguccaucguccucaccgggauggccgg

SEQ ID NO: 4243062 - RNA, 81 nt, Pseudomonas aeruginosa PA01
cgaggcgcgugccgagcggcuggcggauguaguggcggaucaccucgucgcugaccuucgaguuguucuccacgcggaucg

SEQ ID NO: 4243063 - RNA, 56 nt, Pseudomonas aeruginosa PA01
ggcccgcuggggcuggaggaaggcaacaauccguuccucucggcccuuggcggguu

SEQ ID NO: 4243064 - RNA, 60 nt, Pseudomonas aeruginosa PA01
agcgcauggccagcggguagauccgguguucuuccucgugaacccgucuggccaggcguu

SEQ ID NO: 4243065 - RNA, 96 nt, Pseudomonas aeruginosa PA01
gcggcggcgccaggcccugggccggcugggucaguugcaggcgcaggaggaagcggcugcccugccccggccgggacucgugggucagcucgccgc

SEQ ID NO: 4243066 - RNA, 80 nt, Pseudomonas aeruginosa PA01
cgucauccaguucgucgagggcucgggcgcagcgccaggcguaggcgucgucggccucguucucgaugaacaggcugaug

SEQ ID NO: 4243067 - RNA, 130 nt, Pseudomonas aeruginosa PA01
agcgucucgacaagccguuccuggaaggcgccgaggcgcgcgggcugcucaaccugaaaggccaccgcucggucggcggcaugcgcgcuuccaucuacaacgcccuuggccuggacgcggucgaggcgcu

SEQ ID NO: 4243068 - RNA, 64 nt, Pseudomonas aeruginosa PA01
cgacagagcgugcucgggccgcgccugcaauccucgcagaacaccggccagcgccugcugcucg

SEQ ID NO: 4243069 - RNA, 79 nt, Pseudomonas aeruginosa PA01
gcugcuggccagcuuccagaucggcgagcggaucaccgacauccgcguguuccgcuggucgaucuccagcgacggcagc

SEQ ID NO: 4243070 - RNA, 67 nt, Pseudomonas aeruginosa PA01
gcgcgucgaggucggcggggcgcggguugagggugaucuggcacucgccggccuugagcuucugcgc

SEQ ID NO: 4243071 - RNA, 65 nt, Pseudomonas aeruginosa PA01
aucgaacgcggcaggucgcgggacaggcucuccagggguuccuggggcacugccgcgacguugau

SEQ ID NO: 4243072 - RNA, 92 nt, Pseudomonas aeruginosa PA01
aagcccggcacccuggcgcgcugggggaucggcuacgaggaggugcuucgccagcgcuucccgcggcugguccacugcgcgguaucgggcuu

SEQ ID NO: 4243073 - RNA, 89 nt, Pseudomonas aeruginosa PA01
gucggcgguguucgcggugaugaugacgguggucuaugccuuccaggguugcgagaucaugggcgucgccgccggcgagaccgagcgac

SEQ ID NO: 4243074 - RNA, 57 nt, Pseudomonas aeruginosa PA01
gccgaggaauuuccccgcgaacucuaucucaaggccggcgcggccgggauccucggc

SEQ ID NO: 4243075 - RNA, 68 nt, Pseudomonas aeruginosa PA01
gcgaucuccagcagcuucugcuggcgccguugcaggcugcaaucgcgcucccagagguggcugaccgc

SEQ ID NO: 4243076 - RNA, 83 nt, Pseudomonas aeruginosa PA01
cuuucuugccggaaaaguaguugcccugguugcgcugcgcauaggcggcgaccagguccagaugcucguugcgguaggcgaag

SEQ ID NO: 4243077 - RNA, 59 nt, Pseudomonas aeruginosa PA01
aagcggacccgcgccagguugcgccgggggugaccuggcagccuggcgcggguccgcuu

SEQ ID NO: 4243078 - RNA, 59 nt, Pseudomonas aeruginosa PA01
ugugcagguuccggaacaggcaauccucccgcauccgcaggagaggccggaaccgcaca

SEQ ID NO: 4243079 - RNA, 67 nt, Pseudomonas aeruginosa PA01
ggauaaguuuuucauggcuuugugccguuacuuuggcgcaaggcuuuucggaaaaauuuacauaucc

SEQ ID NO: 4243080 - RNA, 73 nt, Pseudomonas aeruginosa PA01
gcggcggucugcgcguggaauucggcggggaagcugaucuugaacagcacguuuuccaucacguagcugccgu

SEQ ID NO: 4243081 - RNA, 66 nt, Pseudomonas aeruginosa PA01
gcccaggugguugugcggcgccacggugccgcggucgaagaccuggcgguugcgcaccaccucggc

SEQ ID NO: 4243082 - RNA, 57 nt, Pseudomonas aeruginosa PA01
gcacggagcgauacggugcgcggccucgugagccauugcaccuauccguucuggggc

SEQ ID NO: 4243083 - RNA, 85 nt, Pseudomonas aeruginosa PA01
gcgagaccugggacaugacacggaacaggcggcaugccguauaaucggcagccuguuucaguugucaugcccgcguggcccccgc

SEQ ID NO: 4243084 - RNA, 68 nt, Pseudomonas aeruginosa PA01
gguuuucagagcuuuuccagacagccggcaaauucgccugccagguuguucagaagauucucauagcc

SEQ ID NO: 4243085 - RNA, 83 nt, Pseudomonas aeruginosa PA01
cgcugacgccgcugugcucgccgcccaucaccccggcgauggccagggcgcgcugguggucggcgaucaccagggugucggcg

SEQ ID NO: 4243086 - RNA, 70 nt, Pseudomonas aeruginosa PA01
ccgaagaugcaggugcuguucagcggcaggucgcgggcguagaccuugaagcugucaugcaccugggcgg

SEQ ID NO: 4243087 - RNA, 64 nt, Pseudomonas aeruginosa PA01
ggcgucggcugaucggcagcaacaagggcgcgucgucgcccaguugcgcggucagcgcgguauc

SEQ ID NO: 4243088 - RNA, 96 nt, Pseudomonas aeruginosa PA01
cccuggauaucgaucuggaccaguuggagcgggccuacucgcugaugauguaaaggagaggaaccuuccggcugcgucuccgccgaaauccauggg

SEQ ID NO: 4243089 - RNA, 55 nt, Pseudomonas aeruginosa PA01
gggcagcuucagcaagcgcucggcgggguagagccgggcgcuggcauaggcgccc

SEQ ID NO: 4243090 - RNA, 55 nt, Pseudomonas aeruginosa PA01
gccgguuuccacuccgcgcgccucggcccgcgagugcugcgcaccgagaccgcgc

SEQ ID NO: 4243091 - RNA, 64 nt, Pseudomonas aeruginosa PA01
gcugucgaucacguaacggaugcccggcaccgucagcgagguuuccgcgacguugguggacagc

SEQ ID NO: 4243092 - RNA, 78 nt, Pseudomonas aeruginosa PA01
ggucgcgguggagccggugaagcugaccaucgccacguccggguggcggcccagcgguucgccggccucgcggccgcc

SEQ ID NO: 4243093 - RNA, 98 nt, Pseudomonas aeruginosa PA01
gcucgaugucgcagaagagaaugaugcgguuguguucgguggcguuuuccgcguaguggaugaagguuucaucgaacaccaccgccucgccgucgcgc

SEQ ID NO: 4243094 - RNA, 110 nt, Pseudomonas aeruginosa PA01
cguacucgaagccgucggcgaagcgggucgaggcguugaccaucaccgaagcggaauccacuucggcgaggaaacgccgcgcaucgcugaaguucucgguaaugaucgcg

SEQ ID NO: 4243095 - RNA, 55 nt, Pseudomonas aeruginosa PA01
ggcauuggcgaucuccagcagacgcuggcgcugcucggcgucgagaucgccggcc

SEQ ID NO: 4243096 - RNA, 77 nt, Pseudomonas aeruginosa PA01
cgaccccgugggcgagguugccgcacggcagggugccgcggugcggccccuugcuggccgcagcccggaccaucucg

SEQ ID NO: 4243097 - RNA, 58 nt, Pseudomonas aeruginosa PA01
ucgucgagggugccgaagccgccggggcagagcaccagggcgucggcuuccuugacga

SEQ ID NO: 4243098 - RNA, 81 nt, Pseudomonas aeruginosa PA01
ccaugaagucguacaucucgaggaaguugccacugaccacacggaaaauggcgacaccuuuggauuuauuagaggccaugg

SEQ ID NO: 4243099 - RNA, 82 nt, Pseudomonas aeruginosa PA01
uugaggauuuccagggaagacgcguaguccgggucgccggcggugacgaaggucaccagggcggcgcgguuuuccugcuuga

SEQ ID NO: 4243100 - RNA, 94 nt, Pseudomonas aeruginosa PA01
accgcuauccgaucaagucuuccgccgccgagucccuggagcgugucgcgcucgaugcgcugggcguggucggcgaccgacgcuggauggcggu

SEQ ID NO: 4243101 - RNA, 61 nt, Pseudomonas aeruginosa PA01
gcugcaucggcucgucauucgccgguuuuccgacgccggcaggggagaugaccgauguugc

SEQ ID NO: 4243102 - RNA, 81 nt, Pseudomonas aeruginosa PA01
guagggcggauaacgccccuggcguuauccgcggggcuccggagaaucggcggacaaccgccaggcgguuauccgcccuac

SEQ ID NO: 4243103 - RNA, 58 nt, Pseudomonas aeruginosa PA01
cgcaccaucuuucccaucagccucggccuggccgccagcugggaccccgagguggucg

SEQ ID NO: 4243104 - RNA, 56 nt, Pseudomonas aeruginosa PA01
ggcguucaucgccaggugcagccagccgaaguggaucagcaucggcgugaacagcc

SEQ ID NO: 4243105 - RNA, 98 nt, Pseudomonas aeruginosa PA01
gcggguggcggucgagggcgucgagcagagccuggagcaggcccuggcugggcgccugcugccggacucuuucgaacaccuggucggcuugcacccgc

SEQ ID NO: 4243106 - RNA, 66 nt, Pseudomonas aeruginosa PA01
gcgagcgcaagcuguucgccgggcgccggcagaugcuuggcgcggcgcugugcagcuugcugcugc

SEQ ID NO: 4243107 - RNA, 82 nt, Pseudomonas aeruginosa PA01
gcgcuucaccaccccugggagagaauccguaaauccuugauuuucaagcauuuacucuucgucgucgccgggaguggugcgc

SEQ ID NO: 4243108 - RNA, 100 nt, Pseudomonas aeruginosa PA01
uccucgcgccaguccugcagggugcgcuggcugagcaaugccaggcgcagcaggugcgcggcauugcggcgguucagcgagccgcggcaggccgcgagga

SEQ ID NO: 4243109 - RNA, 71 nt, Pseudomonas aeruginosa PA01
ggucgggauugaugcugaccagguguucgaugaucuucgacagcggcuuggucagcauccagugguagacc

SEQ ID NO: 4243110 - RNA, 71 nt, Pseudomonas aeruginosa PA01
ggaccuuggccucgacgccggcgugcgcuuguuguuguuauggcgcacgccgcggagacggccuucggucc

SEQ ID NO: 4243111 - RNA, 57 nt, Pseudomonas aeruginosa PA01
caggaguucggcggcgcgcucgaagguacccagccgggcagccgcuucgaacgccug

SEQ ID NO: 4243112 - RNA, 56 nt, Pseudomonas aeruginosa PA01
ccaggcgcgcuucgucgcacugcgggucgcccaggcagucgaccagcgccgccugg

SEQ ID NO: 4243113 - RNA, 56 nt, Pseudomonas aeruginosa PA01
ggcggauggcgcucauggucgccucggugccggagcugaccaugcgcaccaucucc

SEQ ID NO: 4243114 - RNA, 110 nt, Pseudomonas aeruginosa PA01
gcagauaggcgggaaggauauuguugccgcuggaguacuuguagcagauguagcgcuugaggcugcugcggauguacucggugagcugcaccacguccuucuccuucugc

SEQ ID NO: 4243115 - RNA, 91 nt, Pseudomonas aeruginosa PA01
ccuggacgaucagcaguuuuuccgagagcagcaggucgaggacgaacuuuucgucguuguggaucgggcagaccuucggaucgauccgcgg

SEQ ID NO: 4243116 - RNA, 88 nt, Pseudomonas aeruginosa PA01
gaucggugccgugcugaacaccgccaagguggaagagggcgcuaccguugccaucuucggccugggcggcaucggccuggcagcgauc

SEQ ID NO: 4243117 - RNA, 77 nt, Pseudomonas aeruginosa PA01
ucucucgggaaccgcuacgccgaugcaugccgucgacgaccagggcgacaaguaucugguuggcggucucugcgaga

SEQ ID NO: 4243118 - RNA, 71 nt, Pseudomonas aeruginosa PA01
gcucggccugcugccgggccgggcgcgccugcagaagcgccugaccgcccuggccuugcaggaggucgagc

SEQ ID NO: 4243119 - RNA, 76 nt, Pseudomonas aeruginosa PA01
uuccgggcacgccggucuugacguaggugauguauuuuuccagcagcgccggaucgagccgcgccuugacccggaa

SEQ ID NO: 4243120 - RNA, 62 nt, Pseudomonas aeruginosa PA01
gcgccgccggccaguucaccggcgcgcagagcaguugcgcgccggacagcgccggcaggcgc

SEQ ID NO: 4243121 - RNA, 83 nt, Pseudomonas aeruginosa PA01
ucgaaggcggacugguugagggaauugagguaaagcuugaacgacuucgacucgaugauguucggcgaguccgccgggaucga

SEQ ID NO: 4243122 - RNA, 58 nt, Pseudomonas aeruginosa PA01
gccuguucuggagccgccggcgcgaggagcgggaagucgccggcuggcccgagcgggc

SEQ ID NO: 4243123 - RNA, 107 nt, Pseudomonas aeruginosa PA01
cguugaucucgucgauggucaucagggccauguccuucagcgaggucucggagaucgccauggucccggacagcgaguggaggaugccgaccuugaugguuucggcg

SEQ ID NO: 4243124 - RNA, 107 nt, Pseudomonas aeruginosa PA01
gcggcgggcuucgcggcugcgguuuucgccgcaggcuuggccgccgguuucgccacaggcuucgccgccggcuuggcugcgggcuucgcggcugcgguuuucgccgc

SEQ ID NO: 4243125 - RNA, 88 nt, Pseudomonas aeruginosa PA01
cagcuucggcaagcaugccgaucaacgaugcuugugcuugcgguguuucuugccgcggugaccgcugucguuguccuugcccagguug

SEQ ID NO: 4243126 - RNA, 67 nt, Pseudomonas aeruginosa PA01
gcggcuucucgucggcaaagggaucggaaaggaagcccuugccaucgaccuugccggcgcuggccgc

SEQ ID NO: 4243127 - RNA, 58 nt, Pseudomonas aeruginosa PA01
cagcgccuggucggcccacuggcgaagggccuguucccaguucgccgccggcgcgcug

SEQ ID NO: 4243128 - RNA, 62 nt, Pseudomonas aeruginosa PA01
ccugguggaaguggucgaggccccggagcauccgugguucgucgccugccaguuccacccgg

SEQ ID NO: 4243129 - RNA, 77 nt, Pseudomonas aeruginosa PA01
ccuacgagccgccggccgaggcgccggaccaggacuacccguucuggcucgccaccggccgggugcucgaacacugg

SEQ ID NO: 4243130 - RNA, 57 nt, Pseudomonas aeruginosa PA01
gaccgccagcagcucgucgcgaugcagcagcuugccgcgcggcacgccguuggcguc

SEQ ID NO: 4243131 - RNA, 81 nt, Pseudomonas aeruginosa PA01
ggggaugcauguuguucaguugccgaugauaagaaugcacuucaugcaucuuagcaggcgcacuaggauggccggaucccc

SEQ ID NO: 4243132 - RNA, 71 nt, Pseudomonas aeruginosa PA01
ggcuguacaugaucaggccgcaaccgaccgaacaguagguacagguguugcgggucucgaccgugugcgcc

SEQ ID NO: 4243133 - RNA, 69 nt, Pseudomonas aeruginosa PA01
gggaacuccuggcgggugccgcgcuggcguugcugccgggcgcuagccgcggucauucgcagugguccc

SEQ ID NO: 4243134 - RNA, 69 nt, Pseudomonas aeruginosa PA01
guccgggugcuuguugcgcaugugcucgacauaggugucguagucgggcaugccgaccagcauccgggc

SEQ ID NO: 4243135 - RNA, 87 nt, Pseudomonas aeruginosa PA01
gccgaagucgccguugccggcauagggcuuggcgucgguguggccgcugaugcugaucuuguucggcaccuggcggauggucucggc

SEQ ID NO: 4243136 - RNA, 94 nt, Pseudomonas aeruginosa PA01
cgccaggcgcuugcgcacgaugcugucgguggucgggcucggcgugccgcgcuggccgaguuccgccgacagggucggcaacgggcagccggcg

SEQ ID NO: 4243137 - RNA, 76 nt, Pseudomonas aeruginosa PA01
gcggcgcucgcaggcgacgucgagccgaggccauggcuuacagggccucgguguuggccucgucgucgaacgcugc

SEQ ID NO: 4243138 - RNA, 73 nt, Pseudomonas aeruginosa PA01
uccggcauccuuccggacguccgcgucagcggcgacgaacgcagcuacgccgagcgugccgaagacugccuga

SEQ ID NO: 4243139 - RNA, 55 nt, Pseudomonas aeruginosa PA01
augccggacgaaaaaaaaccggagccgcgagggacuccgguuuuccuucuggcau

SEQ ID NO: 4243140 - RNA, 96 nt, Pseudomonas aeruginosa PA01
gcgcggaccuggccggcguggcgaccuucaagcgucggcucaaggccgcccaggccgagcuggagcgugaguucgccgcgugcugggacgaugcgc

SEQ ID NO: 4243141 - RNA, 55 nt, Pseudomonas aeruginosa PA01
cgagggaagacgcgaccggggugaaacguuuaggcuggucgcacuuccucccccg

SEQ ID NO: 4243142 - RNA, 88 nt, Pseudomonas aeruginosa PA01
agcaggccgccuuucugcugcugcaacuggucgaucaccggguugaccugauccaucgccucgggcggcagcagcaacgccgccugcu

SEQ ID NO: 4243143 - RNA, 63 nt, Pseudomonas aeruginosa PA01
gcgagccuuucggcgccucggcgcgagcgaugaugucgcucagcccggugccgaaauacccgc

SEQ ID NO: 4243144 - RNA, 55 nt, Pseudomonas aeruginosa PA01
ccaccuacaucggccugcgccugacccaggaaggcgcaggcgaccugugggucgg

SEQ ID NO: 4243145 - RNA, 81 nt, Pseudomonas aeruginosa PA01
cuugagcaggcgcgggcugacguaauggaugcuggcgccgcaggcgcugagcaggaccacgucgcucgggcuggccucgag

SEQ ID NO: 4243146 - RNA, 55 nt, Pseudomonas aeruginosa PA01
agaagcacgacgcucgccggcggugacuugcacugcacgguagccaucgguuucu

SEQ ID NO: 4243147 - RNA, 128 nt, Pseudomonas aeruginosa PA01
uccagcgcgccggcgaaguacugcugcuugagccacagcugggucagccgccaggucugcccgcggccccagaccuccugcaccgagcugaugugcccggcacgcgggucgccgaugcggucguugga

SEQ ID NO: 4243148 - RNA, 61 nt, Pseudomonas aeruginosa PA01
ggacaguugccaaucccgcagcgaggucgcuuccacugcgcugaagggcuccgcgcugucc

SEQ ID NO: 4243149 - RNA, 84 nt, Pseudomonas aeruginosa PA01
ggccgccaggccguucuucuggcgcagggugcccaucagcucgcggcgcucggugaggaucuugugcggauaggccugguggcc

SEQ ID NO: 4243150 - RNA, 70 nt, Pseudomonas aeruginosa PA01
cccugcuggcgagcaacccggcgguggucaagcgcccggcgcugaucaaccgggauugcuacggcgaggg

SEQ ID NO: 4243151 - RNA, 62 nt, Pseudomonas aeruginosa PA01
aaugcauuugccgcugccuggggccuuucuuuaaauggcccuucuuagcgaaaaaaugcauu

SEQ ID NO: 4243152 - RNA, 88 nt, Pseudomonas aeruginosa PA01
guucgccgauugccgcgaucuugaccuggcggcggaaaaggccgccuucggcauuuucuucaaccagggcgaggucuguucggcgaac

SEQ ID NO: 4243153 - RNA, 115 nt, Pseudomonas aeruginosa PA01
agucccggguccagcuccagcaugcgacggaugugcgcgucggcguucuugucggucggguugaaaccggucaggaacggaugcacgcgccgccgcugcucggcuggcagggauu

SEQ ID NO: 4243154 - RNA, 62 nt, Pseudomonas aeruginosa PA01
gccauguucacaucguuguucgggugcagguacuuguacucacccuugguguggcccauggc

SEQ ID NO: 4243155 - RNA, 68 nt, Pseudomonas aeruginosa PA01
agggcuucgucgagggguuugacgaaacgcaugucgacgaccguggcgucgaggcuuucggcgaccuu

SEQ ID NO: 4243156 - RNA, 90 nt, Pseudomonas aeruginosa PA01
gcagccacuggcugacgguggugccggugagcuggcggaaaugccgggugaagguccgccggcucaucagcacccgcugugccaggcugu

SEQ ID NO: 4243157 - RNA, 77 nt, Pseudomonas aeruginosa PA01
gcggccuguucgauggcgugguggaccaccgggauaccgugggugaggaugccgccgccgaccaugaacaucgccgc

SEQ ID NO: 4243158 - RNA, 118 nt, Pseudomonas aeruginosa PA01
gauaucgaaggagcgcuccguggaggugucguugacccgcgggaaguucuucaacgcgacgcuacccaguuugacguugauuucccgucccaccucgaccuugcauuucuucgggauc

SEQ ID NO: 4243159 - RNA, 96 nt, Pseudomonas aeruginosa PA01
cgcuggugguguucccggucggcgcgcuguaucgccaggagaugauccaugcccuggagagcaucgggcgucgcuggcgcaucggcuauuccagcg

SEQ ID NO: 4243160 - RNA, 66 nt, Pseudomonas aeruginosa PA01
gaggucgaucuggcccuugaccagcuucugcgcguuuuccuggucgcguagcgccaggucggccuc

SEQ ID NO: 4243161 - RNA, 69 nt, Pseudomonas aeruginosa PA01
ggcagaucaaggccagcagcaggguggucgccgccaggaugccgaucgccccgcgcugucuugcaggcc

SEQ ID NO: 4243162 - RNA, 66 nt, Pseudomonas aeruginosa PA01
cgcucggccagggcaaugucgaagccgaccgagagcgccuuggccuugucgucguccuggcuggcg

SEQ ID NO: 4243163 - RNA, 62 nt, Pseudomonas aeruginosa PA01
acggcaggcagaggucuguuaccggauaugaaaaacggguuuuccgcaggccucgccgccgu

SEQ ID NO: 4243164 - RNA, 95 nt, Pseudomonas aeruginosa PA01
cgaaguggcgcuccuucugcacguaguuaugguggcaaucgaccgccuccagguuggcuucgaacggcuugcggaucaccuggcgcgccgccucg

SEQ ID NO: 4243165 - RNA, 57 nt, Pseudomonas aeruginosa PA01
gcggccuucgaccggguacgcaagggugccgcuccgccgcucgccguggaaggcugc

SEQ ID NO: 4243166 - RNA, 130 nt, Pseudomonas aeruginosa PA01
gucgagccggacagcuccuggcguugcgccuugccgcugcgugcggcuucggccaggcgcgccacuucgcuggcguugccccagaggucgcgcgauucggcguggcgcagcaccggcaccaucaggccgu

SEQ ID NO: 4243167 - RNA, 129 nt, Pseudomonas aeruginosa PA01
ggcccauccgggcguuuucgaaaaucaccaggugcuggugcucggugcgcaccucaugcagcauguugucgaugcugaagcgcuggccguagcccugguacagaguuuccugauaaucgcucaugggcc

SEQ ID NO: 4243168 - RNA, 91 nt, Pseudomonas aeruginosa PA01
cggugugcgcugcaucggcgcgccgaaggcgauauggccgauuucgaugacgccauccuucggcgugauccgcagguagcugagcaggccg

SEQ ID NO: 4243169 - RNA, 75 nt, Pseudomonas aeruginosa PA01
uggaugugccucagggguucuaugauaugggggcaaugauugguaaucgugccgguguuaagaacccugcuaccg

SEQ ID NO: 4243170 - RNA, 55 nt, Pseudomonas aeruginosa PA01
gcucgggucgagggccuugagacgcuccagcagggucaggccgucgaugccgggc

SEQ ID NO: 4243171 - RNA, 78 nt, Pseudomonas aeruginosa PA01
gaaggguucggccaggauucgcgcgcggcgcucgggguugacccgccagccgugcggggucauggccaggagguuuuc

SEQ ID NO: 4243172 - RNA, 107 nt, Pseudomonas aeruginosa PA01
ggcccuugccgcgaccgcacuccaugcggcgguuguucauguagggcucggggucggucucguaggcccaguuguagcgccgccccugcagcgggaaggcaagggcc

SEQ ID NO: 4243173 - RNA, 100 nt, Pseudomonas aeruginosa PA01
ggcgggugccguagcgcuccccggcgagguccugcaaggccucgcggcagugcgccucggccuugucgaugucgccgcggccgcgcgcgaucaccccgcu

SEQ ID NO: 4243174 - RNA, 55 nt, Pseudomonas aeruginosa PA01
gcuguugcugcgguaaugccugaccaguuccuccaggcuaccguugaagaacugc

SEQ ID NO: 4243175 - RNA, 121 nt, Pseudomonas aeruginosa PA01
gccgcaccgccucguccagcucgauguauggaaccuucugaccgggugcggcgcggggcacgucggcgcgugcgaugaccggagggaugccgucguuggucagggugacgugguugucggc

SEQ ID NO: 4243176 - RNA, 63 nt, Pseudomonas aeruginosa PA01
ggccgccaugagcgugccggaggcgcguuucgaagagaucgccgcgcugcucgcuggcuggcc

SEQ ID NO: 4243177 - RNA, 87 nt, Pseudomonas aeruginosa PA01
cguugucgcugaaacugcaugagcggcucgaccuggggaucgccguggacaccccggacggccuguucgugccggugcugcgcgacg

SEQ ID NO: 4243178 - RNA, 63 nt, Pseudomonas aeruginosa PA01
gcggcggcuugcuggcgaucccggcgcuaggggugaucuucggucucgaccagcaacuggcgc

SEQ ID NO: 4243179 - RNA, 55 nt, Pseudomonas aeruginosa PA01
guuggucggcuggucgccgaagcgguucgagguuccgucgaugcagaccaccaac

SEQ ID NO: 4243180 - RNA, 73 nt, Pseudomonas aeruginosa PA01
ggucugggucgccgcggggguguagaggaccaugaugucgacggucuucggcgcggccugggcggcagaggcu

SEQ ID NO: 4243181 - RNA, 65 nt, Pseudomonas aeruginosa PA01
gcggguccugucgauccauggcgaaggcuuccacgaccgcaucgccaucgagcugccaggccagc

SEQ ID NO: 4243182 - RNA, 81 nt, Pseudomonas aeruginosa PA01
gccagaccgggccgacgguguggaucacgugggccgccggcagacggaacccacgggugaucuucgccucgccggucuugc

SEQ ID NO: 4243183 - RNA, 63 nt, Pseudomonas aeruginosa PA01
ggaaucggcgaacaggaucgcgcagccauugccgagggccugucgcggcuacuggccgacacc

SEQ ID NO: 4243184 - RNA, 82 nt, Pseudomonas aeruginosa PA01
gcucaggucgacggcgaagccugccucggcgagccccuggcgcagguacuggccgaugcgcgguucgucuucgacgaucagc

SEQ ID NO: 4243185 - RNA, 106 nt, Pseudomonas aeruginosa PA01
cccuggucgcggcuguagaaguccuggcgguggcuuucgguccauuccuugcccuggucgagcaugaccggagcggccgccagggcggcggaagaaagagccaggg

SEQ ID NO: 4243186 - RNA, 56 nt, Pseudomonas aeruginosa PA01
cucagcaguaccuggucgaggaucgccgaagcgccccacggccgcgggcuguugag

SEQ ID NO: 4243187 - RNA, 107 nt, Pseudomonas aeruginosa PA01
gccgcucugcaggucgagguugccggcccggcuguccaggcggccgcccugguuguccagcgcgccgccgauacgcagccgguugucgcccugggccuggagcgugc

SEQ ID NO: 4243188 - RNA, 72 nt, Pseudomonas aeruginosa PA01
ggcgauccgcacagugccgucgcugccggccucguuggcgauggcuucgacgccgcuguagccgacauugcc

SEQ ID NO: 4243189 - RNA, 71 nt, Pseudomonas aeruginosa PA01
uggagcggacgccggccguugcaauggcuguacgagaacgucgcggucgaccagcgcuggugccuggucca

SEQ ID NO: 4243190 - RNA, 55 nt, Pseudomonas aeruginosa PA01
caacgccaggcgcuggcuuucgucguacucgcgggcgaagucguggccggcguug

SEQ ID NO: 4243191 - RNA, 70 nt, Pseudomonas aeruginosa PA01
gacgaagcgguugaaggcauuggccaacguaccgaauucaucguugcuggugaccuucaggcgcuugguc

SEQ ID NO: 4243192 - RNA, 63 nt, Pseudomonas aeruginosa PA01
caggucgaacuggcugugcaggucauugaucacacuggccaccugggcauccagcucggccug

SEQ ID NO: 4243193 - RNA, 129 nt, Pseudomonas aeruginosa PA01
ggcgcuggaaaccgaacugcgccgcgcccucgagcgcgacgaguugcagcucuacuaccaacccaagcugagccuggagagcggcuugcuggucggcgccgaggcacuggugcgcugguaccauccgcu

SEQ ID NO: 4243194 - RNA, 130 nt, Pseudomonas aeruginosa PA01
gcggugaggccuucgcgggcaucgucgccggugguggcgaucuugaacuucuucgccaggccuucggccucgauguaguuguucagguuacgcgucagcgccgaacggaaaccggccaggugggugccgc

SEQ ID NO: 4243195 - RNA, 67 nt, Pseudomonas aeruginosa PA01
gcgcuucuacgaccaggguggccuggccggcaagaaggcgcuggucagccugacccugggcgggcgc

SEQ ID NO: 4243196 - RNA, 61 nt, Pseudomonas aeruginosa PA01
gcgaugggcgauaacgccguuguuccgcgcucugcggcgggaaaacgcggaucgcccuugc

SEQ ID NO: 4243197 - RNA, 99 nt, Pseudomonas aeruginosa PA01
guagcgcuuguggaugucuucgaccugcaggcuguacaugcgcgugucuccgggagaggucaguggguuugcggucugagguaggccagccagcgcagc

SEQ ID NO: 4243198 - RNA, 79 nt, Pseudomonas aeruginosa PA01
gcuguagagcagcggcaacggguggucgaccaggccgaggccgagcaggccguuguugaucacuccgcugccgcgcagc

SEQ ID NO: 4243199 - RNA, 59 nt, Pseudomonas aeruginosa PA01
ccuggugguggacccgaugagcuuccaguaccuggcgggcucggaagucgacuaccagg

SEQ ID NO: 4243200 - RNA, 55 nt, Pseudomonas aeruginosa PA01
ggucgacucguugucggugacguggccgccgaugaucaccagauugcgggugacc

SEQ ID NO: 4243201 - RNA, 77 nt, Pseudomonas aeruginosa PA01
ccagugcaucgcccugucccuggccggcaucuuguuccucaacccgaucgucgccgcggcggcggggcuggcgcugg

SEQ ID NO: 4243202 - RNA, 55 nt, Pseudomonas aeruginosa PA01
gccggucucgcggcggucgaaggcuucgaaggccucgauggcgucgccgaucggc

SEQ ID NO: 4243203 - RNA, 87 nt, Pseudomonas aeruginosa PA01
ccgagcagaauccguuucaucguuuguucucucuugagguggaucggagccaucuggagcgggccagcgacgccgugagcuuuucgg

SEQ ID NO: 4243204 - RNA, 74 nt, Pseudomonas aeruginosa PA01
ugcugcaggaacggguagucgagcggcucggcuccaaccaguugaucccgcuggauauccgcaucaucgcggca

SEQ ID NO: 4243205 - RNA, 82 nt, Pseudomonas aeruginosa PA01
gcgcaccacucccggcgacgacgaagaguaaaugcuugaaaaucaaggauuuacggauucucucccagggguggugaagcgc

SEQ ID NO: 4243206 - RNA, 78 nt, Pseudomonas aeruginosa PA01
gcacgccgucgucguccacgugguccucgaugccguccagcaggcgcgccuugccgaccacgucgacgcgggcguagc

SEQ ID NO: 4243207 - RNA, 56 nt, Pseudomonas aeruginosa PA01
ggcugguggugaaaccgaccugguuguugaucaccagguggauggugccaccgguc

SEQ ID NO: 4243208 - RNA, 57 nt, Pseudomonas aeruginosa PA01
gugcgcgaccugcugagaaaggucggucgcgacuguagccuguucagcgucgugcgc

SEQ ID NO: 4243209 - RNA, 58 nt, Pseudomonas aeruginosa PA01
gcgauggcgaugacgauuuuggagccacgcuuaccgccuuccagcgucucgccgacgc

SEQ ID NO: 4243210 - RNA, 61 nt, Pseudomonas aeruginosa PA01
cgggucggccgauggcggcggaccgucgccgcuggcggucugcggcagcaggucgacgccg

SEQ ID NO: 4243211 - RNA, 85 nt, Pseudomonas aeruginosa PA01
ggcucggaagugucguagauguggaucagggugcggguggcgggcaccgccaucaccaccaggaucacgaacggcaccaccgucc

SEQ ID NO: 4243212 - RNA, 56 nt, Pseudomonas aeruginosa PA01
ggcacccgcucgcugggcgaguugcuguucagcgacagcgccuucgagcgcgggcc

SEQ ID NO: 4243213 - RNA, 79 nt, Pseudomonas aeruginosa PA01
gauccucgccgaugcgauggaagcccugaucggcgccaucuaccuggauaccggcauggacuccgcgcgcgagcggauc

SEQ ID NO: 4243214 - RNA, 72 nt, Pseudomonas aeruginosa PA01
ggcgccgaugagcaggaagguggugcgcauggagucguagcguuucuccaucugcucguugagcuuggcgcc

SEQ ID NO: 4243215 - RNA, 91 nt, Pseudomonas aeruginosa PA01
ggcggugaagugcucgccaugggcgaagagcacggcacagcgggauuccucgcugcgcucguauucacccauggccagcgccagguccgcc

SEQ ID NO: 4243216 - RNA, 77 nt, Pseudomonas aeruginosa PA01
ggcggccugguagccgagguugucguacuugccggaguugacggugagcacggacucguccuuggcgccguaccacu

SEQ ID NO: 4243217 - RNA, 80 nt, Pseudomonas aeruginosa PA01
ggagcguggcgccccgcgcggacagagcgcgccgccggcgaacaacgccauggccgcgcuguucgccaacgccaagcaac

SEQ ID NO: 4243218 - RNA, 85 nt, Pseudomonas aeruginosa PA01
cgccggggguguuccucaaggacggcagcgcgcuggucaccgcccuguugcuggccgucgcccugccgcccuacgcccccuggug

SEQ ID NO: 4243219 - RNA, 56 nt, Pseudomonas aeruginosa PA01
gcgcgccagcuacgccaagcgcgucgucgcccggcagcgcugagagacuggcgcgc

SEQ ID NO: 4243220 - RNA, 63 nt, Pseudomonas aeruginosa PA01
gggcggcggcauggggcugaugcagggugccgggauucgcaucgucaccccguccagccgccu

SEQ ID NO: 4243221 - RNA, 63 nt, Pseudomonas aeruginosa PA01
acgacucuagcucauuauccuuuccggaaauaaauggauuaggguaguacgcauagcguacgu

SEQ ID NO: 4243222 - RNA, 106 nt, Pseudomonas aeruginosa PA01
gccgcguccgcuucgaggcugcgcagcgcgcugacggugaggacuccgaacaccgcgaucaucacguaggucagccagcgcugcacgguaugcagcaggucguggc

SEQ ID NO: 4243223 - RNA, 74 nt, Pseudomonas aeruginosa PA01
gccgagcauguugcugucuucgccggugcucaucggccgccccagcaccagguaggacagcgccugcuccuggc

SEQ ID NO: 4243224 - RNA, 129 nt, Pseudomonas aeruginosa PA01
gcgccaucgcguuucaggcggucgauggcuuccagcggaacguccagccggcgcagcgcgaguaugcgcgagagcugcucgaucuguuccggcugguaguagcgguagccguugucgcuaccggugcgc

SEQ ID NO: 4243225 - RNA, 82 nt, Pseudomonas aeruginosa PA01
gcgcuucaccacuccugggagagaauccguaaauccuugauuuucaagcauuuacucuucgucgucgccgggaguggugcgc

SEQ ID NO: 4243226 - RNA, 125 nt, Pseudomonas aeruginosa PA01
ugucgucgccggccagcggcacuucguugcccugggcgucguacagcuugccgucgaggaaauagucgccuucgugcagggcggcgauguccugguagcgcaggguccgcucgcuggcggcgacg

SEQ ID NO: 4243227 - RNA, 76 nt, Pseudomonas aeruginosa PA01
gcucucguacaucaggcguugcgcgauggucgcgaggaacgcccgcggcgagcggaucgacgccgggucggggagc

SEQ ID NO: 4243228 - RNA, 85 nt, Pseudomonas aeruginosa PA01
gcuggucaguuucgagaugccuucgguguaggccuugucgaacugcagcggaaugccgaaggcgaucgaggcgaggauggucagc

SEQ ID NO: 4243229 - RNA, 59 nt, Pseudomonas aeruginosa PA01
gcggcgccgcccugcugcuggcggccaagguggcacgccagagcccgguggcgauccgc

SEQ ID NO: 4243230 - RNA, 84 nt, Pseudomonas aeruginosa PA01
gucggugaggaagagcuggaagcugcgcuggucgcugggguugcgcucgcggcggaccagguuucuucccuccagcucgcggau

SEQ ID NO: 4243231 - RNA, 57 nt, Pseudomonas aeruginosa PA01
gucgcguggaauugcugguagcaaaauuaaaauugguacuacugcuucuacugcgac

SEQ ID NO: 4243232 - RNA, 73 nt, Pseudomonas aeruginosa PA01
acggcgaggaguggcaguugaucaugcgcggcaucuacggccugccgccggaccgcugccacaccuacgcggu

SEQ ID NO: 4243233 - RNA, 60 nt, Pseudomonas aeruginosa PA01
cgcauccggagugucgcuugaccgguacggaugccggucaacuaccaauucuggaaugcg

SEQ ID NO: 4243234 - RNA, 79 nt, Pseudomonas aeruginosa PA01
uggcgcugguccagcggcgggucgaacugcuucuccacccgcaggucgcgcaguugguccucgccgccgaucagcgcca

SEQ ID NO: 4243235 - RNA, 64 nt, Pseudomonas aeruginosa PA01
ugcccggcgacccgcgcggaggacgucgaacugcacgaccgccugcuccgcgauugccugggcg

SEQ ID NO: 4243236 - RNA, 127 nt, Pseudomonas aeruginosa PA01
accugcaacugcuggccgacuucgcguucggcugagcauugccugagggcacgcugcgcggugcgggacgcgcacucaggcaaugcucagccaucgagaccgcggggaaaacggucggccaccaggu

SEQ ID NO: 4243237 - RNA, 61 nt, Pseudomonas aeruginosa PA01
gaccugcaccagcaccagccggucgcgcggacccagcggcuggcuggcaagggugcggauc

SEQ ID NO: 4243238 - RNA, 118 nt, Pseudomonas aeruginosa PA01
acgagcugcaccugguaucggaaaaucccaaccugccgcuggagcaguugcucggcaagccgaugagccugucgcuggagcugcccggcggcagccggcgcuucuuucacggcaucgu

SEQ ID NO: 4243239 - RNA, 100 nt, Pseudomonas aeruginosa PA01
ggucggagcgauccgccuggcgcugauguugcugaucgccaucgucaucgccguggcgaugaagaucgucggcguacugcugaucaccucgcugcugauc

SEQ ID NO: 4243240 - RNA, 130 nt, Pseudomonas aeruginosa PA01
gcccggcucgauagcguagaugcggccgccaagcuuguccuugaagcgggcgaugucggcgaaggucuucagcccgcccucggcgacguagcucggcaccgcauagguggacugcgcgucggccaggguc

SEQ ID NO: 4243241 - RNA, 86 nt, Pseudomonas aeruginosa PA01
ggcgcgggaugucgcggccgucgagguagugauugaugucuuccagcggcacuccgaccucggccgccagcucgacguucuucgcc

SEQ ID NO: 4243242 - RNA, 99 nt, Pseudomonas aeruginosa PA01
gacggcuugccgucgauauacaccagguucggagugccgccggugaggccgacaugggccuccuuggcuucgcccggaccguugacgacgcaaccgauc

SEQ ID NO: 4243243 - RNA, 82 nt, Pseudomonas aeruginosa PA01
ccgaugggcuucuccuggcugaccaggggcgagaagcccugcagcgggcucgccggguuggucagccaggcgcugucguugg

SEQ ID NO: 4243244 - RNA, 71 nt, Pseudomonas aeruginosa PA01
gucgcgagcugcgcgaagcgcuggacgcucuccuugccgacugggcgccgcgcaucgagcgcggccgugac

SEQ ID NO: 4243245 - RNA, 79 nt, Pseudomonas aeruginosa PA01
cccgcuggacaagggcuccgcgcccuacgcggucgcgcccagugcacagggugcggucugguacggcgcggacggcggg

SEQ ID NO: 4243246 - RNA, 63 nt, Pseudomonas aeruginosa PA01
gagcgaacgucgcgggagaauaacaucauauugccauuacgcaauaucucccacgaaacgcuc

SEQ ID NO: 4243247 - RNA, 122 nt, Pseudomonas aeruginosa PA01
auugaaacacuagcugcuggugcggccgccaguuggcuuguggguauugcauuugccacggcaacagccacuccuauaggcauucugggguucgcacugguaauggcaguuaccggggcgau

SEQ ID NO: 4243248 - RNA, 67 nt, Pseudomonas aeruginosa PA01
cggcguggccggcgcgauggcguccacgguggugcugcccuggccgccgguauugccggccgggucg

SEQ ID NO: 4243249 - RNA, 82 nt, Pseudomonas aeruginosa PA01
gaacaucagcgccgggccgauggcaucgacccgcucgcgggaguccgggcggucguggccgucgacccgcucgucggugauc

SEQ ID NO: 4243250 - RNA, 64 nt, Pseudomonas aeruginosa PA01
cgccagguuggugaguacguaggccggggcgacgaaguuggccaugauguucaccgccacggug

SEQ ID NO: 4243251 - RNA, 74 nt, Pseudomonas aeruginosa PA01
gcugugacagggggugaggcuuauucaagugagaucaggccagucauaucguaagccgggccgcccugcagagc

SEQ ID NO: 4243252 - RNA, 75 nt, Pseudomonas aeruginosa PA01
gucggccgcuacggccaggucaaucucgaacgccugcuggaacugcagcccgacuugauccuggucuggcccggc

SEQ ID NO: 4243253 - RNA, 57 nt, Pseudomonas aeruginosa PA01
agcugcugugcacgugcggcgcgaagcgcugcuccacauagcgcgcgugcagcaguu

SEQ ID NO: 4243254 - RNA, 55 nt, Pseudomonas aeruginosa PA01
cgaucggcaccacgaucaucuugaucagacggaugaagaugucgccggccgguug

SEQ ID NO: 4243255 - RNA, 63 nt, Pseudomonas aeruginosa PA01
ccggccugucuucugccggacagcccuguugucccgcuguugcccggcagacagucaggccgg

SEQ ID NO: 4243256 - RNA, 96 nt, Pseudomonas aeruginosa PA01
cggaaugucgucgucgaagcugucguaguccugggccgguugcggcgccgguugcugcugcggggccggacgcgacugcugcugcggggccugcug

SEQ ID NO: 4243257 - RNA, 103 nt, Pseudomonas aeruginosa PA01
ugcaggagcgcuauccggaugccuacuacgugucgccggccaucgucgagaugccgggacagaccgaaguggugcgcacggagaccuucgcaccgauccugua

SEQ ID NO: 4243258 - RNA, 55 nt, Pseudomonas aeruginosa PA01
gaucucgaggaugcggccggagaagauguucuucuugcccuucuucucgacgguc

SEQ ID NO: 4243259 - RNA, 92 nt, Pseudomonas aeruginosa PA01
ggucgccgcgcugguguucuggcgcgugcugcccgagucgaaacacuuccggccggcaccgcugaagccggcgacccugcucaacggcuacc

SEQ ID NO: 4243260 - RNA, 55 nt, Pseudomonas aeruginosa PA01
ggcuucggcuccccagccggacgacgacgcgcgucugggacgggugcugaagacc

SEQ ID NO: 4243261 - RNA, 56 nt, Pseudomonas aeruginosa PA01
gcgcgugcauuggcuggccggcgaccagaagcugcuggcccaggacuaugccgcgc

SEQ ID NO: 4243262 - RNA, 94 nt, Pseudomonas aeruginosa PA01
cgcccggaccagguagcgaucgccugaaggcucauccggggaugagccuuuuccuugggcugagccucaggccaguuccagccagaucggggcg

SEQ ID NO: 4243263 - RNA, 82 nt, Pseudomonas aeruginosa PA01
gcugcggguucgccuggacgucaaggacuucgccacgccggugcaguucgucaacgccagcgcgcaauccgaccguaccagc

SEQ ID NO: 4243264 - RNA, 56 nt, Pseudomonas aeruginosa PA01
ggcggggcaagugaccugcccccauugccuaaugaggccagugucauugucccgcc

SEQ ID NO: 4243265 - RNA, 82 nt, Pseudomonas aeruginosa PA01
gcacucgaugggcgccaucgucucggugcugcucgccggggccuugcccgagcgcaucgagcggcuggcguugaucgauggc

SEQ ID NO: 4243266 - RNA, 67 nt, Pseudomonas aeruginosa PA01
auggcguugaccgccagcugguaggugccgaucuuguuggcgacaucgccauuggcggugaugcggu

SEQ ID NO: 4243267 - RNA, 71 nt, Pseudomonas aeruginosa PA01
gcgcgucguagcuguccagcgccaggcggaacucgagggucucgguguggcgcaggcgcaguugcgcgggc

SEQ ID NO: 4243268 - RNA, 94 nt, Pseudomonas aeruginosa PA01
cguuggacugaggcgucucugcgacgucggagacaaggcgguggcuggcugagccaaucgcccuuugcggcgugaagggcgcccggaacuagcg

SEQ ID NO: 4243269 - RNA, 73 nt, Pseudomonas aeruginosa PA01
gucgcgggugauggucgagaagcucgagcccaccggguaguugagguuggccucgaggaucaucauccccgac

SEQ ID NO: 4243270 - RNA, 85 nt, Pseudomonas aeruginosa PA01
gcggcgccggccgauguccagguggcgcugaacgagcugaucgagaucgccgauucgcuggcuggacguuuccccggcuugccgc

SEQ ID NO: 4243271 - RNA, 60 nt, Pseudomonas aeruginosa PA01
guugcucggcaugcgcaucaaggucgugagcuucgauacccaugcggaugccguggcggc

SEQ ID NO: 4243272 - RNA, 87 nt, Pseudomonas aeruginosa PA01
ccaaauucuucccgccgcuggugaccggcaucgucaucaccaccaucggccugacccugaugccggucgccgcgcgcugggcgaugg

SEQ ID NO: 4243273 - RNA, 56 nt, Pseudomonas aeruginosa PA01
uuguggaacacgucgauguuggcgcccaucaggcggccggcgucgaaguucggcag

SEQ ID NO: 4243274 - RNA, 65 nt, Pseudomonas aeruginosa PA01
cugccggccaggcggguguucagcucgaacuugccgaggguguuggcaucggccauggccggcag

SEQ ID NO: 4243275 - RNA, 83 nt, Pseudomonas aeruginosa PA01
uugccgccgaccuggacguacugcccggcagggguucucuccaucgccuucuugccggccauggccuccacgucggccagcga

SEQ ID NO: 4243276 - RNA, 69 nt, Pseudomonas aeruginosa PA01
uggugcaggucgaggugcauugcgacaccucgcucaaccugcuggcgcgcaacgaccucgaccugucca

SEQ ID NO: 4243277 - RNA, 64 nt, Pseudomonas aeruginosa PA01
gccgcgccaggcgacuccgggcgugcaaccucagggucgcaguucgaacagcgccggcagcggc

SEQ ID NO: 4243278 - RNA, 75 nt, Pseudomonas aeruginosa PA01
uguccggcggcgaacagcagaugcucgccaucggccgcgcgcugaugagcaagccaaagcuguugcuguuggacg

SEQ ID NO: 4243279 - RNA, 81 nt, Pseudomonas aeruginosa PA01
gccguggcuggaucgcagcccgguucgcucgauccgcuacaagggcuggcugagcaagcuguggcuggugaucuucgcggu

SEQ ID NO: 4243280 - RNA, 70 nt, Pseudomonas aeruginosa PA01
gcaaggucgaacaguugggcgcggaagccgucguaggcgauguacuuccagcgcucgcugcgcaccaugu

SEQ ID NO: 4243281 - RNA, 99 nt, Pseudomonas aeruginosa PA01
gauccggaguugccgcuguaccuguugcaggaaggcgaugcgcgcgcgcugucggcguaucucuccugccagcaggacaucgccggcgacggcugcguc

SEQ ID NO: 4243282 - RNA, 102 nt, Pseudomonas aeruginosa PA01
gcaccacgguguuggccagcuugccggccucgacguugaacuugcgcaccgagguggcgcaggucggggugucgacgcuggggaagauguucagcaccuugc

SEQ ID NO: 4243283 - RNA, 60 nt, Pseudomonas aeruginosa PA01
cggccccggcugagcugcggcaggccauccaggaugccugccugcgccuggccgaggccg

SEQ ID NO: 4243284 - RNA, 109 nt, Pseudomonas aeruginosa PA01
caucaccucgagguuggcgaacaugcccggcagcagcuugccguccggguucuccagggcagcgcggaccugcagguugcgggucucguugucgaccuugggguugaug

SEQ ID NO: 4243285 - RNA, 123 nt, Pseudomonas aeruginosa PA01
ccggacuugucggcgaugcgcucguacagcuucaucgcgucgcuguugcucucgugggucagccagugcacccgcgaacagccagcggcgccggccucggcguagacaugcucgaucagccgg

SEQ ID NO: 4243286 - RNA, 69 nt, Pseudomonas aeruginosa PA01
ccgaucggcaaguuccaggugcugcgccaucgucucgcggaaauggccacgcaacuggagguuucccgg

SEQ ID NO: 4243287 - RNA, 91 nt, Pseudomonas aeruginosa PA01
gcugaucaccagcgccacccuggugguggugaugcuggcgguagccuggaaacgcaaucacucguucaccgccacccucucggugaucggc

SEQ ID NO: 4243288 - RNA, 75 nt, Pseudomonas aeruginosa PA01
ggcuguagccgacccgcuugagccauucggcuuccugggcgaagucggcuugggucagcggguuggcuuccagcc

SEQ ID NO: 4243289 - RNA, 68 nt, Pseudomonas aeruginosa PA01
ggauggucucuuccaucaccgagcgcaggaucucguccuugcucuugaagugauggaagaugcugccc

SEQ ID NO: 4243290 - RNA, 70 nt, Pseudomonas aeruginosa PA01
gcgcacugccgggucgagccggggcgggcgcugaugaucggugauucgccguucgaccuggaaauggcgc

SEQ ID NO: 4243291 - RNA, 82 nt, Pseudomonas aeruginosa PA01
cauccggcccggcgucuacguggucgccgaggagcgucgccaacgccugguggagauccaugucgacgccgacacccgggug

SEQ ID NO: 4243292 - RNA, 57 nt, Pseudomonas aeruginosa PA01
ggcucgcgagcgccagggcaacgaugcauuccucgcugccuuccugcucggcgagcc

SEQ ID NO: 4243293 - RNA, 127 nt, Pseudomonas aeruginosa PA01
cgcgccgguuggcgggccgcguacuccucggugcagaacggcgucugccagaccugcaucggauggaugcgggucgguuccucgccuucggcggcgaagaucaccaugcgcccguccuccaggcgcg

SEQ ID NO: 4243294 - RNA, 67 nt, Pseudomonas aeruginosa PA01
caggccgaccaggaacgcggugaucgucugugguugcagguccaugugccgcgccugcucggcacug

SEQ ID NO: 4243295 - RNA, 65 nt, Pseudomonas aeruginosa PA01
ccagccgagcgucagcccgcuggucagccuguggaagggcgugaccaagccgcuggcgcugcugg

SEQ ID NO: 4243296 - RNA, 58 nt, Pseudomonas aeruginosa PA01
gcggucguugauguacuugaagugauccaggucgaccaucagcaggcucagcggcugc

SEQ ID NO: 4243297 - RNA, 87 nt, Pseudomonas aeruginosa PA01
uccggugguguggaacgacuaucugcuggcgcugcuggcgaccgcccuggccagcggccuggccuggaucguggcgcaccugcugga

SEQ ID NO: 4243298 - RNA, 91 nt, Pseudomonas aeruginosa PA01
aggcgaucguccugcucaagagccggccggugcugcuggugaagaacgguaucuucgacgaagcgccgcuggccggccuggagcagcgccu

SEQ ID NO: 4243299 - RNA, 77 nt, Pseudomonas aeruginosa PA01
cggcgcggucggcacgguaaucgccgggaucguccuguucggcgaauccauggcauugcugcgccuggccagcgucg

SEQ ID NO: 4243300 - RNA, 87 nt, Pseudomonas aeruginosa PA01
ugcgcggaacgaugccgguggcgaggacgaucucgucguagccgcccgcgaccaggucguccacgccgacccggcgguucaggugca

SEQ ID NO: 4243301 - RNA, 81 nt, Pseudomonas aeruginosa PA01
gcgcauuccggaggcgccggaaugggucgccgggguguucucccaucgcggcguccuggucccggugcucgaccucugcgc

SEQ ID NO: 4243302 - RNA, 57 nt, Pseudomonas aeruginosa PA01
gacauguaaugaagccucgguacugggagggcgguacgaagagguuauuuauauguc

SEQ ID NO: 4243303 - RNA, 111 nt, Pseudomonas aeruginosa PA01
gccgccaucccagggcacgccgaucaggccgaccugcagcgccgccgggucggugaacgccggcaggcgcaugaaggucgggauaccggcgaagcggggaaucucggcggc

SEQ ID NO: 4243304 - RNA, 70 nt, Pseudomonas aeruginosa PA01
ggucguucccuggccuuccagcgugccgccuugcuggcgcagggcggcuugcaggaaggcuucggcgauc

SEQ ID NO: 4243305 - RNA, 98 nt, Pseudomonas aeruginosa PA01
gccgcuguggcgccggcaggcgggguccgaggagguguugcuggcgcuuugcgaagaagcccagcgcagccucgaccucgaacaggggccgcugcugc

SEQ ID NO: 4243306 - RNA, 85 nt, Pseudomonas aeruginosa PA01
cgguggcgauccucaccgcggcgaugcgcuucgccggccagggcggccaggccggcaccgaugucaccgcggugcagagcacccg

SEQ ID NO: 4243307 - RNA, 98 nt, Pseudomonas aeruginosa PA01
uccggcguccuggcccugcaaccccugguaguggugcuggaugccgccgcgcuggccuccggccaaccgcugccggaggcacaggaacaggcgcugga

SEQ ID NO: 4243308 - RNA, 71 nt, Pseudomonas aeruginosa PA01
uuguggcuguugcucgguguggcauugcugggcacgcccucaacgcgcgcaaccgacggcaggguuugcaa

SEQ ID NO: 4243309 - RNA, 62 nt, Pseudomonas aeruginosa PA01
ccgcgaugccuuccagcaggcuggcguagauguucgccagggcuugcccguaggugucgugg

SEQ ID NO: 4243310 - RNA, 95 nt, Pseudomonas aeruginosa PA01
gccggaacggcuugcugacauagucgucggcgccgcuguucaacgccugcacgauguccuguucggcgucacggcuggucagcaugaucgccggc

SEQ ID NO: 4243311 - RNA, 70 nt, Pseudomonas aeruginosa PA01
gcugcacggcuuccugggucugcggcaugacgccgucgucggccgcgaccaccaggaucacgaugucggu

SEQ ID NO: 4243312 - RNA, 56 nt, Pseudomonas aeruginosa PA01
uugcccguucggcgacggcaggucggaaaucagcuugucggggccgcacgcggcga

SEQ ID NO: 4243313 - RNA, 88 nt, Pseudomonas aeruginosa PA01
agcacucgcugauggugguggagcacgacauggguuucgucggcagcaucgccgaccaugucaccgugcugcaccagggccacgugcu

SEQ ID NO: 4243314 - RNA, 82 nt, Pseudomonas aeruginosa PA01
gcagcacgcgcuaccuaaccugaccgggccugaacaauaacaacggaggccccggccaugucccuggguagcgauuacuugc

SEQ ID NO: 4243315 - RNA, 75 nt, Pseudomonas aeruginosa PA01
gcgggggcgaagcgcgcgagaaagcggucgguggccgagggcgcgguaccggcgaguuccgcgcguuccuugcgc

SEQ ID NO: 4243316 - RNA, 63 nt, Pseudomonas aeruginosa PA01
ucgcggugaucgaccaggggcggcugguggccauugguagccaugcccggcugaucgccgaga

SEQ ID NO: 4243317 - RNA, 130 nt, Pseudomonas aeruginosa PA01
gcuguugcgagucgaggaucaacgcacggacguccaguuucggggucggguaguggcuguccagagcgauccaguucucgacccguucguacgcuacccccuggucgcuggcgaugaauucggcgacggc

SEQ ID NO: 4243318 - RNA, 64 nt, Pseudomonas aeruginosa PA01
ggccgagcgcgaguuccaggcacuggucgacgccaucgccacgcuuccuccucgcugccaggcc

SEQ ID NO: 4243319 - RNA, 63 nt, Pseudomonas aeruginosa PA01
ggagccguugcagugguagcacucgcgguuguucucgaucaccagcuuccaguuggcggcuuc

SEQ ID NO: 4243320 - RNA, 76 nt, Pseudomonas aeruginosa PA01
ucgcccauuucgugcagguaguccuccagguccucgcggaucgaggcacgcugcagggagucguuguagaggguga

SEQ ID NO: 4243321 - RNA, 88 nt, Pseudomonas aeruginosa PA01
gcuggugguguccggugggcgcaguccgguggccuuccucgaagccuugagcgaggagccgcuggacuggucgcggaucacagucagc

SEQ ID NO: 4243322 - RNA, 72 nt, Pseudomonas aeruginosa PA01
ugagccgccagggcgugccgcugaacgcgcugcugcugucgagcgucgguaucgcccuggcgacccugcuca

SEQ ID NO: 4243323 - RNA, 79 nt, Pseudomonas aeruginosa PA01
gcagggccggcggcgacucgccgguuuccugggcgucgaugaacucgccgagccagccggccaguugcuccggcucggc

SEQ ID NO: 4243324 - RNA, 79 nt, Pseudomonas aeruginosa PA01
gcgcgggucaggguccgcgggcugacgcccaggcgacgcgcggcaucgcccaggcuccagucggcggccggcucggcgc

SEQ ID NO: 4243325 - RNA, 70 nt, Pseudomonas aeruginosa PA01
cucaugaggaugucuccuugguagaacguucagccugaaacuacgcugcggagacugucaggcucaugag

SEQ ID NO: 4243326 - RNA, 109 nt, Pseudomonas aeruginosa PA01
cuugccaucaggacggguaacggucugcgccgccaggucgauggacaacugguagccuucguucgccucgaccuggcggaacaguucguccaccucggccucgggcagg

SEQ ID NO: 4243327 - RNA, 88 nt, Pseudomonas aeruginosa PA01
gcuggcgucgacauugccgacaaucaccgccagggucgggcggauacgcccggcggcgaucagguugucgaggauggucggggucggu

SEQ ID NO: 4243328 - RNA, 75 nt, Pseudomonas aeruginosa PA01
gcaggccggcuucgcgcagguauucggugaccaccuuggagccgggugccagcgaggucuucacccauggcuugc

SEQ ID NO: 4243329 - RNA, 63 nt, Pseudomonas aeruginosa PA01
auugggacugcuccugccccuggccgccggcagcgccguggccgcggaggagggcagcucggu

SEQ ID NO: 4243330 - RNA, 79 nt, Pseudomonas aeruginosa PA01
cgcucgaucggccugggccuggaagacguagcccuggccaacgcccucuaccgccugcgccaggcaggcugaucgcgug

SEQ ID NO: 4243331 - RNA, 107 nt, Pseudomonas aeruginosa PA01
gcucguccgccucguuguggccgcggcgacgguagcagaccaggucgaugaccacgucacgcuugaacugcaugcgguagucgacggccaguugggugacgaacagc

SEQ ID NO: 4243332 - RNA, 127 nt, Pseudomonas aeruginosa PA01
ugaucgaauacuucuccagcuucaugacccugcagccgggcgacaugaucgccaccggcaccccggaaggccuguccgacgugguccccggcgacgaaguggugguggagguggagggcgucggucg

SEQ ID NO: 4243333 - RNA, 77 nt, Pseudomonas aeruginosa PA01
gccgagguuuccaccggcaggcguucgcgcagcgccaccgccaugucgacgaacaacugcugguaggcggccugggu

SEQ ID NO: 4243334 - RNA, 57 nt, Pseudomonas aeruginosa PA01
acuccaagggcgugaugauccuuaccggcuaccuggguagccgcuacgcccaggagu

SEQ ID NO: 4243335 - RNA, 119 nt, Pseudomonas aeruginosa PA01
ggaggaugcggccuucccagaugcccucgcagaggaucggcagcgggucgucggcguggcgcaccagcgccagcacgcugacgaacugugcgccgcgcucggcguccgggacauccuuc

SEQ ID NO: 4243336 - RNA, 56 nt, Pseudomonas aeruginosa PA01
gguggcaguuacccuggugcugacgcauaucaccaucgucagcgugaccgucuacc

SEQ ID NO: 4243337 - RNA, 82 nt, Pseudomonas aeruginosa PA01
ggccgggucgaaggaggcgucgcgcaggucgagcagggucgccuuggccuugucggucaggcuggcgucgucuucgaccucc

SEQ ID NO: 4243338 - RNA, 93 nt, Pseudomonas aeruginosa PA01
aggccgugccgagcacguuggccaggucgccggcggcaccgaccccggugccgaucgccaccgccuggccaaggauguuccaggcgcuggccu

SEQ ID NO: 4243339 - RNA, 58 nt, Pseudomonas aeruginosa PA01
uugccguacuucagggugacgucgaaaccgaacggcggguugaccccgaggucggcga

SEQ ID NO: 4243340 - RNA, 68 nt, Pseudomonas aeruginosa PA01
ggcuucuagacuuuucuugucgaugcguggcugucgccacgcucauuccaggagagucccagcaugcc

SEQ ID NO: 4243341 - RNA, 62 nt, Pseudomonas aeruginosa PA01
gccguggcccaucuucagggucuuggcgccagaggccagggccagcaacugauggccgaggc

SEQ ID NO: 4243342 - RNA, 130 nt, Pseudomonas aeruginosa PA01
gccagcugugacugcgcagugguugcgguugcaggcucuggaugcugugcgccuguagcaguccgccgcccaggcgcacgccaacuucggugcccggcgcgccgcgcagaucgaugcgcaggcggcuggc

SEQ ID NO: 4243343 - RNA, 67 nt, Pseudomonas aeruginosa PA01
gccgucggugaucacggugcaggugcucggguucggcaacgagcgccuggagccuucgcgcgacggc

SEQ ID NO: 4243344 - RNA, 63 nt, Pseudomonas aeruginosa PA01
cugcugggccucccggcgcagacgacgcgccucuucuugcagguagcggcgccgggccagcag

SEQ ID NO: 4243345 - RNA, 128 nt, Pseudomonas aeruginosa PA01
gauucuccgccggcgaccgccaauccagggugcccagugacaggcgcuggcgucgcgcccguugguucgcugccggcagcgccucgccacgcuccagcgcucgggccucgugaucgcuggcgaggauc

SEQ ID NO: 4243346 - RNA, 125 nt, Pseudomonas aeruginosa PA01
ggucgacugccauggcucgcagugcggguucugcacgccggguuucgucaugucgcuguucgcccugcagaagaacagcgccggcgccgauccggccaaggcccacgaggcgcucgccggcaacc

SEQ ID NO: 4243347 - RNA, 128 nt, Pseudomonas aeruginosa PA01
uggguacguccaggucuucgaagucgcugaagaucuuguuggcuucgagguugcccgccaucaguuccucgucgggcagcuggaaguugucaacgaacucggugaugucggcaccaacgaugaacacg

SEQ ID NO: 4243348 - RNA, 62 nt, Pseudomonas aeruginosa PA01
gccgaagcugguggcgcggcugcaggaguugccgcagcucgccgacgucgccagcgacuggc

SEQ ID NO: 4243349 - RNA, 75 nt, Pseudomonas aeruginosa PA01
cugcucgggcaggcggucgguguaggugcucuugagcuugcucauggagcgguacugcaugaucaccuugggcag

SEQ ID NO: 4243350 - RNA, 72 nt, Pseudomonas aeruginosa PA01
uggggcugaccucgcuguucggcagcggcaugaccaccaacaacccgaucggcggcggcgaccucagccuca

SEQ ID NO: 4243351 - RNA, 64 nt, Pseudomonas aeruginosa PA01
ucgacgaaggcccgggcgcuccggaacgagcggccgcgccggaagcguucgggcucuucgacga

SEQ ID NO: 4243352 - RNA, 71 nt, Pseudomonas aeruginosa PA01
guucuccuuggaacuauggguauugauuuagccacgaaaucguagccgguaacugaguugcaaggaguuac

SEQ ID NO: 4243353 - RNA, 57 nt, Pseudomonas aeruginosa PA01
guggccgaggugaucgcuuccggcgaccucaccagccgcaucgacaccucuggccgc

SEQ ID NO: 4243354 - RNA, 79 nt, Pseudomonas aeruginosa PA01
gcgcagccgcucgaccgucuccagcaacggcaccccggggucgggacggccgcugcgaugggcgucgagcaggcgcugc

SEQ ID NO: 4243355 - RNA, 70 nt, Pseudomonas aeruginosa PA01
gcgguggccuggaggguuuccuugaucgccggcaccagugcggugcggaugaaauuguccggguugcggu

SEQ ID NO: 4243356 - RNA, 86 nt, Pseudomonas aeruginosa PA01
ggauuggccgugguuuuuuuacuguuggcggccgucggagcacgcggaaagagaaccgucagcggccgaaaaacagcggacuuucc

SEQ ID NO: 4243357 - RNA, 55 nt, Pseudomonas aeruginosa PA01
ggcgaagcgaucgaaaggcgacuccugcacgguguaguccucgaucuucuucucc

SEQ ID NO: 4243358 - RNA, 99 nt, Pseudomonas aeruginosa PA01
ggccgaacgcggugucuuucuucagcucguacagccgcaggcgcagcggcgccgccuggccggcggcggacggguugagguucggugcggcguggagcc

SEQ ID NO: 4243359 - RNA, 107 nt, Pseudomonas aeruginosa PA01
gcgcugucggcggcacggaccaguccuucggcaucgccggcaugccgcggguagagagcgaugccgaugcucggggugacgaagucgaugcguucgccauucagcgc

SEQ ID NO: 4243360 - RNA, 61 nt, Pseudomonas aeruginosa PA01
gcgcgagcgcggcugcuccauccagguaugcccgccgaggaugcugucgacccgcucgcgc

SEQ ID NO: 4243361 - RNA, 71 nt, Pseudomonas aeruginosa PA01
gcggggcuggagcgagucgaugcgguggugcuggcaaccagcaccggcgacuucugcugcccggccaccgc

SEQ ID NO: 4243362 - RNA, 84 nt, Pseudomonas aeruginosa PA01
ccgccauggucgaggaccaggcguacguauagcagggcgauggugaacgucuugccgguaccggcgcuggccucgaucaggcgg

SEQ ID NO: 4243363 - RNA, 73 nt, Pseudomonas aeruginosa PA01
ggcgaccuacggggucaagguggugcaggucggcaucgagcgccugacccugcccaaggugacccucggcgcc

SEQ ID NO: 4243364 - RNA, 67 nt, Pseudomonas aeruginosa PA01
ucgaggccgccgccaucgcgguugcgcaguucgacgcugccgccgugcugggcggcgaugcgcuuga

SEQ ID NO: 4243365 - RNA, 69 nt, Pseudomonas aeruginosa PA01
guuucggucgcaguagaagcaguaguaccaauuuuaauuuugcuaccagcaauuccacgcgacagcgac

SEQ ID NO: 4243366 - RNA, 73 nt, Pseudomonas aeruginosa PA01
ggcgucgucgcgcaguugcggauuaccguaggugaccagcaucagcgggaugugcaggugcucggcgaucgcc

SEQ ID NO: 4243367 - RNA, 78 nt, Pseudomonas aeruginosa PA01
gaaggcgugcaguuggcccgccgcgccgucgccgaccaguugcgcgcgcuggacggcggcgagccgcugcgccacuuc

SEQ ID NO: 4243368 - RNA, 67 nt, Pseudomonas aeruginosa PA01
cggcaagggcggcaacaccuucgccuacggcggacgcaugcuaccgguguucgaccgucccucgccg

SEQ ID NO: 4243369 - RNA, 73 nt, Pseudomonas aeruginosa PA01
ggcagcgccggcgacgugcugcgccuucuggagguccuucgccagggcggcgcgccguugcugacgccuggcc

SEQ ID NO: 4243370 - RNA, 55 nt, Pseudomonas aeruginosa PA01
gguuuuuccuggggagguuguuggaguaaucggcugcaacggcuccgggaagucc

SEQ ID NO: 4243371 - RNA, 77 nt, Pseudomonas aeruginosa PA01
aagcgcgaagcuggaagcccgacgccgauacccgccucgugugcggguaucgacgccagacuuccagcuccuugcuu

SEQ ID NO: 4243372 - RNA, 57 nt, Pseudomonas aeruginosa PA01
gcggaucaccgcgauguugcagaucgaccuggaggcgcugcagcagaacgguggcgc

SEQ ID NO: 4243373 - RNA, 105 nt, Pseudomonas aeruginosa PA01
ggucgcgcgcgcuccaggccagcggcgcggagccgcccggcggcguccaggcgcauuguuucgcccggcuccugcgcuugaccgccagguagcgauugagcgauu

SEQ ID NO: 4243374 - RNA, 91 nt, Pseudomonas aeruginosa PA01
cucgcgcugcucgcuggagaucaggucgaucuugcugaccaggaucacgucggcgaauucgaccuggucgaucagcaggucggugaucgag

SEQ ID NO: 4243375 - RNA, 115 nt, Pseudomonas aeruginosa PA01
cggcgaucugccgcagcaguucgcgcaccggcgggcgcgagaggccgaacucgucgcacagggcgaguucgucgacgaccgcgccgggcgccaguuccaugcucaggauccgccg

SEQ ID NO: 4243376 - RNA, 68 nt, Pseudomonas aeruginosa PA01
cgggccggcccagaugcauucgcgcuugaucaccgggucgagaccgaacuugcucuggcuuggcuccg

SEQ ID NO: 4243377 - RNA, 82 nt, Pseudomonas aeruginosa PA01
auccgcgccaguucgucgacgcuccagccgagcuugcgcaggucguagcgguggucggcgauguugucggcgguggucggau

SEQ ID NO: 4243378 - RNA, 78 nt, Pseudomonas aeruginosa PA01
gcuugaggauuuccugguuguagcgagcgcccaugccgaguuccugcugcucgcucaucaucacgaaaucgcucuugc

SEQ ID NO: 4243379 - RNA, 58 nt, Pseudomonas aeruginosa PA01
ggcuggcgauugcuguuaccaugcgcgaaccgccuuaugugaccagcauucgccugcc

SEQ ID NO: 4243380 - RNA, 59 nt, Pseudomonas aeruginosa PA01
uucgcgccagccuucggcgcuggugccgaagucgguacgcaggucguagguggugcgga

SEQ ID NO: 4243381 - RNA, 81 nt, Pseudomonas aeruginosa PA01
gaggcgcgccccucgaaguucggcccgaugaccgagaccuggggcaugugggagaacuuccugauccugcgcgaccaccuc

SEQ ID NO: 4243382 - RNA, 68 nt, Pseudomonas aeruginosa PA01
guugcagcaggcggaucgagucgaagaucuuguaggcgaucagcggcuccaucacguucaguugcaac

SEQ ID NO: 4243383 - RNA, 75 nt, Pseudomonas aeruginosa PA01
gggaucgggcagccccaguagcgcuggcggcugaugccccagucgcgcaggcggaacugggugcgcgccuggccc

SEQ ID NO: 4243384 - RNA, 65 nt, Pseudomonas aeruginosa PA01
uugagcagggcgcgaucguacagguggaggacgaacaccgggguguccggcgcggccuuguucaa

SEQ ID NO: 4243385 - RNA, 55 nt, Pseudomonas aeruginosa PA01
gaucagcagcgacuggcagaccuguccgcgcagggcgggcuguucgccguugauc

SEQ ID NO: 4243386 - RNA, 75 nt, Pseudomonas aeruginosa PA01
ucgugcccaacgucuggucgcugcacauccgcgaugcgcagucgccgaugugcuucaccaacggcaagggcgcga

SEQ ID NO: 4243387 - RNA, 79 nt, Pseudomonas aeruginosa PA01
agggucacgcccucgggcaguucguaggugcuccagaggcucaacgagcgcggcgggguauugcccagggccugucccu

SEQ ID NO: 4243388 - RNA, 55 nt, Pseudomonas aeruginosa PA01
gaucaacgggcagaagguguggaucucgcggauccagcacuccgaccugaugauc

SEQ ID NO: 4243389 - RNA, 63 nt, Pseudomonas aeruginosa PA01
cuggggaccgucuugcuggcggguuguucgacaucgacgcccucgcucgacgagacggaccag

SEQ ID NO: 4243390 - RNA, 80 nt, Pseudomonas aeruginosa PA01
gcgcaccacucccggcgacgacgaagaguaaaugcuugaaaaucaaggauuuacggauucucucccaggaguggugaagc

SEQ ID NO: 4243391 - RNA, 63 nt, Pseudomonas aeruginosa PA01
ggcugccgggccggcaagagacgcccgccggccucaggcucguccuucgcggucgcgguagcc

SEQ ID NO: 4243392 - RNA, 67 nt, Pseudomonas aeruginosa PA01
cagccucggcagcuucaccggcgccuggcucgggcuggccacgguggcggcgcugcugcugggacug

SEQ ID NO: 4243393 - RNA, 65 nt, Pseudomonas aeruginosa PA01
gcggaucgcccugcgccuggacgccgaaggccgccugccggcgcaggcccgcagcggcuaugcgc

SEQ ID NO: 4243394 - RNA, 65 nt, Pseudomonas aeruginosa PA01
cgacgaugcuggccggguugaaguccuucaucgaguugaucugcagccccaccgccagcucgucg

SEQ ID NO: 4243395 - RNA, 62 nt, Pseudomonas aeruginosa PA01
gcauugucgcggcagcccuuggcgacguucaccaggcucaguugggcguugccggaccaugc

SEQ ID NO: 4243396 - RNA, 62 nt, Pseudomonas aeruginosa PA01
gagugccucgcgcugaaaaggaguuuuuccuggaagauagggguuuuucagcucgauuauuc

SEQ ID NO: 4243397 - RNA, 71 nt, Pseudomonas aeruginosa PA01
ggcgcccgccuaucgagccggcaagccuccgccaacgccaagccuugccgaagcgaugggccaccagcgcu

SEQ ID NO: 4243398 - RNA, 89 nt, Pseudomonas aeruginosa PA01
gucgcugagcaccucgcugaccagcuugcuguuggucgccugguucggcgccaugccgaagcgcugguucagggaggcgccguagcgac

SEQ ID NO: 4243399 - RNA, 102 nt, Pseudomonas aeruginosa PA01
ccacgggaucaccguacugcugaucgagcaugacaugggcauggugaugaacaucuccgaccacaucaucgugcucgaccacggcgacgugaucgcccgugg

SEQ ID NO: 4243400 - RNA, 74 nt, Pseudomonas aeruginosa PA01
gcgugggaucuucuucgccagcguggcgccggcgcugcuggugcuggcccuggcgaugcgcuggcugcccaggc

SEQ ID NO: 4243401 - RNA, 80 nt, Pseudomonas aeruginosa PA01
uugacugguaccggacuuguguuuuuacugucgaaauggucguuuuaccaagggaagcgcaaugcaagcguacgagucgg

SEQ ID NO: 4243402 - RNA, 81 nt, Pseudomonas aeruginosa PA01
ggccgguucgaagcgcgccagcagguggcggauggcggccugcacgccggccaucaccgccagcuggugcgccuugagguc

SEQ ID NO: 4243403 - RNA, 69 nt, Pseudomonas aeruginosa PA01
ggcucuuuuuucagggucgaucacggaagcggcggauuauccgccgccaccgccgauugauccagagcc

SEQ ID NO: 4243404 - RNA, 69 nt, Pseudomonas aeruginosa PA01
ccugagcguuucgugggagauauugcguaauggcaauaugauguuauucucccgcgacguucgcuccgg

SEQ ID NO: 4243405 - RNA, 56 nt, Pseudomonas aeruginosa PA01
gccggagagauccgcaaccugcgcauuacccucggugcgggcgggcucuaccuggc

SEQ ID NO: 4243406 - RNA, 76 nt, Pseudomonas aeruginosa PA01
cugcgcgagcagggcgugcgcccggcgaauuucuacuacgaaaaguucgcugccagcgcggccugaacccgagcag

SEQ ID NO: 4243407 - RNA, 57 nt, Pseudomonas aeruginosa PA01
cgacaaagacgucgcgcggccucuccuucccggcagaggcccguggcgucuucgucg

SEQ ID NO: 4243408 - RNA, 76 nt, Pseudomonas aeruginosa PA01
guacucggcgaacagcucgucgcggaaggucgggcccuuggcgucgaagaccaccgcgaacgggcuguccggguac

SEQ ID NO: 4243409 - RNA, 105 nt, Pseudomonas aeruginosa PA01
cagcuuucgucgugguuauagccgcugguggugcagcccaggcaacggacgaaggcuuccuugcccggaucgaccaccagcgccuggccggccuugccgacgcug

SEQ ID NO: 4243410 - RNA, 93 nt, Pseudomonas aeruginosa PA01
ggggcgucagcgcugggcagcaucuguuguacgucgcucgccggguguuccugcgggcggccgaacagauagccuugcaccaggucgaccccc

SEQ ID NO: 4243411 - RNA, 130 nt, Pseudomonas aeruginosa PA01
ggucgccugagagcgggcgugagccuggugauugcgucuacaauggcgauuucguuucugacaggaguucgcccauggaggcucucgacgccuugcucacucgcguuucccacgcccgccugagcgaucc

SEQ ID NO: 4243412 - RNA, 71 nt, Pseudomonas aeruginosa PA01
gccggcagggucucgagcacaccgccgaucgcauggcgcaaugcggcguucugcucgggauccucgcuggu

SEQ ID NO: 4243413 - RNA, 76 nt, Pseudomonas aeruginosa PA01
gccgagccaggcgcugggcgucugguucggcgccccccuggcguugagccgagcgcucagcgccgaccugcucggc

SEQ ID NO: 4243414 - RNA, 85 nt, Pseudomonas aeruginosa PA01
ugccaggccaagucgccggucaagaccaugcaucacgugcgcuugcuggagcauggucgguugaucgugcuggacauccgcggua

SEQ ID NO: 4243415 - RNA, 109 nt, Pseudomonas aeruginosa PA01
ggcgauccucgucgagguccucgaacuggccuggcggcaguuggugcagcgucacggccggccguugcgcgccgacggcacgccgugcgauccggacuucgucaucguc

SEQ ID NO: 4243416 - RNA, 56 nt, Pseudomonas aeruginosa PA01
gcgcgacgcuguugcuggcgggcguggcgaucuucggcagcggcaaggcgucgcgc

SEQ ID NO: 4243417 - RNA, 81 nt, Pseudomonas aeruginosa PA01
gcgggaguuggacggaacaguucgguggccccggcaacuguuccgcccggcuguagcggaacuguuccgguggcucuacgc

SEQ ID NO: 4243418 - RNA, 122 nt, Pseudomonas aeruginosa PA01
ggcgcucgaccuggccgauccgcaggcgccgcugggcguggaaaaacccagcgacuucaccuggaaccaguugcucggguucgacgccugcgugcagugcggcaagugcgaggcgaugugcc

SEQ ID NO: 4243419 - RNA, 94 nt, Pseudomonas aeruginosa PA01
gggcuacaccgagcuguaccgcgccucgcccaacgcgcgcaacaucgccgaauugcugcuguugcgcgaggacgugccacguucgcugcugucc

SEQ ID NO: 4243420 - RNA, 91 nt, Pseudomonas aeruginosa PA01
aucggagcgauaacgcgaagccggaagugggguacgcuugaugcguucgaaccccgcuuccggcuuuuaguauccagcuuaugacuuugau

SEQ ID NO: 4243421 - RNA, 64 nt, Pseudomonas aeruginosa PA01
gauuccccgcugaguccaccagaaccccggcccaggccgggguuuuucguuuucgcggguuguc

SEQ ID NO: 4243422 - RNA, 82 nt, Pseudomonas aeruginosa PA01
ccuguucaagugguggcugauuugaucgaugucagucgcugcacgucggacggcaugauuucggcagacagccucuugcagg

SEQ ID NO: 4243423 - RNA, 67 nt, Pseudomonas aeruginosa PA01
cgccgcgccuucgucgccggugaagcggcgcggacgcagauccuccgccggcggcagggcgcuggcg

SEQ ID NO: 4243424 - RNA, 111 nt, Pseudomonas aeruginosa PA01
guccgccgggccguggaucggcuucuugccguuggugaaguugaggaagccgccuuccucgaccaccgccagcagcucggugccggugcgcucgcggaaggccucgcgggc

SEQ ID NO: 4243425 - RNA, 58 nt, Pseudomonas aeruginosa PA01
cagcgccuugcgcgcgcgucugcuggguucgccgcgggagggcgccagcgaggugccg

SEQ ID NO: 4243426 - RNA, 66 nt, Pseudomonas aeruginosa PA01
ugguccaugugcuggcccgcgaggcgccggaacugcgcgccuccucgccgcacauccugcgggcca

SEQ ID NO: 4243427 - RNA, 61 nt, Pseudomonas aeruginosa PA01
gaugaacaccgaguccuggcccagggcguugcccaaugccgccagcaggccggugaccauc

SEQ ID NO: 4243428 - RNA, 64 nt, Pseudomonas aeruginosa PA01
caugggccacuccuacgacggcaucgaggaguacgacaacccgcugccgaaguggugguucaug

SEQ ID NO: 4243429 - RNA, 68 nt, Pseudomonas aeruginosa PA01
gcgcccgguguaggccagcucgcgcaucaugccaucgccgaugauccgcggcaggcgcugcagggugc

SEQ ID NO: 4243430 - RNA, 100 nt, Pseudomonas aeruginosa PA01
gcgcaccggccgcgcgcagcaccgggaucuucgcauugcguaccacccgcuccaggguggugccgaugaacaggucgcgcagcggcgugugccggugcgc

SEQ ID NO: 4243431 - RNA, 121 nt, Pseudomonas aeruginosa PA01
agcagcgccagcacggcggcgccgacgaucagcagggaguuuguccgcaggcuguggagcauggccugcugcugcgccucccagcuacggucgacacgcgccaucaccugcccggcgcgcu

SEQ ID NO: 4243432 - RNA, 64 nt, Pseudomonas aeruginosa PA01
ucgucgacguugacgcccagcuugccggcauagucgggaucgagcgcgugcucggcgucgacga

SEQ ID NO: 4243433 - RNA, 62 nt, Pseudomonas aeruginosa PA01
cgagucgguggucggcgagauccagaagcaacucggcaucggucucggccagacuaccgccg

SEQ ID NO: 4243434 - RNA, 93 nt, Pseudomonas aeruginosa PA01
gcuguuggccggggcgaugcgguucugcuggucggacucggcacaggccuggucggcgaccuggcggaccucggcgucgcucaggguagcggc

SEQ ID NO: 4243435 - RNA, 113 nt, Pseudomonas aeruginosa PA01
ggggcugccggcaaaucgaacugcugcaucggccgcuggaggagucgccacccuacgacgggguguuuuccgggccggcggccgcgcccucucggcucgaucgccgcagccuc

SEQ ID NO: 4243436 - RNA, 73 nt, Pseudomonas aeruginosa PA01
ucgacgacguccggcuuguacugguggugguagcgcggcgcggcgacccauuggccgaccgggcgaccgucga

SEQ ID NO: 4243437 - RNA, 65 nt, Pseudomonas aeruginosa PA01
gcaccuggaacaggucaacggugcgcucgacaagcacgagcgccuggucggccugguucuggugc

SEQ ID NO: 4243438 - RNA, 116 nt, Pseudomonas aeruginosa PA01
uucuucagcggcaggccgcuccagucgcggacuaccugggugccgagccgggcgaaccaguccucgauuucccggcucugcucggcgugggccgcgagcggccgcgagcuggagaa

SEQ ID NO: 4243439 - RNA, 55 nt, Pseudomonas aeruginosa PA01
gccuggagguccaggcgcuggccgagguguucgagccgcacgcugcccuccaggc

SEQ ID NO: 4243440 - RNA, 85 nt, Pseudomonas aeruginosa PA01
ucggcggacgugggauuguccugggaugccgcggcgcgcgccuggaucugccggcgcaacggccaccagggcgagcguucgucga

SEQ ID NO: 4243441 - RNA, 58 nt, Pseudomonas aeruginosa PA01
gcgucgaugauggcgucggacagcggcgugucgaugcugccggcggcgucguugucgu

SEQ ID NO: 4243442 - RNA, 74 nt, Pseudomonas aeruginosa PA01
gccggcgaagggcgggaacugcgcgcgcagcgggugggccucgaacuggcgcagcaguuccucgccgagcuggc

SEQ ID NO: 4243443 - RNA, 74 nt, Pseudomonas aeruginosa PA01
ccgggguggugcugaucagccugcgccggcagcgcccggacggcacccgccgcuggcuggucggcgcgcucugg

SEQ ID NO: 4243444 - RNA, 61 nt, Pseudomonas aeruginosa PA01
cggggagccucgucgacgaggcccgccaugggccaagguuuguugucgggaggcucucccg

SEQ ID NO: 4243445 - RNA, 100 nt, Pseudomonas aeruginosa PA01
acuaccggcgcgcggauacgcccgaccugaagcaccgggcugcgcaccagguagcgacggcgcuggcgcugcgggucgccgaucagccagucgagguagu

SEQ ID NO: 4243446 - RNA, 100 nt, Pseudomonas aeruginosa PA01
acgucgccgcuggaguccucggugccaccgccggugcgagcgaugccgaucgaggcgcgcugcgccaggcgcuggcacuggugcggcagcagcggcgcgu

SEQ ID NO: 4243447 - RNA, 105 nt, Pseudomonas aeruginosa PA01
gugccgcgcggcguccagcgugcgauccaguucggcgcgcagcgaguaagucugccacagcucguugugcagguucggcugggccaguugcugggccuggcgcac

SEQ ID NO: 4243448 - RNA, 56 nt, Pseudomonas aeruginosa PA01
gucggcgauggccgccagggcgcgcuccagguugugcgcggugucgccaucgcgac

SEQ ID NO: 4243449 - RNA, 58 nt, Pseudomonas aeruginosa PA01
gaaggcggcgaaggcggcaucgacgaaacgguacggcagguguucgucgcgccccuuc

SEQ ID NO: 4243450 - RNA, 64 nt, Pseudomonas aeruginosa PA01
cgcauuaucuggaacucgcggaacagccgauuucaaaggaugucuuugcgggugaggaugugcg

SEQ ID NO: 4243451 - RNA, 58 nt, Pseudomonas aeruginosa PA01
ucgucgucguccaccguguaguagccgucgagcaggcgcugcauggcgcggccgacga

SEQ ID NO: 4243452 - RNA, 79 nt, Pseudomonas aeruginosa PA01
acgaacaccaggugcucggcccaguggaucugccgcugcgcuuccagcaggucggguucgagcaccuggcucuguucgu

SEQ ID NO: 4243453 - RNA, 100 nt, Pseudomonas aeruginosa PA01
gcucgccuggcgcuaucgaggcuccgagcuggaguugcggauuggcaccgacagugucgacccgcgucucuaugugaggcguuucauggagucggggagu

SEQ ID NO: 4243454 - RNA, 66 nt, Pseudomonas aeruginosa PA01
gaggaugucguugaucaccagguugggaaagaugaacaggcuuuuguuggugugggcgauguccuc

SEQ ID NO: 4243455 - RNA, 65 nt, Pseudomonas aeruginosa PA01
cugacgccgcuggcgaucaccggguucuccagcaacuggucgccgaucuucagcaggcuguccag

SEQ ID NO: 4243456 - RNA, 55 nt, Pseudomonas aeruginosa PA01
ugcugguccuggacgaggagcgcgcguugcucgaccaguucguccagcgccagca

SEQ ID NO: 4243457 - RNA, 79 nt, Pseudomonas aeruginosa PA01
ggcggcgguacucaccgacgaggccgaugcggccgaaccgggcgcggaucgccggaucgucgccuucgucaccgccgcc

SEQ ID NO: 4243458 - RNA, 55 nt, Pseudomonas aeruginosa PA01
agcagcgcgucgcgcuggcucgcgcgcugauccacgagccgcgccugcuguugcu

SEQ ID NO: 4243459 - RNA, 94 nt, Pseudomonas aeruginosa PA01
ggccaaggccagccccgcgcgcuccggcgauuuccucgccggcgucgcggcgagcaacgacggcgagcgggucgccgcgcagauggcccuggcc

SEQ ID NO: 4243460 - RNA, 62 nt, Pseudomonas aeruginosa PA01
gggcgauccgcucgcugcgccacaggcaacgcggcgccagucccgcagcggcgagaucggcc

SEQ ID NO: 4243461 - RNA, 58 nt, Pseudomonas aeruginosa PA01
gccuugccgaucagcgacgagcugggcuucguccucggcgcgcuggugaucggcuggc

SEQ ID NO: 4243462 - RNA, 59 nt, Pseudomonas aeruginosa PA01
cuaucucgagggcggugccgugcugcguccgcagggccagccggacguccucgaccugg

SEQ ID NO: 4243463 - RNA, 70 nt, Pseudomonas aeruginosa PA01
gcgggcguuggccgaacgccucgggguggagaccuggugcgaggucgaggcguugcccgacgauguccgc

SEQ ID NO: 4243464 - RNA, 62 nt, Pseudomonas aeruginosa PA01
cgacgauacgccccuuggaguuguucgccucaucggccgccagcuucaggccgcguucggcg

SEQ ID NO: 4243465 - RNA, 56 nt, Pseudomonas aeruginosa PA01
cuuacggucgaucucgauggccgccuuuuucaggccagcgaucagacggcuguagg

SEQ ID NO: 4243466 - RNA, 67 nt, Pseudomonas aeruginosa PA01
gcccuugccgcccugagcaacagccuggucaaggccggccuggucgugcuggugggcggcaagcggc

SEQ ID NO: 4243467 - RNA, 76 nt, Pseudomonas aeruginosa PA01
guucuugccgcccggauaguucugcgcgaggcuggcggcggcgcgguucuccgaggacaucagggcgagcaggagc

SEQ ID NO: 4243468 - RNA, 79 nt, Pseudomonas aeruginosa PA01
gggugccgcgcaggaucggccgcagcauguccuccagcgguccguggauggcacccucgccgaacaugugcuggcgccc

SEQ ID NO: 4243469 - RNA, 61 nt, Pseudomonas aeruginosa PA01
guuccuugauguccuugaucgccuuguucgacgacucgcggucgaagaugaucaggcgaac

SEQ ID NO: 4243470 - RNA, 61 nt, Pseudomonas aeruginosa PA01
gaucagcucggcgccgcguagcgugccgucgucguccaggcgcgccggcgccgggcugauc

SEQ ID NO: 4243471 - RNA, 65 nt, Pseudomonas aeruginosa PA01
gcacuucgccgugguggaagaggccgaucacaagguggucggcuuccugaccauggaggacgugc

SEQ ID NO: 4243472 - RNA, 85 nt, Pseudomonas aeruginosa PA01
uccgcgagaucggugaugcggcggcgcuggacgaggcgguggacgaugccuuucccggcagccgccugcacaucgacaacccggg

SEQ ID NO: 4243473 - RNA, 55 nt, Pseudomonas aeruginosa PA01
ucgacgagaagcucgacgccgcggcuuccuaccgccgggucaagcaacucgacga

SEQ ID NO: 4243474 - RNA, 108 nt, Pseudomonas aeruginosa PA01
gcggccgaauugcgcggugaaguugcuguucugcccgggcuggaucacgcccuugcgcacuuucggggucuccgggccguugcggaacaccgccgugcacucugccgc

SEQ ID NO: 4243475 - RNA, 61 nt, Pseudomonas aeruginosa PA01
gcugcugacccuggcgaucggcugguggcugaucaacacccugaccggccgggucggcggc

SEQ ID NO: 4243476 - RNA, 66 nt, Pseudomonas aeruginosa PA01
cgcuguccggccccaugagguacagguagaccggcaugaucuccucgccggugggguuguucagcg

SEQ ID NO: 4243477 - RNA, 58 nt, Pseudomonas aeruginosa PA01
uuuccaagcuggacgccggcgugaucaccccggacaucgccccguucgagcuuggcga

SEQ ID NO: 4243478 - RNA, 66 nt, Pseudomonas aeruginosa PA01
caguugcccggccauguccuccagcgaccagagcaccuguugcggaucgucguagccgagcaucug

SEQ ID NO: 4243479 - RNA, 76 nt, Pseudomonas aeruginosa PA01
gcgcuugccggccugacugucugccgggcaacagcgggacaacagggcuguccggcagaagacaggccgguuccgc

SEQ ID NO: 4243480 - RNA, 81 nt, Pseudomonas aeruginosa PA01
gucgccguggucgagcacgaugauguggucggagauguucaucaccaugcccaugucaugcucgaucagcaguacggugau

SEQ ID NO: 4243481 - RNA, 81 nt, Pseudomonas aeruginosa PA01
cuccaguuccaccuggaucugcuccuggucgaucgguacguacuugcggaucacuuccagcaggucuuucugcaacugggg

SEQ ID NO: 4243482 - RNA, 87 nt, Pseudomonas aeruginosa PA01
gaacuccgugcgaguguugcgcggcuccgccaguucguggccgaggccacgugcggcaagggcggcgcaaccgaaggcggugaguuc

SEQ ID NO: 4243483 - RNA, 85 nt, Pseudomonas aeruginosa PA01
gcggcaugcucggugucccgccggugaccaguuacguggagagcgccgcgggcguggccgccggcggacguaccgggcucaccgc

SEQ ID NO: 4243484 - RNA, 55 nt, Pseudomonas aeruginosa PA01
cuucggcggccgggugcucggcgacgacaagccgaaguaccugaacuccccggag

SEQ ID NO: 4243485 - RNA, 130 nt, Pseudomonas aeruginosa PA01
ccaggcgcugccgucggcggaccugaucguccugcccggcucgaagagcgugcgcgccgaccucgcggcgcugcgcgagcguggcugggacgaggcgauccuccgucaccugcgcuacggcggucgccug

SEQ ID NO: 4243486 - RNA, 128 nt, Pseudomonas aeruginosa PA01
ggcgugacaggcguugaugcgggcgagcauuuccuccacguggggcagcauggcgcgacucuugugggucggcugcaugccgccgcggguggcgaugaacagcucgucgucgaaggccuggcgcagcu

SEQ ID NO: 4243487 - RNA, 57 nt, Pseudomonas aeruginosa PA01
cuggcgccaugcagcaguugcgacaguucaccggcgucgcgcagcgcgucgcgccag

SEQ ID NO: 4243488 - RNA, 59 nt, Pseudomonas aeruginosa PA01
gcgacugaguacccguugcggaugaucgaggaacacccgcagcaggcgguacucggcgc

SEQ ID NO: 4243489 - RNA, 55 nt, Pseudomonas aeruginosa PA01
ggcaaauagagagcguccgaaauccucucggauuuuggcgaagcggcuauuggcc

SEQ ID NO: 4243490 - RNA, 88 nt, Pseudomonas aeruginosa PA01
gccacgcggcggaggugaucaagcgccugcgcgccuuccugcgcaagggccagcggcgccugcaggcgcucgaccucaaccagguggc

SEQ ID NO: 4243491 - RNA, 58 nt, Pseudomonas aeruginosa PA01
ucauucgcgaccugccgcugaucgccagcaacuggcgcagcaagcagucgcugccuga

SEQ ID NO: 4243492 - RNA, 76 nt, Pseudomonas aeruginosa PA01
guaguccucggcguagccagccucguguccgagcaacagguauucgcgcucggacgaggcgaacugcucgaacaac

SEQ ID NO: 4243493 - RNA, 66 nt, Pseudomonas aeruginosa PA01
gucaugaguaucuauggauuacguaucuaucgagagaaugggaccgccgcuguagauauaacugac

SEQ ID NO: 4243494 - RNA, 96 nt, Pseudomonas aeruginosa PA01
ugggggucgaccuggugcaaggcuaucuguucggccgcccgcaggaacacccggcgagcgacguacaacagaugcugcccagcgcugacgccccca

SEQ ID NO: 4243495 - RNA, 90 nt, Pseudomonas aeruginosa PA01
cggcgcagauggacacuuugcgugaacuggccggugguagcgacaccgcggccaucgagaaccagaucaagcgccugucccaggugaccg

SEQ ID NO: 4243496 - RNA, 97 nt, Pseudomonas aeruginosa PA01
ccagcuggcguagcgagcggcauucaggccggcgagcuugucggaaagcuucaucaguucgcugaucugcaguggcgugagcuggcgcaguugcugg

SEQ ID NO: 4243497 - RNA, 59 nt, Pseudomonas aeruginosa PA01
gcgaccuguugcuccagaucgcuucgcggcgccacguagaccugcugcaacaggcucgc

SEQ ID NO: 4243498 - RNA, 80 nt, Pseudomonas aeruginosa PA01
ccgguuuaaagaugaugcggcgcugacgauacaggcugucgaagguagcccgcggcaauugcugcaucucgggaauacgg

SEQ ID NO: 4243499 - RNA, 76 nt, Pseudomonas aeruginosa PA01
cgcggguguccuugagcuuggucagcaggcgcucgagauuggccucgggcagcucgaucaggcugaagguaucgcg

SEQ ID NO: 4243500 - RNA, 98 nt, Pseudomonas aeruginosa PA01
ggagcgccuggccauguaccugcagggcguggacucggucuacgaccuggucuggaccgacggcccguucggcaaggucaccuauggcgacguguucc

SEQ ID NO: 4243501 - RNA, 97 nt, Pseudomonas aeruginosa PA01
gcgcgcgcaggcaggcgagcaucaggugggcgaaguccuggcagaccccgcgacggcgcuccagcacuucguccagcggcgucgccaccuggguggc

SEQ ID NO: 4243502 - RNA, 65 nt, Pseudomonas aeruginosa PA01
cguagccgaugugcggguucagugcggugaccagcaucaggccgcgcuccagcaggucggccaug

SEQ ID NO: 4243503 - RNA, 64 nt, Pseudomonas aeruginosa PA01
ugcuggccuacgccgcggcgcugcugugcgggggggaaaucagcaggcccggcguaguccagca

SEQ ID NO: 4243504 - RNA, 64 nt, Pseudomonas aeruginosa PA01
uccacgcugucgacgacgaagccguagugauccauggucugcaggccguugcuggcagcguggg

SEQ ID NO: 4243505 - RNA, 127 nt, Pseudomonas aeruginosa PA01
gcugaugcuggugaugcucggccugucgcuggccggucugcgccugcacgagaccuggcggccguugcugcugucucuggugcgggucuggggcgguuucgcggucggcuaugggaucgcugccggc

SEQ ID NO: 4243506 - RNA, 119 nt, Pseudomonas aeruginosa PA01
gccgugcucgccgccaagcaauugccgccguacggcggcgacacccucugggcgagcagcacggcggccuacgaggcgcugucggcgccgcugcggcgucugcuggacggccucacggc

SEQ ID NO: 4243507 - RNA, 63 nt, Pseudomonas aeruginosa PA01
gguugguggcggugugcgccgguuccgaccugaugcauccgaucggcgcgcuggcuaccggcc

SEQ ID NO: 4243508 - RNA, 99 nt, Pseudomonas aeruginosa PA01
gugccguagccuccacgcggacuuccaccugcgggugcgacgcgcugaauugaccgaggcgcggcaccagccagguggcggcgaaggagggcucggugc

SEQ ID NO: 4243509 - RNA, 69 nt, Pseudomonas aeruginosa PA01
gcggaagcggagaacaucgucggcggggcggauaaauccacgcuauccgccgaucaguuccguucgcgc

SEQ ID NO: 4243510 - RNA, 96 nt, Pseudomonas aeruginosa PA01
ucgucgccuugcaccuggccaaggcguugcaggagcagacgccgaaccagguccugcugcuggacgucggccagcccaccggcgaggcgcuggcga

SEQ ID NO: 4243511 - RNA, 55 nt, Pseudomonas aeruginosa PA01
ccgggcugccgcuucguuccgaugccucagaguucgaacggaauggucagcuugg

SEQ ID NO: 4243512 - RNA, 102 nt, Pseudomonas aeruginosa PA01
uccccucagcgccugaucagcacccgucggccuuggugcacgaggcgcaggccaugggucugcgccagcaucgccagggccagcggcaggucgucgacggga

SEQ ID NO: 4243513 - RNA, 78 nt, Pseudomonas aeruginosa PA01
cugcgcgcuguuccucugagcguagcgacggggaauccgccugcgauuccccguuaaccuuaaguuacagaacaccag

SEQ ID NO: 4243514 - RNA, 58 nt, Pseudomonas aeruginosa PA01
cagccugaaggacuggccggcggcggacugcgccaccaggcagcuguucuucaggcug

SEQ ID NO: 4243515 - RNA, 55 nt, Pseudomonas aeruginosa PA01
gucgccaugccauccucgcgcugcuuuccgagcagggcgaggucagcguggacgc

SEQ ID NO: 4243516 - RNA, 60 nt, Pseudomonas aeruginosa PA01
ucucgcugucaucaacccguguggccucucgccagggcucgggugcauguuucagcgagg

SEQ ID NO: 4243517 - RNA, 61 nt, Pseudomonas aeruginosa PA01
cgagauguaccgccugcacggcgugccacagaaggacaucgccaaggaacugggcgucucg

SEQ ID NO: 4243518 - RNA, 55 nt, Pseudomonas aeruginosa PA01
ggcguucuccacuuccuggcgcugcaucaguugcugccggguccgcaggaacgcc

SEQ ID NO: 4243519 - RNA, 62 nt, Pseudomonas aeruginosa PA01
gucgcugaccuggcaaccgcaguccaccaggcccuggaucagcugcuugaccagcucgggac

SEQ ID NO: 4243520 - RNA, 72 nt, Pseudomonas aeruginosa PA01
uuuccaccgccuccuggacaucgacaucgcugaguauuucgucgauccgcuugccaugggggucguuggaga

SEQ ID NO: 4243521 - RNA, 76 nt, Pseudomonas aeruginosa PA01
gccuggaagcccugugccggcgcugcguggcgcucgacgagucgacccgcacccagccccaggcgcgacaacaggc

SEQ ID NO: 4243522 - RNA, 60 nt, Pseudomonas aeruginosa PA01
gcgccggcuuccucgaacugcucggcgccgaggugccgaccagcgccagcgagccagcgc

SEQ ID NO: 4243523 - RNA, 72 nt, Pseudomonas aeruginosa PA01
guagcccgggaucgagcaaauugccgcagcggaagcgcaccuugcggcgaaccugcucggccaacugguagc

SEQ ID NO: 4243524 - RNA, 61 nt, Pseudomonas aeruginosa PA01
ggucagugccaugaagaagcucggcaucaagcgcgaugccgaccucaucagguaugcggcc

SEQ ID NO: 4243525 - RNA, 94 nt, Pseudomonas aeruginosa PA01
ccgggaaguccagggcggcgagcagcgcguugaguuccaggugccggcgcucgcugggcaucaggccgacgcgcuugaccccgaagacccccgg

SEQ ID NO: 4243526 - RNA, 73 nt, Pseudomonas aeruginosa PA01
accugcggccauucguggucggugaugcuguagacgaaggugucgucuagccgcccgccggccagccgccggu

SEQ ID NO: 4243527 - RNA, 58 nt, Pseudomonas aeruginosa PA01
cggcagguucgccagguaaagaccgccgacgcgacugucuuucguagcgaaccuggcg

SEQ ID NO: 4243528 - RNA, 103 nt, Pseudomonas aeruginosa PA01
cagcccgccgcugccggcaaacuuuccccggcgcaaccgcaucaucagcggacucucgcugggugugcugguggucgaggcaagucccgccagcggcucgcug

SEQ ID NO: 4243529 - RNA, 100 nt, Pseudomonas aeruginosa PA01
ccggcauggcgcagcuggaggauggcuuccacgcguugggccuguccuggauucccucgaagggcaacuucaucgccguggaucuggcucgcgaugccgg

SEQ ID NO: 4243530 - RNA, 84 nt, Pseudomonas aeruginosa PA01
ucacguugcuggaaaugguggugguaguggcggugaucggcauccuccucggcaucgccauucccaguuaccagaacuacguga

SEQ ID NO: 4243531 - RNA, 79 nt, Pseudomonas aeruginosa PA01
cgcucaguccucggucucgucgccguggcggcggccgucuucggccaccgcacgcucgaucagcgccgacagcucggcg

SEQ ID NO: 4243532 - RNA, 84 nt, Pseudomonas aeruginosa PA01
ggaucaacguggaaauggucgacgcggugcucaacgacucuuucggccagcgccaggugucgaccaucuucaacccgcugaacc

SEQ ID NO: 4243533 - RNA, 70 nt, Pseudomonas aeruginosa PA01
gcggaacaucgccuugaucccgcgcaccgccuggcgcaggcggucgcgguucucgaucagggcgaaacgc

SEQ ID NO: 4243534 - RNA, 79 nt, Pseudomonas aeruginosa PA01
ucgacgucuccucgcggcgcaagaucgcgcucuucaccaacgucgaggagcgcgcggugaucgcccuggaagacgucga

SEQ ID NO: 4243535 - RNA, 129 nt, Pseudomonas aeruginosa PA01
cgucggccaggccggcuuccagcagcgggaucaggcccagcugggucgcggucggguagcagcccggcacggcgaucaggcgggccuggcggaucuucucgcgguucacuuccggcaggccguagacag

SEQ ID NO: 4243536 - RNA, 63 nt, Pseudomonas aeruginosa PA01
gcggaaauggccaagggagccgggccuacgaucguaggcgagccuccccgggccauuuccugc

SEQ ID NO: 4243537 - RNA, 56 nt, Pseudomonas aeruginosa PA01
gguggaagacucggggcaggguaucucccccgagauccugccgcgcaucuucgauc

SEQ ID NO: 4243538 - RNA, 101 nt, Pseudomonas aeruginosa PA01
gccggguggcgguggucggccugggcggccucggucacaugggccugaaguucgccagggcgcucggugccgagguggcccuguucacccgcucgccgggc

SEQ ID NO: 4243539 - RNA, 129 nt, Pseudomonas aeruginosa PA01
ccgugaugggacagggugagcggcggauaacgccguuggcguuaugcgcccuacggcuccucgcgcagggugggcgguagggcgaauaaccgcuugcgguuauccgccauucccgugguuuuucucgcg

SEQ ID NO: 4243540 - RNA, 79 nt, Pseudomonas aeruginosa PA01
gcgcaccagcagauuaucgcgggugaugccggcguuauugaccacgaucagcgguuggccgagaugcugcuggaugugc

SEQ ID NO: 4243541 - RNA, 57 nt, Pseudomonas aeruginosa PA01
auugcggcacacgcaugcaggcgcaggaccacgagcgggugaugcaguguccgcagu

SEQ ID NO: 4243542 - RNA, 73 nt, Pseudomonas aeruginosa PA01
cccggugcuguucgccggcggcggcggaccguagcgguuggcgccggugcugccgggcaggaccagcaucagg

SEQ ID NO: 4243543 - RNA, 82 nt, Pseudomonas aeruginosa PA01
gcggccgaucggcguggucgagggugucgacuaucaccauaccggugagguccgucgcaucgaccgcaaggguauuggccgc

SEQ ID NO: 4243544 - RNA, 78 nt, Pseudomonas aeruginosa PA01
gucgacaagguccucgccgaccucagcgccggggagaucgagcgacuccaggcccccugggucggcggccugcucgac

SEQ ID NO: 4243545 - RNA, 76 nt, Pseudomonas aeruginosa PA01
ucgaggaacuccugcuggcacguggccccgguggccaggaagacgaggucagggccaucugccagcgggaacucga

SEQ ID NO: 4243546 - RNA, 66 nt, Pseudomonas aeruginosa PA01
cugguggucggcgccgguucgucggggguacagaucgccgacgagcugcaacgugccgggcgccag

SEQ ID NO: 4243547 - RNA, 67 nt, Pseudomonas aeruginosa PA01
aucagguuggccagagugucggagccgacgcucgacagguugcccgacacaccgcuggcuuucugau

SEQ ID NO: 4243548 - RNA, 56 nt, Pseudomonas aeruginosa PA01
gucguugcaggcgcccggcgaggaacggcaucgccucgccggcgccaugcagcagc

SEQ ID NO: 4243549 - RNA, 71 nt, Pseudomonas aeruginosa PA01
guccacuucgcagcgcugcgcgagcagggugucgcgacgcggcgccugcucgaucagguugagcaccggac

SEQ ID NO: 4243550 - RNA, 78 nt, Pseudomonas aeruginosa PA01
cgggcuacccggccugccuugccgucggaaguaagccggggucgcgacgauggccaagcgcagguccgggccgacccg

SEQ ID NO: 4243551 - RNA, 76 nt, Pseudomonas aeruginosa PA01
cgccuggccaaggccggccugguggcugccaccgaaggcgugcgcgguggcuuccgccuggcacggccggccaacg

SEQ ID NO: 4243552 - RNA, 86 nt, Pseudomonas aeruginosa PA01
gguguucaccgaacagggcguguuccguggcagcgugcugccgcugcuggccucgggccacgccuucaauaccgagguggacaacc

SEQ ID NO: 4243553 - RNA, 55 nt, Pseudomonas aeruginosa PA01
guugcuugcccuugaucugcuuccacaccuggccgagcagcucgggcggcgcgac

SEQ ID NO: 4243554 - RNA, 67 nt, Pseudomonas aeruginosa PA01
gccguucggcaaaggauagccgcguggguucugaaacgaaaccgaccggccacgccuuuccagcggc

SEQ ID NO: 4243555 - RNA, 61 nt, Pseudomonas aeruginosa PA01
gcuggccaccagcgccuggcgcaacagggucuugccgcugcccaggggcccggugaccagc

SEQ ID NO: 4243556 - RNA, 87 nt, Pseudomonas aeruginosa PA01
cgccgguucgcaccgggauuuccaucggcgacucgaucgccgcccuguggggcgugaucggcgcgcugauggcgcugcgacaccgcg

SEQ ID NO: 4243557 - RNA, 62 nt, Pseudomonas aeruginosa PA01
guuguucaggucgccgccgaugcgccgguuguccuggcgcguccaguugcgaucggagcgau

SEQ ID NO: 4243558 - RNA, 79 nt, Pseudomonas aeruginosa PA01
uaccgccauaucaccguucugcucgaggaggccguuuccgcacuggccccgcgggaggacggcugcuaucuggacggua

SEQ ID NO: 4243559 - RNA, 106 nt, Pseudomonas aeruginosa PA01
cgccgagccaugcggcauaggcgccccagagccgcuggcguucgucgcggaaccgcucgggcucgccgaacagccagcugcgcaggugccgccagcggcucgcgcg

SEQ ID NO: 4243560 - RNA, 85 nt, Pseudomonas aeruginosa PA01
gaucuuguugucgcgguuaccguugaaguucuggucggcgaagucgcuguccagcuuggugcgauagccguugaagucgaaguuc

SEQ ID NO: 4243561 - RNA, 112 nt, Pseudomonas aeruginosa PA01
ggcagugcucgaccagguccugcagggugucgcgcagggugcugagcuccucgaucuugcgauucagcucgcgcacgugcugcgccgccagggccuugacgucggcacuggc

SEQ ID NO: 4243562 - RNA, 73 nt, Pseudomonas aeruginosa PA01
gcgcacggcguugaccaggucgcuggcgcugagguucaucgaggucagcuuggccgggucgggccagaugcgc

SEQ ID NO: 4243563 - RNA, 100 nt, Pseudomonas aeruginosa PA01
gcuggcgcggugaguuucugcacguugaugccgaugcgcgcgaucccguuccggcuggucugccugcuuggcaugaacgauggcgacuacccccgccagc

SEQ ID NO: 4243564 - RNA, 78 nt, Pseudomonas aeruginosa PA01
gcuccuccagcggcgcguaggcgcugagcgccucguacaucacgcgcucggcgaugaccucgcugucgaccaggacgc

SEQ ID NO: 4243565 - RNA, 56 nt, Pseudomonas aeruginosa PA01
ugcccgggcccuguacgaaagcgcgucgccaacgucuuuucguagagcgcccggca

SEQ ID NO: 4243566 - RNA, 92 nt, Pseudomonas aeruginosa PA01
gagcuaaugccauaagucucgacgccaaagggcgccucgcgaugccgagucgguaucgugacgagcucguuucgcguugugccggccagcuc

SEQ ID NO: 4243567 - RNA, 67 nt, Pseudomonas aeruginosa PA01
gcgccugaaacugccguucgacaaggucacggucaacgugacccugcucggcggcgguuucggccgc

SEQ ID NO: 4243568 - RNA, 63 nt, Pseudomonas aeruginosa PA01
cgcuugcccuugaacuuguaggccagcacgcagccguccugggccugcuucaucagggcaucg

SEQ ID NO: 4243569 - RNA, 97 nt, Pseudomonas aeruginosa PA01
gccguagagcgcgcccuuggccagguugacgcuggccgacugcaacgacuggcgcaggucggccagggucagcugguaggcggcgagcuucuccggc

SEQ ID NO: 4243570 - RNA, 113 nt, Pseudomonas aeruginosa PA01
ucgcgugcgucagccguuccgcgcgcugcacgacgccggccugcuggacggcaugcucagcgagucgcuccugcagccgguggcguuggagcgccuggaggucgacagcguga

SEQ ID NO: 4243571 - RNA, 64 nt, Pseudomonas aeruginosa PA01
gcuaggaacgcggauagcuuuucuucgcugucagcaguuaagugaugggcuuccgcuuccaugc

SEQ ID NO: 4243572 - RNA, 88 nt, Pseudomonas aeruginosa PA01
ccuggcgcuggccaugggugaauacgagcgcagcgaggaaucccgcugugccgugcucuucgcccauggcgagcacuucaccgccggg

SEQ ID NO: 4243573 - RNA, 59 nt, Pseudomonas aeruginosa PA01
ggugacugaaggcggcauauucgauuuucagcacggcaucgagguccgccucggucauc

SEQ ID NO: 4243574 - RNA, 76 nt, Pseudomonas aeruginosa PA01
gaugggcauggcgccuccucuccuaguggugaccccuaccaaaggccacguggguugggaugugccaguaagcguc

SEQ ID NO: 4243575 - RNA, 109 nt, Pseudomonas aeruginosa PA01
ccuggcgacgcugguggaugccguugcggcggagguccgcgcauguccggcgggauucuccggcaggucgaaacccuucgccagcagcggcaggccgagcagugccagg

SEQ ID NO: 4243576 - RNA, 56 nt, Pseudomonas aeruginosa PA01
ucggcucgcgccggcgcguucucugucggagagggagcgccuggcgucgaugccga

SEQ ID NO: 4243577 - RNA, 56 nt, Pseudomonas aeruginosa PA01
ucuguucgucgagauagaggaugcggcccagcgcguccuucugcucggccagcagg

SEQ ID NO: 4243578 - RNA, 72 nt, Pseudomonas aeruginosa PA01
gagagcgagcagguuggucuggucggcgaugcccuugaucacaucgaccacgccgccgaucucguugcuguc

SEQ ID NO: 4243579 - RNA, 86 nt, Pseudomonas aeruginosa PA01
ggacgucguaguugaccugccagccggugaugaagaugcucgaacuggcgcugucgagggcgcuggccaggucgcugaaguagucc

SEQ ID NO: 4243580 - RNA, 81 nt, Pseudomonas aeruginosa PA01
gccgguagaagcgcugggcgacgcccgucgcgccggccaccagcagguugccaugggcguggcccggcgcgugguagcggu

SEQ ID NO: 4243581 - RNA, 104 nt, Pseudomonas aeruginosa PA01
ggccgcgguggauucgaacaggccgugcagguaggugcccaugacguucccgucgacgcugcgggcaccauccgcgcggccaucgucgagcaccaccgccggcc

SEQ ID NO: 4243582 - RNA, 85 nt, Pseudomonas aeruginosa PA01
gggcggcgccaccuucgacgccugcgugcgcuuccucaaggaagacccgugggaacgccugcgcaagcucaaggcggcgcugccc

SEQ ID NO: 4243583 - RNA, 129 nt, Pseudomonas aeruginosa PA01
cgcugcgcgcggggcauccgcugcccggcucgcgcuuguugcauggcgugccggugucguagaaauacuggcagcggguacgcugcaacagguugccgccggugcuggccauguugcgcaacugcggcg

SEQ ID NO: 4243584 - RNA, 61 nt, Pseudomonas aeruginosa PA01
ucgcgcgccaggaugccgagccgcgccaggcgguggcgguggucggcuauccggcgcgcga

SEQ ID NO: 4243585 - RNA, 66 nt, Pseudomonas aeruginosa PA01
ggcgccggcgucgcgcgcgguggcgaucaugcugaccaggucgcugaccgaggugcgcgcggcguc

SEQ ID NO: 4243586 - RNA, 65 nt, Pseudomonas aeruginosa PA01
uggcggaguggguguuggaguaggacccuauuugaggagucuauaugaacuauuuauucgugcca

SEQ ID NO: 4243587 - RNA, 129 nt, Pseudomonas aeruginosa PA01
uggcgcgccuggaugccgggcaacucgccgaggcgcgcaaggcgcuguucguggucagcaccuucggcgacggugaggcgccggacagcgcccgcggcuucgaacgcaaggugcuuggccaggccgcca

SEQ ID NO: 4243588 - RNA, 92 nt, Pseudomonas aeruginosa PA01
augagcuugccuccugcugggacgaaugggaguucagagcugcagccaguaaguguagaacuguucgucacggacauagccgaggcgcucgu

SEQ ID NO: 4243589 - RNA, 84 nt, Pseudomonas aeruginosa PA01
auccugcuggcgcaggucgacgucgagggccagcugcgccugaagcgcagccgcgcacugaucgucggucuuggcggccugggu

SEQ ID NO: 4243590 - RNA, 70 nt, Pseudomonas aeruginosa PA01
gcuuuccgccagcaggauguagagcugaacgaucagcgcguagaggcuuuccacauguugcggggacagu

SEQ ID NO: 4243591 - RNA, 68 nt, Pseudomonas aeruginosa PA01
gcugcuacuggcccuggcuacgcgccugccggacuaccagcaggcgguacgcagcggucgcuggcagc

SEQ ID NO: 4243592 - RNA, 69 nt, Pseudomonas aeruginosa PA01
gcugggucgccuggggcaggcggaagagaucgccaagguggucggcuuccucgcuucggacggcgcagc

SEQ ID NO: 4243593 - RNA, 64 nt, Pseudomonas aeruginosa PA01
ggccgccgaagcgcauggucaggccgcucacuucgagaaucggucggcucauggcuucagcucc

SEQ ID NO: 4243594 - RNA, 71 nt, Pseudomonas aeruginosa PA01
cgccgccgcgcaggcgguacaggcggcugucgccggcccacaggcagcucgccugguugccgcgcgcggcg

SEQ ID NO: 4243595 - RNA, 91 nt, Pseudomonas aeruginosa PA01
gugggaugucgagccuggccgagcgcuucugcucgacgcccgaggcguccaguuccucgcagaaguccucguggaccaggcgcaucaccgc

SEQ ID NO: 4243596 - RNA, 80 nt, Pseudomonas aeruginosa PA01
ccagcuuuaucugcaggacccggucgccagccucagccguccggugaaggaacugcgcggguuccgcaaggugaugcugg

SEQ ID NO: 4243597 - RNA, 60 nt, Pseudomonas aeruginosa PA01
gucguagguggcgaccgcggucugguccgccagccggcgcaccucgguggccaccacggc

SEQ ID NO: 4243598 - RNA, 86 nt, Pseudomonas aeruginosa PA01
ggucguagcgcucguucugcuugaucgccaccaccugggcgguaccgcucuugccggcgaucagguaggccgagguggcgccgacc

SEQ ID NO: 4243599 - RNA, 100 nt, Pseudomonas aeruginosa PA01
ccggugaggaccaccgccaggaccuugucguuguaggccuuggccgccgagccgaaggucacgucgacgcagggcuuguaguucaggcguucgucgccgg

SEQ ID NO: 4243600 - RNA, 123 nt, Pseudomonas aeruginosa PA01
ggcgaugaugaagcccaccucgcccgccuucaggucgacggucucggugugcuucggagugaauaccccgacgcuguccaccugguggaccuugccgguggacuucaccaggaucuugucgcc

SEQ ID NO: 4243601 - RNA, 87 nt, Pseudomonas aeruginosa PA01
gaaaacgccgcuggcgccgaggcaggcguggaccuucucgaacaggccgggcaggucggcuucggcuucgauguugucgguguauuc

SEQ ID NO: 4243602 - RNA, 91 nt, Pseudomonas aeruginosa PA01
cgucgcgccgaacugcgaggcgcugucggguccuggcgucgaguagcucgcgcagggucuugaacagcggugcgcggucgguauagcgacg

SEQ ID NO: 4243603 - RNA, 61 nt, Pseudomonas aeruginosa PA01
ccugguccaccugggccugacccgcggcgccccggacaacaucacggcccugguggucagg

SEQ ID NO: 4243604 - RNA, 71 nt, Pseudomonas aeruginosa PA01
gccugaucguggugugcauggccaagccgcuggcgaagacgccgggcagcucgaugcacauccaccagagc

SEQ ID NO: 4243605 - RNA, 73 nt, Pseudomonas aeruginosa PA01
cucggcgaacagcccggccaguucgcgggcgacgcggaucgccucggcgucgucggcgaugcgccgggccggg

SEQ ID NO: 4243606 - RNA, 63 nt, Pseudomonas aeruginosa PA01
cuuccucgguaucggcaucgugcucggcuccuggugggccuacuacgagcugggcuggggggg

SEQ ID NO: 4243607 - RNA, 58 nt, Pseudomonas aeruginosa PA01
ccucgaucacgcuggauuggcugagcugguuuucccuggccaacuggcguaucgacgg

SEQ ID NO: 4243608 - RNA, 69 nt, Pseudomonas aeruginosa PA01
ucgacaccuucaaccgggucggccuggagccguucaaggcccgggucuacgccaggauggaggaaccgg

SEQ ID NO: 4243609 - RNA, 82 nt, Pseudomonas aeruginosa PA01
uccgaaugaaccgggguguucugcgguauuucucgccgagcgggcaagaagugcgaaauagagcgcuuggguacuucucggg

SEQ ID NO: 4243610 - RNA, 59 nt, Pseudomonas aeruginosa PA01
uccacgcauuucucgguggaggagauuuccgcaaagauccucgucgaaaaaggcgugga

SEQ ID NO: 4243611 - RNA, 85 nt, Pseudomonas aeruginosa PA01
gaugccgcugucacgcgccugaccgguggcgcgguagcgcaccaggcggaaggcggcguccuggaucagcgccuggcgcggcauc

SEQ ID NO: 4243612 - RNA, 80 nt, Pseudomonas aeruginosa PA01
cccugcgcagcgcgaggccagccagcaacucuuggacgaagccgcggacaaguugccgccggccuuccgcgaacgccugg

SEQ ID NO: 4243613 - RNA, 74 nt, Pseudomonas aeruginosa PA01
cggcgcugagggccggccgauggaaauccugcugcuacgccuggacuucugggacuggcuggccuucgguaccg

SEQ ID NO: 4243614 - RNA, 73 nt, Pseudomonas aeruginosa PA01
acgugcguguaugauacccgagcucaaacgguuuagcuaaauucaugcggcuuggugucauucaugcaggcgu

SEQ ID NO: 4243615 - RNA, 129 nt, Pseudomonas aeruginosa PA01
cgccuggaucuucugcgcgacgaagccgcugcgggugacgaucgccuggccgcgcgggcccugggcgaaacguaccagggccugggcccagggguucuucucgccgggcuucagguagaggaacaggcg

SEQ ID NO: 4243616 - RNA, 80 nt, Pseudomonas aeruginosa PA01
gcuccgaccagggaaucuccgcuucgucgaaaagccgcaccuccaggcuuucaucgccggcggagaaauccaggucgagc

SEQ ID NO: 4243617 - RNA, 59 nt, Pseudomonas aeruginosa PA01
cgagagcuucgccaaccugauggacuacgguuucaccgccgggauggaggagcaucucg

SEQ ID NO: 4243618 - RNA, 130 nt, Pseudomonas aeruginosa PA01
cggugccaucgucggugucgccgauguacaugccggggcgcuugcguacggcauccagccccuucagcaccuugaugcuggaagagucguacguguuguucucgcucaugcuucacucccgauggucgug

SEQ ID NO: 4243619 - RNA, 123 nt, Pseudomonas aeruginosa PA01
gugcagguccuugagcuucacguaguugccggcgguguaggcgaagaagccgcgcuccuugucgcucagcggacgggccuucuucgccgggcugccgacguagaggaagccgcucuccagcac

SEQ ID NO: 4243620 - RNA, 59 nt, Pseudomonas aeruginosa PA01
uacaaggucgagugcgccuacgaggcgaucaacgucuggucggcacgcuggaucgagug

SEQ ID NO: 4243621 - RNA, 60 nt, Pseudomonas aeruginosa PA01
gcgccuggcggaagaaggcggcauggucgccagcgaccagccgcccuccccgcuccccgc

SEQ ID NO: 4243622 - RNA, 71 nt, Pseudomonas aeruginosa PA01
gcacccgcucgcggucgcccuggccauugucgaucgcuuccggcagggccugggcgaucgcgacgcggugc

SEQ ID NO: 4243623 - RNA, 79 nt, Pseudomonas aeruginosa PA01
ggugcucugcaccgcggugacaucggugccggccuggccgcccuggccggcgaagcgcaucgccgcggugaggaucgcc

SEQ ID NO: 4243624 - RNA, 57 nt, Pseudomonas aeruginosa PA01
ucucgaugaucaucaggcuggcguugggcacgucgacgccgaccucgaucaccgugg

SEQ ID NO: 4243625 - RNA, 64 nt, Pseudomonas aeruginosa PA01
ucgucgaagagcccgaacgcuuccggcgcggccgcucguuccggagcgcccgggccuucgucga

SEQ ID NO: 4243626 - RNA, 56 nt, Pseudomonas aeruginosa PA01
guugcugaaggauaugcguggaaggcucuguacuuacaaccagcaccuuuagcgac

SEQ ID NO: 4243627 - RNA, 93 nt, Pseudomonas aeruginosa PA01
cggugaucugcauguccuccaugcgcgguaggcgcaucuucgccggacgcccggugugguaggcgaccaccgcgcacaggcaggccggcgccg

SEQ ID NO: 4243628 - RNA, 89 nt, Pseudomonas aeruginosa PA01
gcgcaaugcccugaugcuggucggcggggugcugcugauguucgucaccaacgccaagcugaccagcaucguggugcuggcguugccgc

SEQ ID NO: 4243629 - RNA, 61 nt, Pseudomonas aeruginosa PA01
cugcggguuguccgcggcgagcuuaggagauuauccgcgcuucggccaccgacagccucag

SEQ ID NO: 4243630 - RNA, 71 nt, Pseudomonas aeruginosa PA01
ccggcacagggucgggugcucagccggcgcgagacgauccugcugguccuguucgcccugacccugcacgg

SEQ ID NO: 4243631 - RNA, 76 nt, Pseudomonas aeruginosa PA01
uucucgacugcuucuucgauaccgccgaccauguagaacgccugcuccggcaggugaucguagucgccguugagaa

SEQ ID NO: 4243632 - RNA, 81 nt, Pseudomonas aeruginosa PA01
ggcgaucuuggucaggguguugcggcugucgggauugagacggucgagauuguugccgaacagcaccuugcucgacaugcc

SEQ ID NO: 4243633 - RNA, 77 nt, Pseudomonas aeruginosa PA01
ggcaauggccggccguagggaaucgaacgccagugcggcggcaccguaucgacgcucugcagguucgaccagaugcc

SEQ ID NO: 4243634 - RNA, 93 nt, Pseudomonas aeruginosa PA01
gaggucgaggucgcagggcagcucgaggucuucgucgcuggccagcacgcgggugaugugcgccuugagcugcucgagggaagucucgaucuc

SEQ ID NO: 4243635 - RNA, 114 nt, Pseudomonas aeruginosa PA01
gcucggccaggcggcguggcacggugccgagcagcucggugcuggcgacgauggccgggauggucagguagugaggcaccagcaauugcaccuggcgcugcacccuggccgagc

SEQ ID NO: 4243636 - RNA, 64 nt, Pseudomonas aeruginosa PA01
cuggcgggccuggagaggcaguucgauggcaugcugcucgagcaccaucgacaggaccuggcgg

SEQ ID NO: 4243637 - RNA, 75 nt, Pseudomonas aeruginosa PA01
gcuaccacgucuauggccaucuguugggcugcgucgaggcgacccucgacgccaaucccgggcuggccgaugagc

SEQ ID NO: 4243638 - RNA, 108 nt, Pseudomonas aeruginosa PA01
gcaugcccacaagcugcaguucaucccgguggugacccgcgagcagguacccgguugccugaacggacguaucaccacguugaucgagaacggcgaucuggagcgugc

SEQ ID NO: 4243639 - RNA, 75 nt, Pseudomonas aeruginosa PA01
cuggcuggagaggaaagugcccggguccuggcgggguugccgcaggcgcggaucacuuucaauuaccugggccag

SEQ ID NO: 4243640 - RNA, 55 nt, Pseudomonas aeruginosa PA01
gaggcggcgcgacgggugaugggcaucgccuugccgaucaucugcgcgcuguuuc

SEQ ID NO: 4243641 - RNA, 128 nt, Pseudomonas aeruginosa PA01
auggccgacagguccucgacguugcggcgcaggguguacucggcguaggcgccgccgucgauguaguggaagaggaacggcggcagcuugcguugggcggcggcgcgguagucgguggaagcggaaau

SEQ ID NO: 4243642 - RNA, 58 nt, Pseudomonas aeruginosa PA01
gcacuucgaacuggccgccgacgccaucuucaaggccaucggccaggccuucgaaggc

SEQ ID NO: 4243643 - RNA, 72 nt, Pseudomonas aeruginosa PA01
ggcgaagaagcgguucagggugaugccggagaucaggaagucaccgcggauccacugggccaggucuucgcc

SEQ ID NO: 4243644 - RNA, 55 nt, Pseudomonas aeruginosa PA01
ggugcuggcaucgcggcgcacguaccaggccaugucggcgcgauuguccagcacc

SEQ ID NO: 4243645 - RNA, 57 nt, Pseudomonas aeruginosa PA01
cuugaucgguuguacgccggaggucggcggcaggcugucggcguagcgaucgucgag

SEQ ID NO: 4243646 - RNA, 61 nt, Pseudomonas aeruginosa PA01
ugcuugccggugcuuucauucgcggcaugcaugccgccgggauggccgccaccggcaagca

SEQ ID NO: 4243647 - RNA, 61 nt, Pseudomonas aeruginosa PA01
ccgggccgcgacggccgcccaggcacuccucgacguagcucugcuucggcuucuggcccgg

SEQ ID NO: 4243648 - RNA, 68 nt, Pseudomonas aeruginosa PA01
cgccaccuggugcuggacaaucgcgccgacauggccugguacgugcgccgcgaugccagcacccugcg

SEQ ID NO: 4243649 - RNA, 79 nt, Pseudomonas aeruginosa PA01
augucgucuuccucgaaggccgaggccucgaccuugcggcugcgcaggucggcuucgucgucuuccagcaggaugucgu

SEQ ID NO: 4243650 - RNA, 77 nt, Pseudomonas aeruginosa PA01
gaggcauggcgacuggccugccauugugugccccaucaucaaaggggguuucaaugaccaggcaguugaccacucuc

SEQ ID NO: 4243651 - RNA, 97 nt, Pseudomonas aeruginosa PA01
guucuggguaagggucacgaucugccgcgcgcggagagacugcgucgaaaacggcugguuucucuggcucggcagaucgugaacagcuuccaaggac

SEQ ID NO: 4243652 - RNA, 80 nt, Pseudomonas aeruginosa PA01
gccgcugucgcugacgcuguacagcaggcgcucgcguccgcccucgucgaagcgccgcugcacgcgcacggcgacauggc

SEQ ID NO: 4243653 - RNA, 91 nt, Pseudomonas aeruginosa PA01
gccggcaccugggaacccuggccgauaccgucagucaguugcagcacgcgcucgacugacgcgggaguuugccugcucccaggcggccggu

SEQ ID NO: 4243654 - RNA, 81 nt, Pseudomonas aeruginosa PA01
cugccacaggccgagcagggcgaucgccagcaucgccgcagcgaaauagcgccagccgaugcccugcacggccugguacag

SEQ ID NO: 4243655 - RNA, 61 nt, Pseudomonas aeruginosa PA01
gccaucgucauccucggugccggccggcagaccaacgacccggccuggggcgacgaugcgc

SEQ ID NO: 4243656 - RNA, 59 nt, Pseudomonas aeruginosa PA01
gguccugagccaggcgggcguacgcacggaaguguucgacgccaugcccucggucggcc

SEQ ID NO: 4243657 - RNA, 72 nt, Pseudomonas aeruginosa PA01
ucuggcuccaggccggaucggaaaagcgucggucgucaucgccugggcguagcuccgacuggccgagcagga

SEQ ID NO: 4243658 - RNA, 64 nt, Pseudomonas aeruginosa PA01
cgugugggugcuugugauguaagacuggugaucgcaagauuaucagcaacgcaaguaacacucg

SEQ ID NO: 4243659 - RNA, 56 nt, Pseudomonas aeruginosa PA01
ggccggcgacgguggccgaggucaaccaggaguggcuggccgacucguagccggcc

SEQ ID NO: 4243660 - RNA, 61 nt, Pseudomonas aeruginosa PA01
ccacggcacgcuugaucgccucggugugcuccagcuccaggcggauguucagcggccgcgg

SEQ ID NO: 4243661 - RNA, 55 nt, Pseudomonas aeruginosa PA01
gccgccgauggucugccggucguugagcaggacgaucggcugaccguccggcggc

SEQ ID NO: 4243662 - RNA, 64 nt, Pseudomonas aeruginosa PA01
gcugagcgccugcucgcggcugaucaauugggccucgaucacguccggcaggcgcucgaucugc

SEQ ID NO: 4243663 - RNA, 57 nt, Pseudomonas aeruginosa PA01
cugcaucggcggcggcgaggcgaccgcgaucgccgucgagcgcuugcgcugaugcag

SEQ ID NO: 4243664 - RNA, 75 nt, Pseudomonas aeruginosa PA01
cggguguucggcgugcuggcgcuggucaccgccaccggcggggugguguucaacgccagcaccgugaccuacccg

SEQ ID NO: 4243665 - RNA, 73 nt, Pseudomonas aeruginosa PA01
ucgcggcgacgacaaccaacuggugaccuucgccgucgacccggccagcggccaguugcguuucgucgaacgg

SEQ ID NO: 4243666 - RNA, 64 nt, Pseudomonas aeruginosa PA01
ggagcgugaaugagaaggggcugcagucgggaucaacauuccccugcgagccccuuuucgcuuc

SEQ ID NO: 4243667 - RNA, 61 nt, Pseudomonas aeruginosa PA01
gcuguuguugcugucgaacccacggaugcucuucgacgaugguggcgaaagcgacgacagc

SEQ ID NO: 4243668 - RNA, 114 nt, Pseudomonas aeruginosa PA01
ucccggcgcccucgccgaaguauuucggguccuugaacuccggcccggcgaaggcguagcccuugccgcgcgggguaucgaggaagccggucugcagcgggauggagucggcga

SEQ ID NO: 4243669 - RNA, 60 nt, Pseudomonas aeruginosa PA01
gcaaccugcucggccucgaccugcagggacagaguuggcaggcgcucgccgagcgggugc

SEQ ID NO: 4243670 - RNA, 83 nt, Pseudomonas aeruginosa PA01
cggcggauagcgccgcuggcgcuguucgcccuaccucacgacucccaccgguagggcgaauaaccgcucgcggucauccgccg

SEQ ID NO: 4243671 - RNA, 85 nt, Pseudomonas aeruginosa PA01
gggcaaccugaacagccagugcgcggugcugaccuggcuaccgaacaacgccacggaagcgauccgugccugguccagauagccc

SEQ ID NO: 4243672 - RNA, 91 nt, Pseudomonas aeruginosa PA01
ccguggcgccggauagcgccucggccaguucgucguucagugccagcaggcggcgggcauagccgagcagcguaucgccggcgucggucgg

SEQ ID NO: 4243673 - RNA, 75 nt, Pseudomonas aeruginosa PA01
agaagguguggugccgcgcgguguagccgacguuuuccaggucguugugcuugccgccggcgcgcacgcauuucu

SEQ ID NO: 4243674 - RNA, 89 nt, Pseudomonas aeruginosa PA01
gcugguacagcuggcucucgcucagguucucgucgacagucuccuuguucgaggagcaggcugcggugagggcgaggauggcgaucagc

SEQ ID NO: 4243675 - RNA, 77 nt, Pseudomonas aeruginosa PA01
cugcggcaauggaucgccgccgccggcgcagggcugcgcgacagccugcugcggcauggcggcauccuguuucgugg

SEQ ID NO: 4243676 - RNA, 87 nt, Pseudomonas aeruginosa PA01
gcagguccaucgggcagaccucgacgcagacggugcagcccuugucggcgaugcagcggucuucgucgauggucaccggggcgcugc

SEQ ID NO: 4243677 - RNA, 123 nt, Pseudomonas aeruginosa PA01
ggcgcgggcccggcccaccgacgcgaugccgacgaagccgauggcgugcggaucggcgcucaccgcggccgccagccgaucguuggauucgaagcggcgggcgucgcuggccaggcuuuugcc

SEQ ID NO: 4243678 - RNA, 82 nt, Pseudomonas aeruginosa PA01
agggugcgcugggcaucgagcacgucgaggaaguugaacuugcccaucucgaagccgcgggucaucgaguccagcgcgcucu

SEQ ID NO: 4243679 - RNA, 55 nt, Pseudomonas aeruginosa PA01
aacggcgagcaaugaaaaaggcgaucgaaggaucgccuuuuuuucguucgcuguu

SEQ ID NO: 4243680 - RNA, 63 nt, Pseudomonas aeruginosa PA01
gcgggucagccucugguccgagguggagcacgaguuucgcugaggcggcaguggcugaacugc

SEQ ID NO: 4243681 - RNA, 127 nt, Pseudomonas aeruginosa PA01
cucgguggacaagguggagaacggcaacacccugguggcccaggccggacagaccaugagcgacaucgugguagcgauccgccgggucaccgacaucaugucggagaucgccgccgccuccgccgag

SEQ ID NO: 4243682 - RNA, 79 nt, Pseudomonas aeruginosa PA01
cgacgacguuggggaacagggucuucuggucggcgaggacuuccagcuugaccagguugugcccguccagcagcucgcg

SEQ ID NO: 4243683 - RNA, 60 nt, Pseudomonas aeruginosa PA01
ucaggcaggccuugaagcaaggccagggccaugcccugcagccggucagggucggccugg

SEQ ID NO: 4243684 - RNA, 88 nt, Pseudomonas aeruginosa PA01
gcuguaccugaucuucgugguggucaccgcgcuuuccggcuacggcaagaucaagcucggugccgaccacgacgagccggaauucagc

SEQ ID NO: 4243685 - RNA, 81 nt, Pseudomonas aeruginosa PA01
cgcagcuggccgcugcgguuguuguggcugccaugugcggugcgggcgggccagaccaggacgucgccggcguccagcucg

SEQ ID NO: 4243686 - RNA, 69 nt, Pseudomonas aeruginosa PA01
gcgcgccgagggcgccgaccagcagggccaggcgcagcgacagucggccugguggcgucaucggcgcgc

SEQ ID NO: 4243687 - RNA, 87 nt, Pseudomonas aeruginosa PA01
aggcccacggccagggcuacggcgagcguaccgagggacacugggaguauccggugcgccugccguuccugauccgcgcgguggccu

SEQ ID NO: 4243688 - RNA, 63 nt, Pseudomonas aeruginosa PA01
agcccucggcguugacgaagcgcagcagcacgugcugcgcgucgcugcgcucgacgcugggcu

SEQ ID NO: 4243689 - RNA, 107 nt, Pseudomonas aeruginosa PA01
cgcgcaguauccgagcgaagucgguagcaccgucgagcuggagcaggcccugggccugccgccgguggacgugcugggcuccaccgacaagcugcuggugcugcucg

SEQ ID NO: 4243690 - RNA, 80 nt, Pseudomonas aeruginosa PA01
gucaggguguggcacagggcugccgagcgcauccaugacgcccgcaggcucacucggcagcaagcuguucgaaccccgac

SEQ ID NO: 4243691 - RNA, 58 nt, Pseudomonas aeruginosa PA01
cggccauggucucgcugacccaggcuucggcgcgcugguuuagcucggcgauggcgcg

SEQ ID NO: 4243692 - RNA, 82 nt, Pseudomonas aeruginosa PA01
gugcuucugcaacucggcgauggcuucguggccggcguugggucgggccgccaggcaagccuugccgaguuccgcgagguac

SEQ ID NO: 4243693 - RNA, 66 nt, Pseudomonas aeruginosa PA01
acccgcggccgcugaacauccgccuggagcuggagcacaccgaggcgaucaagcgugccguggagu

SEQ ID NO: 4243694 - RNA, 60 nt, Pseudomonas aeruginosa PA01
cgaggcuggcgcuggcuccgucggugaucgagucgccgagcgucaccagcguccgcguug

SEQ ID NO: 4243695 - RNA, 85 nt, Pseudomonas aeruginosa PA01
agagccagcgccuggagcuggaagugcucgcggugcugccgcaggagcguuucgcccgcgacgcgcuguucgccccgcuggcccu

SEQ ID NO: 4243696 - RNA, 55 nt, Pseudomonas aeruginosa PA01
cgucuggaaagcgucgacgcgcugcuuuacaacggcgccgacgaggauccugacg

SEQ ID NO: 4243697 - RNA, 79 nt, Pseudomonas aeruginosa PA01
gguggucgaugcgaagagcgccaacgucgagggcuaugucaccgagcaggcccucgacgggcucuucgagaugaucgcc

SEQ ID NO: 4243698 - RNA, 58 nt, Pseudomonas aeruginosa PA01
guugccggucggguugauguggaacuggguguccuugugcagcagcucggccggcagc

SEQ ID NO: 4243699 - RNA, 110 nt, Pseudomonas aeruginosa PA01
gcgccuggccguucugggcgaagcggugggacagcgagccgcuggcgaggaacgccaccgugccgucguagugcucuuccaccgccuugcgcauggcccagcccaggcgc

SEQ ID NO: 4243700 - RNA, 70 nt, Pseudomonas aeruginosa PA01
ccgaccuguucggccggcugcacgccauugaccaccucgauggcguguccgccggccuggagaaagucgg

SEQ ID NO: 4243701 - RNA, 79 nt, Pseudomonas aeruginosa PA01
ggugcgcgacaagcaguggucgcaggaaauccgccuggcuucgcccagcggcggcuucuucgacuacgugcucggcgcc

SEQ ID NO: 4243702 - RNA, 63 nt, Pseudomonas aeruginosa PA01
gaucgggcggaggcgcccgcgggucauucgauguucuggaccugcucgcgcaucugcucgauc

SEQ ID NO: 4243703 - RNA, 74 nt, Pseudomonas aeruginosa PA01
gcggcaagggcggcgucggcaagaccaaugugucggugaaccuggcacuggcucuggccgaucucggccgucgc

SEQ ID NO: 4243704 - RNA, 82 nt, Pseudomonas aeruginosa PA01
ccugggacgggaaggggauuacacguugaagcggaaaugcaucacgucgccguccuugacgauguaguccuugccuuccagg

SEQ ID NO: 4243705 - RNA, 67 nt, Pseudomonas aeruginosa PA01
ggccagcggcgggaucgccuuggucgggucgcguucgcgcagcaccgcuucgccgaucucgucggcc

SEQ ID NO: 4243706 - RNA, 61 nt, Pseudomonas aeruginosa PA01
ucgcgcgccggauagccgaccaccgccaccgccuggcgcggcucggcauccuggcgcgcga

SEQ ID NO: 4243707 - RNA, 88 nt, Pseudomonas aeruginosa PA01
gaucgacgggaugaaccagucgguggccaccgccaccgaggagcagaccgcgguggucgauucgcugaacauggacaucaccgagauc

SEQ ID NO: 4243708 - RNA, 93 nt, Pseudomonas aeruginosa PA01
auuucuggcucggcaaggacgguuucgacgccuuccucgccaaucugcgcaaaggggaggcgugauggcugcucaacccacgauccgcgaagu

SEQ ID NO: 4243709 - RNA, 64 nt, Pseudomonas aeruginosa PA01
ucgcgcgcagcgccaaggauggccugggcaaccucgcccgggguaccggccaguugugcggcga

SEQ ID NO: 4243710 - RNA, 69 nt, Pseudomonas aeruginosa PA01
guccaggcccugccagccggggaugcccagguucaucucggcgucauccagcaggcaggcguccagggc

SEQ ID NO: 4243711 - RNA, 66 nt, Pseudomonas aeruginosa PA01
cggcgcgagggccuccggaagcccggccaggcuuuccagguaggcgcguuccagguccuggcgccg

SEQ ID NO: 4243712 - RNA, 108 nt, Pseudomonas aeruginosa PA01
gccacggccuggcugaaccuguuccaguuggcggcguugcagcccggcgagaaagugcugcugcacgccggcgccagcggcgucgguucggccggcauccaauugugc

SEQ ID NO: 4243713 - RNA, 83 nt, Pseudomonas aeruginosa PA01
ccgguggccacggugcugcugaucuggaucggaguggucgacgucgauuaccugaagaagauccgcccguacgugaucaucgg

SEQ ID NO: 4243714 - RNA, 121 nt, Pseudomonas aeruginosa PA01
agggcuggcugcuaggcacccagucgcaccuggauuuuuugccggaaagccacaccgacuuuaucauugcgguccucggcgaggaguucggccuggucggcgucugccugcugcuggugcu

SEQ ID NO: 4243715 - RNA, 71 nt, Pseudomonas aeruginosa PA01
accgcggcgcgcucggaacccgguuuggccaggguggcccggccgauccggaucgggcgccuuccauaggu

SEQ ID NO: 4243716 - RNA, 76 nt, Pseudomonas aeruginosa PA01
ggcuaaaguucgguuuguuuugccgauuuggcaagcagcucgucgacucccgcaaaacagaccgggaaaaccggcc

SEQ ID NO: 4243717 - RNA, 87 nt, Pseudomonas aeruginosa PA01
ugugcgugcgcaggccggcggccuugccgcucugcucgcgcucguagccgaguaccgcgccgagcgccgccgccagcagcaggcgca

SEQ ID NO: 4243718 - RNA, 57 nt, Pseudomonas aeruginosa PA01
uggccagcucggcgccggcaugauaggccauggcguagccgucgccggcguuggucg

SEQ ID NO: 4243719 - RNA, 75 nt, Pseudomonas aeruginosa PA01
gcgguacaucucgaaggcguagcgggugcgcuugggcagcucggugagggcauccgcgauguguucgagggucgc

SEQ ID NO: 4243720 - RNA, 67 nt, Pseudomonas aeruginosa PA01
ggucucgccggacuugaccggauuccguucgccuugcuggcggaucgcggcgaaguccucccagauc

SEQ ID NO: 4243721 - RNA, 108 nt, Pseudomonas aeruginosa PA01
ugaucacucguccggugccgaucacgcacuggaauggccggccgcgcucguaggaggagucgaacagcgugccgucuuccagggugcccuuguacuggguggugauca

SEQ ID NO: 4243722 - RNA, 79 nt, Pseudomonas aeruginosa PA01
ucgugaagaacccggaagugaaggucggcgaccuggccaagcaggccggugccgaaaucguuuccuucguucguuacga

SEQ ID NO: 4243723 - RNA, 57 nt, Pseudomonas aeruginosa PA01
ggcgagcagcggcaggcugucgcgcagcagggcgccggcggccuugcgcagcuugcc

SEQ ID NO: 4243724 - RNA, 61 nt, Pseudomonas aeruginosa PA01
guaucucggcgaagguggaaggcgacgagaucgucuucgccugaccucuucguggacggac

SEQ ID NO: 4243725 - RNA, 125 nt, Pseudomonas aeruginosa PA01
ugccggccguuugcgaaugcucgggacuggugucgugaaauuuuaaguguuauuuuucaugaaaaauaaccaauauaauuucacggaggucgcgauguuccugcaauccaacgagcaugucggca

SEQ ID NO: 4243726 - RNA, 80 nt, Pseudomonas aeruginosa PA01
gcuggagcaacugggcuaugguuucgcucucgaugucgacaucgaugggcgcccgaucgagccgcaggcguuguaccagc

SEQ ID NO: 4243727 - RNA, 76 nt, Pseudomonas aeruginosa PA01
gaccggaucggggcgaacagcgggcauugcggcggaagucgcgggccagagcggucgccuuucauuguccuggguc

SEQ ID NO: 4243728 - RNA, 68 nt, Pseudomonas aeruginosa PA01
ggccuccgaggcgcucgguuacgaccuuugggcgcugguccagaaugguccugaagagcgccugaacc

SEQ ID NO: 4243729 - RNA, 67 nt, Pseudomonas aeruginosa PA01
gcgcccgucgaagggaacagcaggcgcaggugggucuucugcugcgguacgcuuuccgcuucggcgc

SEQ ID NO: 4243730 - RNA, 103 nt, Pseudomonas aeruginosa PA01
gcucucgaccuccaggcgcagucgcggacgcucuucggugaagcgcgucagcaccggcaucagcacuucgccggcgaggucuuccggcacgccgaggcgcagc

SEQ ID NO: 4243731 - RNA, 124 nt, Pseudomonas aeruginosa PA01
ccagacauggucgccguccggggucaccaggugcaggucgaggucgguguugucgcugucccaggacagcagcacgcgcagcuuggccggcacuuccccgccgccgccaccgugauagaacugg

SEQ ID NO: 4243732 - RNA, 73 nt, Pseudomonas aeruginosa PA01
uggugaccugccuggagggcagcgugcggcucgaacaccucggccagcgccuggaccuccaggccggccagca

SEQ ID NO: 4243733 - RNA, 62 nt, Pseudomonas aeruginosa PA01
gccgucgggcugcgcucaccuggaccugggggcgcagcgucaggugagcgcagccugacugc

SEQ ID NO: 4243734 - RNA, 109 nt, Pseudomonas aeruginosa PA01
aacuggucgaccggcaccuuggcggcgguguagguggcgcuguuggcggcgcuggcgccggcgccggcgauggugccgccgguggccaggaugaccacguuggacaguu

SEQ ID NO: 4243735 - RNA, 76 nt, Pseudomonas aeruginosa PA01
ucuggguauucggaguuugcaucgguuugguaagucgggaugacccccuagccgaaacagugcucuaccccccaga

SEQ ID NO: 4243736 - RNA, 68 nt, Pseudomonas aeruginosa PA01
cgcuauggugcaccgcgugcagccgccaaagcagcgccgaacgguggcuggcguagugcaccagggug

SEQ ID NO: 4243737 - RNA, 83 nt, Pseudomonas aeruginosa PA01
gccguccaggccgguaucggcgauccagccuucgaggucgucggcgaccuggcgcgggucgccuaccagggucacguagcggc

SEQ ID NO: 4243738 - RNA, 58 nt, Pseudomonas aeruginosa PA01
ggugcugaucggcuucuacggccuguucuuccucaccgugaagcugcgcaacagcgcc

SEQ ID NO: 4243739 - RNA, 58 nt, Pseudomonas aeruginosa PA01
ggugaaugcuucgcggaugcggcgugcggaguucugccccauccgcccaagcauuucc

SEQ ID NO: 4243740 - RNA, 78 nt, Pseudomonas aeruginosa PA01
cgucucaggccccgugcgcgggauguucgaaggcgccgggaucggccggcaggaucauucgcgccggggccuggcgcg

SEQ ID NO: 4243741 - RNA, 57 nt, Pseudomonas aeruginosa PA01
caucaccaugcccagcgacugcgcccaguccggcagcgcgguguagugcagguggug

SEQ ID NO: 4243742 - RNA, 77 nt, Pseudomonas aeruginosa PA01
gccaccacuucgucgaggucggagaccagcagugaggagacgugcgggaucuucgacucgauguauuccuuguuggc

SEQ ID NO: 4243743 - RNA, 72 nt, Pseudomonas aeruginosa PA01
cucgagagcggccugcgcuucggcgacauggacaucuuccaucgccacgaaagcauggccggcaauggcgag

SEQ ID NO: 4243744 - RNA, 64 nt, Pseudomonas aeruginosa PA01
cgagcggccagggccugcaccggacgcucgccgguguaggugacgcgcuuuggccggaugcucg

SEQ ID NO: 4243745 - RNA, 61 nt, Pseudomonas aeruginosa PA01
gucgcgggccugcggaugccugagcaguucuucgcugcuccaggucugcgugccccccggc

SEQ ID NO: 4243746 - RNA, 81 nt, Pseudomonas aeruginosa PA01
cugcgccgccuuggccgcgcccugcggggugaucgguccguuguugccgaucaggccgcaggcguggcccucgaugcgcag

SEQ ID NO: 4243747 - RNA, 79 nt, Pseudomonas aeruginosa PA01
acgcguucucgucgaaguccagggugaucuccaggccacggccgaagacgaucggcccgggcaucggcaggcgccgcgu

SEQ ID NO: 4243748 - RNA, 72 nt, Pseudomonas aeruginosa PA01
cuggcuggacggcggacaugcggacuggaacaucgcggugaaccuuucggcccugcaguucgcccaugccgg

SEQ ID NO: 4243749 - RNA, 77 nt, Pseudomonas aeruginosa PA01
cgucggguccucguugccgccaagccacugcagguucgauccgcaguggcggcagaagguacgggugacgccuggcg

SEQ ID NO: 4243750 - RNA, 64 nt, Pseudomonas aeruginosa PA01
gcugggcggcgagcagccggugaucgaguugccccucgaucacccgcggcagccgcugcgcagc

SEQ ID NO: 4243751 - RNA, 109 nt, Pseudomonas aeruginosa PA01
guucgggcggaucggcggcgaggaguucgccgugcugcugcccggcugcgacgagcagaccgcgcgacagaucggcgaacgccugcagcgcgaggugcaacgccugcgc

SEQ ID NO: 4243752 - RNA, 70 nt, Pseudomonas aeruginosa PA01
guugccgccagcuguagcgcaggcguugaugccgcaccaccagcgccucgcgcucggcaugacgcgcgac

SEQ ID NO: 4243753 - RNA, 81 nt, Pseudomonas aeruginosa PA01
gaagcccagcggguugaugucguagcucaccagcagguucuuggucugcugguaguggucgagcaucaucuugugcgucuc

SEQ ID NO: 4243754 - RNA, 84 nt, Pseudomonas aeruginosa PA01
caggccgaaggcggcguuguagguggcgaucaccucgccggcgauggagauggcgaucuccgccggcagcuugccuuucaccug

SEQ ID NO: 4243755 - RNA, 63 nt, Pseudomonas aeruginosa PA01
cggcggcagguuuucucgacgccgcaagcgaacgcccaccggcgaagaacaauuugcgcgccg

SEQ ID NO: 4243756 - RNA, 59 nt, Pseudomonas aeruginosa PA01
gcggcgugcuggcggaagaaugcagccaggcgcucucggcguucuuccgcgcgcggcgc

SEQ ID NO: 4243757 - RNA, 63 nt, Pseudomonas aeruginosa PA01
gggcgccugggccaggccgguuuccugcgccaggcgcgggcugaccaccgggcccaugcgcuc

SEQ ID NO: 4243758 - RNA, 82 nt, Pseudomonas aeruginosa PA01
ccaguagaugucgccgccgaccucguggcggaccagcagaaugcguugcuccaccaccagcaggccggcggcgcggauacgg

SEQ ID NO: 4243759 - RNA, 66 nt, Pseudomonas aeruginosa PA01
gcugcgccuggagcaggccugcgagcccgaucccccggagcugcugcaacugcgccaggcguucgc

SEQ ID NO: 4243760 - RNA, 64 nt, Pseudomonas aeruginosa PA01
gcgcuggcgcugagcguggcgaugaagcucuuggucgcugcgacgcugcgcucggcgccggcgc

SEQ ID NO: 4243761 - RNA, 82 nt, Pseudomonas aeruginosa PA01
gcgcccggggcgucggcugcaucgcacgaccggcgcggaccagcagcgggucgucgagcagcucgcgcaggcgguucagcgc

SEQ ID NO: 4243762 - RNA, 57 nt, Pseudomonas aeruginosa PA01
guucgucacucgucgaggaaggagcgaaggugcucgcuucgcgacggauggcgcagc

SEQ ID NO: 4243763 - RNA, 92 nt, Pseudomonas aeruginosa PA01
ugcaggcgcaggucgcugcugccgaggcugugcagcaucaggcugcgaaccuggaucucguccucggcgcggcagacgaucugcacuucgua

SEQ ID NO: 4243764 - RNA, 61 nt, Pseudomonas aeruginosa PA01
gggcgcgcagguugaggaugguggcgaucacguugaucgcgcccaugaucgagcugauccc

SEQ ID NO: 4243765 - RNA, 86 nt, Pseudomonas aeruginosa PA01
cgggagucucagaaguccagugccugcaccccuggaugcugcggaucgaacccauccaggcgcaugcgcucggcgaaugccucccg

SEQ ID NO: 4243766 - RNA, 55 nt, Pseudomonas aeruginosa PA01
aggccgaguugcgccaggacgaagacguucucgacaccugguucagcuccggccu

SEQ ID NO: 4243767 - RNA, 78 nt, Pseudomonas aeruginosa PA01
guugcggcacggucuucaccgucagcgaauagagcgcgccgagcuugaagcgcucggcggagaagccggccgccucgc

SEQ ID NO: 4243768 - RNA, 55 nt, Pseudomonas aeruginosa PA01
ucaggccuggccgucgcugccccgucgacucgcggccagcucggccaggcccugg

SEQ ID NO: 4243769 - RNA, 72 nt, Pseudomonas aeruginosa PA01
gcaggccgugcucggcgccgacgggcugccgcaggcuuggcugcaucgcucgguggcgccgagcaucaccgc

SEQ ID NO: 4243770 - RNA, 65 nt, Pseudomonas aeruginosa PA01
gugaaggugaugaacgucucgcugauccucuacgccgagcaugaguucaacgcauccaccuucac

SEQ ID NO: 4243771 - RNA, 122 nt, Pseudomonas aeruginosa PA01
uggggcggcgcgcagaccgggcaccuggccuacgccauggcccucgaggagaucgccgcuggcgacggcgccugcucgaccaucaugagcgugcacaacucggucggcugcaugccgaucca

SEQ ID NO: 4243772 - RNA, 80 nt, Pseudomonas aeruginosa PA01
ucagaauguacuuaauauuauucuucacagcaaagugauacauacuagcgaagaaggcaugaucuugaggcacauccuga

SEQ ID NO: 4243773 - RNA, 65 nt, Pseudomonas aeruginosa PA01
cugggaaacgucgccucgaccugcggcgccaucaggccgaggucgcgcaggggcgaguuuuccag

SEQ ID NO: 4243774 - RNA, 66 nt, Pseudomonas aeruginosa PA01
ggaucguagccuuggagaaaccguccucccaggagcagggccagugguauuuccagcgcuacaucc

SEQ ID NO: 4243775 - RNA, 86 nt, Pseudomonas aeruginosa PA01
gcaccucgcguucggaaucggccgacacccauugcaggccgcuauaggugcugcugagguagucggcuaccgaacugccggcccgc

SEQ ID NO: 4243776 - RNA, 65 nt, Pseudomonas aeruginosa PA01
cgucgccggugcggucgaggaagccgguguugaugaacaccacgcgauccuuggccgccuugaug

SEQ ID NO: 4243777 - RNA, 76 nt, Pseudomonas aeruginosa PA01
accggcuggccguugcgguggacccggcggaacugcccggugacguacucgccgcgguucaggcggcgccagaggu

SEQ ID NO: 4243778 - RNA, 82 nt, Pseudomonas aeruginosa PA01
cggucauaggcgcuuguucuuguagugguuugccuugaaguggccggagcauaaccgagcaggggcaggcugcccaaggccg

SEQ ID NO: 4243779 - RNA, 76 nt, Pseudomonas aeruginosa PA01
acgugcggcuggucgaggucagcgauccgcaauugcgcgugcaguugcgugaaguggccugggaccaggcgcaggu

SEQ ID NO: 4243780 - RNA, 60 nt, Pseudomonas aeruginosa PA01
gugagcgggaggaucgaauugcaggcggugcgcuucgccuauccgacccgucccgaacac

SEQ ID NO: 4243781 - RNA, 113 nt, Pseudomonas aeruginosa PA01
gguggaaaugccguucgacgucgcucgcccggcagaccggcccgaccugcucgucgaacagccagugggcauggcugccgggcggccagaggaagucguugcggcggaucgcc

SEQ ID NO: 4243782 - RNA, 63 nt, Pseudomonas aeruginosa PA01
uucaaggucgaggaguggguguacggcccgcgcaacggcgugaccuacauccugaccuucgaa

SEQ ID NO: 4243783 - RNA, 129 nt, Pseudomonas aeruginosa PA01
uggcggugagcggcgcccccucuucgcugacgaacgccggcagccacugcgccugcugcgaggggcugccccagcggcggaugcaguuggccgccgacaacggcaccagcagggccgccgccagcguca

SEQ ID NO: 4243784 - RNA, 97 nt, Pseudomonas aeruginosa PA01
ccugcuggacgccgagcaguucugaggccuggcgccugagacggaaagccccgcgaugcggggcuuuuuucugggcgccgggggcucggcgcgcggg

SEQ ID NO: 4243785 - RNA, 114 nt, Pseudomonas aeruginosa PA01
gcucccagacguccucgggcgccagcuugacgccgcgcggcaacagguugcggaacucgcagaacucgcgcauggcgucgagcaggcccuggcgcaggccguucacaugggugc

SEQ ID NO: 4243786 - RNA, 80 nt, Pseudomonas aeruginosa PA01
ggcuacagcgugguccucggcaaugccgccagucccggcgugcuggaacuggccaacaucgccgaggcgcgcugguugcu

SEQ ID NO: 4243787 - RNA, 80 nt, Pseudomonas aeruginosa PA01
cagcgcucgucggucugcaggcgguagucgcggccgaucucguggucgccgagguacuccgccagcgguucgagcaguug

SEQ ID NO: 4243788 - RNA, 56 nt, Pseudomonas aeruginosa PA01
ugccgugcuugaugaugccgccgaugaaguacagggcggucucggacaggccggca

SEQ ID NO: 4243789 - RNA, 69 nt, Pseudomonas aeruginosa PA01
gggcgaacugguggucggcgacaucgugcgccuguccgccggcgacaugauccccgccgacauccgccu

SEQ ID NO: 4243790 - RNA, 57 nt, Pseudomonas aeruginosa PA01
guugcaugaacggcgugccguucugggugaccaggaugccacccucguucaggcagc

SEQ ID NO: 4243791 - RNA, 74 nt, Pseudomonas aeruginosa PA01
ucgaccaagcuggcgaugucgauccgcgagaccccucagucggucagcguggucacccgccagcgcauggacga

SEQ ID NO: 4243792 - RNA, 130 nt, Pseudomonas aeruginosa PA01
ccugcccguccgccugauccugcgcgaccgccagcgccugcgccgcuaccaacaggccggcggacugagccugguggaagacggccaggccagccucuacccgaucgccgcggaaaccccggacggcggg

SEQ ID NO: 4243793 - RNA, 58 nt, Pseudomonas aeruginosa PA01
gccgaugacuuucggguuggcgccggggaaguuggcgcggaccacgacggucggcggc

SEQ ID NO: 4243794 - RNA, 66 nt, Pseudomonas aeruginosa PA01
ggccuuccucuggcuguucgccagcggacgcaaccugcguuacgccgaucccagccugaccgagcc

SEQ ID NO: 4243795 - RNA, 64 nt, Pseudomonas aeruginosa PA01
acauggcggacaguggcgauccgcaucccguccgggaugacgcauccccauuuucccuucgugu

SEQ ID NO: 4243796 - RNA, 81 nt, Pseudomonas aeruginosa PA01
cuggaccaaccgcagcgaggcgucuggcacggcgaucuccaugaacggauugccgccgcgcgccucgauccacucggccag

SEQ ID NO: 4243797 - RNA, 118 nt, Pseudomonas aeruginosa PA01
ggccugaucaucgccaucggcgcgcagaaugccuucguccucgcgcagagccugcgccgcgagcaucaccucucgguagccgcgcucugcguguucugcgacgcggugcuggucagcc

SEQ ID NO: 4243798 - RNA, 80 nt, Pseudomonas aeruginosa PA01
gcggcagcggccgcgacggucaaucgggaagcggcggcauaccuucgucgccccgaccgaccuugcgcaaccguacccgc

SEQ ID NO: 4243799 - RNA, 104 nt, Pseudomonas aeruginosa PA01
guuugucggucaugcucguguccuccucucgaggguugaaagggaugcggcguuuuucgccgcgugcacuuacuccgaaggcuugcgcgauggaucguucaaac

SEQ ID NO: 4243800 - RNA, 68 nt, Pseudomonas aeruginosa PA01
ggcuuucccgucgaugcggagcggauagccgcgauacgguuauccgcuccacucaacggggcgaggcc

SEQ ID NO: 4243801 - RNA, 60 nt, Pseudomonas aeruginosa PA01
cacgccaggccacguuuugccgggaggccgcuacacuucuggcagguacccggccggcug

SEQ ID NO: 4243802 - RNA, 55 nt, Pseudomonas aeruginosa PA01
ucgcucauggggccgaggccgucggggcggccggcgaacuccggguccauggcga

SEQ ID NO: 4243803 - RNA, 70 nt, Pseudomonas aeruginosa PA01
gccagcagauguacggccaugguuuguugaucccgauccccgacaucgaccacaccgacuucaugcuggu

SEQ ID NO: 4243804 - RNA, 83 nt, Pseudomonas aeruginosa PA01
gcgggucaagaagcugccggcgcagccgcgcgccagcuuccgcgaguggcuggccgccgcacgccgugcaggcuggggccugu

SEQ ID NO: 4243805 - RNA, 68 nt, Pseudomonas aeruginosa PA01
guacaccuuggcgcgacugucgagcagggucgcgagcagggcgaugccgauggcgccgccgagguugc

SEQ ID NO: 4243806 - RNA, 59 nt, Pseudomonas aeruginosa PA01
aagcggacccgcgccaggcugccaggucacccccggcgcaaccuggcgcggguccgcuu

SEQ ID NO: 4243807 - RNA, 68 nt, Pseudomonas aeruginosa PA01
cugccgcucaagggcgugaccuugccgcugagcggaucgugcaggguggccuccuugagcuucggcag

SEQ ID NO: 4243808 - RNA, 82 nt, Pseudomonas aeruginosa PA01
cggcaugcaucaggagcggcugaaccucggucugcuggcgagcaacuucaagcagauauucgguuguuucagcggugugcug

SEQ ID NO: 4243809 - RNA, 83 nt, Pseudomonas aeruginosa PA01
cggcgccggacgcacugcggugcgcgagauagaggggcgcaagcugcguuuuuccuacgccacgcugcgugccucgggcgucg

SEQ ID NO: 4243810 - RNA, 91 nt, Pseudomonas aeruginosa PA01
gcgcugcgccaggcggcgauggacgugcauggccgggccaugcagaacugagggcucagccgcgcaugccgaagccgcgcgccaucagcgu

SEQ ID NO: 4243811 - RNA, 92 nt, Pseudomonas aeruginosa PA01
cggcccgaauucggcgagggcuuguuccggcaacugguggaaggccgucgccgguugccgcgagccgagcaugcaguagccgggcagggccg

SEQ ID NO: 4243812 - RNA, 62 nt, Pseudomonas aeruginosa PA01
gcgggaagucgagggucuuggaguaggcggagaagccggcgacgaucaucuucggcuuaugc

SEQ ID NO: 4243813 - RNA, 55 nt, Pseudomonas aeruginosa PA01
gcacgggagugccggagguauugcugacccgcaaggugaccucgcgcucgcuggc

SEQ ID NO: 4243814 - RNA, 117 nt, Pseudomonas aeruginosa PA01
gcgcggucaucgcggcugccgacggcgaacugccagguccgugacucguggccguccuccggcuggccggggcgcucgaccuggagguccggcggcggguugcgguugaucgcacgc

SEQ ID NO: 4243815 - RNA, 60 nt, Pseudomonas aeruginosa PA01
ccacgucgccgaccaggcggccgucggccuggcgguugaugccgacgucgaugacgaugg

SEQ ID NO: 4243816 - RNA, 58 nt, Pseudomonas aeruginosa PA01
cuucaucucuucguugaugcgcguggcacguacguccagggcaccacggaagaugaag

SEQ ID NO: 4243817 - RNA, 75 nt, Pseudomonas aeruginosa PA01
ugauccugcuuggcgcggucggcgcgcuguccuacagcaagcuggggcagagcgaagacccgccguucaccuuca

SEQ ID NO: 4243818 - RNA, 102 nt, Pseudomonas aeruginosa PA01
gucggugcgccgaagguccgugccaugcaguugcugcggcaguacgaagauggcuaucgcggcagcuacgguggcgcgaucggcauucucgacagcgccggc

SEQ ID NO: 4243819 - RNA, 77 nt, Pseudomonas aeruginosa PA01
ggauggucaggucuucgcgcuugagcagcugcgcggccauggucgcggugaaaugcucgagggcgcaggugaucgcc

SEQ ID NO: 4243820 - RNA, 55 nt, Pseudomonas aeruginosa PA01
ugcggccgaggucgagguugcgcaggucggcgccgcgcaggucggccuuggcgca

SEQ ID NO: 4243821 - RNA, 72 nt, Pseudomonas aeruginosa PA01
ggcugacgugcuuccgguaugaagaagcccggcuccggccgggcuuuuucaugucucggauuucaacgcacc

SEQ ID NO: 4243822 - RNA, 88 nt, Pseudomonas aeruginosa PA01
ggccuucguggucggcacgguggaacuggugguggccggggugcucgacgaacuggccgccaguuucgccgucagccagggccgggcc

SEQ ID NO: 4243823 - RNA, 72 nt, Pseudomonas aeruginosa PA01
gccugcuccuggccgaaaagggccucgacuaccaguuggaagcgaucgccccguucggccagccggccuggu

SEQ ID NO: 4243824 - RNA, 79 nt, Pseudomonas aeruginosa PA01
cguauuucuuguugugcuugucggucauggcuguggccuuguggcuauggcaggaaagagcgggcggucaggaagcgcg

SEQ ID NO: 4243825 - RNA, 78 nt, Pseudomonas aeruginosa PA01
gugggcgggcugcgccaggguguugccaggcagggccggcaggcgcgccaggugcagcgagaccaauaccgcgaccac

SEQ ID NO: 4243826 - RNA, 60 nt, Pseudomonas aeruginosa PA01
guccagcgcagcaccagcucgccgccguagaccuggccaucgacgcucagcucguugggc

SEQ ID NO: 4243827 - RNA, 112 nt, Pseudomonas aeruginosa PA01
uucuuggucacggaaacucucucgaacgauggaaugcgcagguacgacggcccccuucgcgggggccgucagcgguucauuccauuuccuucagccacucgguguucuugaa

SEQ ID NO: 4243828 - RNA, 92 nt, Pseudomonas aeruginosa PA01
ggucguagcccauggucagcgguagguguacccagggugcgccggggaucaggucgccgcugaauaccaccgggccgucgggcauggcgauc

SEQ ID NO: 4243829 - RNA, 91 nt, Pseudomonas aeruginosa PA01
cgccgugucgccgucacgggcgucgagcgcccggcuggcgccgaauucgccggcuagggcgaggcgcucgggacugacgucgaccgcggcg

SEQ ID NO: 4243830 - RNA, 85 nt, Pseudomonas aeruginosa PA01
cuucuccaugaagcccuuggcgucgcgcaccgggcggucguucuccaggucguagcggacgauggcguagguggcuggggagaag

SEQ ID NO: 4243831 - RNA, 71 nt, Pseudomonas aeruginosa PA01
cggccaccaucgauuggugaucccgccgcgaccgcagagcgaaggcgcgccgcggaucgccaucgaggccg

SEQ ID NO: 4243832 - RNA, 70 nt, Pseudomonas aeruginosa PA01
ucuucggucuuggugucacggcugucggccaggaaacgauaggcuugcagcagugcggccggaccgagga

SEQ ID NO: 4243833 - RNA, 75 nt, Pseudomonas aeruginosa PA01
ggcaugcucagcgcccugcgccgcagcuucgaccugauccacgcgcugcgcggcggcaagcgguugagcaucgcc

SEQ ID NO: 4243834 - RNA, 57 nt, Pseudomonas aeruginosa PA01
gcacgccuaccgaguagaguugcuucaccagcaggugcaaaccggugccuggcgugc

SEQ ID NO: 4243835 - RNA, 81 nt, Pseudomonas aeruginosa PA01
gcccugaucgccgguugaugcggguuccgguaggggaagcgccgugcuuccucugucgguucgcauaggucggcgcguggc

SEQ ID NO: 4243836 - RNA, 60 nt, Pseudomonas aeruginosa PA01
cacaucugggacaaggcguucaucggcgguucgcugguggcgaccuucuuccagggcgug

SEQ ID NO: 4243837 - RNA, 89 nt, Pseudomonas aeruginosa PA01
cggccagccgcugagcccgcagcgccggcgccugcucgccgcccucggccagccucuggcccaggcccuggcgcgggcucgccuggccg

SEQ ID NO: 4243838 - RNA, 106 nt, Pseudomonas aeruginosa PA01
gcaguuucaugaagguuuagguacuucgaaguuaccgcguuggcgauggaaucgauaucguccgguagugccuucggaagugccugauaagugccuucccacgcuc

SEQ ID NO: 4243839 - RNA, 70 nt, Pseudomonas aeruginosa PA01
cuucuucagcuugaucacgucgaacaguuggcagaccgcuucauccuugucgcugaucagcucgaagggg

SEQ ID NO: 4243840 - RNA, 83 nt, Pseudomonas aeruginosa PA01
ccgaacagcccgucggccagggucaggcgcaggucgcccucgguuauggcggccuucaggcccuggcggaauacgcugugcgg

SEQ ID NO: 4243841 - RNA, 77 nt, Pseudomonas aeruginosa PA01
ggucggcgggcuugccgcgcucaagcgcuggcucggcgagcgucagucggcguuccucgccggcaagccuggcgacc

SEQ ID NO: 4243842 - RNA, 77 nt, Pseudomonas aeruginosa PA01
uccacgccggucggguagccguugagcagcaggcguccugccuucuguuccaggagcgguaccaggucggcgaagga

SEQ ID NO: 4243843 - RNA, 66 nt, Pseudomonas aeruginosa PA01
ggccucggccuggucgucguaguggccgucgaagggcacgccgcucugcccgaccggguugaugcc

SEQ ID NO: 4243844 - RNA, 59 nt, Pseudomonas aeruginosa PA01
cugucggcggugaugaaguaguccggcaggcgucgcgccgggucgucgcuguccggcag

SEQ ID NO: 4243845 - RNA, 73 nt, Pseudomonas aeruginosa PA01
gguggaaguggacggguacugcuucaugaagucagccagguucuugaugucagcguagcuguucucuuugacc

SEQ ID NO: 4243846 - RNA, 63 nt, Pseudomonas aeruginosa PA01
ggcgucgcgcaguucgaaggcgggaaacagcucuuccaguucucgccauagcugcgcagcgcc

SEQ ID NO: 4243847 - RNA, 73 nt, Pseudomonas aeruginosa PA01
gcgcggguccugguggauggucgcgagcuggucgacaaccaccaguucuaccucgccacccggacuuacgcgc

SEQ ID NO: 4243848 - RNA, 99 nt, Pseudomonas aeruginosa PA01
gaaucuguccuugccgcccagcccggugucuucccaggucuucucgccggccagcagaagaggauagacauggggaggggcgugcccgccgaucuuuuc

SEQ ID NO: 4243849 - RNA, 55 nt, Pseudomonas aeruginosa PA01
gugccgaacagcgccaggcgcaccgccugcugggccuggcgggccaguucggcgc

SEQ ID NO: 4243850 - RNA, 60 nt, Pseudomonas aeruginosa PA01
gcacgucgagcuugguggcgaaguccucggggaucgcccgggucacgaaguugacgaugc

SEQ ID NO: 4243851 - RNA, 84 nt, Pseudomonas aeruginosa PA01
ccucggccaccaggcgcuuguguaccacuuccagggcggcgugcuucuggcagacgaucagcaggcugcgcuggcggccgaugg

SEQ ID NO: 4243852 - RNA, 69 nt, Pseudomonas aeruginosa PA01
gguuggcgaaugacggcggcggccugggugggcgccucucuggcguuggccccgcccucggcgccggcc

SEQ ID NO: 4243853 - RNA, 127 nt, Pseudomonas aeruginosa PA01
ggcccagucguccgguugcagccguaccauccagcccucgccguagcaaucccgguugaucagcgccgggcgcuugaccaccgccggguugcucgccagcagggucccggccaacgggcugcgggcc

SEQ ID NO: 4243854 - RNA, 109 nt, Pseudomonas aeruginosa PA01
gggugucgccgguggucacguccuucaugccgaucagcgcggcgaugucgccggcgcgcacuuccuugaucucgucgcgcugguuggcgugcaucugcaccauccgccc

SEQ ID NO: 4243855 - RNA, 57 nt, Pseudomonas aeruginosa PA01
gagaucagcggccgcuggcugcccugguucgccguggcggcggcgcugcugaucguc

SEQ ID NO: 4243856 - RNA, 92 nt, Pseudomonas aeruginosa PA01
gccuggauacgggcgccaggggugccuugccaagguguggccgagccccgguuacucgccggcauuggcacccuggacccgggccuccuggc

SEQ ID NO: 4243857 - RNA, 87 nt, Pseudomonas aeruginosa PA01
gccuugagcaguugcuggcccaggugauggccgucaagcuggaagucuucgacgccgcgcgccugcgccugcaacuggagcagcggc

SEQ ID NO: 4243858 - RNA, 66 nt, Pseudomonas aeruginosa PA01
cagcaggccggcuucggugcaguguuccuugaccucggagagggccuuuuccaagccggccaccug

SEQ ID NO: 4243859 - RNA, 75 nt, Pseudomonas aeruginosa PA01
uggcgaaggcgaugcucuccggcgucagggugagcgcgaccuggccguggcgccgguagaggaacacgcccgcca

SEQ ID NO: 4243860 - RNA, 88 nt, Pseudomonas aeruginosa PA01
gccgucgagguaggccuggaagcuggccaucacccgcggauaguccucgggauggaugaugcucuuccaggucuccacgcucuccggc

SEQ ID NO: 4243861 - RNA, 61 nt, Pseudomonas aeruginosa PA01
aaccggcuuccacuacgcugaaagccgacgaugccgagguuuucggcguccuggaaggguu

SEQ ID NO: 4243862 - RNA, 91 nt, Pseudomonas aeruginosa PA01
gggcaggagcauguguuggucaucacccagcaccauaucguguccgacgguuggucgaugcaggugauggucgacgaacugcuccaggccu

SEQ ID NO: 4243863 - RNA, 61 nt, Pseudomonas aeruginosa PA01
ggucugcgaagaauacguacggguuaccgagaaacucgguauccccuauguguucaaggcc

SEQ ID NO: 4243864 - RNA, 91 nt, Pseudomonas aeruginosa PA01
gccuggucaugcugaugaccggugcaucgucuauccgcgaagugaucgccuucccgaagacccagagcgcuggcgacgucaugacccaggc

SEQ ID NO: 4243865 - RNA, 70 nt, Pseudomonas aeruginosa PA01
gggcccaggccgccaucaacuggccgacggcgcccgccgcgccguacagcaggaugcgugugccgggccc

SEQ ID NO: 4243866 - RNA, 83 nt, Pseudomonas aeruginosa PA01
ccugccguucgacgccaugcucggcgcgcugaaggcguuuuccggccuggcucaucgcugccaguggguacgcgagcggcagg

SEQ ID NO: 4243867 - RNA, 55 nt, Pseudomonas aeruginosa PA01
gcugcgcaucggcaccgaaggcgccuacccgcccuucaacggcaucgaugccagc

SEQ ID NO: 4243868 - RNA, 59 nt, Pseudomonas aeruginosa PA01
gcggcugguugaucucgugggcgaugcccgaggccaguucgccgagagugaccagccgc

SEQ ID NO: 4243869 - RNA, 55 nt, Pseudomonas aeruginosa PA01
gguugucuguugcugccugacacaagauauugauucccgucagguacggauaacu

SEQ ID NO: 4243870 - RNA, 66 nt, Pseudomonas aeruginosa PA01
gacggugcgguucauguagaugauguugagaucguugucggcgaucaucacguuggccgagacguu

SEQ ID NO: 4243871 - RNA, 77 nt, Pseudomonas aeruginosa PA01
gaccgagaccccgcuggcgcugacguuggcgaugcggccgcuguugaucccgaccagggcgccgagcgaagacgguc

SEQ ID NO: 4243872 - RNA, 93 nt, Pseudomonas aeruginosa PA01
gccaacugaaccagaguugcugggugaaggcgaugaucgcgccgaccgccaggaucaacagcgccucgccuugcaggaggcgguucaggcggc

SEQ ID NO: 4243873 - RNA, 61 nt, Pseudomonas aeruginosa PA01
ucgcuucgcagcguagauguagucgcuccggaggugcgcuaccugggggcugcgguagcga

SEQ ID NO: 4243874 - RNA, 63 nt, Pseudomonas aeruginosa PA01
uggccggugucgaacgggugcccucgcgggcauggccgcgcaccuggucgggggcgcuggccg

SEQ ID NO: 4243875 - RNA, 90 nt, Pseudomonas aeruginosa PA01
gucccggcggggcaucagcguucgcggcauguccagcgagcacacccuggugcugguggacggccagcggaucuccaccucguccggggc

SEQ ID NO: 4243876 - RNA, 129 nt, Pseudomonas aeruginosa PA01
gccgucgcgggugaagaugcaggugccguugccguauucguggucguugaucaacugcauggccucuuccaggcuguugacgcgaaccacgcacagcaccgggccgaagaucucuuccuuguagauggu

SEQ ID NO: 4243877 - RNA, 68 nt, Pseudomonas aeruginosa PA01
cgcgcacgccgauuccuuggcccagguaggccacuugcgggccguugggaaucggcgggaaggcgucg

SEQ ID NO: 4243878 - RNA, 80 nt, Pseudomonas aeruginosa PA01
ucguaggccgcaccgccgugguagcggcgcagcagucccuguucggcgagcugguugaugucgcggcggauggucugcgg

SEQ ID NO: 4243879 - RNA, 77 nt, Pseudomonas aeruginosa PA01
gguccaguucguagcgggagaucgccaguugauggcgcgagccguauucgcagaccuuuuccgagacguacuggacc

SEQ ID NO: 4243880 - RNA, 60 nt, Pseudomonas aeruginosa PA01
gccggucggcacaucguugacgaagcgccagcugucgcucucgacgauguugccggcggc

SEQ ID NO: 4243881 - RNA, 58 nt, Pseudomonas aeruginosa PA01
uccugcucggccucgcccgagguguggcgguccaccacccggccgagagcgggcagga

SEQ ID NO: 4243882 - RNA, 100 nt, Pseudomonas aeruginosa PA01
gucguccaucgccaggcccugcuccagguucgccggcgcggucggcacccagcucgccaguugcgcgggcagacgcugggcggccuggcgguuggucggc

SEQ ID NO: 4243883 - RNA, 55 nt, Pseudomonas aeruginosa PA01
ggauuucuuccuggguggcagccugggcggacagcgcgccagccaggcagaaacc

SEQ ID NO: 4243884 - RNA, 57 nt, Pseudomonas aeruginosa PA01
ggggugauccagcucaccggcguggccagccgcuacgucggccuguggaucgccgcc

SEQ ID NO: 4243885 - RNA, 55 nt, Pseudomonas aeruginosa PA01
cagggucaagcugcgacgugccgcacguuguguggacgugguggguugcaccuug

SEQ ID NO: 4243886 - RNA, 74 nt, Pseudomonas aeruginosa PA01
gguugcuggccuucaguucgagcaucgucuggcucagcgcgucggugcgcucgcggaccugcucggccagcacc

SEQ ID NO: 4243887 - RNA, 58 nt, Pseudomonas aeruginosa PA01
gguggcaggaugcgcagacuggagccccccaugugcgacacccugauccuucgccacc

SEQ ID NO: 4243888 - RNA, 84 nt, Pseudomonas aeruginosa PA01
gcuugcccagaccgcgagcggugcgcuuggucuuacccuugacguucaggguagugacgcgcuguaccuucacgcugaacaggc

SEQ ID NO: 4243889 - RNA, 97 nt, Pseudomonas aeruginosa PA01
gucgacaccgcgcggcaggugcgccaucggugccucggccggcaggccggcggccaguuggcgggccaccguggcgcugaaggccugcagggucggc

SEQ ID NO: 4243890 - RNA, 85 nt, Pseudomonas aeruginosa PA01
gcucaccgugccaccccgccggacagccgcgaugcacuggcguagugccuugccgcugcuggcuucgagcuugagcgcggugagc

SEQ ID NO: 4243891 - RNA, 61 nt, Pseudomonas aeruginosa PA01
ccaggcacuguuggcgugguaagcuagcacagccagaacugcaacagcccgcagccccugg

SEQ ID NO: 4243892 - RNA, 56 nt, Pseudomonas aeruginosa PA01
gcgcggcgaggaacugcugagcgauuacgcucuccucggcaccacccucggcccgc

SEQ ID NO: 4243893 - RNA, 77 nt, Pseudomonas aeruginosa PA01
cgcagcgagguuucgccagccauggucgguccgcgucggguggaucggaaaagugcuggcgaguguggccgcgggcg

SEQ ID NO: 4243894 - RNA, 105 nt, Pseudomonas aeruginosa PA01
gccuucuaccugucgcggcggcugguacgcgguaucgucggcccgcucgaccaacuggcgaaggucgcgcauaccgugcgccgcgaacgggauuucgagaagcgc

SEQ ID NO: 4243895 - RNA, 64 nt, Pseudomonas aeruginosa PA01
ggagaagguucgcgcgcgucuggagauccuccuggagcagaccggcgccgacgagcuuaucuuc

SEQ ID NO: 4243896 - RNA, 56 nt, Pseudomonas aeruginosa PA01
aucgcgauggugguggccgggcugaucaucggcaaccacggacgccacuacgcgau

SEQ ID NO: 4243897 - RNA, 62 nt, Pseudomonas aeruginosa PA01
gggggugcugguggcggcgauccugguugugccgaucggcgucgcccacgccggcgccgacc

SEQ ID NO: 4243898 - RNA, 85 nt, Pseudomonas aeruginosa PA01
gccgcuggccaccggagagcugcucgggauagcggucggcgagccagucgagcugcaccauguugagcagcucguggaccuuggc

SEQ ID NO: 4243899 - RNA, 70 nt, Pseudomonas aeruginosa PA01
gguucgaaaccggugggcaacuggccggcggacuucaccgucagcgcacgguagcuguccaccuugaacu

SEQ ID NO: 4243900 - RNA, 74 nt, Pseudomonas aeruginosa PA01
ggagcauguggggaugccggcgagcaagguccaucgcuaucugcaggcauugaucgccagcggcuucgcggucc

SEQ ID NO: 4243901 - RNA, 70 nt, Pseudomonas aeruginosa PA01
agccggucagcgggaugguccgcaguaccuugcccugcaaggacagcucgaugaucugcgccggcugguu

SEQ ID NO: 4243902 - RNA, 113 nt, Pseudomonas aeruginosa PA01
ggucaggccgucgccaucgccguagcgaccguugucguaggcgagccggccgccguggucggccgacuugaggaugacguugaucaccccggcgauggcguccgagccguacu

SEQ ID NO: 4243903 - RNA, 68 nt, Pseudomonas aeruginosa PA01
ugggaugggaugcgugcagugggcugcuugugcaacauuugcgagguaggugauuuauguauuuccca

SEQ ID NO: 4243904 - RNA, 70 nt, Pseudomonas aeruginosa PA01
ggcggcgacuuccgacucgcugccgaugcgcuugagcggcacgugcucgcgcagggucgggaucaccgcc

SEQ ID NO: 4243905 - RNA, 57 nt, Pseudomonas aeruginosa PA01
gagcaggugauaggcgaugcgcuugaccaguggugcguaacgcuggaucaguugcuc

SEQ ID NO: 4243906 - RNA, 90 nt, Pseudomonas aeruginosa PA01
ggacauccgugagcggcuggcggcuccugcugacgcgccccgacgaggagugcgcggcccuggccgccagccucggcgaggcgggcgucc

SEQ ID NO: 4243907 - RNA, 56 nt, Pseudomonas aeruginosa PA01
gcgcggcgcuggcccgaaccagcacgcgcaucgugcuggucgaauaccgcgcccgc

SEQ ID NO: 4243908 - RNA, 58 nt, Pseudomonas aeruginosa PA01
gccggagcugccggccgaccugucggcgaugcccuacgucggcugggagcguucgcgc

SEQ ID NO: 4243909 - RNA, 61 nt, Pseudomonas aeruginosa PA01
ccgcugaugcucgccggccugcugcuguucaccuucggcuucuucggcgcgcacucggugg

SEQ ID NO: 4243910 - RNA, 68 nt, Pseudomonas aeruginosa PA01
gcaugaugcauugggugaugccggcggcgaugcucggcaucgcgugcggcagcucgaugcgcgucagc

SEQ ID NO: 4243911 - RNA, 60 nt, Pseudomonas aeruginosa PA01
gcgcgguggucuucaggccggcgacgucggagccggcgccgaccucggagacgccgaugc

SEQ ID NO: 4243912 - RNA, 57 nt, Pseudomonas aeruginosa PA01
gccagguguccagguccugccaaccguccagggcgcgggucaggaggaucgccuggc

SEQ ID NO: 4243913 - RNA, 73 nt, Pseudomonas aeruginosa PA01
gaccgacggaucgcucggcgggguuucgcugcacagguaggcgaagacguccuugagcagguaggcgucgguc

SEQ ID NO: 4243914 - RNA, 81 nt, Pseudomonas aeruginosa PA01
ucgccaccuucguuuccgccggcgacagcaguucggcguugcgccgggcgcuggucugcgcggugcuggcggugguggcga

SEQ ID NO: 4243915 - RNA, 64 nt, Pseudomonas aeruginosa PA01
gguaaugggcguggauaucggcaugaccguguucguguucguguucguguucguguucguggcc

SEQ ID NO: 4243916 - RNA, 68 nt, Pseudomonas aeruginosa PA01
auguucuccugcggcaugggugcguucaucgccggcaacgacggacgcacuucgcugcgggucggcau

SEQ ID NO: 4243917 - RNA, 117 nt, Pseudomonas aeruginosa PA01
ccgcuagaggccgaguccuucgcuggcugcccagcgcgccaucaggcgguucgacggcaggcuuucgucgagcagcuugcgcgcgcuuuccacccccgcgaccggcaggcccugcgg

SEQ ID NO: 4243918 - RNA, 116 nt, Pseudomonas aeruginosa PA01
gcgcauguacugcuggcuggcaucgacccacggcugguggucccagcuggccagccguccucgcgccagcgcggcggccaccaggcgucggcggcgcuggcugucgaguacggcgc

SEQ ID NO: 4243919 - RNA, 80 nt, Pseudomonas aeruginosa PA01
gaggcgcugcugcucugguaucgccgccugggccuggacgugcucgaggucuacgggaugaccgagaacagcggcuacuc

SEQ ID NO: 4243920 - RNA, 82 nt, Pseudomonas aeruginosa PA01
ggcgacagcgcggugggcggcagcgggguuucgguggucgugccgcugaccucgcaacugccgcccgaccuggcgcggcgcc

SEQ ID NO: 4243921 - RNA, 69 nt, Pseudomonas aeruginosa PA01
ggcgacaggcgcggguacuggugcagcccgcacugcggacacugcaucacccgcucgugguccugcgcc

SEQ ID NO: 4243922 - RNA, 57 nt, Pseudomonas aeruginosa PA01
ggcgagcuuggcggcgauggcguagggcacgccgcugcccauggucgccagcuugcc

SEQ ID NO: 4243923 - RNA, 122 nt, Pseudomonas aeruginosa PA01
ccagggcgaugaagcgccgcacgccgucgucgugcaccgacaacugcggcaauucgcgaucacccgccuccaccaguugcgcgccguccucggugccacgggcuaugcggccuucgcgcugg

SEQ ID NO: 4243924 - RNA, 73 nt, Pseudomonas aeruginosa PA01
ggccgccgucggcguaaagcgcuuuggcugacccgcgggucaugcgcgauugcgcuugcgcggccucccggcc

SEQ ID NO: 4243925 - RNA, 97 nt, Pseudomonas aeruginosa PA01
cguagccugcgcgagcguggccuggcugaagagcgccuggcccucgcggucgaggugcucgacgaccaggcccugcgcgaccugcugcaacgcuacg

SEQ ID NO: 4243926 - RNA, 67 nt, Pseudomonas aeruginosa PA01
gcgcgacagcucgaacagacgcuggccggcgaaagcgucggucagcgguuccgggccgagguugcgc

SEQ ID NO: 4243927 - RNA, 65 nt, Pseudomonas aeruginosa PA01
gcuggaggucggcacgccgcuggcgcucgccggcauacagcgccagggcacgcucgaccucgcgc

SEQ ID NO: 4243928 - RNA, 64 nt, Pseudomonas aeruginosa PA01
ggccugcgggucagccugcgcuugccacgccuggggcuggagugaugggcuggccugucgggcc

SEQ ID NO: 4243929 - RNA, 94 nt, Pseudomonas aeruginosa PA01
gcugcuggggugcggcgggggugcccugggccggagcggcgggaaccugcgcgcccucgcucgccaccggcggcgcucccucggccugggcagc

SEQ ID NO: 4243930 - RNA, 78 nt, Pseudomonas aeruginosa PA01
cucgaugggacggucgagcagcacgucgagguucucgaaggcgacccggcgcagaugcgcgucgaucagucggucgag

SEQ ID NO: 4243931 - RNA, 87 nt, Pseudomonas aeruginosa PA01
gggugcgcccgcugccaucgauggcgacgaacacgaacaccgccucggugacuuugcgccauucgcuggacagcgggucgucgcucc

SEQ ID NO: 4243932 - RNA, 78 nt, Pseudomonas aeruginosa PA01
uguccagggugucguugaaggugaagaugggacgguugaugcuuucccaagggucuucuucacuggccgccagggaca

SEQ ID NO: 4243933 - RNA, 60 nt, Pseudomonas aeruginosa PA01
cagggccacauggagauggaacccaugaucugccguccguucacucuuugucuggcccug

SEQ ID NO: 4243934 - RNA, 62 nt, Pseudomonas aeruginosa PA01
cgacguguugcagcaggcuggcaucgagguagcccuccugccauagccguugcagggcuucg

SEQ ID NO: 4243935 - RNA, 72 nt, Pseudomonas aeruginosa PA01
gcaggacgucgcacagcgcgccgaggccgguacugaugccguaggcacgcucgccguuggcgacgauacggc

SEQ ID NO: 4243936 - RNA, 55 nt, Pseudomonas aeruginosa PA01
cagcaccuggcgcaucgccguggcgcugccgccauugggcgugucgcgggugcug

SEQ ID NO: 4243937 - RNA, 56 nt, Pseudomonas aeruginosa PA01
gcggaauggcugucgccccaacugaccagcagcggucguucggcagccaguuccgc

SEQ ID NO: 4243938 - RNA, 63 nt, Pseudomonas aeruginosa PA01
ggcgacgccaucaaccuguuccgcuggcgccgcggugccauggcgcaggucgaugcgcgcgcc

SEQ ID NO: 4243939 - RNA, 67 nt, Pseudomonas aeruginosa PA01
ugguggcgggacaaugacacuggccucauuaggcaaugggggcaggucacuugccccgccgaugccg

SEQ ID NO: 4243940 - RNA, 62 nt, Pseudomonas aeruginosa PA01
gccgaaaccgccgccgagcagggucacguugaccgugaccuugucgaacggcaguuucaggc

SEQ ID NO: 4243941 - RNA, 80 nt, Pseudomonas aeruginosa PA01
cgauagucggccucggcagucgcgauuucggcgcgcuggucaccgcgcugagccgcaauagccgcagcaaccugcugucg

SEQ ID NO: 4243942 - RNA, 66 nt, Pseudomonas aeruginosa PA01
gcgacuggucgcagcgcugggacuacgugaucugaucggccuggcccaggugcugcagccaguugc

SEQ ID NO: 4243943 - RNA, 98 nt, Pseudomonas aeruginosa PA01
gcaagcgcugccugggcgccuacgugcugaaucgggaaagcggcgaagucgauaccuuccgugcccgcuucagcgugcuggccuccgguggcgcgagc

SEQ ID NO: 4243944 - RNA, 97 nt, Pseudomonas aeruginosa PA01
gcggcgaucuggucccauagccggcgaagguagcggaugucggcgagaaucucguccucgcccgcaccuuccgcggcggugcgcaggaugaagccgc

SEQ ID NO: 4243945 - RNA, 75 nt, Pseudomonas aeruginosa PA01
cccggccguuguugcagccgaccuggaccgccgccuugccggccagguccagauugcgcagcacgccagccaggg

SEQ ID NO: 4243946 - RNA, 75 nt, Pseudomonas aeruginosa PA01
gccgaggauuucgccgacaugccggcggaguuccaucaugagccugaacucggccuggccugcggcgacgacggc

SEQ ID NO: 4243947 - RNA, 71 nt, Pseudomonas aeruginosa PA01
gccgacccgcugauccucaaguugcgcgaacuggccgaacgucuucgcgaauugaaggacagcgucaaggc

SEQ ID NO: 4243948 - RNA, 57 nt, Pseudomonas aeruginosa PA01
cggauuucggccuggcuccgguaggcgccgaccuacaggacgccaaggccgaagccg

SEQ ID NO: 4243949 - RNA, 62 nt, Pseudomonas aeruginosa PA01
guuguugcuggccaguuggccggacuugaucgacaacucgccggccuuggccagcggcgcac

SEQ ID NO: 4243950 - RNA, 77 nt, Pseudomonas aeruginosa PA01
gguggcgaggguggcgacgagcagcgaguucuucgccgcgcggaggauuuccggaucguuggccaccaccgcauacc

SEQ ID NO: 4243951 - RNA, 61 nt, Pseudomonas aeruginosa PA01
uggccggauugccgccgggcguauaggcgucgacgaggcguugccaggugauagccggcca

SEQ ID NO: 4243952 - RNA, 98 nt, Pseudomonas putida KT2440
uccggccucuucgcgggcaagcccgcuccuacaacgacugcgcccgccugaagauugugcgaucugugcaggaacgggcuugccgcuaagaggccgga

SEQ ID NO: 4243953 - RNA, 66 nt, Pseudomonas putida KT2440
cucgacgaagcgggcaccgccgucuucuguuucgagggcagagcagaugcggucuugcaggucgag

SEQ ID NO: 4243954 - RNA, 62 nt, Pseudomonas putida KT2440
ggcugugugucaguucaagcacgaugaccgaggcggucaguggcgagcgugucacaccggcc

SEQ ID NO: 4243955 - RNA, 64 nt, Pseudomonas putida KT2440
ggccucggccuugccuuugguggccuggcgcacggccagggcaacgcgggcagcggucuggguc

SEQ ID NO: 4243956 - RNA, 87 nt, Pseudomonas putida KT2440
cagugccuggcuacggucauucagcaccacggccagacugcguucgugcaggcugagggccugggucacuguugcagccaagugcug

SEQ ID NO: 4243957 - RNA, 86 nt, Pseudomonas putida KT2440
gggucagcagaucgaccugucgaugcgcauguuugcgggugcgcaaguggcgagcaugcuguugacguucuuguugcuggugaucc

SEQ ID NO: 4243958 - RNA, 93 nt, Pseudomonas putida KT2440
cccagcagcaugacaucggcgaaguccugaugcuggccuggaugaacgaaaaggcgcugcuucaguacauugcuggugcucagcaacucuggg

SEQ ID NO: 4243959 - RNA, 95 nt, Pseudomonas putida KT2440
uugccugugccggccucuucgcggguaaacccgcuccuaccucggugcgaucccuguuggagcggguuuacccgcgaagaggccggcacaggcaa

SEQ ID NO: 4243960 - RNA, 71 nt, Pseudomonas putida KT2440
ggcgcugccgcuguucuaccucaagcgcuggcugguccagggccaggugcacgaagagcagcacgagggcc

SEQ ID NO: 4243961 - RNA, 80 nt, Pseudomonas putida KT2440
gccagguaaucgucgacgccgcuggugugcucggcgaugaaggcauggucgaacaccgccggcucgcccuuggccugcgc

SEQ ID NO: 4243962 - RNA, 94 nt, Pseudomonas putida KT2440
cccggcggccaauggcuugucggccagguaggcgucgacgguugccucgagguugucggccuugcccuggucgcugucuuugagcuugccgagg

SEQ ID NO: 4243963 - RNA, 66 nt, Pseudomonas putida KT2440
ugagcagggcgauuucgaacuugaacuguucgaugaggauuucaucguucugaaucuuccugcuca

SEQ ID NO: 4243964 - RNA, 63 nt, Pseudomonas putida KT2440
gaguggcucaugugcugcgcggucuuuguugggggcagccucgcgucgguacaugugccacuc

SEQ ID NO: 4243965 - RNA, 87 nt, Pseudomonas putida KT2440
ccacgcugauccgucacuugcuggcucagcgcccagccaacgagcgcugggcgguauugaucaacgaguucggccuugucggccugg

SEQ ID NO: 4243966 - RNA, 105 nt, Pseudomonas putida KT2440
cgacuggcugguacggccgcgguuggccugcacgcuggugcgcgacggcgagcgcacaccgucgaaggcauuguugcgggcacggccugccguauuggcaggacg

SEQ ID NO: 4243967 - RNA, 83 nt, Pseudomonas putida KT2440
ggcgcaggcugaagccccggcguagcgguaggguggggguggacgccuguuccagcacguugcugucgguggcggcuggcgcc

SEQ ID NO: 4243968 - RNA, 69 nt, Pseudomonas putida KT2440
uaguggucaggcaugaaggcagguuucugaucuacaacgggucagguuugccacacguguuuaucgcug

SEQ ID NO: 4243969 - RNA, 70 nt, Pseudomonas putida KT2440
auuuccacggucucuacguuauccagguucagcaggcuguugauagccucgauaguggagucggagaggu

SEQ ID NO: 4243970 - RNA, 116 nt, Pseudomonas putida KT2440
uugaaguaaccucggucacugugggagugggcuugcccgcgaacacgggcgaagcccgugccauccacggcggugucuucuucgcggguaaaccccccacagugacaggcuuucaa

SEQ ID NO: 4243971 - RNA, 79 nt, Pseudomonas putida KT2440
cguaucgauaucagcgcggcgaucuucaccgaaauguuccugagcaugguguacggcaucgucgaugccgaacgacgcg

SEQ ID NO: 4243972 - RNA, 87 nt, Pseudomonas putida KT2440
cugugggagcgggcgugcccgcgaaacaagcgacgcggugcauggcaccggcuucgccgguguucgcgggcaagcccgcucccacag

SEQ ID NO: 4243973 - RNA, 56 nt, Pseudomonas putida KT2440
cgaugcccagcgccucggccugcucgaccaaccagcgccaggcauccagggcaucg

SEQ ID NO: 4243974 - RNA, 74 nt, Pseudomonas putida KT2440
gcuugagcaccaaauggcgcgugucgagcggcggcugccauugccgugcgcgaagaacgcccguucgcucuugc

SEQ ID NO: 4243975 - RNA, 99 nt, Pseudomonas putida KT2440
ggugaaaugggccguggcuuugccgugguggcugaugaagugcgacaguuggcccagcgcaccgccgaauccaccgggcagauccacggccugaucgcc

SEQ ID NO: 4243976 - RNA, 117 nt, Pseudomonas putida KT2440
ggauugaggugaggccguucgcgggcacgcccgcucccacaggugucucgcaagcuucaaggcuugcgcuguaccugugggagcgagcgcgcccgcgaauggacacacaaccagacc

SEQ ID NO: 4243977 - RNA, 63 nt, Pseudomonas putida KT2440
cugcugcugggugagguuggcuugagcaggcagaguaaacaggccgaugccggccagcagcag

SEQ ID NO: 4243978 - RNA, 67 nt, Pseudomonas putida KT2440
cuguuccugcugaugcgagggcgcggcugauguugcaaguugagggccuguaucugugcaggggcag

SEQ ID NO: 4243979 - RNA, 115 nt, Pseudomonas putida KT2440
gggcguuauugagguuguucuggugccagaccaggcucuggcgcugcugggucauggccguuuccagcugccccagaaagcgcugguaauugaccagccagcugccauugacccc

SEQ ID NO: 4243980 - RNA, 66 nt, Pseudomonas putida KT2440
ucgcgggcaagcucgcgccuacaauggacgcagcgcuuucuguuguaggagcggguuuacccgcga

SEQ ID NO: 4243981 - RNA, 81 nt, Pseudomonas putida KT2440
acugcuacgugcacugggccuugcgcucgggcggcccgcucggcuguugccuguccccgcgggccuguugcgcggcgcugu

SEQ ID NO: 4243982 - RNA, 56 nt, Pseudomonas putida KT2440
gcacccaguuggugccagguucguugcguauggccugguacagugcaacggugugc

SEQ ID NO: 4243983 - RNA, 58 nt, Pseudomonas putida KT2440
uacccaagccaaucggcggcaccaugccggcggccauggucgccgccauuggcgcgua

SEQ ID NO: 4243984 - RNA, 100 nt, Pseudomonas putida KT2440
gcgcgcgacgaaaucggcguaaccgaagcaccggucagcuucucgaucugcuuggucaggcuguccaccugcuggugcagugccuugaucucguugcggc

SEQ ID NO: 4243985 - RNA, 76 nt, Pseudomonas putida KT2440
guggcaguggcguuacccagcggagcaccgguguuggcgauggccaugguguuuuucugcugguugaggucgccac

SEQ ID NO: 4243986 - RNA, 83 nt, Pseudomonas putida KT2440
cuucgcggguaaacccgcuccuacaggauggaugcagguuugaaaucugcaccguaccugugggagcgggcaagcccgcgaag

SEQ ID NO: 4243987 - RNA, 111 nt, Pseudomonas putida KT2440
cccuuguucgaggcgcuggcgcauuacgaccgggcgcgggugcugcaugcccguggcgaagugcugcgugcgcuggacgaagugcgccaagggcugcaacgucugcaaggg

SEQ ID NO: 4243988 - RNA, 93 nt, Pseudomonas putida KT2440
gggcgaugaucugcaaacugaggauagagucgccaccgagcucgaagaaguuaucggugcuaccgaccuguuccagcuugagcacaucggccc

SEQ ID NO: 4243989 - RNA, 66 nt, Pseudomonas putida KT2440
gguggaugaccuugugcggcgugaguauguggauggcuuuucugacguugcugcaaguuauguauu

SEQ ID NO: 4243990 - RNA, 93 nt, Pseudomonas putida KT2440
uugcugacccaguugcggguggugccagcgcaacaguacuucggcaccgacgaugcgguugucgcgggcauccaccugcggcuggaagugcag

SEQ ID NO: 4243991 - RNA, 76 nt, Pseudomonas putida KT2440
cgcugugcguacucgcgaaggcgcagaccugggcuccaugcccgucgcccaauucguugaguugcugacacaagcg

SEQ ID NO: 4243992 - RNA, 119 nt, Pseudomonas putida KT2440
cacgccccuggccgccauccccggugccgcggaacugaucgagcagguuggccaggccguggaccgccgccuggccagccugcaugaagacccgcaccaugccggccgcagcaagcgug

SEQ ID NO: 4243993 - RNA, 63 nt, Pseudomonas putida KT2440
gggaucaggucguaguucaucugggccuuguggcccuugaugcgcucgacgaccaugaugccc

SEQ ID NO: 4243994 - RNA, 70 nt, Pseudomonas putida KT2440
ggcaaccuggcuguaaggcggcuccacugcguagggcagggcauaggggccgucuucaccaaagguuucu

SEQ ID NO: 4243995 - RNA, 70 nt, Pseudomonas putida KT2440
gcuggcuacucgcuggacggccugcgugccgccuucaagggcgaggccgcauuccgccagcuggugcugc

SEQ ID NO: 4243996 - RNA, 66 nt, Pseudomonas putida KT2440
cuuguucgccggcaugcgaggcaaacuguuccagcgugaacagugggcgauccaugccuggagaag

SEQ ID NO: 4243997 - RNA, 118 nt, Pseudomonas putida KT2440
caggugcugcaucagcucgucgacaucgacgcgguuggaucgcgggaugaugacaauacggcacggguucucgugguccgacucgucgcgcaggucggcgaccaucggcagcuucuug

SEQ ID NO: 4243998 - RNA, 57 nt, Pseudomonas putida KT2440
ugaccuugggugagcggggcggugacaucaccuaugccgcacugcuggcccaaggca

SEQ ID NO: 4243999 - RNA, 71 nt, Pseudomonas putida KT2440
ccacggugccguuggccggcacagugaugacgguuuugccgucgcucagcgugaaggucaaugcacugugg

SEQ ID NO: 4244000 - RNA, 57 nt, Pseudomonas putida KT2440
caggggcguuucaucgagggcuacuauguaguuggccuguuggcugaaaugcugcug

SEQ ID NO: 4244001 - RNA, 71 nt, Pseudomonas putida KT2440
ugccucgcugcugcuggcgccguucggcucgcauggggucaaccuggcggcgaucagcgcggcgaucugca

SEQ ID NO: 4244002 - RNA, 61 nt, Pseudomonas putida KT2440
uacagccuuggggagcguccguauagugcgcaccacaacgacggacaaccccgaaguugua

SEQ ID NO: 4244003 - RNA, 59 nt, Pseudomonas putida KT2440
agcagcacauggcguggguccgcgaugcuggccggcagacccucgcuggggugcaugcu

SEQ ID NO: 4244004 - RNA, 66 nt, Pseudomonas putida KT2440
gcgcccguacucgcuccugccugggguccgacugcaggaccuuggcuucaagcggguuagcggugc

SEQ ID NO: 4244005 - RNA, 61 nt, Pseudomonas putida KT2440
uuggggcgcgcuauguggaugagcguuaugccgauaccgccaauacccagagcgcccccgg

SEQ ID NO: 4244006 - RNA, 58 nt, Pseudomonas putida KT2440
gugcugguggguggcggcauggcggugcugucguacgccaugcugacccgaccgacgc

SEQ ID NO: 4244007 - RNA, 73 nt, Pseudomonas putida KT2440
gguuucggcaacggcgaugcggaacucgucgaccgcaacgcguuugacaugcugcccauccgccgcgacaacc

SEQ ID NO: 4244008 - RNA, 66 nt, Pseudomonas putida KT2440
gcucuucaggccgcacaggcgcucggcgucggcauaguugaggucgaagaaguugcggccgauggc

SEQ ID NO: 4244009 - RNA, 77 nt, Pseudomonas putida KT2440
ggccaucugcuuugccgucguacaggccagugugccguugcuuggcgcguggcguggcgacagccuguggaugagcc

SEQ ID NO: 4244010 - RNA, 65 nt, Pseudomonas putida KT2440
gccauggccagcagcaccuuguucagccagaaccuggugaugaccguggugcuguucgccauugc

SEQ ID NO: 4244011 - RNA, 117 nt, Pseudomonas putida KT2440
cgcuggucgaucaacugcccagucaggccgugcaccuggacaucaccgacgacaacaccgugugggcccgugaugcccagcgucaguggcaacugcaaggcgugaucgauuucggcg

SEQ ID NO: 4244012 - RNA, 117 nt, Pseudomonas putida KT2440
ugugggagcggccuugcgucgcgaaaagggugcggagcgccccuacgauugcagcuuugccgcugaaauugcuggggccgcuuugcggcccuaucgcgacgcaaggccgcucccaca

SEQ ID NO: 4244013 - RNA, 100 nt, Pseudomonas putida KT2440
ugcagcgcuuugaccauguccgcgacgaaacgcuccgaaugcagguacaccaccuuggcguucggauuuuucuucagcagaugguuacccacagcaugca

SEQ ID NO: 4244014 - RNA, 68 nt, Pseudomonas putida KT2440
agauggccagaaucaucgccaacuggcccaguucggggacuaccagugcugcguucauggcuucgucu

SEQ ID NO: 4244015 - RNA, 80 nt, Pseudomonas putida KT2440
ccguccgucuugagccuagauaauucauugaucgaggucacggccggguuacgaauuguuucuaugcucaaggccuucgg

SEQ ID NO: 4244016 - RNA, 66 nt, Pseudomonas putida KT2440
gaugauggugucgugcagguugucgcgccagcccucuucaugggugacauugucgaagccgucauc

SEQ ID NO: 4244017 - RNA, 85 nt, Pseudomonas putida KT2440
ucgccgucgacggcaagcugaucaagcgcgaggaggccgccgaggccacccgccgggugaucauguacaacaaacccgacggcga

SEQ ID NO: 4244018 - RNA, 91 nt, Pseudomonas putida KT2440
agccuguacuggccucuucgcgggugaacccgcuccuacagggggagaaccugugggagcgggcuugcccgcgaagaggccgguacaggcu

SEQ ID NO: 4244019 - RNA, 71 nt, Pseudomonas putida KT2440
ugccaggcaucuaccuggguagccaccucaccgggcggaucuccgaccgcgugcugcgcccuugccuggca

SEQ ID NO: 4244020 - RNA, 81 nt, Pseudomonas putida KT2440
cggcgcgcugguuucaccggccuugauggugaccugggcauuguugcucagggucacgaccaggucgugagccagcggcug

SEQ ID NO: 4244021 - RNA, 126 nt, Pseudomonas putida KT2440
gcucggaaguggcagccagcuuugguccgcugacggucgauuuugccuuccgccgggugacgcucgacgguguggagguggcauugacacgcaaggaguaugcuuugcuggcgauauuggccgggc

SEQ ID NO: 4244022 - RNA, 73 nt, Pseudomonas putida KT2440
gcguugaaggaauucgggcgcaacuucggcuggcaugauuucagccaguacgaccuggaugccccguucccgc

SEQ ID NO: 4244023 - RNA, 59 nt, Pseudomonas putida KT2440
ccaaaagcggcuggaggauggcagcggcuaucggcuggucauccacccgccgcugacgg

SEQ ID NO: 4244024 - RNA, 56 nt, Pseudomonas putida KT2440
gucguagaucgacaugccggcggugacggaaccgcccggcgaguugauguacagau

SEQ ID NO: 4244025 - RNA, 75 nt, Pseudomonas putida KT2440
gcugagcagagccaggcgaguauugagguccaggccuuucggcccgacuucaaucgccuuggcaacgcgcucggc

SEQ ID NO: 4244026 - RNA, 57 nt, Pseudomonas putida KT2440
gcucgggcggcacuucuugcgccugcaacucgugcaggugcacaccgugcgccuggc

SEQ ID NO: 4244027 - RNA, 108 nt, Pseudomonas putida KT2440
cccuggccgcagugcauacccuggguauccagguggaccugccgacugccgugcugcucagcgugguagcggcagugugcgccugcggcgccucgggcguggccgggg

SEQ ID NO: 4244028 - RNA, 91 nt, Pseudomonas putida KT2440
gcuugcagguacagcgccagcucgucgagcaggccgucgagccacucuucaaaggcaaacggcugauggcgcuggcgcauuuucagcaggc

SEQ ID NO: 4244029 - RNA, 77 nt, Pseudomonas putida KT2440
gcugcuggccuaccugguggcgccgcggcugcuggcccgcgagcgugaugccgaggcggcacaggaggccgugcagc

SEQ ID NO: 4244030 - RNA, 86 nt, Pseudomonas putida KT2440
ucgaggccugacgcuggucuuuagcggguauacuugggcauucguuuucccaggauacccgcaacaaugcacagcgacgccuucga

SEQ ID NO: 4244031 - RNA, 60 nt, Pseudomonas putida KT2440
gcuacugcuggaagcggguucacggccaaagggacugugggcuucgaugccagcaggggu

SEQ ID NO: 4244032 - RNA, 82 nt, Pseudomonas putida KT2440
ggcugcccaaggccgugcgccaggcaaagcgcuucggugccaucugcaccgggguguuccugcuggggcgggccggguuacu

SEQ ID NO: 4244033 - RNA, 58 nt, Pseudomonas putida KT2440
cccgcuuccuugaacuuaugcacgauguucugcaucugcgaagggcugaggaauuggg

SEQ ID NO: 4244034 - RNA, 103 nt, Pseudomonas putida KT2440
gcccuugggucagcaccgccuguggcaugcgugccucggccuguuucaaacgguucugcacgucgaccugcgccauguccgggucggugccuggcucgaaggu

SEQ ID NO: 4244035 - RNA, 61 nt, Pseudomonas putida KT2440
uugccgucgaguucgaccugcuccuugaccagcgaauuguccucgaaacacuugaugguaa

SEQ ID NO: 4244036 - RNA, 61 nt, Pseudomonas putida KT2440
gucgaucgacaugggcggcagcaucguugcggccaaccgugcagccgcgcaguugcuuggc

SEQ ID NO: 4244037 - RNA, 73 nt, Pseudomonas putida KT2440
gcaaacgcggguugcgcuuguggaugagguugccguugcaugugccggccucuucgcggguaaacccgcuugu

SEQ ID NO: 4244038 - RNA, 65 nt, Pseudomonas putida KT2440
caacagugucgaacugcucaacgacgcacgccacgggcugcuuguggagcacuuuggccagguug

SEQ ID NO: 4244039 - RNA, 90 nt, Pseudomonas putida KT2440
caggucgaagccuggcuggacgaggucggcgccgaagugcuggucaauaccaccgguuucgccuuguccagccccgagcgccccaaccug

SEQ ID NO: 4244040 - RNA, 88 nt, Pseudomonas putida KT2440
gcggcccuaucgcgacgcaaggccguucccacaaaguacgucguacgccgauccucugugggagcggccuugcgucgcgaugggcugc

SEQ ID NO: 4244041 - RNA, 83 nt, Pseudomonas putida KT2440
gccggccucuucgcggguaaacccgcuccugcgacgggcuacgucaccuuugcaggcgcggguuuacccgcgaaggggccggc

SEQ ID NO: 4244042 - RNA, 65 nt, Pseudomonas putida KT2440
gcccuggcagguguggauccaaugacuaugguugauggcacauggaugucauuucugccggaggu

SEQ ID NO: 4244043 - RNA, 98 nt, Pseudomonas putida KT2440
uccggccucuuagcggcaagcccguuccugcacagaucgcacaaucuucaggcgggcgcagucguuguaggagcgggcuugcccgcgaagaggccgga

SEQ ID NO: 4244044 - RNA, 79 nt, Pseudomonas putida KT2440
ucgcgggcacgcccgcucccacagguaaugcacaaguuucaaaaacggugcagaccugugggagcgggcaugcccgcga

SEQ ID NO: 4244045 - RNA, 74 nt, Pseudomonas putida KT2440
ugguaggagcggguuuacccgcgaauacgguggucgaugcaccaucgcauucgcggguaaacccgcuccuacca

SEQ ID NO: 4244046 - RNA, 99 nt, Pseudomonas putida KT2440
gcuccaugaagacaaccauguccaggcaccagggcgggccuguguggcuguuugccuaugccucguugaucuggcgcccggagugcaauucgguggagc

SEQ ID NO: 4244047 - RNA, 68 nt, Pseudomonas putida KT2440
agccuagaugcgcugugcaaacgcuacgacaucgacaacucgggccgugaguugcacggcgcacugcu

SEQ ID NO: 4244048 - RNA, 71 nt, Pseudomonas putida KT2440
cuuuguagguugcuuccuugcugaaaucgaugaccauggcaucgucuucgccgaugaagcagucggcaaag

SEQ ID NO: 4244049 - RNA, 104 nt, Pseudomonas putida KT2440
gcgaacgaugccgccgaagauguugaccagaacggccgcgacauugcugucggacagaaugaucuugaacgcuucgguaacgcgcucuuugguagcaccaccgc

SEQ ID NO: 4244050 - RNA, 81 nt, Pseudomonas putida KT2440
gaugacugcaaaaugggacucgaguuugcugccuucguagccgccuacacgggcguagacugcgggccaguuuguguuuuc

SEQ ID NO: 4244051 - RNA, 74 nt, Pseudomonas putida KT2440
gaggggcgugacggcagugacuggcugguagagagccugaccgauuauuacgccaacgaguuguuacgccgcuc

SEQ ID NO: 4244052 - RNA, 82 nt, Pseudomonas putida KT2440
ucgcgacacaaggccgcucccacagguaauacgcugugcucuggcugagcgcauuaucugugggagcggccuugugucgcga

SEQ ID NO: 4244053 - RNA, 72 nt, Pseudomonas putida KT2440
ggcgcaggucauacuuguacggcacguugcugccaugccaggccacaacguccaguggcgagugcugcagcu

SEQ ID NO: 4244054 - RNA, 83 nt, Pseudomonas putida KT2440
caggccuguucgaagcagcacaccgcggcacgcuguuccucgacgagaucggcgacaugccggugucgcugcaaacacgccug

SEQ ID NO: 4244055 - RNA, 78 nt, Pseudomonas putida KT2440
ugcgugugcaucugcgccuggaccgcggcgaggccauucugucccucgaccugucugggcacagccugcaccagcgug

SEQ ID NO: 4244056 - RNA, 68 nt, Pseudomonas putida KT2440
gccagcgggcuggaacugaucgaauagagccgcggcugcaaugguuugagcaguuccagccagcuggc

SEQ ID NO: 4244057 - RNA, 106 nt, Pseudomonas putida KT2440
gacgcacuggucgcugugugcggugcgcagaugccagcguugcucgauggccgcgagcagcgcccggacacugcguuugccgugcgggcggggcaaguguugcguu

SEQ ID NO: 4244058 - RNA, 58 nt, Pseudomonas putida KT2440
uacgcgccgggcauccgcugccggguucacguuuguugcagggggugccggugucgua

SEQ ID NO: 4244059 - RNA, 75 nt, Pseudomonas putida KT2440
gcauuugcauauggcgcuccuucgggguggaugggaugugcgacccgaucacccacggcguuaugucgaaggugu

SEQ ID NO: 4244060 - RNA, 82 nt, Pseudomonas putida KT2440
ucgacauccccaccuucaucgcgaaucaggucugccguuuuuccguaggagcgguuccagguuacgccgauguagggugcga

SEQ ID NO: 4244061 - RNA, 72 nt, Pseudomonas putida KT2440
uugggaaccauagcaaaguauucggcggcugaccuacccggaucagucggcgaaugcuuuucuagaucucga

SEQ ID NO: 4244062 - RNA, 76 nt, Pseudomonas putida KT2440
guucacguagcgggugccuuguucagcgccagccgcuucuuccugcaggcuggugagcuggguaccuucgugacac

SEQ ID NO: 4244063 - RNA, 76 nt, Pseudomonas putida KT2440
cgcggcaagccagcguccacagguucggcacagaucucaagagcggugcaauaccuguggcgcuggcuugccggcg

SEQ ID NO: 4244064 - RNA, 65 nt, Pseudomonas putida KT2440
ggcuguucuccggugugggcuugcccagccagcggucgcugcuggucaaccgccuggaugaggcc

SEQ ID NO: 4244065 - RNA, 100 nt, Pseudomonas putida KT2440
guugucagugccggcccuuucgcggguaaacccgcuccuacaggauuaucgcugccccuguaggagcggguuuacccgcgaagaggccagcaccggcaac

SEQ ID NO: 4244066 - RNA, 60 nt, Pseudomonas putida KT2440
gcgcagcugcuggaccugccgguuagcgcagcgcugggccggccgcugcagcagcugugc

SEQ ID NO: 4244067 - RNA, 86 nt, Pseudomonas putida KT2440
ucugcgcagcagaacgcaaagcggcgacuuggcaccccaccccuucaggguuaugccgagccgccgcuuugucguuacagaacaga

SEQ ID NO: 4244068 - RNA, 103 nt, Pseudomonas putida KT2440
guaccggcccuuucgcggcuaaagccgcccucacaggacugcgcaguuguugaaacugugaagauccccguaggagcggguucacccgcgaagaggccggugc

SEQ ID NO: 4244069 - RNA, 99 nt, Pseudomonas putida KT2440
cguaauucuguaagggucauaacgugcguccaugaaguugcgggcccagcauagcggcugcaaucgauagacgcacguuaucagacuugccgaauugug

SEQ ID NO: 4244070 - RNA, 84 nt, Pseudomonas putida KT2440
uaccuccaggaaggggagccgcucaaguguagcgcuggcccgccagccugccaugacacggcuucagccuccugacugacggua

SEQ ID NO: 4244071 - RNA, 121 nt, Pseudomonas putida KT2440
caaggccggcgccugcgacuucaucgaaaaacccuacaacgaccaguugcugcucgacagcguucaggcugcgcuggagcacgccgggcuggcgcgacagggcgaucaggcgcuggccuug

SEQ ID NO: 4244072 - RNA, 67 nt, Pseudomonas putida KT2440
ggccgaguugcuggagcuggcccgccagcgggaaaccuggcuggcgcaaaugcucggugcuuaugcc

SEQ ID NO: 4244073 - RNA, 55 nt, Pseudomonas putida KT2440
gaucggugugcgguagcguagcgacaggccgaugcugcauaccgccaugccgauc

SEQ ID NO: 4244074 - RNA, 70 nt, Pseudomonas putida KT2440
ucggcaucaaggauggccaccagggucacccgcgggaagugguggcccuuggcgagcaucugggugccga

SEQ ID NO: 4244075 - RNA, 80 nt, Pseudomonas putida KT2440
gccggccucuucgcggguaaacccgcuccuacgagguaacgcguugccugguaggcggguuuacccgcgaagaggccggc

SEQ ID NO: 4244076 - RNA, 55 nt, Pseudomonas putida KT2440
aaggcgucgaucacgguguuaccgguggugaagaugugcgccggaucggugccuu

SEQ ID NO: 4244077 - RNA, 68 nt, Pseudomonas putida KT2440
gugauguucguggucaucuucaucaucgcggucaucgucgcccuggccaacaugggcaugaacgucac

SEQ ID NO: 4244078 - RNA, 57 nt, Pseudomonas putida KT2440
uugcuggaucaaguauucacuuugugcaucaagggcacugguggcuucguccagcaa

SEQ ID NO: 4244079 - RNA, 58 nt, Pseudomonas putida KT2440
ggucguugaguucggcaauggcacguggccccgugccguuggcguacaucggcucacc

SEQ ID NO: 4244080 - RNA, 65 nt, Pseudomonas putida KT2440
acgacaaaggcgccguguugccccgcuugcaucagcaugccggggcagccggcgccuuuuugcgu

SEQ ID NO: 4244081 - RNA, 63 nt, Pseudomonas putida KT2440
uacaggcgaaggaucucuagcggccgaagcgcaucggccagcccaccacuuucuucgcccgug

SEQ ID NO: 4244082 - RNA, 62 nt, Pseudomonas putida KT2440
cugcauuccucaaccuggaugaagugauccacaucauccguaccgaggaauaucccaagcag

SEQ ID NO: 4244083 - RNA, 69 nt, Pseudomonas putida KT2440
cugcugcagcuguucgacgugcuguaucaaugccgcagcgugacccgcgccgccgaacagcuggggcag

SEQ ID NO: 4244084 - RNA, 93 nt, Pseudomonas putida KT2440
ccuguccgggccucuucgcggguaaacccgcuccuacagguucaucacaggcgcauguaggagcggguuuacccgcgaaguggccaaugcagg

SEQ ID NO: 4244085 - RNA, 59 nt, Pseudomonas putida KT2440
gaugaagcucuuaugaauaguuauguguuggcgcgcaacuuuauaacagcuuuuugauc

SEQ ID NO: 4244086 - RNA, 80 nt, Pseudomonas putida KT2440
agccuguaggagcggguucacccgcgaaugcggugguggugccacugacguauucgcggguaaacccgcuccuacacguu

SEQ ID NO: 4244087 - RNA, 58 nt, Pseudomonas putida KT2440
cgccagcuccaucagugggaacggcuugaacaggacgugacucacuccgaguucggcg

SEQ ID NO: 4244088 - RNA, 64 nt, Pseudomonas putida KT2440
gccuguucaccgacacugccgacuggaacuugaucgaaacccacuggcaggaucugaugcaggu

SEQ ID NO: 4244089 - RNA, 72 nt, Pseudomonas putida KT2440
caccagccgugcagggcgcgggugaaggcuucgaaguugaagucugggguccugcccugaaugguuccggug

SEQ ID NO: 4244090 - RNA, 58 nt, Pseudomonas putida KT2440
cgacaaagacgucgcucuccccuccacacccauggagcggguagcggcgucuuuuucg

SEQ ID NO: 4244091 - RNA, 58 nt, Pseudomonas putida KT2440
uccuggccaugcaccgcaucgaaaccgaugugcggcaugaugcgguccuuggccauga

SEQ ID NO: 4244092 - RNA, 72 nt, Pseudomonas putida KT2440
ggcgccuggcagcugaugcacagaauguacgccuuucauggccuugaucuggucuucguugcgcaggcugcc

SEQ ID NO: 4244093 - RNA, 61 nt, Pseudomonas putida KT2440
gcuacgagccgcaggcaagcgcaggccaauacucggcuuguucuugcuugcggcuugucgc

SEQ ID NO: 4244094 - RNA, 81 nt, Pseudomonas putida KT2440
agaccucaucgggcgggguuugaucgaugccguggcguucgggcgcgccuacauugccaacccugaccugguggagcgucu

SEQ ID NO: 4244095 - RNA, 91 nt, Pseudomonas putida KT2440
cuugugggagcggguuuacccgcgaaugcgucggagcaggcaacgagguugucuggucuggccucuucgcggguaaacccgcucccacagg

SEQ ID NO: 4244096 - RNA, 63 nt, Pseudomonas putida KT2440
gcugguugcccagcuggacgauggcguagaucgccgccucuucaucgauccagcgcaacaggc

SEQ ID NO: 4244097 - RNA, 61 nt, Pseudomonas putida KT2440
ggguugguggucagggcgaacagcgccucauggaaggcaauguaggcuuugaccccggccu

SEQ ID NO: 4244098 - RNA, 84 nt, Pseudomonas putida KT2440
agcccgugguggcggccaaccacuucaucgaggcgguagcccauggugucgagaaaauucugguuggccuugaucacccggccu

SEQ ID NO: 4244099 - RNA, 76 nt, Pseudomonas putida KT2440
ggucagguugaugacaaugcacugguugggcacgacguugucgagcaucacccggaucauuucgucgagcuugacc

SEQ ID NO: 4244100 - RNA, 63 nt, Pseudomonas putida KT2440
ugagcggcuggguaugacccagcguguauuuggcgauaucgguggggucgagcccaacgcuca

SEQ ID NO: 4244101 - RNA, 106 nt, Pseudomonas putida KT2440
guaccggccucuucgcggcuaaagccgugccugcagggggacgguauugccccuggguuugacgcuaucccuguaggagcggcuucagccgcgaaagggccgguac

SEQ ID NO: 4244102 - RNA, 79 nt, Pseudomonas putida KT2440
gcucugcgcccucaccgaaguauucgauaaggggcucuguuacugcgcccucuucgggcucuuuagguuugcgcuuggc

SEQ ID NO: 4244103 - RNA, 77 nt, Pseudomonas putida KT2440
ggcgugccgaugauccagguggagacccugggugccggcgguggcuccaucgcccaccuggacgaguuuggcaugcu

SEQ ID NO: 4244104 - RNA, 95 nt, Pseudomonas putida KT2440
caggcgccagggaugccuugggccuguaugaaaagccuugagacgaaggucaggcaaggcuuuucauacgggccuuagugcaacaccuugcucug

SEQ ID NO: 4244105 - RNA, 55 nt, Pseudomonas putida KT2440
uggcucaggcugccauccgugccuuuuaccgcgacacggaugguuugccgggcca

SEQ ID NO: 4244106 - RNA, 80 nt, Pseudomonas putida KT2440
gugaccgcgcgaaccgguguagccguugccgaaguccgaaucggugaacaggcugaccaccgcguuacgcugcacaucgc

SEQ ID NO: 4244107 - RNA, 55 nt, Pseudomonas putida KT2440
ucuucaucaacgaugaucgccgcgacuucagccggcgacauggcguugaugacga

SEQ ID NO: 4244108 - RNA, 61 nt, Pseudomonas putida KT2440
uggcuuaucggcguagcgccaacuggacauucgauggggccaguggugcgcuguugagcca

SEQ ID NO: 4244109 - RNA, 67 nt, Pseudomonas putida KT2440
gcugcauguggccgaggucggccugaucggccugauggugaucguacugaucacggccuucaccggc

SEQ ID NO: 4244110 - RNA, 61 nt, Pseudomonas putida KT2440
gcgcagcagguucugcgcggucagcaggcgguauuccuugcuggcgcggaagucgcugagc

SEQ ID NO: 4244111 - RNA, 72 nt, Pseudomonas putida KT2440
ucaggcgaccgucgaucguugguugagugccacuggcacccagguggcugcccaaugacucggcgugccugg

SEQ ID NO: 4244112 - RNA, 69 nt, Pseudomonas putida KT2440
gauagcgugugggugcuccucagccauggugagugcaccacuggcgaguccgaagcccgcgccucaauc

SEQ ID NO: 4244113 - RNA, 69 nt, Pseudomonas putida KT2440
ccaguucggcggcgaucagcgaacguucgaauugcucgaccuguucgcugagguugccgcugagcaugg

SEQ ID NO: 4244114 - RNA, 80 nt, Pseudomonas putida KT2440
ccuacagugauauaccuuccgauacaaagaucaagguggucaaaucgccgaaaagugugccggauggcuauguauugagg

SEQ ID NO: 4244115 - RNA, 90 nt, Pseudomonas putida KT2440
uggggaucaucucacugguggcguugagcuucauggugcacgagcccaacgguaucaucgacugguucagcgccagguccuuguucucua

SEQ ID NO: 4244116 - RNA, 56 nt, Pseudomonas putida KT2440
ggcagcggcgaucauguugcuaucuucaccucggguggcaccauugccgcccugcu

SEQ ID NO: 4244117 - RNA, 71 nt, Pseudomonas putida KT2440
gccgucgauaccggagaacugcgguuccaccacccgcgacagguaaucgcucaguuccgguaucgacaggc

SEQ ID NO: 4244118 - RNA, 57 nt, Pseudomonas putida KT2440
cagugaccgaucaucagccagcaaugcgggcgcagcacggccagguggucggugaug

SEQ ID NO: 4244119 - RNA, 129 nt, Pseudomonas putida KT2440
cuuuuuugugggagcggccuugugucgcgaaaggggcgcgaagcggccccgggauuucagcuucgcagcacagagugccggggcugcuucgcagcccuuucgcgacacaaggccgcucccacaaaaaag

SEQ ID NO: 4244120 - RNA, 107 nt, Pseudomonas putida KT2440
agcgcgucgcggugguggguaaacgcuuuuucgugcagccacaguugcuggcgagccgccagccacuggcugcgggaaaccaccgggugccugcuuucgcgugugcu

SEQ ID NO: 4244121 - RNA, 60 nt, Pseudomonas putida KT2440
uugucgggcucaguggccuggugcugcuguucgucgauacccugccacugaaccugauga

SEQ ID NO: 4244122 - RNA, 55 nt, Pseudomonas putida KT2440
cgcggccagaccgguaccauugcugccaucagcaacggugauguccuggucagcg

SEQ ID NO: 4244123 - RNA, 59 nt, Pseudomonas putida KT2440
gaucguccacccgcagcauggaggccagcaauggcagcaucagcagguuggugaugauc

SEQ ID NO: 4244124 - RNA, 78 nt, Pseudomonas putida KT2440
gggaaaugaccugaaguagaaguacgggucgugcgcgaucagcgcacgacccguacuuuucucucacucgucgauccc

SEQ ID NO: 4244125 - RNA, 92 nt, Pseudomonas putida KT2440
gucugcuucgcgggcaugcccgcucccacagguucagcacaagucugaggguugugcuggaccugugggagcgggcgcgcccgcgaagaggc

SEQ ID NO: 4244126 - RNA, 118 nt, Pseudomonas putida KT2440
ggugccuagacuggggcauuguguugauugugcggcuucuucgcggcuguaggcgcggguuuacccgcgaaagggccagcacaggcaauggauaacccccaggagagcuagcgugacc

SEQ ID NO: 4244127 - RNA, 71 nt, Pseudomonas putida KT2440
gucugauaacgugcgucuaucgauugcagccgcuaugcugggcccgcaacuucauggacgcacguuaugac

SEQ ID NO: 4244128 - RNA, 78 nt, Pseudomonas putida KT2440
cugacggauaccuucggccaguuucucggugcccauggcgucuucguucaucgcccagcggaacuggcuuucguucag

SEQ ID NO: 4244129 - RNA, 81 nt, Pseudomonas putida KT2440
gaugucggcagcaguacccugcaucggggcguugaucgccgugcgcucggcgcccuugcgcagggcaggguucuuggcauu

SEQ ID NO: 4244130 - RNA, 75 nt, Pseudomonas putida KT2440
gccggucagcuggucagcaagcaggaccugucgcucaaugcccugggccggccgcugacccguuaugaccgacgc

SEQ ID NO: 4244131 - RNA, 67 nt, Pseudomonas putida KT2440
gucgcaucaggcugugagaggauguccgccaacaaagccaggacccugaacgcagccugaugaagac

SEQ ID NO: 4244132 - RNA, 67 nt, Pseudomonas putida KT2440
gugaucucgucgaagaaaucgcucagcucaagggucuugcuggcaauguagccuucgaugaacucgc

SEQ ID NO: 4244133 - RNA, 57 nt, Pseudomonas putida KT2440
cggucgugaagagagaucugagcaaaaugcuagcuccggaucaucccauguacaccg

SEQ ID NO: 4244134 - RNA, 91 nt, Pseudomonas putida KT2440
gcuaguaugguguuuugcaaauacggccaauaacucgcagcgcaaaaaacgccgcaaguuauggucguuauuugugaaacaccacacuagc

SEQ ID NO: 4244135 - RNA, 68 nt, Pseudomonas putida KT2440
cucaugugacgcugcucgguagagucgagcaucugaaggaucuugacucgaggcagggucaccuugag

SEQ ID NO: 4244136 - RNA, 56 nt, Pseudomonas putida KT2440
gcucggccauuuccgaagcgaacagcuuggccugugacgcuuccgacaggcacggc

SEQ ID NO: 4244137 - RNA, 56 nt, Pseudomonas putida KT2440
gccgcaggcgacuuccugcaguugugcgcaacggugcugcaggccuucgccugggc

SEQ ID NO: 4244138 - RNA, 57 nt, Pseudomonas putida KT2440
gucggcguugaaaguaucgguucauaugaaagauacuguuucucauuaacgcucgau

SEQ ID NO: 4244139 - RNA, 73 nt, Pseudomonas putida KT2440
ucgagcgauugucgaucuuccccgaccgcacaaauguucaguucgugcggguaaucgaucgucagacgcucga

SEQ ID NO: 4244140 - RNA, 55 nt, Pseudomonas putida KT2440
cgguucgccgccggaagcuugccgauucgcucggacagcuucaggcgcuggaccg

SEQ ID NO: 4244141 - RNA, 69 nt, Pseudomonas putida KT2440
gugccggucggucaucagguucaugcagaaaucgagcuuuugcuugggcuccacggugaccaccggugc

SEQ ID NO: 4244142 - RNA, 62 nt, Pseudomonas putida KT2440
ggcuugccgugcucgugggggaugaacgagaagucggucagcugauuguugagcaggaagcc

SEQ ID NO: 4244143 - RNA, 75 nt, Pseudomonas putida KT2440
ucuucgcuuagucccugguguaagcgaggcaauggauaacgccgugcaucacgcguacaucaggccuagagaaga

SEQ ID NO: 4244144 - RNA, 57 nt, Pseudomonas putida KT2440
gcccgcggcuggcggcgcguuugcagcaccguugcuaccugcaggccggccgugugc

SEQ ID NO: 4244145 - RNA, 87 nt, Pseudomonas putida KT2440
ggccgguccuuucgcggguaaacccgccccuauacacaugcacaggccgucguguaggagcggguucacccgcgaagaggccggacc

SEQ ID NO: 4244146 - RNA, 56 nt, Pseudomonas putida KT2440
gggcguauucacgcagagcgccagcagggucguggcgcuccucguggaugcggccc

SEQ ID NO: 4244147 - RNA, 61 nt, Pseudomonas putida KT2440
cgccagcaaggcugcucggccgaggagcugaugcagcgccuuggccagcaguuugccggcg

SEQ ID NO: 4244148 - RNA, 67 nt, Pseudomonas putida KT2440
gcacaugcggcacgcgccgaguugcauugccagcugggacaggugcaagaggcgcgugcggccuggc

SEQ ID NO: 4244149 - RNA, 107 nt, Pseudomonas putida KT2440
agccuguaccgaccucuucacgggcucgcccgcagcucagggaucacguuaccuucaggguguucaccgcaccugugggcaugcccguuaagaggccggaacgaacu

SEQ ID NO: 4244150 - RNA, 64 nt, Pseudomonas putida KT2440
ggccggggcaugaagcgguggcguggaacucggcgcugaucuacgacaugaucuucacccagcc

SEQ ID NO: 4244151 - RNA, 82 nt, Pseudomonas putida KT2440
uucgcaggcacgcccgcucccacagguacggcacagcguucgagaccugugcugcaccugugggagcgggcgugcccgcgaa

SEQ ID NO: 4244152 - RNA, 87 nt, Pseudomonas putida KT2440
agugcgcgacaccuuugagcgcgagguugucggacucgguggcaccgcugguccagacgauuucgcgcggaucggcguugaucagcu

SEQ ID NO: 4244153 - RNA, 75 nt, Pseudomonas putida KT2440
cagccccuguucggcuuggcgcuugcuggugucgaugaucgacacugcugccugcgccaguuguucguucugcug

SEQ ID NO: 4244154 - RNA, 64 nt, Pseudomonas putida KT2440
agcgcucgcugaaucuggccagcucgcaguaucgcgaaggcuucgccgauuuucagcgggugcu

SEQ ID NO: 4244155 - RNA, 58 nt, Pseudomonas putida KT2440
gcgcagguggucgaacagggccugcaucaccuugacagccuugucgaugucaucgcgc

SEQ ID NO: 4244156 - RNA, 90 nt, Pseudomonas putida KT2440
gucgaugaucugcugguugcucugaccuucgccaagcaugcggaagauuucccggcgcaggucggcagcaaucggcgcguuggagucggc

SEQ ID NO: 4244157 - RNA, 80 nt, Pseudomonas putida KT2440
gcgcgccggucggcuggaagcccagguuagccagguauugcgccugcaggcgcguggcccugggcaguaccggcgcacgc

SEQ ID NO: 4244158 - RNA, 60 nt, Pseudomonas putida KT2440
aguugaacgcgucgcuuucggccugucgcaucggcacauggccgagcaucgcguucaucu

SEQ ID NO: 4244159 - RNA, 84 nt, Pseudomonas putida KT2440
ggcaagcuggcagcgcuuuaccccaggggagguggcgggugacuaccaccugacccucgugggugagcgggugggugaguugcc

SEQ ID NO: 4244160 - RNA, 60 nt, Pseudomonas putida KT2440
gcuugagccuuggacgccuggccgagguugccgguccaggccaggcccgcgaggccaagc

SEQ ID NO: 4244161 - RNA, 55 nt, Pseudomonas putida KT2440
auguggucguugaucgaggcguccuucucgaugaagguguccgacgacggcacgu

SEQ ID NO: 4244162 - RNA, 81 nt, Pseudomonas putida KT2440
gccuugauguaagcaggcgcggccuguucgcggcgguucgacgccucgaacaggccgcgccugcuuaaacgugcucaaggu

SEQ ID NO: 4244163 - RNA, 76 nt, Pseudomonas putida KT2440
gugucgaggaccagaucaccgugaccgggccgguaguccaggcggcaagguucgucacagugaaaucgggcgacac

SEQ ID NO: 4244164 - RNA, 66 nt, Pseudomonas putida KT2440
agcacccucuugccugauguaaucagcgauuucuccaucacucaucgaaucaggcggagaaauguu

SEQ ID NO: 4244165 - RNA, 62 nt, Pseudomonas putida KT2440
cuucgaacguuccgaugacgauaucuaccagacugacccagucugaucguugaucggcgaag

SEQ ID NO: 4244166 - RNA, 65 nt, Pseudomonas putida KT2440
auguuaguguccuugccgcaccaaagcugcugagugcucgagccaaggucggacaaggcagacau

SEQ ID NO: 4244167 - RNA, 89 nt, Pseudomonas putida KT2440
gcagaaucgauuaauagacucagguugcuuggaaagucgugugcaaauuuuuuauacccgcuuccaaaaagcaaacucaguguaucugu

SEQ ID NO: 4244168 - RNA, 89 nt, Pseudomonas putida KT2440
cuuguaggggcggguucacccgcgaagcaggcaacgcgguggauggcaccggcguagccgguguucgcgggcaaacccgcgccuacagg

SEQ ID NO: 4244169 - RNA, 63 nt, Pseudomonas putida KT2440
ggagcccaugaugacuaaaaacauccuaucaagcuauaggaagaauaaucaucauguuguucc

SEQ ID NO: 4244170 - RNA, 73 nt, Pseudomonas putida KT2440
gcgccagcgauuaccaggacagcccggcgcugagcgcuuucaacgccgaguucugccuggugucgcugaaagu

SEQ ID NO: 4244171 - RNA, 81 nt, Pseudomonas putida KT2440
cuggcccacgcuuccagugcuuaucauugcucggguuucaaggaaaaaaccgcaauccuuggcauugacggcaagggcgag

SEQ ID NO: 4244172 - RNA, 76 nt, Pseudomonas putida KT2440
cgccggcaagccagcgccacagguauugcaccgcucuugagaucugugccgaaccuguggacgcuggcuugccgcg

SEQ ID NO: 4244173 - RNA, 57 nt, Pseudomonas putida KT2440
gcuuggccuucuuuucggcaguggugaggaugccgaugcccaagggcuuggucaggu

SEQ ID NO: 4244174 - RNA, 67 nt, Pseudomonas putida KT2440
agcagccugggcuacgagguaggguugauccauuacagucagcccaauaucgcaggccccgacagcu

SEQ ID NO: 4244175 - RNA, 98 nt, Pseudomonas putida KT2440
ggaagccaccgucgacauugagcguggugccggugguguagcuggaggcaucgcuggccagguacagcaccgcacccgccauuuccuuggggucggcc

SEQ ID NO: 4244176 - RNA, 71 nt, Pseudomonas putida KT2440
guuggugcaauugcaguugaaugccgccauccucggccaauggcagguaaaaaucaugcaguucuaccagc

SEQ ID NO: 4244177 - RNA, 56 nt, Pseudomonas putida KT2440
gcguugauggugugccagguggccagguugaggugguagcuggucggcaucagcgc

SEQ ID NO: 4244178 - RNA, 56 nt, Pseudomonas putida KT2440
cagucgguucauggcugcaccuguacgucgcgcgagguggggccaggaaucggcug

SEQ ID NO: 4244179 - RNA, 86 nt, Pseudomonas putida KT2440
gugggcuguuucgcgggcaugcccgcucccacaggugaagccugugcagucguuguuggagcgggcaugcccgcgaagcagccaac

SEQ ID NO: 4244180 - RNA, 74 nt, Pseudomonas putida KT2440
gcgcuuuggaggcggagcggucggcggccacggcuugcugggucuugagcugcuugaguucuuuuuccaggcgc

SEQ ID NO: 4244181 - RNA, 55 nt, Pseudomonas putida KT2440
gcuguucgacuuccagccgcuggagcccgaacccuucagccugguggugaacagc

SEQ ID NO: 4244182 - RNA, 127 nt, Pseudomonas putida KT2440
cuuuguccauuggcugagaaggcgucuucacaguggcccccgcgccuggcgcaucggccgggugaugugccgaguguucaucgguguuuugcgccauggcgcccacggacgcugcagccaaacaaag

SEQ ID NO: 4244183 - RNA, 75 nt, Pseudomonas putida KT2440
gccuguuccugaucucggcgacgccgaaugugcagaagcagaaaacccucgccgacgucgagaaaggcaucuggc

SEQ ID NO: 4244184 - RNA, 92 nt, Pseudomonas putida KT2440
cggcaaaggccuccagcgcuuuggcgcgcucggccucgaacggcgaguugaccaguaccgccagcgcgguaaggcgcucggucauguugucg

SEQ ID NO: 4244185 - RNA, 56 nt, Pseudomonas putida KT2440
cggcgggcugcccgucgugagucuugcgugcaugacucaccgcggaaaguccgccg

SEQ ID NO: 4244186 - RNA, 88 nt, Pseudomonas putida KT2440
ggccaggugcagcagaccaacuuccacaacuaccggcagcugcgcaucagcgaagcgccggcgguggaggugcaccugcugccuagcc

SEQ ID NO: 4244187 - RNA, 102 nt, Pseudomonas putida KT2440
accaauacaucagcccggacuacaucgauaucuucguggccugcaaggaaagcgaacuggccgaguucgaagugucgauuuccgaucuugaguacaacuggu

SEQ ID NO: 4244188 - RNA, 83 nt, Pseudomonas putida KT2440
uucgcggguaaacccgcuccuacaggggacgcgccggguucaaggcaaacgcgguaccugguaggagcggguucacccgcgaa

SEQ ID NO: 4244189 - RNA, 130 nt, Pseudomonas putida KT2440
gcagcagcgcuucguagucuuccacggaggccgccugcggcaggcgcucuagugcguggcgcagccacgcauagggcucuuggccguuggcuuuggccgucucgaccaggcuguaaaguugcgcacuggc

SEQ ID NO: 4244190 - RNA, 82 nt, Pseudomonas putida KT2440
cgcuuguugcaagggcagccgugugcugcgaagaggccugcaaacacugaccucuucgcagcaccagacugccccggaagcg

SEQ ID NO: 4244191 - RNA, 75 nt, Pseudomonas putida KT2440
ggcgugccgcugaugaacggcuuccugucgaaggaaauguucuucgccgaaacgguuuucaucaguuccaccgcc

SEQ ID NO: 4244192 - RNA, 70 nt, Pseudomonas putida KT2440
gcgcguugccaaggcgauugaagucgggccgaaaggccuggaccucaauacucgccuggcucugcucagc

SEQ ID NO: 4244193 - RNA, 78 nt, Pseudomonas putida KT2440
cgaucauuggcgugcccugggccagcagcaagguggcgaaguaguugcgcaucuggcgcaugcgcagggcauugaucg

SEQ ID NO: 4244194 - RNA, 55 nt, Pseudomonas putida KT2440
uccuucggcgacggguccuugcccuugugcaggcuaaggcccaacucgccgagga

SEQ ID NO: 4244195 - RNA, 81 nt, Pseudomonas putida KT2440
gcuggcugacguugauuucgaacgggggguaaucggggcgcgcacugcccauuaccaggcguucgcguuguuucagccagu

SEQ ID NO: 4244196 - RNA, 92 nt, Pseudomonas putida KT2440
ggguguuggcugcuucgcgggcaugcccgcuccaacaacgacugcacaggcuucaccugugggagcgggcaugcccgcgaaacagcccacuc

SEQ ID NO: 4244197 - RNA, 56 nt, Pseudomonas putida KT2440
gcgcaccaggaugcccgcggcaucacugcccugauggcggcgcaaaccaugggcgc

SEQ ID NO: 4244198 - RNA, 71 nt, Pseudomonas putida KT2440
gcgccagcuggcauugggccauggcuuugccuggcuggagggcgcggucauggccggggucaagcuggugc

SEQ ID NO: 4244199 - RNA, 80 nt, Pseudomonas putida KT2440
gcccaacccucucgguacgucuggagcgcgaaaggugaagacaucuugcgcaagauccagggugcccgagaggcaauggc

SEQ ID NO: 4244200 - RNA, 67 nt, Pseudomonas putida KT2440
ugcugaccgucagcagcuggcugguggugugcguguucgccgcgcuaccguuccugcugacccagca

SEQ ID NO: 4244201 - RNA, 69 nt, Pseudomonas putida KT2440
cugcuacaccccccacgcgcacagaggccaccuucggguggccuuugucguaugugggguucguaggag

SEQ ID NO: 4244202 - RNA, 61 nt, Pseudomonas putida KT2440
gguggccugcgucagccaggccaaccguagccucauggcccgccuggcgcaccaggccacc

SEQ ID NO: 4244203 - RNA, 92 nt, Pseudomonas putida KT2440
caccuugcgggccuuggcugcuggcacguuguucgucgaccgacugcucgcugcgcaacgccggcuggucgggguugaacuguucggaggug

SEQ ID NO: 4244204 - RNA, 117 nt, Pseudomonas putida KT2440
aaggcugauucaagccucuacccgccgcuucgcggccaagccgcugccacagguacugcgcaaucccuguaggugcggcuuuagccgugaagaggccagugagccucacacagcauu

SEQ ID NO: 4244205 - RNA, 90 nt, Pseudomonas putida KT2440
cugcgccggccucuucgcggcuaaacccgcuccuacaacgguuaauguccgacuguaggagcggguuuacccgcgaagaggccggcacag

SEQ ID NO: 4244206 - RNA, 85 nt, Pseudomonas putida KT2440
acaccaucuucgcuuccuuccugguggccggcucggugucguggauguacuacgccgaccgccucauggagcugccuuccggugu

SEQ ID NO: 4244207 - RNA, 115 nt, Pseudomonas putida KT2440
ucgacguccaucgaggugaagucaugguggccaccgcgcuugcagcgcacggcgaagugcuugccggccagcagguggccgaaguggugcuugcacuuggcgacgaugucgucga

SEQ ID NO: 4244208 - RNA, 83 nt, Pseudomonas putida KT2440
gccgaucagcuggcugaacagcuugccgacgucuucggugagcgcaucgucagaagucagcaggcuguagucgguguacaggc

SEQ ID NO: 4244209 - RNA, 94 nt, Pseudomonas putida KT2440
ggccucuucgcggguaaacccgcuccuacagguucaccacagcccucucaggcggugcacuacuuguaggagcggguuuacccgcgaagaggcc

SEQ ID NO: 4244210 - RNA, 77 nt, Pseudomonas putida KT2440
gggaagguggguuaugucggcagccugcugggcgagcaaaaccgugcagcuacuguccgcgucaccuugaccaaccc

SEQ ID NO: 4244211 - RNA, 99 nt, Pseudomonas putida KT2440
gaaaucaacgccgcugaggugcucgauaaacguagugacaaagugcuggcggguuuguucgccgucacugacgaugucgauaccggcguguuguuguuc

SEQ ID NO: 4244212 - RNA, 66 nt, Pseudomonas putida KT2440
ucagcgacaccaggcagaacucggcguugaaagcgcucagcgccgggcuguccugguaaucgcugg

SEQ ID NO: 4244213 - RNA, 82 nt, Pseudomonas putida KT2440
guccgguggccagcagcagcgucuggucaucgcccgcaccauugccguggagccggaggugcugcugcuugacgaaccgugc

SEQ ID NO: 4244214 - RNA, 60 nt, Pseudomonas putida KT2440
gugcgcugcugugggucgaggucgccaagcaggcgguacaccucggccugguagucgcgc

SEQ ID NO: 4244215 - RNA, 64 nt, Pseudomonas putida KT2440
uguuugcagggacguaaugcgggaucacgaccagguguggucaguauaugcucuaugcgauaca

SEQ ID NO: 4244216 - RNA, 68 nt, Pseudomonas putida KT2440
gcagaacagcggcuggccagcuuccugguggggcucuccaggcgcuucgucagccgcgguuacucugc

SEQ ID NO: 4244217 - RNA, 73 nt, Pseudomonas putida KT2440
agcguggucgagggugaagucgcuguggaauugcaggcgcagggucgcggucaguggcuucaucggucacgcu

SEQ ID NO: 4244218 - RNA, 79 nt, Pseudomonas putida KT2440
ugcgccuuggccuugcgcuugaguuccugaucguugaggaacaagccgaucaggcucucggcgacagaggucuuggcca

SEQ ID NO: 4244219 - RNA, 63 nt, Pseudomonas putida KT2440
cacgaucaguggcaacugcgcgacccgggcgaaggugaacaugcgcagcuugccgcugcugug

SEQ ID NO: 4244220 - RNA, 56 nt, Pseudomonas putida KT2440
gugaaaccaaacgcuugcaagccaaguacguauggcuuggaaucuguuggauucac

SEQ ID NO: 4244221 - RNA, 82 nt, Pseudomonas putida KT2440
uucgcggguaaacccgcuccuacaagguaccccaccggccuggaaccguggcgaucccuguaggagcggguuuacccgcgaa

SEQ ID NO: 4244222 - RNA, 85 nt, Pseudomonas putida KT2440
ggcgacggauaucgccuuugcggugggcguauuggcccugcucggcaagucgaucccguccaacguacguguauuccuccucgcc

SEQ ID NO: 4244223 - RNA, 64 nt, Pseudomonas putida KT2440
caccccucaaucgcacggguagcugcucagcaaacuggcgcuacccagauaggcuugaggggug

SEQ ID NO: 4244224 - RNA, 129 nt, Pseudomonas putida KT2440
cuguggccgaguaugugcgccacuggcuguuguacagcgcccuggucgacgccaugggcgugccauggagcauguccggcuaccugagccggggcggugcacugcgggcaagcgucaccaccggccagg

SEQ ID NO: 4244225 - RNA, 88 nt, Pseudomonas putida KT2440
ggcagugcacgccaccggcguuuucggcgacguugccaccgaucgagcaggcaauuugcgaggaagggucgggugcguaguacauacc

SEQ ID NO: 4244226 - RNA, 67 nt, Pseudomonas putida KT2440
guccggcaaugcaccuuuggcaguuuccggcgcaccuuccggcuuccugccgaggucauugccgagc

SEQ ID NO: 4244227 - RNA, 65 nt, Pseudomonas putida KT2440
ucggccuuguacgagcucuccugcaugaacuccaccgcaucgcgggugcccgacugcagggccga

SEQ ID NO: 4244228 - RNA, 101 nt, Pseudomonas putida KT2440
gcuuggaaucucuacuaccaccuaccaucuagauccggaguaucugcacaucagaugcuggcggcagacugguauguggauaccggaagauuuggucgagc

SEQ ID NO: 4244229 - RNA, 56 nt, Pseudomonas putida KT2440
ugcaggugauaguggcccaccaggcguggugaaccgggggucacugcaucgccgca

SEQ ID NO: 4244230 - RNA, 56 nt, Pseudomonas putida KT2440
gaccaccggugguugcugcagucacgcugaugcuguugcccguggccaccgugguu

SEQ ID NO: 4244231 - RNA, 79 nt, Pseudomonas putida KT2440
gguagaggcguaccaguggcaacagggugcugcccaaccguaucaggcgugucagguugccgcugcguacgcccuugcc

SEQ ID NO: 4244232 - RNA, 80 nt, Pseudomonas putida KT2440
ucgcgggcacgcccgcucccacaggugcagcacaggucucgaacgcugugccguaccugugggagcgggcgugccugcga

SEQ ID NO: 4244233 - RNA, 64 nt, Pseudomonas putida KT2440
gauuuccaccuguggguagcgcucggucagcuccgccaccagcgcgcucauccagguguggauc

SEQ ID NO: 4244234 - RNA, 106 nt, Pseudomonas putida KT2440
gguguuucgcuauccgguggauggccgcuucuugcgcuggggcuucaugcgggacggccugcgcuucgaagcggaauucggcacuguauugaucagcgacgauauc

SEQ ID NO: 4244235 - RNA, 89 nt, Pseudomonas putida KT2440
ggugcuguucgaguuugggcagcguuucgcuggcaaaggccuucagcucggccuugucggacgaugcagccucuuucuugaacagcucc

SEQ ID NO: 4244236 - RNA, 83 nt, Pseudomonas putida KT2440
cuucgcgggcgcgcccgcucccacaggugcagcgcaaaucuucagcgguauguccgccugugggagcgggcaagcccgcgaag

SEQ ID NO: 4244237 - RNA, 73 nt, Pseudomonas putida KT2440
ggcgcgcugaucggcgccauuggcuuugcgcuguucgacgaacugcgcagccugucgccgcugcucaagcgcu

SEQ ID NO: 4244238 - RNA, 78 nt, Pseudomonas putida KT2440
cccugugggagcggguucacccgcgaaugcgauggugcauucacugccgcauucgcggguaaacccgcuccuacaggg

SEQ ID NO: 4244239 - RNA, 90 nt, Pseudomonas putida KT2440
ggccguggcgccuggccgaacaugcgcguggccgagcguauccagcauguggaauccuuccucgcgcgcaugcgugaacagcgccaggcc

SEQ ID NO: 4244240 - RNA, 110 nt, Pseudomonas putida KT2440
uuugcggugucugugccggccucuucgcggguaaacccgauccuacaggggcaaugcgauccauguaggagcggguuuacccgcgaagaggucgguacaggccacgcaaa

SEQ ID NO: 4244241 - RNA, 61 nt, Pseudomonas putida KT2440
uccgccucgaaguugcgcgccugcgggugcauuuccggguaggcagccacuuccaggugga

SEQ ID NO: 4244242 - RNA, 71 nt, Pseudomonas putida KT2440
guuuggcgugcuugagcacugggccgcgaaugucguagcagacauuggcgagcuuguucgauuugcugaac

SEQ ID NO: 4244243 - RNA, 62 nt, Pseudomonas putida KT2440
gcaccugcggccaccucggugcugaagcagugaaugauuugcggcugguugagcaggaaugc

SEQ ID NO: 4244244 - RNA, 77 nt, Pseudomonas putida KT2440
guccaggcgcagcucaccgucguacacuuggccauugacgcucaaccaguuacccaacggugaauccucguccuggc

SEQ ID NO: 4244245 - RNA, 67 nt, Pseudomonas putida KT2440
agggcccgcugggcaacgaagagauggcgcggcuguuccgcgaaaucaugucgucgugccuggcccu

SEQ ID NO: 4244246 - RNA, 58 nt, Pseudomonas putida KT2440
uugucagcguccggcgcaccugcucaucguuugcaggacaugcugcucagccuggcgg

SEQ ID NO: 4244247 - RNA, 70 nt, Pseudomonas putida KT2440
gaugucguuggcaaguuugaugaucaguuuggccugaugguaacuggccgcagccuugccagcgaagauc

SEQ ID NO: 4244248 - RNA, 72 nt, Pseudomonas putida KT2440
gguaaaggucacagguagguuuucggcuggagcuauuuggcuccaaccguacccuuccuggagaccuuuccc

SEQ ID NO: 4244249 - RNA, 64 nt, Pseudomonas putida KT2440
ggcggcgcgguucggcggagcggcuguugaagcugucccacuguuccugccagccgugcaugcc

SEQ ID NO: 4244250 - RNA, 67 nt, Pseudomonas putida KT2440
ggggauccguugcugcgguaaggauggcguugugugccgccaucuuaaccacagcaaggguauuugc

SEQ ID NO: 4244251 - RNA, 67 nt, Pseudomonas putida KT2440
gggcgacgggguugggcgucgaugaacugacccagguguucaucacugcgcgcagccucaagcgccu

SEQ ID NO: 4244252 - RNA, 60 nt, Pseudomonas putida KT2440
cgaccuggacgagaagaccagcgggcugcaggcagccgaccugaucaucgucgcgggucg

SEQ ID NO: 4244253 - RNA, 82 nt, Pseudomonas putida KT2440
gcgaauggcaggugaucguugcgcgccagggcaacggcaauggccggguuguggcuggcgucgaugaucaccugaugaaagc

SEQ ID NO: 4244254 - RNA, 68 nt, Pseudomonas putida KT2440
guguugaucggcugcgccguugccgggcucgcccuucaccuuuuccgcugauggagccgaucaugcgc

SEQ ID NO: 4244255 - RNA, 55 nt, Pseudomonas putida KT2440
cguggcuucgucgcgggccuggcgcaaggcguaugccaggcuggacgaggccaug

SEQ ID NO: 4244256 - RNA, 88 nt, Pseudomonas putida KT2440
cguccucugcguauuccucggcagucaccaggucggugcagggcccuuugcagcguuuuaucugguacugcaggcauggccgggugcg

SEQ ID NO: 4244257 - RNA, 94 nt, Pseudomonas putida KT2440
gcugggcacccgaaagauccgccugacggguggcgagccacugguacgccagggcaucgucgaccugugcgggcgcaucgccgcccugcccggc

SEQ ID NO: 4244258 - RNA, 71 nt, Pseudomonas putida KT2440
uguaggagcggguucacccgcgaaugcgauggugaggcaaaugacgcauuccggguaaacccgcuccuaca

SEQ ID NO: 4244259 - RNA, 78 nt, Pseudomonas putida KT2440
cgguaaggcauuggcagugaucggucaccaggcauucugacaggcaggcauggccucuucacggccaauggcuuaucg

SEQ ID NO: 4244260 - RNA, 101 nt, Pseudomonas putida KT2440
cucgcggcuggcccccgcuuugacggccugcugcgaaugcacggcgaugcagccgucgcagcggguggucacagccacggccaaggagaucagcucgcggg

SEQ ID NO: 4244261 - RNA, 89 nt, Pseudomonas putida KT2440
ggcuggucugggcgaagcgcugcucgcguucgucgaaaaucuugguggccaugucggcgaacugggcgcgcaaggugucacgggccucc

SEQ ID NO: 4244262 - RNA, 59 nt, Pseudomonas putida KT2440
ugccuauguaguccagccccccuugaucuauucaucaaggaggcuggcugcaucaggua

SEQ ID NO: 4244263 - RNA, 76 nt, Pseudomonas putida KT2440
cagcgcaccgaccagguugagaucagccuugguguacgacagccaggcuuuuuucaacaccugggcgacgucgcug

SEQ ID NO: 4244264 - RNA, 63 nt, Pseudomonas putida KT2440
gaagacguuggcgcccuguuccuuggcgaaaugcgccaacagggaagagaagccgaugacuuc

SEQ ID NO: 4244265 - RNA, 95 nt, Pseudomonas putida KT2440
aaggcgccaggccucuucgcggguaaacccgcuccuacaggggauguggaugcuguuguaggagcggguucacccgcgaagaggccggaugccuu

SEQ ID NO: 4244266 - RNA, 77 nt, Pseudomonas putida KT2440
gcccaggguauugagcaggccacgucagccugccggaaauguauugcgaaauccguggcacugcgucaaaacccggc

SEQ ID NO: 4244267 - RNA, 57 nt, Pseudomonas putida KT2440
cugugagccgcccguggugcggugccgaggugaugaggcaaccugggcggcucaugg

SEQ ID NO: 4244268 - RNA, 96 nt, Pseudomonas putida KT2440
gcgcgguagcacaauggcaaacguacagaucucccaggguaauucgcgcgaccuuccugcuuaugccugucggaucuacgucacagcguuccgugc

SEQ ID NO: 4244269 - RNA, 65 nt, Pseudomonas putida KT2440
aggucgcaccugucgcacugcucagcgcuugagcacgcgucagggcaggcgaagggugcaggucu

SEQ ID NO: 4244270 - RNA, 76 nt, Pseudomonas putida KT2440
cgccaaauaccugauuggcaguggcaaggucgaagagcugcacgaccugguccaugccgaacagguagaccuggug

SEQ ID NO: 4244271 - RNA, 86 nt, Pseudomonas putida KT2440
ggugaaucgcaacaacgcugaugcaucaguauuuuggcugucccagccauacgccguguagugcaucagguucguugcauuucgcc

SEQ ID NO: 4244272 - RNA, 75 nt, Pseudomonas putida KT2440
gccggacgcaggugaucgcucggcaauugcaacacgggguggucguugcccagaugauccaaccaguacuccagc

SEQ ID NO: 4244273 - RNA, 68 nt, Pseudomonas putida KT2440
ggcguggguugcgguaacgcaggugggcagcgaggaaacggcugaccuccgcuacaugcacccagguc

SEQ ID NO: 4244274 - RNA, 60 nt, Pseudomonas putida KT2440
cgaucgcauccaggucauccccuugagcgaaguugaagguagugccauugaugucgaucg

SEQ ID NO: 4244275 - RNA, 56 nt, Pseudomonas putida KT2440
guugggcgugagcgagcgcagugugaacaguuaccuggcucaggcuauguaccaau

SEQ ID NO: 4244276 - RNA, 123 nt, Pseudomonas putida KT2440
ggccaaugccugcucgccgcugugcgccuggcgcaccugguagccguauuggcguaacacaucgccuagcaugucgcgcaccagguggucgucguccaccagcaguaccgugcgguuauggcc

SEQ ID NO: 4244277 - RNA, 55 nt, Pseudomonas putida KT2440
cuucuccaagcgcgugggugccagcguggcugagcaccuggcgauguggaugggg

SEQ ID NO: 4244278 - RNA, 86 nt, Pseudomonas putida KT2440
ggaauuugccgggagcggguuuucucgcgaaugcgaugucgaauacaccgccgcauucgcggguaaacccgggucaggcgcaaacc

SEQ ID NO: 4244279 - RNA, 89 nt, Pseudomonas putida KT2440
gccacacgccucgguggugcauugcaaauaagcgauucgcaggaaaauauggcgcccuucgcuaguacguaugcgcauccggcuguggc

SEQ ID NO: 4244280 - RNA, 114 nt, Pseudomonas putida KT2440
ggggcugcuuugcagcccauucgcgggcaagcccgcuccgacauugaucggcgucgguguacgcagaucguuguaggagcgggcuugcccgcgaaugggccgcagagcggcccc

SEQ ID NO: 4244281 - RNA, 65 nt, Pseudomonas putida KT2440
ggagucguugcgcugguucauugccaacagcaguugcugcugccagugggcacgguuggcgaucc

SEQ ID NO: 4244282 - RNA, 81 nt, Pseudomonas putida KT2440
agcccacggcagugguccagcacaccggcagcucuucuuuugcggccaggguugcagcguccuggagccacuucauggccu

SEQ ID NO: 4244283 - RNA, 56 nt, Pseudomonas putida KT2440
gcgccagcaacggucgauagucgcccaccgcaugggcggcguugagcugcuggcgu

SEQ ID NO: 4244284 - RNA, 83 nt, Pseudomonas putida KT2440
cgucaugggcauagucggccagggcauauccggcgccgagcgggcggugcuccgaauaaccauggccggccagguccagggcg

SEQ ID NO: 4244285 - RNA, 76 nt, Pseudomonas putida KT2440
ucuagcuuaaaucagcuucuacgccaugaguugcggauccccgccgcagcucuuggcugagcgcugaaugagcaga

SEQ ID NO: 4244286 - RNA, 57 nt, Pseudomonas putida KT2440
cugcccgucaguuugggcgggcugcguugcagccccagccucagcuggccggcuugg

SEQ ID NO: 4244287 - RNA, 56 nt, Pseudomonas putida KT2440
caggugcaugacaguuucaaggucuaugcccgugaccugccacuggucagcgccug

SEQ ID NO: 4244288 - RNA, 58 nt, Pseudomonas putida KT2440
cuggccguugcugcguguguccagguacaggaucagggcugcgcuguacagcggguag

SEQ ID NO: 4244289 - RNA, 93 nt, Pseudomonas putida KT2440
gaacgcuucaaagucuuccagcgaagcgucgggugcccugacuacgaaaggguagcgcucugccaggcgcugcuggaagaagcuguagacuuc

SEQ ID NO: 4244290 - RNA, 85 nt, Pseudomonas putida KT2440
gguuuccagcuguugcugcugagugugccgguaagccucccgcuccguuuggugcuuaccggacuccaguagccagaguuugucc

SEQ ID NO: 4244291 - RNA, 57 nt, Pseudomonas putida KT2440
gcagcacggugaggaucacaucgaucacuucgggggugaaccagcucauugugcugc

SEQ ID NO: 4244292 - RNA, 76 nt, Pseudomonas putida KT2440
gagguucauggcuucucuccuggguaacacuugggugugaggaguguugcuccccggucgagaaccauuucacguc

SEQ ID NO: 4244293 - RNA, 67 nt, Pseudomonas putida KT2440
cuuggacagcucuucaaccuuggcgucgauggcagccuugucgucgccuuugacagcggcuuccagg

SEQ ID NO: 4244294 - RNA, 63 nt, Pseudomonas putida KT2440
ucgagucaagaaugcgugggucuuuggucagcuccaggaucucacugaauucuugaacguuga

SEQ ID NO: 4244295 - RNA, 73 nt, Pseudomonas putida KT2440
gccuucuucgcgggugaacccgcucccacaggggccgcguagcuuguagcggcggguuuacccgcgaaagggc

SEQ ID NO: 4244296 - RNA, 123 nt, Pseudomonas putida KT2440
cgugccaacaagucagccuucaauggccgagguccaugguggaauucgggagcgcaacauaugaacuacgcgcugccaaagaaacugugggaccggcucgggcuggucucgauacuggauacg

SEQ ID NO: 4244297 - RNA, 112 nt, Pseudomonas putida KT2440
gagguguucgccgggagaguuucagcgccugggagaucgagcgccgcccgcgaagcgccgcgcgggcggcgcucgaucucacaggcgcugaaaauccuccggcaaacaccuc

SEQ ID NO: 4244298 - RNA, 59 nt, Pseudomonas putida KT2440
ccgugcucaaucggcagccagccaaucgccgggcacgggugcugcugauucaguacugg

SEQ ID NO: 4244299 - RNA, 64 nt, Pseudomonas putida KT2440
uagaucgacggauccccuguagccuucuagcugaugcccaaggcuaucggcaagucugcgacua

SEQ ID NO: 4244300 - RNA, 126 nt, Pseudomonas putida KT2440
ggucaugacggggugguauugcugaucgagcaucgcuuuggcaagcaccuggauucggucgguuucaucgacaucaaggacaauugcuucaucggccauggugcgaucgugaugccucgcgugacc

SEQ ID NO: 4244301 - RNA, 55 nt, Pseudomonas putida KT2440
aggcgacgguugaguucgagccgauccgcaggcgcuugaacccggacugacgcuu

SEQ ID NO: 4244302 - RNA, 80 nt, Pseudomonas putida KT2440
ccggacaugaucgacaaggcccgugagcgcaagcggcugugcaucccgcgugugcgcacggucauugccgacauugccgg

SEQ ID NO: 4244303 - RNA, 113 nt, Pseudomonas putida KT2440
gcgggcguuggagagcagguugaucagcaccugggccaggcgcugcgggucaccuucggcccaaugguccgggucgcaaagguugaagaacuguacuucgaaauugcgccggu

SEQ ID NO: 4244304 - RNA, 88 nt, Pseudomonas putida KT2440
augucgcauauucgcaaacuguaacgcaagcacaaaaacacccuuuaaccgugcucaguacgcggcuuugcggguuauuuugcgacau

SEQ ID NO: 4244305 - RNA, 55 nt, Pseudomonas putida KT2440
ggucggauccagcggcgauucaucgugacgauggaacgcauugcggaucuugauc

SEQ ID NO: 4244306 - RNA, 57 nt, Pseudomonas putida KT2440
gagcagguucgcccgcuacucgaugaacugggcaacccggccggugcgacccugcuc

SEQ ID NO: 4244307 - RNA, 87 nt, Pseudomonas putida KT2440
gccgauggcggucugcaguucguuggcccacuggcugacacgaaugcucaugccguggugggcgaacagcgccagcacguggucggc

SEQ ID NO: 4244308 - RNA, 67 nt, Pseudomonas putida KT2440
uugggcuuguaggugaaggucagcgugcaaugggacuuccagugcuggcggaccucaucguguucaa

SEQ ID NO: 4244309 - RNA, 88 nt, Pseudomonas putida KT2440
cacugcauacagcggcgccagcgggcgcugggcgcgaagauggcugacaauuuccgccaggucuucgcuggcgccggaaugguagcug

SEQ ID NO: 4244310 - RNA, 82 nt, Pseudomonas putida KT2440
uugcugcgucugauggugcggugguuuaugccgggagugguuugaggggcuacggcgagcugaucaucaucaagcacagcga

SEQ ID NO: 4244311 - RNA, 96 nt, Pseudomonas putida KT2440
cccagggcguuugccugccuugcgcauggcguccagcugcucugccaccgacucggcaaagcgcuugccgugcgcuuccacgggccagugcucggg

SEQ ID NO: 4244312 - RNA, 106 nt, Pseudomonas putida KT2440
uuggggccgcuuggcggcccauucgcggguaaacccgcgccuacaaaacauacgcggcuuucguaggagcggguuuacccgcgaaugggcugcaaagcagccccaa

SEQ ID NO: 4244313 - RNA, 79 nt, Pseudomonas putida KT2440
ggccaucgagcaugggugaaauauuagcgaugaaggcaucuaguccauuggcuucgauuuuaucccgcuucauguuguc

SEQ ID NO: 4244314 - RNA, 78 nt, Pseudomonas putida KT2440
agucacgacgcuguguguccgcuauguaacgcaaccgaagguugcuucacauagcgggcacacaaggcaggucugauu

SEQ ID NO: 4244315 - RNA, 63 nt, Pseudomonas putida KT2440
ggcgcgagcccaugucggcguacuugccguagcuggcgaaggcgcccgacauggacuugagcc

SEQ ID NO: 4244316 - RNA, 81 nt, Pseudomonas putida KT2440
aaagacguuuuuccuggucagaaccuggaaaugagcauucgcaucgaauguugauuucuggcuuuugucagaucguucuuu

SEQ ID NO: 4244317 - RNA, 68 nt, Pseudomonas putida KT2440
ccagcagugugugauagucacuggcgguuuguugcaaagcggccaguucccugucgcgcagcuccugg

SEQ ID NO: 4244318 - RNA, 70 nt, Pseudomonas putida KT2440
gaugcggcacaaucccuggaggcggugcagcgugacaucgacguacugcugccaggcauucuggagcguu

SEQ ID NO: 4244319 - RNA, 66 nt, Pseudomonas putida KT2440
ccggcuggcugucuuucaggucggcgcagaaguagccuucgcgcucgaacuggaagcgguccucgg

SEQ ID NO: 4244320 - RNA, 91 nt, Pseudomonas putida KT2440
ugcugcgcaggguaucgaucagcgaggccagcaccuugucgguauaggccaggguguugucguacccguugaugauuuccuccucgcugca

SEQ ID NO: 4244321 - RNA, 130 nt, Pseudomonas putida KT2440
ggaagaaggcguuuccgcagccgaggucaucaugacugugcugcacgccggcgguaaguuugacgacaacuccuacaaaguauccggcggucugcacgguguaggugugucgguugugaacgcccugucc

SEQ ID NO: 4244322 - RNA, 100 nt, Pseudomonas putida KT2440
ggggcugcugugcagcccuucucgggcucgcccgcucccacagguacagugcagucucugugggagcgggcgagcccgcgaagggccgcacagcggcccc

SEQ ID NO: 4244323 - RNA, 75 nt, Pseudomonas putida KT2440
gcaugcugcucagcauuucgccgcauuuguccagaugauggagauaggcgcgcgagaaguuggugcagguauagc

SEQ ID NO: 4244324 - RNA, 69 nt, Pseudomonas putida KT2440
gcauccuggcaguggcugaccaccugucacagaaacggguugccgcgggugaaaagccacugcugaugc

SEQ ID NO: 4244325 - RNA, 72 nt, Pseudomonas putida KT2440
ggcuuuagccgcgaaugaacgcaccgcgagcuuucaggaaugaggcguuaucguucauucgcggcuaccgcc

SEQ ID NO: 4244326 - RNA, 72 nt, Pseudomonas putida KT2440
gcagguuuacugcugagcuugaacagcuugugguaggccgcgaagaguugcuguuccucagcauuguacugc

SEQ ID NO: 4244327 - RNA, 129 nt, Pseudomonas putida KT2440
ccggucagcgcgucaucggccuugaguggcaguacgucguagucuuucagcgccuugucguagucaaggccugccucuuugaaggcggcacggauguacuggucgucgaugaacuugccgguguccagg

SEQ ID NO: 4244328 - RNA, 75 nt, Pseudomonas putida KT2440
guggcccaggcugacccgcgccaucauggccaggaucagcccggucauggcgccaacggucagcgcgugggucac

SEQ ID NO: 4244329 - RNA, 104 nt, Pseudomonas putida KT2440
ccggacgcauggggccgggugaggugcuggggaucgaggggaucaucgacgaagaagauucgcuggccgaauuccgcacgcugaccaguugcgugcuguaccgg

SEQ ID NO: 4244330 - RNA, 68 nt, Pseudomonas putida KT2440
ggccuguucgcgggcaagcccgcuccuacacugaucgauguaagggcgggcuugcccgcgaacaggcc

SEQ ID NO: 4244331 - RNA, 58 nt, Pseudomonas putida KT2440
ggucgguuugacguucucagccaccgaggucuggucggcugugauggugaccuugacc

SEQ ID NO: 4244332 - RNA, 90 nt, Pseudomonas putida KT2440
gugcacgggcgcuucgaugauguucucaagcgcagucaugugcgaccacagguugaagugcuggaacaccaucgacaggcgcgaacgcau

SEQ ID NO: 4244333 - RNA, 88 nt, Pseudomonas putida KT2440
gaucggagucggucuuggcugaacaggguuaugcgcgcagaucagucuggugaacauagccuguuuuccgacgauccgaaagccaguc

SEQ ID NO: 4244334 - RNA, 71 nt, Pseudomonas putida KT2440
gcacugauuguaucgaaaugcugcagcaccaaauuacccaugcgccgcgcgucauccgaugcagcagucgc

SEQ ID NO: 4244335 - RNA, 86 nt, Pseudomonas putida KT2440
ccgggcucuucgcggguaacccgcuccuacacacaugccucaagaucugugcacuguaggagcggguuuacccgcgaaagggccgg

SEQ ID NO: 4244336 - RNA, 87 nt, Pseudomonas putida KT2440
ggcuacccguacggcgaucgcguuccgcguacgguccgcaugcugguuaccgucaccgccgaacgcaucccuggugucgagauggcc

SEQ ID NO: 4244337 - RNA, 96 nt, Pseudomonas putida KT2440
gcgccguacaggcuggggucgccgcugugcacccgggccacauccugaccuuuuucaugugcgcugcgcauggcggcgaugaucuguuccaggugc

SEQ ID NO: 4244338 - RNA, 65 nt, Pseudomonas putida KT2440
gccuugaugcuggcagcgccgcgcaguauucgcagcaugcugcgcggaaugcugccguacgaagc

SEQ ID NO: 4244339 - RNA, 77 nt, Pseudomonas putida KT2440
gccggggcugguggugcaugcugccgaugaugcucucgugcccgcagaugaggcacaugucauccacaaguccuggu

SEQ ID NO: 4244340 - RNA, 74 nt, Pseudomonas putida KT2440
gccgcuguccaggcugggcagcaacccggaccgggcauguuccgggcugcugucgagcuugaaacccagcaggc

SEQ ID NO: 4244341 - RNA, 84 nt, Pseudomonas putida KT2440
gccaucgcccaggcgcgcucgguaggugcggacuacguguuguacacgcgcuucgcacguaccgacgaucgcaucggcaauggu

SEQ ID NO: 4244342 - RNA, 67 nt, Pseudomonas putida KT2440
gccggguucgcgcuguggaccgugcuggucugauucggggccaaucgcaucccacgcgaaucccggu

SEQ ID NO: 4244343 - RNA, 87 nt, Pseudomonas putida KT2440
cgagauccugugggagcgggcuugcccgcgaauacgaugguggauucaccgccgcauucgcgggcaagcccgcucccacaguguucg

SEQ ID NO: 4244344 - RNA, 71 nt, Pseudomonas putida KT2440
ccacggugccguuggccggcacggugaugacgguuuugccgucacucagcgugaaggucaaugcacugugg

SEQ ID NO: 4244345 - RNA, 58 nt, Pseudomonas putida KT2440
gcugcucacgcagccauugcggcaaguuguuccagcccgcagucaccugugucggugc

SEQ ID NO: 4244346 - RNA, 66 nt, Pseudomonas putida KT2440
agcggcugcggaugccauugauguugaagguggcaaucuucagcgcuuucaugcguccgggucgcu

SEQ ID NO: 4244347 - RNA, 64 nt, Pseudomonas putida KT2440
cgguccuugaacugcggcuggucgagguugaacacgaaacccugggccaccugcgguuuggccg

SEQ ID NO: 4244348 - RNA, 67 nt, Pseudomonas putida KT2440
gauguuuacagccugaaccggcccuuucgcgggcugccggcgaaagggucgguucaggcgacccauc

SEQ ID NO: 4244349 - RNA, 61 nt, Pseudomonas putida KT2440
caaccaaucgcuggcgcaauuuagagagcugaaaauaccggagcugugccagcggugguug

SEQ ID NO: 4244350 - RNA, 59 nt, Pseudomonas putida KT2440
ccuggagcugcgccucaagcagagcgcguugucacccuucugcuugcaccgcagccagg

SEQ ID NO: 4244351 - RNA, 91 nt, Pseudomonas putida KT2440
acgguuaccacggcuccaccuucgccggugcaugccugggcgguaugagcggcaugcacgagcaggguggccugccgaucccgggcaucgu

SEQ ID NO: 4244352 - RNA, 98 nt, Pseudomonas putida KT2440
gcuggccuuuucgcggguaaacccgcuccuacaauggauugcaucggugguuggacacagaccgucguaggagcggguuuacccgcgaagaggccagu

SEQ ID NO: 4244353 - RNA, 73 nt, Pseudomonas putida KT2440
guuggccguggagcagcuggccgcagaacugggcaucagccggcgucaacuggaccggcaguuccaggccagc

SEQ ID NO: 4244354 - RNA, 65 nt, Pseudomonas putida KT2440
agugccgcggacucgucgccaguaucggccagcagcgaugugguggcggugaggccggcggcgcu

SEQ ID NO: 4244355 - RNA, 65 nt, Pseudomonas putida KT2440
cgaagcgcggcaaggugggguugaccaggcaguccugcaacucggccuuguccgucagaaacucg

SEQ ID NO: 4244356 - RNA, 103 nt, Pseudomonas putida KT2440
ggggcgcauuaacgcucuuguacguugcagcgccugccagaucgagcaccgcccgcgcggcacacgaucuggcaggcgcugcacuauuggaggcguacgcccc

SEQ ID NO: 4244357 - RNA, 74 nt, Pseudomonas putida KT2440
ggcguacuuccuugcccucggcaaucagcuugcggcgcaugcgcagcugcgagaaggcgaugaccagguacacc

SEQ ID NO: 4244358 - RNA, 125 nt, Pseudomonas putida KT2440
gcagcucaacgacgcacccgagcaggcccugcgcgugcaguugcaggccagguugcguaacgcugacgugguguugcagcgcagccgcaaacugcgcgcgaugaaugccgugucgcaagagcugc

SEQ ID NO: 4244359 - RNA, 78 nt, Pseudomonas putida KT2440
uugauucgcccaugaccuccugacgccuccuagcaacuggaaaagcuuggaagcaucuaggaagucagggcgauucag

SEQ ID NO: 4244360 - RNA, 79 nt, Pseudomonas putida KT2440
gcucaagaucgccaucagccucuauccgcuugccaaucagcuccacguugguggaccagacaauggugcggucgcgggc

SEQ ID NO: 4244361 - RNA, 63 nt, Pseudomonas putida KT2440
ucgcgggcaugccugcccccacggguucugcgcuuaacccugcgggagcgggcaugcccgcga

SEQ ID NO: 4244362 - RNA, 79 nt, Pseudomonas putida KT2440
cgugggacgccaaagcgcuugcccuugagcgcgcuggcaucuaccgccaguucaagguacgacgcugggcguaccgucg

SEQ ID NO: 4244363 - RNA, 71 nt, Pseudomonas putida KT2440
cuucuucacaggcuccuugcugaucgaggugaucuucagccucgacggccugggccugaugaguuucgaag

SEQ ID NO: 4244364 - RNA, 68 nt, Pseudomonas putida KT2440
gcucggcauuggugaugcgggcguucucuugcaggcuguugagaaugccgauaucaguacgaucgagu

SEQ ID NO: 4244365 - RNA, 58 nt, Pseudomonas putida KT2440
gacggugugaaaacgugaugacggggguagcccgcaggucagccguuuucacacaguc

SEQ ID NO: 4244366 - RNA, 78 nt, Pseudomonas putida KT2440
ggucuggcgcauguaggucgacuuaccgcccauguucgggccggugaugaucagcaugcgcguacuguuguccaggcc

SEQ ID NO: 4244367 - RNA, 69 nt, Pseudomonas putida KT2440
ucagccaggcgcuggaucaguugaccagccugcuggagccggccaucgugcugauccugggcuugcugg

SEQ ID NO: 4244368 - RNA, 113 nt, Pseudomonas putida KT2440
cuucggugucgucccagucggccagcaggcggcgugccaguggcagcagcacuucgccuucggcagucaggcugacgcugcgcguggugcggcugagcagggcgccgccgagg

SEQ ID NO: 4244369 - RNA, 63 nt, Pseudomonas putida KT2440
ggcugcggccuugcgcagcgguaccgcggaaaucugcaggguggcgcuggcaauggucgcgcc

SEQ ID NO: 4244370 - RNA, 102 nt, Pseudomonas putida KT2440
ggccugcaucggccuuuguaggagcggguuuacccggaaugcgucauuugccucaccaucgcauucgcgggugaacccgcuccuacaggggucaugcacgcc

SEQ ID NO: 4244371 - RNA, 77 nt, Pseudomonas putida KT2440
ggguuuuagugggggagcgugggcgcuugcgaaaaccguuggacaguugcgaaggcguuacgcuucccaggugacgc

SEQ ID NO: 4244372 - RNA, 68 nt, Pseudomonas putida KT2440
uggcuguaggccaguacguggccgucgagggcgcugcgcaaggccugggcgccgugcuggccuagcca

SEQ ID NO: 4244373 - RNA, 90 nt, Pseudomonas putida KT2440
guuucuauguggcgccggagcuggugaacaguggcugggccgagcucaacucgcgcggccggcugcuguucauggcugcgcacccggagc

SEQ ID NO: 4244374 - RNA, 123 nt, Pseudomonas putida KT2440
ccuugguguagaugucguugguaaccacggcgaucugguagugaucgcgcauggccuugcacagcgcuuccagcagugcggucuugccagagccgaccgggccgccgacaccgacgcgcaggg

SEQ ID NO: 4244375 - RNA, 130 nt, Pseudomonas putida KT2440
cguuaacugaucgacuauuggggcugcuuugcagcccaucgcgacacaaggccgcucccccauugccuuugugggagcggccuugugucgcgaaaggaccgcgaagcggucccaaaagucucagcuucag

SEQ ID NO: 4244376 - RNA, 86 nt, Pseudomonas putida KT2440
guuccggcccuuucgcggguaaacccgcgccuacaggcggugcaaagcccguaggagcggguuuacccgcgaagaggcccuagaac

SEQ ID NO: 4244377 - RNA, 66 nt, Pseudomonas putida KT2440
cgccugcaagaguugcugcuggccguuggcgaggagaucgccugcccgguaccggcguugcaggcg

SEQ ID NO: 4244378 - RNA, 57 nt, Pseudomonas putida KT2440
ugggcugaccccgcuguaccuuccaaacgauccaagagucagcauggcguuagucca

SEQ ID NO: 4244379 - RNA, 87 nt, Pseudomonas putida KT2440
ggaucuucucgccgaucaaguuccaggccgacaugggcgugcugcuggcauucauguucgucuggaacauggucggcgcauugaucc

SEQ ID NO: 4244380 - RNA, 90 nt, Pseudomonas putida KT2440
cugugccggccucuucgcggguaaacccgcuccuacagucggacauuaaccguuguaggagcggguuuagccgcgaagaggccggcgcag

SEQ ID NO: 4244381 - RNA, 73 nt, Pseudomonas putida KT2440
gcgauagguggcgcuguaguucgacugcagguccauguuggccugcuugaagugugccgcgccgccuucgagc

SEQ ID NO: 4244382 - RNA, 82 nt, Pseudomonas putida KT2440
cuggcagcgagucaguaaucugggugaugaauuggccgggcugcccaaggaccugagccggcgcacccuggacgcuagccag

SEQ ID NO: 4244383 - RNA, 74 nt, Pseudomonas putida KT2440
uuggcgcgguauggucgguuccgugcucaugcagcggaugcuggaggagcaggauuucgaccuuaucgagccgg

SEQ ID NO: 4244384 - RNA, 96 nt, Pseudomonas putida KT2440
gcgcguaaugcacaggcagcagcaugugaacggccgucacacaggcgcucaauggcgccguguaacaguugcuucucaucugccaugccaucgcgc

SEQ ID NO: 4244385 - RNA, 75 nt, Pseudomonas putida KT2440
cuggaugcucauaagcucuuugaaaaugcuuugaccucaauacgucuaggcaucgaagauuuugagcugucccag

SEQ ID NO: 4244386 - RNA, 76 nt, Pseudomonas putida KT2440
gcgggcuugcccgcucccacaggucgugcacagcuuucaaaagcggugguguuccugugggagcgggcaagcccgc

SEQ ID NO: 4244387 - RNA, 68 nt, Pseudomonas putida KT2440
gcugccauggccgucggcgagcgcgugauccugccgcaggugggcaccuuugccgacggcguggcggu

SEQ ID NO: 4244388 - RNA, 91 nt, Pseudomonas putida KT2440
agccuguaccggccucuucgcgggcaagcccgcucccacagguucucccccuguaggagcggguucacccgcgaagaggccaguacaggcu

SEQ ID NO: 4244389 - RNA, 130 nt, Pseudomonas putida KT2440
cucgucgucggcagguguuggucgcugcauuuucagcgccugugaggucgagcgccgccuacgcggugcgcgaucucacaggccauaaagccgucaugacgaacgcccuuguguaacgccagacaccgag

SEQ ID NO: 4244390 - RNA, 105 nt, Pseudomonas putida KT2440
gucugcuuugcagcccaucgcgacgcaaggccgcucccacagaggaucggcguacgacguacuuugugggaacggccuugcgucgcgauagggccgccaagcggc

SEQ ID NO: 4244391 - RNA, 99 nt, Pseudomonas putida KT2440
ggcgccugguccggaccggaaugauggcccauugucggcaucgcggggcaguucggcaauguccauaaaggucaucggcgagggggaucaggucaugcc

SEQ ID NO: 4244392 - RNA, 67 nt, Pseudomonas putida KT2440
ucgaccgcuacuucaagcagaucgucggcgacgugaagcuggcgaaaaagcucaaagugguggugga

SEQ ID NO: 4244393 - RNA, 56 nt, Pseudomonas putida KT2440
gguucgucugcggguugcugaugguccagacugucuacagcgcgcagaugauagcu

SEQ ID NO: 4244394 - RNA, 84 nt, Pseudomonas putida KT2440
acugucuggguugaugagcugaagcggcaguaacucagccaauugcgcggcgcugcgcgcauuuugcccaucgaugcggauagu

SEQ ID NO: 4244395 - RNA, 81 nt, Pseudomonas putida KT2440
gcgcccguucuucaaggagguguaccacugcauggccgcgcucggccugccacgugacaccuucaugcacgaaaugggugu

SEQ ID NO: 4244396 - RNA, 76 nt, Pseudomonas putida KT2440
ggcugcauuggucgugacgcucgcugccaugaaccucccggaccaggggagggcgaacgccacgaccgaugcagcc

SEQ ID NO: 4244397 - RNA, 67 nt, Pseudomonas putida KT2440
aggccuugcgccugcuggccaauggcggcaaccccgaagacgugcuggcccagcuggcccggggccu

SEQ ID NO: 4244398 - RNA, 87 nt, Pseudomonas putida KT2440
acgaugccguacccucggcgcgguaguugcgcgaguccugcaucggguaguaggucuugcccagcacgguguacggguuggccuugu

SEQ ID NO: 4244399 - RNA, 57 nt, Pseudomonas putida KT2440
ucaugcuuucuggcaggugcggcuggauggcagucaguaccgccuugaagcacuuga

SEQ ID NO: 4244400 - RNA, 69 nt, Pseudomonas putida KT2440
gcugcugccagggcaauggauggacaccuucuggcuggguuugcagauccucuugauccuggcagcggc

SEQ ID NO: 4244401 - RNA, 55 nt, Pseudomonas putida KT2440
gcagccuugcuuaccucgaucaagccuuacuuugggcaggugggcaacugguugc

SEQ ID NO: 4244402 - RNA, 74 nt, Pseudomonas putida KT2440
ggcgcaaggugcugaugcucggcgacggggucaacgauguaccgguacuggccgccgccgauaucagcaucgcc

SEQ ID NO: 4244403 - RNA, 118 nt, Pseudomonas putida KT2440
gcacuuucaggugcccggcauccaucuuugcgagccuucgccacagcgcacgccggugcucuaucaggcgggggcgucgagccguggcaaggacuucgcugccgggcacgccgagugc

SEQ ID NO: 4244404 - RNA, 100 nt, Pseudomonas putida KT2440
guugccggugcuggccucuucgcggguaaacccgcuccuacaggggcagcgauaauccuguaggagcggguuuacccgcgaaagggccggcacugacaac

SEQ ID NO: 4244405 - RNA, 79 nt, Pseudomonas putida KT2440
cugguucuggguggccgaggcgaaggaugccugggucugagagacuucggcgauguuuuccuugccguccugggucugg

SEQ ID NO: 4244406 - RNA, 60 nt, Pseudomonas putida KT2440
ugcugauaucggcggcggccaguaccgguacaucguugaccccgucgccgagcaucagca

SEQ ID NO: 4244407 - RNA, 119 nt, Pseudomonas putida KT2440
gggggccgcugcgcgccccuccgcgggcuugcccgcucccacagggcuugcguucagccuggggcuaagcuguaccugugggaacgggcaagcccgcggaggggcgccaagcggccccc

SEQ ID NO: 4244408 - RNA, 124 nt, Pseudomonas putida KT2440
cuggagugccggggggcugcugcgcagaccuucgcggacacgcccgcucccacagguaucgcgcguacacccgugggagcgggcgugcccgcgaaggggcgcaaagcgcccccggaaaugccag

SEQ ID NO: 4244409 - RNA, 119 nt, Pseudomonas putida KT2440
uguugucugaaccggccucuucgcgggcccgcccgcucccacaaggaccccacugucuucagggcugugauaucccugugggugcgggcgggcccgcgaaaaggccggcacaggcaaua

SEQ ID NO: 4244410 - RNA, 71 nt, Pseudomonas putida KT2440
cuucgaaacucaucaggcccaggccgucgaggcugaagaucaccucgaucagcaaggagccugugaagaag

SEQ ID NO: 4244411 - RNA, 63 nt, Pseudomonas putida KT2440
gacuucucgaucacgauacccaggcccgccacgguggcaccugccugcuugaugaucgagauc

SEQ ID NO: 4244412 - RNA, 74 nt, Pseudomonas putida KT2440
cauccagcaccugcugcuggccgaggcccgcauacacacgcgagaucagcucggacagcgccagguagcuggug

SEQ ID NO: 4244413 - RNA, 127 nt, Pseudomonas putida KT2440
ucgcugugcaccaggcucccgccgauuacccuucaggcaagcagggcgaugugaucaccguggaauucacgguaauggguaucccuugcgugggccucaaugguggcccggccuucaagcacuguga

SEQ ID NO: 4244414 - RNA, 74 nt, Pseudomonas putida KT2440
guucgggaagguauuuuugaacaugggucugacccaucuugaaggucaggccuuugucgaaggcaucaccgaac

SEQ ID NO: 4244415 - RNA, 57 nt, Pseudomonas putida KT2440
aaugaagaucccagaguuuaugguauuucugagaauacuaucgacaggauuuuuauu

SEQ ID NO: 4244416 - RNA, 62 nt, Pseudomonas putida KT2440
caacggcgaaccggccguguucgaccacgccuuuaucgccgaacauggccauggcgucgaug

SEQ ID NO: 4244417 - RNA, 92 nt, Pseudomonas putida KT2440
gccucuucgcggguaaacccgcuccuacaaguagugcaccgccugagagggcuguggugaaccuguaggagcggguuuacccgcgaagaggc

SEQ ID NO: 4244418 - RNA, 69 nt, Pseudomonas putida KT2440
uguacugcggcgugcgccugaaggcggcgguguucgacgaaucaucgcccuucggcgccacccucgacg

SEQ ID NO: 4244419 - RNA, 129 nt, Pseudomonas putida KT2440
guggugggggcgacgguuuauggcggccaugaccguacgguguaugucgagcgccagccggucuauuacgcgccgccgccgguguacguacaaccgccuccacagccgcuguacuaccagcccuacuac

SEQ ID NO: 4244420 - RNA, 108 nt, Pseudomonas putida KT2440
cgcccgguaucgccguugggcgaaacuugacgaagucagcaaaaaggagcgcugaggcuuccuucaauccugcgacucgcaagcagugccgaacggaaauugagggcg

SEQ ID NO: 4244421 - RNA, 87 nt, Pseudomonas putida KT2440
gcgccugguguucgagccgauguaccggcagaucuuaccgggucuggaccugucggugccgaucggcgcgagcuacaccaacggcgc

SEQ ID NO: 4244422 - RNA, 66 nt, Pseudomonas putida KT2440
gccagcgcuggauaccgguaauuucacgcuccaggcgcaucagcuccugggugccgccacgcuggu

SEQ ID NO: 4244423 - RNA, 68 nt, Pseudomonas putida KT2440
ggagagugaaaccaaguccuuugaaugugccagacugcaaaacauaaucuaggcgguaaucacuuucc

SEQ ID NO: 4244424 - RNA, 74 nt, Pseudomonas putida KT2440
gcgaauuuuuaccugguggucgauacgcccggcguaaucgaucacaccguccgggcgauagcgcgccaggucgc

SEQ ID NO: 4244425 - RNA, 69 nt, Pseudomonas putida KT2440
gugacaucgcgcuggaugccgauguaguaggucagcugguccgccucguugugcaccggugugauggac

SEQ ID NO: 4244426 - RNA, 63 nt, Pseudomonas putida KT2440
uucgcggguaaacccgcuccuacaagaugcgccaaaccuuguaggagcggguuuacccgcgaa

SEQ ID NO: 4244427 - RNA, 63 nt, Pseudomonas putida KT2440
ggugaagcagguucgcgugucgugaucgaagaguuucucgacggcgaggaagccagcuucauc

SEQ ID NO: 4244428 - RNA, 79 nt, Pseudomonas putida KT2440
ucgagacaauaguuguucaugauuucagugccgcucucaccagcaaagcggucaaugauuucgugggcgcgcugcucga

SEQ ID NO: 4244429 - RNA, 63 nt, Pseudomonas putida KT2440
gucugcgucugcuucugcuuuugcuguugcuucuaagcgcgcgauaguucaggcgacgcagau

SEQ ID NO: 4244430 - RNA, 74 nt, Pseudomonas putida KT2440
guugcugggcguagcccuguccaaaacguagcuuuggugagauccccaccuuuuggauaaaggucgccuacaac

SEQ ID NO: 4244431 - RNA, 82 nt, Pseudomonas putida KT2440
cgugacacggcgaccgaggaugaagacgaucagccgaacaugcacaucgagcgguugucgcgcuuuucgucgguccugcacg

SEQ ID NO: 4244432 - RNA, 57 nt, Pseudomonas putida KT2440
ggccugccagguagcgggugggccaaaguagucgcccaccuguuuaccgguacgguc

SEQ ID NO: 4244433 - RNA, 68 nt, Pseudomonas putida KT2440
gucagggcaagguccgcugccgaaacugaacuuccuuguucauucgacacagaggacauugccauggc

SEQ ID NO: 4244434 - RNA, 57 nt, Pseudomonas putida KT2440
cagccgcugcugcgcugggccauggaagaaagccugggccagacggagcgugcgcug

SEQ ID NO: 4244435 - RNA, 59 nt, Pseudomonas putida KT2440
gccgcuuguacgcaguggcgagcgccuuuaccugcgccguuacuggaguuacgagcggc

SEQ ID NO: 4244436 - RNA, 108 nt, Pseudomonas putida KT2440
cuguaugggccucuucgcgggcuugcccgcucccacaaguacugcaaaguccuugaaaccugcguaauaccugugggagcgggcaagcccgcgaagaggccgguacag

SEQ ID NO: 4244437 - RNA, 72 nt, Pseudomonas putida KT2440
caggucaaccagguaaugguggugguacugaucguggcgaugauccugaucgcgaccaugaccuauggcccg

SEQ ID NO: 4244438 - RNA, 85 nt, Pseudomonas putida KT2440
ggcacgccauaccugcgggcugaucgccucgccgccgggguaaccgcuuuguuguggcgugaucagcaacugccgguggcgggcc

SEQ ID NO: 4244439 - RNA, 56 nt, Pseudomonas putida KT2440
ccgaagccacgucggcagggucugacggaguguccaggccuucgaugguggugcgg

SEQ ID NO: 4244440 - RNA, 122 nt, Pseudomonas putida KT2440
cgcuacccuacaggcaccggacaccacggcaccgcaaccacugaccaaccugguguuguccaacgacggccugguacucaguggccgcggugaagcaggugccaccguuaccgugcuuggcg

SEQ ID NO: 4244441 - RNA, 78 nt, Pseudomonas putida KT2440
gugccggcccuuucgcggguaaacccgcuccuacacaaaucccagugggagcgggcgcgcccgcuaaagggccgcgac

SEQ ID NO: 4244442 - RNA, 59 nt, Pseudomonas putida KT2440
cgaccacuacgacacggcgguguacucugggguguccaccgacuacagcgugguggucg

SEQ ID NO: 4244443 - RNA, 104 nt, Pseudomonas putida KT2440
ucucgauguacagcuggcgggcgaugaccugaagcugcucugggcugaucugcccgaccaggcgguacaucaggucucgccagguccagaaacugucguugggg

SEQ ID NO: 4244444 - RNA, 61 nt, Pseudomonas putida KT2440
cggcaaugaccucggcaggaagccggaaggugcgccggaaacugccaaaggugcauugccg

SEQ ID NO: 4244445 - RNA, 57 nt, Pseudomonas putida KT2440
gacacguuguucgcgcgcuguuguugauauuuggcacgcgucacagagcaagguguc

SEQ ID NO: 4244446 - RNA, 62 nt, Pseudomonas putida KT2440
cgaugggucaggucuucgaccaugcgcugacgcugcagcaguucgaccaccugggccaggcg

SEQ ID NO: 4244447 - RNA, 56 nt, Pseudomonas putida KT2440
auguugcugguggccaccagggucugugccugggccaggucggccagcagcagcau

SEQ ID NO: 4244448 - RNA, 86 nt, Pseudomonas putida KT2440
ucgaacagguccuuguacuucgaacgcagggccaugacuucggucauguccacuucguugaagguggucagcaucgccauguucga

SEQ ID NO: 4244449 - RNA, 93 nt, Pseudomonas putida KT2440
cccugugggagcgggcacgcccgcgaaugcgauagcucaggcaaagguauuuccaggucugacgcauucgcgggcgcgcccgcucccacaggg

SEQ ID NO: 4244450 - RNA, 89 nt, Pseudomonas putida KT2440
agcccccuuaacguguaggagcggguuuacccgcgaauacgucaguggcaccaccaccgcauucgcgggugaacccgcuccuacaggcu

SEQ ID NO: 4244451 - RNA, 110 nt, Pseudomonas putida KT2440
gaccgagcugccugcuucgcgggugaacccgcuccuacaggggccuugccgucuucagggcagcacccaccuguaggagcggguuuacccgcgaagcagccgacucgguc

SEQ ID NO: 4244452 - RNA, 70 nt, Pseudomonas putida KT2440
cccucgacguugguagcgguggcguugccuucgcgaccgccauugacuaccagguagccgucuuugaggg

SEQ ID NO: 4244453 - RNA, 67 nt, Pseudomonas putida KT2440
gguccuggugguaugcaucuuuggcuuccgcuucaugcugugggucaacaagauugccguuugggcc

SEQ ID NO: 4244454 - RNA, 67 nt, Pseudomonas putida KT2440
auguuugcagcgccugugagauccagcgccgcccgcgcggcacucgaucucacaggugccaaaacau

SEQ ID NO: 4244455 - RNA, 74 nt, Pseudomonas putida KT2440
caccgucgcguugaugggccaagcggcgcagaguggccagcuguucggccuguaucaacgccuuaacuauggug

SEQ ID NO: 4244456 - RNA, 71 nt, Pseudomonas putida KT2440
gccucaauggcaaugucgagcuggcggggaugcagcaugaccugcuguucggcauugaccaugaagaccgc

SEQ ID NO: 4244457 - RNA, 56 nt, Pseudomonas putida KT2440
aucaccugcacuggccucuucgcggguuuacccgcgaagaggccggcucaggcgau

SEQ ID NO: 4244458 - RNA, 56 nt, Pseudomonas putida KT2440
ucguacgacaaguccaaagagucuucguacaccaagucucacgacucuucguacga

SEQ ID NO: 4244459 - RNA, 82 nt, Pseudomonas putida KT2440
uggccugugggagcgggcgugccggcgaaugcgauauugaauuuaccauugcauucgcgggcacgcccgcucccacugguua

SEQ ID NO: 4244460 - RNA, 57 nt, Pseudomonas putida KT2440
ggugaaaugcagggcaaaaagaacuggcaauugccguucugggccgugcuguuuccc

SEQ ID NO: 4244461 - RNA, 61 nt, Pseudomonas putida KT2440
guuuuuggacgaucccaacaggugaauggucucguucaucccguuguaguccuccagagac

SEQ ID NO: 4244462 - RNA, 127 nt, Pseudomonas putida KT2440
gacaagggcaacgcgcuucccugugggagcgggcacgcccgcgaacaccggcgaagccggugccauccaccgugucgccugauucgcgggcaugcccgcucccacagagggagugcggcgugcuugc

SEQ ID NO: 4244463 - RNA, 85 nt, Pseudomonas putida KT2440
ggcgguggauucgguggucacgaggcgggccugcggugcgaagcgaaaaaugccgcauagucuaccagccucguggccauucgcc

SEQ ID NO: 4244464 - RNA, 71 nt, Pseudomonas putida KT2440
gcgaaaucgccgaggcgcuggaggccgagggcuacuucuucuccucggccgguggcagcccggucaguugc

SEQ ID NO: 4244465 - RNA, 80 nt, Pseudomonas putida KT2440
gugcucgugcucgcgcagguugagguuguggucaagcagugacuugagccacgccuuggccgugacgccggcuucggcgc

SEQ ID NO: 4244466 - RNA, 109 nt, Pseudomonas putida KT2440
guuuaccggcuggucgaauugcaggcuuugcugacgggcugugcaggccucgacagacgucugcccugcccgcucggcaaaugcgugccagggcaggaagccggcaggc

SEQ ID NO: 4244467 - RNA, 81 nt, Pseudomonas putida KT2440
cguugcccuggaacucucgcuggucugcuccaucaggcuggaucagcugguggaccuguccggccagauuccgggguugcg

SEQ ID NO: 4244468 - RNA, 65 nt, Pseudomonas putida KT2440
cugcugcuugaccgcuccgggccacuggcacuguucgccguggccgacacggucaaggacagcag

SEQ ID NO: 4244469 - RNA, 88 nt, Pseudomonas putida KT2440
ggcggugcgggccuucaauaagcuugucgaccgguaccaauaugaauagcucuucagguucgauaggcuugcugaaggucuucuuguc

SEQ ID NO: 4244470 - RNA, 69 nt, Pseudomonas putida KT2440
ggcuccucggaagucaggucuggcaagguaucccugugacaccgccgaccugagacuuccgauuccgcc

SEQ ID NO: 4244471 - RNA, 77 nt, Pseudomonas putida KT2440
ccggcaggaagucugguuucacaucgaacggguuggcuugcaacgggccggccaguaggagugugaggaagagcagg

SEQ ID NO: 4244472 - RNA, 59 nt, Pseudomonas putida KT2440
cgguuugccaggcagggcggcguuuuuccaggaaagcgcgcaggcccuccuggccuucg

SEQ ID NO: 4244473 - RNA, 74 nt, Pseudomonas putida KT2440
gcagcaauggcggcagccagaagggcuagcuugcguggguuagucauuguugcuccugcuauuggguuuguugc

SEQ ID NO: 4244474 - RNA, 60 nt, Pseudomonas putida KT2440
uggccgugcugcuggggcuggacguggacgaacucagcgucuccgcgcgcagcauugccg

SEQ ID NO: 4244475 - RNA, 67 nt, Pseudomonas putida KT2440
cuucgcgggugaacccgcuccuaccagggauacacaugcccuuguaggagcggguucacccgcgaag

SEQ ID NO: 4244476 - RNA, 68 nt, Pseudomonas putida KT2440
guugcagcaggcggaucgagucgaagaucuuguaggcgaucagcggcuccaucacguucagcugcagc

SEQ ID NO: 4244477 - RNA, 68 nt, Pseudomonas putida KT2440
gcacggcgaccuuggccaaucgcugucgcugggccgaccggucacggcacuguuggccgagcgccugc

SEQ ID NO: 4244478 - RNA, 73 nt, Pseudomonas putida KT2440
cugcccagcgcagcugcguccggugcgcuggcgaacaauucuucgcgcaauucgacgcggcugacgccagcgg

SEQ ID NO: 4244479 - RNA, 78 nt, Pseudomonas putida KT2440
acgcgucguagucgaccgaauaacuguuggcacggccagggucguuguugucagucccuugguuguagacaucgucgu

SEQ ID NO: 4244480 - RNA, 78 nt, Pseudomonas putida KT2440
cccuguaggagcggguuuacccgcgaaugcggcagugaaugcaccaucgcauucgcgggugaacccgcucccacaggg

SEQ ID NO: 4244481 - RNA, 75 nt, Pseudomonas putida KT2440
ggcccuuucgcgggcaagcccgcucccacaaugaacggguauccccuguagaagcgggcuugcccgcgaagggcc

SEQ ID NO: 4244482 - RNA, 71 nt, Pseudomonas putida KT2440
gauucagcugaccgguauugccagccgucauaucgguauguggauugccgugaugcugguguugcuggguc

SEQ ID NO: 4244483 - RNA, 91 nt, Pseudomonas putida KT2440
aucgagucgauggagauggccggcguugucaccccgaugaacagcaacggcucgcgggaagugauagccccgggcggcccgcgcgacugau

SEQ ID NO: 4244484 - RNA, 72 nt, Pseudomonas putida KT2440
auucgcgggcaagcccgcuccuacaucgaccgguggugucgccacguuguaggagcugguuuacccgcgaau

SEQ ID NO: 4244485 - RNA, 70 nt, Pseudomonas putida KT2440
ggucauagguguuccacacguagucgaacggcgugucgccaucgaugcgcguguaggacagcuugaagcc

SEQ ID NO: 4244486 - RNA, 65 nt, Pseudomonas putida KT2440
uucgcgggcaugcccgcucccgcaggguuaagcgcagaacccgugggggcaggcaugcccgcgaa

SEQ ID NO: 4244487 - RNA, 83 nt, Pseudomonas putida KT2440
cuucgcgggcuugcccgcucccacagguacggugcagauuucaaaccugcauccauccuguaggagcggguuuacccgcgaag

SEQ ID NO: 4244488 - RNA, 74 nt, Pseudomonas putida KT2440
gcugacggucaaggcaucgccauccaggccuuucagauacagcugaaagugccccaguggggugcgcugcaagc

SEQ ID NO: 4244489 - RNA, 55 nt, Pseudomonas putida KT2440
gcgggcuggagugauguacaugccggcugcgauagcaucgaaacgaccagcucgc

SEQ ID NO: 4244490 - RNA, 75 nt, Pseudomonas putida KT2440
cugauuuuaaguugccuguaccugccucuucgcgagcaugcccgcgaagaggcagguacaggugcaaucgaucag

SEQ ID NO: 4244491 - RNA, 55 nt, Pseudomonas putida KT2440
guuggguuuccuuguaguuggccacuacauaggcuugcugcaggggcaccacagc

SEQ ID NO: 4244492 - RNA, 78 nt, Pseudomonas putida KT2440
ggcagccaucgcccgcuugggugcgucggcaagcaucaagcccagauggccgugcucccagcggguacguuggcuguu

SEQ ID NO: 4244493 - RNA, 75 nt, Pseudomonas putida KT2440
uccggcaugacguucacgccguugacgcugaguuugucaccuacaggccggcgcaaggcggugugcagcaccgga

SEQ ID NO: 4244494 - RNA, 68 nt, Pseudomonas putida KT2440
aaccucgggaauggucguaucgugcagcgcuuccgauaaccccacuugcagacguauuccugaguguu

SEQ ID NO: 4244495 - RNA, 64 nt, Pseudomonas putida KT2440
cggcacgugggcgaucgacagcagcaggucgaugaccugggccuucuucauugccgaagugucg

SEQ ID NO: 4244496 - RNA, 100 nt, Pseudomonas putida KT2440
gccggcccuuucgcgggcaugcccgcucccacagguagcccacaggccuugaaggcggcgugguuccugugggagcgggcgcgcccgcgaagaggccggu

SEQ ID NO: 4244497 - RNA, 75 nt, Pseudomonas putida KT2440
gcuuguugaugaucugcccgaccaggccgcccaguugcuccagcuggucgauauggcgggcauacaucaacacgc

SEQ ID NO: 4244498 - RNA, 75 nt, Pseudomonas putida KT2440
guucggaaggugaguuccccggacgcuuacucgcuguaugcguucgagacgggagcagaguuguacuuucuggac

SEQ ID NO: 4244499 - RNA, 77 nt, Pseudomonas putida KT2440
gccgcuggcucacgaccuggucgugacccugagcaacaacgcucaggucaccaucaaggcuggcgagaccagcgcgc

SEQ ID NO: 4244500 - RNA, 74 nt, Pseudomonas putida KT2440
gccgggcccggccucgguaucgccgugaccgggcuacuggcacugguugcgcaugugcuggggcuuggcucggc

SEQ ID NO: 4244501 - RNA, 64 nt, Pseudomonas putida KT2440
accugagcacgagacgaaaaaugagcauucacgccggcgcagucauuuguuugucgugccaggu

SEQ ID NO: 4244502 - RNA, 76 nt, Pseudomonas putida KT2440
ugcgcauggugucucuccuuucauaggccggugauuaccggaugagcacagucuagggagaucaccgucaagcgca

SEQ ID NO: 4244503 - RNA, 64 nt, Pseudomonas putida KT2440
caccuggcucaagaagcuggcucgacugccuccguggucgggccuguuucuggagucgcucgug

SEQ ID NO: 4244504 - RNA, 68 nt, Pseudomonas putida KT2440
cagucuuagcaucgcggaaguacagcucggacacauccaccagcaacuucuucggugcugccgggcug

SEQ ID NO: 4244505 - RNA, 70 nt, Pseudomonas putida KT2440
cugucaacucgcuugccgaucaggccuuccagcuucagccggcaggcacugucgagcagugacuggacag

SEQ ID NO: 4244506 - RNA, 62 nt, Pseudomonas putida KT2440
ccgaucagguuggcguacucguuggacuugaaguccgacagacgcacgaugaccuuuuucgg

SEQ ID NO: 4244507 - RNA, 67 nt, Pseudomonas putida KT2440
guuccagccuuggcguucggcgggucaagcgaccuugcuaaccucgagaagguuaaggcaguggaac

SEQ ID NO: 4244508 - RNA, 60 nt, Pseudomonas putida KT2440
cauguaguccaaagcuuuguagccgguuucguaagcgcugcgcagguauagggcuacgug

SEQ ID NO: 4244509 - RNA, 87 nt, Pseudomonas putida KT2440
uggcugggggugaagcggccuuguaucggcccucucgcgucgaaccgccgcgaaagggccgguacagguuuacucaauggucagcca

SEQ ID NO: 4244510 - RNA, 103 nt, Pseudomonas putida KT2440
ggggccgcgugcggcccauucgcggcacaaggucgcuuccacaaggaaccaugaucuccugugggagcggccuugugucgcgaaugggcugccaagcagcccc

SEQ ID NO: 4244511 - RNA, 71 nt, Pseudomonas putida KT2440
ccacagugcauugaccuucacccugagcgacggcaaaaccgucaucaccgugccggcuaauggcaccgugg

SEQ ID NO: 4244512 - RNA, 99 nt, Pseudomonas putida KT2440
gcgggcaucuacggcagcgccgggauugcccuggcggcgguggccaacgcugccaucgugcccuuggucaaccugcucugcguacugguguuugcccgc

SEQ ID NO: 4244513 - RNA, 57 nt, Pseudomonas putida KT2440
uuccaagauugucgacaauccuguuuuucaagaaugggcugucaacaaucuguggag

SEQ ID NO: 4244514 - RNA, 91 nt, Pseudomonas putida KT2440
ccuugugggagcgggcgugcccgcgaacacgggcgcagcccgugccaaccaccgcggugccugcuucgcgggcucgcccgcucccacaagg

SEQ ID NO: 4244515 - RNA, 91 nt, Pseudomonas putida KT2440
gugcacggucuggaacacccauuucugguugccggugguggcguccaaagccagcaccgaagcgccguaagugugguccaguuugcugcgc

SEQ ID NO: 4244516 - RNA, 80 nt, Pseudomonas putida KT2440
ccgcgucacgcagcgcagcgguggacuccugcacccggucgaucacugccugcaggcggccccguacgcgcuggucgcgg

SEQ ID NO: 4244517 - RNA, 82 nt, Pseudomonas putida KT2440
gcucaguugcagguuggccuguucgucgagcagaacgguccagccaccgucauguucggccgcagccggaaacaugcagagc

SEQ ID NO: 4244518 - RNA, 68 nt, Pseudomonas putida KT2440
gcggauggcauggcugaccccggcgggcauccacaaggcaugcccgccggggaucacccagcugccgc

SEQ ID NO: 4244519 - RNA, 88 nt, Pseudomonas putida KT2440
gcugucgugacggcguacuucaccuuuguauggguaaacgucgaugacgucgcccaugcccagguuggugcagucgaauucgaucggc

SEQ ID NO: 4244520 - RNA, 86 nt, Pseudomonas putida KT2440
cguuggccguuacguugagaaauagcacaccgagcaguguaccggguacguugacccgguugugcaggcucaacguggcaccgaug

SEQ ID NO: 4244521 - RNA, 79 nt, Pseudomonas putida KT2440
guuucucaacguggucggcggggugaaggugcuggaaacggcuucggaccuggcccugcuggcggcggugaugucgagc

SEQ ID NO: 4244522 - RNA, 77 nt, Pseudomonas putida KT2440
guucgcggguuaacccgcgccuacacauugauggauggacaccaccugccguuguaggagcggguucacccgcgaau

SEQ ID NO: 4244523 - RNA, 99 nt, Pseudomonas putida KT2440
gggcgaucagacgaucgcacagcgcuauaagcuaaaguccagagagucccacucuuuggaauuuaauguguauguggacgguguucgucucuaucgccc

SEQ ID NO: 4244524 - RNA, 70 nt, Pseudomonas putida KT2440
gugggcgcggguuuacccgcgaaugcgucauugaauuugccgacgcauucgcggguaaacccgcuccuac

SEQ ID NO: 4244525 - RNA, 86 nt, Pseudomonas putida KT2440
cccgcgugcugcuggaucuccgguacgugcuugugcgccagcuccaggccauacagcuguagcgccggggcuuuggcggcgccggg

SEQ ID NO: 4244526 - RNA, 64 nt, Pseudomonas putida KT2440
ggcgcaggaacagccgguagcccaggcgcucuuccaguuggcgcaucugcuggcugaccgcgcc

SEQ ID NO: 4244527 - RNA, 69 nt, Pseudomonas putida KT2440
gagccuggaggcaugucgaugguguguuuucgaaccaugaaauuaccguccucauccuccagaucgcuc

SEQ ID NO: 4244528 - RNA, 66 nt, Pseudomonas putida KT2440
ggcaaaagccucuggggccaguugggagaaauggucgauuuucaacgugcccugaaagcuuuugcc

SEQ ID NO: 4244529 - RNA, 79 nt, Pseudomonas putida KT2440
ucgcgacacaaggccgcucccacagggacugcauucccuugugccagcguggcccugugggagcggccuugugucgcga

SEQ ID NO: 4244530 - RNA, 59 nt, Pseudomonas putida KT2440
gccggggcgaucgggcggcugcccuugcugcugccagucauuugccugaucacccuggu

SEQ ID NO: 4244531 - RNA, 62 nt, Pseudomonas putida KT2440
ugucucgcgaugaccugaucuggccgguuuuucucaaggaaggcucagguacacgcgaggcg

SEQ ID NO: 4244532 - RNA, 67 nt, Pseudomonas putida KT2440
acaccaagcucugcguguucgaccauaugagccagcacaacauccucgacaugcucgagcguggugu

SEQ ID NO: 4244533 - RNA, 91 nt, Pseudomonas putida KT2440
cucugugggagcgggcaugcccgcgaaucaggcgacacgguggauggcaccggcuucgccgguguucgcgggcgugcccgcucccacaggg

SEQ ID NO: 4244534 - RNA, 56 nt, Pseudomonas putida KT2440
cugccugggcggcgcuguucgccguggccacgcuguagcccucgucuuccaggcag

SEQ ID NO: 4244535 - RNA, 81 nt, Pseudomonas putida KT2440
ccuggcguauguagcgcagaugccggucguagccgccauuuuccagguaggcugccacgcccaucugcgucacgcuacagg

SEQ ID NO: 4244536 - RNA, 57 nt, Pseudomonas putida KT2440
guucgucgacagugagcaugcccggcaguuggucgagcacuucacugacggcguaac

SEQ ID NO: 4244537 - RNA, 80 nt, Pseudomonas putida KT2440
ucgcgggcaugcccgcucccacagggcucaccacaacccugaaggcugugaggucccugugggagcgggcgugcccgcga

SEQ ID NO: 4244538 - RNA, 87 nt, Pseudomonas putida KT2440
cuuugcugccuguacuggccucuucgcgggcaagauagcccugucgaagcgggcuugcccgcgaaaaggccaguacagucaaaaaag

SEQ ID NO: 4244539 - RNA, 55 nt, Pseudomonas putida KT2440
cagugccagugccgccgggccgcugauccagcaggucaaccagcaacuggcacug

SEQ ID NO: 4244540 - RNA, 122 nt, Pseudomonas putida KT2440
cagauauguacagccugccuuggccucuucgcggguaaaccugccccuacagggaaauauguggccauguaggagcggguuuacccgcgaagaggccggcacagcugaacagggauaucaug

SEQ ID NO: 4244541 - RNA, 71 nt, Pseudomonas putida KT2440
ugcgauuugucguuggugcggcaaugaugggccaauugauggucaucgagagcuggcucaaugacugcgca

SEQ ID NO: 4244542 - RNA, 85 nt, Pseudomonas putida KT2440
ugagggccgcaggcccuuucgcggguaaacccgcuccuacgacgguguaggagcgggcuugcccgcgaagaggccgguggauuca

SEQ ID NO: 4244543 - RNA, 74 nt, Pseudomonas putida KT2440
aacagcuuguccgcagcgccuucgcccucuuccgccgcacgguugaggaagccgaaguuguugcggauguuguu

SEQ ID NO: 4244544 - RNA, 76 nt, Pseudomonas putida KT2440
ucgucggcaaugugcagcuggugguucuugccuugcaccaguucggcaaagcucagcgugcugccguuacuggcga

SEQ ID NO: 4244545 - RNA, 129 nt, Pseudomonas putida KT2440
uaucgucguugccugugccggccucuucgcggguaaacccgcuccuacagguacaucaccgcccuagggcaugugacgcccuugugggagcggguuuacccgcgaagaggcuggcacagucaacagaca

SEQ ID NO: 4244546 - RNA, 82 nt, Pseudomonas putida KT2440
ucgcgacacaaggccgcucccacagauaaugcgcucagccagagcacagcguauuaccugugggagcggccuugugucgcga

SEQ ID NO: 4244547 - RNA, 65 nt, Pseudomonas putida KT2440
gugguuugccuguguuggccucuucgcggguaaccccgcgaagaggcgguacaggaauaaacuac

SEQ ID NO: 4244548 - RNA, 76 nt, Pseudomonas putida KT2440
ucaaggagcuguuucggggguugccggaccaucaacgugucuggucauucggcagcaucgaacauggcgaaaauga

SEQ ID NO: 4244549 - RNA, 77 nt, Pseudomonas putida KT2440
cggccuucaaggccuguucggucuugccgacccacgcgauuuccggguggguguagaugaccgacgggaucaggucg

SEQ ID NO: 4244550 - RNA, 74 nt, Pseudomonas putida KT2440
agcgguccuugccagugugcuuggcuucauauaaugccugaucggcgcggaccagcgcggugguaaggcucucu

SEQ ID NO: 4244551 - RNA, 55 nt, Pseudomonas putida KT2440
gggcugcugugcuggugccucggcgaagcaagguccgcacccgagccaguagcuc

SEQ ID NO: 4244552 - RNA, 78 nt, Pseudomonas putida KT2440
gcaccgccuggaugaagucgagcucgcucaucgccugauacggcgcggcauaguagcugauguucuccacggcaaugc

SEQ ID NO: 4244553 - RNA, 55 nt, Pseudomonas putida KT2440
augcuguagacaagguuucgaugguugccagccagcucggaggcuuucugcgcgu

SEQ ID NO: 4244554 - RNA, 117 nt, Pseudomonas putida KT2440
uggccucacugggagcagccaacgccgucggucugguggucgggccggcgcuggccgcacugcuggcgcggcacagccugagccugccguuccauaucaugucgcugcugccggcca

SEQ ID NO: 4244555 - RNA, 58 nt, Pseudomonas putida KT2440
gcugcccaggccggaacugaggcgauagaaauccucgggcaguuccuccaggcgcagc

SEQ ID NO: 4244556 - RNA, 55 nt, Pseudomonas putida KT2440
ggucggucaagucguccgcagguacguauacggccuguacggaggugaucgaacc

SEQ ID NO: 4244557 - RNA, 83 nt, Pseudomonas putida KT2440
gcaacccauggcuuccaucugcuuggccugguucacgaaggcuucgaugguguguaccgggcuggugguguaagcgauggugc

SEQ ID NO: 4244558 - RNA, 122 nt, Pseudomonas putida KT2440
uguggcagcaacucucuugcucaaagccugaaaggcugcgcgaucacugugggagcgggcucgcccgcucccacagggucggcguauugcuuugaaucagggagcgucaggccgcagccgca

SEQ ID NO: 4244559 - RNA, 88 nt, Pseudomonas putida KT2440
agucgccacguaccaccaccaguucagaaccgccguagaccucgguacccugauggucacgugucaguugcugggcgccgugguagcu

SEQ ID NO: 4244560 - RNA, 66 nt, Pseudomonas putida KT2440
ggcuggccaguacugugugcucagcggucgaaccgagugcuggccaugcaguuacgugacccugcc

SEQ ID NO: 4244561 - RNA, 78 nt, Pseudomonas putida KT2440
acaccggcuuuagcgucgagcagguacgucgccugcgugacgaguucggcguguaccugaucgacagcggccgugugu

SEQ ID NO: 4244562 - RNA, 61 nt, Pseudomonas putida KT2440
cguggguaagucacacauuggcuguaaauuuuuuucagggucgacgcuguucuugccugcg

SEQ ID NO: 4244563 - RNA, 115 nt, Pseudomonas putida KT2440
caguggaaaccuagcaugaacucacugccugaacaaaaaauacaaggaggcaccgugacgcuucaugucccuuuuuuggguuuagcgcaguggcaagcaggccuguuuccugaug

SEQ ID NO: 4244564 - RNA, 103 nt, Pseudomonas putida KT2440
ggggcugcuuggcagcccauucgcgacacaaggccgcucccacaggagaucaugguuccuuguggaagcgaccuugugccgcgaaugggccgcacgcggcccc

SEQ ID NO: 4244565 - RNA, 87 nt, Pseudomonas putida KT2440
ccauucgcgggcaagcccgcucccacaggaucaccacaugccugaagguuguggagucccugugggagcgggcuugcccgcgaaugg

SEQ ID NO: 4244566 - RNA, 80 nt, Pseudomonas putida KT2440
gguacugcggcaggauggugcuuugcagcguaucgcuugcgggggcuugcagcaguucuuccaugcgcuugcgcaguacc

SEQ ID NO: 4244567 - RNA, 96 nt, Pseudomonas putida KT2440
cggccucuucgcgggcuugcccgcucccacagguacagcacaguucucaaggucuguggugauacugugggagcgggcaagcccgcgaaggggccg

SEQ ID NO: 4244568 - RNA, 84 nt, Pseudomonas putida KT2440
gccugcuucgcggguaaacccgcuccuacaaagguucgcgccaggcgugaggccgguguaggcgcggguuuacccgcgaauggc

SEQ ID NO: 4244569 - RNA, 77 nt, Pseudomonas putida KT2440
uggcggugucggcguucuucaucagcuggcucagcucacugccauccugcgggcugagggcgaugccgaugcuggcg

SEQ ID NO: 4244570 - RNA, 59 nt, Pseudomonas putida KT2440
gguggugauguucggccccuaucagcaggagcguuggcagguggccuacgaucgccguc

SEQ ID NO: 4244571 - RNA, 71 nt, Pseudomonas putida KT2440
agcugcgucaguuguucggccaugcaguggauuacccgccgcuggccgucacucagcugauaaccgcggcu

SEQ ID NO: 4244572 - RNA, 66 nt, Pseudomonas putida KT2440
gcuggccacgaauacaugaucgugaccaacuacccgaacaaccugcauguggucgauguggccagu

SEQ ID NO: 4244573 - RNA, 108 nt, Pseudomonas putida KT2440
acuuguucgaaaccaccgagaggcgaucgauacggccguccagguaggcguccagcaucacuuugacggagccgaucagaucguugaucgauggcucuucgcccaagu

SEQ ID NO: 4244574 - RNA, 77 nt, Pseudomonas putida KT2440
gguagcggcgcaggugucgaugcccugguacugguagcuuugcaucaguucacggguaucgaugccagcgcguugcu

SEQ ID NO: 4244575 - RNA, 63 nt, Pseudomonas putida KT2440
gcucuucgcgagcgagucagacauccaaaguaccaacggcaccuuuguuugcucgucaggagc

SEQ ID NO: 4244576 - RNA, 92 nt, Pseudomonas putida KT2440
cgcagccugaaccuugacagcaccuugcgcgucagccucaguggcgcccaggcugaggccuggcgcgaggcgcuggucaaggccggggugcg

SEQ ID NO: 4244577 - RNA, 113 nt, Pseudomonas putida KT2440
ucaucagcgccggccaccacaggcgguugauggcguccugaaccaugucgcgcugggcuugggugcccuggcgcaucauggucaggagcauuucguagcccuggcgcuggugg

SEQ ID NO: 4244578 - RNA, 68 nt, Pseudomonas putida KT2440
ggccuguucgcgggcaagcccgcccuuacaucgaucaguguaggagcgggcuugcccgcgaacaggcc

SEQ ID NO: 4244579 - RNA, 86 nt, Pseudomonas putida KT2440
ugaccggcgaugcgaucaguugcaggccuggcgccggcccaauguuuuuuccaggccaugcaacgauccgggcaggccaguggucg

SEQ ID NO: 4244580 - RNA, 94 nt, Pseudomonas putida KT2440
ugcucggccgaggccugcaggcgcuggugccacacgacccaguagcgcuggcuguggucgaugaagcccaguggucgccaggccaggucaugca

SEQ ID NO: 4244581 - RNA, 82 nt, Pseudomonas putida KT2440
gcgccgauuuccggcaggcgguuggccaggcgcuggccgucggcggugagugccaggcgcaccugccuacggucgucggcgc

SEQ ID NO: 4244582 - RNA, 83 nt, Pseudomonas putida KT2440
ugcuccggccuuuucgcggguuagcccuccccuacauugguauguucuuuguaggagcgggcuugcccgcgaagaggccagca

SEQ ID NO: 4244583 - RNA, 94 nt, Pseudomonas putida KT2440
accugcauucgcgggcaaugcccgcuccugccggaauaccacagcauuaaaggucuggguaaucugcaggagcgggcuugcccgcgaagaaggu

SEQ ID NO: 4244584 - RNA, 84 nt, Pseudomonas putida KT2440
agcagugcccacggugccguuggccggcacggugaugacgguuuugccgucacucagcgugaaggucaaugcacugugguuguu

SEQ ID NO: 4244585 - RNA, 79 nt, Pseudomonas putida KT2440
cgaaccaccuggcagcuauaaccgaauucguugucguaccagacguacagaacaacgcgguugucguuggcgauggucg

SEQ ID NO: 4244586 - RNA, 95 nt, Pseudomonas putida KT2440
ccugucucggcccuuccaugcaugacccguuccugcacaggaacgcgcguuauccaguguaggagcggguucacccgcgaagaggccaugacagg

SEQ ID NO: 4244587 - RNA, 91 nt, Pseudomonas putida KT2440
ugggaacaacuguccugcucacacguugaagcuuggcgcgaucaccgggagcguugccagggcuucacacguguggcuccacaguuaccca

SEQ ID NO: 4244588 - RNA, 72 nt, Pseudomonas putida KT2440
gcgaccaaggccauggccagcaguaucaggccgaaugccagggccuggccugcugccgccgugggguggcgc

SEQ ID NO: 4244589 - RNA, 93 nt, Pseudomonas putida KT2440
ggcuggccuguucaagcagaagcagugccgcgcuggugcgcaggucagccuuggcgaaccagcuacggcgcugcucggcauugagggccagcc

SEQ ID NO: 4244590 - RNA, 55 nt, Pseudomonas putida KT2440
ccauuccugcacggugcaugcacgcaaccuuugugaugcgccguggauagagugg

SEQ ID NO: 4244591 - RNA, 64 nt, Pseudomonas putida KT2440
cggguggcugggcaggccggcguaaugcaccuucuccacgccguccugcugcuccagccauucg

SEQ ID NO: 4244592 - RNA, 64 nt, Pseudomonas putida KT2440
ggcaaccugcacagugugcuuagcgaguuguauuccaaugcgcuggagcauggugugcugggcc

SEQ ID NO: 4244593 - RNA, 73 nt, Pseudomonas putida KT2440
guugaucgccaugcuggaggaggggguagggaucaguaccuugccguaccucgcuuuuccgcaggagaacgac

SEQ ID NO: 4244594 - RNA, 64 nt, Pseudomonas putida KT2440
cuggucgucgagcuugggguuggccggaugcaugaucaucuucggccccaggucguugauccag

SEQ ID NO: 4244595 - RNA, 62 nt, Pseudomonas putida KT2440
uggcuuuggcgguuugccggggcagcguuucgaccugauccuguccaacccgccguaugucg

SEQ ID NO: 4244596 - RNA, 72 nt, Pseudomonas putida KT2440
ugaccaagcgcgugacccucgacagccgcgacgagaucggcgacauggcgucggcggucaaucgcuuugucg

SEQ ID NO: 4244597 - RNA, 96 nt, Pseudomonas putida KT2440
gccauccaguuuggcaacgauggcaccuucgccuauguggucaaugagcagagcaccgucaauguccgcaagcugaaggugggugccagcgauggc

SEQ ID NO: 4244598 - RNA, 60 nt, Pseudomonas putida KT2440
gccuuuaagugggcccagcaaaagaguuuaauuaagucuguugagggcgccguuguaggc

SEQ ID NO: 4244599 - RNA, 66 nt, Pseudomonas putida KT2440
augagccaggucaggaucagccgucagcacugggauaaccugcugggcgagcuugaccuggcccgu

SEQ ID NO: 4244600 - RNA, 129 nt, Pseudomonas putida KT2440
gugugugcguauuuauugccugugccggccucuucgcgggugaacccgcuccuacaagggggugucgcuuucuugaguguaggaguggguuggcucacgaagaggccgguacaggcuggccaucacuuc

SEQ ID NO: 4244601 - RNA, 122 nt, Pseudomonas putida KT2440
cgugcagcuguucgauggcagcggccaggaauaccguggucaguugcucgaggugggcaagaaaacuguccgcgucagccuugaccaggccuuugccggccaggccgauucaccgcugcaug

SEQ ID NO: 4244602 - RNA, 86 nt, Pseudomonas putida KT2440
cuuucgcgggcacgcccgcucccacagggaccucacagccuucaggguuguggugagcccugugggagcgggcaugcccgcgaagg

SEQ ID NO: 4244603 - RNA, 76 nt, Pseudomonas putida KT2440
gaugaccuguucgcgcccugacgggcugcgcaggucggccuccugccagcgcagacgaucaggguaccgguucauc

SEQ ID NO: 4244604 - RNA, 61 nt, Pseudomonas putida KT2440
gcugaucgccuugguaccgcugcuggccgccaguggcccagacaccagccaaggcgacagc

SEQ ID NO: 4244605 - RNA, 90 nt, Pseudomonas putida KT2440
cugggcaccgccuuguucgucaagagccgaaagggcuaucugccgacugacaccgcccaggccuuggccgagcaggccgaacgugccgag

SEQ ID NO: 4244606 - RNA, 80 nt, Pseudomonas putida KT2440
ggguacagcugggucgaugcggaaaacagcaugaaggugccuuccuacacccuguucgacgccucgaucggcuaugaccu

SEQ ID NO: 4244607 - RNA, 80 nt, Pseudomonas putida KT2440
gguccuuggcgcggucuucggcggcuugcugagcguguugcauggccugcucgaaaccgucgagcugaucgugcauggcc

SEQ ID NO: 4244608 - RNA, 98 nt, Pseudomonas putida KT2440
gccggaucauuacaucaacgacaauuggccaugcaaggcaaucgauggcagagacguuugcguacaggucgauggucguugaguuggaugaaaccggc

SEQ ID NO: 4244609 - RNA, 56 nt, Pseudomonas putida KT2440
uucgcggguaaacccgcuccuacacugcccaauguaggagcggguuuacccgcgaa

SEQ ID NO: 4244610 - RNA, 64 nt, Pseudomonas putida KT2440
cuggaaggccagcgggucagccguguggugguucgcgaccggcggcugcgcuggccgauuccgg

SEQ ID NO: 4244611 - RNA, 75 nt, Pseudomonas putida KT2440
ggcuucggcagcaugugugcggcaauuggcgggauguucaugacgcagauugucggcagcgugcugaccgcuacc

SEQ ID NO: 4244612 - RNA, 71 nt, Pseudomonas putida KT2440
ccuggcuggccaggagcugacgccacuguucggccagcccgacugguuccucggcauccugaccugccagg

SEQ ID NO: 4244613 - RNA, 101 nt, Pseudomonas putida KT2440
gugaccgacauugucggcuuguggaaguaccuggccaagcacggcaaccaguugggcggguugucggcgccacgguucuugcgcauggucggcaaggacac

SEQ ID NO: 4244614 - RNA, 109 nt, Pseudomonas putida KT2440
gccgccggagcgccuggaaaaacugcgcgccuuccucggcgaguugggccuuagccugcacaagggcaaggacccgucgccgaaggacuaccaggcccugcuggcgagc

SEQ ID NO: 4244615 - RNA, 55 nt, Pseudomonas putida KT2440
uccacagauuguugacagcccauucuugaaaaacaggauugucgacaaucuugga

SEQ ID NO: 4244616 - RNA, 56 nt, Pseudomonas putida KT2440
gcgcacgcauccgcaaggccauggccgaaggccgcccaugccgcgaagugcugcgc

SEQ ID NO: 4244617 - RNA, 82 nt, Pseudomonas putida KT2440
gugccagcagugcucagucagucgaucagcgaaagcggccauaaccgcacgguacugcugguggacgacgaccaccuggugc

SEQ ID NO: 4244618 - RNA, 68 nt, Pseudomonas putida KT2440
gggaaccauagcaaaguauucggcggcugaccuacccggaucagucggcgaaugcuuuucuagaucuc

SEQ ID NO: 4244619 - RNA, 64 nt, Pseudomonas putida KT2440
gcgucgccuugcaacguaccccacagaugaucgucgcccugcuggcggugcucaaggcuggcgc

SEQ ID NO: 4244620 - RNA, 70 nt, Pseudomonas putida KT2440
guaggagcggguucacccgcgaaugcuacagaagccucaccgccgcauuagcagguaaacccgcgccugc

SEQ ID NO: 4244621 - RNA, 71 nt, Pseudomonas putida KT2440
ccacgguaccguuggccggcacggugaugacgguuuugccgucgcucagcgugaaggucaaugcacugugg

SEQ ID NO: 4244622 - RNA, 71 nt, Pseudomonas putida KT2440
ccacagugcauugaccuucacgcugagcgacggcaaaaccgucaucaccgugccggccaacggcaccgugg

SEQ ID NO: 4244623 - RNA, 93 nt, Pseudomonas putida KT2440
gggccaagcguguggcugaucaggcgcugaugugcgugcagcagcauccggugcacagccaucuggucagcgaucgcgcagcgcuggaggccu

SEQ ID NO: 4244624 - RNA, 88 nt, Pseudomonas putida KT2440
aauuucaaaauugcugucauagcagcggccagaacgcucuauugauaggucgauggagauguagucguuguuguacguuuugcaaauu

SEQ ID NO: 4244625 - RNA, 77 nt, Pseudomonas putida KT2440
guguacaacugccgguaaagcagagcgcaacgcugugauggcgcacgcguucuaccgcuggcuggcaugaagugcac

SEQ ID NO: 4244626 - RNA, 64 nt, Pseudomonas putida KT2440
guuggcgcaaccagucgaucaaugggcgguugcuacggcuucggucgaucggguuggcgccgac

SEQ ID NO: 4244627 - RNA, 95 nt, Pseudomonas putida KT2440
gaucgggcagcugcugccacaucagugggugccugccuaacuuacgcaaggugaguugggcggacgcuuacucaccaucggccugcgugccgauc

SEQ ID NO: 4244628 - RNA, 58 nt, Pseudomonas putida KT2440
guugaucauggccggcgcacguuugcagauccaguacuugcccaccgccgugaccagc

SEQ ID NO: 4244629 - RNA, 95 nt, Pseudomonas putida KT2440
caucggcaacccacgcgaccgugcaguguucauuacccgccagggcaaucgcaucagcccccgggcagugaggcugcggguaaagguugccggug

SEQ ID NO: 4244630 - RNA, 66 nt, Pseudomonas putida KT2440
gggagaguacugcgacccuguuaccucauauuacuuauuagguaacggcuaucgcggcuacaaccc

SEQ ID NO: 4244631 - RNA, 83 nt, Pseudomonas putida KT2440
gcggcccaggacgacggcagugccagcgugccacaaccggccaaggcccacugguggccacuggcauugucgggcgucgccgc

SEQ ID NO: 4244632 - RNA, 111 nt, Pseudomonas putida KT2440
uccucguaggucaugcgggccggcacgacuucgcacacauugggcacuucgcucauggaaauaacgcgggcaauguccaggugcugcgaguaacuguacuguucaaccgga

SEQ ID NO: 4244633 - RNA, 113 nt, Pseudomonas putida KT2440
ugaaccugugccggcccuuucgcgggugaacccgcugauggacacacgucgaggguuggaccuaggccgccguaggaucggguuuacccgcgaagaggccagcacagguugca

SEQ ID NO: 4244634 - RNA, 61 nt, Pseudomonas putida KT2440
cagcaucgcagggggagccguuggaggugcuauagcuacagugguuuguacugcgguguug

SEQ ID NO: 4244635 - RNA, 55 nt, Pseudomonas putida KT2440
guuguugcaugagcgcuucgagcuugaagacugccugaucgaagugcugcacaac

SEQ ID NO: 4244636 - RNA, 92 nt, Pseudomonas putida KT2440
ccuugugucgcgaaagggcugcauagcagccccagguuuguugcauacacgcggaaauugccggcgcuaugcggcccuuucgcgacacaagg

SEQ ID NO: 4244637 - RNA, 62 nt, Pseudomonas putida KT2440
cuggcaauaagggugaucgcguccgcuuaaaaauacgcggacaccaucgcccuuaaugcugg

SEQ ID NO: 4244638 - RNA, 124 nt, Pseudomonas putida KT2440
ccgcuggggggagaguccaccaacguugccagcuguggcuguaacugugcuggcaagggugcagccugaacuuugucggcgcguuuacggcugcugcgcggggcaguggcuuuuuuugcagcgg

SEQ ID NO: 4244639 - RNA, 63 nt, Pseudomonas putida KT2440
ugaguaccuucggcgacggcgaagcgcccgacagcgcucgcgccuucgagcgcaagguacucg

SEQ ID NO: 4244640 - RNA, 73 nt, Pseudomonas putida KT2440
ccugguagccgucggcacgcaggacggccacgccgggcauguucugcgaggucauggccaccacgaacagcgg

SEQ ID NO: 4244641 - RNA, 78 nt, Pseudomonas putida KT2440
ggggcacggccaaucacacugaagaaguuggccucggcaucggccaggucgacuucggcgguguccagguuguuuucc

SEQ ID NO: 4244642 - RNA, 70 nt, Pseudomonas putida KT2440
cggcccuuuagcgggcgcgcccgcucccacugggauuuguguaggagcggguuuacccgcgaaagggccg

SEQ ID NO: 4244643 - RNA, 90 nt, Pseudomonas putida KT2440
gcuugggcaggccguagaucaggucgagguugaccgagcgaaacugcagcgugcgcgcagccucgaucaggguacgggucuguuccaggc

SEQ ID NO: 4244644 - RNA, 56 nt, Pseudomonas putida KT2440
ccagugcagugggccugggcgcaaugagugcagugauccagguggcaaugaacugg

SEQ ID NO: 4244645 - RNA, 74 nt, Pseudomonas putida KT2440
ggccccauugugacggagcggcggcgcauagcccugguaagggagcaauugccacuguucaucgucauugugcc

SEQ ID NO: 4244646 - RNA, 63 nt, Pseudomonas putida KT2440
ggaauuggagagccaugacccacagaagcggacaguucuguucgucgagaugccuucgucucc

SEQ ID NO: 4244647 - RNA, 69 nt, Pseudomonas putida KT2440
uggugcgccaggcccgggcaagcggcaugcugcugaacuucaaugcccuguucgaagguuuggcgauca

SEQ ID NO: 4244648 - RNA, 59 nt, Pseudomonas putida KT2440
ccuggcugcggugcaagcagaagggugacaacgcgcucugcuugaggcgcagcuccagg

SEQ ID NO: 4244649 - RNA, 96 nt, Pseudomonas putida KT2440
gagcgcgaugugcgcggcgagugggugucucucgaugacagcuacgccgcgguguuggcgcgucaugaguacccccagccgguccaggugcugcuc

SEQ ID NO: 4244650 - RNA, 97 nt, Pseudomonas putida KT2440
gcugccgcugaaacgggccuuguuggcguugcuggcgauguacugauuguuccucagaggcucgcugaucaugccggugaucucgucguagaacagc

SEQ ID NO: 4244651 - RNA, 64 nt, Pseudomonas putida KT2440
ggccucuucgcgggcaagcccgcuccuacaccgucguaggagcggguuuacccgcgaaagggcc

SEQ ID NO: 4244652 - RNA, 73 nt, Pseudomonas putida KT2440
gcccuuucgcggguaaacccgccgcuacaagcuacgcggccccugugggagcggguucacccgcgaagaaggc

SEQ ID NO: 4244653 - RNA, 79 nt, Pseudomonas putida KT2440
ggguggagguguugccugugcugacccuuucgcggguaaacccgcgaagcggccagaacaggcaaccucaccuucggcu

SEQ ID NO: 4244654 - RNA, 112 nt, Pseudomonas putida KT2440
ggccgaugcgcguggcguaacccucgacccggcguugaccgcguugcucgaaggcuucgacuggcccggcaacauccgucagcuggaaauggugguacgcaccgcgcuggcc

SEQ ID NO: 4244655 - RNA, 61 nt, Pseudomonas putida KT2440
accacagcccauuggccugggcgauuucaccgaccgggcgcagcgggucgagggcaguggu

SEQ ID NO: 4244656 - RNA, 75 nt, Pseudomonas putida KT2440
gcagccugaucgauguguugaagcuggguggcgucgguuacgugcgccuggucgagcacaugccgccauggcugc

SEQ ID NO: 4244657 - RNA, 82 nt, Pseudomonas putida KT2440
ggccgcgaccaucgauacgccccggcgccuguugauaacgguucaucaacuggcccuccgcgugcgguaccacggcguggcc

SEQ ID NO: 4244658 - RNA, 56 nt, Pseudomonas putida KT2440
acggguaucgcacaccaguucgaagcccagggccuugaacagggugcgguacuggu

SEQ ID NO: 4244659 - RNA, 69 nt, Pseudomonas putida KT2440
gaagcucaguacaacaucgaccagggcgacaccgagugggccccgagcguugguguuggccugaacuuc

SEQ ID NO: 4244660 - RNA, 104 nt, Pseudomonas putida KT2440
gcucagggaggggcugacgauacggcgcucgcugccgacaugaucgcggaagcugucguugucuucgacagcgagguugauccggcccagcagauucccuucgc

SEQ ID NO: 4244661 - RNA, 92 nt, Pseudomonas putida KT2440
cgcaccccggccuugaccagcgccucgcgccaggccucagccugggcgccacugaggcugacgcgcaaggugcugucaagguucaggcugcg

SEQ ID NO: 4244662 - RNA, 94 nt, Pseudomonas putida KT2440
gcgccaggcuggcaccgaucacgcuguucaugcgcuccauggucaucaugaccaucagugccaaugccagcaccuucgggaaccagcccagcgc

SEQ ID NO: 4244663 - RNA, 56 nt, Pseudomonas putida KT2440
auccugcuagcgaccagcgucucgacccugguuggucugcugucgguggcagugau

SEQ ID NO: 4244664 - RNA, 56 nt, Pseudomonas putida KT2440
ugcgugaucgaguugcggguaggccucaucgccauagcgugcacgcuugaucagca

SEQ ID NO: 4244665 - RNA, 80 nt, Pseudomonas putida KT2440
gggucuuuuccgacacuucgaagucgaucuugcgcucauccagaucaacacgcaugaccuugacuucgauggugucgccc

SEQ ID NO: 4244666 - RNA, 98 nt, Pseudomonas putida KT2440
ccagcgcuggaugcacucgauguugugucgggccuguucguucaacugcucgaccugguucggagacaggugcggcgcgccaugcaugaucucgcugg

SEQ ID NO: 4244667 - RNA, 61 nt, Pseudomonas putida KT2440
ggcgaagguauugaacgcccgcaucugcacuugcaggcugcgugcgaucgguuccagcgcc

SEQ ID NO: 4244668 - RNA, 58 nt, Pseudomonas putida KT2440
cuacgcggguaaacccgcuccuacaacgauguguguaggggcggguuuacccgcgaag

SEQ ID NO: 4244669 - RNA, 95 nt, Pseudomonas putida KT2440
guggugggugcgcugacggugauccuguggaagaacuucgacacccucggguuguacgaaaucaucccgggcuuccuguucgccagcaucgccau

SEQ ID NO: 4244670 - RNA, 102 nt, Pseudomonas putida KT2440
gccugguagucguugaguugcagguuguagcgcagguugacccggcggcggaaggcauccauccggcuggccucgaucugcguuguggacggucgccagagc

SEQ ID NO: 4244671 - RNA, 68 nt, Pseudomonas putida KT2440
ucugcacgacaucuucuucgaagcggcggccaaucaggcgcuucacugcgaacaggguguugugcggg

SEQ ID NO: 4244672 - RNA, 78 nt, Pseudomonas putida KT2440
ucgcgggcacgcccgcucccacaggaaucaccagaccuggaggucaugugauaccugugggagcgggcgugcccgcga

SEQ ID NO: 4244673 - RNA, 68 nt, Pseudomonas putida KT2440
gccuucggccugggccacggcgggggcggcuaggcugccgacgaccaggcuugcgcccaggccgaugc

SEQ ID NO: 4244674 - RNA, 84 nt, Pseudomonas putida KT2440
gggagcugaccgaagggcugacgcgauucugcucgaucugcgagaucgucgaauuggucagcccgcugcgacgggccaguuccc

SEQ ID NO: 4244675 - RNA, 77 nt, Pseudomonas putida KT2440
uuacaaaauaaguagccgccaagagucuggaguuuuuuugaaccugcuugguagcgccacucuggcugcuuuuguaa

SEQ ID NO: 4244676 - RNA, 87 nt, Pseudomonas putida KT2440
ggaucaaugcgccgaccauguuccagacgaacaugaaugccagcagcacgcccaugucggccuggaacuugaucggcgagaagaucc

SEQ ID NO: 4244677 - RNA, 59 nt, Pseudomonas putida KT2440
gaaaacagcccaggaagcggaguuuacuggcuguaaccgagcauucugcggcuguuuuc

SEQ ID NO: 4244678 - RNA, 108 nt, Pseudomonas putida KT2440
gcgagaacgcggacuaccaguacaacaagaagcugcugcgcgaaaucgaccgcagggugcgauaccugcgcaagcggcuugaagaugugaaagugguggcguacucgc

SEQ ID NO: 4244679 - RNA, 124 nt, Pseudomonas putida KT2440
agauuuuggggccgcuuugcggcccaucgcgacacaaggccgcucccacaguggcacugcacacgccggcccaugugggagcggccuugcgucgcgaugggcugcgcagcagccccggcaaucu

SEQ ID NO: 4244680 - RNA, 123 nt, Pseudomonas putida KT2440
gcugagaccuuuugcgccugucaggccccggaagccuggcgggcguuuuuucucguugaagacguuaccgcacgcuugccggacgcuuggccaaccccuucuucacgcaaacgauuuaucagc

SEQ ID NO: 4244681 - RNA, 60 nt, Pseudomonas putida KT2440
gccggcgcaaagugacguggugcgccacgaaaccuucgcaccgauccuguacgugcuggc

SEQ ID NO: 4244682 - RNA, 73 nt, Pseudomonas putida KT2440
gcaagccguggcugggccaaugcggcgcugacccugagccuguucggcgccaguuucaucagcgcacggcugc

SEQ ID NO: 4244683 - RNA, 55 nt, Pseudomonas putida KT2440
caggcgcugaucacacaguuugccugacaucaugcaagccuggcggcggcgccug

SEQ ID NO: 4244684 - RNA, 55 nt, Pseudomonas putida KT2440
ggcccgcagcaacgcgcgcaacuggucuuccaucacuugcgggcgcugcaggguc

SEQ ID NO: 4244685 - RNA, 76 nt, Pseudomonas putida KT2440
gcaaccugcucgguaccuggcugcaggaacgcuucuucguugaggcuuucguucuggcucagguacugguuagggc

SEQ ID NO: 4244686 - RNA, 80 nt, Pseudomonas putida KT2440
gcccgacaaucugcucgcugcccgacggcuugaucaugccuacgcccuggucacccucgggcagguugagcaggucgcgc

SEQ ID NO: 4244687 - RNA, 65 nt, Pseudomonas putida KT2440
agugcgcagcgugcuguucggugaucguuaucagccgcguuucaccgggcagucgguguggcgcu

SEQ ID NO: 4244688 - RNA, 117 nt, Pseudomonas putida KT2440
ggggcugcugugcagcccuucgcgggcuugcccgcucccacagggauaucacagcauucaaacccugugauuaccugugggagcgggcaagcccgcgaagggccgcaaagcggcccc

SEQ ID NO: 4244689 - RNA, 55 nt, Pseudomonas putida KT2440
ucgucgaugaggcccugcagcggcgcgaugacgcccuccagauccuugucggcga

SEQ ID NO: 4244690 - RNA, 60 nt, Pseudomonas putida KT2440
gggucgguuuuauugguguugcccugugccccuggggugaugccgaucaagccgccaccc

SEQ ID NO: 4244691 - RNA, 99 nt, Pseudomonas putida KT2440
ucgucgguguaagccgccucccagcccucgaccuuccaugcccaggccagccagggcaggaaguucggcgggcagcgugacgagucggccacgccccgg

SEQ ID NO: 4244692 - RNA, 78 nt, Pseudomonas putida KT2440
gcgccaggcuguggcuggaguugagcaaacgccagcgcgccugcugcaagcgcaucuccagccaccaggccuuggugc

SEQ ID NO: 4244693 - RNA, 77 nt, Pseudomonas putida KT2440
ggcaccuucgcggguaaacccgcuccuacauguaucgcguaucccuguguaggagcggguuuacccgcgaaagggcc

SEQ ID NO: 4244694 - RNA, 83 nt, Pseudomonas putida KT2440
ggauucugcagauggggaugcuguguuggcggccgucguggaugcugucagcgaugcauucgaaauccaucacugcaccaucc

SEQ ID NO: 4244695 - RNA, 70 nt, Pseudomonas putida KT2440
gccacagccagcaguugcucgucgcgcaggcuuucuucacgccgcucugaacgcagcugcuccuggcggc

SEQ ID NO: 4244696 - RNA, 57 nt, Pseudomonas putida KT2440
gcacugcaagcaucgagcugaagcgacugaaccccgcuucaacgguacuugcauugc

SEQ ID NO: 4244697 - RNA, 75 nt, Pseudomonas putida KT2440
ucuucaauagguaccuccaccgaugucaucgccggcgggcacgcuccgaggcauugauggaaugcauuuugacga

SEQ ID NO: 4244698 - RNA, 71 nt, Pseudomonas putida KT2440
ugaacaacccgccgguacuggcagucagcacgccccaagcguucuaccagcaaguacuggcgagugcacca

SEQ ID NO: 4244699 - RNA, 86 nt, Pseudomonas putida KT2440
ccugcgccaacgccgugccuugcgccuggccuggcaguucguucgcccuuaucgccgccaggugcugcuggcauugcuggcgcugg

SEQ ID NO: 4244700 - RNA, 61 nt, Pseudomonas putida KT2440
gguucacguuguuguucucgucgacgguuaagacccgaucgaugcuaaacagcgugaagcc

SEQ ID NO: 4244701 - RNA, 61 nt, Pseudomonas putida KT2440
ggucaccaccacguugagaucgccaauaccccgcuugucggucuucaucggguggcuggcc

SEQ ID NO: 4244702 - RNA, 102 nt, Pseudomonas putida KT2440
ggcugggcaagugagccaaugaucggccucuguggcagcguacgcuuuuguacucugcacaagaccgcugcugccacagggugccauuacacuuuccagacc

SEQ ID NO: 4244703 - RNA, 107 nt, Pseudomonas putida KT2440
cugugccggccuuuucgcgggcccgcccgcacccacagggauaucacagcccugaagacagugggguccuugugggagcgggcgggcccgcgaagaggccgguucag

SEQ ID NO: 4244704 - RNA, 97 nt, Pseudomonas putida KT2440
gucauugauacgcugcagcuugugguucugaugcugcagccgggucagcucggccugcaguucagcgaccgacaggaggccgguugcgggcaauggc

SEQ ID NO: 4244705 - RNA, 71 nt, Pseudomonas putida KT2440
gcaugcgcuccgucaccuuguuauccuuaucgaaacguccugaacugagcguagcagugaggcggcgcagc

SEQ ID NO: 4244706 - RNA, 130 nt, Pseudomonas putida KT2440
uguuuuuugcguugccugugccggccucuucgcgggugaacccgcuccuacgacgggcuguguccaacuguccaccccgugguaggagcggguuuacccgcgaaugcggugguggcggcaacggugaacg

SEQ ID NO: 4244707 - RNA, 68 nt, Pseudomonas putida KT2440
ccuucgcgacgaaucgaacggcgcgcgcgccaaggcgacgcugcagacugagauuugucucgaccagg

SEQ ID NO: 4244708 - RNA, 56 nt, Pseudomonas putida KT2440
gugaauccaacagauuccaagccauacguacuuggcuugcaagcguuugguuucac

SEQ ID NO: 4244709 - RNA, 72 nt, Pseudomonas putida KT2440
caaggguucguggugguggcgguggugcacccgggggacaacgugcgcgaccacagucgccuuggcacccug

SEQ ID NO: 4244710 - RNA, 96 nt, Pseudomonas putida KT2440
gcaagcucuuguuggccugacgcagcgcuugcacggcaccggcauccagcaccagggugccacggguuugcaggugaccggccagccacugcuugc

SEQ ID NO: 4244711 - RNA, 59 nt, Pseudomonas putida KT2440
ggguugucagaaaucagggucgcaaccgacguuguugggaucugguuaguggccagccc

SEQ ID NO: 4244712 - RNA, 72 nt, Pseudomonas putida KT2440
cauggccguaaugccgaagucugggacacugacggcaaacguuacaucgacuucgucggcgguaucggcgug

SEQ ID NO: 4244713 - RNA, 73 nt, Pseudomonas putida KT2440
gaaguuaucaugcguuguauuucgcaucugcuuuccuacccagcuuaauugcgaagucaaucgcgugaauuuc

SEQ ID NO: 4244714 - RNA, 99 nt, Pseudomonas putida KT2440
gugcgcugcggggagcaggccacggucaaggucaugagccugcuggucuacccguucaucgucgcucuggcguugcugggccuguaccuggugccgcac

SEQ ID NO: 4244715 - RNA, 57 nt, Pseudomonas putida KT2440
ccggcuugaaccauggcuggcuacguuggccuuguggcccgucgcggucacagucgg

SEQ ID NO: 4244716 - RNA, 55 nt, Pseudomonas putida KT2440
gcgcugugacgaccugcuggcgcuacugcucggcggcagcgguaacucgccgcgc

SEQ ID NO: 4244717 - RNA, 67 nt, Pseudomonas putida KT2440
ucucgcuuugaauucagacgcagauaccugaucuggucaggcucaacucgucugagcaucgacgggg

SEQ ID NO: 4244718 - RNA, 93 nt, Pseudomonas putida KT2440
gccgguaccgaagguguugaucgagauggaggucggcugggccacgccaauggcguacgacaccuggaucucgcaacgcucggccaaaccggc

SEQ ID NO: 4244719 - RNA, 88 nt, Pseudomonas putida KT2440
gaucaccaccuccgguuaccguguggggccauucgauguggaaagcgcguugaucgagcacccggcggugaucgaggcagcggugauc

SEQ ID NO: 4244720 - RNA, 81 nt, Pseudomonas putida KT2440
gcaggcaccggaaucacccuuuggggugagccgggcaagggcuguguccgcucaccccaaagggugauuccgggugccugc

SEQ ID NO: 4244721 - RNA, 96 nt, Pseudomonas putida KT2440
cgcccucuucgcgggcacgcccgcucccacagguaagucacaggcuucagccuucgaaauuacccugcgggagcgggcgugcccgcgaagagggcg

SEQ ID NO: 4244722 - RNA, 80 nt, Pseudomonas putida KT2440
ucgcggguaaacccgcuccuacagggaucgccacgguuccaggccggugggguaccuuguaggagcggguuuacccgcga

SEQ ID NO: 4244723 - RNA, 60 nt, Pseudomonas putida KT2440
ugaugcaguucaacggugaagguauccagcacguggccuuccugaccgaugaccugcuca

SEQ ID NO: 4244724 - RNA, 83 nt, Pseudomonas putida KT2440
uugaucuucaucccgcgaaacggcucggcugccuugaugaaccacugcaauucggccaacugcuguucggggguaagggucga

SEQ ID NO: 4244725 - RNA, 72 nt, Pseudomonas putida KT2440
gguaccagggugugguguuugccuucgacggugauguccaguucgccuucgacgaugaacaccacggcuucc

SEQ ID NO: 4244726 - RNA, 81 nt, Pseudomonas putida KT2440
ggguaaguggcacagcguggcugacagaguccugcacauccgauguguucuggccuucaguuauguaggcgccauauauuc

SEQ ID NO: 4244727 - RNA, 78 nt, Pseudomonas putida KT2440
uggcauugaaggcggguaccggcaaguacaaggaaaucucggccagccugugggugcugugcgcgaucuucauugcca

SEQ ID NO: 4244728 - RNA, 60 nt, Pseudomonas putida KT2440
gcauucgcgggcaagcccgcuccuacaggggccuuguaggagcgggcuugcccgcgaagc

SEQ ID NO: 4244729 - RNA, 55 nt, Pseudomonas putida KT2440
gguggcaggaucgauguucaugccggcaccuggcuugaacagguagaccgccgcc

SEQ ID NO: 4244730 - RNA, 126 nt, Pseudomonas putida KT2440
cgccgugaccggcugcugcucgugacaaccuaugaauugugcguggcgcccauggcgcauggcacgccaguaguucuccugggcgauccagcgcaauucgcggcugcaggguagcgggucauggcg

SEQ ID NO: 4244731 - RNA, 63 nt, Pseudomonas putida KT2440
uuguugccacuggugcugcugcagaucggcaccgguaggguuguggcagcacgggugcagcag

SEQ ID NO: 4244732 - RNA, 57 nt, Pseudomonas putida KT2440
gccguccuugucgaagugguaccaggcagccgccccggcaccgacggucaagguggc

SEQ ID NO: 4244733 - RNA, 80 nt, Pseudomonas putida KT2440
ccacggcgguggaggcagguggccugugcuucguaaggugacugcagguaggcagcaaugccccgcucaaucacccgugg

SEQ ID NO: 4244734 - RNA, 122 nt, Pseudomonas putida KT2440
agcagcuggucauacgggguggcgccccacauguccgauucggucagggucugcgcgccgaucuguggcaugcccaccgacuugggcuggguuggggaguacggcucguucgggauguugcu

SEQ ID NO: 4244735 - RNA, 76 nt, Pseudomonas putida KT2440
ccggcuggacgaucugcaauugcggaugaucggccaguaccuucuucaacucgucguagcggaucgcacagaccgg

SEQ ID NO: 4244736 - RNA, 83 nt, Pseudomonas putida KT2440
guaggcgcggguuugcccgcgaacaccggcuacgccggugccauccaccgcguugccugcuucgcgggugaacccgccccuac

SEQ ID NO: 4244737 - RNA, 73 nt, Pseudomonas putida KT2440
ccguugucggcgcuggaugcgcguauccgcaagcaccugcgcgagcagauucgugccauccagcgcgaacugg

SEQ ID NO: 4244738 - RNA, 86 nt, Pseudomonas putida KT2440
ugggcugagcguaccgggguugcguugcagcccuucgcgugcaagcccgcgaaggguugcaacgcaaccccaaaaaacucagugca

SEQ ID NO: 4244739 - RNA, 55 nt, Pseudomonas putida KT2440
gcgugcggcguuuuccagcacguugaccagugccugcucgaucaacgccgcaugc

SEQ ID NO: 4244740 - RNA, 57 nt, Pseudomonas putida KT2440
ugcgccaugguugaagcugcaccuucauuuccugaaggagcaguucaaccauggccg

SEQ ID NO: 4244741 - RNA, 105 nt, Pseudomonas putida KT2440
gcggguuauugaccaaaaggcgcugcuguugcaucgcgucuucggccagcuggccaagccgaugacgcgguacaucggcgucgcgcaggcggucagguaacccgc

SEQ ID NO: 4244742 - RNA, 78 nt, Pseudomonas putida KT2440
gcguacugcucuucgagcagcuugcgggccacggcgucggacuugcugucaucgaccaguugcucgaccagcguacgc

SEQ ID NO: 4244743 - RNA, 125 nt, Pseudomonas putida KT2440
guucugugggugcggccuugugucgcgaaagggccgcaaagcggccccggcaaucuaaguugcgaagcugaaaaucuggggcugcuucgcagcccuuucgcgacacaaggccgcucccacagagc

SEQ ID NO: 4244744 - RNA, 68 nt, Pseudomonas putida KT2440
ggcuucauccagcgauuuggcgugguggcguuccaugaacuguccaccacugucaaacgcuuccaguc

SEQ ID NO: 4244745 - RNA, 82 nt, Pseudomonas putida KT2440
cccaggcgcggucugguaccgccgggugaguucaucccgauugccgaacgcaccggccugauugccgagaucgauaccuggg

SEQ ID NO: 4244746 - RNA, 55 nt, Pseudomonas putida KT2440
guccagcgcagaggccacacggguggcguagaugugcuuguggcgcuggcuggac

SEQ ID NO: 4244747 - RNA, 76 nt, Pseudomonas putida KT2440
gccgcacgaccugggaaaaugcucagcugacggccaaggugcugcagccuuugggauuucgccggguggugcuggu

SEQ ID NO: 4244748 - RNA, 57 nt, Pseudomonas putida KT2440
gggggcgcucuggguauuggcgguaucggcauaacgcucauccacauagcgcgcccc

SEQ ID NO: 4244749 - RNA, 60 nt, Pseudomonas putida KT2440
cagugaugucuuccagugggcgccccagcggcaccacggcgcucagguagugcggcacug

SEQ ID NO: 4244750 - RNA, 65 nt, Pseudomonas putida KT2440
ugcgcugugugccaggcggcugaccagugcuucgcugagccuggcgcugauggcauacaccgaca

SEQ ID NO: 4244751 - RNA, 56 nt, Pseudomonas putida KT2440
cggugauuacugcguggugcacguguaccucgacaagcgcacccgccggaucacug

SEQ ID NO: 4244752 - RNA, 80 nt, Pseudomonas putida KT2440
gggccauugugguggucugcgacuacgacgcgggccuggccaacccacugcccggcgaugugucgcuggccauccugccc

SEQ ID NO: 4244753 - RNA, 70 nt, Pseudomonas putida KT2440
gggccaguacaugggacagauccgccggcuugcggcacugccaggucggcacguuguucaggauugguuc

SEQ ID NO: 4244754 - RNA, 63 nt, Pseudomonas putida KT2440
ccggaggcuugcuguucaucggggcgcugaauaccggcggcuuucugauagcacaagccuagg

SEQ ID NO: 4244755 - RNA, 56 nt, Pseudomonas putida KT2440
agggugcuagcucaaugaugcacuggguaggcucgugcaaaauggguauagauucu

SEQ ID NO: 4244756 - RNA, 58 nt, Pseudomonas putida KT2440
gcuggucagcacggucacgccaaucagcaacggcugcgggccgcugcgcuuggccagc

SEQ ID NO: 4244757 - RNA, 59 nt, Pseudomonas putida KT2440
agacuucgucggggcugcgcagguugguuacugcaaugcgcugcucacgacgcaggucu

SEQ ID NO: 4244758 - RNA, 63 nt, Pseudomonas putida KT2440
ggccaggccuugggcuucggccagcgcgacuaccuugagcccggccagguccagggucuggcu

SEQ ID NO: 4244759 - RNA, 61 nt, Pseudomonas putida KT2440
gccacuggguugguucaccccugacaacaccgcgcggcucgggcaugugaucacccagggc

SEQ ID NO: 4244760 - RNA, 91 nt, Pseudomonas putida KT2440
gcccgccgacaaaauggccuggucggcggucggcaccgucgcaaugaaccuggugcugauccgcuggcacaagccuggccgguaucggggc

SEQ ID NO: 4244761 - RNA, 111 nt, Pseudomonas putida KT2440
cggcccgcggcgagcgcaaaguucugccgccaggcaaccgcuggcaagccgaguuguggcgagcauugcuggaggauguuggcgagcaaggcauggcgcaaagccgcgccg

SEQ ID NO: 4244762 - RNA, 129 nt, Pseudomonas putida KT2440
auuucgaccaauuauucaucggcgccgacggcaucgaccugggccgggguaccacuaccuucaacgaguugcuugggcugagccgggucauggcggaaguugcccgugaagugaucgugauggucgagu

SEQ ID NO: 4244763 - RNA, 112 nt, Pseudomonas putida KT2440
gacccgcuugaaauugucgauaucgaucauggccagguacugcccggacgucgccauccgcagcuggcggucggccugggccaugaacgagcggcgguugggaaugucgguc

SEQ ID NO: 4244764 - RNA, 110 nt, Pseudomonas putida KT2440
ccuguaccggccucuucgcgggcuugcccgcucccacaggaucaccgcaacccucaaggauugcgcccugccugugggagcgggcaagcccgcgaagaggccgaugcagg

SEQ ID NO: 4244765 - RNA, 71 nt, Pseudomonas putida KT2440
cuggagcgcaucuaugccugguucccgcgcuugaagaccaagcgcaagacucaggcugggcugacuuccgg

SEQ ID NO: 4244766 - RNA, 57 nt, Pseudomonas putida KT2440
guugccgcacaggccuugcgggccggcuucgguguagcggaaggucuugccggcgac

SEQ ID NO: 4244767 - RNA, 75 nt, Pseudomonas putida KT2440
gccacccuggcugccaucgagguggucguugccgucagugccggcgaucacaucgguggccgcugccaggcuggc

SEQ ID NO: 4244768 - RNA, 124 nt, Pseudomonas putida KT2440
ucccucaugacugcccccuuguuguguucuuuuuuggugggucaaugcauugcaggcuuugcagaaagccugaucuagaggccugcaauagcuugaggagaucguagcggggauguuugcggga

SEQ ID NO: 4244769 - RNA, 123 nt, Pseudomonas putida KT2440
guuuggcuggcugaaagagaaccgcgggugcugcuugacgagauguaccggagcgcugcggccuguggucaacgguguaugucgcuaggucaccagcguuaucuaaauuuuaugcuaccgaac

SEQ ID NO: 4244770 - RNA, 76 nt, Pseudomonas putida KT2440
gcgggcuugcccgcucccacagguucaccgcugguuccagaaccggugaagaaccugugggggcgggcgagcccgc

SEQ ID NO: 4244771 - RNA, 102 nt, Pseudomonas putida KT2440
ggcgcuggugcuggaaaacgaccuggcgcauuucccguugccguucuucgauacccgcgacaccggcaagguagugcugccggugguguucagcggcgugcc

SEQ ID NO: 4244772 - RNA, 88 nt, Pseudomonas putida KT2440
gcugaacucggguucgucguggucggcaccgaguuugaucuugccguagccagacaaggcggugaccaccacgaagaccagguacagc

SEQ ID NO: 4244773 - RNA, 82 nt, Pseudomonas putida KT2440
gcugauccuuaccaagcugcacgccggcgguaaguucuccaacaagaacuaucaguuuuccggcggcuugcacggggugggc

SEQ ID NO: 4244774 - RNA, 128 nt, Pseudomonas putida KT2440
gcagguuggcgccccguuugccgucggcgcagugcucggucugcugcuggcgcggccuuuggcagccagauuggccgggccgcgucugcagcagauguuugccguggcagguugggccgcugcccugu

SEQ ID NO: 4244775 - RNA, 77 nt, Pseudomonas putida KT2440
ucaucgaugugggcgaauugggcgugguuauguuucucuucgugauuggccuggagcucaaucccucgcaucugugg

SEQ ID NO: 4244776 - RNA, 60 nt, Pseudomonas putida KT2440
cugcugcaaggcugccaacauugccgggcugcagccgcgcaaggguugggccugcagcag

SEQ ID NO: 4244777 - RNA, 80 nt, Pseudomonas putida KT2440
cuguggcgcggcaggcucauggcgcgugccugucagcagguaucagugcgcguguucgugggcuugcgguugguccgcag

SEQ ID NO: 4244778 - RNA, 128 nt, Pseudomonas putida KT2440
ggggcagcagagcugaaagaggaucuggacaccaguagccugucgggguaucucaagaucggugcgaucucuacagcguugacaggcauauugccagaggccaugaaucagcuaucaagcauugcccc

SEQ ID NO: 4244779 - RNA, 84 nt, Pseudomonas putida KT2440
auuugcgggcuugcccgcucccacaggaacaccaccgcuuuugaaagcugugcacgaccugugggagcgggcaagcccgcgaau

SEQ ID NO: 4244780 - RNA, 68 nt, Pseudomonas putida KT2440
ccuggcgcugacguugaucggccugguguucuucagcguggcgcuggcacgguuucgucggagccugg

SEQ ID NO: 4244781 - RNA, 62 nt, Pseudomonas putida KT2440
gcgcacacguucggccacgcugaucaauaccucgucacccacggcguggccgagggugucgu

SEQ ID NO: 4244782 - RNA, 70 nt, Pseudomonas putida KT2440
ggcguguuucuguucggcagggugcuggaccacuucuucggccaguacugcucgaugaacaguuucaccc

SEQ ID NO: 4244783 - RNA, 88 nt, Pseudomonas putida KT2440
uccucaaccuggcggucagugaacggcugcggcgcauaagcgaggagcguuucagcgccagccgugcacuggccgccagcgaugcgga

SEQ ID NO: 4244784 - RNA, 58 nt, Pseudomonas putida KT2440
agugguaauacagguugccgggcgagauuuccaugugcgcggcaaugugguugguacu

SEQ ID NO: 4244785 - RNA, 128 nt, Pseudomonas putida KT2440
ccuggcugugcagccgcagguacgcgguggucaccuugccagguggcaguugcaguucgaacaaguaguuguucugccggaucugccggcugucguagggcaaggcaucgccggugcgcugcgccagg

SEQ ID NO: 4244786 - RNA, 89 nt, Pseudomonas putida KT2440
ccugugcuggccucuucgcgggcaagcccgcuccuacaaagaacauaccaauguaggggagggcuaacccgcgaaaaggccggagcagg

SEQ ID NO: 4244787 - RNA, 83 nt, Pseudomonas putida KT2440
guugcugacgcucgucggugaucacauagcuguuuggcccaacguacucaacagccuccgggucgccgaagccagucagcggc

SEQ ID NO: 4244788 - RNA, 125 nt, Pseudomonas putida KT2440
cggccaaggccucaccgcccgcugcuagcgcuugcucgacgacggcuuguagcgguucggcgcggcgcccggcgaggaccaggcugaaguuguccucgagcagggcgagggcgacggcacggccg

SEQ ID NO: 4244789 - RNA, 57 nt, Pseudomonas putida KT2440
uccggccaacccugcugaugauccauauaaucgaucuucggcagcaaagguggcgga

SEQ ID NO: 4244790 - RNA, 88 nt, Pseudomonas putida KT2440
gcaccuggcgggcgccacugcgcagcuguucaccggccugacgcaacaguucaaggcccgugccacagaugcgcugcaccgccagugc

SEQ ID NO: 4244791 - RNA, 58 nt, Pseudomonas putida KT2440
gaugcgcgacauuuucggcgcggaaaucagcgcccccgcgccggaccugucgaguauc

SEQ ID NO: 4244792 - RNA, 64 nt, Pseudomonas putida KT2440
ucgucggccagggcaacuggcugccguuccagcgcagcagcgacagccaugcccuggucggcga

SEQ ID NO: 4244793 - RNA, 74 nt, Pseudomonas putida KT2440
gccggcgcuuugcaggcgcuccacgauguucaccgcaugacggcugaacugguggcgcugcagcgagugcuggc

SEQ ID NO: 4244794 - RNA, 64 nt, Pseudomonas putida KT2440
ccuccaacgguugcgaucgacaucacgacagggucguuggugccgacguagacguuguccgggg

SEQ ID NO: 4244795 - RNA, 106 nt, Pseudomonas putida KT2440
guaccggcccuuucgcggcugaagccgcuccuacagggauagcgucaaacccaggggcaauaccgucccccugcaggcacggcuuuagccgcgaagaggccgguac

SEQ ID NO: 4244796 - RNA, 64 nt, Pseudomonas putida KT2440
cgcucggugcaggccgcccgaggcacggccgaccaguccucggcgauugccaccgaaaccagcg

SEQ ID NO: 4244797 - RNA, 84 nt, Pseudomonas putida KT2440
ggcgcugguguucccugguacauggccuggacggccugaggguugcgcugcagguugccaaaccauggccagcacaccgguacc

SEQ ID NO: 4244798 - RNA, 127 nt, Pseudomonas putida KT2440
gccgcgcagggcuuucugcagggauuccuggaaaguacggccgauggccaugacuucacccacggauuucaucuggguggucaggcgggcgucggcuuucgggaauuucucgaaggcgaagcguggc

SEQ ID NO: 4244799 - RNA, 71 nt, Pseudomonas putida KT2440
ccacggugccguuggccggcacggugaugacgguuuugccgucgcucagcgugaaggucaaugcacugugg

SEQ ID NO: 4244800 - RNA, 129 nt, Pseudomonas putida KT2440
agggcaucagggcgaagaucacguacuggaucagcagcuguucaaggcuguuguagcuggccuucuccagcucguuaaucaugugcggcggaaucuuguagauccgggcgauaucgagcccgguggccu

SEQ ID NO: 4244801 - RNA, 79 nt, Pseudomonas putida KT2440
uggagggccuacggguugcggugggcaucauggacccgguggacaccaacgacagcagcccgaccggaaaggccuacca

SEQ ID NO: 4244802 - RNA, 109 nt, Pseudomonas putida KT2440
gggcugcgccugugccggcccuuucgcggcugaagccgcuccugcguugccggugcaggagcggcuuuagccgcgaagaggcccgcacagacaacacgaaaagcagccc

SEQ ID NO: 4244803 - RNA, 75 nt, Pseudomonas putida KT2440
ggcgaauucgccggugccgauggcaaagcugcccagugccauggcggcuuccaucuuggcgacgguguuuuuacu

SEQ ID NO: 4244804 - RNA, 84 nt, Pseudomonas putida KT2440
ccuggcgggucauguccucgcgcaggucgaaggcaucgagaaagcgcuuuucggccugcucgcgcaggaacagcacuuggcggg

SEQ ID NO: 4244805 - RNA, 55 nt, Pseudomonas putida KT2440
uacugcgccaccagcguuccgggcguguacgccaucggugacgugguacgcggua

SEQ ID NO: 4244806 - RNA, 55 nt, Pseudomonas putida KT2440
cgauggugaaggccgcgugcacggcaugaagggccugcgcguggucgaugccucg

SEQ ID NO: 4244807 - RNA, 67 nt, Pseudomonas putida KT2440
acccugagucauuacgcuacacucuuggauccaaugaugggcaacaguggcguaacgacagcacggu

SEQ ID NO: 4244808 - RNA, 79 nt, Pseudomonas putida KT2440
gcguuuggucgaagugcucaauauugccagcaugagcggcuuguugcuggcgguggcgagcuucuucugggccaaccgc

SEQ ID NO: 4244809 - RNA, 75 nt, Pseudomonas putida KT2440
ucuauguguuugcagugcugagcauguucuggggcguggcaauucucagcuucagccuggcgcugcaguccaaga

SEQ ID NO: 4244810 - RNA, 80 nt, Pseudomonas putida KT2440
gggccuugaggcgcuugcgcggcucuggaaugccgaccauauccagcaacuccagggugcgcgcagucgcuuccuugccc

SEQ ID NO: 4244811 - RNA, 98 nt, Pseudomonas putida KT2440
gaaaccggcagguggucauugucgagaaugguggucgucacgcucgauuugcugcuaucgaccugcagguucucgaaguuaccacccguggcgguuuc

SEQ ID NO: 4244812 - RNA, 64 nt, Pseudomonas putida KT2440
cauggcaauguccucugugucgaaugaacaaggaaguucaguuucggcagcggaccuugcccug

SEQ ID NO: 4244813 - RNA, 114 nt, Pseudomonas putida KT2440
ggggccgcucugcggcccauucgcgggcaagcccgcuccuacaacgaucugcguacaccgacgccgaucaaugucggagcgggcuugcccgcgaaugggcugcaaagcagcccc

SEQ ID NO: 4244814 - RNA, 60 nt, Pseudomonas putida KT2440
gcggcgaggucgaagcgcucgaucagcucaucgaugcgcugggcgcucucggcuuugggc

SEQ ID NO: 4244815 - RNA, 67 nt, Pseudomonas putida KT2440
uguucgcggguaaacccgcuccuacagggcacgcccagaauuguaggagcgggcuugcccgcgaaua

SEQ ID NO: 4244816 - RNA, 61 nt, Pseudomonas putida KT2440
gcugucgccuuggcuggugucugggccacuggcggccagcagcgguaccaaggcgaucagc

SEQ ID NO: 4244817 - RNA, 79 nt, Pseudomonas putida KT2440
ggagcgggcgugcccgcgaaugcacccggccuuguaaccacugugcaccugcugacgcauucgcgggcacgcccgcucc

SEQ ID NO: 4244818 - RNA, 81 nt, Pseudomonas putida KT2440
cccuguaggcgcggguuuaccugugaaugcgaugguggcugcacugccgcauucgcgggugaacccgcuccuacauagggg

SEQ ID NO: 4244819 - RNA, 72 nt, Pseudomonas putida KT2440
aggucuugagcaggucaucggucaggaaggccacgugcuggauaccuucaccguugaacugcaucaggaacu

SEQ ID NO: 4244820 - RNA, 71 nt, Pseudomonas putida KT2440
ccagguuuccgcagcacugccugaagagccguccgccgaggaggccuucgauccggaugcugacccccugg

SEQ ID NO: 4244821 - RNA, 55 nt, Pseudomonas putida KT2440
augggaaagcuguauugcgcgauaacuguucugucaauugccggcuuuuacccau

SEQ ID NO: 4244822 - RNA, 59 nt, Pseudomonas putida KT2440
cgauggccguacgguagugcucguccacauaaagaauccaguacucaccccgcgccacg

SEQ ID NO: 4244823 - RNA, 70 nt, Pseudomonas putida KT2440
ggugcccgguaccgguguugaagugcuucauggcgcugcgccccggcacgucgaucacuguuaccccacc

SEQ ID NO: 4244824 - RNA, 129 nt, Pseudomonas putida KT2440
augcgguucuucgcaugcuugucacgcacgaagcgcucuucuucggcggcggcaaucagcuugccgucaauguacagggccgcggaagggucauggcuaagggcgccggacaggccaagaaucgucaau

SEQ ID NO: 4244825 - RNA, 60 nt, Pseudomonas putida KT2440
caggcgauaagcgaagucggggccaccgcugauggugccaccguauucgcugauggccug

SEQ ID NO: 4244826 - RNA, 105 nt, Pseudomonas putida KT2440
gugccggccuauucgcgggugagcccgcuccuacagguacagcgcagcccucaaggccuguggugauuccugugggagcgggcgugcccgcgaaaagaccggcac

SEQ ID NO: 4244827 - RNA, 72 nt, Pseudomonas putida KT2440
gguuguauuguucgaacagcagcauggccaaggggucuuuuucggccagcaucuggucgggcaccuucagcc

SEQ ID NO: 4244828 - RNA, 92 nt, Pseudomonas putida KT2440
cgucguagcagcgaucagccacuugggcgaagagccaucgaucaacgaucugaucggcuccgucaaagugaugcuggacgccuaccuggacg

SEQ ID NO: 4244829 - RNA, 69 nt, Pseudomonas putida KT2440
gacgauguccgugguacguaacacgcguugaaggucaaugccuugccguggcguacgcacgguaucguc

SEQ ID NO: 4244830 - RNA, 71 nt, Pseudomonas putida KT2440
ggugagguugccuguucuggccgcuucgcggguuuacccgcgaaagggucagcacaggcaacaccuccacc

SEQ ID NO: 4244831 - RNA, 78 nt, Pseudomonas putida KT2440
cccggcuugcaacgcggguugcgguugcggcugauggaaaaucagcucgauacggcugucccugcgccagucgcuggg

SEQ ID NO: 4244832 - RNA, 90 nt, Pseudomonas putida KT2440
cccgccugccgggcaguucgaagcgguggcuuucagugccgagacacgccugucgggcaucgacuucgaacagcaccgcuaccgcaaggg

SEQ ID NO: 4244833 - RNA, 55 nt, Pseudomonas putida KT2440
gaugcagcgcacgccagcgcaggugcaacguuugcgcugacgcuguuguugccuc

SEQ ID NO: 4244834 - RNA, 60 nt, Pseudomonas putida KT2440
ugcgcacgauguugaguacggccugaaucaucuguucucggucgaucagcacguccggca

SEQ ID NO: 4244835 - RNA, 75 nt, Pseudomonas putida KT2440
ucgccagcaagccagcucucacaggugcaucaugccuucaggccuggcaccgugugggagcgggcaagcccgcga

SEQ ID NO: 4244836 - RNA, 97 nt, Pseudomonas putida KT2440
uugagcugcaagcugcgaguugccagcggcaagcaagcgccgggcgggugcgaugccgcuuuuucuugccgcuuguggcccccagcuugccgcccaa

SEQ ID NO: 4244837 - RNA, 77 nt, Pseudomonas putida KT2440
gugcgccaggcccugagccugcugcuggacuacgaguggaccaacaagcagcuguucaacggcgccuacacccguac

SEQ ID NO: 4244838 - RNA, 72 nt, Pseudomonas putida KT2440
guagcgugacgcagaugggcguggcagccuaccuggaaaauggcggcuacgaccggcaucugcgcuacauac

SEQ ID NO: 4244839 - RNA, 84 nt, Pseudomonas putida KT2440
uggugcgcgccgccgagaucaugcgcaacaccgucagcguggccaacgccaacgaguaugcgcggauugucgucgagcgcucca

SEQ ID NO: 4244840 - RNA, 80 nt, Pseudomonas putida KT2440
uugggguaugcagggcaccugugaggggcgggucugccugggaagagccgggccugcaacaggugaucugaaugccccga

SEQ ID NO: 4244841 - RNA, 59 nt, Pseudomonas putida KT2440
uagcccugagcaagccucccguccuuucgauagccaacgggacggguuugucauggcug

SEQ ID NO: 4244842 - RNA, 129 nt, Pseudomonas putida KT2440
ugcagcagauuccgcaggccuaaccaauucccaccuucuguuccaagaaucucguuccggaacugcaacgggucuuguggaaaggggauguauucguaggggguugcguaggcaauggacucugcaaca

SEQ ID NO: 4244843 - RNA, 55 nt, Pseudomonas putida KT2440
acggugaacaccgggaaacuguccacuucguuguaguagcccgugugaucgccgu

SEQ ID NO: 4244844 - RNA, 75 nt, Pseudomonas putida KT2440
ccgcacugcugggcgccaaccacuggcaguucuggcgacacaucggccugccggugcuggccccggcacugcugg

SEQ ID NO: 4244845 - RNA, 84 nt, Pseudomonas putida KT2440
gccggccccuaugucggccguugccuggcggcgcucggcgcagaggugaucaaggucgagcggccggguagcggcgacgccggc

SEQ ID NO: 4244846 - RNA, 130 nt, Pseudomonas putida KT2440
gcuuuuuccaggcgcggcucggcacugccggcuucggggcggcgagugguuucgcguggggggugccacuggcagugaaagcgguugcgcccgguggccugcagagcgaagggcuguugucggggauggc

SEQ ID NO: 4244847 - RNA, 86 nt, Pseudomonas putida KT2440
gggcuucggcggcgccaauggcggccuugaucgcugccaguugggcgcgggcagcgacuacugcugcguuggccgugucaaagcgc

SEQ ID NO: 4244848 - RNA, 81 nt, Pseudomonas putida KT2440
ugcuggccuauucgcgggcaagcccgcuccuacaauucugggcgugcccuguaggagcggguuuacccgcgaacaccggca

SEQ ID NO: 4244849 - RNA, 88 nt, Pseudomonas putida KT2440
ccaguggaaucggugggcgccgugacgauuucgcugggggugacgcacugggauggcgagacucacggcgagcccaugagcgcacugg

SEQ ID NO: 4244850 - RNA, 67 nt, Pseudomonas putida KT2440
ggugcgccagggcgaugugcuguucgaacucgaucaggagcaguaccgcauugccuuggcccgugcc

SEQ ID NO: 4244851 - RNA, 91 nt, Pseudomonas putida KT2440
gcuagugugguguuucacaaauaacgaccauaacuugcggcguuuuuugcgcugcgaguuauuggccguauuugcaaaacaccauacuagc

SEQ ID NO: 4244852 - RNA, 70 nt, Pseudomonas putida KT2440
cuggugugggucggccgucugauggugcuggccguggcccugaucgccaucgccauggccgccaacccgg

SEQ ID NO: 4244853 - RNA, 74 nt, Pseudomonas putida KT2440
caaugcugucucggugccagcgcgcauguccaucggcucgguggccagccagauggcaucgaugcggaucauug

SEQ ID NO: 4244854 - RNA, 58 nt, Pseudomonas putida KT2440
cggggugauccuggccgguggcugccagucggccggcacauacgccaggaucgggucg

SEQ ID NO: 4244855 - RNA, 58 nt, Pseudomonas putida KT2440
gccagugggcggugcaggcgcagcuggugaucccguucgaccugcacggcacccuggc

SEQ ID NO: 4244856 - RNA, 59 nt, Pseudomonas putida KT2440
gccaacuacauccagggcgcagauugccuggauagucucgcuaaaauugugcaguuggu

SEQ ID NO: 4244857 - RNA, 60 nt, Pseudomonas putida KT2440
cgaggcgacgagguagaggagcguuaccagauucaugcucaugcuuacuucuucgccucg

SEQ ID NO: 4244858 - RNA, 76 nt, Pseudomonas putida KT2440
gguccuuuucgcgggcaagcccgcuccugcaggucuucgcgaccguugcaggagcgggcuugcccgcaaaugggcc

SEQ ID NO: 4244859 - RNA, 62 nt, Pseudomonas putida KT2440
ucguggauuuccagcgugccgucgccuuuguagaguacgguugacgcauggggcuccaucgg

SEQ ID NO: 4244860 - RNA, 66 nt, Pseudomonas putida KT2440
ugcgucagcuugaggcaugugcugucccggcagaagcgcugacugccaggccucaagccucgcgca

SEQ ID NO: 4244861 - RNA, 56 nt, Pseudomonas putida KT2440
ccugggucaagccccagcgcgcgcacagucgcaagugcagcucgguuucauccagg

SEQ ID NO: 4244862 - RNA, 75 nt, Pseudomonas putida KT2440
guagcgggugguguugucggcauacagcguguagggaaugacaucgccugucgggccgaccagcccacccgaggc

SEQ ID NO: 4244863 - RNA, 76 nt, Pseudomonas putida KT2440
gcaccggugggccuguuggcuguagguuuggcaucagcgguuggugcggugcugggcuugcgccaagggcuggugc

SEQ ID NO: 4244864 - RNA, 55 nt, Pseudomonas putida KT2440
cgcacuguucaaagaaccggaaguggaacacauccugguucgucacgagcaggcg

SEQ ID NO: 4244865 - RNA, 90 nt, Pseudomonas putida KT2440
ugcugcgcgucggcaacggugcugcccauggcgguggcacacagcacgcgcccgccguuggugguuaccuugccauccuugagcgcagua

SEQ ID NO: 4244866 - RNA, 76 nt, Pseudomonas putida KT2440
ggcuccgaucgucugaucgaacguucuggccgcguugcugaagguggcuccgaucgucugaucgaacguucuggcc

SEQ ID NO: 4244867 - RNA, 76 nt, Pseudomonas putida KT2440
ccuguaggcgcggguuuacccgcgaaugcgucgguacauugaccgccgcauucgcggguaagccuguuccuacagg

SEQ ID NO: 4244868 - RNA, 94 nt, Pseudomonas putida KT2440
ucggcggguucggcgaggcuggcauugguggggugauuggcuucgcgcaucacugacagcaccagugccgggcuauccugcaucaguucggcga

SEQ ID NO: 4244869 - RNA, 73 nt, Pseudomonas putida KT2440
ccaguggcgguuguugaugauggccuugaagcccaucggcguuucgccggccaccagcagcucgaccggcugg

SEQ ID NO: 4244870 - RNA, 95 nt, Pseudomonas putida KT2440
gccguggccaacugcugcuggaaauggccaaggcgcugagccgccuugcgcucggccucuucggccauguccaccaccggcgccaggcgcgcggc

SEQ ID NO: 4244871 - RNA, 87 nt, Pseudomonas putida KT2440
gucggcgcugaugaccugcacgguggugcccgguucgccgcgaccggugagcaggcugccaucggcacucaguugcaguucgcuggc

SEQ ID NO: 4244872 - RNA, 130 nt, Pseudomonas putida KT2440
gaggcgccggugcaggugcugcgccacuaccuggccuuucgugagcagccgcugagcuucuacccgccgaaaguggcguggucaugacgaggcuucggcgucggccaccuggcagccagggugcauguuc

SEQ ID NO: 4244873 - RNA, 69 nt, Pseudomonas putida KT2440
ggcaacgcuaucggccuguucguguggggcuggccgcacggccccgagcaacaggccgaacgccucgcc

SEQ ID NO: 4244874 - RNA, 58 nt, Pseudomonas putida KT2440
agggccuggaaacgcugcgccugcguaugcgugcgcacugcgaaagcgcucaggcccu

SEQ ID NO: 4244875 - RNA, 77 nt, Pseudomonas putida KT2440
ugaagcggugauccgcgacuucgugcagcaggauaacggcuugcuggguauccgcgucgagggcgugcggcgcuuca

SEQ ID NO: 4244876 - RNA, 87 nt, Pseudomonas putida KT2440
gaggcuggugguaucgaucagcaccgccuugggcugauagaacgcaccgaccauguucuugcccagcggaugauugaugccggucuu

SEQ ID NO: 4244877 - RNA, 69 nt, Pseudomonas putida KT2440
gccagacgcaggcggauggcuucgagcaaggcaucgcggccuucgacaauggccaccccuguguauagc

SEQ ID NO: 4244878 - RNA, 57 nt, Pseudomonas putida KT2440
uggcguuuuaucugcugguggcgcugcugcgcgccgaucgcagcuagggagcggcca

SEQ ID NO: 4244879 - RNA, 86 nt, Pseudomonas putida KT2440
ccaguuugaucgcuucgucgaugucguggcugaccaugauuaccgucuuguucagcgcccgcugcauuucgaagaacucguucugg

SEQ ID NO: 4244880 - RNA, 66 nt, Pseudomonas putida KT2440
gccaucgaugucgaucuaccagcugcuggaacacuucccggcagccaagaucgucauugguguggc

SEQ ID NO: 4244881 - RNA, 123 nt, Pseudomonas putida KT2440
uuuggggccgcuucgcgccccuucgcgggcaagcccgcuccuacagguacagugcagcaugugcagccugcagugauccugugggagcgggcgagcccgugaagaaggcgacgcgguccugaa

SEQ ID NO: 4244882 - RNA, 111 nt, Pseudomonas putida KT2440
gcuggacagcgacgaacuggccuggcugcgccgcgaggccuucggguucguguuccagggcuaccaccugauccccuccggcucagcccaggaaaacgucgagaugccagc

SEQ ID NO: 4244883 - RNA, 90 nt, Pseudomonas putida KT2440
ggcgccgacugcacccgccuguucgaacggaucaaggccuugcgcccgcugcagggccaggaccuggaccuguuccgccgggugcacgcc

SEQ ID NO: 4244884 - RNA, 75 nt, Pseudomonas putida KT2440
gcuucauccgcugcuaccagcgcaaacucgaugaaccgauccaucuucuugcguuccuuggcguggaugacccgc

SEQ ID NO: 4244885 - RNA, 73 nt, Pseudomonas putida KT2440
gaacuccagcauuaagggcgaugguguccgcguauuuuuaagcggacgcgaucacccuuauugccaggauuuc

SEQ ID NO: 4244886 - RNA, 128 nt, Pseudomonas putida KT2440
gcccacgguacgacggcucucacggaaggccgacgauugaaggcgagcgacuaggucggcgaccagagcucuugcuucgauuagguugguacgugaaccgcccuugucguagacaccagcaacugggc

SEQ ID NO: 4244887 - RNA, 76 nt, Pseudomonas putida KT2440
gaggccacuugaaucucccuugcuggugauagguuuccaaccugaaucaaguacagggaguucauauaugcgcguc

SEQ ID NO: 4244888 - RNA, 56 nt, Pseudomonas putida KT2440
gcucacugaacgaggugcagcuggcaagcucagcccgcugcucgucgcucaguggu

SEQ ID NO: 4244889 - RNA, 95 nt, Pseudomonas putida KT2440
uuguccucaaggaagaagggcaccuggcuuuucaugccggagaacaguucuucgcgaucagagaagccggugauguucuugcccuugaugaucaa

SEQ ID NO: 4244890 - RNA, 80 nt, Pseudomonas putida KT2440
uucgcggguaaacccgcuccuacgacggucuguguccaaccaccgaugcaauccauuguaggagcggguuuacccgcgaa

SEQ ID NO: 4244891 - RNA, 58 nt, Pseudomonas putida KT2440
ggaaugcaccagcaccaguucgaugcggucgguuucgagccggcgcaggcugcgcucc

SEQ ID NO: 4244892 - RNA, 96 nt, Pseudomonas putida KT2440
cgcccucuucgcgggcacgcccgcucccgcaggguaauuucgaaggcugaagccugugacuuaccugugggagcgggcgugcccgcgaagagggcg

SEQ ID NO: 4244893 - RNA, 76 nt, Pseudomonas putida KT2440
uggcaaccggguuaccaggaccaugcgcugcggcaggaagagugugugguucauguagcccgguacauuguugcca

SEQ ID NO: 4244894 - RNA, 124 nt, Pseudomonas putida KT2440
gccuggcuggacaguguucaucaagaguaaugguguagcugaggccguuggugcccgucagguguuacucgcuaccggugcccaggagcgcccagcgccauuuccaggauggacguugccaggu

SEQ ID NO: 4244895 - RNA, 56 nt, Pseudomonas putida KT2440
ccugggcaaguuugccgacguaguccagguacuggaccggcaguggcuuguucagg

SEQ ID NO: 4244896 - RNA, 76 nt, Pseudomonas putida KT2440
ggcacaggccguaggaguacgccagcaacugagcgggcucauagccgugcuggcguauuucuucccggaugcuguc

SEQ ID NO: 4244897 - RNA, 74 nt, Pseudomonas putida KT2440
ggaaagcgcacgguuggugcugcgccaauggcaugacgaugacuugcgcgaguuugccgcacugugcgccgacc

SEQ ID NO: 4244898 - RNA, 60 nt, Pseudomonas putida KT2440
gcaugcuguugagcuguuugagguugccgcugguggggucguacaguucgaucaguucgc

SEQ ID NO: 4244899 - RNA, 66 nt, Pseudomonas putida KT2440
gacaagcccgcugcacagguauucgcguugccagugccacgcgaauaccugugcagcgggcuuguc

SEQ ID NO: 4244900 - RNA, 60 nt, Pseudomonas putida KT2440
ggcagcugggugauccccggcgggcaugccuuguggaugcccgccggggucagccaugcc

SEQ ID NO: 4244901 - RNA, 64 nt, Pseudomonas putida KT2440
gcaccugggucugagaaccaucggggcugcaacgcagccccaaaccugaucaggcuacaggugc

SEQ ID NO: 4244902 - RNA, 82 nt, Pseudomonas putida KT2440
ccggcacuuucugcccgcuggcuuccaggaucuggcgcaucugcaggcccagguccugcucgccaauggccaggaucgccgg

SEQ ID NO: 4244903 - RNA, 65 nt, Pseudomonas putida KT2440
ccaggucuauggguucgcccggcaaaguggcggugccauuugugucgacagcgagccuggccggg

SEQ ID NO: 4244904 - RNA, 69 nt, Pseudomonas putida KT2440
cauuccguggucgggcccaaugccugggacgacaccacgaagugggcagagggcugggccacgcagaug

SEQ ID NO: 4244905 - RNA, 81 nt, Pseudomonas putida KT2440
gcaaguugcaagcggcaagcugcaagaaagcagcucggcgcauggaugcucuuuucuugaggcuuguagcucaaggcuugc

SEQ ID NO: 4244906 - RNA, 64 nt, Pseudomonas putida KT2440
ccuauucuguagcgguugccuugcaugccaaugaggugcacaucggcagcaauuacgaauggcg

SEQ ID NO: 4244907 - RNA, 72 nt, Pseudomonas putida KT2440
gcggucaacuucgauguguauggcaacguuucgcaccaguugcagacgcgccuguauuucgaccugauccgc

SEQ ID NO: 4244908 - RNA, 58 nt, Pseudomonas putida KT2440
uccagguccucguugcgcggcggcaccuuguaggcugcggcgcccgucccgaccugga

SEQ ID NO: 4244909 - RNA, 82 nt, Pseudomonas putida KT2440
acggucaugauggauuccugaaaaguaagggccgggcaucugcaugcccggcccucauauuucacgacagcacgaugacugu

SEQ ID NO: 4244910 - RNA, 84 nt, Pseudomonas putida KT2440
ugccggcccuuucgcggcuaaagccgcuccuacaaggaacgcguaaccccuguaggagcggcuuuagccgcgaaagggccggca

SEQ ID NO: 4244911 - RNA, 129 nt, Pseudomonas putida KT2440
gguucagcgugucgccacgcucggagcgggcgcggccauccaggcggguguauugcaacaccgcguccagguacgcgcccuguggcccgaccagcguccaguaggugcccacgcuaucgccaucgagcu

SEQ ID NO: 4244912 - RNA, 56 nt, Pseudomonas putida KT2440
cggaagaucagcgccgcacggcugcgcugggcgguggggcuguugaugaucuucug

SEQ ID NO: 4244913 - RNA, 64 nt, Pseudomonas putida KT2440
gcgacggcguugucuucggcguuggacacagggcaaccgugggcgucagggacagugccuucgu

SEQ ID NO: 4244914 - RNA, 73 nt, Pseudomonas putida KT2440
gaccgccaacgccgccgugcuggccagugguaucuccaaggcccuggucaccacugcggcuggccugaugguc

SEQ ID NO: 4244915 - RNA, 67 nt, Pseudomonas putida KT2440
gcugauguuguucucgucaaggcgcuuggccucacggcgcagcgccgagaagaacagcuccaucagc

SEQ ID NO: 4244916 - RNA, 117 nt, Pseudomonas putida KT2440
gggucacggucagcugcggugcauugccggcguucggggucggggugaagccgagcaggcgcacagcggcuucagccugagccugcagcuugggcaccacgucguuaccgcugacgc

SEQ ID NO: 4244917 - RNA, 62 nt, Pseudomonas putida KT2440
ccuccaacgguugcgaucgacaucacgacagggucguuggugccgacguagacguuguccgg

SEQ ID NO: 4244918 - RNA, 59 nt, Pseudomonas putida KT2440
ucgguugucguugucguccaguugcaccgcgguguagcccacgaacagcaacaugccga

SEQ ID NO: 4244919 - RNA, 88 nt, Pseudomonas putida KT2440
cugugccggccuuuucgcggguaaacccgcuccuacaacgauagcgaaccuguguaggagcggguuuacccgcgaaaaggccgcgcag

SEQ ID NO: 4244920 - RNA, 55 nt, Pseudomonas putida KT2440
ggagucgauggccaccagggucugccccugcacaccuucacgcgccacguacuuc

SEQ ID NO: 4244921 - RNA, 86 nt, Pseudomonas putida KT2440
accgaccuguucgauggugaacggcuguuccagcugucccgcgggcggucgauggcggucaagccguucaucauggacaacgcggu

SEQ ID NO: 4244922 - RNA, 97 nt, Pseudomonas putida KT2440
accugcagggugucgaagaugucggugaucgccacaccgugggucuuggccuuuucccggucgauggcggcaucgacuuguggcacguugaccuggu

SEQ ID NO: 4244923 - RNA, 63 nt, Pseudomonas putida KT2440
ugcucuguagcauggucauuccgcuggcgaagcugcucugucagcuggccgugcuguugagca

SEQ ID NO: 4244924 - RNA, 72 nt, Pseudomonas putida KT2440
gcugaccggcacgggugaagccggugccacggugacaguacgugaugccggcaacaacgugcucgguacggc

SEQ ID NO: 4244925 - RNA, 94 nt, Pseudomonas putida KT2440
ggccucuucgcgggcaagcccgcuccuacggaaucugcaccgccuuguaauacggcgccgacccugugggagcgggcuugcccgcgaagaggcc

SEQ ID NO: 4244926 - RNA, 57 nt, Pseudomonas putida KT2440
ggugugccacgugcgcuggagcgaaacaccuugagcuacagcguagcggugcgcgcc

SEQ ID NO: 4244927 - RNA, 99 nt, Pseudomonas putida KT2440
gccaaugcgcugaugcaugggcgugacggcaccagcggcguggacugggcccaggccagcaagguggguuaugcccugcuguucucaccgcugauuggu

SEQ ID NO: 4244928 - RNA, 68 nt, Pseudomonas putida KT2440
ucagacuugagcacgagugccauagcagaagcuagcuugcgacugauggggcugugcuccgguaccga

SEQ ID NO: 4244929 - RNA, 106 nt, Pseudomonas putida KT2440
uuggggcugcuuugcagcccauucgcggguaaacccgcuccuacgaaagccgcguauguuuuguaggcgcggguuuacccgcgaaugggccgccaagcggccccaa

SEQ ID NO: 4244930 - RNA, 81 nt, Pseudomonas putida KT2440
guccagcguguaggcgaucugcuuguucgauucgccuuuggucaugcgcucgagcaccagcaguugcuugcgggucagggc

SEQ ID NO: 4244931 - RNA, 97 nt, Pseudomonas putida KT2440
ccggccucuucgcggcugaugccgcuccuaccggaccagcacaagccugaauaccgugggguccucguaggagcggcuuuagccgcgaagaggccgg

SEQ ID NO: 4244932 - RNA, 78 nt, Pseudomonas putida KT2440
ggcguacaggaugcuguugucgcugccuucgauauaggcaccgaaguugauggcguagcucagcagcguggugucguc

SEQ ID NO: 4244933 - RNA, 72 nt, Pseudomonas putida KT2440
gggagcaaucaggucuucaggcgaguucggccugauaccccucaucccgaaucgcagugaggaucugcuccu

SEQ ID NO: 4244934 - RNA, 63 nt, Pseudomonas putida KT2440
gagcagugccaugcgcucuuugaagcuggcgcggaaguccaguucaccgcgcauggcgcgcuc

SEQ ID NO: 4244935 - RNA, 63 nt, Pseudomonas putida KT2440
gcaccacgucgcuuucgccggccaguugcuugacggcauccuggcgguucuggguggcguagc

SEQ ID NO: 4244936 - RNA, 99 nt, Pseudomonas putida KT2440
cgccguuauuuccaggcguucgacguguucgcuuugaguuccgaucacgagccguucggcaugguccugcucgaagcgaugguugccggugugccggug

SEQ ID NO: 4244937 - RNA, 64 nt, Pseudomonas putida KT2440
gguuucgguuugcagcagaucgugcagaacuucauuuccggccugauccugcugaccgagcgcc

SEQ ID NO: 4244938 - RNA, 68 nt, Pseudomonas putida KT2440
uugcgcgaggcuugaggccuggcagucagcgcuucugccgggacagcacaugccucaagcugacgcaa

SEQ ID NO: 4244939 - RNA, 56 nt, Pseudomonas putida KT2440
agucguuguucuuugucuggucgaccaggauguugcggucggcaaggaacaggauu

SEQ ID NO: 4244940 - RNA, 77 nt, Pseudomonas putida KT2440
ggcgcggguuuacccgcgagccgggcgacgcgguguauggcaccgguugcaccgguguucgcggguaaacccgcucc

SEQ ID NO: 4244941 - RNA, 65 nt, Pseudomonas putida KT2440
gcggcgucaagcacgacagcgccgacaagcauguaucgggggaggcgcuguacauugacgaucgc

SEQ ID NO: 4244942 - RNA, 116 nt, Pseudomonas putida KT2440
gccgccugcgugccauggagcgcgauggccagcuuaucuauacccggcgcggcacuuaugccccgguagacaagcuggaccugaucuguggucgcgucuccggccaccgcgacggc

SEQ ID NO: 4244943 - RNA, 63 nt, Pseudomonas putida KT2440
gccuggugaugaguacgaccccaucgucuacgacgguggcggguugguacugaucaaccgugc

SEQ ID NO: 4244944 - RNA, 57 nt, Pseudomonas putida KT2440
augccuuuugaguauuucggcugacagcguuuauaaggucgaguaccgauggggcau

SEQ ID NO: 4244945 - RNA, 71 nt, Pseudomonas putida KT2440
gcguacugacccaggagucgggccaucuuuauuccaagcccgcgcuauccaucgcccuggcucaggggcgc

SEQ ID NO: 4244946 - RNA, 55 nt, Pseudomonas putida KT2440
gagguugcgcgccaacuugccguuggcggugaccggcaaguuggcgagcagcauc

SEQ ID NO: 4244947 - RNA, 55 nt, Pseudomonas putida KT2440
aggugcucgaugaucaucccggcgacguucuugccgguggugaccucgaugcccu

SEQ ID NO: 4244948 - RNA, 83 nt, Pseudomonas putida KT2440
gcaaagccgcugagguagucaggcaaauggccgaaaccaacuucguguuggccaugggccugggcugauacgguggcgguugc

SEQ ID NO: 4244949 - RNA, 79 nt, Pseudomonas putida KT2440
ucgcgacacaaggccgcucccacagggccacgcuggcacaagggaaugcagucccugugggagcggccuugugucgcga

SEQ ID NO: 4244950 - RNA, 55 nt, Pseudomonas putida KT2440
ggcgaucaccaaggcgugcaaggccaucuacacccgcgccaaggcggugaucguc

SEQ ID NO: 4244951 - RNA, 61 nt, Pseudomonas putida KT2440
ggcuucuuugcaagccuugugggagcgggacugcccgcccccacagagccgcaaagcggcc

SEQ ID NO: 4244952 - RNA, 64 nt, Pseudomonas putida KT2440
caggccaggucugcgcgcagcaggugcggguucugcguaccugaccacacgcggaucugcccug

SEQ ID NO: 4244953 - RNA, 86 nt, Pseudomonas putida KT2440
gcgccacaguugcugguacucggcgcuuuuugcauaguccggcucacagaacagccgguggugcuugccacgcagcucgucggcgc

SEQ ID NO: 4244954 - RNA, 73 nt, Pseudomonas putida KT2440
ggccugaaggacaucggcccggugguggccggcgacccgcugcuggccaucgacaaggucgaguucuucggcc

SEQ ID NO: 4244955 - RNA, 61 nt, Pseudomonas putida KT2440
agggcccggcauuguuguucgaaaagcccaccggcuucgacaucccagugcugggcaaccu

SEQ ID NO: 4244956 - RNA, 67 nt, Pseudomonas putida KT2440
ucgauggcaggcgcacugguugggcaggaagcagcagcguucuugcgugguuugugcuugcuguuga

SEQ ID NO: 4244957 - RNA, 72 nt, Pseudomonas putida KT2440
gccguaccgagcacguuguugccggcaucacguacugucaccguggcaccggcuucacccgugccggucagc

SEQ ID NO: 4244958 - RNA, 100 nt, Pseudomonas putida KT2440
uuugcggccauucgcgggcaagcccgcucccacacgugucucacagggccagaaaucugugggugaccguggagcgggcgcgcccgcgaauggcugcaaa

SEQ ID NO: 4244959 - RNA, 60 nt, Pseudomonas putida KT2440
cuggaacugggcgucaagcacgacuggcaaggccugagccugagugccgcccuguuccag

SEQ ID NO: 4244960 - RNA, 57 nt, Pseudomonas putida KT2440
uggaugccugcgaaacgcugucggauggcacggccggcggcgucgagccaggcucca

SEQ ID NO: 4244961 - RNA, 60 nt, Pseudomonas putida KT2440
gcgugacagggcagcuuuacagccuuucucaagcgaguggcuguagccugcuuguuaugc

SEQ ID NO: 4244962 - RNA, 110 nt, Pseudomonas putida KT2440
gcuccuacuaguuugugaauuacuguuguggcagggucgaaacagccguuaagacggaacaaucguuguguugcuguugcgccccacaacugauucaggggaucaggagc

SEQ ID NO: 4244963 - RNA, 82 nt, Pseudomonas putida KT2440
ggcaccugguguuuucuucgagugccgccguauacggcaacccgcaguacgugccgaucgaugaagcacacaccaaggggcc

SEQ ID NO: 4244964 - RNA, 69 nt, Pseudomonas putida KT2440
gggguugucggucguucggucagucauagcgcgauccguagcgguggguggucaguguccggcaggccc

SEQ ID NO: 4244965 - RNA, 86 nt, Pseudomonas putida KT2440
uagcagugcccacggugccguuggccggcacggugaugacgguuuugccgucgcucagcgugaaggucaaugcacugugguuguug

SEQ ID NO: 4244966 - RNA, 98 nt, Pseudomonas putida KT2440
uggcuuggaagacuaugcuuucucuaaacgcagauggcugaaauggacuauuuuccaccugguuuagcagaagcugcugcauaugucgcgaaaagcca

SEQ ID NO: 4244967 - RNA, 102 nt, Pseudomonas putida KT2440
caccacccugugggagcgggcuugcccgcgaacaccggcaaagccgugccaugcaccgcagugcuugcuucgcgggcaagcccgcucccacaggguaaggug

SEQ ID NO: 4244968 - RNA, 130 nt, Pseudomonas putida KT2440
gccgauccugaucgcccuggccagcgaggcggcgccugagcgucugcggaguacggcggucagccugacuuacuguggugugccgcugggcggggcgguugcgucgcugaucggcauggccggagugggc

SEQ ID NO: 4244969 - RNA, 81 nt, Pseudomonas putida KT2440
cauggucauugccgguaccugcuucgugaagauggcgccgaucauccagcgccucuacgagcagaugcucgagccgaaaug

SEQ ID NO: 4244970 - RNA, 82 nt, Pseudomonas putida KT2440
cgccacaacugcgacugaugaaaacccucgggcaguucagaaauacgguugucgcugagguucagggugugcaguucuggcg

SEQ ID NO: 4244971 - RNA, 65 nt, Pseudomonas putida KT2440
ggguuacuggcaguucuucacacagcucaucagccuugagcaccgugcagguuuugucaguaccc

SEQ ID NO: 4244972 - RNA, 86 nt, Pseudomonas putida KT2440
gccgcuggcaggucugaguaguucagguaccacagguugcugauguacagcccggugccuagacgcucaaggaucugcgcacuggc

SEQ ID NO: 4244973 - RNA, 76 nt, Pseudomonas putida KT2440
gcuuccaccgggugcucaggaaagugcagcucggcaugggccaacugcacgucagucuugggcacgcugauaaagc

SEQ ID NO: 4244974 - RNA, 82 nt, Pseudomonas putida KT2440
gggggcggaggugaugcuucaacggggccgguuucgaugcuaaagucgccgcccaugaaccgucugccuucaaaccgucccc

SEQ ID NO: 4244975 - RNA, 61 nt, Pseudomonas putida KT2440
gcugguucaucgacuggaugcucgauaccguacugguaaugcucuccagcgaugacccggc

SEQ ID NO: 4244976 - RNA, 63 nt, Pseudomonas putida KT2440
cggugguguucgagccgcacccgaccuaugacaauuuguuuggccguaucgaauacagcaccg

SEQ ID NO: 4244977 - RNA, 87 nt, Pseudomonas putida KT2440
guccugaacaugcucugcgucucggagcgucucuuuugccagccagagcgauagaacacucgagcgcagcgcucgguacucagagac

SEQ ID NO: 4244978 - RNA, 63 nt, Pseudomonas putida KT2440
gggucgcaaccgacguuguugggaucugguuaguggccagcccaccggucagguugacgaucu

SEQ ID NO: 4244979 - RNA, 68 nt, Pseudomonas putida KT2440
ggcggcuuugcgcuugugcguacucggcuucgcggguggccagggcggcacgggcgcguucgaccgcc

SEQ ID NO: 4244980 - RNA, 56 nt, Pseudomonas putida KT2440
cuucgcggguaaacccgcugcugcagguccccguaggagcggguucacccgcgaag

SEQ ID NO: 4244981 - RNA, 129 nt, Pseudomonas putida KT2440
gaagcugagacuuuugggaccgcuucgcgguccuuucgcgacacaaggccgcucccacaaaggcaaugggggagcggccuugugucgcgaugggcugcaaagcagccccaauagucgaucaguuaacgc

SEQ ID NO: 4244982 - RNA, 75 nt, Pseudomonas putida KT2440
ucagugaaugcagucagucuaccgagggaccugcgacauccgccaaggauucccuucuauuggcgcgauagcuga

SEQ ID NO: 4244983 - RNA, 64 nt, Pseudomonas putida KT2440
gcgcagaccaggaguggccuggaccacgucgucgaggcuacgcaucgacuggucguccaugcgc

SEQ ID NO: 4244984 - RNA, 67 nt, Pseudomonas putida KT2440
gcccaggcaguacaucagcgacacgucaaugcauaguccgagguucacugggcaucugcacuugggc

SEQ ID NO: 4244985 - RNA, 61 nt, Pseudomonas putida KT2440
cagcucggccagcaggcgcaggguuuccugauggaacagcucgcccuugcuggucaggcug

SEQ ID NO: 4244986 - RNA, 89 nt, Pseudomonas putida KT2440
cuggcccuuucgcgggagacccguuccuacgcaggcaccgcacccggcggugacccguguaggagcggguuuacccgcgaaggggccgg

SEQ ID NO: 4244987 - RNA, 65 nt, Pseudomonas putida KT2440
gcggcgggucugaucacggaacugcuugacgcgguccucgaugauccgcugaucguacucgucgu

SEQ ID NO: 4244988 - RNA, 104 nt, Pseudomonas putida KT2440
ccguauccacggugguauuugaaacgacgcgcuggaucgaaagcgggccuggacggccgaaagcuuucgaaccagacgcguuacaaggguaauaaccguugcgg

SEQ ID NO: 4244989 - RNA, 64 nt, Pseudomonas putida KT2440
aacgacaaagcggcggcucggcauaacccugaagggguggggugccaagucgccgcuuugcguu

SEQ ID NO: 4244990 - RNA, 89 nt, Pseudomonas putida KT2440
gucgucugguuggcguccaucggcagcauaaaguaaggguguggguuccaucccguaucugugcugcuaggacaaaaacaaugaacgac

SEQ ID NO: 4244991 - RNA, 60 nt, Pseudomonas putida KT2440
ggcgccugguuguugcugcucagccgcuacagcggccagcgcagugucagcuuuggcgcc

SEQ ID NO: 4244992 - RNA, 95 nt, Pseudomonas putida KT2440
cggccucuucgcgggcgcgcccgcucccacagguccagcacaacccucagacuugugcugaaccugugggagcgggcaugcccgcgaagcagacg

SEQ ID NO: 4244993 - RNA, 79 nt, Pseudomonas putida KT2440
ucgcgggcaugcccgcucccacaggucugcaccguuuuugaaacuugugcauuaccugugggagcgggcgugcccgcga

SEQ ID NO: 4244994 - RNA, 96 nt, Pseudomonas putida KT2440
gucgcgcaucaucccggccgaugagcuuggcccaggggcacucgaagcgggugccgccgaguucaucgaccgccagaugaauacccccuacgcgac

SEQ ID NO: 4244995 - RNA, 78 nt, Pseudomonas putida KT2440
cuguucaagaagaugagugugcuggacaaccugcucaccggucugucgcguuuccagcgcaguuacuuucucgaacag

SEQ ID NO: 4244996 - RNA, 116 nt, Pseudomonas putida KT2440
cgcgacuggguggccgcggucauguacucgucauaguugcccgggaacaggcgcagcucaccguaauccaggucagccaugugggugcagacgcuguugaggaagugccggucgug

SEQ ID NO: 4244997 - RNA, 61 nt, Pseudomonas putida KT2440
cucauucgcgggcuugcucgcucccaagucaaccuaugggagcgggcgagcccgcgacgag

SEQ ID NO: 4244998 - RNA, 113 nt, Pseudomonas putida KT2440
cuuccgcaucgauuucgaccaggguaccuggaggucucguucgcugugggaccuggacaugcccaagcccgcagcgcccgggcuuuccgauagccaugaacucggcccggaag

SEQ ID NO: 4244999 - RNA, 65 nt, Pseudomonas putida KT2440
gaucgaggcgcugcgccaguugcgcccggacgccaaggagcuggagcuggugcaccgccuggauc

SEQ ID NO: 4245000 - RNA, 100 nt, Pseudomonas putida KT2440
guuugacugucuuccgcgaaaggcagcuaugggucgaaugcggccugucgugaccggcugcaaucgacccaaagcugcccgugaugggggggcggcuaac

SEQ ID NO: 4245001 - RNA, 125 nt, Pseudomonas putida KT2440
ccagcuggcagugcagcagcacuuccccgaggguacccagaugacccggccgacaggcggcuucauccucugggugagccugcccggucgggucaauacccaggagcugcaugugcgcgcgcugg

SEQ ID NO: 4245002 - RNA, 86 nt, Pseudomonas putida KT2440
gccgcgcaguguccagggccuggccaagcugcgcggccaaggcuucgcgcucaucgucacggcccgcuacccaccaacugugcggu

SEQ ID NO: 4245003 - RNA, 92 nt, Pseudomonas putida KT2440
gcgauggaaaucgauaugcggcgguagugcuggcagugugcgcaaacucaaaccgcucaucgacaagcgcugccccuguguuugccccucgc

SEQ ID NO: 4245004 - RNA, 82 nt, Pseudomonas putida KT2440
uucgcgggcaugcccgcucccacaguaaucgcaccgcacuuaaggccugugcaguaccugugggagcgggcgugcccgcgaa

SEQ ID NO: 4245005 - RNA, 90 nt, Pseudomonas putida KT2440
gcccuggcggugcacuugccuggcgucgagaauggcaaagcccuggcugucgucauuggucgugcgcaggccaaucugcaccgagugggc

SEQ ID NO: 4245006 - RNA, 81 nt, Pseudomonas putida KT2440
ggcccuuucgcggguaaacccgcuccuacagugcacagaucuugaggcauguguguaggagcggguuacccgcgaagagcc

SEQ ID NO: 4245007 - RNA, 63 nt, Pseudomonas putida KT2440
cuggaugucgucgaggucguagagggugaugguccagccgaagcugcggaugaugucauccag

SEQ ID NO: 4245008 - RNA, 87 nt, Pseudomonas putida KT2440
uccugacugagugcacaaggcccgcuugguugauucggauaccuauucgaagccaccggggccuuguuggcaccgcagcaaacagga

SEQ ID NO: 4245009 - RNA, 61 nt, Pseudomonas putida KT2440
cugcugcaagcggcugcccaguucguccagguccuggaugaacagcacgaacuugucguag

SEQ ID NO: 4245010 - RNA, 83 nt, Pseudomonas putida KT2440
ccuuggcgaugccguugcuaucgccgauguuggcaaacaccucgacggcaugcccaucacgggugauggccggcucgaagcgg

SEQ ID NO: 4245011 - RNA, 70 nt, Pseudomonas putida KT2440
ggcgcggugcuggucggcgacaacagcuauuacgacacccuguugcaguacgcccagaacggcaucgccc

SEQ ID NO: 4245012 - RNA, 60 nt, Pseudomonas putida KT2440
gucuggccuuccggugccugguacagcgccuugcguuugaccagcgcgcgcagggccagc

SEQ ID NO: 4245013 - RNA, 77 nt, Pseudomonas putida KT2440
uucguacagauggccaagcgggagauugugcggguccugaaggauaaccauaccucugacgcuggccugcguaugga

SEQ ID NO: 4245014 - RNA, 80 nt, Pseudomonas putida KT2440
cagugguugggcaagaaucugguuaccuaccagaccgaugccaacggucaacccgucuccaagauucuggucgaauccug

SEQ ID NO: 4245015 - RNA, 129 nt, Pseudomonas putida KT2440
cgaucauguggcgggcacggccgaaaucugucacgccgaaggcggucagcgauggcuggaugaggaugucgucgcggugcaggcuggccaguuguucuucggaguugcgccgggucaucaaagugaucg

SEQ ID NO: 4245016 - RNA, 78 nt, Pseudomonas putida KT2440
gguagaugaucgagugaaaggccuugagcugggagccgaugacuaccugaucaagcccuucgcuuucucagagcuacu

SEQ ID NO: 4245017 - RNA, 118 nt, Pseudomonas putida KT2440
ggcugcuuugcagcccauucgcgggcacgcccgcccccagagguuuuucacaguccucaaagccggugucguaccugugggagcgggcgugcccgcgaaugggccugaaaacccagcc

SEQ ID NO: 4245018 - RNA, 62 nt, Pseudomonas putida KT2440
gugauugccuggugcuugaugugccaggggagccuuggcugcgcgagcaccugggcgagcau

SEQ ID NO: 4245019 - RNA, 79 nt, Pseudomonas putida KT2440
ccggccucuucgcggguaagcccgcuccuacaggggaugcgguugccuguaggcgcggguuugcccgcgaggaggccgg

SEQ ID NO: 4245020 - RNA, 101 nt, Pseudomonas putida KT2440
uggggcugccuugcagcccuucgcggcaagcccgcuccuacaggggacgcauauccuuuguaggagcgggcuugcccgcgaagggccgcaaagcggcccca

SEQ ID NO: 4245021 - RNA, 64 nt, Pseudomonas putida KT2440
gcauggucgaagucgucaccacccaaggcgguaucaccgccgguggccagcacuucgaauacgc

SEQ ID NO: 4245022 - RNA, 74 nt, Pseudomonas putida KT2440
accuucgacacugauauccagguccagggucugcgaaguagcacccgggccuuugaugccgaagucguucaggu

SEQ ID NO: 4245023 - RNA, 73 nt, Pseudomonas putida KT2440
gcccuucgcgggcaagcccgcuucuacaggggauacccguucauugugggagcgggcuugcccgcgaaagggc

SEQ ID NO: 4245024 - RNA, 62 nt, Pseudomonas putida KT2440
caccauuccgcugaaucgcggaguucagcaugaaggcgaacucaaggcgcucagugauggug

SEQ ID NO: 4245025 - RNA, 104 nt, Pseudomonas putida KT2440
gugccggccuuuucgcgggcgcgcgcguucccacggguuugccacuggccccgagccuugugcaauaccugugggagcgggcaugcccgcgaagagggcggcuc

SEQ ID NO: 4245026 - RNA, 63 nt, Pseudomonas putida KT2440
ggugcgggcgaauuucucgggguucugcugguugagcagcagcuugagguauuccucgcgacc

SEQ ID NO: 4245027 - RNA, 68 nt, Pseudomonas putida KT2440
aagucuucgccauguuccagcagcagcggccgagccucgcagcgcuggcggaccauggcguaggauuu

SEQ ID NO: 4245028 - RNA, 106 nt, Pseudomonas putida KT2440
ugugccggccccuucgcggguaaacccgcgccuacagguacgacacaggguucggaugcggugcagucuucguaggagcgaguuuacccgcgaagaggccggcaca

SEQ ID NO: 4245029 - RNA, 86 nt, Pseudomonas putida KT2440
cacugggucugcuuggccugagcuggcagcagcgcggccucaagcgccugcugcgccuggccgagcaaaccacuuccgacccacug

SEQ ID NO: 4245030 - RNA, 57 nt, Pseudomonas putida KT2440
cgcggguagggcucgaaguaggcgaaccagaucugguccuguucagccuucaccucg

SEQ ID NO: 4245031 - RNA, 61 nt, Pseudomonas putida KT2440
gcuccggcgaguuggcccgcgagcgauugcgcaagaagcuugacgggccgaucgccaaggc

SEQ ID NO: 4245032 - RNA, 62 nt, Pseudomonas putida KT2440
cgguccuuucgccggcccuggcgcagccucagcccgaggcugauccgggucggcgauacccg

SEQ ID NO: 4245033 - RNA, 63 nt, Pseudomonas putida KT2440
gucggccagagccuucaguucggcggggauuucuucuucgcgguagcuggugcccuggucggc

SEQ ID NO: 4245034 - RNA, 74 nt, Pseudomonas putida KT2440
uggguggcgcagcaguggaugggccgggucgaguaacggcucuuccucauaaacauccaccgccgcguagcccg

SEQ ID NO: 4245035 - RNA, 73 nt, Pseudomonas putida KT2440
ucggcagccgaccacguggcuuaucggcguagcgccaacuggacauucgauggggccaguggugcgcuguuga

SEQ ID NO: 4245036 - RNA, 86 nt, Pseudomonas putida KT2440
ccugaucgccacggcuuacgaccuggccugguucuggaagucagacccggagcaggucaugggccgcacccuggacgugauuaugg

SEQ ID NO: 4245037 - RNA, 61 nt, Pseudomonas putida KT2440
acguggccgguuugcuggugcuggcaggcgccguggcugugcugcccacaggccgccgcgu

SEQ ID NO: 4245038 - RNA, 61 nt, Pseudomonas putida KT2440
gcggcgugagcugguggccgagcuuaaccucaguuaucgcuuccucagccaguucgcccgc

SEQ ID NO: 4245039 - RNA, 71 nt, Pseudomonas putida KT2440
ggcgggagggguugcgcaacauggcgaggccucaugcggaauagccacgauguucgcugccgccugcuguc

SEQ ID NO: 4245040 - RNA, 88 nt, Pseudomonas putida KT2440
agaaccuggcgcgcaauggccugccguucgacagugugccguucguaccggccagcgaacacuggcaaggcccguucgaccgggugcu

SEQ ID NO: 4245041 - RNA, 87 nt, Pseudomonas putida KT2440
ugcaaaagcgggcuugcccgcgaaugcgugaggucaggggacagcuuagccugaacugacgcauucgcgggcaagcccgcuccugca

SEQ ID NO: 4245042 - RNA, 68 nt, Pseudomonas putida KT2440
gccagaaugaucagggugcuggaggcgaagaacgaagcguugcgcuccagguuaccgaucacgcuggc

SEQ ID NO: 4245043 - RNA, 76 nt, Pseudomonas putida KT2440
ugaaucgcccugacuuccuagaugcuuccaagcuuuuccaguugcuaggaggcgucaggaggucaugggcgaauca

SEQ ID NO: 4245044 - RNA, 56 nt, Pseudomonas putida KT2440
gcgugcaguuuucaagcuguugcacauuuuucgcgcagcuugccccgcugcugcgc

SEQ ID NO: 4245045 - RNA, 76 nt, Pseudomonas putida KT2440
uugucugugcuggccucuucgcggguaaacccgcccguaggagcggguucacccgcgaagaggccagcacaggcga

SEQ ID NO: 4245046 - RNA, 88 nt, Pseudomonas putida KT2440
caagucauucaagcuguaccucaacucgcugaaccagacgguguucaccucgcugggcgcguugcagguaugccuggaaaaagaccug

SEQ ID NO: 4245047 - RNA, 89 nt, Pseudomonas putida KT2440
cugagcaucaccgacccguugucggugaucguuggcgugcgcaccagcaacuauuccucggucacccgcagcguggccggcgagcgcag

SEQ ID NO: 4245048 - RNA, 57 nt, Pseudomonas putida KT2440
acucggcgggggauguguuccugggguuggaccugagcgcgcauuuguuccccgagu

SEQ ID NO: 4245049 - RNA, 58 nt, Pseudomonas putida KT2440
uaucgccugagccggccucuucgcggguaaacccgcgaagaggccagugcaggugaug

SEQ ID NO: 4245050 - RNA, 80 nt, Pseudomonas putida KT2440
cgacaaccgcuaccugcucagcgccuugcagaccgugccagggcaacugcgcgggguggugaugcuggagcgggaugucg

SEQ ID NO: 4245051 - RNA, 85 nt, Pseudomonas putida KT2440
gggguuggugaacaccucgcccuuguagccgucgacgaucaguucaauaccgucgaccuuggaguauggcaggucgaccaggccc

SEQ ID NO: 4245052 - RNA, 104 nt, Pseudomonas putida KT2440
ccagcucguucuuccgcaugccgggcucaaugcguuccaagaugcggucaugcaucuuuucgacgauucgagcagccacacgcauguaggaaauuucuugcugg

SEQ ID NO: 4245053 - RNA, 56 nt, Pseudomonas putida KT2440
gguguucgauccggccgccagcaagcgacacuuccgccugguggccucggacuacc

SEQ ID NO: 4245054 - RNA, 84 nt, Pseudomonas putida KT2440
gcggucaauggcgugcgcuggccggcgccgaacgcuugcuggcaggcacugauggcgcuggacagcgagcgccuggauggcugc

SEQ ID NO: 4245055 - RNA, 112 nt, Pseudomonas putida KT2440
ggcugugagauguguccgccacaacccuugcagugccugugagaucgagcgccgcccgcgcggcgcucggucucacaggcgcugaaacugucguggcgaacacuuggcagcc

SEQ ID NO: 4245056 - RNA, 59 nt, Pseudomonas putida KT2440
aaccaguucaaccuggggcugcguucguauuacuucggcauggccauguugagcugguu

SEQ ID NO: 4245057 - RNA, 73 nt, Pseudomonas putida KT2440
ggcccgcggggcuuuuuuauguuugccaucguauucaccccaauacgcagugcauggaaugccaccgcaggcc

SEQ ID NO: 4245058 - RNA, 125 nt, Pseudomonas putida KT2440
cgcccugccacaccaguacgacgagcuggcggccaugaucgaaggccaguucggccgccuagauggccugcucaacaaugcgucgaucaucggcccgcgcacgccgcuggagcaguugucgggcg

SEQ ID NO: 4245059 - RNA, 87 nt, Pseudomonas putida KT2440
ggccuauucgcgggugaacccgcuccuacaacggcaggugguguccauccaucaauguguaggcgcggguuaacccgcgaacgggcc

SEQ ID NO: 4245060 - RNA, 77 nt, Pseudomonas putida KT2440
ggcccuuucgcggguaaacccgcuccuacacagggauacgcgauacauguaggagcggguuuacccgcgaaggugcc

SEQ ID NO: 4245061 - RNA, 115 nt, Pseudomonas putida KT2440
ggagggcugcuuuucguguugucugugcgggccucuucgcggcuaaagccgcuccugcaccggcaacgcaggagcggcuucagccgcgaaagggccggcacaggcgcagcccuuc

SEQ ID NO: 4245062 - RNA, 57 nt, Pseudomonas putida KT2440
gcauggcguugagggcugggugcucgggagguucucccuuccaggccucggccaugc

SEQ ID NO: 4245063 - RNA, 79 nt, Pseudomonas putida KT2440
ugcagguuggccuugaccccggccucaccgcccaggccgaacgggcagcgguagucguacggguaaggcaugaacugca

SEQ ID NO: 4245064 - RNA, 91 nt, Pseudomonas putida KT2440
gcaucggcaaaacuugcggcaaguuguuccagcguggcaggcgggagcucaugaaggacgcugacagcaugcccgcucagcuugccgaagc

SEQ ID NO: 4245065 - RNA, 114 nt, Pseudomonas putida KT2440
gguacaccacgcgcguggcgcccggcacuuuguguccucgucagguggcaaugccgguuuggcagucgccuaugccggacgcaagcugggggugccggugaccguggugauacc

SEQ ID NO: 4245066 - RNA, 57 nt, Pseudomonas putida KT2440
ugcuuacccaauagcguguccuguacucgacccgcacgggcaggcugcgggugagca

SEQ ID NO: 4245067 - RNA, 73 nt, Pseudomonas putida KT2440
gacggcccuuucccggcuaaagccgcgccuacgcgguccccguaggagcggcuuuagccgcgaagaggccguc

SEQ ID NO: 4245068 - RNA, 60 nt, Pseudomonas putida KT2440
cugagcguugucgaacacgcccaguggaaacugcgagaucugugugucgcgcaaguucag

SEQ ID NO: 4245069 - RNA, 65 nt, Pseudomonas putida KT2440
gcccaggugaccuucgugucgaucagcagugacccgcugaacgacacccccgaggcgcugaaggc

SEQ ID NO: 4245070 - RNA, 57 nt, Pseudomonas putida KT2440
gaggucguauugccaacuggcggcaucuggaugccggacaguggcgaugcggcccuc

SEQ ID NO: 4245071 - RNA, 56 nt, Pseudomonas putida KT2440
ucggcgcguguaccgggcagcgguucgguugaauugccguuguaugcgcguaucga

SEQ ID NO: 4245072 - RNA, 58 nt, Pseudomonas putida KT2440
cucguucaugccuuggcuggugggcaccgcacugauccacucgcuggcggugaccgag

SEQ ID NO: 4245073 - RNA, 61 nt, Pseudomonas putida KT2440
ugcagcagggcgcugacguccaccgcgugcugguacugguugauguuugcgccuugcagca

SEQ ID NO: 4245074 - RNA, 65 nt, Pseudomonas putida KT2440
cccgaucgcucgggcugcuguuauaugcgcaccaugccaccuuaauacauccuuggcggaucggg

SEQ ID NO: 4245075 - RNA, 59 nt, Pseudomonas putida KT2440
gggccagcaacaguucggccguggcgcgcugaucggcauggugcugcuguugccggccc

SEQ ID NO: 4245076 - RNA, 79 nt, Pseudomonas putida KT2440
guaaucgccggugcgggucagcucugcacggaaaccuuuuucgcuguugaucugacgcugcaguuccuuggcgaucugc

SEQ ID NO: 4245077 - RNA, 71 nt, Pseudomonas putida KT2440
gccgcauggggcuggagcagaagcuggagcugaugggcucgcacccggacuucugguucagccgcgacggc

SEQ ID NO: 4245078 - RNA, 80 nt, Pseudomonas putida KT2440
gugcugagcgugcugacagcggccaacaccuacaccaucccgggcuacaacgggguaagcguggccggcaccuacggcac

SEQ ID NO: 4245079 - RNA, 61 nt, Pseudomonas putida KT2440
uggccgcugauguguggcccgaguacugcagccaggccgccgccgcucaucagcgccgccg

SEQ ID NO: 4245080 - RNA, 68 nt, Pseudomonas putida KT2440
cuugggcgagcuugucgaggaacugcaugcggcgcaucaggcguucagccuugucgcgcucgcccggg

SEQ ID NO: 4245081 - RNA, 60 nt, Pseudomonas putida KT2440
ccagcucggcguguuggccggugcacuggcuuuucgcuuacuggcgcgcuugccggcugg

SEQ ID NO: 4245082 - RNA, 65 nt, Pseudomonas putida KT2440
gauagaggcugauggcgaucuugagcgcgccuuccgcucgcgcaaggcggugucggccagcuauc

SEQ ID NO: 4245083 - RNA, 81 nt, Pseudomonas putida KT2440
gacccgcgcgugaccgugcaccugggugaaggcuggcaugugccgcgggccuugcugccggugcaggaaaagcgcgcgauc

SEQ ID NO: 4245084 - RNA, 104 nt, Pseudomonas putida KT2440
gggucaggcgcagccagaugcgcgguguggcuggggcgcuguaccaccaccugcuggucggacaggcgcccgagcacacggcggaucaccgugcggcugacacc

SEQ ID NO: 4245085 - RNA, 76 nt, Pseudomonas putida KT2440
gcgggcaugcccgcucccacagguucgguaaugcccgcaggugcggcgcgacuccugugggagcgggcgcgcccgc

SEQ ID NO: 4245086 - RNA, 61 nt, Pseudomonas putida KT2440
gcucgccaugcaccaggcggcuuuugugcaccagcggaaaggcaugcuguggcauggcagc

SEQ ID NO: 4245087 - RNA, 103 nt, Pseudomonas putida KT2440
ggggccgcuuugcggcacaucgcgacacaaggccgcucccacaggaaacugcgcucuacuugugggagcgaccuugugucgcgaugggcugcaaagcagcccc

SEQ ID NO: 4245088 - RNA, 61 nt, Pseudomonas putida KT2440
gucagaagcgucgaggucgagccagacccgcuggguuauggcggccuggugaugcucgagc

SEQ ID NO: 4245089 - RNA, 73 nt, Pseudomonas putida KT2440
guuccgggcacagcugcugcagcggccggcccagcgcugcgcuaaccggcagguccagcagcugcgcaagggc

SEQ ID NO: 4245090 - RNA, 63 nt, Pseudomonas putida KT2440
gcucaguucauugccccggcagcuggcuucaauggcgggcugcuguggcgcaacgggcugggc

SEQ ID NO: 4245091 - RNA, 96 nt, Pseudomonas putida KT2440
cgguuccacuuccgggucguaggcaccguugcgcugcuucaccagaucgauccauggguaggcuucgcaacgugccucgacccgcuugaucaacug

SEQ ID NO: 4245092 - RNA, 56 nt, Pseudomonas putida KT2440
ugcacccaggccaugugcggcacgggcuucgcccaggcacagguugagugggugca

SEQ ID NO: 4245093 - RNA, 57 nt, Pseudomonas putida KT2440
gccggcgauggcgccgcggcugaccaccaggcgaucggaagcagcgccaucgccggc

SEQ ID NO: 4245094 - RNA, 88 nt, Pseudomonas putida KT2440
cgggguuacccgcccucgguguucgccaagcugcccaagcugguggagcgggcaggcaauggcgaaccuggcggugguucgaucacug

SEQ ID NO: 4245095 - RNA, 69 nt, Pseudomonas putida KT2440
ggccucuucgcggguaaacccgcuccuacaaggauccuguguaggagcggguuuacccgcgaagaggcc

SEQ ID NO: 4245096 - RNA, 61 nt, Pseudomonas putida KT2440
agcucuccuguccuggccucuucgcgggcuugcccgcgaagaggccagacaggcaaccgcu

SEQ ID NO: 4245097 - RNA, 97 nt, Pseudomonas putida KT2440
ccggccucuucgcggcuaaagccgcuccuacgaggaccccacgguauucaggcuugugcugguccgguaggagcggcaucagccgcgaagaggccgg

SEQ ID NO: 4245098 - RNA, 83 nt, Pseudomonas putida KT2440
caggccuggccucuucgcggguaaacccgcuccuacacaggauccuuguaggagcggguuuacccgcgaagaggccgguacug

SEQ ID NO: 4245099 - RNA, 65 nt, Pseudomonas putida KT2440
acuguucguaguagccucgcccgcccucggucagacggaugcugcgggugguacggacgaacagu

SEQ ID NO: 4245100 - RNA, 65 nt, Pseudomonas putida KT2440
gccuugcacgcuucaagggcgcgcaucauaugcuuuuccacggcgcucugugacagcugcauggc

SEQ ID NO: 4245101 - RNA, 83 nt, Pseudomonas putida KT2440
gcgcgcccuugggugucacuugggucuucucggccgguucgugaucggugagggucagcucaagcaauuugccaagggcgagc

SEQ ID NO: 4245102 - RNA, 61 nt, Pseudomonas putida KT2440
ccgcaagcgcuucagguacugcauuggcgccaugucggugcagcgcuugaaguguucaugg

SEQ ID NO: 4245103 - RNA, 64 nt, Pseudomonas putida KT2440
uggcgaguaacuaccgagacugauugggaugucuccaccaagggcaugcuggucuuggucgcca

SEQ ID NO: 4245104 - RNA, 64 nt, Pseudomonas putida KT2440
cugcucccaggccgccaggucugccggggcgucacgccagggcagggcuucggucugggcgcgg

SEQ ID NO: 4245105 - RNA, 105 nt, Pseudomonas putida KT2440
agacgaccuccuaucgagggcggagcauuacaguacgcuccgcacucaccauccugcgugguuauuguuagcgucacuguaugcgcccuugguucucagcagucu

SEQ ID NO: 4245106 - RNA, 81 nt, Pseudomonas putida KT2440
gggguugucaguguugcucggucugaugauuucacugggggcgaccagugucaucggccaaggggcagccggauugauccu

SEQ ID NO: 4245107 - RNA, 92 nt, Pseudomonas putida KT2440
acggcgccuuacauccguuuccaauaauccauggcaaccguguugcacacgguccaugaggcuuauuggagacaagaauaaugacaugccgu

SEQ ID NO: 4245108 - RNA, 78 nt, Pseudomonas putida KT2440
gguacggcgcuaucguucgaggugaaggcugaacaggaccagaucugguucgccuacuucgagcccuacccgcgugcc

SEQ ID NO: 4245109 - RNA, 129 nt, Pseudomonas putida KT2440
agaaagugccuucauuuuugcagcguugccccuagacgcaauuuuggucgcgguaacagggacgccucugcuauugagaaacaagaucgaaggagggcaaucguggccgaaucgcuccuuguacuuuuu

SEQ ID NO: 4245110 - RNA, 57 nt, Pseudomonas putida KT2440
ggugcguacuugaccagcuggugguugcccuugcccaccaccugcaggcugcgcgcc

SEQ ID NO: 4245111 - RNA, 57 nt, Pseudomonas putida KT2440
caccgccugguggaagaggugaaugacuuguacauccgccacuuccagcagccguug

SEQ ID NO: 4245112 - RNA, 128 nt, Pseudomonas putida KT2440
ggaaggcugauuggcguuagccuguuccggccucuucgcggguaaagccgcaccugcagggauugccauacccuugcaggcgcgggcuggcccgcgaagaggcggguucagguccagucaauccuucu

SEQ ID NO: 4245113 - RNA, 56 nt, Pseudomonas putida KT2440
gcuugucgaauaucagugccgccaauugggccggcuggcuugauauuuucggcagc

SEQ ID NO: 4245114 - RNA, 56 nt, Pseudomonas putida KT2440
gcccggcgccgguuugucgagauauccgcguguuucucggccaaguggcgcugugc

SEQ ID NO: 4245115 - RNA, 114 nt, Pseudomonas putida KT2440
ggggcuggacucuucgcgggcuugcccgcucccacacggugccaggccugaaggcaugaugcaccugugagagcuggcuugcuggcgauaggccuucaauaucacuccagcccu

SEQ ID NO: 4245116 - RNA, 80 nt, Pseudomonas putida KT2440
gaccuggacccgacggccguaggccuggcccgugaacgccuggcucacgugcacaaugccucggucgaacgggcccgguu

SEQ ID NO: 4245117 - RNA, 58 nt, Pseudomonas putida KT2440
uccaggccgcaguccaguggcaugaucgcgcagcauaugccgguguugauggccugga

SEQ ID NO: 4245118 - RNA, 82 nt, Pseudomonas putida KT2440
cugcgaccaugugccggugcgcuccuuccugcaacugaccgugggcugguuccucaaggacgcuaaacuggcgcuggugcag

SEQ ID NO: 4245119 - RNA, 59 nt, Pseudomonas putida KT2440
gaaaacagccgcagaaugcucgguuacagccaguaaacuccgcuuccugggcuguuuuc

SEQ ID NO: 4245120 - RNA, 64 nt, Pseudomonas putida KT2440
ggugucggugauggccguggaaggcagggccagaggcugcgggucguggucaucagccagcgcc

SEQ ID NO: 4245121 - RNA, 75 nt, Pseudomonas putida KT2440
ggcgcucggcaccgguaaugaagucgucccagccuucgacgguaugcgggcgcagcuucagccguucgagcagcu

SEQ ID NO: 4245122 - RNA, 130 nt, Pseudomonas putida KT2440
cccgucgccuuucgacgcgcgguagcacaauggcaaacguacagaucucccaggguaauucgcgcgaccuuccugcuuaugccugucggaucuacgucacagcguuccgugcaaguauugggcuuuggcg

SEQ ID NO: 4245123 - RNA, 82 nt, Pseudomonas putida KT2440
gcugacgcggauacgggcgaugguguuuucgcaguaacggcgcagggccgggcugaguucgccgucguccacuucgcgcagc

SEQ ID NO: 4245124 - RNA, 60 nt, Pseudomonas putida KT2440
cgugauuguccuugaggccgaagcggccacugcucgccuuggcgaucaaggcacaaagcg

SEQ ID NO: 4245125 - RNA, 96 nt, Pseudomonas putida KT2440
cggaaguaccggugagcaccugcggacuuuucgcccuuucgaaucguucgcccacgaaaucgagcauguccaaggccgcacggcgcuguacuaccg

SEQ ID NO: 4245126 - RNA, 55 nt, Pseudomonas putida KT2440
gggcuggcggcauuucggccguuucgaucagcgccgggccaaaugccuccagcuc

SEQ ID NO: 4245127 - RNA, 111 nt, Pseudomonas putida KT2440
gcuggucugcuccucggccgcuguggcgaucugccgguucaugucgcggaucgcuuccaccgccugcgugauacguugcagcaucugcccggccugcucgacuugcucagc

SEQ ID NO: 4245128 - RNA, 57 nt, Pseudomonas putida KT2440
gagcuggcgcagcugguuguucgauucgcgcuuccauugcggcaggcuggccagcuc

SEQ ID NO: 4245129 - RNA, 118 nt, Pseudomonas putida KT2440
uuggcgagcgcacugaacgccugacccggcaccugugcaggcguguuagccguggggcucgcgcaacaaggccaaccacgccugcgccgcucgugacagguaggcgccacgccgccag

SEQ ID NO: 4245130 - RNA, 84 nt, Pseudomonas putida KT2440
gguuccagguuucaaggccggcaaaggccugaaagacgccgucaacuaagucgucuuucagccggacccggccuggccuggucc

SEQ ID NO: 4245131 - RNA, 61 nt, Pseudomonas putida KT2440
guuucuggaggugaucaagcauggagcgcccuccuccuaccugcuuucgcuuaccgaugac

SEQ ID NO: 4245132 - RNA, 71 nt, Pseudomonas putida KT2440
gcgcaccggcaaagugguguggaacaagaaguucggcgaccacagcgccggcuacaccaugaccggugcgc

SEQ ID NO: 4245133 - RNA, 92 nt, Pseudomonas putida KT2440
gccagcagaugcucgccgggauugcgggugccuucggggaaaauccagaucgaggugucguccugcagaacccggguggucuucuguaaggc

SEQ ID NO: 4245134 - RNA, 94 nt, Pseudomonas putida KT2440
ggcccauucgcgggcuugcccgcucccacaggcauugcacaggguucggaccuugugcagguccugugcgagcgggcaagcccgcgaaugggcc

SEQ ID NO: 4245135 - RNA, 80 nt, Pseudomonas putida KT2440
gggcuagcugcggugcuacuuggugcuucugcuguugcgcaagcaaguguuggcagcaauaccaccgcaucugacaaccc

SEQ ID NO: 4245136 - RNA, 84 nt, Pseudomonas putida KT2440
ucggcgugcugcaagccggugauuaccgacugaccgugggcaguggcggcaucggccugaucaccgaagugagcaccacgcugg

SEQ ID NO: 4245137 - RNA, 64 nt, Pseudomonas putida KT2440
gcccaauuacugguagggccgcuugccgaucgcuauggccgcaagcggcugguaguaggugggu

SEQ ID NO: 4245138 - RNA, 64 nt, Pseudomonas putida KT2440
gccggcaucggcaaacgccugcucggcgcccugcaggccaagagcaaggcgcuuuccggccggc

SEQ ID NO: 4245139 - RNA, 79 nt, Pseudomonas putida KT2440
agcgcagagguaccguccgaacugggcggccaacgccucgaccaggucgccgcccaauuguucgccgaguacucgcguu

SEQ ID NO: 4245140 - RNA, 72 nt, Pseudomonas putida KT2440
cuguuucgccaguugaauggcccggcgguuaccuuucggcugaucccggggcgcauugcgacggugagugag

SEQ ID NO: 4245141 - RNA, 130 nt, Pseudomonas putida KT2440
gcugcccaugcucaguucgcugaucugccgggcgcaggggaucauugcaucgagcaaggccgcgccgcuuucggugaguucgacgaugaccuugcgccggucgcccgggucuggcgaaagcugcaccagc

SEQ ID NO: 4245142 - RNA, 76 nt, Pseudomonas putida KT2440
gcaucgagcucgagcgcguucaauugcagggugucaggcaacgcaccagccggcuugaacgccucggagcggaugu

SEQ ID NO: 4245143 - RNA, 79 nt, Pseudomonas putida KT2440
gccagcaccguuguuucguugcgcgucgagaacagguucaaggccaggcggccuacguucucggcaacaaucgucuggc

SEQ ID NO: 4245144 - RNA, 68 nt, Pseudomonas putida KT2440
gcccugcggcauugcuuaggcuuacgcggucgaaccacgccgcaaagccaggagaagugcccaugggc

SEQ ID NO: 4245145 - RNA, 70 nt, Pseudomonas putida KT2440
agcgccaggcgauugccauugguauggaaauuggcauccauaacgggaccuuggcgauugcccuggcguu

SEQ ID NO: 4245146 - RNA, 86 nt, Pseudomonas putida KT2440
ggaacuggccuuggugcacgugcucgggguggcugcagccgaugaaggcguucagcgaugcgaugcgauguaccaggccguuuucc

SEQ ID NO: 4245147 - RNA, 77 nt, Pseudomonas putida KT2440
cguggccccgacaggcugauggccuggacgcugaccaugggguaggcggcgcgggucauggccuguugcaggucgcg

SEQ ID NO: 4245148 - RNA, 77 nt, Pseudomonas putida KT2440
gugcgcugauggagcuguucuucucggcgcugcgccgugaggccaagcgccuugacgagaacaacaucagccugcgc

SEQ ID NO: 4245149 - RNA, 70 nt, Pseudomonas putida KT2440
gaaggauuucuaagcuuucaauagacuuaucauacauaagcuugucuauuucuggguuuauaaauucuuu

SEQ ID NO: 4245150 - RNA, 94 nt, Pseudomonas putida KT2440
auccagaaguugaucaccacgccuugccccucggcgguguucaggcuggucuugaaacugccgcagcguaaggcauagagcauggucagcggau

SEQ ID NO: 4245151 - RNA, 81 nt, Pseudomonas putida KT2440
gguaucgcuagagcgaugguagagaacccgaggcaggugcguuacagaccugccguuuagcuccgucgcuagugcuauacc

SEQ ID NO: 4245152 - RNA, 103 nt, Pseudomonas putida KT2440
ggggcguacgccuccaauagugcagcgccugccagaucgugugccgcgcgggcggugcucgaucuggcaggcgcugcaacguacaagagcguuaaugcgcccc

SEQ ID NO: 4245153 - RNA, 55 nt, Pseudomonas putida KT2440
agggugguggucuugcccaugcccgccgggccgaccauggcgaucaccccacccu

SEQ ID NO: 4245154 - RNA, 63 nt, Pseudomonas putida KT2440
guguuguucuucugcuccgccgaauacgacuugcaggcuuugggcgaagcauuggaacaggac

SEQ ID NO: 4245155 - RNA, 99 nt, Pseudomonas putida KT2440
agucagccuucaauggccgagguccaugguggaauucgggagcgcaacauaugaacuacgcgcugccaaagaaacugugggaccggcucgggcuggucu

SEQ ID NO: 4245156 - RNA, 92 nt, Pseudomonas putida KT2440
gccuggccucuucgccggcaaaccugcgcccacacggacugugcaauaagcacaaauccugugggcgcgggcuugccggcgaagaagccggc

SEQ ID NO: 4245157 - RNA, 66 nt, Pseudomonas putida KT2440
gcccuggaacacgaacccgaaggccucgcggcgcagccaggccaguucgucgcuguccagcucggc

SEQ ID NO: 4245158 - RNA, 61 nt, Pseudomonas putida KT2440
uucuccaggcauggaucgcccacuguucacgcuggaacaguuugccucgcaugccggcgaa

SEQ ID NO: 4245159 - RNA, 83 nt, Pseudomonas putida KT2440
gccccuauguaggagcggguucacccgcgaaugcggcagugcagccaccaucgcauucacagguaaacccgcgccuacagggc

SEQ ID NO: 4245160 - RNA, 75 nt, Pseudomonas putida KT2440
guugcuggcgugauacuggcccuguaggucauugcucguuaaagugauggccugacgccauauuaucuggccgac

SEQ ID NO: 4245161 - RNA, 80 nt, Pseudomonas putida KT2440
aggucgauuucgccgaugucgaacagguaguccaggucgucgaagcggcgcuggauggacucggcaaucgggaucgacuu

SEQ ID NO: 4245162 - RNA, 86 nt, Pseudomonas putida KT2440
guucuagggccucuucgcggguaaacccgcuccuacgggcuuugcaccgccuguaggcgcggguuuacccgcgaaagggccggaac

SEQ ID NO: 4245163 - RNA, 62 nt, Pseudomonas putida KT2440
cgagcauugucuggauccguuuggggaaucauuacgcccucucgggguccgaacagugcucg

SEQ ID NO: 4245164 - RNA, 55 nt, Pseudomonas putida KT2440
cgacgggcacauggcgucguuggggucauaguuguaacaggcgccauugccguug

SEQ ID NO: 4245165 - RNA, 114 nt, Pseudomonas putida KT2440
guuguucaccguugcugugagugcgccgcuguagcgauaguccgucuugcuggugccgaccgcgccauaggccagcaacuggucguucagcucguacucaccacgcaggaugac

SEQ ID NO: 4245166 - RNA, 94 nt, Pseudomonas putida KT2440
gccuggacgaucagcgccaucaacugaucuggaccuaccaccauaucuugcucgauggcuggaguacgucgcaguugaugggcgaaguccuggc

SEQ ID NO: 4245167 - RNA, 83 nt, Pseudomonas putida KT2440
guccucuguaggaacggguuuacccgcgaaugcgauguuggauucaccgacguauucgcggguaaacccgcuccuacagggac

SEQ ID NO: 4245168 - RNA, 109 nt, Pseudomonas putida KT2440
gccccugcccccagccgccuggcacagccgguuggcaaacugaugcugcacgcggguaucgacuugcugcccggcugggcccaggcacugcucggccugcagcacgggc

SEQ ID NO: 4245169 - RNA, 89 nt, Pseudomonas putida KT2440
ccgggaauugaaacugcaugagguuccaguggguggcgcuuugugcacgcugccuuuuuggacguucauggcagaagggcaauugcugg

SEQ ID NO: 4245170 - RNA, 129 nt, Pseudomonas putida KT2440
ccugccgcuaccgcggugaggccauucgcggguaaacccgcgccuacaccggccucacgccuggcgcgaaccuuuguaggagcggguuuacccgcgaagcaggcgacgcgguaucacgccuugagcagg

SEQ ID NO: 4245171 - RNA, 62 nt, Pseudomonas putida KT2440
cgagguuggcagccuggcaaugcugagcgguuuuuccgcuuggugccaggcucccagccucg

SEQ ID NO: 4245172 - RNA, 78 nt, Pseudomonas putida KT2440
gucgguagccauugcccgcucgcgcgacaagcugcgcucguugcagcuguugucgcggcgcggcauaggccugccgau

SEQ ID NO: 4245173 - RNA, 129 nt, Pseudomonas putida KT2440
aaggugccuuaccuggcgcucagcgagcaggacgugauugcccagaccgccucgcaaagcuucgacaucucggucuggcaguuccuggcugcgccgcuguucggcgccaagguagagaucgugccuaau

SEQ ID NO: 4245174 - RNA, 67 nt, Pseudomonas putida KT2440
ucgaucgcagugauuucacccggcgccgcagccgccaccugggugaacaucgccagcgaaaugucga

SEQ ID NO: 4245175 - RNA, 61 nt, Pseudomonas putida KT2440
ggucugcaccaucgggcgcgaugccggcacugcggcggcugucgaaaagaugggcggcacc

SEQ ID NO: 4245176 - RNA, 74 nt, Pseudomonas putida KT2440
ggggguuggccugaaucuucgcggcgaucgccucggggcugaacucgcugagcgggaucgggccaaugaugccc

SEQ ID NO: 4245177 - RNA, 78 nt, Pseudomonas putida KT2440
uggucgccaggucagcgaggugauggcaccguacugauccucguaggugucgcguuccugcugugaacuggugcgcca

SEQ ID NO: 4245178 - RNA, 71 nt, Pseudomonas putida KT2440
gcguuacgugacgcuucaugguuggcucggguuuuugcacucaagagccgaaaauaagcgauauuagacgc

SEQ ID NO: 4245179 - RNA, 74 nt, Pseudomonas putida KT2440
gacguuuuuccuggucagaaccuggaaaugagcauucgcaucgaauguugauuucuggcuuuugucagaucguu

SEQ ID NO: 4245180 - RNA, 78 nt, Pseudomonas putida KT2440
ccgggcccagcguuugaugccgagcuacagccggauguugcccagcugauugauggcucggccccggagcuggcccgg

SEQ ID NO: 4245181 - RNA, 58 nt, Pseudomonas putida KT2440
gucguugggucgccuucaaaaucgggagacgcauaggucuugaaggcacccagucgau

SEQ ID NO: 4245182 - RNA, 66 nt, Pseudomonas putida KT2440
gcgauugggccaagucuuauuuggauucguuauucgaggccgauccguuaaaucuguggccaucgc

SEQ ID NO: 4245183 - RNA, 77 nt, Pseudomonas putida KT2440
aucgaggccguggucauccccggcaagggccaguugaucaagaccggcucgcugggcgaugucauggucgagucgau

SEQ ID NO: 4245184 - RNA, 87 nt, Pseudomonas putida KT2440
ucaccgcuucgggcgcuggucgcugcugaucagcuggguacauauuauuggugauccacucacaguaguggcuggcguccugcggga

SEQ ID NO: 4245185 - RNA, 66 nt, Pseudomonas putida KT2440
ggcauucgcggguaaacccgcuccuacauugggcaguguaggagcggguuuacccgcgaagaagcc

SEQ ID NO: 4245186 - RNA, 116 nt, Pseudomonas putida KT2440
uggcggcauggggucguucggcggggcgcugguuggcggccugcugguggguguggugcaaagcaugaugaccagucucuggccgcaaggcgccagccugaugaucuacggcgcca

SEQ ID NO: 4245187 - RNA, 99 nt, Pseudomonas putida KT2440
uggcguuccuggguguggauggcgauguccuguucgccgcgcugcugggagcacuguuggugagcgcggcacgcgaucgauugaucaccagugaggcca

SEQ ID NO: 4245188 - RNA, 59 nt, Pseudomonas putida KT2440
ggucgaggcuucgccaggcgguguacuggccgcuggccgccuggucgucggccuuggcc

SEQ ID NO: 4245189 - RNA, 110 nt, Pseudomonas putida KT2440
agccgacccaggcugcgcugggcuucgccaagaagugcgguguggaacuggccgagaucgaccagagcggccccaagcugcgcuucucccagcacaucccgggcaaggcu

SEQ ID NO: 4245190 - RNA, 85 nt, Pseudomonas putida KT2440
gcaggagcgggcuugcccgcgaaugcgucaguucaggcuaagcuguccccugaccucacgcauucgcgggcaagcccgcuuuugc

SEQ ID NO: 4245191 - RNA, 86 nt, Pseudomonas putida KT2440
ggcgacgucuggguccagguguuacgcagcacaucgagguauucgucgguacgugcguagcgggcaucuuugucgagaaagucgcc

SEQ ID NO: 4245192 - RNA, 108 nt, Pseudomonas putida KT2440
gucgacccgcguacuggccacuugcuggugcuaucggccgacuccaacaugcugcuggagcuggacgagcagggccagcaagucagcuucaugacgcugcugggcggc

SEQ ID NO: 4245193 - RNA, 94 nt, Pseudomonas putida KT2440
gcgcagucuguaccuguacggcucggucggccgggguaaaagcuggcugcucgauggcuuuuuccaggccgugccgauagccgccaagcugcgc

SEQ ID NO: 4245194 - RNA, 94 nt, Pseudomonas putida KT2440
ggugggcaacgccucggcugauggcgcaggcgauggcaaggugcugaccgaaccugggcugaucguucgccacuuugccgagguuugccugacc

SEQ ID NO: 4245195 - RNA, 62 nt, Pseudomonas putida KT2440
gggagggugaucgcgcugguggucagcuccgccugcgacuaccaggcgccgguggccuuccc

SEQ ID NO: 4245196 - RNA, 74 nt, Pseudomonas putida KT2440
uggaccauuggcgauggcgucgacaaugagcugauggguuacaucagcagcgccaacaucgccacugguuucca

SEQ ID NO: 4245197 - RNA, 57 nt, Pseudomonas putida KT2440
ggaguacgcgguggccgauuacaaccgcauucgcgacaugaucgcugacgugauucc

SEQ ID NO: 4245198 - RNA, 74 nt, Pseudomonas putida KT2440
gggcgacgcgguuacuuguaaggcagcaugcgcaacagcguguugucgcgcugcacauagugaugguauagccc

SEQ ID NO: 4245199 - RNA, 86 nt, Pseudomonas putida KT2440
cgucaccguugaucgacuugcuguacaggcccucggccuuggcgaacuugucgaaggcugcagcguuguaccagccagcagugccg

SEQ ID NO: 4245200 - RNA, 92 nt, Pseudomonas putida KT2440
aggauugcucaggauagcggauuggcugcgacucaggugcuugucacaggcuaccaagaggccgagccaaccgcucagagccgagcggugcu

SEQ ID NO: 4245201 - RNA, 94 nt, Pseudomonas putida KT2440
ggccccuucgcgggcuugcccgcucccacaguaucaccacagaccuugagaacugugcuguaccugugggagcgggcaagcccgcgaagaggcc

SEQ ID NO: 4245202 - RNA, 71 nt, Pseudomonas putida KT2440
gaucaagcgcgccugggcguucgacgugaccgggaacaugaucccggucacggucgagcgccuggcggauc

SEQ ID NO: 4245203 - RNA, 84 nt, Pseudomonas putida KT2440
gcugcugccacaucagugggugccugccuaacuuacgcaaggugaguugggcggacgcuuacuuccuauguucaaaaaagcagc

SEQ ID NO: 4245204 - RNA, 74 nt, Pseudomonas putida KT2440
uucgcggguaaacccgcuccuacaggaucugcacugccuugcgcgguccccguaggagcggguuuacccgcgaa

SEQ ID NO: 4245205 - RNA, 68 nt, Pseudomonas putida KT2440
ggccaggugguagcaggucgagcaagccaaggcagcugagggauuugccagagccgcuggcaccgacc

SEQ ID NO: 4245206 - RNA, 125 nt, Pseudomonas putida KT2440
cggugcccacagcggccuugugcaugaccagggcugcggugcugguggcaucuacagcguacuugucgcuggugccagcggucagcgcggugccgccauucgcaacgguggcgauguuggaaccg

SEQ ID NO: 4245207 - RNA, 60 nt, Pseudomonas putida KT2440
cggaguucgcgguugugccggaaagcgccgccgcgcugaaaccggccaaucugagcuucg

SEQ ID NO: 4245208 - RNA, 59 nt, Pseudomonas putida KT2440
gcgcaugcugcuuggucacgaacggcguuuggcccgucagcgugaucgcagcguugcgu

SEQ ID NO: 4245209 - RNA, 75 nt, Pseudomonas putida KT2440
gucgcguuugcguggguacaccaggaaggucggguaggugaacuccggugccugcgguacccgcucgaacacgcc

SEQ ID NO: 4245210 - RNA, 73 nt, Pseudomonas putida KT2440
cuggcacauguacgauaccgucaaggguuccgacuacaucggugaccaggacgcuaucgaauacaugugucag

SEQ ID NO: 4245211 - RNA, 63 nt, Pseudomonas putida KT2440
guucauccgaggcguugcggcacuagcacgguggaggcucuauggcugcugcugcggaugaau

SEQ ID NO: 4245212 - RNA, 86 nt, Pseudomonas putida KT2440
cuucgcggcuaaagccgcuccuacaggggcugcacccgucucgaaugcagugcuguaccuguguaggagcggcuuuagccgcgaag

SEQ ID NO: 4245213 - RNA, 62 nt, Pseudomonas putida KT2440
cagcgggcgaaugcggaucaugggacuucuccuuugugcaagaucugucauucguuuggcug

SEQ ID NO: 4245214 - RNA, 78 nt, Pseudomonas putida KT2440
ggcgagcagguggagaucaucaccagcaagcacggcaaccccagccgugacugguugaacuccaaccugggcuacguc

SEQ ID NO: 4245215 - RNA, 112 nt, Pseudomonas putida KT2440
gcaugugccggccucuucgcgggcacgcccgcucccacggguugcucaccggcgcugaagccuguggaguaucggcgggagcgggcaugcccgcgaaggggcuggcaaaagc

SEQ ID NO: 4245216 - RNA, 130 nt, Pseudomonas putida KT2440
acgauggucacggucucgaagccgcgaugcggaugcuggccuacgccgcgucgugcucgggucggggugaaaucaugcggaccggcguaguccagcagcaggaacgggcugaucuggcuggccagguugu

SEQ ID NO: 4245217 - RNA, 72 nt, Pseudomonas putida KT2440
ggcugucggcacgcuugagggugucgcgcgccggcaccgccagcaggccacccaccgggucguccgccagcu

SEQ ID NO: 4245218 - RNA, 85 nt, Pseudomonas putida KT2440
cuucgcggguaaacccgcuccuacagggugcugagccgaccuucgauguugugcgguccuuguaggugcggguuuacccgcgaag

SEQ ID NO: 4245219 - RNA, 62 nt, Pseudomonas putida KT2440
cauccagguccggcagcgugcccagugcugcaccauacagcagcgagcgucggcccuggaug

SEQ ID NO: 4245220 - RNA, 61 nt, Pseudomonas putida KT2440
ggucagcggugcauuuuaccauucgccaagcugcaugaaggaaaaaugcugccgcuaaacc

SEQ ID NO: 4245221 - RNA, 82 nt, Pseudomonas putida KT2440
gcagggcggcgaguagcagauagugcaguuucaugauggguuccucgugauggcauguuuuaucugcgacagcggcaagugc

SEQ ID NO: 4245222 - RNA, 56 nt, Pseudomonas putida KT2440
gggcgcugucgaguuugcguggcuugccaaaggccugcagcugcuuggccgcgccc

SEQ ID NO: 4245223 - RNA, 55 nt, Pseudomonas putida KT2440
gucgcccucaucgcucacgauguggaaauggccgcagacgccuccugagggcugc

SEQ ID NO: 4245224 - RNA, 104 nt, Pseudomonas putida KT2440
guuccggccucuucgcgggcaagcccgcucccacaggaauggcaccagauucaagcccggcgccuauccugugggagcgggcuugcccgcgaagaggccgguac

SEQ ID NO: 4245225 - RNA, 122 nt, Pseudomonas putida KT2440
gaagagcuuuccaaacucuaugaauucgaucuggccuugcucagccaacagagcgauguaaagcucaagucacugauuggcagccaggccacgguagaaauagaguuauccaacggcucuuu

SEQ ID NO: 4245226 - RNA, 93 nt, Pseudomonas putida KT2440
cuugugccggccccuucgcggguaaacccgcgccugcaaaggugacguagcccgucgcaggagcggguuuacccgcgaagaggccggcccagg

SEQ ID NO: 4245227 - RNA, 116 nt, Pseudomonas putida KT2440
ugugggagcggccuugcgucgcgauaagagcgcgcagcgcuccccucuuucugcgcuugagcugccacugccggggcugcugcgcagcccuuucgcgacgcaaggccgcucccaca

SEQ ID NO: 4245228 - RNA, 84 nt, Pseudomonas putida KT2440
gcugauuucuauugccuguaccagcccuuucgcgggcaagcccgcuccuacaagcgaaagggccgguacagcagucaggccagc

SEQ ID NO: 4245229 - RNA, 76 nt, Pseudomonas putida KT2440
acaccaggcagaacguggguuucgccaagcuugaugcuuccggugucgcccuugaagaagcccauguuccgggugu

SEQ ID NO: 4245230 - RNA, 88 nt, Pseudomonas putida KT2440
gaugaucagcccgucgcagaugggcauccuguugucggcguuuuccauugccuaugccuuugcccaguugccaaugggcaugaucauc

SEQ ID NO: 4245231 - RNA, 75 nt, Pseudomonas putida KT2440
cgcuucgacaagauccuguugcugaucauccuggccagccuggucacggugauccucgacagcaucgaugaggug

SEQ ID NO: 4245232 - RNA, 66 nt, Pseudomonas putida KT2440
caggccgaggccggcaccggcugcccgcugaccaugacguuugccgccgugccggcauugcgccug

SEQ ID NO: 4245233 - RNA, 88 nt, Pseudomonas putida KT2440
cggcagcaggucggcgcggugguaguagcuggccgggugcugguacagcgccuggcugucggcuaccaccgcaccuuccaguugcucg

SEQ ID NO: 4245234 - RNA, 91 nt, Pseudomonas putida KT2440
cccugugggagcgggcucgcccgcgaacaccggcaaagccggugccauccaccgaguugucugcuucgcgggcgagcccgcucccacaggg

SEQ ID NO: 4245235 - RNA, 67 nt, Pseudomonas putida KT2440
cggcggugcguucugcagccucgguggcgauaccggcucacugaaggccaagcaggacggcgcccug

SEQ ID NO: 4245236 - RNA, 82 nt, Pseudomonas putida KT2440
cgccuuuguuucucuggcgucugugagaucgagcgccgcgcgggcggcgcucgaucucauaggcgcugaaacuguuguggcg

SEQ ID NO: 4245237 - RNA, 62 nt, Pseudomonas putida KT2440
ccaggcgcuuggccagcaaggacgacaugauguuggcuucgucaucguuggucagggccagg

SEQ ID NO: 4245238 - RNA, 84 nt, Pseudomonas putida KT2440
ccgcuuaugccgccgacuuugaacuggacccgaucgucgugcgcgacggcugggugcgcaucaguggucggcgucgcuaagcgg

SEQ ID NO: 4245239 - RNA, 57 nt, Pseudomonas putida KT2440
guggcaugcgccuguuccagaccgaaucguccgaccgcucggaaaaggucaugccgc

SEQ ID NO: 4245240 - RNA, 77 nt, Pseudomonas putida KT2440
cgugcaguggcgaaaucaacuacgaaguggaggauguuaaagacacuaucgagaagauucuugcucacuacuugccg

SEQ ID NO: 4245241 - RNA, 116 nt, Pseudomonas putida KT2440
gguaaucgucuuugucggccucuuugcccagguaguuacccagcgcaccaccggcaccaccgccggcugccgcgccaauguagcuacccguggugccgcccacggagcgaccgacc

SEQ ID NO: 4245242 - RNA, 66 nt, Pseudomonas putida KT2440
ggcaaaagcuuucagggcacguugaaaaucgaccauuucucccaacuggccccagaggcuuuugcc

SEQ ID NO: 4245243 - RNA, 129 nt, Pseudomonas putida KT2440
gggugccaacgcgcuggucgcgguauucagcuaucugguuaucgucggccccaucaagcguaucgaauugcgugaugcugccccgaagccacacgcugagccugccaccgacggcgaacuggccagcuc

SEQ ID NO: 4245244 - RNA, 58 nt, Pseudomonas putida KT2440
gggcgggaugaaggccgaggacugggugccgauggacggcccggugaucaacccgcuc

SEQ ID NO: 4245245 - RNA, 100 nt, Pseudomonas putida KT2440
ugcaugcuguggguaaccaucugcugaagaaaaauccgaacgccaaggugguguaccugcauucggagcguuucgucgcggacauggucaaagcgcugca

SEQ ID NO: 4245246 - RNA, 83 nt, Pseudomonas putida KT2440
ggauagguuggucggcgaucaccgugaagucaucgaauuuggcuucgagacggagauugucgagaaaauugaccuugauuucc

SEQ ID NO: 4245247 - RNA, 89 nt, Pseudomonas putida KT2440
ggccugacuguacugaccgccgaugucgauggcuggcagggccuugcggucgagcuugccguuggcguugugcggcaagcugucgaacc

SEQ ID NO: 4245248 - RNA, 90 nt, Pseudomonas putida KT2440
gcgcuggucggcuugcugucggugguuuaccugucggguaucuacaguucugcacaggucggcgcccuggcggacaaacugggccggcgc

SEQ ID NO: 4245249 - RNA, 111 nt, Pseudomonas putida KT2440
aggccuuggggaucggucagagcguggcggugagcuauuccgacccgacggcgaucaagcuaccgguguacgggcggguucagcugaccggcacgcagccggcagggaccu

SEQ ID NO: 4245250 - RNA, 55 nt, Pseudomonas putida KT2440
cccuguggcagcagcggucuugugcagaguacaaaagcguacgcugccacagagg

SEQ ID NO: 4245251 - RNA, 76 nt, Pseudomonas putida KT2440
ugggaaaggucuccaggaaggguacgguuggagccaaauagcuccagccgaaaaccuaccugugaccuuuaccuca

SEQ ID NO: 4245252 - RNA, 61 nt, Pseudomonas putida KT2440
uccacaccacuaccacggccaacccugaaaucgacaccagcgccagguagauggugucggg

SEQ ID NO: 4245253 - RNA, 56 nt, Pseudomonas putida KT2440
aggguuuugccggugugcguguuguuauccccaacgugccuucggcaggaaauccu

SEQ ID NO: 4245254 - RNA, 107 nt, Pseudomonas putida KT2440
ggggccgcuuugcggcccaucgcgacacaaggccgcucccacagguacagcaucggcuugcugugggaguguggccuugugucgcgaucaggcugcggagcagcccc

SEQ ID NO: 4245255 - RNA, 82 nt, Pseudomonas putida KT2440
ggcuggcaggguuacuggaucgacgccgcuucgucccugcgcaugcaggaugacgcggugaucauccucgacccggucaacc

SEQ ID NO: 4245256 - RNA, 82 nt, Pseudomonas putida KT2440
ucaagggcaagaacaucaccggcuucucugaucgcgaagaacuguucuccggcaugaaaagccaggugcccuucuuccuuga

SEQ ID NO: 4245257 - RNA, 74 nt, Pseudomonas putida KT2440
uucgcggguaaacccgcuccuaccacggcguggacacacaucgcggucgucguaggagcggguucacccgcgaa

SEQ ID NO: 4245258 - RNA, 78 nt, Pseudomonas putida KT2440
ggcgucggccgcagcgccaccuuccggcucggcauagcaguagaagcgcuugagcuguggauggcgcgccgccaggcc

SEQ ID NO: 4245259 - RNA, 95 nt, Pseudomonas putida KT2440
gcauaggagcagccuugugcugcgaggggccauuacagauaacacaccuguagguggcuguauuggcccuuucgcagcacaaggccgcaccuugc

SEQ ID NO: 4245260 - RNA, 122 nt, Pseudomonas putida KT2440
ccccuuuugaaaccggugcaucugggggauacggcaaugcucucugaagaucuguacaucauguucgggauugucggcagugugcuggcccuggauauagcagccaucguuuuguacagggg

SEQ ID NO: 4245261 - RNA, 57 nt, Pseudomonas putida KT2440
gcguucuuuggcgaugagccgcugauuguacgauccagcugccuagccgaagaccgc

SEQ ID NO: 4245262 - RNA, 99 nt, Pseudomonas putida KT2440
ucaaccccuucgcgggcacgcccgcucccacagguacagcgcugauuucaagcgcagcgcaguaccugugggagcgggcgcgcccgcgaagggccuuga

SEQ ID NO: 4245263 - RNA, 101 nt, Pseudomonas putida KT2440
auguagucgucgcaguuggucagcucgucgaacgagguuuccuugggcagcaggugccagguuucgucgacgaucugguuguucuuaaugauucgcugcau

SEQ ID NO: 4245264 - RNA, 66 nt, Pseudomonas putida KT2440
gucgauggaaauggugcgcauggucagcucgggcacugaagccaccaugagcgccauccgucuggc

SEQ ID NO: 4245265 - RNA, 71 nt, Pseudomonas putida KT2440
aagcucuauucuucgcggguaaacccgccccuacacacaucguuguaggagcggguuuacccgcguagcuu

SEQ ID NO: 4245266 - RNA, 60 nt, Pseudomonas putida KT2440
caacaguugccggagcgcgucagcccggcccugggcggaacggauuucggcagcgcguug

SEQ ID NO: 4245267 - RNA, 61 nt, Pseudomonas putida KT2440
gcuguccuugaccgugucggccacggcgaacagugccaguggcccggagcggucaagcagc

SEQ ID NO: 4245268 - RNA, 57 nt, Pseudomonas putida KT2440
ugacgggauguucuucggccaggaccgccuggacuuugucgaggaggcgcuacguca

SEQ ID NO: 4245269 - RNA, 107 nt, Pseudomonas putida KT2440
uucaggcgcgucugcagcacggcgugcaggccguuggugcggauuuccgaaaggccaaaggucaugcccagcggcugcuggcguucgugcaggucgaggccgucgaa

SEQ ID NO: 4245270 - RNA, 77 nt, Pseudomonas putida KT2440
ccgcaggcugaagagguucggcgucaguggcugaacaucgagcagugucuggcgagugaacuuuucggcgcuagcgg

SEQ ID NO: 4245271 - RNA, 92 nt, Pseudomonas putida KT2440
gcuuguauccgagggcgucgagcaggcguucaagggucagugcacagccgugcacgucgccgaugaugucaaaacuucgcgccggaucgagc

SEQ ID NO: 4245272 - RNA, 57 nt, Pseudomonas putida KT2440
ugaucggcaaugcaaaacgcccggccuugagccgggcguuuucguuugugccgauca

SEQ ID NO: 4245273 - RNA, 78 nt, Pseudomonas putida KT2440
gugccgccugguugcguucgucgaugucugccgcuucguccagguaguacggcaggcgaaugcgcccggccaggucac

SEQ ID NO: 4245274 - RNA, 77 nt, Pseudomonas putida KT2440
cgaagggcucgggcaguugaacugccaaggucucaaccgugcgcuggaccuggccaguguacugcccgagcgcuuug

SEQ ID NO: 4245275 - RNA, 68 nt, Pseudomonas putida KT2440
gcacaucacccucgggcgucagccagggcacggugcgcaccgguucggcgaagcccagggugucaugc

SEQ ID NO: 4245276 - RNA, 129 nt, Pseudomonas putida KT2440
cguuuguuucuggccaaucccuccugugccaggcgcgcgcgaccgccuuguuuguacgacgcgauaucgaggcgugcgccagggggcucgcgugcgcgucccacaggaauaacuggcccgaaacaaacg

SEQ ID NO: 4245277 - RNA, 130 nt, Pseudomonas putida KT2440
ucgcucaggcgcuggacggcuugcagccugacacaggcaguggcggccgccgacacgagaucccggugugguacgacgccagugucggccccgagcugccugugcuggcagcccgcagcggcuugaguga

SEQ ID NO: 4245278 - RNA, 92 nt, Pseudomonas putida KT2440
gagucagccuugauaacgcagcguuucgcaucauugguccggacggcacgguugggccauaccugaugcgcgacggcaaugucuggcaccuc

SEQ ID NO: 4245279 - RNA, 99 nt, Pseudomonas putida KT2440
gggcggcccuuucgcggguaaacccgcuccuacaggggucggugucgcuuggacgaacccuguaggagcgggucuacccgcgaaccgggggccaggccc

SEQ ID NO: 4245280 - RNA, 58 nt, Pseudomonas putida KT2440
ggccgaccguguugcuaguggacgacgaggagucgauccuuagcagucugcgucggcu

SEQ ID NO: 4245281 - RNA, 83 nt, Pseudomonas putida KT2440
gcgucuuccggguaacgcuuguacuuggcaagguggcgcagcaggucgcucugccagguuggcaaggcguugcuguuggacgc

SEQ ID NO: 4245282 - RNA, 57 nt, Pseudomonas putida KT2440
guuggcaauggagaacguugucaacgcaccgcgggugaccagcagcuccuugccgac

SEQ ID NO: 4245283 - RNA, 64 nt, Pseudomonas putida KT2440
gcugaagucuguacaggccucuucgcgggcgcgcccgcgaauggggccuuacaggccuaccagu

SEQ ID NO: 4245284 - RNA, 72 nt, Pseudomonas putida KT2440
ggcaggcuucgaggaugcuggugucgucgguggcgaugaccacacggcuggcaccgcucuugcgggccugcu

SEQ ID NO: 4245285 - RNA, 115 nt, Pseudomonas putida KT2440
gggggcagagugcgagcgggucaugcuggucggugccagcaacggcgauaccgcaguagcggcuaucgaagcguugcggcauugcccugcagcaggcuugcuggcgcuauacccc

SEQ ID NO: 4245286 - RNA, 128 nt, Pseudomonas putida KT2440
uggcguugcagggcggugggcaaggagcaaggccagguuggugaucaggucuauggcugcgacgaucuuguugucaccgcugcgcuugaucagcgccuccacgucuuccuuggcugccgacagcgcca

SEQ ID NO: 4245287 - RNA, 112 nt, Pseudomonas putida KT2440
gagguguuugccggaggauuuucagcgccugugagaucgagcgccgcccgcgcggcgcuucgcgggcggcgcucgaucucccaggcgcugaaacucucccggcgaacaccuc

SEQ ID NO: 4245288 - RNA, 85 nt, Pseudomonas putida KT2440
gacggguagcugagguaagccgguggcggccucuuggcgcgugacccgucgaagaggccgccaccggcacgcugauuucccuguc

SEQ ID NO: 4245289 - RNA, 87 nt, Pseudomonas putida KT2440
ggccguggcuucgcggugguggccgacgaggugcgcagccuggccgcacgcaccucgcgugccgccgacgacauucgccacaugguc

SEQ ID NO: 4245290 - RNA, 83 nt, Pseudomonas putida KT2440
ccgcguucuucaucaugcuguucauccugcugcgcgccucgaucccgcgcccacgcuaugaccaggugauggacuucagcugg

SEQ ID NO: 4245291 - RNA, 88 nt, Pseudomonas putida KT2440
gugcagcaccgcuuucauggcagccuguuggcguuguaucaggaugaacagcucaaccagcaacugccggggcuggcggcgcugucac

SEQ ID NO: 4245292 - RNA, 117 nt, Pseudomonas putida KT2440
gggcaaaggaaggccauggacgcgggcagggucucgagcacaccgccgacagcgugacguagcgcggcguucugcucgggauccucgcuggugaagauguuguugccaucuuugucc

SEQ ID NO: 4245293 - RNA, 85 nt, Pseudomonas putida KT2440
ggcugaccauugaguaaaccuguaccggcccuuucgcggcgguucgacgcgagagggccgauacaaggccgcuucacccccagcc

SEQ ID NO: 4245294 - RNA, 77 nt, Pseudomonas putida KT2440
cuggcgggacuguaccgugaggcgcgccuggaggacccgcggguccuugccgcuuacgcgcgugcgcgcucugccag

SEQ ID NO: 4245295 - RNA, 92 nt, Pseudomonas putida KT2440
gggcggcaucgcgaagguugccgggaucaacaucuucgaccugaucaaugcgaucaaggaugaguugauccuggcguucaguacugccgccu

SEQ ID NO: 4245296 - RNA, 104 nt, Pseudomonas putida KT2440
gcaggcgauagcgcaccugguugaccuuggccaugguuucggccagcgccugggucgaaucgcgguugagcaccaugcgcaaggugaucaggcugcgccccugc

SEQ ID NO: 4245297 - RNA, 56 nt, Pseudomonas putida KT2440
gcaggcgcuugucuccgggcugcgaggcgccaucgagcaggaugccacgcgcuugc

SEQ ID NO: 4245298 - RNA, 57 nt, Pseudomonas putida KT2440
gcagucuucggucgaaggccuggagcgugaaggugauggcuggcgagugaagacugc

SEQ ID NO: 4245299 - RNA, 55 nt, Pseudomonas putida KT2440
cgcgcuugccagggguagccaauauucgcucgaguuuugcccugaagcaggugcg

SEQ ID NO: 4245300 - RNA, 82 nt, Pseudomonas putida KT2440
ggcucuguaugaaaagccuugagguucggugaugcugcguugaaaacagccugaccuucgucucaaggcuuaauacagcccc

SEQ ID NO: 4245301 - RNA, 94 nt, Pseudomonas putida KT2440
ucagccuucaauggccgagguccaugguggaauucgggagcgcaacauaugaacuacgcgcugccaaagaaacugugggaccggcucgggcugg

SEQ ID NO: 4245302 - RNA, 110 nt, Pseudomonas putida KT2440
uuugcguggccuguaccgaccucuucgcggguaaacccgcuccuacauggaucgcauugccccuguaggaucggguuuacccgcgaagaggccggcacagacaccgcaaa

SEQ ID NO: 4245303 - RNA, 130 nt, Pseudomonas putida KT2440
gagguguguggaugccuugcggccaggugcaugccauucgcugugucggcgacgugaagaugcgcaguguguucgugcgcagcgacgcggcaaccggccugccccugcagagcaaggccaucagcaucuc

SEQ ID NO: 4245304 - RNA, 69 nt, Pseudomonas putida KT2440
cuccuacgaaccccacauacgacaaaggccacccgaagguggccucugugcgcgugggggguguagcag

SEQ ID NO: 4245305 - RNA, 75 nt, Pseudomonas putida KT2440
gggucgacacggcuaugacacguacagccuccccgccccggguaaggugugcgugucauaggucuugucaaaccc

SEQ ID NO: 4245306 - RNA, 74 nt, Pseudomonas putida KT2440
cauagaccauuucgcgcagggugccggccagcggcaugugcacgcggugguaguccuugggcgacagguagaug

SEQ ID NO: 4245307 - RNA, 67 nt, Pseudomonas putida KT2440
cgccgccugggcaaccgaccagcccagcaacgacgcgccgagggcgaucuugcugcccaggcggucg

SEQ ID NO: 4245308 - RNA, 58 nt, Pseudomonas putida KT2440
gacugugugaaaacggcugaccugcgggcuacccccgucaucacguuuucacaccguc

SEQ ID NO: 4245309 - RNA, 80 nt, Pseudomonas putida KT2440
augacuggacgcugaccaucuaaaaggccauuggggcugcauugcagccccaaugguuauuugaucggccgccagaucau

SEQ ID NO: 4245310 - RNA, 93 nt, Pseudomonas putida KT2440
gagcuucaagccguaagcuucaagcugcaagaaaaagcaggccgagcgccgggcugcauugucgugcagcgugaagcucguugcuugcagcuu

SEQ ID NO: 4245311 - RNA, 62 nt, Pseudomonas putida KT2440
uccaucuuucuguacuguuccucuaugcuggaacuuaaggacgguacagcguucaggaugga

SEQ ID NO: 4245312 - RNA, 98 nt, Pseudomonas putida KT2440
ggccgcuucgcgggugaacccgcuccuacauugacugcgcgaugccuaagggcggcgcaaccgucggucguaggagcggguucacccgcgaagaggcc

SEQ ID NO: 4245313 - RNA, 101 nt, Pseudomonas putida KT2440
uugauuccucguuaggcuucaaacuuucgcaaaugcuugcgcccggccgcauggaaguaggugcacugcgaguguuugaccugccaagagacgaggaucaa

SEQ ID NO: 4245314 - RNA, 93 nt, Pseudomonas putida KT2440
ccuguaccggccucuucgcggguaaacccgcuccuacaccagguaucacaugcccuguaggagcggguucacccgcgaagaggccggcacagg

SEQ ID NO: 4245315 - RNA, 91 nt, Pseudomonas putida KT2440
gauuucgauuagccagccugaucgccgccuccuugcgcccaaggcgggauagccagcgcaagaggcggcgaucaucuggcugaucggaauc

SEQ ID NO: 4245316 - RNA, 97 nt, Pseudomonas putida KT2440
aggugaauggauaaaacgacgguugaucguugagcgcagcgggcgccuuuacgcuaccgaugcucuggagucggccuuucgcuuuguugauucacuu

SEQ ID NO: 4245317 - RNA, 74 nt, Pseudomonas putida KT2440
ggcgauacuucauccuugcacugaagcaauugagcucuaaggagcucggccugcuucagcaaggcuacguugcc

SEQ ID NO: 4245318 - RNA, 100 nt, Pseudomonas putida KT2440
ggcgcugggcuacccgcugcugugcguggagggugucgaggcugacgacgugaucggcacccuggcgcgcagcagugccgcccugggucgcccggugauc

SEQ ID NO: 4245319 - RNA, 65 nt, Pseudomonas putida KT2440
ucgcggguggcgauguacauggacaccaacagcagcacgaacaucaauggcaccgacacccgcga

SEQ ID NO: 4245320 - RNA, 77 nt, Pseudomonas putida KT2440
uuggcuucugcggcccuuucgcggguaaacccgcucgcguaggagcggguuuacccgcgaagagguccucagcccaa

SEQ ID NO: 4245321 - RNA, 63 nt, Pseudomonas putida KT2440
gcuuaggcuucaguuauaccuguacaacaauucaauuuuguacaggauugccuggagcccagu

SEQ ID NO: 4245322 - RNA, 98 nt, Pseudomonas putida KT2440
uuaccuucuucgcgggcaagcccgcuccugcagauuacccagaccuuuaaugcugugguauuccggcaggagcgggcauugcccgcgaaugcagguga

SEQ ID NO: 4245323 - RNA, 93 nt, Pseudomonas putida KT2440
agaguagucucgacagcgagaugcuggugcugcagcucgacccucagggacggaucgagauggucaacggcaauuucgagagcgagaugcucu

SEQ ID NO: 4245324 - RNA, 57 nt, Pseudomonas putida KT2440
gccgcgcgacuccagcuggucugccaccugcaagguagucagcugguuguuggccgc

SEQ ID NO: 4245325 - RNA, 72 nt, Pseudomonas putida KT2440
ggcgcaggucggcugaauaaugaaaacgucuuuaccgcgaacauuuucauugaucucaguacugaucucgcc

SEQ ID NO: 4245326 - RNA, 112 nt, Pseudomonas putida KT2440
cgcaaucacccgggccaaugcugucucggugccagcgcgcauguccaucggcucgguggccagccagauggcaucgaugcggaucauugagcgaaagcccgaauaaauugcg

SEQ ID NO: 4245327 - RNA, 62 nt, Pseudomonas putida KT2440
ucaaugacaaaguggcaggcguaaaccucaucccagguuugauugcccaacuuugccauaga

SEQ ID NO: 4245328 - RNA, 119 nt, Pseudomonas putida KT2440
aucggguugggauugguggucaucggcgccgaacugacaggcccuguacugaucggcccuggcgugaucggcgagguacugaucggcgcggcgccauuggacgccgggaacgucuggau

SEQ ID NO: 4245329 - RNA, 110 nt, Pseudomonas putida KT2440
ucugugccggccucuucgcggguaaacccgcuccuacaggggggcgcacaauguuugggccugcggccauccuguaggagcggguuuacccgcgaagaggccggcacagg

SEQ ID NO: 4245330 - RNA, 64 nt, Pseudomonas putida KT2440
aaccgaccugcagcgucugcgugaucgccugauccgugaaguggacugcaugcagcaauugguu

SEQ ID NO: 4245331 - RNA, 105 nt, Pseudomonas putida KT2440
guaccggccucuucgcgggcuugccccguucacacaggaauugcaccgauuuauagaagugcacaguaccugugggagcgggcaagcccgcgaacaggccaguac

SEQ ID NO: 4245332 - RNA, 61 nt, Pseudomonas putida KT2440
uggacgcucaacgcggcgagcggauggaguuucgacagccgucgcugauagggagcgccca

SEQ ID NO: 4245333 - RNA, 61 nt, Pseudomonas putida KT2440
uguuccgcgugcugguggacuucgaugaagacaugccgauggucgacgagaaccuggagca

SEQ ID NO: 4245334 - RNA, 112 nt, Pseudomonas putida KT2440
gcuugugcuggccucuucgcgggcaagcccgcucccacagggucggcgccguauuacaaggcggugcagauuccguaggagcgggcuugcccgcgaagaggccggcacaggc

SEQ ID NO: 4245335 - RNA, 67 nt, Pseudomonas putida KT2440
ggccuuggcggugccgaagucgauggcugcagcgccgcugaucaucgaguccggcccguacaggguc

SEQ ID NO: 4245336 - RNA, 105 nt, Pseudomonas putida KT2440
gaccuguacggcgcagcucuugaucaacuuuugggcaaagucgaugagguaguagcacucucgauuuucccagaggccaccgaugaagaugcggccggucaaguc

SEQ ID NO: 4245337 - RNA, 64 nt, Pseudomonas putida KT2440
guucugcggcuugcugaggcgcgacugaugggcgccguggucgaccucgacaggcugcuggaac

SEQ ID NO: 4245338 - RNA, 58 nt, Pseudomonas putida KT2440
acgccgcacauugccuguauggccuggucuacgccgugcaccugggcauuggcggcgu

SEQ ID NO: 4245339 - RNA, 57 nt, Pseudomonas putida KT2440
gcaaugcaaguaccguugaagcgggguucagucgcuucagcucgaugcuugcagugc

SEQ ID NO: 4245340 - RNA, 78 nt, Pseudomonas putida KT2440
cgguuuccuuuggcagccauguugaaaguggcgcagucgggccgcgccaucguuauugugcuugccaguagauagccg

SEQ ID NO: 4245341 - RNA, 66 nt, Pseudomonas putida KT2440
ugacgcgcagccucuucacggucugcggugaugucccggccaaccgccgucaggaggcugccguca

SEQ ID NO: 4245342 - RNA, 88 nt, Pseudomonas putida KT2440
gagcagaugcagaucauguauggccuggcuggcgagcgugaccugcaggaguacaccuugccguggcuggccgguuaugagcauucuc

SEQ ID NO: 4245343 - RNA, 68 nt, Pseudomonas putida KT2440
gggaucggcgagcguggaggugaccgaagaaaacuucaccugguuccaccuucacuuuccggaagccc

SEQ ID NO: 4245344 - RNA, 63 nt, Pseudomonas putida KT2440
ggguucuucgccgcuugccauucagggugccacugcaccgcgaacaagaacggcgaaaugcuu

SEQ ID NO: 4245345 - RNA, 91 nt, Pseudomonas putida KT2440
accugggccugccgucggaagaaaccuucaugggcaaggguguuucggccugugccaccugugacgguuucuucuaccgcaacaagccggu

SEQ ID NO: 4245346 - RNA, 64 nt, Pseudomonas putida KT2440
gguggugcugguaccagaggcgccgaggguguugaacaggucgcugguggcacguagcaccgcu

SEQ ID NO: 4245347 - RNA, 71 nt, Pseudomonas putida KT2440
gccggccagggcgcugucgauggccgccugauagucaccgcgcaagguguacagcagcgccugcagccggc

SEQ ID NO: 4245348 - RNA, 80 nt, Pseudomonas putida KT2440
cagcgcugcgcgguuuuccacaugcggguugcgcaugauuaccgccuugccaccccccaucggcaagccggccagugcug

SEQ ID NO: 4245349 - RNA, 67 nt, Pseudomonas putida KT2440
uccaaccugguguucugcuccgaaggcagcccggccggcuucgauccggggcaguacaccaccggga

SEQ ID NO: 4245350 - RNA, 61 nt, Pseudomonas putida KT2440
caugaucggccaggcgcagacuggcaccggcaaaaccgcugccuucgcccugccgauccug

SEQ ID NO: 4245351 - RNA, 112 nt, Pseudomonas putida KT2440
ggcugccaaguguucgccacgacaguuucagcgccugugagaccgagcgccgcgcgggcggcgcucgaucucacaggcacugcaaggguuguggcggacacaucucacagcc

SEQ ID NO: 4245352 - RNA, 86 nt, Pseudomonas putida KT2440
guggccugcaggagcggguucacccgcgaauacgagggugaacccaccgacgcauucgcgggugaacccgcuccugcaggguucgc

SEQ ID NO: 4245353 - RNA, 56 nt, Pseudomonas putida KT2440
ggaguugggcugcaugcagaucgcaucgaagccggugaucgcgcacagccagcuuu

SEQ ID NO: 4245354 - RNA, 98 nt, Pseudomonas putida KT2440
cuggggcaagccgaccuggggcagcuggugggugugggaugcccgccuuacguccaugcucauccugcuguuccuguacuucggcauuauugcgcugg

SEQ ID NO: 4245355 - RNA, 65 nt, Pseudomonas putida KT2440
ugccggugaagcacugcucuuugccgccgccgcugcggaugcugagugcgucguuuuaacuggcg

SEQ ID NO: 4245356 - RNA, 72 nt, Pseudomonas putida KT2440
gccugccuggucagcgaacgaaggcgcuggcugguggauaccgcgacgcucuucuucgccgaucgggccggc

SEQ ID NO: 4245357 - RNA, 94 nt, Pseudomonas putida KT2440
gcggcaagccgucuacguauuugguggucagcagcauggccagcacacucgggcuggccaugcuuuucucgaucaucugggcgggcuuguccgc

SEQ ID NO: 4245358 - RNA, 57 nt, Pseudomonas putida KT2440
uguucaagcugaccgaugagcugucgcuguacgccaacuacaucgaaggccugagca

SEQ ID NO: 4245359 - RNA, 64 nt, Pseudomonas putida KT2440
gcaaggucggcgggcgggugcugaacgagcagccauugaugcagaacgugcuggccgaccuggc

SEQ ID NO: 4245360 - RNA, 97 nt, Pseudomonas putida KT2440
uuggcgcccaacucgggaaguuugauggacaguguguauuguccggugcggcuaucgacaccgcucuccaugaaacucaugaaguuaagggcguugg

SEQ ID NO: 4245361 - RNA, 59 nt, Pseudomonas putida KT2440
aacagccaguucgagcgcccgagugcccagggccguaucugguucucgaccugguuguu

SEQ ID NO: 4245362 - RNA, 71 nt, Pseudomonas putida KT2440
ccacggugccguuggccggcacggugaugacggucuugccgucgcucagcgugaaggucaaugcacugugg

SEQ ID NO: 4245363 - RNA, 76 nt, Pseudomonas putida KT2440
ggcuacccgccaggcucggguauuugaagcguuguaccuugauacgccgcagcaugcagaccuggcacggguggcc

SEQ ID NO: 4245364 - RNA, 65 nt, Pseudomonas putida KT2440
gcuugagccauugggcaaugccauugcuuugcaccagggcaauuucguuuuccagaggcgccagc

SEQ ID NO: 4245365 - RNA, 64 nt, Pseudomonas putida KT2440
ucgaggcgcacuucggcguacccaugaccggugccgugcucaauacccugaacgugcgccugga

SEQ ID NO: 4245366 - RNA, 76 nt, Pseudomonas putida KT2440
gucauucaggcccaugaggaucuugugcgccuccagcaccuuggagcgcaccacaucuucauucugguccugcgac

SEQ ID NO: 4245367 - RNA, 129 nt, Pseudomonas putida KT2440
ugucuguugacugugccagccucuucgcggguaaacccgcucccacaagggcgucacaugcccuagggcggugauguaccuguaggagcggguuuacccgcgaagaggccggcacaggcaacgacgaua

SEQ ID NO: 4245368 - RNA, 79 nt, Pseudomonas putida KT2440
gcgcguggaacaaggccugccagugcacaugccggacaccaugaaggccuucggcaucaauggcggccucaagcacggc

SEQ ID NO: 4245369 - RNA, 104 nt, Pseudomonas putida KT2440
guaccggccucuucgcgggcuugcccgcucccacagguauuacgcagguuucaaggacuuugcaguacuugugggagcgggcaagcccgcgaagaggcccauac

SEQ ID NO: 4245370 - RNA, 73 nt, Pseudomonas putida KT2440
gcccuguuaccagcgcuggcgccgggugaccugccggggcaggcacgcuugagcgaggcgcugguggcggggc

SEQ ID NO: 4245371 - RNA, 55 nt, Pseudomonas putida KT2440
gcgcagccgacuuucaagcacggacaggucugccgagcuugucaggucggcuggc

SEQ ID NO: 4245372 - RNA, 102 nt, Pseudomonas putida KT2440
ggccggccucucugcgguaaacccgcuccuaccagggacgugccggccuugaaugcggcgcugccccugguaggagcggguuuacccgcgaagaggccggcc

SEQ ID NO: 4245373 - RNA, 55 nt, Pseudomonas putida KT2440
aguucgguaucggcacgcugcugggccugggcggcggcuggcugaugcugcaacu

SEQ ID NO: 4245374 - RNA, 116 nt, Pseudomonas putida KT2440
gggugaucugguuggugcuggggucgacgcugaugucggagaacagcagcuugcccggcagcggguaggcgcugccgucauccuggaucagcguggcgcgugccuggccgucgccc

SEQ ID NO: 4245375 - RNA, 73 nt, Pseudomonas putida KT2440
guagcggccucuucgcggguaaacccgcuccuacaggcgaccgugcaggguuuacccgcgaagaggccggaac

SEQ ID NO: 4245376 - RNA, 119 nt, Pseudomonas putida KT2440
ccggccaaguggccauggucgccaucaucgccuggaaccacagcagcccggccacgcccaggcggcguagggcgcugcgguuuucccgggccaauugcucggcggccuggucaggcugg

SEQ ID NO: 4245377 - RNA, 72 nt, Pseudomonas putida KT2440
ggugaguugccgcgcuuuguacuggacccgcgacugacggcgcgcgcggugcagaaccuggugcgcaaugcc

SEQ ID NO: 4245378 - RNA, 66 nt, Pseudomonas putida KT2440
ccaucucgcgcaguuuuugccccaccacguuggggaugccggcguguuuggcauaggcugcguugg

SEQ ID NO: 4245379 - RNA, 103 nt, Pseudomonas putida KT2440
cacccugagcaaucuuuauggacggccguugcaagucagcgcggcgaucaccgcagcgcgugaugaugcaguggucgggccuuaucugaaugacggcaaggug

SEQ ID NO: 4245380 - RNA, 78 nt, Pseudomonas putida KT2440
ucgcgggcacgcccgcucccacagguaucacaugaccuccaggucuggugauuccugugggagcgggcgugcccgcga

SEQ ID NO: 4245381 - RNA, 83 nt, Pseudomonas putida KT2440
cggcaaugcgcaacugguggugacgggugccguaguguuuggcgaucagguccgaauacuggaacucgucgccgcgcucgccg

SEQ ID NO: 4245382 - RNA, 56 nt, Pseudomonas putida KT2440
gugaugucgcugauccugcuggcgccaagcuggggcggcaugaucaacggcaugau

SEQ ID NO: 4245383 - RNA, 81 nt, Pseudomonas putida KT2440
cccggauugcgcaaggcgcacaccagcgcgccaugcccacccauggaguggccgcugaugcugcgcucgcccgacgccggg

SEQ ID NO: 4245384 - RNA, 63 nt, Pseudomonas putida KT2440
ggccucuucgcggguaaacccugcacggucgccuguaggagcggguuuacccgcgaagaggcc

SEQ ID NO: 4245385 - RNA, 83 nt, Pseudomonas putida KT2440
ggcgucuuuguugcaggcucucgaacagcgccucgcgaugcuguuccagguguugcgcgaguuuguuguucagugcggacgcu

SEQ ID NO: 4245386 - RNA, 76 nt, Pseudomonas putida KT2440
ucggcaggccuaugccgcgccgcgacaacagcugcaacgagcgcagcuugucgcgcgagcgggcaauggcuaccga

SEQ ID NO: 4245387 - RNA, 62 nt, Pseudomonas putida KT2440
gcgggccuggaucaguucggcgauggccugcuucuguucaucgcuggccugcuccagggcgc

SEQ ID NO: 4245388 - RNA, 55 nt, Pseudomonas putida KT2440
ggcaugucgauuaccugcaugaugggcacuugcaucacaugcaggcgaucauguc

SEQ ID NO: 4245389 - RNA, 78 nt, Pseudomonas putida KT2440
cugaguuuuuugggguugcguugcaacccuucgcgggcuugcacgcgaagggcugcaacgcaaccccgguacgcucag

SEQ ID NO: 4245390 - RNA, 67 nt, Pseudomonas putida KT2440
ggcguggcugcagccguccacguaggcgugcaggaugcagcguugcggugcgggcugcaguuguucc

SEQ ID NO: 4245391 - RNA, 80 nt, Pseudomonas putida KT2440
ccugggugaauaccugcagcgccguuacccugaccgccaugacgugcaaagcgacaaggcgcuguauggcuaugcccagg

SEQ ID NO: 4245392 - RNA, 61 nt, Pseudomonas putida KT2440
uuccuucacacgggggcacgauagacaguagcagucagugugccagcuuguagugaagggg

SEQ ID NO: 4245393 - RNA, 63 nt, Pseudomonas putida KT2440
aucggccacgcgcagacguugcugaacgcaccggggcaguugucucgucugcugcuggccgau

SEQ ID NO: 4245394 - RNA, 75 nt, Pseudomonas putida KT2440
ggguuugacaagaccuaugacacgcacaccuuacccggggcggggaggcuguacgugucauagccgugucgaccc

SEQ ID NO: 4245395 - RNA, 81 nt, Pseudomonas putida KT2440
gauaauguaauuggggcugcuuugcagcccuucgcgggcgagcccgcgaagggccgcaaggcggccccgguucauucaauc

SEQ ID NO: 4245396 - RNA, 81 nt, Pseudomonas putida KT2440
gccguucgguggcuucaaacagucgggcaacggccgugacaagucgcugcacgcacuggagaaguacaccgagcugaaggc

SEQ ID NO: 4245397 - RNA, 82 nt, Pseudomonas putida KT2440
uucgcgggcgcgcucgcucccacagguacagcgcaagccuugaagcuugcgagacaccugugggagcgggcgugcccgcgaa

SEQ ID NO: 4245398 - RNA, 83 nt, Pseudomonas putida KT2440
ggggcgaugcuggaaguguuggugcaccuggagaucgaccccgaggauuucccuaccaccaugcgcuugcuucgcaucgaacu

SEQ ID NO: 4245399 - RNA, 129 nt, Pseudomonas putida KT2440
gccguuguuguuguccaggccaauccaggcgcccuuggcaucgaucaccagugcuucggccaggccaaacggcugcgcguagcgccgugacucgaccagcgcaucagcagcgaacgaccagcaacgcuc

SEQ ID NO: 4245400 - RNA, 63 nt, Pseudomonas putida KT2440
gaucuagaaaagcauucgccgacugauccggguaggucagccgccgaauacuuugcuaugguu

SEQ ID NO: 4245401 - RNA, 80 nt, Pseudomonas putida KT2440
gggcccgcgaaagcagaucgcgaauuucaacuauauguguaaaaaugcacaaacaguugauuuugcggucugccaugccu

SEQ ID NO: 4245402 - RNA, 75 nt, Pseudomonas putida KT2440
cccgccagcaagccuucgagcuccgccagccaggccucggccugcuggcgguaaugcucgcgggaaugcuccggg

SEQ ID NO: 4245403 - RNA, 63 nt, Pseudomonas putida KT2440
gcgucgcccgaacaguagaagcccuccucgucgaacgccucggcggucugcugcggcgagcgc

SEQ ID NO: 4245404 - RNA, 105 nt, Pseudomonas putida KT2440
gaggcuucaggcaguuggucggcagcacaaacgcuacaguuagcggcuaugguaaugccaucaagcagccacugucaguguccgauaugcccgauugcgugcuuc

SEQ ID NO: 4245405 - RNA, 101 nt, Pseudomonas putida KT2440
gccugugccggccucuucgcggguaaacccgcuccuacgggggaccgcgcacgguccgcgccuguaggagcggauuuacccgcgaagaggccggcgcaggc

SEQ ID NO: 4245406 - RNA, 117 nt, Pseudomonas putida KT2440
gccccggguaugcgguauugcugguggcgauggccauggcuggccuggccaaugguguguaccacccggccgacuaugcgcugcuggccaacggcaucgagcccgcacgccuggggc

SEQ ID NO: 4245407 - RNA, 76 nt, Pseudomonas putida KT2440
ggugcgagccauagugguugaugugcucgauggccugguucaggccgucgaccacgcgaaucgacaggaucgcauc

SEQ ID NO: 4245408 - RNA, 82 nt, Pseudomonas putida KT2440
uucgcgggcacgcccgcucccacagguacugcacaggccuuaagugcggugcgauuacugugggagcgggcaugcccgcgaa

SEQ ID NO: 4245409 - RNA, 63 nt, Pseudomonas putida KT2440
gcuucauggccaaggaccgcaucaugccgcacaucgguuucgaugcggugcauggccaggagu

SEQ ID NO: 4245410 - RNA, 87 nt, Pseudomonas putida KT2440
gucgagcaaggacuacagccgccucgaaggccugcacagccuggacuucguguuguuguucgugcccaucgaggcggccuuuucggc

SEQ ID NO: 4245411 - RNA, 124 nt, Pseudomonas putida KT2440
ggcgcgccaccgcccccguaggagcgggcuugcccgcgaacaccggcaacgccugugccaucuagcgcguugccugcuucgugggcaagcccgcugccgcucuuuaucaguguguggucaggcc

SEQ ID NO: 4245412 - RNA, 76 nt, Pseudomonas putida KT2440
cggcucaggcgcuggcuggcauuggcgaugccgccgucgacaucgcccugguccagcacggugcgcugcacgcgcg

SEQ ID NO: 4245413 - RNA, 106 nt, Pseudomonas putida KT2440
ggcauuccugcgcgaaaccuuggcgagugaccgguucaccacgccacccuugguacgugguguguacuggucgucagugguacagcaaggcgacaugcgcaaugcc

SEQ ID NO: 4245414 - RNA, 58 nt, Pseudomonas putida KT2440
auuguugcugccguuguggcuaccggcuacgaagagccguccgccauucagcaacaau

SEQ ID NO: 4245415 - RNA, 96 nt, Pseudomonas putida KT2440
guccuggccggcuuucaugauguucaagucguauucggggcugaugccgaacagcuccaguaccugaucgagcauuugccggugcuggccggugac

SEQ ID NO: 4245416 - RNA, 91 nt, Pseudomonas putida KT2440
gcuggcucaugccuuugccggugucggucagcacgaacucggcacgcacgccuucuugcacauugaccugggcauugagcaucccgccagc

SEQ ID NO: 4245417 - RNA, 92 nt, Pseudomonas putida KT2440
ggcgaaccggcgagcccggugaaaugcaggguaaaaagaacuggcaauugccguucugggccgugcuguuucccuacaaccucuccgucgcc

SEQ ID NO: 4245418 - RNA, 98 nt, Pseudomonas putida KT2440
gucgcggcgaggugccggagguggugcugaacaaccucuaccagcaaacccagcugcagagcguauucggcaucaacgugguggcccuggucgacggc

SEQ ID NO: 4245419 - RNA, 62 nt, Pseudomonas putida KT2440
gcaggagcagcacuuccgugaagaccuguucuaccgggucaacggugugucgcugcgccugc

SEQ ID NO: 4245420 - RNA, 83 nt, Pseudomonas putida KT2440
cagugcccacggugccguuggccggcacggugaugacgguuuugccgucgcucagcgugaaggucaaugcacugugguuauug

SEQ ID NO: 4245421 - RNA, 57 nt, Pseudomonas putida KT2440
cgccacagcucugaagguucgacgcuggguggcgaaccuucgguuggcuggcuggcg

SEQ ID NO: 4245422 - RNA, 78 nt, Pseudomonas putida KT2440
ucaucgaccacgguauggguaucgucauuggcgaaaccgccgagaucggcgaugacgucacccuguaccaggggguga

SEQ ID NO: 4245423 - RNA, 123 nt, Pseudomonas putida KT2440
gcggcgucuucgagcgcgagcagcagggcgugaacugaucguucagggccuguuccucuucggugagaaacagaucgcgaugguccggugugcccugcagcacgcgugucaggcaggugccgc

SEQ ID NO: 4245424 - RNA, 126 nt, Pseudomonas putida KT2440
ucguuuuuagccucacuggccucuucgcggguaaacccgcuccuaccaaagaccgcacaaucgcucagagcugugcauguaggagcgggcuugcccgcgaagaagccaacgccguugaaccugcga

SEQ ID NO: 4245425 - RNA, 59 nt, Pseudomonas putida KT2440
gaaacgccuuguucuuuuucgaggaagcgacagcgucgccuccucgaaacagggcguuc

SEQ ID NO: 4245426 - RNA, 55 nt, Pseudomonas putida KT2440
gcgugguagugccugccggcaaggaccugaccuuugcccccggugccuaccaugu

SEQ ID NO: 4245427 - RNA, 55 nt, Pseudomonas putida KT2440
gcacgguucaagaagugccggccggcuucggucaggcucaugccuugggccgagc

SEQ ID NO: 4245428 - RNA, 58 nt, Pseudomonas putida KT2440
ucagcuuuggcuaucagccgugaugagguuugugcucaucggcggcuuccagggcugg

SEQ ID NO: 4245429 - RNA, 74 nt, Pseudomonas putida KT2440
ugccgacaaggaaagccaccagguguucaucgagccggaaggcuugaacacccaugaguuguaucccaacggua

SEQ ID NO: 4245430 - RNA, 70 nt, Pseudomonas putida KT2440
cgugcuguuggcggcgaugugguugcaagcggcugugcgcgcucaagcaacacuugccaccggcagcgcg

SEQ ID NO: 4245431 - RNA, 85 nt, Pseudomonas putida KT2440
uguaggggcggguucacccgcgaacaccggcgcagccggugccauguuccgcguugccugcuucgcgggugaacccgcuccuaca

SEQ ID NO: 4245432 - RNA, 106 nt, Pseudomonas putida KT2440
gucgauugcagcgaaccgugaggccuugaggguccaggcauugaucgccaggcucaaaggccugcugagcaaggccgggcucgaugcgcuugcgcagcugugcgac

SEQ ID NO: 4245433 - RNA, 110 nt, Pseudomonas putida KT2440
cgugaaccgcuucggcgcaaaucaguguggugcccagggcauuggugccgacgccacguucgugccaaugggcgccggcgcugaaaccauggugcuggcgcgguucgaug

SEQ ID NO: 4245434 - RNA, 55 nt, Pseudomonas putida KT2440
uggcagcgaggugggcaucaagguguuguggaucuuguugaucgccuugcugccg

SEQ ID NO: 4245435 - RNA, 67 nt, Pseudomonas putida KT2440
gagcgcagucgaggcuuugcgcgaauugaacccgcaacugcgcgugauucgccaacgugacugccuc

SEQ ID NO: 4245436 - RNA, 59 nt, Pseudomonas putida KT2440
gucaugccgcggcgcuugcgcaggccgcggaugcgggugccgaggaacugcggcgcggc

SEQ ID NO: 4245437 - RNA, 80 nt, Pseudomonas putida KT2440
ugacgugauguuuuggcaccugugagaucgagugccgcgcgggcggcgcuggaucucacaggcgcugcaaacauugcgca

SEQ ID NO: 4245438 - RNA, 63 nt, Pseudomonas putida KT2440
auaccgccaccggccaggagguaauggcgugccugcacgcugaccugccugccgguagggugu

SEQ ID NO: 4245439 - RNA, 130 nt, Pseudomonas putida KT2440
ugagugagcaguuccuuuggcuggguguguuguuccugcugcuggaaugggcggccaucgccaucuacucaggccugggcgccuacaugcagcguugguucagccagcccggcccacgccgaauguucaa

SEQ ID NO: 4245440 - RNA, 69 nt, Pseudomonas putida KT2440
cugccccagcuguucggcggcgcgggucacgcugcggcauugauacagcacgucgaacagcugcagcag

SEQ ID NO: 4245441 - RNA, 76 nt, Pseudomonas putida KT2440
caccucggugaacuguucggcgaccguggcccgggccguggccgaccauuuccgccgugacauucaccccgaggug

SEQ ID NO: 4245442 - RNA, 61 nt, Pseudomonas putida KT2440
gauauucacgaugcuggccaagggaaccccggcgcgggugauugccgagcaguuguguauc

SEQ ID NO: 4245443 - RNA, 84 nt, Pseudomonas putida KT2440
uucgcgggugaacccgcuccuacaaggaccgcgcagguuucaaaccuugcaccgucucuguguaggagcgggcucacccgcgaa

SEQ ID NO: 4245444 - RNA, 74 nt, Pseudomonas putida KT2440
auguagcggguuucggcgauggccggguguaccgggugauccgggcccugaccgccucgcucgagcagcugcau

SEQ ID NO: 4245445 - RNA, 70 nt, Pseudomonas putida KT2440
cgcccacugcuucagaguucgcgcuuuuuucugucguaaugagguaagccaaccaugaaugcagugaucg

SEQ ID NO: 4245446 - RNA, 70 nt, Pseudomonas putida KT2440
gccgccaacucguucgcuacgcuggaagugccggaagcgcgccuggacaugguacgaacggguggcgcgc

SEQ ID NO: 4245447 - RNA, 74 nt, Pseudomonas putida KT2440
gccacccgcaggguguggaucaccagcccguacuucaucccugacgaggccguguucgccgccuugcggcuggc

SEQ ID NO: 4245448 - RNA, 61 nt, Pseudomonas putida KT2440
gccgggggugugcuucgucaucaccggcccaggcgugaccaacgucgccacccccaucggc

SEQ ID NO: 4245449 - RNA, 94 nt, Pseudomonas putida KT2440
ggccucuucgcggguaaacccgcuccuacagggguagcgccagccuggcaguugacgcuaccccuguaggagcggguuuacccgcgaaagggcc

SEQ ID NO: 4245450 - RNA, 94 nt, Pseudomonas putida KT2440
ggcccauucgcgggcuugcccgcucgcacaggaccugcacaagguccgaacccugugcaaugccugugggagcgggcaagcccgcgaaugggcc

SEQ ID NO: 4245451 - RNA, 59 nt, Pseudomonas putida KT2440
ggaacuggccaggcggcuguccauaccgcuggagggugugggcuucccuggccauuucc

SEQ ID NO: 4245452 - RNA, 86 nt, Pseudomonas putida KT2440
gugggcuugcuguggggcguaggcagccuggucgggccgcuggucaguggggcggccaugaaugucgcgccgcaugguuugcccau

SEQ ID NO: 4245453 - RNA, 69 nt, Pseudomonas putida KT2440
gccaacugcaccugucgccgcaggccaugacuggcaucccaucgggucugcccgcgcaggcgcuugagc

SEQ ID NO: 4245454 - RNA, 61 nt, Pseudomonas putida KT2440
gcgggucagggcgauuucgucguugcccagcggggcaccguggcagucuuccuugcccugc

SEQ ID NO: 4245455 - RNA, 60 nt, Pseudomonas putida KT2440
ggcagcgccugggcgaggauggguucaucgaucugcacccauucaacgcccagggcggcc

SEQ ID NO: 4245456 - RNA, 64 nt, Pseudomonas putida KT2440
gcagauguucggcaacucgagcagguuguccugaugugcgccaugcucggcggcggacuucugc

SEQ ID NO: 4245457 - RNA, 65 nt, Pseudomonas putida KT2440
uagcggguggcgagcaugccgccgguggaguggccgagcacaaugguuugcuucacacccagcug

SEQ ID NO: 4245458 - RNA, 57 nt, Pseudomonas putida KT2440
ggccgggaugucgaagcguagguguaccgcgcuggacacuuuguugacauucugccc

SEQ ID NO: 4245459 - RNA, 81 nt, Pseudomonas putida KT2440
augaucgucaccguacagcgcuggaacaacccgccgcugccguaacggcaggcugcaacgguuuuccaacggaucgauuau

SEQ ID NO: 4245460 - RNA, 82 nt, Pseudomonas putida KT2440
ucacacaauucggcgcgcacuucuucgaucaggcuggcccacugggccgggucggaguagaugcgcgacgacacuugcuugg

SEQ ID NO: 4245461 - RNA, 55 nt, Pseudomonas putida KT2440
gccgcagcggcacagguuggcggacagcucauugcgaaucuguucgucgcugggc

SEQ ID NO: 4245462 - RNA, 86 nt, Pseudomonas putida KT2440
ucuucgcgggcuugcccgcucccacagggaccgcacagguauuggacgcuuguggggccuugggagagcgggcaagcccgcgaaga

SEQ ID NO: 4245463 - RNA, 78 nt, Pseudomonas putida KT2440
gcggccguaaucgagcaccaccacauggugggaaaugcccaugaccacgccgaugucgugcucgaucagcaccaccgu

SEQ ID NO: 4245464 - RNA, 112 nt, Pseudomonas putida KT2440
guuugugccggccucuucgcggguaaacucgcuccuacgaagacugcaccgcauccgaacccugugucguaccuguaggcgcggguuuacccgcgaaggggccggcacaggc

SEQ ID NO: 4245465 - RNA, 61 nt, Pseudomonas putida KT2440
ggcugacgugcgcggcgccggggugggcuuuugcuacaacuucggucgcgugcugucggcc

SEQ ID NO: 4245466 - RNA, 78 nt, Pseudomonas putida KT2440
gggugcugccgaacucggaccaugggggcgugcgugcgcauguugucacuacccucgugccgaugguucagcguaucc

SEQ ID NO: 4245467 - RNA, 79 nt, Pseudomonas putida KT2440
ccgcaggcugucgauguaguugcgcgaacuggacaucaggaaggcguugucgaggaugcgcgguacaucuggcucacgg

SEQ ID NO: 4245468 - RNA, 103 nt, Pseudomonas putida KT2440
uucggccauuggccugcuugagcugauaggcgauauucucgacauuucccgcaucgaauccgggcacaucagccugcagccaguacccaccaaucuggucgaa

SEQ ID NO: 4245469 - RNA, 67 nt, Pseudomonas putida KT2440
caggcgcauggccaggcaaccgggccggggaucagauacguacccuggaugccucgccaugcgcuug

SEQ ID NO: 4245470 - RNA, 87 nt, Pseudomonas putida KT2440
ccgcggaugccaccggacaguuugaucgggccggugugcaggcccuguacgccgaucuccgacaggcgcuuccacaacgcuucgugg

SEQ ID NO: 4245471 - RNA, 57 nt, Pseudomonas putida KT2440
aaggcgcuacagcuaccgucaguugcacgagcgcagccgcgcccuggccagugccuu

SEQ ID NO: 4245472 - RNA, 80 nt, Pseudomonas putida KT2440
auccgccugaagcguugacgauggcuuuccgcgaucugaucgaugacguggacgaggugguuuucgacgucuuagcggau

SEQ ID NO: 4245473 - RNA, 60 nt, Pseudomonas putida KT2440
gggucgucaccuucccagaugauggccaacuggucaccgcgcucuucaagguggcggucc

SEQ ID NO: 4245474 - RNA, 88 nt, Pseudomonas putida KT2440
ucuucgaggcgcuuucugccgcacugacaucagagcagcgggcagcgaugcaacuggugggcagugcggcggcgaggcaacugcguga

SEQ ID NO: 4245475 - RNA, 129 nt, Pseudomonas putida KT2440
ugcucaugcgccccagcccuuccugguacaggcuggcguaggcuucgcucuccagcagguggaaaucgcugcuggucuucagugggccuucuucgaucagcaguaccuugaaaccggcagcgcugagca

SEQ ID NO: 4245476 - RNA, 96 nt, Pseudomonas putida KT2440
gcugcccuggccggcgccuugcucggcuggcuggcucagcugggccuguuccgccugcugcacggcuugcugccgagcguggugcccgcuggcggc

SEQ ID NO: 4245477 - RNA, 68 nt, Pseudomonas putida KT2440
ggcaagcuggugcgcguggugcacggggaaauccgcgauaucgccguggacgugcgcaaaagcucgcc

SEQ ID NO: 4245478 - RNA, 125 nt, Pseudomonas putida KT2440
ucgcgggcaugcccgcucccacagguccagcgcaggcuucaaggccacgcgguaccuguggggcaacugcgcgauagccuguggggcaacugcgcgaucgcuuguaggagcggguuuacccgcga

SEQ ID NO: 4245479 - RNA, 86 nt, Pseudomonas putida KT2440
gcuuagcgggcacgcccgcucccacaggaucaccacaauuccaaggcaugugguaacccugugggagcgggcaugcccgcgaaugc

SEQ ID NO: 4245480 - RNA, 61 nt, Pseudomonas putida KT2440
cucgucgcgggcucgcccgcucccauagguugacuugggagcgagcaagcccgcgaaugag

SEQ ID NO: 4245481 - RNA, 99 nt, Pseudomonas putida KT2440
gccuaccgccgcgaagucggcaugguguuccagcacuucaaccuguuuccgcacaugacugugcuggaaaaccugugccuggcgcagaagguggugcgc

SEQ ID NO: 4245482 - RNA, 99 nt, Pseudomonas putida KT2440
ggggccgcuuugcggcccuucgcgggcaagcccgcuccuacaaaggauaugcguccccuguaggagcgggcuugccgcgaagggcugcaaggcagcccc

SEQ ID NO: 4245483 - RNA, 82 nt, Pseudomonas putida KT2440
ggccaaaaagcuucgcgggugaacccgcuccuacaagggcauguguaucccugguaggagcggguucacccgcgaagaggcc

SEQ ID NO: 4245484 - RNA, 74 nt, Pseudomonas putida KT2440
augcaguugucggccuuggcagugguguagacgugcucgaucaacugucgaccaaugcccaggccacguugcgu

SEQ ID NO: 4245485 - RNA, 103 nt, Pseudomonas putida KT2440
ggcgcuucgugcucgaaauacggauauucgagcugcaggcgguccugaugaucuucguugacagccaucagcaucggaugcccgucgcgcaggaacagucgcc

SEQ ID NO: 4245486 - RNA, 124 nt, Pseudomonas putida KT2440
cccggacggcucgccugacgucucguauaccgguaagaacaaagccaauggcguaugccagaucaaggacugacugcgcgauugcgcgguugggcuggcgcagugucagcgggcugcaucaggg

SEQ ID NO: 4245487 - RNA, 85 nt, Pseudomonas putida KT2440
cagcagcgggugguccugcaaggucagguuggucaugucaggcaagaacugggcgaucaucggacauucgggguggcccgagcug

SEQ ID NO: 4245488 - RNA, 96 nt, Pseudomonas putida KT2440
gcccgucguaggagcggguucacccgcgaacaccggcaaugccggugccauccaccgcgucaccuguuucgcgggcaugcccgcucccacgcgugc

SEQ ID NO: 4245489 - RNA, 106 nt, Pseudomonas putida KT2440
gcugcugucgcugaccgagcaugugaucgacagccguuacacucaugucaucgucgacgaagcccacgagcugucggcaccgaugcuggcgguacucgaucgcagu

SEQ ID NO: 4245490 - RNA, 64 nt, Pseudomonas putida KT2440
gcuguuucgaugguugcuaaugaagcagcagaagcuucauuggcagcgcaucgacugaugcagc

SEQ ID NO: 4245491 - RNA, 99 nt, Pseudomonas putida KT2440
uuggcgggccguucuccggcuggauccucgaacauuucgccgccggccagcacggccuggccggcuggcaguggauguuccugauccagggccugccga

SEQ ID NO: 4245492 - RNA, 76 nt, Pseudomonas putida KT2440
cgggaucccuugccauuuaucugucgacucguuguucuuuugcgguggacgugucggcuauguaaaugguucaccg

SEQ ID NO: 4245493 - RNA, 71 nt, Pseudomonas putida KT2440
gccgugcgcauugccgucgagccgcaacugcucaaccaguacaaccugucgcuggacgaagugcgcaccgc

SEQ ID NO: 4245494 - RNA, 102 nt, Pseudomonas putida KT2440
ggccggccucuucgcggguaaacccgcuccuaccaggggcagcgccgcauucaaggccggcacgucccugguaggagcggguuuaccgcagagaggccggcc

SEQ ID NO: 4245495 - RNA, 88 nt, Pseudomonas putida KT2440
cggcaauugacaccgugcugucguuacgccacuguugcccaucauuggauccaagaguguagcguaaugacucagggucgaguuggcg

SEQ ID NO: 4245496 - RNA, 57 nt, Pseudomonas putida KT2440
ggcggugauggucgagcuguucccgacccgcauccgcuacaccucgaugucgcugcc

SEQ ID NO: 4245497 - RNA, 62 nt, Pseudomonas putida KT2440
gcccgucagcuuggcauggccaccuggcaagccggcgccgccgugaccguggcuggcguggu

SEQ ID NO: 4245498 - RNA, 74 nt, Pseudomonas putida KT2440
gcaguugcuggccagcuugcgggagcagggguacagcgugcuggaccugaccgacaacgagcuggccaagcugc

SEQ ID NO: 4245499 - RNA, 78 nt, Pseudomonas putida KT2440
ucgaauggcugguggcaaaacgcuuggccaacugcagcaucucgcgguuggccuugcuguugccguugagcuggucga

SEQ ID NO: 4245500 - RNA, 85 nt, Pseudomonas putida KT2440
ggugcucgccuuggcccgauagcgguauaucgaggacuucgucaaccugaaagucuucggcgaccgcuuugaggauggcggugcc

SEQ ID NO: 4245501 - RNA, 130 nt, Pseudomonas putida KT2440
caugccggugcgcauggcauuucgcacccucgaacaggaaggccugcuggugcgcuuugguggccggggguuucaggugcgcucggucagcgccgaugacaucgcgggugcggucgaggugcgcggugug

SEQ ID NO: 4245502 - RNA, 63 nt, Pseudomonas putida KT2440
guuauccacacuuuccugauucaacucacccgcccaacgguugagcaggaacagguugguaau

SEQ ID NO: 4245503 - RNA, 73 nt, Pseudomonas putida KT2440
gccgacgugcugggucagguggaagccguugcugaaguccgcagcuggccaccacuggccauggcaggucggc

SEQ ID NO: 4245504 - RNA, 86 nt, Pseudomonas putida KT2440
ggcugaccgcguucggccugcaacaucgccaggccccgcucguaacgccgucccuggcgagucagcagcgccagcgcggccacgcc

SEQ ID NO: 4245505 - RNA, 81 nt, Pseudomonas putida KT2440
cuggacgccaagggccuggcgauguauggccagaugaccgccggcagcuggaucuacaucggcagccagggcaucguccag

SEQ ID NO: 4245506 - RNA, 69 nt, Pseudomonas putida KT2440
ggcgcgcaaggcuuguucggcguuguccgguucggccaaggcggcgccaagcaggcuuucacuggcgcc

SEQ ID NO: 4245507 - RNA, 95 nt, Pseudomonas putida KT2440
gugauugaccuugagcacguuuaagcaggcgcggccuguucgaggcgucgaaccgccgcgaacaggccgcgccugcuuacaucaaggcagcucgc

SEQ ID NO: 4245508 - RNA, 56 nt, Pseudomonas putida KT2440
gccaggaucaacucauccuugaucgcauugaucaggucgaagauguugaucccggc

SEQ ID NO: 4245509 - RNA, 70 nt, Pseudomonas putida KT2440
uucgugugggugcuugugaguacggacugauagucaaaaagauuaucagcaucacaaguggccaugcgag

SEQ ID NO: 4245510 - RNA, 80 nt, Pseudomonas putida KT2440
ccggcuugcaggcaacgcugcuggucauccuucauggccuuggcggucacggcgaugaucggcaguuugcgccagcgcgg

SEQ ID NO: 4245511 - RNA, 64 nt, Pseudomonas putida KT2440
uagucggcgagcacacuucuugguugccggccaguccuggcggcgggugguguguucgcgagua

SEQ ID NO: 4245512 - RNA, 86 nt, Pseudomonas putida KT2440
cguccuugcaacgguaggccuucaggccuucgaagcacugcuggccguagugcagggccguggagccuucacugaugugcaguacg

SEQ ID NO: 4245513 - RNA, 73 nt, Pseudomonas putida KT2440
guuggcaaaggcaucgaccgcggcacgguagcgguccugcgcguugccgcgcccgccgaaugcuuugaccagc

SEQ ID NO: 4245514 - RNA, 128 nt, Pseudomonas putida KT2440
uuguagauaugcggccccacauaguccaucucucgaggcggguacagugcauuggaucuccagccaucuacugccagauaccaaucaccauugaccuguaccggauggcgagggucgccgaaauacga

SEQ ID NO: 4245515 - RNA, 75 nt, Pseudomonas putida KT2440
cgcugccggggcugucggggaucgggcugaaggcagaguaguacacgcgcuugaggccguagcccugguacagcg

SEQ ID NO: 4245516 - RNA, 64 nt, Pseudomonas putida KT2440
caguucgcaucagugaccguguucggcagaagcuuugccgagcucggacuugagugugaagcug

SEQ ID NO: 4245517 - RNA, 70 nt, Pseudomonas putida KT2440
gcaaugcuggcccaguggcuggaaggcgucgaugcgcucgcgcaggccgaccagccacugggccgggggc

SEQ ID NO: 4245518 - RNA, 127 nt, Pseudomonas putida KT2440
agcacuuuauaagccuguacuggccccuucgcggguaaacccgcuccuacagagacggcaccacauucaagaccggugcaauaccugugggagcgggcgugcccgcgaagaggccggcacaggcgcu

SEQ ID NO: 4245519 - RNA, 58 nt, Pseudomonas putida KT2440
ucccggugcaccugcagcagguggagcugaacccgaucugucgcucggucaucgagga

SEQ ID NO: 4245520 - RNA, 56 nt, Pseudomonas putida KT2440
uguuuuccacaggcggcuccacacuauccguggaaaagaguuggccuguggaaaca

SEQ ID NO: 4245521 - RNA, 94 nt, Pseudomonas putida KT2440
ccugcaagggaggcgguagccgcgaaugaacgauaacgccucauuccugaaagcucgcggugcguucauucgcggcuaaagccgcgccuacggg

SEQ ID NO: 4245522 - RNA, 55 nt, Pseudomonas putida KT2440
gugacgaucgcaggcagguucagugcaacggucugcaggccgccaucgauuucac

SEQ ID NO: 4245523 - RNA, 76 nt, Pseudomonas putida KT2440
ccgagugccggcggugccaacgcgguggcgggugacuaccuguuccgcgacuacgccgccuacggcaaccucucgg

SEQ ID NO: 4245524 - RNA, 58 nt, Pseudomonas putida KT2440
uguugccggccuggagcgcgccaugcagcgaaugaucggcguguugaugcuggcggca

SEQ ID NO: 4245525 - RNA, 107 nt, Pseudomonas putida KT2440
gugccggccguagccaggacgaggauucaccguuggguaacugguugagcgucaauggccaaguguacgacggugagcugcgccuggacuggaccuacagccgcgac

SEQ ID NO: 4245526 - RNA, 99 nt, Pseudomonas putida KT2440
ggugucgaccacgcuggcacgggcgauguucaccagauagccuucaacccccagggccugaaggacgugggcaucgaccagaugccggguguuggcgcc

SEQ ID NO: 4245527 - RNA, 67 nt, Pseudomonas putida KT2440
caggcguaacaggccgucuucgagcaccacaugggccgacaggucagugaacggcaguugcgcgcug

SEQ ID NO: 4245528 - RNA, 73 nt, Pseudomonas putida KT2440
gaaauccuggcgauaagggugaucgcguccgcuuaaaaauacgcggacaccaucgcccuuaaugcuggaguuc

SEQ ID NO: 4245529 - RNA, 80 nt, Pseudomonas putida KT2440
ucgcgggcaugcucgcccccacagguacaccaccaguuucaacguuugcggaaucucugugggagcgggcgugcccgcga

SEQ ID NO: 4245530 - RNA, 111 nt, Pseudomonas putida KT2440
cagaucuuuugccggaccgguuuggacaacguauuugacuucgacgucacgcucccaacgcuucugauugucgagcggguugccguugucgucggugcgcauguagaacug

SEQ ID NO: 4245531 - RNA, 59 nt, Pseudomonas putida KT2440
gacauccucauucaggauggagcaguagugaugcgcuuccaucugcacaucaggauguc

SEQ ID NO: 4245532 - RNA, 67 nt, Pseudomonas putida KT2440
gcagccagcgggguaucuccgaucuugaugcugcugggcaagaucgagugcgagcccgcucccacgc

SEQ ID NO: 4245533 - RNA, 59 nt, Pseudomonas putida KT2440
cgcgagcuggccgagggcucgcuggucgaggugcugcggcccuucgcuggccgcucgcg

SEQ ID NO: 4245534 - RNA, 61 nt, Pseudomonas putida KT2440
ccuuccgcgcugcggccgaacgcaucggcuacccggugcugcucaaggccagcgcgggagg

SEQ ID NO: 4245535 - RNA, 78 nt, Pseudomonas putida KT2440
gcgaggugcgcguggguaucgcgucgaacgccgagggcuaccggcugugggucgaugacgauggcccggguauugcgc

SEQ ID NO: 4245536 - RNA, 64 nt, Pseudomonas putida KT2440
caacagucugugucugcacggcaauggcacucaacgccucggacgaguagucagggauuuguug

SEQ ID NO: 4245537 - RNA, 98 nt, Pseudomonas putida KT2440
cuggccucuucgcggguaaacccgcuccuacacggucaccaccagguuccaauggugugcagcccccguaggagcggguucacccgcgaaagggccag

SEQ ID NO: 4245538 - RNA, 71 nt, Pseudomonas putida KT2440
ccacagugcauugaccuucacgcugagcgacggcaaaaccgucaucaccgugccggcuaauggcaccgugg

SEQ ID NO: 4245539 - RNA, 87 nt, Pseudomonas putida KT2440
gaugcgcagcggguugcucuucaggcggcgcuggcugucuucguccaguugcuccaggcgcgccgagaggaacucgaccagcgcguc

SEQ ID NO: 4245540 - RNA, 86 nt, Pseudomonas putida KT2440
gcgagguaggccaggucacugagcagcugggcccgaaugaccagugucgaauacguccugcguucaauggucuuggcuaguuucgu

SEQ ID NO: 4245541 - RNA, 89 nt, Pseudomonas putida KT2440
cuucuucgcgggcaagcccgcuccugcauguccaccacugccuugaugggggugauguaccugugugagcgggcuugcccgcgaagagg

SEQ ID NO: 4245542 - RNA, 92 nt, Pseudomonas putida KT2440
ccccggauuggcauuucgacaaccgccaggucgaccugaucggccagggcuucgaugcagcgauuggcggugguuucgaacugccgccgggg

SEQ ID NO: 4245543 - RNA, 57 nt, Pseudomonas putida KT2440
guucggccaaccaacugaugggugugcuggagcgcgccucgguccugguggucgggc

SEQ ID NO: 4245544 - RNA, 110 nt, Pseudomonas putida KT2440
ugcauuggggccgcuuugcaucccuucgcggaagcccgcuccuacaagggccgcaaugaccugugcaggagcgggcuugcccgcgaagggccgcaaggcggccccaauca

SEQ ID NO: 4245545 - RNA, 104 nt, Pseudomonas putida KT2440
guacccguggcggcaaccuguauggugcggcauugcucggggcguuguccggccuguuacucggcccgugcaugacugcgccguuggccggugcgcugcuguac

SEQ ID NO: 4245546 - RNA, 58 nt, Pseudomonas putida KT2440
acuggccagugauuucgcaccgcuggaacugcagcugcugcgcagggaucaggccggu

SEQ ID NO: 4245547 - RNA, 79 nt, Pseudomonas putida KT2440
gcccuacgccuuuggucagcaggccgguacuggucgacagugcgccgguacucaggcuguugaucgagucggccagggu

SEQ ID NO: 4245548 - RNA, 105 nt, Pseudomonas putida KT2440
ggcgguguggcacugaucgauugcaccuguaccugccucuucgcgggcaugcucgcgaagaggcagguacaggcaacuuaaaaucagaaacuguagcuacccguc

SEQ ID NO: 4245549 - RNA, 82 nt, Pseudomonas putida KT2440
ccuguacuggccucuucgcggguaaacccgccccuacagccgaccguaggagcggguuuacccgcgaagaggccggcacagg

SEQ ID NO: 4245550 - RNA, 70 nt, Pseudomonas putida KT2440
gcgccgucguugccgcguuugacgcuggcggugugguaggccaucuccgccguggugaccggcaaggugc

SEQ ID NO: 4245551 - RNA, 74 nt, Pseudomonas putida KT2440
guggugcuggccagcggcgugcagcugaccuaccugccgcuggaugucacgcacaagcugcugaccaguaacgc

SEQ ID NO: 4245552 - RNA, 121 nt, Pseudomonas putida KT2440
gccagcaccacggucacgcccagcaggcacaggcucagcaauugugcccgggccagacgccggucggacucgagcaugauuugcuggccacguucgcucaguguggucaccaguugcuggc

SEQ ID NO: 4245553 - RNA, 75 nt, Pseudomonas putida KT2440
uggcacugggugaggugucuucggcgguggcccauagccugcgcaacccgcuggccagcauccgcucaagugccg

SEQ ID NO: 4245554 - RNA, 58 nt, Pseudomonas putida KT2440
uccguaguugauguugucauauuucgccauuuccuuuaugacgucaucagcgcacgga

SEQ ID NO: 4245555 - RNA, 70 nt, Pseudomonas putida KT2440
gggcagagccggccugcgggguuguggguugccagcagcucaucgaucaauccgggcuggcuacaagccu

SEQ ID NO: 4245556 - RNA, 76 nt, Pseudomonas putida KT2440
cugguaggagcggguuuacccgcgaaugcgauggugcaucgaccaccguauucgcggguaaacccgcuccuaccag

SEQ ID NO: 4245557 - RNA, 82 nt, Pseudomonas putida KT2440
ucgaagcccagguacugcaguuucguagcgaaggcgggaagggcaugaacaucaccgccccguucaagcugcgugccuucga

SEQ ID NO: 4245558 - RNA, 65 nt, Pseudomonas putida KT2440
cguacugccugaugaucuaagcuguccuugccacugggccaggcacggaucggucaggcggcccg

SEQ ID NO: 4245559 - RNA, 55 nt, Pseudomonas putida KT2440
cgugcuuuuuaaccuggccaguggccggguccagcaccagguuauugaaggcacg

SEQ ID NO: 4245560 - RNA, 110 nt, Pseudomonas putida KT2440
ccugcaucggccucuucgcgggcuugcccgcucccacaggcagggcgcaauccuugaggguugcggugauccugugggagcgggcaagcccgcgaagaggccgguacagg

SEQ ID NO: 4245561 - RNA, 57 nt, Pseudomonas putida KT2440
ccagaugguagauacgcgucauggccucauuauuggcacguggcgugucgccacugg

SEQ ID NO: 4245562 - RNA, 78 nt, Pseudomonas putida KT2440
cugcucagccagauacucggcauugucguuaucggccagcgcacgcauggccggcaggcgcacaaagcccuggcgcag

SEQ ID NO: 4245563 - RNA, 96 nt, Pseudomonas putida KT2440
cuggcugacgugaaaugguucucgaccggggagcaacacuccucacacccaaguguuacccaggagagaagccaugaaccucaagacuaucgccag

SEQ ID NO: 4245564 - RNA, 75 nt, Pseudomonas putida KT2440
gcagaccaaagggcugcuggcggcguuguucgaccaagccuaucgacaacgcgcccgccuggcccugcugacugc

SEQ ID NO: 4245565 - RNA, 70 nt, Pseudomonas putida KT2440
ggccucuucgcggguaaacccgcgccugcaagugguaaccccuugcaggcgcggucuugcccgcaaggcc

SEQ ID NO: 4245566 - RNA, 77 nt, Pseudomonas putida KT2440
cugacgccuugcuccagcaauugccgcguggggauuuccaggcucagcggcacgcucggcggcaaggcguguaacag

SEQ ID NO: 4245567 - RNA, 96 nt, Pseudomonas putida KT2440
ggccucuucgcggcuaaagccguuccuacaggggguuugcacaggccucaaggccgacaccuaaccuguaggagcggcuuuagccgcgaagaggcc

SEQ ID NO: 4245568 - RNA, 56 nt, Pseudomonas putida KT2440
cgaaggugggcaggcuggagccggugaagcgguggcacagguucagcucaccuucg

SEQ ID NO: 4245569 - RNA, 70 nt, Pseudomonas putida KT2440
ggcucgauaaggucgaaauccugcuccuccagcauccgcugcaugagcacggaaccgaccauaccgcgcc

SEQ ID NO: 4245570 - RNA, 92 nt, Pseudomonas putida KT2440
gagccuguccgauuaccagguggccuucgagcgccugccgcaggccaaccgccaggcagugcuggaacgcugggggccgcccgaacaggauc

SEQ ID NO: 4245571 - RNA, 77 nt, Pseudomonas putida KT2440
gcagccguugcgcaugccgguacaccuggcguuuuccuaugacgaagaagucgguuguuugggcgugcgcucgaugc

SEQ ID NO: 4245572 - RNA, 77 nt, Pseudomonas putida KT2440
cccgcgcgaagugcugcgucagguggugaccaaguucgacgaacugggccugacuaucugcgccgcauucgagcugg

SEQ ID NO: 4245573 - RNA, 56 nt, Pseudomonas putida KT2440
cgugcuuuuguucaaccugugugccuuguucaauagguggcacaaaugaaggcaug

SEQ ID NO: 4245574 - RNA, 72 nt, Pseudomonas putida KT2440
uggagagcgucaaggcugccaggccaggguacagaguguccugcguggugccggccuugaaccguaguauca

SEQ ID NO: 4245575 - RNA, 82 nt, Pseudomonas putida KT2440
ggcgugccgaggggcgguagcgcaugcagcgguccgccgaacacaggugcgagccgccuuugauuaccgccaccggcacgcc

SEQ ID NO: 4245576 - RNA, 63 nt, Pseudomonas putida KT2440
gggccgcuuugcggcucugugggggcgggcagucccgcucccacaaggcuugcaaagaagccu

SEQ ID NO: 4245577 - RNA, 72 nt, Pseudomonas putida KT2440
ccgagcagguguuccugggcgaggugacgcaggagucgauugccgcguaccugagcucggggagaucgcggg

SEQ ID NO: 4245578 - RNA, 79 nt, Pseudomonas putida KT2440
gccaaugcugucucggugccagcgcgcauguccaucggcucgguggccagccagauggcaucgaugcggaucauugagc

SEQ ID NO: 4245579 - RNA, 85 nt, Pseudomonas putida KT2440
caccgugugcaacugccagggcuacggcacgccgucuguagcccagcauacccuggcccugcuguuggcccuggccacucggcug

SEQ ID NO: 4245580 - RNA, 56 nt, Pseudomonas putida KT2440
ggcccaguggcuggucggccugcgcgagcgcaucgacgccuuccagccacugggcc

SEQ ID NO: 4245581 - RNA, 60 nt, Pseudomonas putida KT2440
gcaucgugaauaucuccaguucgcgcugggucaugcgcugcaaccgggggucacuggugc

SEQ ID NO: 4245582 - RNA, 61 nt, Pseudomonas putida KT2440
aucuauaugcugacuggcauccgauaacgggcaaaguugggcagucgaguagcguauggau

SEQ ID NO: 4245583 - RNA, 73 nt, Pseudomonas putida KT2440
ggaugagcggcgauaguagucgugcgcaucgcgaaagccauugagcggugcagugacuuuaccgucgaagucc

SEQ ID NO: 4245584 - RNA, 85 nt, Pseudomonas putida KT2440
gcguacggcggguucgucgcuggcgcgcaaggcggucagcaguugcuugugguagccgauguuggcggcggcgaacugcuggcgc

SEQ ID NO: 4245585 - RNA, 66 nt, Pseudomonas putida KT2440
gggcugcgcuggccgcguacucgcgggagcauucugcgcgcccuggguaccgguugugugcugcuc

SEQ ID NO: 4245586 - RNA, 57 nt, Pseudomonas putida KT2440
gcauggagcccagcgaggucaccgcauccagcccggugaugccguucuucuccaugc

SEQ ID NO: 4245587 - RNA, 96 nt, Pseudomonas putida KT2440
gccaucgcuggcacccaccuucagcuugcggacauugacggugcucugcucauugaccacauaggcgaaggugccaucguugccaaacuggauggc

SEQ ID NO: 4245588 - RNA, 86 nt, Pseudomonas putida KT2440
uuggcagucagcggcguugcuggcuggcgugauggagaugaccuuggccacguccagcggcaugccguauucauauuggcugcuga

SEQ ID NO: 4245589 - RNA, 66 nt, Pseudomonas putida KT2440
gcauccuguuugcugugcgacagcgcagcccggaagggcugggugaucucucaucaaacaaaaugc

SEQ ID NO: 4245590 - RNA, 65 nt, Pseudomonas putida KT2440
ucagacgggccuugauauugagaauuuccugggcguggaucucgauaucgguggccugacccugg

SEQ ID NO: 4245591 - RNA, 78 nt, Pseudomonas putida KT2440
gcuuuguggcgguugcaggguaaugcugaacuggccguccgcaccggccaccgcagugcccagcaauacgccaccugc

SEQ ID NO: 4245592 - RNA, 57 nt, Pseudomonas putida KT2440
gugccgacaucgcgcucgcgcagggccacgucaccuucgccgaccguguugucgcgc

SEQ ID NO: 4245593 - RNA, 62 nt, Pseudomonas putida KT2440
uucucuuguuagaugcacggcaggcaaugccuugaugccuggugccaguuucagcaagagaa

SEQ ID NO: 4245594 - RNA, 94 nt, Pseudomonas putida KT2440
cgcaacggcaacuggcuacuggguggccugcucagcucgcgcgaugccagccagcggcgcuacccguucuucaucuuccaguugcucaagggcg

SEQ ID NO: 4245595 - RNA, 64 nt, Pseudomonas putida KT2440
gaaguuggcguggucggugaaauggcgcgccuggccgcuucgaccaucgacuacgagaacuauc

SEQ ID NO: 4245596 - RNA, 55 nt, Pseudomonas putida KT2440
ggccucuucgcgggcgagucccuucuugugggagcggguuacccgcgaagaggcc

SEQ ID NO: 4245597 - RNA, 69 nt, Pseudomonas putida KT2440
ggccgacgguggugccggccugauuaucacuggcaaugugauggucgacggccgcgccaugaccgggcc

SEQ ID NO: 4245598 - RNA, 68 nt, Pseudomonas putida KT2440
auccguggccuacuggugcguucggacaugcuggcggcggugucugcgcaccaguuggcuuacgagau

SEQ ID NO: 4245599 - RNA, 57 nt, Pseudomonas putida KT2440
gccagugagcaccgcggacaagccgaugaaguuuugcagguucuggucgcucauggc

SEQ ID NO: 4245600 - RNA, 69 nt, Pseudomonas putida KT2440
aucgaccuggaagaucgacuggaugucguagucaccuuugugaauggcguagaagucgaucagguugau

SEQ ID NO: 4245601 - RNA, 58 nt, Pseudomonas putida KT2440
gcggguuuacccgcgaaugcgucggcaaauucaaugacgcauucgcggguaaacccgc

SEQ ID NO: 4245602 - RNA, 74 nt, Pseudomonas putida KT2440
ggaaaaaagcgaggcguuuguagucaaguggcggcgcaugcugcggcagaagcagcagacccuggccaauuucc

SEQ ID NO: 4245603 - RNA, 93 nt, Pseudomonas putida KT2440
ggcgauggaggcgguaccuagugcgauuuuuguuguaugggcugccauguagcccagauacacccaagggucgaaaaccuggccgacaucgcc

SEQ ID NO: 4245604 - RNA, 100 nt, Pseudomonas putida KT2440
cuggccucuucgcggcuaaagccgcuccuacagguuaggugucggccuugaggccugugcaaacccccuguaggaacggcuuuagccgcgaagaggccag

SEQ ID NO: 4245605 - RNA, 81 nt, Pseudomonas putida KT2440
ugccagugcagacccgcgaacuguucggggugcugcaccucaaaggcagcaucaucgacgauugcgugaucuacaccggcg

SEQ ID NO: 4245606 - RNA, 59 nt, Pseudomonas putida KT2440
cgaugguguccacgcccagcgcggccuugaccuugucgacguuguaaccgaugccguug

SEQ ID NO: 4245607 - RNA, 104 nt, Pseudomonas putida KT2440
ccaacgcuggccgucuccuaugcaagcgcauggcgaggcauccaggguacguaucugauccccggcccgguugccuggccaugcgccugggccggcaaaguugg
